United States Patent 11,078,247 (RNA ENCODING A THERAPEUTIC PROTEIN) - sequence listing, part 22

SEQ ID NO: 38968 - RNA, 1722 nt, Artificial Sequence
  derived and/or modified sequence opt1 from ZNF10__Homo_sapiens__NP_056209
auggacgccaagagccugaccgccuggucccgcacccucgugacguucaaggacgucuucguggacuucacccgggaggaguggaagcugcuggacaccgcgcagcagaucguguaccgcaacgucaugcucgagaacuacaagaaccuggugagccugggcuaccagcucaccaagcccgacgugauccugcggcuggagaagggggaggagccguggcucgucgagcgcgagauccaccaggagacgcaccccgacuccgagaccgccuucgagaucaagagcuccgugagcucccggagcaucuucaaggacaagcaguccugcgacaucaagauggagggcauggcccgcaacgaccugugguaccugagccucgaggagguguggaagugccgggaccagcuggacaaguaccaggagaaccccgagcgccaccuccggcaggucgccuucacccagaagaaggugcucacccaggagcgcguguccgagagcgggaaguacggcgggaacugccugcugcccgcccagcucguccugcgggaguacuuccacaagcgcgacucccacaccaagagccugaagcacgaccucgugcugaacggccaccaggacuccugcgcgagcaacuccaacgagugcggccagacguucugccagaacauccaccugauccaguucgcccggacccacaccggggacaagagcuacaagugcccggacaacgacaacucccucacgcacggcagcagccuggggaucuccaagggcauccaccgcgagaagcccuacgagugcaaggagugcgggaaguucuucagcuggcgguccaaccugacccgccaccagcucauccacaccggcgagaagcccuacgagugcaaggagugcggcaagagcuucucccggagcucccaccugaucgggcaccagaagacccacacgggcgaggagcccuacgagugcaaggagugcggcaagagcuucuccugguucagccaccuggugacccaccagcgcacccacaccggggacaagcucuacacgugcaaccagugcggcaaguccuucguccacagcucccggcugauccgccaccagcggacccacaccggggagaagccguacgagugccccgagugcggcaagagcuuccgccaguccacccaccugauccuccaccagcgcacgcacgugcgggugcgccccuacgagugcaacgagugcggcaagagcuacucccagcggagccaccuggucgugcaccaccgcauccacaccgggcugaagcccuucgagugcaaggacugcgggaagugcuucucccggagcagccaccucuacucccaccagcgcacccacaccggcgagaagccguacgagugccacgacugcggcaagagcuucucccagagcuccgcccugaucgugcaccagcggauccacacgggggagaagcccuacgagugcugccagugcggcaaggccuucauccgcaagaacgaccugaucaagcaccagcggauccacgucggggaggagaccuacaagugcaaccagugcggcaucaucuucagccagaacucccccuucaucgugcaccagaucgcgcacaccggggagcaguuccugaccugcaaccagugcggcacggcccuggugaacaccagcaaccugaucggcuaccagaccaaccacauccgcgagaacgccuacuga

SEQ ID NO: 38969 - RNA, 2742 nt, Artificial Sequence
  derived and/or modified sequence opt1 from ZNF112__Homo_sapiens__NP_001076804
augaccaaguuccaggagauggugaccuucaaggacgucgccgugguguucacggaggaggagcugggccuccuggacagcguccagcgcaagcuguaccgggacgugaugcucgagaacuuccgcaaccugcugcucguggcccaccagcccuucaagccggaccugaucucccagcuggagcgggaggagaagcuccugauggucgagaccgagacgccccgcgacgggugcagcggccggaagaaccagcagaagauggaguccauccaggaggugaccgugagcuacuucucccccaaggagcugagcucccgccagaccuggcagcagagcgccgggggccucauccggugccaggacuuccugaaggucuuccaggggaagaacucccagcugcaggagcagggcaacagccucggccaggugugggcggggauccccgugcagaucuccgaggacaagaacuacaucuucacccacaucggcaacgggagcaacuacaucaagucccagggcuacccgagcuggcgcgcccaccacuccuggcggaagauguaccugaaggagagccacaacuaccagugccgcugccagcagaucuccaugaagaaccacuucugcaagugcgacagcgucuccuggcugagccaccacaacgacaagcucgaggugcaccggaaggagaacuacagcugccacgacugcggggaggacaucaugaaggugucccugcugaaccaggagagcauccagaccgaggagaagcccuaccccugcaccggcuaccgcaaggccuucuccaacgacagcuccagcgagguccaccagcaguuccaccucgagggcaagcccuacacguacuccagcugcgggaagggcugcaacuacuccagccugcugcacauccaccagaacaucgagcgggaggacgacaucgagaacucccaccucaagagcuaccagcgcgugcacaccgaggagaagccgugcaagugcggggaguacggcgagaacuucaaccacugcagcccccugaacaccuacgagcugauccacaccggcgagaugagcuaccggcacaacaucuacgagaaggccuucucccacagccucgaccugaacuccaucuuccgcgugcacacgcgggacgagccccacgaguacgaggagaacgagaacgucuucaaccagagcuccugccuccaggugcaccagaagauccacaccgaggagaagcuguacaccgacaucgaguacgggaaguccuucaucugcagcuccaaccuggacauccagcaccgcgugcacauggaggagaacagcuacaacuccgaggagugcggcaacggguucagccuggcgucccacuuccaggaccuccagaucguccacaccaaggagcagcccuacaagcgguacgugugcagcaacuccuucagccacaaccuguaccugcagggccacccgaagauccacaucggggagaagccccgcaaggagcacggcaacggcuucaacugguccagcaagcucaaggaccaccagcgggugcacacggggcagaagcccuacaagugcaacaucugcggcaagggguucaaccaccgcuccguccugaacgugcaccagcgcguccacaccggcgagaagcccuacaagugcgaggagugcgacaagggguucagccgguccagcuaccugcaggcccaccagcgcgugcacaccggcgagaagccguacaagugcgaggagugcggcaagggguucucccggaacagcuaccuccagggccaccagcgcgugcacaccggggagaagcccuacaagugcgaggagugcggcaagggguucucccggagcagccaccuccagggccaccagcgcguccacacgggcgagaagcccuucaagugcgaggagugcgggaagggcuucuccuggagcuucaaccugcagauccaccagcgggugcacaccggggagaagcccuacaagugcgaggagugcggcaagggcuucuccaaggccagcacccugcuggcccaccagcgcgugcacaccggggagaagccguaccagugcgacgagugcggcaaguccuucagccagcgguccuaccugcagagccaccaguccguccacagcggggagcgccccuacaucugcgaggugugcggcaagggguucucccagcgggcguaccuccagggccaccagcgcgugcacacgcgggucaagcccuacaagugcgagaugugcggcaagggguucagccaguccagccgccuggaggcccaccggcgcgugcacaccggcgggaagcccuacaagugcgaggugugcaccaagggcuucuccgagagcucccggcugcaggcccaccagcgcguccacguggaggggcggccguacaagugcgagcagugcggcaagggcuucagcggguacuccagccuccaggcccaccaccgcgugcacaccggcgagaagcccuacaagugcgaggucugcgggaagggcuucagccagcgcuccaaccugcaggcccaccagcgggugcacacgggggagaagcccuacaagugcgacgcgugcggcaagggcuuccgcuggagcuccgggcugcugauccaccagcgggugcacagcuccgacaaguucuacaagagcgaggacuacggcaaggacuaccccuccagcgagaaccuccaccgcaacgaggacuccguccuguucuga

SEQ ID NO: 38970 - RNA, 1299 nt, Artificial Sequence
  derived and/or modified sequence opt1 from ZNF121__Homo_sapiens__XP_011526569
auguacuucgugaccgagcacggcgccaucgggcugggcagcuuccgcaacgggaagcucaagcccaagugccagcaccugaacaacaucuucuucuggcugaacaagaccuccaacggcauccagauggccgagauccacaacgggggcgagcucugcgacuucauggagaacggcgagaucuucagcgagcacuccugccugaacgcgcacauggggacggagaacaccggcgacaccuacgacugcgacgaguacggggagaacuucccgaugcugcacaacagcgcccccgccggcgagacccucuccguccugaaccagugccggaaggccuucagccugccgcccaacgugcaccagcgcacguggaucggggacaaguccuucgaguacagcgacugcgaggaggccuucguggaccagucccaccuccaggcgaaccggaucacccacaacggcgagacccuguacgagcagaagcagugcggccgcgccuucaccuacagcacgucccacgccgucagcgugaagaugcacaccguggagaagcccuacgagugcaaggagugcgggaaguucuuccgguacuccagcuaccugaacucccacaugcgcacccacaccggcgagaagcccuacgagugcaaggagugcgggaagugcuucacggucagcucccaccucguggagcacgugcggauccacaccggcgagaagcccuaccagugcaaggagugcggccgcgccuucgcggggcggagcggccugaccaagcacguccgcauccacaccggggagaagcccuacgagugcaacgagugcggcaaggccuacaaccgguucuaccugcucacggagcacuucaagacccacaccgaggagaagccguucgagugcaaggugugcgggaaguccuuccgcagcagcuccugccugaagaaccacuuccggauccacaccggcaucaagcccuacaagugcaaggagugcggcaaggccuucacggugagcuccagccugcacaaccacgucaagauccacaccggggagaagcccuacgagugcaaggacugcggcaaggccuucgccaccuccagccagcucaucgagcacauccgcacccacacgggggagaagcccuacaucugcaaggagugcggcaagaccuuccgggcguccagccaccuccagaagcacgugcgcauccacaccggggagaagccguacaucugcaacgagugcggcaaggccuacaaccgguucuaccugcugaccaagcaccugaagacgcacuga

SEQ ID NO: 38971 - RNA, 1872 nt, Artificial Sequence
  derived and/or modified sequence opt1 from ZNF131__Homo_sapiens__NP_001284477
auggaggccgaggagaccauggagugccugcaggaguuccccgagcaccacaagaugauccucgaccgccugaacgagcagcgggagcaggaccgcuucaccgacaucacgcugaucguggacggccaccacuucaaggcccacaaggcgguccucgccgccugcagcaaguucuucuacaaguucuuccaggaguucacccaggagccgcugguggagaucgaggggguguccaagauggccuuccggcaccugaucgaguucaccuacaccgccaagcucaugauccagggcgaggaggaggcgaacgacgucuggaaggccgccgaguuccugcagaugcuggaggccaucaaggcgcucgaggugcgcaacaaggagaacagcgcgccccuggaggagaacacgaccgggaagaacgaggccaagaagcggaagaucgccgagaccuccaacgugaucaccgagagccugcccuccgccgagagcgagcccgucgagaucgagguggagaucgccgagggcacgaucgagguggaggacgaggggaucgagacccucgaggaggucgccuccgccaagcagagcgugaaguacauccaguccaccggcagcuccgacgacagcgcccuggcccugcucgcggacaucaccuccaaguaccgccagggcgaccggaaggggcagaucaaggaggacggcugcccgagcgaccccacguccaagcaggucgaggggaucgagaucguggagcugcagcugagccacgugaaggaccucuuccacugcgagaagugcaaccgcuccuucaagcuguucuaccacuucaaggagcacaugaagucccacagcaccgagagcuucaagugcgagaucugcaacaagcgguaccugcgcgagagcgccuggaagcagcaccucaacugcuaccaccuggaggagggcgggguguccaagaagcagcggaccggcaagaagauccacgucugccaguacugcgagaagcaguucgaccacuucggccacuucaaggagcaccuccgcaagcacaccggggagaagcccuucgagugccccaacugccacgagcgguucgcccgcaacagcacgcugaagugccaccugaccgccugccagaccggcgugggggccaagaagggccggaagaagcuguacgagugccaggugugcaacuccgucuucaacagcugggaccaguucaaggaccaccucgugauccacaccggcgacaagccgaaccacugcacgcugugcgaccugugguucaugcaggggaacgagcuccgccggcaccuguccgacgcgcacaacaucagcgagcgccuggugaccgaggagguccucuccguggagacccgggugcagaccgagcccgucacgagcaugaccaucaucgagcaggucggcaaggugcacgugcugccccugcuccaggugcaggucgacuccgcccaggugaccguggagcagguccaccccgaccugcugcaggacagccaggugcacgacucccacaugagcgagcucccggagcagguccagguguccuaccuggagguggggcgcauccagaccgaggagggcacggaggugcacgucgaggagcugcacguggagcgggugaaccagaugcccgucgaggugcagaccgagcuccuggaggccgaccuggaccacgugacccccgagaucaugaaccaggaggagcgcgagagcucccaggccgacgccgcggaggccgcccgcgaggaccacgaggacgccgaggaccucgagaccaagcccacggucgacagcgaggcggagaaggccgagaacgaggaccggaccgcccugccggugcuggaguga

SEQ ID NO: 38972 - RNA, 2121 nt, Artificial Sequence
  derived and/or modified sequence opt1 from ZNF132__Homo_sapiens__NP_003424
auggcccugcccagcccccaggugcucaugggccugccggcccugcucauggggcccgcgcagcacaccuccuggcccugcggcagcgccgucccgacccugaaguccauggugacguucgaggacguggccgucuacuucagccaggaggagugggagcugcucgacgccgcccagcgccaccuguaccacuccgugaugcuggagaaccucgagcuggugaccagccugggguccuggcacggcgucgagggggagggcgcgcaccccaagcagaacgugagcguggagguccuccaggugcggauccccaacgccgaccccuccaccaagaaggccaacagcugcgacaugugcggcccguuccugaaggacauccugcaccucgccgagcaccaggggacccaguccgaggagaagcccuacacgugcggcgcgugcgggcgcgacuucuggcugaacgccaaccugcaccagcaccagaaggagcacagcggcgggaagcccuuccggugguacaaggaccgcgacgcccucaugaaguccagcaaggugcaccuguccgagaaccccuucacgugccgggagggcggcaaggucauccuggggagcugcgaccuccugcagcugcaggccguggacuccggccagaagccguacagcaaccucgggcagcugcccgaggugugcaccacccagaagcuguucgagugcuccaacugcggcaaggccuuccucaagagcagcacccugcccaaccaccuccgcacccacuccgaggagauccccuucacgugcccgaccggcgggaacuuccucgaggagaaguccauccugggcaacaagaaguuccacaccggggagaucccccacgucugcaaggagugcggcaaggcguucagccacagcuccaagcugcggaagcaccagaaguuccacaccgaggugaaguacuacgagugcaucgccugcgggaagaccuucaaccacaagcucaccuucgugcaccaccagcgcauccacagcggcgagcggcccuacgagugcgacgagugcggcaaggccuucuccaaccgcagccaccugauccggcacgagaagguccacacgggggagcgccccuucgagugccugaagugcggccgggccuucucccagagcuccaacuuccuccgccaccagaaggugcacacccaggugcggccguacgagugcagccagugcgggaaguccuucagccgcuccagcgcccugauccagcacuggcggguccacaccggcgagcgccccuacgagugcuccgagugcgggcgggcguucaacaacaacagcaaccuggcccagcaccagaaggugcacaccggcgagcgccccuucgagugcuccgagugcggccgggacuucagccagagcucccaccuccugcgccaccagaaggugcacacgggggagcgccccuucgagugcugcgacugcggcaaggccuucagcaacuccagcacccugauccagcaccagaagguccacaccgggcagcggccguacgagugcuccgagugccgcaagagcuucucccggagcuccagccucauccagcacuggcgcauccacaccggcgagaagcccuacgagugcuccgagugcgggaaggccuucgcccacagcuccacgcugaucgagcacuggcgggugcacaccaaggagcgccccuacgagugcaacgagugcggcaaguucuucagccagaacuccauccugaucaagcaccagaagguccacaccggcgagaagcccuacaagugcagcgagugcgggaaguucuucucccgcaagagcagccucaucugccacuggcgggugcacaccggcgagcggccguacgagugcuccgagugcgggcgcgcguucagcuccaacagccaccuggugcggcaccagcgcguccacacgcaggagcggcccuacgagugcauccagugcggcaaggccuucuccgagcgcagcacccuggugcggcaccagaaggugcacacccgcgagcggaccuacgagugcucccagugcggcaagcuguucagccaccugugcaaccuggcccagcacaagaagauccacacguga

SEQ ID NO: 38973 - RNA, 2016 nt, Artificial Sequence
  derived and/or modified sequence opt1 from ZNF133__Homo_sapiens__NP_001269925
auggcccacauggccuuccgcgacguggcggucgacuucacccaggacgaguggcggcugcucagccccgcccagcgcacccuguaccgggaggugaugcuggagaacuacuccaaccucgugagccugggcaucuccuucagcaagccggagcugaucacgcagcucgagcaggggaaggagaccuggcgcgaggagaagaagugcucccccgcgaccugccccgaccaccaggaguacggcaacaacugcgaccugcagaaggaggccgaccccgagccggagcuguaccucgaccccuucugcccgcccggguucagcucccagaaguuccccaugcagcacguccugugcaaccacccgcccuggaucuucacgugccugugcgccgagggcaacauccagcccggggaccccggccccggcgaccaggagaagcagcagcaggcgagcgaggggcggcccugguccgaccaggccgagggccccgagggggagggcgccaugccccucuucgggcgcacgaagaagcggacccugggcgccuucagccgcccgccccagcggcagcccguguccagccgcaacggccugcgcgggguggagcucgaggcgucccccgcccagaccggcaaccccgaggagaccgacaagcugcugaagcggaucgagguccucggguucggcaccgugaacugcggcgagugcgggcugagcuucuccaagaugaccaaccugcucagccaccagcggauccacuccggcgagaagccguacgugugcggggucugcgagaagggcuucagccugaagaagucccuggcccgccaccagaaggcccacagcggggagaagcccaucgugugccgggagugcggccgcggcuucaaccgcaagagcacccucaucauccacgagcggacccacuccggggagaagccguacaugugcagcgagugcggccggggguucucccagaaguccaaccugaucauccaccagcgcacgcacagcggcgagaagcccuacgugugccgggagugcgggaagggcuucagccagaaguccgccgucgugcgccaccagcgcacccaccuggaggagaagaccaucgugugcagcgacugcggccucggguucuccgaccggagcaaccugaucucccaccagcgcacccacagcggcgagaagcccuacgccugcaaggagugcgggcggugcuuccgccagcggacgacccuggucaaccaccagcgcacccacuccaaggagaagcccuacgugugcggcgugugcgggcacagcuucucccagaacagcacccucaucucccaccggcgcacgcacaccggcgagaagccguacgucugcggcgugugcgggcggggcuucagccugaagucccaccugaaccgccaccagaacauccacagcggggagaagcccaucgugugcaaggacugcggccggggcuucagccagcaguccaaccucauccgccaccagcggacccacagcggggagaagcccauggucugcggcgagugcgggcgcggcuucucccagaaguccaaccugguggcccaccagcggacccacagcggggagcgcccguacgugugccgggagugcggccgcggcuucagccaccaggccgggcugauccggcacaagcgcaagcacucccgcgagaagcccuacaugugccggcagugcggccucggguucggcaacaagagcgcccugaucacgcacaagcgcgcccacuccgaggagaagcccugcgucugccgggagugcgggcagggcuuccugcagaagucccaccucacccugcaccagaugacccacaccggcgagaagcccuacgugugcaagacgugcgggcgcggcuucagccucaagagccaccugucccggcaccgcaagaccaccagcguccaccaccggcugccggugcagcccgaccccgagcccugcgcggggcagccguccgacagccuguacucccucuga

SEQ ID NO: 38974 - RNA, 1425 nt, Artificial Sequence
  derived and/or modified sequence opt1 from ZNF141__Homo_sapiens__NP_003432
auggagcugcucaccuuccgcgacguggccaucgaguucagccccgaggaguggaagugccuggacccggaccagcagaaccuguaccgggacgucaugcucgagaacuaccgcaaccuggugucccugggcguggccaucagcaaccccgaccucgugaccugccuggagcagcggaaggagcccuacaacgucaagauccacaagaucguggcgcggcccccggccaugugcucccacuucacgcaggaccacuggcccguccaggggaucgaggacagcuuccacaagcugauccuccgccgcuacgagaagugcggccacgacaaccugcagcugcggaaggggugcaagucccucaacgagugcaagcugcagaagggcggguacaacgaguucaacgagugccugagcaccacccaguccaagauccuccagugcaaggccagcgugaagguggucuccaaguucagcaacuccaacaagcgcaagacccggcacacgggcgagaagcacuucaaggagugcggcaagagcuuccagaaguucucccaccugacccagcacaaggugauccacgccggggagaagcccuacacgugcgaggagugcggcaaggccuucaaguggagccugaucuucaacgagcacaagcgcauccacaccggggagaagcccuucacgugcgaggagugcggcuccaucuucaccaccagcucccacuucgcgaagcacaagaucauccacaccggggagaagccguacaagugcgaggagugcggcaaggccuucaaccgguucaccacccucaccaagcacaagcgcauccacgccggcgagaagcccaucacgugcgaggagugccggaagaucuucaccagcuccagcaacuucgccaagcacaagcgcauccacaccggggagaagcccuacaagugcgaggagugcggcaaggcguucaaccggagcaccacccugacgaagcacaagcgcauccacaccggggagaagcccuacacgugcgaggagugcggcaaggccuuccggcaguccagcaagcugaacgagcacaagaaggugcacaccggcgagcgcccguacaagugcgacgagugcgggaaggccuucggccggucccgcguccucaacgagcacaagaagauccacaccggggagaagcccuacaagugcgaggagugcggcaaggccuuccggcgcagcaccgaccgcucccagcacaagaagauccacagcgccgacaagcccuacaagugcaaggagugcgacaaggcguucaagcaguucucccugcugagccagcacaagaagauccacaccguggacaagcccuacaagugcaaggacugcgacaaggccuucaagcgguucucccaccucaacaagcacaagaagauccacaccuga

SEQ ID NO: 38975 - RNA, 1914 nt, Artificial Sequence
  derived and/or modified sequence opt1 from ZNF143__Homo_sapiens__NP_001269585
augcugcucgcccagaucaaccgcgacagccagggcaugaccgaguuccccgggggcgggauggaggcccagcacgugacccugugccugacggaggcggucaccguggccgacggcgacaaccucgagaacauggagggggugucccugcaggccgucacccuggccgacggcagcaccgccuacauccagcacaacuccaaggacgcgaagcucaucgacggccaggugauccagcuggaggacgggagcgccgccuacgugcagcacgucccgauccccaagucccgggacagccugcgccucgaggacggccaggccgugcagcuggaggacgggacgaccgcguucauccaccacaccuccaaggacagcuacgaccaguccgcccugcaggccgugcagcucgaggacggcaccacggccuacauccaccacgccguccaggugccccagagcgacaccauccuggcgauccaggccgacgggaccguggccggccugcacaccggcgacgccacgaucgaccccgacaccaucuccgcccucgagcaguacgcggccaaggucagcaucgacggguccgagagcguggccggcaccgggaugaucggcgagaacgagcaggagaagaagaugcagaucgugcugcagggccacgccacccgggucacggccaagucccagcagagcggggagaaggcguuccgcugcgaguacgacggcugcgggaagcuguacaccaccgcccaccaccucaaggugcacgagcggucccacaccggcgaccgcccguaccagugcgagcacgccgggugcggcaaggccuucgccacgggcuacgggcucaagagccacgugcggacccacaccggcgagaagcccuaccgcugcuccgaggacaacugcaccaagagcuucaagacgagcggggaccugcagaagcacauccggacccacaccggcgagcgccccuucaagugccccuucgaggggugcggccgguccuucaccacgagcaacauccgcaagguccacgugcggacccacaccggcgagcgcccguacuacugcaccgagcccgggugcggccgggcguucgccuccgccacgaacuacaagaaccacgugcgcauccacaccggggagaagcccuacgucugcaccgugcccggcugcgacaagcgguucaccgaguacagcucccuguacaagcaccacgugguccacacgcacagcaagccguacaacugcaaccacugcgggaagaccuacaagcagaucuccacccuggccaugcacaagcgcaccgcgcacaacgacaccgagcccaucgaggaggagcaggaggccuucuucgagcccccgcccggccagggcgaggacgugcugaaggggagccagaucacguacgucaccggcguggagggggacgacguggucuccacccagguggccaccgugacgcagagcggccucucccagcaggucacccugaucagccaggacggcacccagcacgugaacaucucccaggccgacaugcaggccaucgggaacaccaucacgauggugacccaggacggcacccccaucaccguccccgcgcacgacgccgugaucagcuccgccgggacgcacagcguggccauggucaccgccgagggcaccgagggggagcaggucgcgaucguggcccaggaccuggccgccuuccacaccgccuccagcgagaugggccaccagcagcacucccaccaccucgugacgaccgagacccggccccugacccugguggcgacgagcaacggcacccagaucgccgugcagcucggggagcagccgagccuggaggaggccauccgcaucgccucccggauccagcagggcgagacccccgggcuggacgacuga

SEQ ID NO: 38976 - RNA, 879 nt, Artificial Sequence
  derived and/or modified sequence opt1 from ZNF146__Homo_sapiens__XP_005259271
augagccaccugucccagcagcgcaucuacagcggcgagaaccccuucgccugcaaggugugcgggaaggucuucucccacaagagcaaccugaccgagcacgagcacuuccacacccgggagaagccguucgagugcaacgagugcggcaaggccuucucccagaagcaguacgugaucaagcaccagaacacgcacaccggggagaagcuguucgagugcaacgagugcggcaagagcuucucccagaaggagaaccugcucacccaccagaagauccacaccggggagaagcccuucgagugcaaggacugcggcaaggcguucauccagaaguccaaccugauccgccaccagcggacgcacaccggcgagaagcccuucgugugcaaggagugcgggaagaccuucagcggcaagagcaaccugaccgagcacgagaagauccacaucggggagaagcccuucaagugcuccgagugcggcacggccuucgggcagaagaaguaccucaucaagcaccagaacauccacaccggcgagaagccguacgagugcaacgagugcggcaaggccuucagccagcgcaccucccugaucguccacgugcggauccacagcggggacaagcccuacgagugcaacgugugcggcaaggccuucucccagagcuccagccugaccguccacgugcgcucccacacgggggagaagcccuacggcugcaacgagugcggcaaggccuucagccaguucagcacccucgcgcugcaccuccggauccacaccgggaagaagcccuaccagugcuccgagugcggcaaggccuucagccagaagucccaccacauccgccaccagaagauccacacccacuga

SEQ ID NO: 38977 - RNA, 2385 nt, Artificial Sequence
  derived and/or modified sequence opt1 from ZNF148__Homo_sapiens__NP_068799
augaacaucgacgacaagcuggagggccucuuccugaagugcgggggcaucgacgagaugcagagcucccgcaccaugguggucaugggcggggugagcgggcaguccaccgugagcggcgagcugcaggacuccguccuccaggaccggagcaugccccaccaggagauccuggccgccgacgaggugcugcaggaguccgagaugcgccagcaggacaugaucagccacgacgagcucauggugcacgaggagacggucaagaacgacgaggagcagauggagacccacgagcggcugccgcagggccugcaguacgcgcucaacgugcccaucuccgugaagcaggagaucaccuucaccgacgucagcgagcagcugaugcgcgacaagaagcagauccgggagcccguggaccugcagaagaagaagaagcgcaagcagcggucccccgccaagauccucacgaucaacgaggacgggagccugggccugaagaccccgaagucccacgugugcgagcacugcaacgccgccuuccgcaccaacuaccaccuccagcggcacgucuucauccacaccggggagaagcccuuccagugcagccagugcgacaugcgcuucauccagaaguaccugcugcagcggcacgagaagauccacacgggcgagaagcccuuccgcugcgacgagugcgggaugcgguucauccagaaguaccacauggagcgccacaagcggacccacuccggcgagaagcccuaccagugcgaguacugccuccaguacuucagccgcaccgaccgggugcugaagcacaagcgcaugugccacgagaaccacgacaagaagcugaaccggugcgccaucaagggcgggcuccugaccuccgaggaggacagcggcuucuccacgagcccgaaggacaacagccugcccaagaagaagcgccagaagaccgagaagaaguccagcgggauggacaaggaguccgcgcucgacaagagcgaccugaagaaggacaagaacgacuaccugccccucuacuccagcuccaccaaggugaaggacgaguacauggucgccgaguacgccguggagaugccccacagcuccgugggcggcagccaccuggaggacgccuccggggagauccacccgcccaagcugguccucaagaagaucaacagcaagcggucccugaagcagccccuggagcagaaccagaccaucagcccccucuccacguacgaggagagcaagguguccaaguacgcguucgagcugguggacaagcaggcccugcucgacagcgagggcaacgccgacaucgaccaggucgacaaccugcaggaggggccguccaagcccgugcacagcagcaccaacuacgacgacgccaugcaguuccugaagaagaagcgcuaccuccaggccgcguccaacaacagccgcgaguacgcccugaacgugggcaccaucgccucccagcccagcgucacccaggccgccguggcguccgucaucgacgagagcacgaccgccuccauccuggagagccaggcccucaacguggagaucaaguccaaccacgacaagaacgugauccccgacgagguccugcagacccugcucgaccacuacagccacaaggccaacgggcagcacgagaucuccuucagcguggccgacaccgaggugacguccagcaucuccaucaacagcuccgaggucccggaggugacccccagcgagaacgugggcagcuccagccaggcguccagcuccgacaaggccaacaugcugcaggaguacagcaaguuccugcagcaggcccucgaccggaccucccagaacgacgccuaccugaacagccccucccugaacuucgucaccgacaaccagacgcugcccaaccagccggccuucagcuccaucgacaagcaggucuacgcgaccaugcccaucaacagcuuccgcuccggcaugaacagcccccuccggaccacccccgacaagucccacuucgggcugaucgugggcgacagccagcacuccuucccguucagcggggacgagacgaaccacgccuccgccaccagcacccaggacuuccuggaccaggugaccagccagaagaaggccgaggcgcagcccgugcaccaggccuaccagauguccagcuucgagcagcccuuccgcgccccguaccacggcucccgggccgggaucgccacgcaguucagcaccgcgaacggccaggugaaccuccgcggccccgggaccuccgccgaguucagcgaguucccccuggucaacgugaacgacaaccgggccggcaugaccuccagccccgacgccaccacggggcagaccuucggcuga

SEQ ID NO: 38978 - RNA, 1314 nt, Artificial Sequence
  derived and/or modified sequence opt1 from ZNF154__Homo_sapiens__NP_001078853
auggccgccgcgacccugcgcacccccacgcagggcaccgugaccuucgaggacgucgccgugcacuucagcugggaggagugggggcuccuggacgaggcccagcggugccuguaccgcgacgugaugcucgagaaccuggcccugcucaccucccuggacguccaccaccagaagcagcaccugggcgagaagcacuuccggagcaacguggggcgcgcccucuucgugaagacgugcaccuuccacgucuccggcgagccgagcacgugccgggagguggggaaggacuuccuggcgaagcugggcuuccuccaccagcaggccgcccacaccggcgagcaguccaacagcaaguccgacgggggcgccaucagccaccgcgggaagacccacuacaacugcggcgagcacaccaaggcguucuccgggaagcacacccuggugcagcagcagcggacccugacgaccgagcgcugcuacaucugcagcgagugcggcaaguccuucagcaaguccuacagccucaacgaccacuggcggcugcacaccggcgagaagcccuacgagugccgcgagugcgggaaguccuuccggcagagcuccagccugauccagcaccgccggguccacaccgccgugcgcccccacgagugcgacgagugcggcaagcuguucuccaacaagagcaaccucaucaagcaccggcgcgugcacacgggggagcggcccuacgagugcagcgagugcggcaaguccuucagccagcgcuccgcccugcuccagcaccggggcguccacaccggggagcgcccguacgagugcagcgagugcggcaaguucuucaccuaccacuccagccugaucaagcaccagaaggugcacuccgggagccggcccuacgagugcuccgagugcggcaagagcuucucccagaacagcucccugaucgagcaccaccgcgugcacaccggggagcgccccuacaagugcagcgagugcggcaaguccuucagccagcgguccgcccuccugcagcaccgcggcguccacacgggggagcggcccuacgagugcagcgagugcggcaaguucuucccguacuccagcagccugcgcaagcaccagcgggugcacaccgggucccgccccuacgagugcagcgagugcggcaaguccuucacccagaacagcgggcucaucaagcaccggcgcgugcacaccggcgagaagcccuacgagugcacggagugcggcaaguccuucagccacaacuccagccugaucaagcaccagcggauccacucccgcuga

SEQ ID NO: 38979 - RNA, 2349 nt, Artificial Sequence
  derived and/or modified sequence opt1 from ZNF160__Homo_sapiens__XP_005259436
augcuggagaacuacuggaaccucgugagccugggccugugccacuucgacaugaacaucaucuccaugcucgaggaggggaaggagcccuggaccgucaagagcugcgugaagaucgcccgcaagccgcggacccccgagugcgugaagggcgucgugacggacaucccgcccaagugcaccaucaaggaccugcugcccaaggagaaguccagcaccgaggccguguuccacaccgucgugcucgagcgccacgagucccccgacaucgaggacuucagcuucaaggagccccagaagaacgugcacgacuucgagugccaguggcgggacgacacggggaacuacaagggcguccugauggcgcagaaggaggggaagcgcgaccagcgggaccgccgggacaucgagaacaagcugaugaacaaccagcucggcguguccuuccacagccaccuccccgagcugcagcuguuccagggcgaggggaagauguacgagugcaaccagguggagaaguccaccaacaacggcagcuccgucagcccgcugcagcagauccccuccagcgugcagacccaccgcuccaagaaguaccacgagcugaaccacuucagccuccugacccagcggcgcaaggccaacuccugcgggaagcccuacaagugcaacgagugcggcaaggccuucacgcagaacagcaaccugaccucccaccggcgcauccacagcggggagaagcccuacaagugcagcgagugcggcaagaccuucaccgugcgguccaaccucacgauccaccaggucauccacaccggcgagaagccguacaagugccacgagugcgggaagguguuccgccacaacagcuaccuggccacccaccggcgcauccacaccggcgagaagcccuacaagugcaacgagugcgggaaggccuuccggggccacuccaaccugacgacccaccagcucauccacaccggcgagaagcccuucaagugcaacgagugcgggaagcuguucacccagaacagccaccugaucucccacuggcgcauccacacgggcgagaagcccuacaagugcaacgagugcgggaaggcguucagcgugcgguccagccucgccauccaccagaccauccacaccggcgagaagccguacaagugcaacgagugcgggaaggucuuccgcuacaacuccuaccugggccggcaccgccgcgugcacaccggcgagaagcccuacaagugcaacgagugcgggaaggccuucagcaugcacuccaaccuggccacgcaccaggugauccacaccggcaccaagcccuucaagugcaacgagugcagcaaggucuucacccagaacucccagcucgcgaaccaccggcgcauccacacgggggagaagcccuacaagugcaacgagugcggcaaggccuucagcgugcgguccagccugaccacccaccaggccauccacuccggggagaagccguacaagugcaucgagugcggcaagagcuucacccagaagucccaccuccgcagccaccggggcauccacagcggggagaagcccuacaagugcaacgagugcggcaagguguucgcccagacgucccagcuggcccgccacuggcggguccacaccggggagaagcccuacaagugcaacgacugcggccgcgcguucagcgaccgguccagccugaccuuccaccaggccauccacaccggggagaagcccuacaagugccacgagugcggcaagguguuccgccacaacuccuaccuggccacgcaccggcgcauccacaccggcgagaagccguacaagugcaacgagugcgggaaggccuucagcaugcacuccaaccucaccacccacaaggucauccacaccggcgagaagcccuacaagugcaaccagugcgggaagguguucacgcagaacagccaccuggccaaccaccagcggacccacaccggcgagaagcccuaccgcugcaacgagugcggcaaggcguucuccgugcggagcucccugaccacgcaccaggccauccacaccgggaagaagcccuacaagugcaacgagugcggcaaggucuucacccagaacgcccaccucgccaaccaccgccggauccacaccggggagaagccguaccgcugcacggagugcggcaaggccuuccgggugcgcagcucccugaccacccacauggcgauccacaccggggagaagcgcuacaagugcaacgagugcggcaagguguuccggcagagcuccaaccuggccagccaccaccgcaugcacacgggcgagaagcccuacaaguga

SEQ ID NO: 38980 - RNA, 1815 nt, Artificial Sequence
  derived and/or modified sequence opt1 from ZNF169__Homo_sapiens__NP_003439
augagccccggccugcucaccacccgcaaggaggcccugauggccuuccgggacguggcggucgccuucacgcagaaggaguggaagcugcucuccagcgcccagcgcacccuguaccgggaggugaugcuggagaacuacucccaccucgugagccuggggaucgccuucuccaagccgaagcugaucgagcagcucgagcagggcgacgagcccuggcgcgaggagaacgagcaccuccuggaccugugccccgccgagccccggaccgaguuccagccgagcuucccccaccuggucgcguucuccagcucccagcugcuccgccaguacgcccugagcgggcaccccacccagaucuuccccuccagcuccgccggcggggacuuccagcuggaggccccgcggugcagcuccgagaagggcgagagcggcgagacggaggggcccgacuccagccuccgcaagcggcccucccgcaucagccggaccuucuucagcccccaccagggcgacccgguggaguggguggaggggaaccgcgagggcgggaccgaccugcggcuggcgcagcgcaugucccucggcggcagcgacaccaugcugaagggggccgacacguccgagagcggcgccgucauccgggggaacuaccgccugggccucuccaagaaguccagccuguucagccaccagaagcaccacgugugccccgagugcggccggggguucugccagcgcuccgaccugaucaagcaccagcggacccacaccggcgagaagcccuaccucugccccgagugcgggcgccgguucagccagaaggccucccugagcauccaccagcgcaagcacuccggcgagaagccguacgugugccgcgagugcgggcggcacuuccgcuacaccagcucccugacgaaccacaagcggauccacagcggcgagcgccccuucgucugccaggagugcggccggggguuccgccagaagaucgcccuccugcugcaccagcggacccaccucgaggagaagcccuucgugugccccgagugcggccgcggguucugccagaaggcgucccugcugcagcaccagagcucccacaccggcgagcggccguuccucugccuggagugcgggcgcagcuuccggcagcagagccugcuccugucccaccaggugacccacagcggcgagaagcccuacgucugcgccgagugcggccacuccuuccgccagaaggugacgcugauccggcaccagcgcacccacaccggggagaagcccuaccucugcccccagugcggccggggguucagccagaaggugacccugaucggccaccagcgcacgcacaccggggagaagccguaccugugccccgacugcggccggggcuucgggcagaaggucacccucauccgccaccagcggacccacacgggcgagaagcccuaccugugccccaagugcgggcgcgccuucggcuucaagucccugcucacccgccaccagcggacccacagcgaggaggagcuguacguggaccgcgugugcggccaggggcugggccagaagucccaccugaucagcgaccagcggacccacuccggggagaagccgugcaucugcgacgagugcggccgcggguucggcuucaagagcgcccucauccggcaccagcgcacgcacuccggcgagaagcccuacgucugccgggagugcgggcgcggcuucagccagaagucccaccuccaccggcaccgccggaccaagagcgggcaccagcugcugccccaggagguguucuga

SEQ ID NO: 38981 - RNA, 2136 nt, Artificial Sequence
  derived and/or modified sequence opt1 from ZNF175__Homo_sapiens__NP_009078
augcccgccgacgugaaccugagccagaagccgcagguccucggccccgagaagcaggacggguccugcgaggccagcguguccuucgaggacgugaccgucgacuucagccgcgaggaguggcagcagcuggaccccgcgcagcggugccuguaccgcgacgugaugcucgagcuguacucccaccuguucgccgugggcuaccacauccccaacccggaggucaucuuccggaugcucaaggagaaggagccccgcguggaggaggccgaggugagccaccagcggugccaggagcgcgaguucgggcuggagaucccccagaaggagaucuccaagaaggccagcuuccagaaggacauggucggcgaguucacccgggacggguccuggugcagcauccuggaggagcuccgccuggacgccgaccggacgaagaaggacgagcagaaccagauccagcccaugucccacagcgcguucuucaacaagaagacccugaacaccgaguccaacugcgaguacaaggacccgggcaagaugauccgcacccggccccaccucgccagcucccagaagcagccccagaagugcugccuguucacggagagccugaagcucaaccuggaggugaacggccagaacgaguccaacgacaccgagcagcuggacgacguggucgggagcggccagcuguucucccacagcagcuccgacgccugcagcaagaacauccacaccggggagaccuucugcaagggcaaccagugccgcaaggugugcgggcacaagcagucccucaagcagcaccagauccacacgcagaagaagcccgacggcugcagcgagugcggcggguccuucacccagaagucccaccuguucgcccagcagcggauccacagcgugggcaaccuccacgagugcgggaagugcggcaaggcguucaugccgcagcugaagcugagcgucuaccucaccgaccacaccggcgacauccccugcaucugcaaggagugcgggaagguguucauccagcgcuccgagcugcugacgcaccagaagacccacacccggaagaagcccuacaagugccacgacugcggcaaggccuucuuccagaugcucagccuguuccgccaccagcggacccacucccgcgagaagcuguacgagugcagcgagugcgggaagggcuucucccagaacagcacgcucaucauccaccagaagauccacaccggggagcggcaguacgccugcuccgagugcggcaaggccuucacccagaaguccacccugagccugcaccagcgcauccacagcggccagaaguccuacgugugcaucgagugcgggcaggccuucauccagaaggcgcaccucaucguccaccagcggagccacacgggcgagaagcccuaccagugccacaacugcggcaagagcuucaucuccaagagccagcuggacauccaccaccgcauccacaccggggagaagccguacgagugcuccgacugcgggaagaccuucacccagaagucccaccugaacauccaccagaagauccacacgggcgagcgccaccacgugugcagcgagugcggcaaggccuucaaccagaaguccauccucagcaugcaccagcggauccacaccggggagaagcccuacaagugcagcgagugcggcaaggccuucaccuccaagagccaguucaaggagcaccagcgcauccacaccggggagaagcccuacgugugcacggagugcggcaaggccuucaacgggcgguccaacuuccacaagcaccagaucacccacacccgcgagcggcccuucgucugcuacaagugcggcaaggccuucgugcagaaguccgagcugaucacccaccagcgcacgcacaugggcgagaagccguacgagugccuggacugcggcaagagcuucagcaagaagccccagcucaaggugcaccagcggauccacaccggggagcgccccuacgucugcuccgagugcgggaaggcguucaacaaccggagcaacuucaacaagcaccagaccacccacacgcgcgacaaguccuacaagugcagcuacagcgugaagggcuucaccaagcaguga

SEQ ID NO: 38982 - RNA, 1446 nt, Artificial Sequence
  derived and/or modified sequence opt1 from ZNF177__Homo_sapiens__NP_001166122
auggccgccggcuggcugaccaccuggagccagaacuccgugacguuccaggaggucgcgguggacuucagccaggaggagugggcccuccuggaccccgcccagaagaaccuguacaaggacgugaugcucgagaacuuccgcaaccuggccuccgucggguaccagcugugccggcacagccucaucuccaagguggaccaggagcagcugaagaccgacgagcgcggcauccugcagggggacugcgccgacugggagacccagcucaagccgaaggacaccaucgcgaugcagaacauccccggcgggaagacgagcaacggcaucaacaccgccgagaaccagcccggcgagcacucccuggagugcaaccacugcgggaaguuccggaagaacacccgcuucaucugcacccgguacugcaagggcgagaagugcuacaaguacaucaaguacagcaagguguucaaccaccccuccacgcugcgcagccacgucuccauccacaucggggagaagacccucgaguucaccgacugccggaaggccuucaaccaggagagcucccugcgcaagcaccuccggaccccgacgggccagaaguuccaggaguacgagcagugcgacaugagcuucucccugcacagcuccugcagcgugcgcgagcagauccccaccggggagaagggcgacgagugcuccgacuacggcaagaucagcccccugagcgugcacaccaagaccggguccgucgaggagggccuggagugcaacgagcacgagaagacguucaccgacccccucagccugcagaacugcgugcggacccacuccggggagaugccguacgagugcagcgacugcggcaaggccuucaucuuccaguccagccugaagaagcacaugcgcucccacaccggcgagaagcccuacgagugcgaccacugcggcaagagcuucucccagagcucccaccucaacgugcacaagcggacgcacaccggggagaagcccuacgacugcaaggagugcgggaaggcguucaccguccccagcucccugcagaagcacgugcgcacccacacgggcgagaagccguacgagugcagcgacugcgggaaggccuucaucgaccaguccagccugaagaagcacacccggucccacaccggcgagaagcccuacgagugcaaccagugcggcaagagcuucuccaccgggagcuaccucaucgugcacaagcgcacgcacaccggcgagaagaccuacgagugcaaggagugcgggaaggccuuccggaacagcuccugccugcgcguccacgugcggacccacacgggcgagaagcccuacaagugcauccagugcgagaaggccuucagcaccuccaccaaccugaucaugcacaagcgcauccacaacgggcagaagcuccacgaguga

SEQ ID NO: 38983 - RNA, 1863 nt, Artificial Sequence
  derived and/or modified sequence opt1 from ZNF182__Homo_sapiens__NP_001007089
auggccaagccccagggccuggugaccuucgaggacgucgccguggacuucacccaggaggaguggcaguaccucaacccgccccagcgcacgcuguaccgggacgugaugcuggagaccuacagcaaccucgucuucguggggcagcaggucaccaagcccaaccugauccugaagcucgagguggaggagugccccgcggagggcaagaucccguucuggaacuuccccgaggugugccagguggacgagcagaucgagcgccagcaccaggacgaccaggacaagugccugcugaugcaggucggguucagcgacaagaagaccaucaucaccaagagcgcccgggacugccacgaguucggcaacauccuccaccugagcacgaaccugguggccagcauccagcgccccgacaagcacgaguccuucgggaacaacaugguggacaaccucgaccuguucagccgguccagcgccgagaacaaguacgacaacggcugcgccaagcuguucuuccacaccgaguacgagaagaccaaccccggcaugaagccguacggguacaaggagugcggcaaggggcuccgccggaagaagggccugucccugcaccagcgcaucaagaacggggagaagcccuucgagugcacggcgugccggaagaccuucagcaagaagucccaccucaucguccacuggcgcacccacaccggcgagaagcccuucggcugcacggagugcgggaaggccuucagccagaagucccagcugaucauccaccuccggacccacaccggcgagcgccccuucgagugcccggagugcgggaaggccuuccgggagaaguccaccgugaucauccacuaccgcacgcacaccggcgagaagcccuacgagugcaacgagugcggcaaggccuucacccagaaguccaaccugaucgugcaccagaagacccacacgggggagaagaccuacgagugcaccaagugcggcgagagcuucauccagaagcuggaccugaucauccaccacagcacccacacggggaagaagccccacgagugcaacgagugcaagaagaccuucagcgacaaguccacccucaucauccaccagcggacccacacgggcgagaagccccacaagugcaccgagugcggcaagagcuucaacgagaaguccacccugaucguccaccagcgcacccacacgggggagaagccguacgagugcgacgugugcggcaagaccuucacccagaaguccaaccugggggugcaccagcggacccacagcggcgagaagcccuucgagugcaacgagugcgagaaggcguucagccagaaguccuaccucaugcugcaccagcgcgggcacacgggcgagaagcccuacgagugcaacgagugcgagaaggccuucagccagaaguccuaccugaucauccaccagcggacccacaccgaggagaagcccuacaagugcaacgagugcgggaaggccuuccgcgagaaguccaagcucaucauccaccagcggauccacaccggcgagaagccguacgagugccccgucugcuggaaggccuucagccagaagucccagcugaucauccaccagcgcacccacacgggcgagaagcccuacgccugcaccgagugcgggaaggcguuccgcgagaaguccaccuucaccgugcaccagcggacgcacaccggcgagaagcccuacaagugcaccgagugcgggaaggccuucacccagaaguccaaccugaucgugcaccagcgcacgcacgccggcaagaaggcccacgggcggggccacacccgcaagagcaaguucauggcccacuga

SEQ ID NO: 38984 - RNA, 2256 nt, Artificial Sequence
  derived and/or modified sequence opt1 from ZNF184__Homo_sapiens__NP_009080
auggaggaccugagcucccccgacagcacccuccugcagggcgggcacaaccugcucuccagcgccuccuuccaggaggccgugaccuucaaggacgucaucguggacuucacgcaggaggaguggaagcagcuggacccgggccagcgcgaccuguuccgggacgugacccucgagaacuacacccaccuggucagcaucgggcuccagguguccaagcccgacgugaucagccagcuggagcagggcaccgagcccuggaucauggagcccuccaucccggucgggacgugcgcggacugggagacccgccuggagaacagcguguccgcccccgagcccgacaucagcgaggaggagcugucccccgaggugaucgucgagaagcacaagcgggacgacagcugguccagcaaccuccuggaguccugggaguacgagggcagccuggagcgccagcaggccaaccagcagacccucccgaaggagaucaaggugaccgagaagacgauccccuccugggagaagggccccgugaacaacgaguucggcaagagcgucaacgugagcuccaaccuggugacccaggagcccagcccggaggagaccuccaccaagcggagcaucaagcagaacuccaaccccgucaagaaggagaaguccugcaagugcaacgagugcgggaaggccuucagcuacugcagcgcccugauccgccaccagcggacgcacaccggggagaagcccuacaagugcaacgagugcgagaaggcguucucccgcagcgagaaccucaucaaccaccagcggauccacaccggcgacaagcccuacaagugcgaccagugcgggaagggcuucaucgagggcccgucccugacccagcaccagcgcauccacacgggggagaagcccuacaagugcgacgagugcggcaaggccuucagccagcggacccaccuggugcagcaccagcgcauccacaccggggagaagcccuacacgugcaacgagugcggcaaggccuucucccagcggggccacuucauggagcaccagaagauccacaccggggagaagcccuucaagugcgacgagugcgacaagaccuucacccgcagcacccaccucacgcagcaccagaagauccacaccggcgagaagaccuacaagugcaacgagugcgggaaggccuucaacggcccguccaccuucauccggcaccacaugauccacacgggggagaagcccuacgagugcaacgagugcggcaaggcguucagccagcacuccaaccugacccagcaccagaagacccacaccggcgagaagcccuacgacugcgccgagugcggcaagagcuucuccuacuggagcagccuggcccagcaccucaagauccacacgggggagaagcccuacaagugcaacgagugcgggaaggccuucuccuacugcagcucccugacccagcaccgccggauccacacccgcgagaagccguucgagugcagcgagugcggcaaggccuucuccuaccugagcaaccucaaccagcaccagaagacccacacgcaggagaaggcguacgagugcaaggagugcgggaaggccuucauccgguccagcucccuggccaagcacgagcgcauccacaccggcgagaagcccuaccagugccacgagugcggcaagaccuucagcuacggguccagccugauccagcaccggaagauccacaccggcgagcgccccuacaagugcaacgagugcgggcgcgccuucaaccagaacauccaccucacccagcacaagcggauccacacgggcgccaagcccuacgagugcgcggagugcgggaaggccuuccgccacugcuccagccuggcccagcaccagaagacccacaccgaggagaagccguaccagugcaacaagugcgagaagaccuucucccagagcucccaccugacgcagcaccagcggauccacaccggcgagaagcccuacaagugcaacgagugcgacaaggccuucagccgcagcacccaccucaccgagcaccagaacacgcacaccggcgagaagcccuacaacugcaacgagugccggaagaccuucucccagagcaccuaccugauccagcaccagcgcauccacuccggggagaagccguucggcugcaacgacugcggcaagagcuuccgguaccgcuccgcccugaacaagcaccagcggcuccaccccgggaucuga

SEQ ID NO: 38985 - RNA, 984 nt, Artificial Sequence
  derived and/or modified sequence opt1 from ZNF185__Homo_sapiens__NP_001171586
auggccgcccgcgacgagcucggccucgggggcgacagccuggaggcgaugcccgugccggccgcccgggggcgcccccggaucaccaacggccccgaggagcuggccgcccccuccccggcggcccucgccgacuacgaggggaaggacgucgccacccgcgugggcgaggcguggcaggagcggcccggcgcgccccgcgggggccagggggaccccgccgugccggcccagcagcccgccgaccccagcacgcccgagcggcaguccagcccguccggcagcgagcagcugguccgccgggaguccugcgggagcuccgugcugaccgacuucgagggcaaggacguggccaccaaggucggcgaggccuggcaggaccgccccggggcgccccggggcgggcagggcgaccccgccgugccgacccagcagcccgccgaccccagcacgcccgagcagcagaacuccccgagcggcuccgagcaguucgugcgccgggagagcugcaccucccgcguccggagccccuccagcugcauggugaccgugaccgucacggccaccuccgagcagccccacaucuacauccccgccccggccagcgagcucgacagcuccagcaccaccaaggggauccuguucgugaaggaguacgugaacgccuccgaggucagcuccggcaagcccgugagcgcccgcuacuccaacgugagcuccaucgaggacagcuucgcgauggagaagaagccgcccugcggguccacgcccuacagcgagcggaccaccggcgggaucugcaccuacugcaaccgcgagauccgggacugccccaagaucacgcuggagcaccucggcaucugcugccacgaguacugcuucaagugcggcaucugcuccaagcccaugggggaccugcuggaccagaucuucauccaccgcgacaccauccacugcggcaagugcuacgagaagcuguucuga

SEQ ID NO: 38986 - RNA, 1839 nt, Artificial Sequence
  derived and/or modified sequence opt1 from ZNF189__Homo_sapiens__NP_001265160
auggccagccccuccccgccgcccgagagcaaggaggagugggacuaccuggaccccgcccagcgcucccucuacaaggacgugaugauggagaacuacggcaaccuggucagccuggacgugcucaaccgggacaaggacgaggagcccaccgugaagcaggagaucgaggagaucgaggaggaggucgagccccagggggugaucgugacccgcaucaaguccgagaucgaccaggaccccaugggccgggagacguucgagcuggucgggcgccuggacaagcagcggggcaucuuccucugggagaucccccgcgagagccugacccaggagcagcggauguuccgcgagaacaccaacaucauccggaagcgcccgaacuccgaggagaagugccacaagugcgaggagugcgggaagggcuucgugcggaaggcgcacuucauccagcaccagcgcgugcacaccggcgagaagcccuuccagugcaacgagugcggcaagagcuucucccggagcuccuucgucaucgagcaccagcgcauccacacgggggagcggcccuacgagugcaacuacugcgggaagaccuucagcguguccagcacccugauccgccaccagcggauccacaccggcgagcgccccuaccagugcaaccagugcaagcaguccuucagccagcggcgcucccucgugaagcaccagcggauccacacgggggagaagccgcacaagugcagcgacugcggcaaggccuucuccuggaagucccaccugaucgagcaccagcgcacccacaccggcgagaagcccuaccacugcaccaagugcaagaaguccuucagccgcaacagccugcucgucgagcaccagcggauccacacgggggagcgcccccacaagugcggcgagugcgggaaggccuuccggcugagcaccuaccugauccagcaccagaagauccacaccggcgagaagcccuuccucugcaucgagugcggcaagagcuucucccgcagcuccuuccugaucgagcaccagcggauccacaccggggagcgcccguaccagugcaaggagugcggcaagagcuucucccagcugugcaaccucacgcggcaccagcgcauccacaccggggacaagccccacaagugcgaggagugcggcaaggccuucagccgguccagcgggcugauccagcaccagcgcauccacacccgggagaagaccuaccccuacaacgagacgaaggaguccuucgaccccaacugcagccuggugauccagcaggagguguacccgaaggagaaguccuacaagugcgacgagugcggcaagaccuucagcgucuccgcccaccucgugcagcaccagcgcauccacaccggcgagaagcccuaccugugcaccgugugcggcaagagcuucucccggagcagcuuccugaucgagcaccagcgcauccacacgggggagcggcccuaccucugccgccagugcgggaaguccuucagccagcugugcaaccugauccggcaccagggcguccacaccgggaacaagccccacaagugcgacgagugcggcaaggcguucucccgcaacagcggccucauccagcaccagcggauccacaccggggagaagccguacaagugcgagaagugcgacaaguccuucagccagcagcgcucccuggugaaccaccagaagauccacgccgaggugaagacccaggagacgcacgagugcgacgccugcggcgaggccuucaacugccgcaucagccugauccagcaccagaagcuccacaccgcguggaugcaguga

SEQ ID NO: 38987 - RNA, 804 nt, Artificial Sequence
  derived and/or modified sequence opt1 from ZNF197__Homo_sapiens__NP_001020026
augacccgcgagaacguggcccacaacgcccugcggcaggagggccucgucaaggggaaggacgacaccuggaaguggggcacgagcuuccagggguccagcuccagcgugugggagaccucccaccuccacuuccgccagcugcgguaccacgagaccagcggcccccaggaggcgcugucccgccugcgggagcugugccgccgguggcuccgcccggaggcccggaccaaggcccagauccuggagcugcucgugcuggagcaguuccugagcauccuccccggggagauccgcacguggguccagcugcaccaccccggcuccggcgaggaggccguggcccugguggaggagcuccagaaggaccuggacgggcccgcgauccaggucccggugcuggugaaggaccaggacacccuccagaaggucgugagcgcccccggcaccacccugccgcccgugcugcccgggucccacaucgccgccgagaucugcccccacccgcccacggaccucgucgcguucaaccugcaggacccccagcacgacagccccgcccccgaggccuccgcccugagccaggaggagaacccccggaaccagcucauggcccugaugcugcucaccgcgcagccgcaggagcuggugauguucgaggagguguccgucugcuucaccagcgaggagugggccugccugggccccauccagcgcgcccucuacugggacgugaugcuggagaacuacgggaacgugaccucccugggcuaccggaaguaccgccggcagcgcaacaaguga

SEQ ID NO: 38988 - RNA, 1947 nt, Artificial Sequence
  derived and/or modified sequence opt1 from ZNF202__Homo_sapiens__NP_001288709
auggccaccgccguggagcccgaggaccaggaccugugggaggaggagggcauccucauggucaagcuggaggacgacuucacgugccgccccgagagcgugcugcagcgggacgaccccgugcucgagaccucccaccagaacuuccgccgguuccgcuaccaggaggcggccagcccccgggaggcccugauccgccugcgggagcucugccaccaguggcugcgccccgagcggcgcaccaaggagcagauccuggagcuccugguccuggagcaguuccucaccgugcugccgggggagcugcaguccugggugcggggccagcgccccgagagcggggaggaggccgucacccucguggagggccugcagaagcagccccggcgcccccggcgcugggugaccguccacgugcacgggcaggaggugcuguccgaggagaccguccaccucggcguggagccggagagccccaacgagcugcaggaccccgugcaguccagcacccccgagcaguccccggaggagaccacgcagagccccgaccugggcgcccccgcggagcagcggccccaccaggaggaggagcuccagacccugcaggaguccgaggucccggugcccgaggaccccgaccugcccgccgagcgcagcuccggggacagcgagaugguggcccuccugaccgcccugucccagggccucgucaccuucaaggacguggcggugugcuucagccaggaccagugguccgaccuggacccgacgcagaaggaguucuacggggaguacguccuggaggaggacugcggcaucguggugagccucuccuuccccaucccccggcccgacgagaucagccagguccgcgaggaggagccgugggugcccgacauccaggagccccaggagacccaggagcccgagauccugagcuucaccuacaccggggaccgguccaaggacgaggaggagugccuggagcaggaggaccucagccuggaggacauccaccgcccgguccugggcgagcccgagauccaccagacgcccgacugggagaucguguucgaggacaacccgggccgccucaacgagcggcgcuucgggaccaacaucucccaggugaacagcuucgucaaccugcgggagaccacccccgugcacccccugcucggccgccaccacgacugcuccgugugcggcaagagcuucacgugcaacucccaccugguccggcaccuccgcacccacaccggggagaagcccuacaagugcauggagugcggcaagagcuacacccgguccagccaccuggcccgccaccagaaggugcacaagaugaacgccccguacaaguacccccugaaccggaagaaccuggaggagacgucccccgugacccaggccgagcgcacccccagcgucgagaagccguaccggugcgacgacugcgggaagcacuuccgcuggaccuccgaccucgugcggcaccagcgcacgcacaccggcgagaagcccuucuucugcaccaucugcgggaaguccuucagccagaaguccgugcugaccacgcaccagcggauccaccugggcgggaagcccuaccucugcggcgagugcggcgaggacuucagcgagcaccgccgguaccuggcccaccgcaagacccacgcggccgaggagcuguaccugugcagcgagugcgggcggugcuucacccacuccgccgccuucgccaagcaccuccgcggccacgcgagcguccgccccugccggugcaacgagugcggcaagagcuucucccgccgggaccaccuggugcgccaccagcggacccacacgggggagaagccguucacgugcccgaccugcggcaagagcuucucccgcggguaccaccugauccggcaccagcgcacccacagcgagaagaccuccuga

SEQ ID NO: 38989 - RNA, 1665 nt, Artificial Sequence
  derived and/or modified sequence opt1 from ZNF205__Homo_sapiens__XP_005255615
augagcgccgacggcgggggcauccaggacacccaggacaaggagacgcccccggaggugcccgaccgcgggcacccccaccaggagaugcccuccaagcugggcgaggccgucccgagcggggacacccaggagucccuccacaucaagauggagcccgaggagccccacagcgagggcgcgucccaggaggacggcgcccagggggccuggggcugggcgccccugagccacggguccaaggagaaggcccuguuccucccgggcggggcccugcccagcccccggauccccgugcugucccgcgagggccggacccgcgaccggcagauggccgccgcccuccugaccgcguggagccagaugccggugaccuucgaggacgucgcccuguaccucucccgcgaggaguggggccggcuggaccacacgcagcagaacuucuaccgcgacgugcugcagaagaagaacgggcucagccugggcuuccccuucucccggcccuucugggcgccccaggcccacgggaagggcgaggccagcggcuccagccgccaggccggggacgagaaggaguggcggggcgccugcaccggggccguggaggucggccagcgcgugcagaccuccagcguggccgcccuggggaacgucaagccguuccggacccgcgcgggccgggugcaguggggcgugccccagugcgcccaggaggccgccugcgggcgcuccagcggccccgccaaggacagcgggcagcccgcggagccggaccggacgcccgacgccgccccgcccgaccccucccccaccgagccccaggaguaccgcguccccgagaagccgaacgaggaggagaagggcgcccccgagagcggggaggagggccucgcccccgacuccgaggugggccgcaagagcuaccggugcgagcagugcgggaagggcuucuccuggcacagccaccuggugacccaccggcgcacccacacgggggagaagccguacgcgugcaccgacugcggcaagcgcuucgggcgguccagccaccugauccagcaccagaucauccacaccggcgagaagcccuacacgugccccgccugccgcaaguccuucagccaccacuccacccucauccagcaccagcggauccacaccggcgagaagcccuacgucugcgaccgcugcgccaagcgguucacccgccggagcgaccuggugacccaccaggggacgcacaccggcgccaagccgcacaagugccccaucugcgcgaagugcuucacccaguccagcgcccuggugacccaccagcgcacgcacaccggggucaagcccuaccccugcccggagugcggcaagugcuucucccagcggagcaaccucaucgcccacaaccgcacccacaccggcgagaagcccuaccacugccuggacugcgggaaguccuucagccacuccagccaccugacggcccaccagcggacccaccgcggcgugcggcccuacgccugcccccucugcggcaagagcuucucccgccggagcaaccugcaccgccacgagaagauccacaccaccgggccgaaggcgcuggccaugcucaugcugggggccgccgccgcgggcgcccuggccacgcccccgcccgcccccaccuga

SEQ ID NO: 38990 - RNA, 1599 nt, Artificial Sequence
  derived and/or modified sequence opt1 from ZNF20__Homo_sapiens__NP_066966
augauguuccaggacagcguggccuucgaggacgucgccguguccuucacccaggaggagugggcgcugcucgaccccagccagaagaaccuguaccgcgacgugaugcaggagaccuucaagaaccugacguccgucggcaagaccuggaaggugcagaacaucgaggacgaguacaagaacccgcggcgcaaccucagccugaugcgggagaagcugugcgaguccaaggagagccaccacugcggggaguccuucaaccagaucgccgacgacaugcucaaccgcaagacccugcccggcaucacccccugcgagagcuccgugugcggggaggucggcacggggcacagcucccugaacacccacauccgggccgacaccggccacaagagcuccgaguaccaggaguacggcgagaaccccuaccgcaacaaggagugcaagaaggccuucagcuaccucgacuccuuccagagccacgacaaggccugcaccaaggagaagccguacgacgggaaggagugcacggagaccuucaucucccacagcugcauccagcggcaccgcgugaugcacuccggcgacgggcccuacaagugcaaguucugcggcaaggcguucuacuuccugaaccugugccucauccacgagcggauccacaccggggugaagcccuacaagugcaagcagugcggcaaggccuucacccgcagcacgacccugcccguccacgagcggacccacaccggcgugaacgccgacgagugcaaggagugcgggaacgccuucagcuucccguccgagauccgccggcacaagcgcagccacacgggcgagaagcccuacgagugcaagcagugcgggaagguguucaucuccuucagcuccauccaguaccacaagaugacccacaccggcgagaagcccuacgagugcaagcagugcggcaaggcguuccggugcgggagccaccuccagaagcacggccgcacccacacgggggagaagcccuacgagugccggcagugcggcaaggccuuccgcugcaccuccgaccugcagcggcacgagaagacccacaccgaggacaagccguacgggugcaagcagugcggcaagggcuuccgcugcgccagccagcugcagauccacgagcggacgcacuccggggagaagccccacgagugcaaggagugcggcaaggucuucaaguacuucagcucccugcgcauccacgagcgcacccacaccggggagaagccccacgagugcaagcagugcggcaaggccuuccgguacuucagcucccuccacauccacgagcgcacccacacgggggacaagcccuacgagugcaaggugugcggcaaggccuucacgugcagcuccagcauccgguaccacgagcgcacccacaccggcgagaagccguacgagugcaagcacugcgggaaggcguucaucuccaacuacauccgguaccacgagcgcacccacaccggcgagaagcccuaccagugcaagcagugcgggaaggccuucauccgggccagcuccugccgcgagcacgagcggacccacaccaucaaccgcuga

SEQ ID NO: 38991 - RNA, 1488 nt, Artificial Sequence
  derived and/or modified sequence opt1 from ZNF212__Homo_sapiens__NP_036388
auggccgagagcgcccccgcgcgccaccggcgcaagcggcgcagcaccccgcugaccagcuccacgcuccccagccaggccaccgagaaguccagcuacuuccagaccaccgagaucucccuguggacgguggucgccgccauccaggccguggagaagaagauggagagccaggcggcccggcugcagucccucgagggccgcaccgggaccgccgagaagaagcuggccgacugcgagaagauggcgguggaguucggcaaccagcuggaggggaagugggccguccucggcacccugcugcaggaguacgggcuccugcagcggcgccuggagaacguggagaaccuccugcggaaccgcaacuucuggauccugcggcucccgcccggcagcaagggcgaggcccccaaggugucccgcagccuggagaacgacggggucugcuucacggagcaggagugggagaaccuggaggacuggcagaaggagcucuaccggaacgugauggaguccaacuacgagacccuggugagccugaagguccucggccagaccgagggggaggccgagcugggcaccgagaugcugggggaccucgaggaggagggccccggcggggcccaccccgcgggcggggugaugaucaagcaggagcugcaguacacgcaggagggccccgccgaccugccgggcgaguucuccugcaucgccgaggagcaggccuuccucagccccgagcagaccgagcuguggggcgggcagggguccagcgugcugcucgagaccggccccggggacuccacccuggaggagcccgucggcagccgcgugccgagcuccagccggacggugggcugccccaagcagaagucccaccgccagguccagcuggaccaggagugcgggcagggccucaagcugaagaaggacaccagccggcccuacgagugcuccgagugcgagaucaccuuccgcuacaagcagcagcuggccacccaccuccggagccacuccggguggggcagcugcacgcccgaggagccggaggagucccugcgcccccggccccgccugaagccccagaccaagaaggcgaagcuccaccagugcgacgugugccugcgcagcuucuccugcaaggugagccuggucacccaccagcggugccaccuccaggaggggccguccgccggccagcacgugcaggagcgcuucagccccaacucccugguggcccugcccggccacauccccuggcgcaagagccgguccagccucaucugcggguacugcggcaaguccuucagccacccgagcgaccugguccggcaccagcgcauccacaccggggagcggcccuacuccugcacggagugcgagaaguccuucgugcagaagcagcaccuccugcagcaccagaagauccaccagcgcgagcggggcgggcuggcccuggagcccggccgccccaacggccugcucuga

SEQ ID NO: 38992 - RNA, 1821 nt, Artificial Sequence
  derived and/or modified sequence opt1 from ZNF214__Homo_sapiens__XP_006718371
auggccgugaccuucgaggacgucaccaucaucuucacgugggaggaguggaaguuccuggacagcucccagaagcgccucuaccgggaggugaugugggagaacuacaccaacgugaugagcgucgagaacuggaacgaguccuacaagagccaggaggagaaguuccgcuaccuggaguacgagaacuucuccuacuggcagggcugguggaacgccggggcgcagauguacgagaaccagaacuacggcgagaccgugcaggggaccgacagcaaggaccugacgcagcaggaccggucccagugccaggaguggcucauccugagcacccaggugcccggcuacgggaacuacgagcugaccuucgaguccaagagccuccgcaaccugaaguacaagaacuucaugccguggcagucccuggagaccaagacgacccaggacuacggccgggagaucuacaugagcggcucccacggguuccagggcgggcgcuaccggcucggcaucagccgcaagaaccuguccauggagaaggagcagaagcugaucguccagcacagcuacauccccguggaggaggcccucccccaguacgugggggucaucugccaggaggaccugcugcgggacuccauggaggagaaguacugcggcugcaacaagugcaagggcaucuacuacuggaacagccgcugcguguuccacaagcggaaccagcccggggagaaccucugccagugcuccaucugcaaggccugcuucagccagcgcagcgaccuguaccggcacccgcgcaaccacaucggcaagaagcuguacgggugcgacgagguggacggcaacuuccaccaguccagcggcguccacuuccaccagcgggugcacaucggggaggugcccuacuccugcaacgccugcggcaagagcuucucccagaucagcucccuccacaaccaccagcgcguccacaccgaggagaaguucuacaagaucgagugcgacaaggaccugagccggaacucccugcuccacauccaccagcgccugcacaucggggagaagcccuucaagugcaaccagugcggcaagagcuucaaccgguccagcgugcugcacgugcaccagcgcguccacaccggggagaagcccuacaagugcgacgagugcggcaagggcuucucccagagcuccaaccuccggauccaccagcuggugcacacgggggagaaguccuacaagugcgaggacugcggcaagggguucacccagcgcagcaaccugcagauccaccagcgcgugcacaccggcgagaagccguacaagugcgacgacugcgggaaggacuucagccacuccagcgaccuccggauccaccagcgcguccacaccggcgagaagcccuacacgugccccgagugcggcaagggguucagcaaguccagcaagcugcacacccaccagcgggugcacaccggcgagaagcccuacaagugcgaggagugcgggaagggcuucucccagcgcagccaccuccugauccaccagcgggugcacaccggggagaagccguacaagugccacgacugcggcaagggcuucucccacagcuccaaccugcacauccaccagcgcguccacacgggggagaagcccuaccagugcgccaagugcggcaagggguucagccacuccagcgcgcugcggauccaccagcgcgugcacgccggcgagaagcccuacaagugccgggaguacuacaagggcuucgaccacaacucccaccuccacaacaaccaccgccgggggaaccuguga

SEQ ID NO: 38993 - RNA, 1554 nt, Artificial Sequence
  derived and/or modified sequence opt1 from ZNF215__Homo_sapiens__NP_037382
augcagccccugagcaagcucauggccaucuccaagccgcgcaaccugagccugcgggagcagcgcgaggugcuccgggccgacauguccuggcagcaggagaccaaccccgucguggagacccacgacagcgaggcgucccgccagaaguuccggcacuuccaguaccugaaggugagcggcccccacgaggcccugucccagcucugggagcugugccugcaguggcuccgccccgagauccacacgaagaagcagaucaucgagcugcugguccucgagcaguuccuggccauccugccggaggaggugcggaccugggugaaccuccagcaccccaacaacagcaaggacauggucacccugaucgaggacgugaucgagaugcuggaggacgaggacaugcccugcaaggacuccgcccuccagauggggagcaucaaggagaagaugaaggccggcucccgcaccgggaagccccaggagccggugacguucaaggacgucgugguggaguucagcaaggaggaguggggccagcuggacuccgcggucaagaaccuguaccggaacgugaugcucgagaacuuccgcaaccugaacagccugcggaaggcccaccuccuguccaagcccuucgagagccugaagcucgaguccaagaagaagcgcuggaucauggagaaggagaucccccggaagaccaucuucgacaugaaguccaucagcggggaggagagcagccacggcgugaucaugacccgccugaccgaguccggccaccccagcuccgacgccuggaagggggagaacuggcuguaccggaaccagaagaagugggacaucaaccucccgcaggaggccuucauccccgagacgaucuacaccgaggaggaggacuucgagugcagcgagaacaagaaguccuucgacaucaacagcgucuccagcaucugcgcgauccaggugggcauccccucccgcaaggggagccccaagugcgacaaguucaagaccuacuucaaguucaaccuggacuccgugggcaagcagcacagcgaguacgaguacgggaacgaccugucccucagcaccgacauccggcaccagaagucccacacgaccaugaacagcuacgagugcuaccagugcggcaaggccuucugccgcuccagcucccugauccggcaccagaucauccacaccggcgagaagccguacaagugcagcgagugcgggcgcuucuucaaccggcgcaccaaccugacgaagcaccagaagcuccacgccgaggccaaggccugcaccagcaacaagugcggcaaggcguucuccaagagcgaggacuccaacaaccccacccugcacuucgggaacaacuucuaccagugcgucaacugcggcaagagcuucaaccgcuccagcucccugauccggcaccagaugauccacaccggcgagaagcccuucaagugcaaggagugcagcaaggccuucaaccgcuccagcaaccucgugaagcaccagaagcugcacacgcgggacaaguccuga

SEQ ID NO: 38994 - RNA, 3147 nt, Artificial Sequence
  derived and/or modified sequence opt1 from ZNF217__Homo_sapiens__NP_006517
augcagagcaaggugaccggcaacaugcccacccagucccugcucauguacauggacgggccggaggucaucggcagcucccuggggagccccauggagauggaggacgcccuguccaugaagggcacggccguggugcccuuccgcgcgacccaggagaagaacgucauccagaucgagggguacaugccccucgacugcauguucugcagccagaccuucacccacuccgaggaccugaacaagcacgugcugaugcagcaccggccgacgcucugcgagcccgccgugcugcgcgucgaggccgaguaccugagcccccucgacaagucccaggugcggaccgagcccccgaaggagaagaacugcaaggagaacgaguucagcugcgaggugugcggccagaccuuccgcgucgccuucgacguggagauccacaugcggacccacaaggacuccuucacguacggcugcaacaugugcgggcgccgguucaaggagcccugguuccugaagaaccacaugcgcacccacaacggcaagagcggggcccgguccaagcugcagcagggccucgagagcucccccgcgaccaucaacgaggugguccaggugcacgccgccgagagcaucuccagccccuacaagaucugcauggugugcggguuccuguucccgaacaaggagucccugaucgagcaccgcaagguccacaccaagaagacggccuucggcaccagcagcgcgcagaccgacagcccccagggcgggaugcccuccucccgggaggacuuccuccagcuguucaaccugcgccccaagagccacccggagaccggcaagaagcccgugcggugcaucccccagcucgaccccuucacgaccuuccaggccuggcagcuggccaccaaggggaagguggccaucugccaggaggucaaggaguccggccaggagggcagcaccgacaacgacgacuccagcuccgagaaggagcugggggagacgaacaagggcagcugcgccgggcucucccaggagaaggagaagugcaagcacagccacggcgaggcgccguccguggacgccgaccccaagcugcccagcuccaaggagaagcccacccacugcagcgagugcgggaaggccuuccgcaccuaccaccagcuggugcuccacucccggguccacaagaaggaccgccgggccggcgccgagagcccgaccauguccguggacggccgccagcccgggacgugcagccccgaccuggcggcgccccuggacgagaacggcgccguggaccgcggggagggcgggagcgaggacggcuccgaggacggccucccggaggggauccaccuggacaagaacgacgacggcgggaagaucaagcaccugaccagcucccgggagugcagcuacugcggcaaguucuuccgguccaacuacuaccucaacauccaccuccgcacccacaccggggagaagcccuacaagugcgaguucugcgaguacgccgccgcccagaagacgagccugcgcuaccaccuggagcggcaccacaaggagaagcagaccgacgucgccgccgaggugaagaacgacggcaagaaccaggacaccgaggacgcccugcugaccgccgacuccgcgcagacgaagaaccucaagcgcuucuucgacggcgccaaggacgucaccgggagcccgcccgccaagcagcugaaggagaugcccuccguguuccagaacgugcugggcagcgccguccucucccccgcgcacaaggacacccaggacuuccacaagaacgccgccgacgacagcgccgacaaggugaacaagaaccccaccccggccuaccuggaccugcucaagaagcgguccgcgguggagacgcaggccaacaaccugaucugccgcaccaaggccgacgucaccccgccgcccgacgggagcaccacccacaaccuggaggugucccccaaggagaagcagacggagaccgccgccgacugccgguaccgccccagcguggacugccacgagaagccccucaaccuguccgucggcgcgcugcacaacugccccgccaucagccucagcaagucccugauccccagcaucacgugccccuucugcaccuucaagaccuucuaccccgaggugcugaugaugcaccagcggcuggagcacaaguacaaccccgacgugcacaagaacugccgcaacaagucccuccugcggagccgccggaccggcugcccgcccgcccugcucgggaaggacgucccgccccuguccagcuucugcaagcccaagcccaaguccgccuuccccgcccagagcaagucccugcccagcgcgaagggcaagcaguccccgcccgggcccggcaaggccccgcucaccagcgggaucgacuccagcacccuggcccccuccaaccucaagagccaccgcccccagcagaacgugggcgugcagggcgccgcgacgcggcagcagcaguccgagauguuccccaagaccagcgucuccccggcccccgacaagaccaagcgccccgagaccaagcugaagccccugccgguggcccccagccagcccacgcuggggagcuccaacaucaacggcagcaucgacuaccccgccaagaacgacuccccgugggccccgcccgggcgggacuacuucugcaaccgcagcgcguccaacaccgccgccgaguucggcgagccccuccccaagcggcucaagagcuccguggucgcccuggacguggaccagcccggggccaacuaccgccggggcuacgaccugcccaaguaccacauggugcgcggcaucaccagccugcugccccaggacugcgucuacccgucccaggcgcucccgcccaagccccgcuuccugagcuccagcgagguggacucccccaacgugcugaccguccagaagcccuacgggggcagcgggccccucuacacgugcgugcccgccggcuccccggccagcuccagcacccuggaggggaagcggcccguguccuaccagcaccugagcaacagcauggcccagaagcgcaacuacgagaacuucaucggcaacgcccacuaccggcccaacgacaagaagaccuga

SEQ ID NO: 38995 - RNA, 2124 nt, Artificial Sequence
  derived and/or modified sequence opt1 from ZNF224__Homo_sapiens__XP_005259278
augaccaccuucaaggaggccaugaccuucaaggacguggccgucguguucaccgaggaggagcugggccuccuggaccuggcgcagcgcaagcucuaccgggacgugaugcuggagaacuuccgcaaccugcucagcgucgggcaccaggccuuccaccgggacaccuuccacuuccugcgcgaggagaagaucuggaugaugaagaccgccauccagcgggagggcaacuccggggacaagauccagacggagauggagaccgugagcgaggccggcacccaccaggagugguccuuccagcagaucugggagaagaucgccagcgaccugacccgcucccaggaccucaugaucaacagcucccaguucagcaaggagggggacuuccccugccagacggaggcgggccuguccgugauccacacccggcagaaguccagccagggcaacggguacaagccgagcuucuccgacgucagccacuucgacuuccaccagcagcugcacuccggcgagaagucccacacgugcgacgagugcgggaagaacuucugcuacaucagcgcccuccgcauccaccagcgggugcacaugggcgagaagugcuacaagugcgacgugugcgggaaggaguucagccaguccagccaccuccagacccaccagcgcguccacaccggcgagaagcccuucaagugcguggagugcggcaagggguucagccggcgcuccgcccugaacgugcaccacaagcugcacaccggcgagaagcccuacaacugcgaggagugcgggaaggccuucauccacgacagccagcugcaggagcaccagcggauccacaccggcgagaagcccuucaagugcgacaucugcggcaaguccuucugcgggcgcagccggcugaaccgccacuccaugguccacaccgcggagaagccguuccggugcgacacgugcgacaagagcuuccgccagcgguccgcccucaacagccaccgcaugauccacaccggcgagaagcccuacaagugcgaggagugcgggaagggcuucaucugccggcgcgaccuguacacccaccacauggugcacaccggggagaagcccuacaacugcaaggagugcggcaaguccuuccgcugggccagcugccugcucaagcaccagcgggugcacuccggcgagaagcccuucaagugcgaggagugcgggaagggcuucuacacgaacagccagugcuacucccaccagcgcagccacuccggggagaagccguacaagugcgucgagugcggcaagggguacaagcggcgccuggaccuggacuuccaccagcgggugcacaccggcgagaagcucuacaacugcaaggagugcggcaagagcuucucccgcgcccccugccugcugaagcacgagcggcuccacagcggggagaagcccuuccagugcgaggagugcggcaagcgcuucacccagaacucccaccuccacagccaccagcgggugcacaccggggagaagcccuacaagugcgagaagugcggcaagggguacaacagcaaguucaaccuggacaugcaccagaagguccacacgggcgagcgcccguacaacugcaaggagugcggcaaguccuucgggugggccagcugccugcugaagcaccagcggcugcacuccggcgagaagcccuucaagugcgaggagugcgggaagcgcuucacccagaacagccagcuccacucccaccagcgggugcacaccggcgagaagcccuacaagugcgacgagugcggcaagggguucagcugguccagcacccgccugacgcaccagcggcgccacucccgggagacgccccugaagugcgagcagcacggcaagaacaucgugcagaacagcuucuccaagguccaggagaaggugcacagcguggagaagccguacaagugcgaggacugcgggaagggcuacaaccgccggcucaaccuggacaugcaccagcgcguccacaugggggagaagaccuggaagugccgcgagugcgacaugugcuucucccaggcgagcucccugcggcuccaccagaacgugcacgucggcgagaagcccuga

SEQ ID NO: 38996 - RNA, 675 nt, Artificial Sequence
  derived and/or modified sequence opt1 from ZNF22__Homo_sapiens__NP_008894
augcgccuggccaagcccaaggccggcaucagccgguccagcucccaggggaaggcguacgagaacaagcgcaagaccggccggcagcgccagaagugggggaugaccauccgguucgacagcuccuucagccgccugcggcgcucccuggacgacaagccguacaagugcacggagugcgagaaguccuucagccagagcuccacccuguuccagcaccagaagauccacaccggcaagaagucccacaagugcgccgacugcggcaagagcuucuuccagagcuccaaccucauccagcaccggcgcauccacaccggggagaagcccuacaagugcgacgagugcggcgagagcuucaagcaguccagcaaccugauccagcaccagcggauccacacgggggagaagcccuaccagugcgacgagugcggccgcugcuucucccagagcagccaccugauccagcaccagcggacccacaccggggagaagcccuaccagugcuccgagugcggcaagugcuucagccaguccagccaccuccgccagcacaugaaggugcacaaggaggagaagccgcggaagacccgcgggaagaacauccgggucaagacgcaccuccccuccuggaaggccggcaccggccgcaagagcguggccgggcugcgguga

SEQ ID NO: 38997 - RNA, 1425 nt, Artificial Sequence
  derived and/or modified sequence opt1 from ZNF230__Homo_sapiens__XP_011525595
augaccaccuucaaggaggccgugacguucaaggacgucgccguguucuucaccgaggaggagcugggccuccuggaccccgcgcagcgcaagcuguaccaggacgugaugcucgagaacuucaccaaccugcugagcgucgggcaccagccguuccaccccuuccacuuccuccgggaggagaaguucuggaugauggagaccgccacgcagcgcgagggcaacuccgggggcaagaccaucgccgaggccgggccccacgaggacugccccugccagcagaucugggagcagaccgccagcgaccugacccagucccaggacagcaucaucaacaacucccacuucuucgagcagggcgacgugccgagccagguggaggcgggccuguccaucauccacacggggcagaagcccagccagaacggcaagugcaagcaguccuucagcgacgucgccaucuucgacccgccccagcaguuccacuccggggagaagucccacacgugcaacgagugcggcaagagcuucugcuacaucagcgcccuccggauccaccagcgcgugcaccuccgggagaagcuguccaagugcgacaugcgcgggaaggaguucagccaguccagcugccugcagacccgggagcgcgugcacaccggcgagaagcccuucaagugcgagcagugcggcaagggguuccggugccgcgccauccugcagguccacugcaagcugcacaccggcgagaagcccuacaucugcgagaagugcgggcgggcguucauccacgacuuccagcuccagaagcaccagaucauccacaccggcgagaagcccuucaagugcgagaucugcggcaaguccuucugccugcgcagcagccugaaccggcacugcauggugcacaccgccgagaagcucuacaaguccgaggagugcgggaagggcuucaccgacagccuggaccugcacaagcaccagaucauccacacggggcagaagcccuacaacugcaaggagugcggcaaguccuuccgcuggagcuccuaccuccugauccaccagcggauccacagcggggagaagccguaccgcugcgaggagugcggcaagggcuacaucuccaagagcgggcugaaccuccaccagcgggugcacaccggcgagcgccccuacaacugcaaggagugcgggaaguccuucagccgggccuccagcauccugaaccacaagaagcugcacugccgcaagaagcccuucaagugcgaggacugcggcaagcggcucguccaccgcuccuucugcaaggaccagcagggggaccacaacggcgagaacagcuccaagugcgaggacugcggcaagcgcuacaagcggcgccugaaccuggacaucauccucagccuguuccugaacgacauguga

SEQ ID NO: 38998 - RNA, 5538 nt, Artificial Sequence
  derived and/or modified sequence opt1 from ZNF236__Homo_sapiens__NP_031371
augggccugugcgggcuccuggagcgcugcuggcugcaccacgaccccgacggcgugcucacccugaacgccgagaacaccaacuacgccuaccaggucccgaacuuccacaagugcgagaucugccugcucagcuuccccaaggagucccaguuccagcggcacaugcgcgaccacgagcggaacgacaagccccaccgcugcgaccagugcccccagacguucaacguggaguucaaccugacccugcacaagugcacccacagcggggaggacccgaccugccccgugugcaacaagaaguucucccgggucgcgagccucaaggcccacaucaugcugcacgagaaggaggagaaccugaucugcuccgagugcggcgacgaguucacgcuccagagccagcuggccgugcacauggaggagcaccgccaggagcuggccgggacccggcagcacgccugcaaggcgugcaagaaggaguucgagaccuccagcgagcucaaggagcacaugaagacccacuacaagauccgcguguccagcacgcgguccuacaaccgcaacaucgaccggagcggcuucaccuacuccugcccccacugcggcaagaccuuccagaagcccagccagcugacccgccacauccggauccacacgggggagcgcccguucaagugcuccgagugcggcaaggccuucaaccagaagggggcccugcagacccacaugaucaagcacaccggcgagaagccccacgccugcgcguucugccccgccgccuucagccagaaggggaaccuccagucccacguccagcgggugcacagcgaggugaagaacggccccaccuacaacugcacggagugcuccugcgucuucaagagccugggcagccugaacacccacaucuccaagaugcacauggggggcccgcagaacagcaccuccagcaccgagacggcccacgugcucaccgccacccuguuccagacccugccccuccagcagacggaggcgcaggccaccuccgccagcucccagcccagcucccaggccgugagcgacgucauccagcagcugcuggagcucuccgagcccgccccgguggagagcgggcaguccccccagcccggccagcagcugagcaucaccgugggcaucaaccaggacauccugcagcaggcgcucgagaacuccgggcugagcuccauccccgccgccgcccacccgaacgacagcugccacgccaagaccuccgcgccccacgcccagaaccccgacgucagcagcguguccaacgagcagacggaccccaccgacgccgagcaggagaaggagcaggagagcccggagaagcuggacaagaaggagaagaagaugaucaagaagaagucccccuuccuccccggcagcauccgcgaggagaacggggugcgguggcacgucugccccuacugcgccaaggaguuccgcaagccguccgaccuggugcggcacauccgcauccacacccacgagaagcccuucaagugcccccagugcuuccgggccuucgcggugaagagcacccugacggcccacaucaagacccacaccggcaucaaggccuucaagugccaguacugcaugaaguccuucagcaccuccgggagccucaagguccacauccgccugcacacgggcgugcgcccguucgccugcccccacugcgacaagaaguuccggaccuccggccaccgcaagacccacaucgcgagccacuucaagcacaccgagcugcggaagaugcgccaccagcggaagcccgccaaggugcgcgucgggaagaccaacauccccgugccggacaucccccuccaggagcccauccugaucacggaccugggccucauccagcccaucccgaagaaccaguucuuccaguccuacuucaacaacaacuucgucaacgaggccgaccggcccuacaagugcuucuacugccaccgcgccuacaagaagagcugccaccugaagcagcacauccggucccacaccggggagaagcccuucaagugcagccagugcggccgcggguucguguccgccggcgugcugaaggcgcacauccggacccacaccggccucaagagcuucaagugccugaucugcaacggggccuucacgaccggcgggagccugcgccggcacaugggcauccacaacgaccuccgccccuacaugugcccguacugccagaagaccuucaagaccucccugaacugcaagaagcacaugaagacgcaccgguacgagcuggcccagcagcugcagcagcaccagcaggccgccagcaucgacgacuccaccgucgaccagcagagcaugcaggcguccacccagaugcagguggagaucgagagcgacgagcucccccagaccgccgagguggucgccgccaaccccgaggccaugcuggaccuggagccccagcacgugguggggacggaggaggcgggccucggccagcagcuggccgaccagccgcuggaggccgacgaggacggguucgucgccccccaggacccccuccgcggccacguggaccaguucgaggagcagucccccgcgcagcagagcuucgagccggccgggcugccccagggcuucaccgugaccgacaccuaccaccagcagccccaguuccccccgguccagcagcugcaggacuccagcacgcucgagucccaggcccugagcaccuccuuccaccagcagagccugcuccaggcccccuccagcgacggcaugaacgugaccacccggcugauccaggaguccagccaggaggagcuggaccuccaggcccaggggucccaguuccuggaggacaacgaggaccagagccgccggagcuaccgcugcgacuacugcaacaagggcuucaagaaguccagccaccugaagcagcacgugcgcucccacacgggggagaagcccuacaagugcaagcucugcggccggggguucgucagcuccggcgugcugaagagccacgagaagacccacaccggcgugaaggcguucuccugcagcgucugcaacgccuccuucaccacgaacgggagccugacccgccacauggccacccacauguccaugaagccguacaagugccccuucugcgaggagggcuuccggaccacggugcacugcaagaagcacaugaagcgccaccagaccgugcccagcgccgucuccgccaccggggagaccgagggcggggacaucugcauggaggaggaggaggagcacagcgaccggaacgcgucccgcaagagccggcccgaggugaucacguucaccgaggaggagaccgcccagcucgccaagauccgcccgcaggaguccgccaccgugagcgagaagguccuggugcaguccgccgcggagaaggaccggaucagcgagcugcgcgacaagcaggccgagcuccaggacgagcccaagcacgccaacugcugcacguacugccccaagagcuucaagaagcccuccgaccuggugcggcacguccgcauccacaccggcgagaagccguacaagugcgacgagugcggcaagagcuucaccgugaaguccacccuggacugccacgugaagacccacacggggcagaagcucuucagcugccacgucugcuccaacgccuucagcaccaagggcucccugaaggugcacaugcggcugcacaccggggcgaagcccuucaagugcccccacugcgagcuccgcuuccggaccagcggccgccggaagacgcacaugcaguuccacuacaagcccgacccgaagaaggcccgcaagcccaugacccgguccagcuccgaggggcugcagcccgugaaccugcucaacagcuccagcaccgaccccaacgucuucaucaugaacaacuccgugcugaccggccaguucgaccagaaccugcuccagccgggccugguggggcaggccauccugcccgccagcgucuccgccggcggggaccucacggugagccugaccgacggcucccuggcgacccucgaggggauccagcugcagcuggccgccaaccucgugggccccaacguccagaucagcggcaucgacgccgccagcaucaacaacaucacccugcagaucgaccccuccauccugcagcagacgcuccagcaggggaaccugcuggcgcagcagcucaccggcgagccggggcuggccccccagaacagcucccugcagaccagcgacuccaccgugcccgccagcguggucauccagcccaucuccggccucagccugcagccgacggugaccuccgccaaccugaccaucggcccccucagcgagcaggacuccgugcugaccacgaacagcuccgggacccaggaccugacccaggucaugaccagccagggccucgugucccccagcgggggcccccacgagaucacgcugaccaucaacaacuccagccugucccaggugcucgcccaggcggccgggccgaccgccaccagcagcuccggcagcccccaggagaucacgcugaccaucuccgagcugaacaccaccagcggcucccuccccagcacgaccccgaugucccccagcgccaucuccacccagaaccuggucaugagcuccagcggggugggcggggacgccuccgugacccugacgcucgcggacacccagggcaugcugagcgggggccuggacaccgucacccucaacaucaccucccagggccagcaguuccccgcccugcugacggaccccagccucuccgggcagggcggggccggcagcccgcaggugauccuggucucccacaccccccagagcgccagcgcggccugcgaggagaucgccuaccagguggccgggguguccggcaaccuggcccccggcaaccagcccgagaaggaggggcgcgcgcaccagugccucgagugcgaccgggccuucagcuccgccgccguccugaugcaccacagcaaggaggugcacggccgcgagcgcauccacgggugcccggugugccggaaggccuucaagcgcgcgacccaccugaaggagcacaugcagacccaccaggccggccccucccucagcucccagaagccccgggucuucaagugcgacacgugcgagaaggccuucgccaagcccagccagcuggagcgccacucccggauccacaccggcgagcgcccguuccacugcacccugugcgagaaggccuucaaccagaagagcgcgcuccaggugcacaugaagaagcacaccggggagcggcccuacaagugcgccuacugcgugaugggcuucacgcagaaguccaacaugaagcugcacaugaagcgcgcccacagcuacgccggggcgcugcaggaguccgccggccaccccgagcaggacggggaggagcucagccggacccugcaccuggaggaggucgugcaggaggccgccggcgaguggcaggcccucacccacguguucuga

SEQ ID NO: 38999 - RNA, 1809 nt, Artificial Sequence
  derived and/or modified sequence opt1 from ZNF239__Homo_sapiens__XP_011538534
augggccacgcccugcucaaggacguggucauggagcuggaggggagcaaccugugcuucugccucuucgugcccccgcugcugcgcggccucucccugcuguuccagcccagcuccagcgaguggcggcccgugacccucaaccgcaagcuggggcggcagcaccccucccugccgagcucccuccccagcuccuuccccaccggcgacaagcuggggacgagcuacauccagggcugccugugcggccuccaccgcgggggcguccggucccccgggcugugcagccaggaggccgugcgcuccugcgacgcgggccagcugcagaagcucgggcugggcgaccugaacgagaacagcguggagaaccuccagcagaagacccugcaggaccugcuccacgagcuguccagcuggcugguccucgagggcauggccuccaccaucaccgggagccaggacugcaucgugaaccaccggggcgagguggacggggagccggagcuggacaucucccccugccagcaguggggcgaggccagcagccccaucucccgcaaccgggacagcgucaugacgcugcaguccggcugcuucgagaacaucgagagcgagaccuaccucccccugaagguguccagccagaucgacacccaggacuccagcgugaaguucugcaagaacgagccgcaggaccaccaggagucccgccggcuguucgucauggaggagagcaccgagcgcaaggugaucaagggggaguccugcagcgagaaccuccaggugaagcuggucuccgacggccaggagcuggccagcccccuccugaacggggaggccacgugccagaacggccagcugaaggagucccucgaccccaucgacugcaacugcaaggacauccacggguggaagucccagguggugagcugcagccagcagcgggcgcacaccgaggagaagcccugcgaccacaacaacugcggcaagauccugaacaccuccccggacggccaccccuacgagaagauccacaccgccgagaagcaguacgagugcagccagugcgggaagaacuucagccaguccagcgagcugcuccugcaccagcgcgaccacacggaggagaagcccuacaagugcgagcagugcggcaagggguucacccgguccagcucccugcucauccaccaggccguccacaccgacgagaagcccuacaagugcgacaagugcggcaagggguucacccgcagcuccagccugcugauccaccacgccgugcacacgggcgagaagccguacaagugcgacaagugcggcaagggguucucccagagcuccaagcuccacauccaccagcgggugcacaccggcgagaagcccuacgagugcgaggagugcgggaugagcuucucccagcgcagcaaccugcacauccaccagcggguccacaccggcgagcgccccuacaagugcggggagugcggcaagggcuucucccagagcuccaaccugcacauccaccggugcauccacaccggggagaagcccuaccagugcuacgagugcggcaagggguucagccagagcuccgaccugcgcauccaccuccgcgugcacacgggcgagaagccguaccacugcggcaagugcgggaagggcuucagccaguccagcaagcugcugauccaccagcgggugcacaccggggagaagcccuacgagugcuccaagugcggcaagggguucagccaguccagcaaccuccacauccaccagcgcguccacaagaaggacccccgguga

SEQ ID NO: 39000 - RNA, 1932 nt, Artificial Sequence
  derived and/or modified sequence opt1 from ZNF23__Homo_sapiens__NP_001291421
augcuggagaacuacggcaacguggccagccucggguucccccugcugaagccggccgucaucucccagcucgagggcgggagcgagcugggcggguccagcccccuggcggccggcaccggccuccaggggcugcagaccgacauccagacggacaacgaccugaccaaggagauguacgagggcaaggagaacguguccuucgagcuccagcgcgacuucagccaggagaccgacuucuccgaggccagccugcuggagaagcagcaggaggugcacuccgccgggaacaucaagaaggagaaguccaacaccaucgacggcacggucaaggacgagaccagccccguggaggagugcuucuucagccaguccagcaacuccuaccagugccacaccaucaccggggagcagcccagcggcugcacgggccucgggaaguccaucagcuucgacaccaagcuggugaagcacgagaucaucaacuccgaggagcggccguucaagugcgaggagcuggucgagcccuuccgcugcgacagccagcucauccagcaccaggagaacaacaccgaggagaagcccuaccagugcagcgagugcggcaaggccuucuccaucaacgagaagcugaucuggcaccagcggcugcacagcggggagaagcccuucaagugcguggagugcggcaaguccuucagcuacuccagccacuacaucacccaccagacgauccacuccggcgagaagccguaccagugcaagaugugcgggaaggcguucagcgugaacggcucccucagccgccaccagcggauccacaccggggagaagcccuaccagugcaaggagugcggcaacggguucuccugcagcuccgccuacaucacccaccagcgcguccacaccggcgagaagcccuacgagugcaacgacugcggcaaggccuucaacgugaacgccaagcugauccagcaccagcggauccacacgggggagaagcccuacgagugcaacgagugcggcaagggguuccgcugcagcucccagcugcggcagcaccagagcauccacaccggcgagaagccguaccagugcaaggagugcgggaagggcuucaacaacaacaccaagcucauccagcaccagcgcauccacaccggcgagaagcccuacgagugcacggagugcgggaaggcguucuccgugaagggcaagcugauccagcaccagcggauccacaccggggagaagcccuacgagugcaacgagugcggcaaggccuuccgcugcaacagccaguuccggcagcaccuccgcauccacaccggggagaagcccuacgagugcaacgagugcggcaaggccuucuccgucaacggcaagcugaugcggcaccagcgcauccacaccggggagaagccguucgagugcaacgagugcggccggugcuucacgagcaagcgcaaccugcuggaccaccaccggauccacaccggggagaagcccuaccagugcaaggagugcggcaaggccuucagcaucaacgccaagcucacccgccaccagcggauccacaccggcgagaagcccuucaagugcauggagugcgagaaggcguucuccugcagcuccaacuacaucgugcaccagcgcauccacacgggggagaagcccuuccagugcaaggagugcggcaaggccuuccacgugaacgcccaccugauccgccaccagcggagccacaccggggagaagccguuccgcugcgucgagugcggcaagggguucuccuucagcuccgacuacaucauccaccagaccgugcacaccuggaagaagcccuacaugugcagcgugugcggcaaggccuuccgguucuccuuccagcugagccagcaccaguccguccacagcgagggcaaguccuga

SEQ ID NO: 39001 - RNA, 1740 nt, Artificial Sequence
  derived and/or modified sequence opt1 from ZNF248__Homo_sapiens__XP_011517899
augaacaagagccaggagcaggucuccuucaaggacgugugcguggacuucacccaggaggagugguaccugcucgaccccgcccagaagauccuguaccgcgacgugauccuggagaacuacagcaaccucgucuccgugggcuacugcaucaccaagccggaggugaucuucaagaucgagcagggggaggagcccuggauccuggagaagggcuuccccagccagugccaccccgagcggaaguggaaggucgacgacgugcuggaguccagccaggagaacgaggacgaccacuucugggagcuccuguuccacaacaacaagacgguguccgucgagaacggggaccgcggcagcaagaccuucaaccuggggaccgacccggugucccuccggaacuaccccuacaagaucugcgacagcugcgagaugaaccugaagaacaucuccggccugaucaucagcaagaagaacugcucccgcaagaagcccgacgaguucaacgugugcgagaagcuccugcuggacauccggcacgagaagauccccaucggcgagaaguccuacaaguacgaccagaagcgcaacgccaucaacuaccaccaggaccucagccagccgagcuucgggcaguccuucgaguacagcaagaacggccagggguuccacgacgaggcggccuucuucaccaacaagcggucccagaucggcgagacggucugcaaguacaacgagugcgggcgcaccuucaucgagagccugaagcugaacaucagccagcggccccaccucgagauggagcccuacggcugcuccaucugcggcaagagcuucugcaugaaccugcgcuucgggcaccagcgggcccugaccaaggacaaccccuacgaguacaacgaguacggcgagaucuucugcgacaacuccgccuucaucauccaccagggggccuacacccgcaagauccuccgggaguacaaggugagcgacaagacgugggagaaguccgcgcugcugaagcaccagaucgugcacaugggcggcaagagcuacgacuacaacgagaacggguccaacuucagcaagaagucccaccucacccagcugcgccgggcccacaccggcgagaagaccuucgagugcggggagugcggcaagacguucugggagaaguccaaccugacccagcaccagcgcacccacaccggggagaagccguacgagugcacggagugcggcaaggccuucugccagaagccccaccucaccaaccaccagcggacccacaccggcgagaagcccuacgagugcaagcagugcgggaagacguucugcgucaagagcaaccugaccgagcaccagcgcacccacaccggcgagaagcccuacgagugcaacgccugcggcaagagcuucugccaccgguccgcgcugacggugcaccagcgcacccacaccggggagaagccguucaucugcaacgagugcggcaagagcuucugcgugaaguccaaccucaucguccaccagcggacccacacgggggagaagcccuacaagugcaacgagugcggcaagaccuucugcgagaaguccgcccugaccaagcaccagcgcacccacacgggggagaagcccuacgagugcaacgccugcggcaagaccuucagccagcgcagcgugcugaccaagcaccagcggauccacacccgcgugaaggcccucuccacgagcuga

SEQ ID NO: 39002 - RNA, 1107 nt, Artificial Sequence
  derived and/or modified sequence opt1 from ZNF24__Homo_sapiens__NP_008896
augagcgcccaguccguggaggaggacagcauccugaucauccccaccccggacgaggaggagaagauccuccgcgucaagcuggaggaggaccccgacggggaggagggguccagcauccccuggaaccaccuccccgacccggagaucuuccggcagcgcuuccggcaguucggcuaccaggacucccccgggccccgcgaggccgugagccagcugcgggagcugugccgccuguggcuccggcccgagacccacacgaaggagcagauccuggagcuggugguccucgagcaguucguggcgauccugccgaaggagcugcagaccugggugcgcgaccaccaccccgagaacggcgaggaggccgucaccgugcucgaggaccuggaguccgagcuggacgaccccgggcagcccgugagccuccggcgccggaagcgcgagguccugguggaggacauggugucccaggaggaggcccagggccugccgagcuccgagcucgacgccgucgagaaccagcugaagugggccagcugggagcugcacucccuccggcacugcgacgacgacggccgcaccgagaacggggcgcuggcccccaagcaggagcugcccagcgcccucgagucccacgaggugcccggcacgcugaacaugggggugccgcagaucuucaaguacggcgagaccugcuuccccaaggggcgguucgagcgcaagcggaaccccagccgcaagaagcagcacaucugcgacgagugcggcaagcacuucucccagggcagcgcccugauccuccaccagcggauccacuccggggagaagcccuacggcugcgucgagugcgggaaggcguucagccgcagcuccauccuggugcagcaccagcgggugcacaccggcgagaagccguacaagugccuggagugcggcaaggccuucagccagaacuccgggcucaucaaccaccagcgcauccacaccggcgagaagcccuacgagugcguccagugcggcaagagcuacucccagagcuccaaccuguuccgccaccagcggcgccacaacgccgagaagcugcucaacguggugaaggucuga

SEQ ID NO: 39003 - RNA, 1500 nt, Artificial Sequence
  derived and/or modified sequence opt1 from ZNF253__Homo_sapiens__NP_066385
augggcccccugcaguuccgcgacguggccaucgaguucagccucgaggaguggcacugccuggacaccgcccagcggaaccuguaccgcgacgucaugcucgagaacuaccggaaccugguguuccuggggaucguggucuccaagcccgaccucgugaccugccuggagcagggcaagaagccccugacgauggagcgccacgagaugaucgcgaagccgcccgugaugagcucccacuucgcccaggaccucuggcccgagaacauccagaacagcuuccagaucgggaugcugcggcgcuacgaggagugccggcacgacaaccugcagcucaagaagggcugcaaguccgucggggagcacaaggugcacaagggcggcuacaacgggcugaaccagugccugaccaccacccagaaggagaucuuccagugcgacaaguacggcaagguguuccacaaguucagcaacuccaacacguacaagacccgccacaccgggaucaaccucuucaagugcaucaucugcggcaaggccuucaagcggagcuccacccugacgacccacaagaagauccacaccggggagaagcccuaccgcugcgaggagugcggcaaggccuucaaccagagcgccaaccugaccacgcacaagcggauccacaccggcgagaagcccuaccgcugcgaggagugcgggaaggcguucaagcaguccagcaaccucaccacccacaagaagauccacacgggcgagaagcccuacaagugcgaggagugcgggaaggccuucaaccgguccaccgaccugaccacccacaagaucguccacacgggcgagaagccguacaagugcgaggagugcggcaaggccuucaagcaccccagccacgugaccacccacaagaagauccacacccgcgggaagcccuacaacugcgaggagugcggcaaguccuucaagcacugcagcaaccugacgauccacaagcggauccacaccggggagaagcccuacaagugcgaggagugcggcaaggccuuccaccucuccagccaccugaccacccacaagauccugcacacgggggagaagccguaccgcugccgggagugcggcaaggcguucaaccacuccaccacccucuucagccacgagaagauccacaccggcgagaagcccuacaagugcgacgagugcgggaagacguucaccuggcccagcauccuguccaagcacaagcgcacccacaccggcgagaagcccuacaagugcgaggagugcggcaagagcuucacggccuccagcacccugaccacccacaagcggauccacaccggggagaagccguacaagugcgaggagugcgggaaggccuucaacugguccagcgaccucaacaagcacaagaagauccacaucgagcgcaagcccuacaucgugaagaacgucacggaccugcugaacgugccgccccuccugaucuccauccgguga

SEQ ID NO: 39004 - RNA, 1239 nt, Artificial Sequence
  derived and/or modified sequence opt1 from ZNF260__Homo_sapiens__NP_001012774
augaucggcaugcuggagagccuccagcacgagagcgaccugcugcagcacgaccagauccacaccggggagaagcccuacgagugcaacgagugccgcaagaccuucagccucaagcagaaccugguggagcacaagaagaugcacacgggcgagaagucccacgagugcaccgagugcgggaaggucugcagccggguguccagccugacccuccaccuccgcucccacaccggcaagaaggccuacaagugcaacaagugcgggaaggccuucagccagaaggagaacuuccugucccaccagaagcaccacacgggcgagaagccguacgagugcgagaaggugagcauccagaugcccaccaucauccggcaccagaagaaccacaccggcaccaagcccuacgcgugcaaggagugcgggaaggccuucaacggcaaggccuaccugacggagcacgagaagauccacaccggggagaagcccuucgagugcaaccagugcggccgcgccuucucccagaagcaguaccugaucaagcaccagaacauccacaccgggaagaagccguucaagugcagcgagugcggcaaggccuucucccagaaggagaaccugaucauccaccagcggauccacaccggcgagaagcccuacgagugcaaggggugcggcaaggcguucauccagaaguccagccucauccgccaccagcggagccacacgggggagaagcccuacacgugcaaggagugcggcaaggccuucuccggcaagagcaaccugaccgagcacgagaagauccacaucggggagaagcccuacaagugcaacgagugcggcaccaucuuccgccagaagcaguaccugaucaagcaccacaacauccacaccggggagaagccguacgagugcaacaagugcggcaaggccuucucccggaucaccagccucaucguccacgugcgcauccacaccggggacaagcccuacgagugcaaggugugcggcaaggccuucugccagagcuccagccugaccguccacaugcggucccacacgggcgagaagcccuacgggugcaacgagugcggcaaggcguucagccaguucuccacccuggcccuccacaugcgcauccacaccggggagaagcccuaccagugcagcgagugcggcaaggccuucucccagaagucccaccacauccggcaccagcgcauccacacccacuga

SEQ ID NO: 39005 - RNA, 2052 nt, Artificial Sequence
  derived and/or modified sequence opt1 from ZNF263__Homo_sapiens__NP_005732
auggccagcggccccgggucccaggagcgcgagggccugcucaucgugaagcuggaggaggacugcgccuggagccaggagcugccgccgcccgaccccgggcccucccccgaggcgagccaccuccgguuccgccgguuccgcuuccaggaggccgccggcccccgggaggcccugucccgccugcaggagcucugccacggguggcugcggcccgagaugcgcaccaaggagcagauccuggagcuccugguccuggagcaguuccucaccauccugccgcaggagauccagagccgggugcaggagcugcaccccgaguccggcgaggaggccgugacgcucgucgaggacaugcagcgcgagcugggccggcugcgccagcaggucaccaaccacgggcggggcaccgaggugcuccuggaggagccccugccccucgagaccgcgcgcgagagcccguccuucaagcuggagcccauggagacggagcggagccccgggccccgccugcaggagcuccugggcccgagcccccagcgggacccccaggccgugaaggagcgcgcccuguccgcccccuggcucucccuguucccgcccgaggggaacauggaggacaaggagaugaccggcccccagcugcccgagagccucgaggacguggcgauguacaucucccaggaggaguggggccaccaggacccgagcaagcgggcccugucccgcgacaccgugcaggagagcuacgagaacgucgacucccuggagagccacauccccagccaggaggugcccgggacccaggugggccagggcgggaagcucugggaccccuccguccagagcugcaaggagggccuguccccgcgggggcccgcccccggcgaggagaaguucgagaaccuggagggggugccgagcgugugcuccgagaacauccacccccagguccuccugcccgaccaggcccgcggcgaggugcccuggagcccggagcuggggcgcccccacgaccggucccagggcgacugggccccgccgcccgagggcgggauggagcaggcgcucgccggcgccagcuccgggcgcgagcugggccggcccaaggagcugcagcccaagaagcuccaccugugcccccugugcgggaagaacuucagcaacaacuccaaccucauccgccaccagcggauccacgccgccgagcgccugugcaugggcguggacugcacggagaucuucggcgggaacccccgguuccugagccuccaccgcgcgcaccugggcgaggaggcccacaagugccuggagugcgggaagugcuucucccagaacacccaccugacccggcaccagcgcacccacacgggcgagaagcccuaccagugcaacaucugcgggaagugcuucagcugcaacuccaaccuccaccggcaccagcgcacccacaccggcgagaagcccuacaagugccccgagugcggcgagaucuucgcccacagcuccaaccugcugcggcaccagcgcauccacaccggggagcggccguacaagugccccgagugcggcaagagcuucucccgcagcagccaccucgucauccacgagcggacgcacgagcgcgagcggcuguaccccuucuccgagugcggggaggccgugagcgacuccacccccuuccugaccaaccacggcgcccacaaggcggagaagaagcuguucgagugccugaccugcggcaagagcuuccgccaggggaugcaccugacgcgccaccagcggacccacaccggcgagaagccguacaagugcacccucugcggggagaacuucucccaccgcagcaaccugauccggcaccagcgcauccacacgggcgagaagcccuacacgugccacgagugcggggacuccuucagccacuccagcaaccggauccgccaccuccggacccacaccggcgagcgccccuacaagugcuccgagugcggcgagagcuucucccggagcucccgccucaugagccaccagcggacccacaccggguga

SEQ ID NO: 39006 - RNA, 1884 nt, Artificial Sequence
  derived and/or modified sequence opt1 from ZNF264__Homo_sapiens__NP_003408
auggccgccgcggugcugaccgaccgcgcccaggucagcgugaccuucgacgacguggccgucacguucaccaaggaggaguggggccagcucgaccuggcccagcggacccuguaccaggaggugaugcucgagaacugcgggcugcuggugucccucggcugccccgucccgaaggccgagcugaucugccaccuggagcacgggcaggagcccuggacccgcaaggaggaccucagccaggacacgugccccggcgacaaggggaagcccaagaccaccgagccgaccacgugcgagcccgcgcuguccgagggcaucagccugcagggccaggugacccaggggaacuccguggacagccagcucggccaggccgaggaccaggacgggcuguccgagaugcaggagggccacuuccggcccgggaucgacccccaggagaaguccccgggcaagaugagccccgagugcgacggccuggggaccgccgacggcgucugcagccgcaucgggcaggagcaggucucccccggcgaccgggugcgcagccacaacuccugcgagagcggcaaggaccccaugauccaggaggaggagaacaacuucaagugcuccgagugcgggaagguguucaacaagaagcaccuccuggccggccacgagaagauccacagcggggugaagccguacgagugcaccgagugcggcaagacguucaucaaguccacccaccuccugcagcaccacaugauccacaccggggagcggcccuacgagugcauggagugcggcaaggcguucaaccgcaagagcuaccugacccagcaccagcggauccacuccggcgagaagcccuacaagugcaacgagugcgggaaggccuucacgcaccgcagcaacuucgugcugcacaaccggcgccacaccggcgagaaguccuucgucugcaccgagugcggccagguguuccggcaccgccccggguuccuccggcacuacgugguccacagcggggagaacccguacgagugccuggagugcggcaagguguucaagcaccgcagcuaccugauguggcaccagcagacccacacgggcgagaagcccuacgagugcuccgagugcgggaagguguuccucgagagcgccgcccugauccaccacuacgucauccacaccggcgagaagcccuucgagugccuggagugcgggaaggccuucaaccaccgguccuaccucaagcgccaccagcggauccacaccggcgagaagcccuucgugugcagcgagugcgggaaggcguucacccacugcuccacguucauccugcacaagcgcgcccacaccggcgagaagccguucgagugcaaggagugcggcaaggccuucagcaaccggaaggaccugauccgccacuucuccauccacaccggggagaagcccuacgagugcguggagugcggcaaggccuucacccgcaugagcgggcucacgcggcacaagcgcauccacuccggcgagaagcccuacgagugcgucgagugcggcaagagcuucugcugguccaccaaccugauccggcacgccaucauccacaccggggagaagcccuacaagugcagcgagugcggcaaggcguucucccgcagcuccagccugacccagcaccagcggaugcacacggggaagaacccgaucuccgugaccgacgucggccgccccuucaccagcgggcagaccagcgugacgcuccgggagcugcugcucggcaaggacuuccugaacgugaccaccgaggccaacauccugcccgaggagaccuccagcuccgccagcgaccagcccuaccagcgcgagaccccgcaggucuccagccucuga

SEQ ID NO: 39007 - RNA, 1650 nt, Artificial Sequence
  derived and/or modified sequence opt1 from ZNF266__Homo_sapiens__NP_006622
augcuggagaacuacaagaaccucgccaccgugggcuaccagcuguucaagcccagccugaucuccuggcucgagcaggaggagagccgcaccguccagcgcggggacuuccaggccuccgaguggaaggugcagcugaagacgaaggagcuggcgcuccagcaggacgugcugggcgagccgaccagcuccgggauccagaugaucggcagccacaacgggggcgaggucuccgacgugaagcagugcggcgacgugagcuccgagcacagcugccugaagacccacguccggacccagaacuccgagaacacguucgagugcuaccucuacgggguggacuuccugacccugcacaagaagaccagcaccggcgagcagcgguccguguucagccagugcgggaaggccuucucccucaaccccgacgucgugugccagcgcacgugcaccggcgagaaggccuucgacugcagcgacuccggcaagagcuucaucaaccacucccaccuccaggggcaccuccggacccacaacggcgagagccugcacgaguggaaggagugcgggcgcggcuucauccacagcaccgaccuggccgugcggauccagacgcaccgcuccgagaagcccuacaagugcaaggagugcgggaagggcuuccgguacagcgccuaccugaacauccacaugggcacccacaccggggacaaccccuacgagugcaaggagugcggcaaggcguucacccgcuccugccagcugacgcagcaccggaagacccacaccggggagaagccguacaagugcaaggacugcggccgcgccuucaccgucagcuccugccugagccagcacaugaagauccacgugggggagaagcccuacgagugcaaggagugcggcaucgccuucacgcgguccagccagcugaccgagcaccucaagacccacaccgccaaggaccccuucgagugcaagaucugcggcaaguccuuccgcaacagcuccugccugagcgaccacuuccggauccacacggggaucaagcccuacaagugcaaggacugcggcaaggcguucacccagaacuccgaccugaccaagcacgcccgcacccacagcggggagcggccguacgagugcaaggagugcggcaaggccuucgcccgcuccagccggcucuccgagcacacgcgcacccacaccggggagaagcccuucgagugcgugaagugcggcaaggccuucgcgaucagcuccaaccugagcggccaccuccggauccacaccggggagaagcccuucgagugccuggagugcggcaaggccuucacgcacagcuccagccugaacaaccacaugcgcacccacuccgccaagaagcccuucacgugcauggagugcgggaaggccuucaaguucccgaccugcgucaaccugcacaugcgcauccacaccggcgagaagcccuacaagugcaagcagugcggcaagagcuucuccuacagcaacuccuuccagcuccacgagcggacccacaccggggagaagcccuacgagugcaaggagugcggcaaggccuucagcuccagcuccagcuuccgcaaccacgagcggcgccacgcggacgagcggcuguccgccuga

SEQ ID NO: 39008 - RNA, 2136 nt, Artificial Sequence
  derived and/or modified sequence opt1 from ZNF267__Homo_sapiens__NP_001252517
augcuggagaacuaccgcaaccucgugagccugggccuggucguguccaagcccgaccucaucaccuuccuggagcagcggaaggagccguggaacgucaagagcgaggagaccguggccauccagcccgacguguucucccacuacaacaaggaccugcucacggagcacugcaccgaggccagcuuccagaaggugaucucccgccggcacgggagcugcgaccuggagaaccugcaccuccgcaagcgguggaagcgcgaggagugcgagggccacaacgggugcuacgacgagaagaccuucaaguacgaccaguucgacgaguccagcgucgagucccuguuccaccagcagauccugagcuccugcgccaagagcuacaacuucgaccaguaccggaagguguucacccacuccagccuccugaaccagcaggaggagaucgacaucuggggcaagcaccacaucuacgacaagacguccgugcuguuccgccaggucagcacccucaacuccuaccggaacguguucaucggggagaagaacuaccacugcaacaacagcgagaagacccugaaccaguccagcagccccaagaaccaccaggagaacuacuuccuggagaagcaguacaagugcaaggaguucgaggagguguuccuccaguccaugcacggccaggagaagcaggagcagagcuacaagugcaacaagugcgucgaggugugcacccagucccugaagcacauccagcaccagacgauccacauccgcgagaacagcuacuccuacaacaaguacgacaaggaccugagccaguccagcaaccuccggaagcagaucauccacaacgaggagaagcccuacaagugcgagaagugcggcgacucccugaaccacagccugcaccucacccagcaccagaucaucccgaccgaggagaagcccuacaaguggaaggagugcgggaagguguucaaccugaacugcucccuguaccucaccaagcagcagcagaucgacacgggcgagaaccuguacaagugcaaggcgugcagcaaguccuucacccgcagcuccaaccugaucguccaccagcggauccacaccggggagaagcccuacaagugcaaggagugcggcaaggccuuccgcugcagcuccuaccucaccaagcacaagcggauccacacgggggagaagcccuacaagugcaaggagugcggcaaggccuucaaccgcagcuccugccugacccagcaccagaccacccacacgggcgagaagcuguacaagugcaaggugugcagcaagagcuacgcccgguccagcaaccucaucaugcaccagcgcgugcacaccggggagaagccguacaagugcaaggagugcggcaaggucuucucccggagcuccugccugacccagcaccgcaagauccacaccggggagaaccuguacaagugcaaggugugcgcgaagcccuucacgugcuucagcaaccucaucgugcacgagcggauccacaccggcgagaagcccuacaagugcaaggagugcggcaaggccuuccccuacuccagccaccugauccgccaccaccgcauccacaccggggagaagccguacaagugcaaggccugcuccaagagcuucuccgacagcuccggccugaccguccaccggcgcacgcacaccggggagaagcccuacacgugcaaggagugcggcaaggccuucagcuacuccagcgacgugauccagcaccggcgcauccacaccgggcagcggcccuacaagugcgaggagugcggcaaggcguucaacuaccgcuccuaccucaccacccaccagcggagccacaccggcgagcgccccuacaagugcgaggagugcgggaaggccuucaacagccgguccuaccugaccacgcaccgccggcgccacaccggcgagcggccguacaagugcgacgagugcgggaaggccuucagcuaccgcuccuaccugaccacccaccggcgcagccacuccggcgagcggcccuacaagugcgaggagugcgggaaggccuucaacagccgcuccuaccucaucgcccaccagcggagccacacccgcgagaagcuguga

SEQ ID NO: 39009 - RNA, 2844 nt, Artificial Sequence
  derived and/or modified sequence opt1 from ZNF268__Homo_sapiens__NP_001159353
auggccacccgcgugcggaccgccagcaucugggugcccccgcugcaggagcgcaacuccagcugggaccggauccgcaagcuccagggccaggaguccauccuggggcagggcacgcccgggcugcagccccuccccggcaccccgcggcagaagcagaagucccgccggaucgagaagguccuggaguggcuguucaucagccaggagcagcccaagaucaccaagagcugggggccccucuccuucauggacguguucgucgacuucaccugggaggaguggcagcugcuggaccccgcgcagaagugccucuaccgcagcgugaugcuggagaacuacuccaaccuggugagccucggcuaccagcacacgaagccggacaucaucuucaagcuggagcagggcgaggagcugugcaugguccaggcccaggugcccaaccagaccugccccaacaccguguggaagaucgacgaccucauggacuggcaccaggagaacaaggacaagcugggguccaccgccaagagcuucgagugcacgaccuucggcaagcugugccuccuguccaccaaguaccugagccggcagaagccccacaagugcgggacccacggcaagucccucaaguacaucgacuucacgagcgacuacgcccgcaacaacccgaacggguuccagguccacggcaaguccuucuuccacagcaagcacgagcagaccgugaucggcaucaaguacugcgaguccaucgagagcgggaagaccgugaacaagaagucccagcugaugugccagcagauguacaugggcgagaagcccuucgggugcagcugcugcgagaaggccuucagcuccaagagcuaccugcucguccaccagcagacccacgcggaggagaagcccuacggcugcaacgagugcggcaaggacuucuccagcaaguccuaccugaucgugcaccagcggauccacacgggggagaagcugcacgagugcagcgagugccgcaagaccuucuccuuccacagccagcucgugauccaccagcggauccacaccggcgagaaccccuacgagugcugcgagugcgggaaggucuucucccgcaaggaccagcuggugagccaccagaagacccacuccggccagaagccguacgugugcaacgagugcgggaaggccuucggccucaagagccagcugaucauccacgagcggauccacacgggcgagaagcccuacgagugcaacgagugccagaaggccuucaacaccaaguccaaccugaugguccaccagcgcacccacaccggggagaagcccuacgugugcagcgacugcggcaaggccuucacguucaagucccagcugaucgugcaccaggggauccacaccggcgucaagcccuacgggugcauccagugcggcaagggcuucagccucaagucccagcugaucgugcaccagcggagccacaccgggaugaagccguacgugugcaacgagugcggcaaggcguuccgcagcaaguccuaccugaucauccacacccggacgcacaccggggagaagcuccacgagugcaacaacugcggcaaggccuucagcuucaagucccagcugaucauccaccagcgcauccacaccggggagaaccccuacgagugccacgagugcggcaaggccuucagccggaaguaccagcugaucucccaccagcgcacccacgccggcgagaagcccuacgagugcacggacugcgggaaggccuucggccucaagagccagcugaucauccaccagcgcacccacaccggggagaagcccuucgagugcuccgagugccagaaggcguucaacaccaagagcaaccugaucguccaccagcggacgcacaccggcgagaagccguacuccugcaacgagugcggcaaggccuucaccuucaagagccagcucaucgugcacaaggggguccacaccggcgugaagcccuacgggugcucccagugcgccaagaccuucagccugaagucccagcugaucgugcaccagcgcagccacacgggcgucaagcccuacgggugcuccgagugcggcaaggccuuccggagcaaguccuaccucaucauccacaugcgcacccacaccggcgagaagccccacgagugccgggagugcggcaagagcuucagcuucaacucccagcugaucgugcaccagcgcauccacaccggggagaacccguacgagugcagcgagugcgggaaggccuucaaccggaaggaccagcugaucucccaccagcgcacgcacgcgggcgagaagcccuacgggugcagcgagugcggcaaggccuucuccagcaaguccuaccucaucauccacaugcggacccacagcggcgagaagcccuacgagugcaacgagugcgggaaggccuucaucuggaagucccugcugaucgugcacgagcgcacccacgccggcgucaacccguacaagugcagccagugcgagaaguccuucagcgggaagcugcggcuccuggugcaccagcgcaugcacacccgggagaagcccuacgagugcuccgagugcggcaaggccuucauccgcaacagccagcugaucgugcaccagcggacgcacuccggggagaagcccuacggcugcaacgagugcggcaagaccuucagccagaaguccauccucagcgcgcaccagcgcacccacaccggggagaagcccugcaagugcacggagugcggcaaggccuucugcuggaagucccagcugaucaugcaccagcggacccacgucgacgacaagcacuga

SEQ ID NO: 39010 - RNA, 1710 nt, Artificial Sequence
  derived and/or modified sequence opt1 from ZNF273__Homo_sapiens__NP_066971
augagcagcgcgccccgcggcccgcccagcguggcgccccugcccgccgggaucggccgguccaccgccaagaccccggggcuccccggcagccuggagauggggccccugacguuccgcgacgucgccaucgaguucucccucgaggaguggcagugccuggacaccagccagcagaaccuguaccggaacgugaugcucgacaacuaccgcaaccugguguuccugggcaucgccgucuccaagcccgaccucaucacgugccuggagcagggcaaggagccgugcaacaugaagcggcacgccaugguggccaagccgcccguggucugcagccacuucgcccaggaccuguggcccaagcaggggcucaaggacuccuuccagaaggugauccugcgccgguacggcaaguacgggcacgagaaccugcagcuccgcaagggcugcaagagcgccgacgagcacaaggugcacaagcggggguacaacggccugaaccagugccugaccaccacccaguccaagaucuuccagugcgacaaguacgucaaggugcuccacaaguucagcaacuccaacauccacaagaagcgccagaccggcaagaagcccuucaagugcaaggagugcggcaagagcugcugcauccugucccagcugacccagcacaagaagacggccacccgggugaacuucuacaagugcaagaccugcgggaaggcguucaaccaguucagcaaccucaccaagcacaagaucauccaccccgaggucaaccccuacaagugcgaggagugcgggaaggccuucaaccagucccugacgcugaccaagcacaagaagauccacaccgaggagaagcccuacaagugcgaggacugcggcaagguguucagcguguucuccguccucaccaagcacaagaucauccacacgggcaccaagccguacaacugcgaggagugcgggaagggcuucagcaucuucagcacccugaccaagcacaagaucauccacacgggggagaagcccuacaagugcaacgagugcggcaaggccuucaacugguccagcacccugaccaagcacaagcgcauccacaccggggagaagcccuacaagugcgaggagugcggcaaggccuucaaccaguccagcacgcucacccggcacaagaucgugcacaccggcgagaagcccuacaagugcgaggagugcgggaaggccuucaagcgcuccaccacgcugaccaagcacaagcggaucuacaccaaggagaagccguacaagugcgaggagugcggcaaggcguucagcguguucuccacccugacgaagcacaagaucauccacaccggggccaagcccuacaagugcgaggagugcggcagcgccuuccgcgccuucuccacccucaccgagcacaagcggguccacacgggggagaagcccuacaagugcaacgagugcggcaaggccuucaacuggagcuccacccugaccaagcacaagcgcauccacaccggcgagaagcccuacaagugcgaggagugcgggaaggcguucaaccggagcuccaaccugacccgccacaagaagauccacacgggcgagaagccguacaagcccaagcggugcgacagcgccuucgacaacacccccaacuucucccgccacaagcgcaaccacaugggggagaaguccuga

SEQ ID NO: 39011 - RNA, 1866 nt, Artificial Sequence
  derived and/or modified sequence opt1 from ZNF274__Homo_sapiens__NP_057409
auggccagccgccugcccaccgccugguccugcgagccggugaccuucgaggacgucacgcucggcuucacccccgaggagugggggcugcuggaccucaagcagaagucccuguaccgggaggugaugcuggagaacuaccgcaaccucgugagcgucgaguaccccgagcugcagcuggaccccaagcucgacccgcugcccgcggagagcccccugaugaacaucgaggugguggagguccucacccugaaccaggagguggccggcccccggaacgcccagauccaggcccuguacgccgaggacgggucccucagcgcggacgccccguccgagcagguccagcagcagggcaagcaccccggggaccccgaggccgcccgccagcgguuccgccaguuccgguacaaggacaugaccggcccccgcgaggcgcuggaccagcugcgggagcucugccaccaguggcugcagccgaaggcccgcagcaaggagcagauccuggagcuccuggugcuggagcaguuccucggcgcccugcccgugaagcugcggacguggguggagucccagcaccccgagaacugccaggaggucguggcccucguggagggggucaccuggaugagcgaggaggaggugcugcccgccggccagccggcggaggggacgaccugcugccuggaggugaccgcccagcaggaggagaagcaggaggacgccgccaucugccccgucaccgugcuccccgaggagcccgugaccuuccaggacgucgccguggacuucucccgcgaggaguggggccugcuggggccgacccagcggacggaguaccgcgacgugaugcucgagaccuucggccaccuggucagcgugggcugggagaccacccuggagaacaaggagcucgcgcccaacuccgacauccccgaggaggagcccgccccgagccugaagguccaggaguccagccgggacugcgcccuguccagcacgcucgaggacacccugcagggcggggugcaggaggugcaggacaccguccugaagcagauggaguccgcccaggagaaggaccucccccagaagaagcacuucgacaaccgcgagagccaggccaacagcggggcgcuggacaccaaccaggugucccugcagaagaucgacaaccccgagagccaggccaacuccggcgcccucgacacgaaccaggugcugcugcacaagaucccgccccggaagcgccuccggaagcgcgacagccaggucaaguccaugaagcacaacagccgggugaagauccaccagaaguccugcgagcgccagaaggccaaggagggcaacgggugccgcaagaccuucagccgguccaccaagcagaucaccuucauccgcauccacaagggcagccaggugugccggugcuccgagugcgggaagaucuuccgcaacccccgguacuucagcguccacaagaagauccacacgggcgagcgccccuacgugugccaggacugcgggaagggcuucgugcaguccagcucccugacccagcaccagcggguccacagcggcgagcgcccguucgagugccaggagugcgggcggaccuucaacgaccgcuccgccaucagccagcaccuccggacccacacgggcgcgaagcccuacaagugccaggacugcgggaaggccuuccgccaguccagccaccugauccggcaccagcgcacccacaccggcgagcggcccuacgccugcaacaagugcgggaaggccuucacccagagcucccaccugaucggccaccagcgcacgcacaaccggaccaagcgcaagaagaagcagcccaccagcuga

SEQ ID NO: 39012 - RNA, 1845 nt, Artificial Sequence
  derived and/or modified sequence opt1 from ZNF276__Homo_sapiens__NP_001106997
augaagcgcgaccggcugggccgcuuccucagccccggguccagccggcagugcggcgccuccgacgggggcgggggcgugagccgcacccggggccgccccucccugagcgggggcccccgggucgacggggccaccgcgcgccgggccuggggccccgugggguccugcggcgacgccggcgaggacggggccgacgaggccggcgcggggcgcgcccuggccaugggccacugccggcucugccacggcaaguucagcucccgcagccugcgguccaucagcgagcgcgcccccggggcguccauggagcggccgagcgccgaggagcgcgugcugguccgggacuuccagcgccuccugggcguggccgugcggcaggaccccacgcugucccccuucgucugcaagagcugccacgcccaguucuaccagugccacucccuccucaagagcuuccugcagcgcgugaacgccucccccgcggggcggcgcaagccgugcgccaaggugggcgcccagccgcccaccggggccgaggagggcgccugccuggucgaccugaucaccagcagcccccagugccugcacggccucguggggugggugcacggccacgcggccuccugcggggcccugccccaccuccagcgcacccugagcuccgaguacugcggcgucauccagguggugugggggugcgaccagggccacgacuacacgauggacaccagcuccagcugcaaggccuuccugcuggacuccgcccucgcggucaaguggcccugggacaaggagaccgcgccccggcugccccagcaccgcggcuggaacccgggggacgcgccccagaccagccagggccgggggacgggcacccccgugggggccgagaccaagacccugcccuccacggacguggcccagccgcccagcgacuccgacgccgucggcccccgcagcggcuucccgccccagcccucccucccccugugccgggcccccgggcagcugggcgagaagcagcucccgagcuccaccagcgacgaccgcgugaaggacgaguucuccgaccugagcgagggggacgugcuguccgaggacgagaacgacaagaagcagaacgcccagagcagcgacgaguccuucgagcccuaccccgagcggaaggucagcggcaagaaguccgagagcaaggaggccaagaaguccgaggagccgcgcauccggaagaagcccggccccaagcccggguggaagaagaagcuccgcugcgagcgggaggagcugccgaccaucuacaagugccccuaccagggcugcaccgccguguaccgcggggccgacggcaugaagaagcacaucaaggagcaccacgaggaggugcgggagcgccccugcccccacccggggugcaacaaggucuucaugaucgaccgguaccugcagcgccacgugaagcucauccacacggagguccggaacuacaucugcgacgagugcggccagaccuucaagcagcgcaagcaccuccuggugcaccagaugcggcacagcggcgccaagccccugcagugcgaggugugcggguuccagugccgccagcgcgccucccugaaguaccacaugaccaagcacaaggccgagaccgagcuggacuucgcgugcgaccagugcggccggcgcuucgagaaggcccacaaccucaacguccacaugagcauggugcacccccugacgcagacccaggacaaggcccugccccucgaggccgagccgccgcccgggccgcccucccccagcgugaccaccgagggccaggccgucaagcccgagcccacguga

SEQ ID NO: 39013 - RNA, 1353 nt, Artificial Sequence
  derived and/or modified sequence opt1 from ZNF277__Homo_sapiens__NP_068834
auggccgccagcaagacccagggcgcgguggcccgcaugcaggaggaccgggacggguccugcagcaccgucggcggggugggcuacggggacuccaaggacugcauccuggagccccucagccugccggagucccccggcggcacgaccacccuggaggggagccccuccgugcccugcaucuucugcgaggagcacuucccggucgccgagcaggacaagcuccugaagcacaugaucaucgagcacaagaucgugaucgccgacgugaagcuggucgccgacuuccagcgcuacauccucuacuggcggaagcgcuucaccgagcagcccaucacggacuucugcagcgugauccggaucaacuccaccgcgcccuucgaggagcaggagaacuacuuccugcugugcgacgugcuccccgaggaccgcauccugcgggaggagcugcagaagcagcgccuccgggagauccuggagcagcagcagcaggagcgcaacgacaccaacuuccacggcgucugcauguucugcaacgaggaguuccuggggaaccggagcgugauccucaaccacauggcccgcgagcacgccuucaacaucggccugccggacaacaucgugaacugcaacgaguuccugugcacccuccagaagaagcuggacaaccugcagugccucuacugcgagaagacguuccgggacaagaacacccugaaggaccacaugcgcaagaagcagcaccggaagaucaaccccaagaaccgcgaguacgaccgguucuacgucaucaacuaccuggagcucgggaaguccugggaggaggugcagcuggaggacgaccgcgagcugcucgaccaccaggaggacgacuggagcgacugggaggagcaccccgccuccgcggugugccuguucugcgagaagcaggccgagaccaucgagaagcuguacguccacauggaggacgcccacgaguucgaccuccugaagaucaagagcgagcugggccucaacuucuaccagcaggucaagcuggugaacuucauccggcgccaggugcaccagugccggugcuacggcugccacgugaaguucaaguccaaggccgaccugcgcacccacauggaggagacgaagcacaccagccuccugcccgaccgcaagaccugggaccagcuggaguacuacuucccgaccuacgagaacgacacgcuccugugcacccuguccgacagcgaguccgaccucaccgcccaggagcagaacgagaacgugcccaucaucagcgaggacaccagcaagcuguacgcgcugaagcaguccagcauccucaaccagcugcugcucuga

SEQ ID NO: 39014 - RNA, 1632 nt, Artificial Sequence
  derived and/or modified sequence opt1 from ZNF280B__Homo_sapiens__XP_011545198
auggagcagagcugcgaggaggagaaggagcccgagccgcagaagaacauccaggagaccaagcaggucgacgacgaggacgccgagcugaucuucgugggcguggagcacgugaacgaggacgccgagcucaucuucgucggggugaccuccaacagcaagcccguggucuccaacauccugaaccgcgugacgcccggcagcuggucccggcgcaagaaguacgaccaccuccggaaggacaccgcgcgcaagcugcagcccaagagccacgagaccgugaccuccgaggccgucacggugcugccggccagccagcuggagucccggagcaccgacucccccaucaucaucgagccccucagcaagcccgacuaccgcaacuccagcccccaggugguccccaacaacuccagcgagcugcccagcccccugaucaccuucaccgacagccuccaccacccgguguccacggcccugagcgucgggggcaucaacgagagcccccggguguccaagcagcugagcaccuucgaggugaacuccaucaaccccaagcgcgccaagcuccgggacgggaucaucgagggcaacagcuccgcgagcuuccccuccgacaccuuccacaccaugaacacgcagcagagcaccccguccaacaacgugcacaccagccugucccacguccagaacggcgcccccuuccccgccgccuuccccaaggacaacauccacuucaagccgaucaacaccaaccuggaccgcgcgaacgagcucgccaagacggacauccugagccugaccucccagaacaagaccuucgaccccaagaaggagaaccccaucgugcuccugagcgacuucuacuacgggcagcacaagggcgaggggcagcccgagcagaagacccacacgaccuucaagugccuguccugcgugaagguccucaagaacgugaaguucaugaaccacgugaagcaccaccuggaguucgagaagcagcggaacgacagcugggagaaccacacgaccugccagcacugccaccgccaguucccgacccccuuccagcugcagugccacaucgagaacguccacaccgcccaggagcccuccaccgugugcaagaucugcgagcucagcuucgagaccgaccagguccugcugcagcacaugaaggaccaccacaagcccggcgagaugccguacgugugccaggugugccacuaccgguccagcgucuucgccgacguggagacgcacuuccggaccugccacgagaacaccaagaaccuccugugccccuucugccugaagaucuucaagaccgccacgcccuacaugugccacuaccgcgggcacuggggcaagagcgcgcaccagugcuccaagugccgccuccaguuccugaccuucaaggagaagauggagcacaagacccagugccaccagauguucaagaagccgaagcagcuggagggccucccgcccgagaccaaggugacgauccaggucagccuggagccccugcagccgggguccguggacguggccagcaucaccgucuccaccagcgacuccgagcccagccucccccgguccaagagcaagaucuccaagaagucccacuga

SEQ ID NO: 39015 - RNA, 2901 nt, Artificial Sequence
  derived and/or modified sequence opt1 from ZNF280D__Homo_sapiens__NP_001002843
auggccgagcuguucauggagugcgaggaggaggagcucgagcccuggcagaagaaggugaaggaggucgaggacgacgacgacgacgagccgaucuucgugggcgagaucagcuccagcaagcccgccaucuccaacauccugaaccgcgugaaccccagcuccuacagccgggggcugaagaacggcgcgcucucccgcgggaucaccgccgccuucaagcccaccagccagcacuacacgaacccgaccuccaaccccguccccgccagccccaucaacuuccacccggagucccggagcuccgacagcuccgugaucgugcagcccuucagcaagcccggcuacaucaccaacuccagccgcgucguguccaacaagagcagcgagcugcuguucgaccucacccaggacacggggcugucccacuaccagggcggccccacccugagcauggccgggauguccgagagcuccuuccucagcaagcggccguccaccagcgaggugaacaacgucaaccccaagaagcccaagcccuccgagagcguguccggcgcgaacagcuccgccgugcugccgagcgucaagucccccagcgugaccuccagccaggccaugcuggccaaggggacgaacaccuccagcaaccagagcaagaacggcacccccuucccccgcgcgugcccgaagugcaacauccacuucaaccuccuggacccccugaagaaccacaugaaguacugcugccccgacaugaucaacaacuuccucgggcuggccaagaccgaguucuccagcacggugaacaagaacaccaccaucgacuccgagaagggcaagcugaucaugcucgucaacgacuucuacuacggcaagcacgagggggacgugcaggaggagcagaagacccacacgaccuucaagugcuucagcugccugaagauccugaagaacaacauccgguucaugaaccacaugaagcaccaccucgagcuggagaagcaguccagcgaguccugggagaaccacacgaccugccagcacugcuaccgccaguuccccaccccguuccagcugcagugccacaucgagagcacccacacgccccacgaguucuccaccaucugcaagaucugcgagcucagcuucgagaccgagcacgugcugcugcagcacaugaaggacaaccacaagcccggcgagaugcccuacgucugccaggugugcaacuaccgguccagcuccuucagcgacguggagacccacuuccgcaccucccacgagaacaccaagaaccuccugugcccguucugccugaaggucaucaagaucgccacgcccuacaugcaccacuacaugaagcaccagaagaaggggauccaccggugcaccaagugccgccuccaguuccugaccugcaaggagaagauggaccacaagacccagcaccaccggacguucaucaagcccaagcagcuggagggccucccgcccggcaccaaggugaccauccgcgccagcguggggccccugcaguccggcgccagccccaccccgagcaucuccgcgagcgccuccacgcugcagcucagcccgccccggaccaagaacaucaccgccaagaaccccgccaaguccaacaccagcaagcccaacaccgucaaguccaacgccagcaagcccaacacguccaagcccaacgggagcaaguccaaguacaagcccaagaucagcaacaugcagaagaagcaguccacccuggcgagcuccaacaagaaguccaaggugaacaccgcccugcgcaaccuccgguaccgccggggcauccacaagugcaucgagugcugcagcgagaucaaggacuucgccaaccacuucccgaccuacguccacugcagcuucugccgcuacaacacguccugcagcaaggccuacgugaaccacaugaugagcuuccacuccaaccggcccagcaagcgcuucugcaucuucaagaagcacuccgagaaccugcgcgggaucacccuggugugccucaacugcgacuuccugagcgacgucuccggccuggacaacauggccacccaccucagccagcacaagacccacacgugccagguggugaugcagaaggucuccgugugcauccccaccagcgagcaccuguccgagcugaagaaggaggcgcccgccaaggagcaggagccggugagcaaggagaucgcccggcccaacauggccgagcgcgagaccgagaccuccaacagcgaguccaagcaggacaaggccgcgagcuccaaggagaagaacggcugcaacgccaacagcuucgagggguccagcacgaccaaguccgaggagagcaucaccgucagcgacaaggagaacgagaccugccucgccgaccaggagacgggcuccaagaacaucgugagcugcgacuccaacaucggggccgacaagguggagaagaagaagcagauccagcacgucugccaggagauggagcugaagaugugccagagcuccgagaacaucauccugagcgaccagaucaaggaccacaacuccagcgaggcgcgguucuccagcaagaacaucaaggaccugcgccucgccuccgacaacgugagcaucgaccaguuccugcggaagcgccacgagcccgaguccgugagcuccgacgucagcgagcagggcuccauccaccuggagccccucaccccgagcgaggugcuggaguacgaggccaccgagauccugcagaagggguccggcgaccccagcgccaagaccgacgagguggucagcgaccagacggacgacauccccggcgggaacaaccccuccaccaccgaggccaccguggaccucgaggacgagaaggagcggagcuga

SEQ ID NO: 39016 - RNA, 2688 nt, Artificial Sequence
  derived and/or modified sequence opt1 from ZNF281__Homo_sapiens__NP_001268222
augaagaucggcagcggguuccuguccggcgggggcgggaccggcagcuccggcgggagcggcuccgggggcgggggcagcggcgggggcgggggcggcggguccagcggccgccgggccgagauggagcccaccuucccgcaggggauggugauguucaaccaccgccucccgcccgucacguccuucacccggcccgccggcagcgcggccccgccgccccagugcgugcuguccagcuccaccagcgccgcccccgccgcggagcccccgcccccgcccgcccccgacaugaccuucaagaaggagcccgccgccuccgcggccgccuuccccagccagcgcacguccuggggguuccugcagagccucguguccaucaagcaggagaagcccgccgaccccgaggagcagcagagccaccaccaccaccaccaccaccacuacggcggccuguucgccggggcggaggagcggagccccggccucgggggcggggagggcggcucccacggggucauccaggaccugagcauccugcaccagcacgugcagcagcagcccgcccagcaccaccgcgacgugcugcucuccagcuccagccggaccgacgaccaccacggcaccgaggagcccaagcaggacaccaacgucaagaaggccaagcgccccaagcccgagucccaggggaucaaggccaagcggaagcccagcgccuccagcaagccgucccuggugggcgacggggagggcgcgauccugagccccucccagaagccccacaucugcgaccacugcagcgccgccuuccgcuccagcuaccaccuccggcgccacgugcugauccacacgggcgagcggcccuuccagugcucccagugcagcaugggguucauccagaaguaccugcuccagcgccacgagaagauccacucccgggagaagccguucggcugcgaccagugcagcaugaaguucauccagaaguaccacauggagcgccacaagcggacccacagcggggagaagcccuacaagugcgacacgugccagcaguacuucucccgcaccgaccggcugcugaagcaccgccggaccugcggcgaggucaucgugaagggcgccaccagcgccgagcccggguccagcaaccacaccaacaugggcaaccucgcggugcugucccaggggaacaccagcuccagccgccgcaagacgaaguccaagagcaucgccaucgagaacaaggagcagaagaccggcaagaccaacgagucccagaucagcaacaacaucaacaugcaguccuacagcgucgagaugccgaccguguccagcuccgggggcaucaucggcacggggaucgacgagcugcagaagcgggugcccaagcucaucuucaagaagggcagccgcaagaacaccgacaagaacuaccugaacuucgucagcccccugcccgacaucguggggcagaagucccucagcggcaagccguccgggagccugggcaucguguccaacaacagcgucgagaccaucggccugcuccaguccaccagcgggaagcagggccagaucuccagcaacuacgacgacgccaugcaguucuccaagaagcggcgcuaccugcccacggccagcuccaacagcgccuucuccaucaacguggggcacauggugagccagcaguccgucauccagagcgcgggcguguccgugcuggacaacgaggcgccccucagccugaucgacagcuccgcccugaacgccgagaucaagagcugccacgacaaguccgggauccccgacgagguccuccagagcauccuggaccaguacuccaacaagagcgagucccagaaggaggacccguucaacaucgccgagccccggguggaccugcacaccagcggcgagcacuccgagcucguccaggaggagaaccugagccccggcacccagacccccuccaacgacaaggccagcaugcugcaggaguacuccaaguaccuccagcaggccuucgagaaguccacgaacgccagcuucacccuggggcacggcuuccaguucgugagccuguccagcccgcuccacaaccacacccuguuccccgagaagcagaucuacaccacgagcccccuggagugcggguucggccaguccgugaccagcguccuccccuccagccugccgaagccgcccuucgggaugcuguucggcucccagcccggccucuaccugagcgcccuggacgcgacccaccagcagcugacccccucccaggagcucgacgaccugaucgacagccagaagaaccuggagacguccagcgccuuccaguccagcucccagaagcucaccagccagaaggagcagaagaaccuggaguccagcaccggguuccagauccccucccaggagcuggccagccagaucgacccccagaaggacaucgagccccgcaccaccuaccagaucgagaacuucgcccaggccuucggcucccaguucaagagcgggucccgggugccgaugacguucaucaccaacagcaacggcgagguggaccaccgcguccggaccagcguguccgacuucagcggcuacaccaacaugauguccgacgugagcgagcccugcuccacgcgcgucaagacccccaccagccaguccuaccgguga

SEQ ID NO: 39017 - RNA, 1392 nt, Artificial Sequence
  derived and/or modified sequence opt1 from ZNF282__Homo_sapiens__NP_001290410
augcaguucgugagcacccgcccccagccccagcagcugggcauccaggggcucggccuggacuccgggagcugguccugggcccaggcccugccgcccgaggaggucugccaccaggagcccgcgcuccggggcgagauggccgaggggaugccgcccaugcaggcccaggagugggacauggacgcccgccggcccaugcccuuccaguucccgcccuuccccgaccgcgcccccguguuccccgaccggaugaugcgcgagccccagcugcccaccgcggagaucagccuguggacgguggucgccgccauccaggccguggagcggaagguggacgcgcaggccucccagcuccugaaccuggagggccgcaccggcaccgccgagaagaagcucgccgacugcgagaagaccgccgucgaguucgggaaccacauggagagcaagugggcggugcugggcacgcugcuccaggaguacgggcugcugcagcggcgccucgagaaccuggagaaccugcuccggaaccgcaacuucugggugcugcggcugcccccgggcuccaagggggaggcccccaagguccccgugaccuucguggacaucgccgucuacuucagcgaggacgaguggaagaaccucgacgaguggcagaaggagcuguacaacaaccuggugaaggagaacuacaagacccucaugucccuggacgccgagggcagcgugcccaagccggacgcccccguccaggcggagccccgcgaggagcccugcgugugggagcagcggcacccggaggagcgcgagauccccauggaccccgaggccggcgccgagccccuggugccggcccaggacgccuccagccaggucaagcgggaggacacccucugcgugcgcgggcagcggggccuggaggagcgcgcgauccccacggaguccaucaccgacagccccaucuccgcccaggaccugcucagccggaucaagcaggaggagcaccagugcgugugggaccagcaggaccuggccgaccgcgacaucccgaccgaccccaacuccgagagccugaucuccgcccacgacauccucagcuggaucaagcaggaggagcagcccuaccccugggggccgcgcgacagcauggacggcgagcugggccuggacuccgggcccagcgacucccuccugauggucaagaacccgccgcccgccccgccccagccccagccccagccccagccgccccagccccagcugcagagccagccccagccccagucccugccgcccaucgcgguggccgagaaccccggcgggccgcccagccggggccuccuggacgacggguuccagccccaccagggcgccgcccuccgcgugcgguga

SEQ ID NO: 39018 - RNA, 1569 nt, Artificial Sequence
  derived and/or modified sequence opt1 from ZNF286B__Homo_sapiens__NP_001138517
auggagaccgaccuggccgagaugcccgagaagggcgugcucagcucccaggacagcccgcacuuccaggagaaguccaccgaggagggggaggucgccgcgcugcgccugacggcccggagccaggccgccgccgcggccgccgcccccggcucccgcagccuccgcggggugcacgugccgccgccccugcaccccgcgcccgcccgggaggagaucaaguccacgugcagccugaaggccugcuucucccucagccugacccugaccuacuaccggaccgccuuccuccuguccaccgagaacgagggcaaccugcacuuccagugccccagcgacgucgagacccgcccccaguccaaggacagcaccuccgugcaggacuucagcaaggccgaguccugcaagguggcgaucaucgaccggcucacgcgcaacagcgucuacgacuccaaccuggaggccgcccuggagugcgagaacuggcucgagaagcagcaggggaaccaggagcggcaccuccgcgagauguucacccacaugaacagccugagcgaggagaccgaccacgagcacgacguguacuggaaguccuucaaccagaaguccgugcugaucaccgaggaccggguccccaagggcagcuacgccuuccacacgcuggagaagucccugaagcagaaguccaaccucaugaagaagcagcgcaccuacaaggagaagaagccccacaagugcaacgacugcggcgagcuguucacgugccacagcgugcacauccagcaccagcgggugcacaccggggagaagcccuacacgugcaacgagugcggcaagagcuucagccaccgcgccaaccugaccaagcaccagcggacccacacccgcauccucuucgagugccgggagugcaagaagaccuucaccgaguccagcucccuggcgacccaccagcgcauccacgucggggagcggccguacgagugcaacgagugcggcaagggguucaaccgcagcacccaccuggugcagcaccagcucauccacacgggcgugcggcccuacgagugcaacgagugcgacaaggccuucauccacuccagcgcccugaucaagcaccagcgcacccacaccggcgagaagcccuacaagugccaggagugcgggaaggccuucucccacugcagcucccugaccaagcaccagcgcguccacacgggcgagaagcccuacgagugcagcgagugcgggaagaccuucucccagagcacccaccucgugcagcaccagcggauccacaccggcgagaagccguacgagugcagcgagugcggcaagacguucucccagagcuccaacuucgccaagcaccagcgcauccacaucgggaagaagcccuacaagugcagcgagugcggcaaggcguucauccacuccagcgcccugauccagcaccagcggacccacaccggggagaagcccuuccgcugcaacgagugcggcaaguccuucaagugcagcuccagccugauccggcaccagcgcgugcacaccgaggagcagcccuga

SEQ ID NO: 39019 - RNA, 1428 nt, Artificial Sequence
  derived and/or modified sequence opt1 from ZNF296__Homo_sapiens__NP_660331
augagccgccggaaggccggcuccgcgccccgccggguggagccggcgcccgccgccaaccccgacgacgagauggagaugcaggaccuggucaucgagcucaagcccgagccggacgcccagccccagcaggcgccccgccuggggcccuucagcccgaaggagguguccagcgccggccgguucgggggcgagccccaccacucccccgggcccaugccggccggcgccgcccugcucgcgcugggcccccgcaaccccuggacccuguggacgccccucaccccgaacuaccccgaccggcagcccuggaccgacaagcaccccgaccugcugaccugcgggcgcugccuccagaccuucccgcuggaggccaucacggccuucauggaccacaagaagcugggcugccagcuguuccgggggcccagccgcggccagggguccgagcgggaggagcugaaggcccugagcugccuccgcugcggcaagcaguucaccguggccuggaagcugcugcggcacgcgcagugggaccacggccucuccaucuaccagaccgagagcgaggcccccgaggcgccccugcuggggcucgccgaggucgccgccgccguguccgccguggucggcccggccgccgaggccaagagcccccgcgccuccgggagcggccugacccggcgcucccccacgugccccgugugcaagaagacccugagcuccuucagcaaccucaaggugcacaugcggucccacaccggcgagcgcccguacgccugcgaccagugccccuacgccugcgcccagagcagcaagcugaaccggcacaagaagacccaccgccaggugcccccgcagagcccccugauggcggacacgucccaggagcaggccuccgccgccccgcccgagcccgcgguccacgccgccgcccccaccagcacccuccccugcuccgggggcgagggggccggcgcggccgccaccgccggggugcaggagcccggcgccccgggcagcggggcgcaggccggccccgggggcgacacguggggcgccaucaccaccgagcagcggaccgaccccgccaacucccagaaggccagccccaagaagaugccgaaguccgggggcaagagccgcgggcccggcggguccugcgaguucugcggcaagcacuucacgaacagcuccaaccugaccguccaccgccggagccacaccggggagcgccccuacacgugcgaguucugcaacuacgcgugcgcccaguccagcaagcugaaccggcaccgccggaugcacggcaugacccccggcuccacccgcuucgagugcccgcacugccacgugcccuucgggcuccgggccacccuggacaagcaccuccgccagaagcaccccgaggccgcgggcgaggccuga

SEQ ID NO: 39020 - RNA, 1152 nt, Artificial Sequence
  derived and/or modified sequence opt1 from ZNF2__Homo_sapiens__NP_001017396
augcuggagaacuacaacagcaucgugucccucggccugcccgucccgcagcccgacgugaucuuccagcugaagcgcggggacaagcccuggaugguggaccuccacggcagcgaggagcgggaguggcccgaguccgucagccuggacugggagaccaagccggagauccacgacgccuccgacaagaaguccgaggggagccugcgcgagugccucggccggcagagcccccugugccccaaguucgaggugcacacccccaacgggcgcaugggcacggagaagcaguccccgagcggcgagacccggaagaagucccugagccgcgacaaggggcuccggcgccgguccgcccugagccgcgagauccugaccaaggagcggcaccaggagugcuccgacugcggcaagaccuucuucgaccacagcucccucacgcgccaccagcggacccacaccggggagaagcccuacgacugccgcgagugcggcaaggcguucagccaccgguccagccugagccgccaccugaugucccacaccggggagagccccuacgagugcuccgugugcagcaaggccuucuucgaccgguccagccucacgguccaccagcgcauccacaccggcgagaagcccuuccagugcaacgagugcggcaaggccuucuucgaccgguccagccugacccgccaccagcggauccacaccggggaguccccguacgagugccaccagugcggcaaggccuucagccagaaguccauccugacgcgccaccagcucauccacaccgggcgcaagcccuacgagugcaacgagugcggcaaggccuucuacggcgugagcucccugaaccggcaccagaaggcgcacgccggggacccccgcuaccagugcaacgagugcggcaaggccuucuucgaccggagcucccugacccagcaccagaagauccacaccggggacaagcccuacgagugcagcgagugcggcaaggccuucucccagcgcugccggcucacgcgccaccagcgggugcacaccggggagaagccguucgagugcaccgucugcggcaagguguucagcuccaagagcagcgugauccagcaccagcgccgguacgcgaagcagggcaucgacuga

SEQ ID NO: 39021 - RNA, 1863 nt, Artificial Sequence
  derived and/or modified sequence opt1 from ZNF300__Homo_sapiens__NP_001166302
auggugcccgccgagaccagcuccagcggccugcucgaggagcagaagaugaugaagucccaggggcuggucagcuucaaggacguggccguggacuucacccaggaggaguggcagcagcuggacccgucccagcgcacgcucuaccgggacgucaugcuggagaacuacagccaccugguguccaugggcuaccccgugagcaagcccgacgucaucuccaagcucgagcagggggaggagcccuggaucaucaagggcgacaucagcaacuggaucuacccggacgaguaccaggcggacgggcgccaggaccggaaguccaaccugcacaacagccaguccugcauccugggcaccgugagcuuccaccacaagauccucaagggcgugacccgcgacgggucccugugcagcauccugaaggucugccagggcgacgggcagcuccagcgguuccuggagaaccaggacaagcuguuccgccaggugaccuucgugaacuccaagacggucaccgaggccagcggccacaaguacaacccccucgggaagaucuuccaggagugcaucgagaccgacaucuccauccagcgguuccacaaguacgacgccuucaagaagaaccugaagcccaacaucgaccugcccagcugcuacaagagcaacucccgcaagaagccggaccagagcuucggcggcgggaaguccagcucccagagcgagcccaacuccaaccucgagaagauccacaacggcgugauccccuucgacgacaaccagugcgggaacguguuccggaacacccagagccugauccaguaccagaacgucgagacgaaggagaaguccugcgugugcgugaccugcggcaaggccuucgccaagaagucccagcugaucguccaccagcgcauccacaccggcaagaagcccuacgacugcggggcgugcggcaaggccuucagcgagaaguuccaccucguggugcaccagcggacccacacgggggagaagccguacgacugcagcgagugcggcaaggccuucucccagaaguccagccugaucauccaccagcgcguccacaccggggagaagcccuacgagugcagcgagugcggcaaggccuucucccagaaguccccgcugaucauccaccagcggauccacaccggcgagaagcccuacgagugccgcgagugcgggaaggcguucagccagaagucccagcucaucauccaccaccgggcccacaccggcgagaagcccuacgagugcacggagugcgggaaggccuucugcgagaagucccaccugaucauccacaagcgcauccacaccggcgagaagcccuacaagugcgcccagugcgaggaggccuucagccggaagaccgagcugaucacccaccagcucgugcacacgggggagaagcccuacgagugcaccgagugcggcaagaccuucagccgcaagagccagcugaucauccaccagcggacccacacgggcgagaagcccuacaagugcagcgagugcgggaaggcguucugccagaagucccaccugaucggccaccagcgcauccacaccggggagaagccguacaucugcaccgagugcggcaaggccuucagccagaagucccaccuccccgggcaccagcggauccacaccggcgagaagcccuacaucugcgccgagugcggcaaggccuucagccagaaguccgaccuggugcugcaccagcgcauccacacgggggagcgccccuaccagugcgccaucugcggcaaggcguucauccagaagucccagcucaccguccaccagcggauccacaccguggucaagagcuga

SEQ ID NO: 39022 - RNA, 2001 nt, Artificial Sequence
  derived and/or modified sequence opt1 from ZNF311__Homo_sapiens__NP_001010877
augcaggaggugguccugcucgacgagagcuccgggcccccgagccagcugcuguggacccggcaggacacccagcucccccaggaguccgcccugcugcccgcccccuacccggcguucacgaaggacggcagccagggcaaccucccccaggccgacaucacccugaugucccaggcccaggagagcgugaccuucgaggacguggccgucaacuucaccaaccgggaguggcagugccugacguacgcccagcgccaccucuacaaggacgugaugcuggagaacuacgggaacauggugucccugggcuuccccuuccccaagccgccccucaucagccaccuggagcgggaggucgaccccugcgugcaggacccccaggaccgcgagucccugagcugcuccuacccggugagcgcggacaagauguggcccgagaacgagaaggccuccagccagcaggagaucuucgagaacggggaggccuacuggaugaaguucaacucccuccugaaggucgacagccgggaccccaaggugcgcgaggugugcguccaggacgugaagcuggagaaccagugggagaccuccauccgggagaagcuccgcgaggagaaggagggcagcgaggaggugaccugcaagaagggcaagaaccagaagguccuguccaagaaccugaaccccaacagcaagcacagccagugcaacaaggugcucaucgcccagaagcugcacgagugcgcgcggugcgggaagaacuucuccuggcacagcgaccugauccuccacgagcagauccacuccggcgagaagccgcacgugugcaacgagugcgggaaggccuucaagacccgcaaccagcugagcaugcaccggaucauccacacgggcgagaagcccuucaacugcacccagugcgggaaggccuucaacucccgcagcgcccugugccggcacaagaagacccacuccggcgagaagccccacgagugccgcgacugcggcaaggccuucaagacccggaaccgccucugcaugcaccagcugauccacacgggggagaagcccuacaagugcaacugcugcggcaaggcguuccaguucaagcacagccugaccauccacgggcggauccacaccggcgagaagccguacgagugcgaggagugcggcaaggccuucuccgggagcuccgaccucaccaagcacauccgcauccacacgggcgagcggcccuacgagugcagcaagugcgggcgcgccuucucccggagcuccgaccugagcaagcacaagcgcauccacacccgcgagaagcacuacggcugcccccagugcgggaaggacuucuccaucaaggccgagcugaccaagcaccggcgcauccacaccgaggagaagcgguaccgcugcgaggagugcggcaaggccuuccggcacaacugcaagcgccgggcgcacgagcgcgagcacacgggcgagaagcccuaccagugccgggacugcgggaagaccuuccaggacaagcacugccucaccauccaccagcgcauccacaccggcgagaagccguacaagugccuggagugcgggaaggccuucagcggcaaguccaaccugacgaaccaccggcgcauccacaccggggagaagccccacaagugcgaggucugcggcauggccuuccaccacagcagcgugcuccggcagcacaagcgcauccacaccggcgagaagcccuacacgugcuccgagugcgggaccagcuuccggcagggcuccgcccugaucgggcacaagcgcgugcacaccggcgagaagcccuacgagugcgaggagugcgggaaggccuuccgggucagcuccaaccugaccggccacaagaagcgcaagcaccagguguggagcacccacgagcucgacggcucccgcaagagccuguccccggugacggucagccagaccuccguggucagcauccugaccuccgcguga

SEQ ID NO: 39023 - RNA, 6840 nt, Artificial Sequence
  derived and/or modified sequence opt1 from ZNF318__Homo_sapiens__NP_055160
auguaccgcagcagcgcccggagcuccgugagcucccaccgccccaaggacgacggcgggggcgggccccggagcggccgcuccagcggguccagcuccggccccgcccggcgcagcagcccgcccccgccgcccagcggcuccagcucccggacccccgcccgccggccccgcagccccuccgggcaccggggccgccgggccagccccuccccgccccgcgggcggcgcgugucccccuccccgccccgcgcccgccggggcucccccuccccgccccgcgggcggcgccuguucccgcccggccccgccggcuuccgcggguccagccggggcgagucccgcgccgacuacgcgcgggacgggcgcggcgaccaccccggcgacagcgggucccggcgccggagccccggccugugcuccgacagccuggagaagucccugcgcaucaccguggggaacgaccacuucugcgugagcacgcccgagcggcgccggcuguccgaccgccugggcagccccguggacaaccuggaggacauggaccgggacgaccucaccgacgacuccguguucacccgcagcucccagugcagccgggggcuggagcgcuacaucagccaggaggagggcccccugucccccuuccucggccagcuggacgaggacuaccggaccaaggagacguuccugcaccgcagcgacuacagcccccacaucuccugccacgacgagcuccugcgggggaccgagcgcaaccgcgagaagcugaagggcuacuccauccggagcgaggagcgcucccgggaggccaagcgcccccgguacgacgacaccgugaagaucaacagcaugggcggcgaccaccccuccuucaccagcgggacgcgcaacuaccggcagcgccggcgcucccccagcccccgguuccucgaccccgaguuccgcgagcuggaccuggcccggcgcaagcgggaggaggaggaggagcgcucccggagccucucccaggagcuggucggcguggacggcgggggcaccgggugcagcauccccggccuguccggggugcucaccgccagcgagcccggcuacagccugcaccgccccgaggaggucuccgugaugcccaagaaguccauccugaagaagcggaucgagguggacaucauggagcccuccaugcagcucgagagcuucuccagcuccaccagcuccagccaggaccacccccuguacuccggccaccccagccugccccucuccggggcgaucgccgccuucgccagcgagaucgagaacaagggcacgauggucgagaccgcccugaaggagccccaggggaaccuguaccaguggggcccccuccccggcauccccaaggacaacagcccccugcgcgagaaguucgggagcuuccugugccacaaggacaaccucgaccugaaggcggagggccccgagcggcacaccgacuuccugcucccccacgagcgcgccucccaggacgggagcggcuucucccgcauccugagcaugcuggccgacagcaccuccacgcaggagaagcggcgccggagcuuccccgacaucgaggacgaggagaaguuccucuacggggacgaggaggaggaccugaaggccgaguccgugcccaagccccugggcagcuccgagagcgaggugaugcgccagaaggccuccagccuccccuccagcgcgcccgccgucaagcuggagucccuggaggagaccaaccccgaguacgccaagauccacgaccuccugaagaccaucggccuggacaucgggguggccgagaucagccagcucgccgcgcggacccaggagcgccugcacggcaagaagccgucccugcggagcuccgccgaccgccggagcuccguggaccgcuacuucagcgccgaccacugcuccagcgucgaccaccgguucagcgccgaccgcugcuccagcguggaccacugcuucuccgccgaccggcgcagcuccgacccccaccggcuggagagccgcgaggcgcaccacuccaacacgcacagccccgaggugucccacccccacccgcccagccccgucgaccccuaccuccugaccaagaacagcccgcccuuccucaagagcgaccaccccguggggcacaucuccggcccggagguggucgggagcggcuuccaguccagcguggccguccggugcaugcugcccuccgcccccagcgcccccauccgccugccgcacaccgcggcccugucccaguuccacaugccccgggccagccaguucgccgccgcgcgcaucccgcccaacuaccagggcccggccaucccgcccgccagcuucgacgccuaccgccacuacauggccuacgcggccucccgguggcccauguacccgaccagccagcccuccaaccaccccgugcccgagccgcaccgcaucaugcccaucacgaagcaggccacccggagccgccccaaccuccgggugauccccaccgucaccccggacaagcccaagcagaaggagucccugcgcgggagcauccccgccgcccaggugccggugcaggucuccauccccagccugauccgguacaaccccgagaagaucuccgacgagaagaaccgcgcgagccagaagcagaaggugaucgaggagcgggagaagcucaagaacgaccgcgaggcccggcagaagaagauguacuaccugcgcacggagcuggagcggcuccacaagcagcagggcgagaugcugcgcaagaagcggcgcgagaaggacgggcacaaggacccccugcucguggaggucucccggcugcaggacaacaucaugaaggacaucgccgagcugcgccaggaggccgaggaggcggagaagaagcagagcgagcucgacaagguggcccagauccugggcaucaacaucuucgacaagucccagaagucccuguccgacagccgggagccgaccgagaagcccgggaaggccgagaaguccaagagccccgagaagguguccagcuucagcaacuccagcuccaacaaggagagcaaggucaacaacgagaaguuccgcaccaagucccccaagccggccgagagcccccaguccgccaccaagcagcucgaccagcccacggcggccuacgaguacuacgacgccggcaaccacuggugcaaggacugcaacaccaucugcggcaccauguucgacuucuucacccacaugcacaacaagaagcacacgcagacccuggaccccuacaaccggccgugggccagcaagacccaguccgaggccaagcaggacgcgaucaagcgcaccgacaagaucaccgugcccgccaaggggagcgaguuccuggugcccaucuccggcuucuacugccagcucugcgaggaguuccugggggaccccaucagcggcgagcagcacgucaaggggcaccagcacaacgagaaguacaagaaguacguggacgagaacccgcuguacgaggagcgccggaaccucgaccgccaggccggccuggccgugguccuggagacggagcggcgccggcaguccgagcucaagcgcaagcugagcgagaagcccaaggaggagaagaaggagaagaaggccaaggcggugaaggaggugaaggaggacgacaaggucuccgagaagcuggaggaccagcucagcgagggccggaacucccccgagaaggccgagaacaagcgcaacaccgggaucaagcugcagcugaaggaggaggugaagaaggagagccccaccuccagcagcuucggcaaguucuccuggaagaagccggagaaggaggaggagaaguccucccucgugacccccagcaucuccaaggaggagauccuggagagcuccaaggacaaggaggacgggaagacggaggccggcaaggccaagcccaucaagaucaagcugagcggcaagaccgucguggcgcacaccucccccuggaugccgguggucaccacgagcacccagaccaagauccggcccaaccuccccauccccuccaccgugcugcgcaagagcugcuccgccacgaugagcaagccggcgccccugaacaccuuccucuccaucaagagcuccgggaccaccgccaagccccugccgguggucaaggagagcagcgccgaccugcuccugccgcccgacaucaucuccaaggcguucggcggggaggaggugauccugaagggcagccccgaggagaaggugguccucgccgagaaguccgagccgagccaccuccccgagcagauccugccgcccccgcccccgcccccgccgccgcccccgccgcccccgcccgugaucccccaccccgccgcccccuccgccgcgcaggccaacgccauccucgcccccgucaagagcaaccccgucgugucccagacgcugagccccggguucgugggccccaacauccugaaccccguccuccccguggccaucauggcguccgcccagcccgccgccauccccagcgacgagaccgcccccggcguguccgagagcgaccgggaccagacccuguucuccguccuggugcggccgccgccgccccucagcuccguguucagcgagcaggcgaagaagcuggagaagcggaacuccugccuggccaccgccaacgccaaggaccucuacgacaucuucuacagcuccgggggcaagggggcgcccgagacgaagggcgcccccgagaccaagcugagcgggggcccccuggccaacggcgagaacagcaaccucucccgcaccaagagcuccgacaccagcuccacgagcccccugaacuccagcgccucccaggaggagcugcaccaggacgaggggcucgucgccgcgcccaucgugagcaacuccgagaagcccaucgccaagacccugguggcccugggcaaguggagcgucguggagcacguggggcccaaguccaccggcagcaccuacggguuccuccagccccugacgcggcugugccagucccgccccuacgagaccaucacccccaagaccgacacgcucgccaucuggaccagcuccagcuuccaguccgacaccagccgggacaucagccccgagaaguccgagcuggaccugggcgagcccgggccgcccggggucgagccgccgccccagcuccuggacauccagugcaaggagagccagaagcugguggagauccaccuccgcgaguccgucaaccaggacaaggagagccaggagcugcggaaguccgaggacugccgcgagagcgagaucgagaccaacacggagcugaaggagcgcgugaaggagcucuccgagggcaucguggacgagggggucagcaccuccaucggcccccacagcaucgacgacuccaaccugaaccacggcaaccgguacaugugggagggggaggugaagcagccgaaccugcucaugaucgacaaggaggccgagcagagcaacaagcugaugaccggcuccgagacccccagcaagguggucaucaagcugagcccccaggcgugcagcuucaccaaggccaagcucgacuccuuccugagcgaggcccgcucccugcucaacccgcaggacacgcccgugaagaucagcgcccccgagcugcugcuccacagccccgcccgguccgcgaugugccugaccgggagcccgcaggagcagggcguguccgucgugagcgaggaggggcuggagaacuccgcccccgagagcgccucccgcaccagccgguaccgcucccugaagcucaagcgggagcgcagcaaggacuuccaggugaagaagaucuacgagcuggccgucugggacgagaacaagaagcggcccgagaccugggagucccccgagaagccgaagacggaggcgcuggagcuccaggacgugcaccccgagcugaccgugaccaucgagagcaaggcccuggaggacuucgaggccaccgaccucaaggucgaggagcugacggcccugggcaaccucggcgacaugcccguggacuucugcaccacccgcgugucccccgcccaccggagcccgaccguccugugccagaaggugugcgaggagaacuccgugagccccaucgggugcaacuccagcgaccccgcggacuucgagcccaucccguccuucagcggcuucccccuggacagccccaagacgcucguccuggacuucgagaccgagggggagcgcaacucccccaacccgcggagcgugcgcauccccucccccaacauccugaagaccggccucaccgagaacguggaccgggggcugggcggccuggaggggacgcaccaggcccucgaccugcuggccggcgggaugaugcccgaggaggucaaggagagcucccagcucgacaagcaggagagccugggccuggagcucaagaccaucaacuccgccgggcugggcccgagccccugccugcccgaccucguggacuucgugacccgcaccuccggcguccagaaggacaagcugugcagcccccuguccgagccgggggaccccagcaagugcuccagccucgagcugggcccccugcagcucgagaucuccaacgccagcacgaccgagguggcgauccuccagguggacgacgacuccggggacccgcugaaccucgucaaggcccccgugagccggagcccgccccgcgagcaggucaucgaggacaacauggucccgcagggcaugcccgagcaggagaccaccgugggggccauccaggaccacacggagagcagcgugcacaacuga

SEQ ID NO: 39024 - RNA, 1530 nt, Artificial Sequence
  derived and/or modified sequence opt1 from ZNF320__Homo_sapiens__NP_997216
auggcccugagccagggccuccugaccuuccgcgacguggccaucgaguucucccaggaggaguggaagugccuggaccccgcgcagcggacccucuaccgcgacgucaugcuggagaacuaccggaaccuggugagccucgacaucuccagcaagugcaugaugaacacgcuguccagcaccgggcagggcaacaccgaggugauccacaccgggacgcugcagcgccaggccuccuaccacaucggcgccuucugcagccaggagaucgagaaggacauccacgacuucgucuuccaguggcaggaggacgagaccaacgaccacgaggccccgaugaccgagaucaagaagcucaccuccagcacggaccgguacgaccagcgccacgccgggaacaagcccaucaagggccagcuggagucccgguuccaccuccaccuccgccggcaccgccggauccacaccggcgagaagcccuacaagugcgaggagugcgagaagguguucagcugcaagucccaccuggagauccaccgcaucauccacaccggggagaagcccuacaagugcaaggugugcgacaaggcguucaagcacgacagccaccuggccaagcacacccggauccaccgcggcgacaagcacuacacgugcaacgagugcgggaaggucuucgaccagaaggccacccuggccugccaccaccggucccacaccggcgagaagccguacaagugcaacgagugcgggaagaccuucagccagacgucccaccugguguaccaccaccgccugcacaccggcgagaagcccuacaagugcaacgagugcggcaagaccuucgcgcggaacagcgugcucgucauccacaaggccgugcacaccgccgagaagcccuacaagugcaacgagugcgggaagguguucaagcagcgcgccacgcuggccggccaccggcgcguccacaccggggagaagcccuaccggugcgaggagugcgacaagguguucucccgcaagagccaccuggagcgccaccggcgcauccacaccggcgagaagccguacaagugcaaggugugcgacaaggcguuccggagcgacucccgccucgccgagcaccagcggguccacaccggcgagcgccccuacacgugcaacgagugcgggaagguguucagcaccaaggccuaccuggccugccaccagaagcugcacaccggcgagaagcucuacgagugcgaggagugcgacaagguguacauccggaagucccaccuggagcgccaccggcgcauccacaccggggagaagccccacaagugcggcgacugcgggaaggccuucaacagccccucccaccugauccggcaccagcgcauccacacgggccagaaguccuacaagugccaccagugcggcaaggucuucagccuccggagccugcuggcggagcaccagaagaucccguucggggacaacugcuucaagugcaacgaguacuccaagcccagcuccaucaacuga

SEQ ID NO: 39025 - RNA, 1209 nt, Artificial Sequence
  derived and/or modified sequence opt1 from ZNF322__Homo_sapiens__NP_001229728
auguacaccagcgaggagaagugcaaccagcgcacccagaagcggaagaucuacaacgugugcccccgcaagggcaagaagaucuucauccacaugcacgagaucauccagaucgacgggcacaucuaccagugccuggagugcaagcagaacuucugcgagaaccucgcccugaucaugugcgagcggacgcacaccggcgagaagcccuacaagugcgacaugugcgagaagaccuucguccaguccagcgaccugaccucccaccagcgcauccacaacuacgagaagcccuacaagugcagcaagugcgagaaguccuucuggcaccaccucgcccugagcgggcaccagcggacgcacgcgggcaagaaguucuacacgugcgacaucugcgggaagaacuucggccaguccagcgaccugcucgugcaccagcgcucccacaccggcgagaagcccuaccugugcagcgagugcgacaagugcuucucccggagcaccaaccugauccgccaccggcgcacccacaccggggagaagcccuucaagugccucgagugcgagaaggccuucuccggcaagagcgaccugaucucccaccagcggacccacaccggggagcgcccguacaagugcaacaagugcgagaaguccuaccggcaccgcagcgccuucaucgugcacaagcggguccacacgggcgagaagcccuacaagugcggggccugcgagaagugcuucggccagaaguccgaccugaucgugcaccagcgcgugcacaccggcgagaagcccuacaagugccucgagugcaugcggagcuucacccgcagcgccaaccugauccggcaccaggcgacccacacgcacaccuucaagugccuggaguacgagaaguccuucaacugcagcagcgaccucaucguccaccagcgcauccacauggaggagaagccccaccagugguccgccugcgagagcggguuccugcugggcauggacuucguggcccagcagaagaugcggacccagaccgaggagcuccacuacaaguacacggugugcgacaaguccuuccaccagagcuccgcccugcugcagcaccagaccguccacaucggggagaagccguucgugugcaacgugagcgagaagggccucgagcuguccccgccccacgcgagcgaggccucccagaugagcuga

SEQ ID NO: 39026 - RNA, 822 nt, Artificial Sequence
  derived and/or modified sequence opt1 from ZNF32__Homo_sapiens__NP_001005368
auguucggcuuccccaccgccacccugcucgacugccacgggcgcuacgcccagaacguggcguucuucaacgucaugacggaggcccaccacaaguacgaccacagcgaggccaccggcuccagcuccugggacauccagaacagcuuccggcgcgagaagcuggagcagaaguccccggacagcaagacccugcaggaggacucccccggggugcggcagcgcguguacgagugccaggagugcggcaagagcuuccggcagaaggggucccucacccugcacgagcgcauccacacgggccagaagcccuucgagugcacccacugcggcaagagcuuccgggccaaggggaaccuggucacccaccagcgcauccacaccggcgagaagcccuaccagugcaaggagugcgggaaguccuucagccagcggggcucccucgccgugcacgagcgccugcacacggggcagaagccguacgagugcgcgaucugccagcggagcuuccgcaaccaguccaaccuggccgugcaccggcgcguccacagcggcgagaagcccuaccggugcgaccagugcggcaaggccuucucccagaaggggagccucaucgugcacauccgcgugcacaccggccugaagcccuacgccugcacccagugccggaaguccuuccacacccgcgggaacugcauccugcacggcaagauccacacgggcgagacccccuaccucugcgggcagugcggcaagagcuucacccagcgggggagccuggcgguccaccagcgcuccugcagccagcggcugacccucuga

SEQ ID NO: 39027 - RNA, 783 nt, Artificial Sequence
  derived and/or modified sequence opt1 from ZNF330__Homo_sapiens__NP_001278931
augccccaguggaacgugaccagcguccgcggcaagaccaagugcaugaugaaguccagcgacugcgugaucaagcacgccgggguguacuccacgggccuggccauggucggggcgaucugcgacuucugcgaggccugggugugccacggccggaagugccucagcacccacgccugcgccugcccccugaccgacgccgagugcguggagugcgagcgcggggucugggaccacggcggccggaucuucuccugcagcuucugccacaacuuccugugcgaggacgaccaguucgagcaccaggcguccugccaggugcucgaggccgagaccuucaagugcgugagcugcaaccgccuggggcagcacuccugccugcggugcaaggccugcuucugcgacgaccacacgcgcagcaaggucuucaagcaggagaagggcaagcagccgcccugccccaagugcgggcacgagacccaggagaccaaggaccucuccaugagcacccggucccugaaguucggccgccagaccgggggcgaggagggcgacggggccagcggcuacgacgcguacuggaagaaccuguccagcgacaaguacggggacacguccuaccacgacgaggaggaggacgaguacgaggccgaggacgacgaggaggaggaggacgagggccggaaggacagcgacaccgaguccagcgaccucuucaccaaccugaaccugggccgcacguacgccagcggguacgcccacuacgaggagcaggagaacuga

SEQ ID NO: 39028 - RNA, 1392 nt, Artificial Sequence
  derived and/or modified sequence opt1 from ZNF331__Homo_sapiens__NP_061025
auggcccagggccuggugaccuucgccgacgucgcgaucgacuucagccaggaggagugggccugccucaacuccgcccagcgcgaccuguacugggacgugaugcuggagaacuacagcaaccucgugucccuggaccuggagagcgccuacgagaacaagucccuccccaccgagaagaacauccacgagauccgggccagcaagcgcaacuccgaccggcgcagcaagucccuggggcggaacuggaucugcgagggcacgcuggagcgcccgcagcggagccgcgggcgguacgucaaccagaugaucaucaacuacgugaagcgccccgcgacccgggagggcaccccgccccgcacccaccagcggcaccacaaggagaacuccuucgagugcaaggacugcgggaaggccuucagccgcggcuaccagcucucccagcaccagaagauccacacgggcgagaagcccuacgagugcaaggagugcaagaaggccuuccggugggggaaccagcugacccagcaccagaagauccacaccggcgagaagcccuacgagugcaaggacugcgggaaggccuuccgcuggggcagcucccuggugauccacaagcggauccacaccggggagaagcccuacgagugcaaggacugcggcaaggcguuccgccggggcgacgagcucacgcagcaccagcgcuuccacaccggggagaaggacuacgagugcaaggacugcggcaagaccuucagccgggucuacaagcugauccagcacaagcgcauccacuccggggagaagcccuacgagugcaaggacugcggcaaggccuucaucugcggcagcucccugauccagcacaagcgcauccacaccggggagaagccguacgagugccaggagugcggcaaggccuucacgcgggugaacuaccucacccagcaccagaagauccacaccggggagaagccccacgagugcaaggagugcggcaaggccuuccgcugggggagcagccuggugaagcacgagcggauccacaccggcgagaagcccuacaagugcacggagugcggcaaggccuucaacugcggguaccaccugacccagcacgagcgcauccacaccggcgagacccccuacaagugcaaggagugcgggaaggcguucaucuacggcuccagccucgucaagcacgagcggauccacacgggggugaagccguacggcugcaccgagugcggcaaguccuucagccacgggcaccagcugacccagcaccagaagacccacuccggcgccaagagcuacgagugcaaggagugcgggaaggccugcaaccaccugaaccaccuccgcgagcaccagcggauccacaacuccuga

SEQ ID NO: 39029 - RNA, 2112 nt, Artificial Sequence
  derived and/or modified sequence opt1 from ZNF334__Homo_sapiens__XP_011527196
augugcguguuccugcaccuccugagcuacaucaaggacaccuccuucauccccggcccggacugcgagcugcacccccgcgggauggccgccaccggccccugcagcgaggcgcccguccaggggugcgacgccggcgagcuccagcagcuggggcugugcggcguguccgacgugcagcggagcugguccaaguucugcaacuucccgcucacgggcuaccacgucagcaagcccgacgugaucuucaagcuggagcagggggaggagcccuggaucguggaggaguucuccaaccagaacuaccccgacaucgacgacgcccuggagaagaacaaggagauccaggacaagcaccucacccagaccgucuucuucagcaacaagacccugaucacggagcgcgagaacguguucggcaagacccugaaccucgggaugaacuccgugccgagccggaagaugcccuacaagugcaaccccggcgggaacucccugaagaccaacagcgaggucaucguggccaagaaguccaaggagaaccgcaagauccccgacggcuacagcggcuucgggaagcacgagaagucccaccugggcaugaagaaguaccgguacaacccgaugcgcaaggccagcaaccagaacgagaaccucauccugcaccagaacauccagauccugaagcagcccuucgacuacaacaagugcgggaagaccuucuucaagcgggcgauccucaucacgcagaagggccgccagaccgagcggaagcccaacgagugcaacgagugccgcaagaccuucuccaagcggagcacccugaucgugcaccagcgcauccacacgggcgagaagcccuacgucugcuccgacugccggaagaccuuccgcgugaagaccagccugacccggcaccgccggauccacacgggggagcgcccguacgagugcagcgagugccggaagaccuucaucgacaaguccgcccucaucgugcaccagaagauccacggcggggagaaguccuacgagugcaacgagugcggcaagaccuucuuccgcaagagcgcccuggccgagcacuuccggagccacaccggggagaagcccuacgagugcaaggagugcggcaacgcguucuccaagaaguccuaccuggucgugcaccagcgcacgcaccgcggcgagaagcccaacgagugcaaggagugcgggaagaccuucuucugccagagcgcccucaccgcccaccagcggauccacaccggcgagaagcccuacgagugcagcgagugcgagaagacguucuucugccaguccgcccugaacgugcaccgccggagccacaccggggagaagccguacgagugcucccagugcggcaaguuccugugcaccaagagcgcccucaucgcgcaccagaucacccaccgcgggaagaaguccuacgagugcaacgagugcggcaaguucuucugccacaagagcacgcugaccauccaccagcggacccacaccggcgagaagcacggggucuucaacaagugcggccgcaucuccaucgucaagagcaacugcucccagugcaagcggaugaacacgaaggagaaccuguacgagugcagcgagcacgggcacgccguguccaagaacagccaccucaucgugcaccagcgcaccaucugggagcggcccuacgagugcaacgagugcggccgcaccuacugccgcaagagcgcccugacccaccaccagcggacgcacaccgggcagcggcccuacgagugcaacgagugcggcaagaccuucugccagaaguucuccuucguggagcaccagcgcacccacaccggcgagaagcccuacgagugcaacgagugcggcaagagcuucugccacaaguccgccuuccgggugcaccgccggauccacacgggggagaagccguacgagugcaaccagugcgggaagaccuaccgccggcuguggacccucaccgagcaccagaagauccacacgggcgagaagcccuacgagugcaacaagugcgagaagaccuuccgccacaagagcaacuuccugcugcaccagaagucccacaaggaguga

SEQ ID NO: 39030 - RNA, 4029 nt, Artificial Sequence
  derived and/or modified sequence opt1 from ZNF335__Homo_sapiens__NP_071378
auggaggagaacgagguggagagcuccagcgacgccgcccccggcccggggcgccccgaggagcccuccgagagcggccugggggucggcaccuccgaggcggugagcgccgacuccagcgacgccgccgccgcgcccgggcaggccgaggccgacgacuccggcgugggccagagcuccgaccgggggagccgcucccaggaggaggucagcgaguccagcuccagcgccgacccgcuccccaacuccuaccugcccgacagcagcuccgugagccacggccccguggcgggggucaccggcgggccgcccgcccuggugcacuccagcgcccuccccgaccccaacaugcugguguccgacugcacggccagcuccagcgaccugggcuccgccaucgacaagaucaucgagagcaccaucggcccggaccucauccagaacugcaucaccgucaccuccgcggaggacgggggcgccgagacgacccgguaccugauccugcaggggcccgacgacggcgcccccaugaccagccccauguccagcuccacccucgcccacagccuggccgcgaucgaggcccuggccgacggcccgacguccaccagcacgugccucgaggcccagggcgggcccuccagccccgugcagcugcccccggccagcggggcggaggagcccgaccugcagucccucgaggccaugauggagguggucguggugcagcaguucaagugcaagaugugccaguaccgcagcuccaccaaggccacccugcugcggcacaugcgcgagcggcacuuccgccccgucgccgccgcggccgccgccgcgggcaagaaggggcggcuccgcaaguggagcaccuccaccaagagccaggaggaggagggccccgaggaggaggacgacgacgacaucguggacgccggcgccaucgacgaccuggaggaggacuccgacuacaacccggccgaggacgagccccgggggcgccagcugcggcuccagcgccccacccccagcacgccgcggccccgccggcgccccggccggccgcgcaagcugccccggcuggagaucuccgaccuccccgacgggguggagggcgagccccuggucagcucccagagcgggcaguccccgcccgagccccaggaccccgaggccccgagcuccagcggccccggccaccugguggcgauggggaaggugucccgcacccccgucgaggccggcgugagccagagcgacgccgagaacgccgcccccuccugcccggacgagcacgacacccucccccgccggcgcgggcggcccagccgccgguuccugggcaagaaguaccgcaaguacuacuacaagucccccaagccgcugcuccggcccuuccugugccgcaucugcgggagccgguuccugucccacgaggaccuccgcuuccacgugaacagccacgaggcgggcgacccccagcuguucaagugccugcagugcuccuaccggagccgccggugguccagccucaaggagcacauguucaaccacgucggcuccaagcccuacaagugcgacgagugcagcuacaccuccguguaccgcaaggacgucauccggcacgccgccgugcacagccgcgaccggaagaagcgcccggaccccacgcccaagcuguccagcuuccccugcccggugugcgggcgggucuaccccaugcagaagcgccugacccagcacaugaagacccacuccaccgagaagccccacaugugcgacaagugcggcaagagcuucaagaagcgcuacacguucaagaugcaccuccugacccacauccaggccguggccaaccggcgcuucaagugcgaguucugcgaguucgugugcgaggacaagaaggcgcugcucaaccaccagcugucccacgucagcgacaagccguucaagugcagcuucugccccuaccggaccuuccgcgaggacuuccugcucucccacguggccgugaagcacaccggggccaagcccuucgccugcgaguacugccacuucagcacgcggcacaagaagaaccugcgccugcacguccggugccgccacgcguccagcuucgaggaguggggccggcgccaccccgaggagccgcccucccggcgccggcccuucuucagccuccagcagaucgaggagcugaagcagcagcacuccgccgcccccggcccgccgcccagcucccccgggccgcccgagaucccgcccgaggccaccaccuuccagagcuccgaggcccccagccugcugugcuccgacacccucggcggggcgacgaucaucuaccagcagggcgccgaggagagcaccgccauggccacccagaccgcccuggaccugcuccugaacauguccgcgcagcgcgagcugggcgggacggcccuccagguggccguggucaagagcgaggacguggaggccggccuggccucccccgggggccagcccagccccgagggggcgacgccccagguggucacccugcacguggccgagcccggcgggggcgccgccgcggagucccagcucggcccgcccgaccugccccagaucacccuggcccccgggcccuucggcgggaccggcuacagcgugaucaccgcgcccccgauggaggaggggaccagcgcccccggcacccccuacuccgaggagccggccggcgaggccgcccaggccgucguggugagcgacacccucaaggaggccgggacgcacuacaucauggccaccgacggcacccagcugcaccacaucgagcugaccgcggacggguccaucagcuuccccucccccgacgcccucgccagcggcgccaaguggccccugcugcagugcgggggccucccgcgggacggccccgagccgcccucccccgccaagacgcacugcgucggggacagccaguccagcgcguccagcccgcccgccaccuccaaggcccugggccuggccgugccgcccagcccgcccuccgccgcgaccgccgccagcaagaaguucuccugcaagaucugcgccgaggcguuccccgggcgcgccgagauggagagccacaagcgggcccacgccggccccggcgccuucaagugccccgacugccccuucuccgcgcgccaguggcccgaggugcgggcccacauggcccagcacagcagccuccgcccccaccagugcucccagugcagcuucgccuccaagaacaagaaggaccugcggcgccacaugcugacccacacgaaggagaagcccuucgccugccaccucugcgggcagcgcuucaaccggaacggccaccugaaguuccacauccagcgccugcacagccccgacgggcggaaguccggcacccccaccgcgcgcgccccgacccagacgcccacccagaccaucauccucaacagcgacgacgagacccuggccacgcugcacaccgcccuccaguccagccacgggguccugggccccgagcggcugcagcaggcccucucccaggagcacaucaucguggcgcaggagcagaccgugaccaaccaggaggaggccgccuacauccaggagaucacgaccgccgacggccagaccguccagcaccuggugaccagcgacaaccaggugcaguacaucaucucccaggacgggguccagcaccuccugccccaggaguacgugguggucccggagggccaccacauccaggugcaggaggggcagaucacgcacauccaguacgagcagggcgcgcccuuccugcaggagagccagauccaguacgugcccgucuccccggggcagcagcuggugacccaggcccagcucgaggccgccgcccacagcgcggugaccgccgucgccgacgccgccauggcgcaggcccagggccuguucggcaccgacgagacggugcccgagcacauccagcagcugcagcaccaggggaucgaguacgacgugaucacccucgccgacgacuga

SEQ ID NO: 39031 - RNA, 1800 nt, Artificial Sequence
  derived and/or modified sequence opt1 from ZNF343__Homo_sapiens__NP_001269424
augaugcugcccuacccgagcgcccucggcgaccaguacugggaggagauccugcugcccaagaacggggagaacguggagaccaugaagaagcucacccagaaccacaaggccaagggccugcccuccaacgacacggacugcccccagaagaaggaggggaaggcgcagaucgucgugccggugaccuuccgcgacgucaccgugaucuucaccgaggccgaguggaagcggcugagccccgagcagcgcaaccucuacaaggaggugaugcuggagaacuaccggaaccugcucucccuggccgagcccaagcccgagaucuacacgugcagcuccugccugcucgccuucagcugccagcaguuccugucccagcacguccugcagaucuuccucggccugugcgccgagaaccacuuccacccggggaacagcucccccggccacuggaagcagcagggccagcaguacagccacguguccugcugguucgagaacgcggaggggcaggagcgcggcgggggcagcaagcccugguccgcccggaccgaggagcgcgagaccagccgggccuuccccuccccgcugcagcgccagagcgccagcccccggaaggggaacaugguggucgagaccgagcccagcuccgcgcagcgccccaacccggugcagcucgacaagggccugaaggagcuggagacgcuccgguucggcgccaucaacugccgcgaguacgagcccgaccacaaccuggagagcaacuucaucaccaacccccggacccugcucgggaagaagcccuacaucugcagcgacugcggccgcuccuucaaggaccggagcacccugauccgccaccaccggauccacuccauggagaagccguacgugugcagcgagugcgggcgcggcuucucccagaaguccaaccugucccggcaccagcgcacgcacagcgaggagaagcccuaccucugccgggagugcggccaguccuuccgcagcaaguccauccugaaccgccaccaguggacccacagcgaggagaagcccuacgucugcuccgagugcgggcggggcuucagcgagaaguccagcuucauccgccaccagcggacccacuccggggagaagcccuacgugugccuggagugcggccgcagcuucugcgacaaguccacccuccggaagcaccagcgcauccacagcggggagaagccguacgugugccgggagugcggccgcggcuucagccagaacuccgaccugaucaagcaccagcggacgcaccuggacgagaagcccuacgucugccgcgagugcgggcggggcuucugcgacaagagcacccucaucauccacgagcgcacccacuccggggagaagcccuacgugugcggcgagugcgggcggggcuucagccgcaagucccugcugcucgugcaccagcggacccacagcggcgagaagcacuacgucugccgcgagugccggcgcggguucucccagaaguccaaccugauccggcaccagcgcacgcacagcaacgagaagcccuacaucugccgcgagugcggccggggguucugcgacaagagcacccugaucgugcacgagcgcacccacuccggcgagaagccguacgugugcagcgagugcgggcggggcuucucccgcaagagccuccugcugguccaccagcggacccacuccggcgagaagcacuacgugugccgcgagugcgggcggggcuucagccacaaguccaaccucauccgccaccagcggacgcacuga

SEQ ID NO: 39032 - RNA, 1599 nt, Artificial Sequence
  derived and/or modified sequence opt1 from ZNF350__Homo_sapiens__NP_067645
augauccaggcccaggagagcaucacccuggaggacguggccgucgacuucaccugggaggaguggcagcuccugggcgcggcccagaaggaccuguaccgcgacgugaugcucgagaacuacuccaaccugguggccgucggguaccaggccagcaagcccgacgcccuguucaagcucgagcagggcgagcagcuguggacgaucgaggacgggauccacuccggcgcgugcagcgacaucuggaagguggaccacgugcuggagcggcuccaguccgagagccuggucaaccgccggaagccgugccacgagcacgacgccuucgagaacaucgugcacugcuccaagagccaguuccugcucgggcagaaccacgacaucuucgaccugcgcggcaagucccucaagagcaaccugacccuggugaaccaguccaagggcuacgagaucaagaacagcgucgaguucaccgggaacggcgacuccuuccugcacgccaaccacgagcggcuccacaccgccaucaaguuccccgcgagccagaagcugaucuccaccaagagccaguucaucucccccaagcaccagaagacgcgcaagcuggagaagcaccacgugugcagcgagugcgggaaggccuucaucaagaaguccuggcucaccgaccaccaggugaugcacaccggcgagaagccccaccggugcagccugugcgagaaggccuucagccgcaaguucaugcugacggagcaccagcggacccacaccggggagaagccguacgagugccccgagugcggcaaggccuuccucaagaagucccgccugaacauccaccagaagacccacacgggcgagaagcccuacaucugcagcgagugcgggaagggcuucauccagaaggggaaccugaucguccaccagcggauccacaccggcgagaagcccuacaucugcaacgagugcggcaagggguucauccagaagaccugccucaucgcccaccagcgcuuccacaccggcaagacgccguucgugugcuccgagugcggcaagagcugcucccagaaguccgggcugaucaagcaccagcggauccacaccggggagaagcccuucgagugcagcgagugcggcaaggcguucagcaccaagcagaagcugaucgugcaccagcgcacccacacgggcgagcggcccuacgggugcaacgagugcggcaaggccuucgccuacauguccugccucgucaagcacaagcgcauccacacccgggagaagcaggaggccgccaagguggagaacccgcccgcggagcgccacagcucccugcacaccagcgacgugaugcaggagaagaacuccgccaacggggccaccacgcagguccccagcguggcgccccagaccucccugaacaucagcggccuccuggccaaccggaacgugguccugguggggcagcccgugguccgcugcgccgccuccggcgacaaccggggcuucgcccaggaccgcaaccucgugaacgccgucaacgugguggucccgagcgugaucaacuacgugcuguucuacgucaccgagaaccccuga

SEQ ID NO: 39033 - RNA, 1818 nt, Artificial Sequence
  derived and/or modified sequence opt1 from ZNF354A__Homo_sapiens__NP_005640
auggccgccggccagcgcgaggcgcggccccaggugagccugaccuucgaggacgucgccguccucuucacccgcgacgaguggcggaagcuggccccgucccagcgcaaccuguaccgggacgugaugcucgagaacuaccgcaaccuggugagccuggggcuccccuucaccaagcccaaggugaucucccugcugcagcagggcgaggaccccugggagguggagaaggacgggagcggcgucuccagccucggguccaagagcucccacaagaccaccaagagcacccagacgcaggacuccagcuuccagggccugauccugaagcgguccaaccgcaacgugccgugggaccucaagcuggagaagcccuacaucuacgagggccggcuggagaagaagcaggacaagaaggggagcuuccagaucguguccgccacccacaagaagauccccaccaucgagcgcagccacaagaacaccgagcucucccagaacuucagccccaaguccguccugauccggcagcagauccugccgcgcgagaagacgccgcccaagugcgagauccagggcaacagccucaagcagaacagccagcugcugaaccagcccaagaucaccgccgacaagcgguacaagugcucccucugcgagaagaccuucaucaacaccagcucccugcgcaagcacgagaagaaccacagcggggagaagcuguucaagugcaaggagugcuccaaggcguucagccaguccagcgcccucauccagcaccagaucacgcacaccggcgagaagcccuacaucugcaaggagugcgggaaggccuucacccuguccaccagccuguacaagcaccuccggacgcacaccguggagaaguccuaccgcugcaaggagugcggcaagagcuucucccggcgcagcggccuguucauccaccagaagauccacgccgaggagaaccccugcaaguacaaccccgggcggaaggcguccagcugcuccaccagccuguccggcugccagcgcauccacagccggaagaaguccuaccucugcaacgagugcgggaacaccuucaagagcagcuccagccugcgcuaccaccagcgcauccacacgggcgagaagcccuucaagugcuccgagugcggccgggccuucagccaguccgccagccugauccagcacgagcgcauccacaccggggagaagccguaccggugcaacgagugcggcaagggguucaccuccaucagccgccucaaccggcaccgcaucauccacaccggcgagaaguucuacaacugcaacgagugcgggaaggcccuguccagccacuccacgcugaucauccacgagcggauccacaccggcgagaagcccugcaagugcaaggugugcggcaaggccuuccgccagagcuccgcgcucauccagcaccagcggaugcacaccggggagcgccccuacaagugcaacgagugcggcaagaccuuccggugcaacagcucccugagcaaccaccagcgcauccacacgggggagaagcccuaccggugcgaggagugcggcaucagcuucgggcaguccagcgcccugauccagcaccgccggauccacaccggcgagaagccguucaagugcaacacgugcggcaagaccuuccgccaguccagcucccggaucgcccaccagcgcauccacaccggggagaagcccuacgagugcaacacgugcggcaagcuguucaaccaccggagcucccucaccaaccacuacaagauccacaucgaggaggaccccuga

SEQ ID NO: 39034 - RNA, 1584 nt, Artificial Sequence
  derived and/or modified sequence opt1 from ZNF35__Homo_sapiens__NP_003411
augaccgccgagcugcgcgaggccauggcgcucgcccccuggggcccggugaaggucaagaaggaggaggaggaggaggagaacuuccccgggcaggccagcucccagcagguccacagcgagaacaucaaggugugggcccccgugcagggccugcagaccgggcuggacggcuccgaggaggaggagaaggggcagaacaucagcugggacauggccguggugcucaaggcgacccaggaggcccccgccgccuccacccugggcagcuacucccugccgggcacccucgccaagagcgagauccuggagacccacgggacgaugaacuuccugggcgcggagaccaagaaccuccagcugcugguccccaagaccgagaucugcgaggaggccgagaagccccucaucaucuccgagcggauccagaaggccgacccccaggggccggagcugggcgaggccugcgagaaggggaacaugcugaagcgccagcggaucaagcgcgagaagaaggacuuccgccaggugaucgugaacgacugccaccuccccgagagcuucaaggaggaggagaaccagaagugcaagaaguccggcggcaaguacagccugaacuccggggcggucaagaaccccaagacccagcugggccagaagcccuucacgugcagcgugugcgggaagggcuucucccagagcgccaaccucgugguccaccagcggauccacaccggcgagaagccguucgagugccacgagugcgggaaggccuucauccaguccgccaaccugguggugcaccagcggauccacaccggccagaagcccuacgucugcagcaagugcgggaaggccuucacccaguccagcaaccugacggugcaccagaagauccacagccucgagaagaccuucaagugcaacgagugcgagaaggcguucuccuacagcucccagcuggcccgccaccagaaggugcacaucaccgagaagugcuacgagugcaacgagugcggcaagaccuucacgcggagcuccaaccugaucguccaccagcgcauccacaccggggagaagcccuucgccugcaacgacugcggcaaggccuucacccagagcgccaaccucaucgugcaccagcggucccacaccggcgagaagcccuacgagugcaaggagugcgggaaggcguucagcugcuucucccaccugaucgugcaccagcgcauccacacggccgagaagccguacgacugcagcgagugcggcaaggccuucucccagcugagcugccucaucguccaccagcggauccacuccggggaccugcccuacgugugcaacgagugcggcaaggccuucacgugcagcuccuaccugcucauccaccagcgcauccacaacggggagaagcccuacacgugcaacgagugcggcaaggccuuccggcagcgcagcucccugaccgugcaccagcggacccacaccggcgagaagcccuacgagugcgagaagugcggggcggccuucaucagcaacucccaccugaugcgccaccaccggacccaccucgucgaguga

SEQ ID NO: 39035 - RNA, 1224 nt, Artificial Sequence
  derived and/or modified sequence opt1 from ZNF365__Homo_sapiens__NP_055766
augcagcagaaggccuucgaggagagccgcuaccccuggcaggaguccuucgagaacguggccgucugccugccgcuccggugcccccgcugcggcgaccacacccgguuccgcagccuguccagccugcgggcgcaccucgaguucucccacagcuacgaggagcgcacccugcugacgaagugcucccucuuccccagccugaaggacaccgaccuggugaccuccagcgagcuccugaagcccgggaagcugcaguccagcggcaacguggucaagcagaagccguccuacgugaaccucuacagcaucucccacgagcacagcaaggaccggaagcccuucgagguggucgccgagcgccccguguccuacgugcagaccuacacggccauggaccugcacgccgacagccuggacgggacccgguccggccccgggcucccgaccagcgacaccaaggccagcuucgaggcgcacguccgcgagaaguucaaccggaugguggaggccguggaccgcacgaucgagaagcggaucgacaagcugaccaaggagcuggcccagaagaccgccgagcuccuggagguccgcgcggccuucgugcagcugacccagaagaagcaggaggugcagcggcgcgagcgggcccucaaccgccaggucgacguggccguggagaugaucgccguccugcggcagcgccugacggaguccgaggaggagcuccugcggaaggaggaggagguggugaccuucaaccacuuccuggaggcggccgccgagaaggagguccagggcaaggcccgccuccaggacuucaucgagaaccugcugcagcgcguggagcucgccgagaagcagcuggaguacuaccagagccagcaggcguccggcuucgugcgggaccugagcgggcacguccucaccgacaucuccagcaaccgcaagcccaagugccugucccggggccacccccacagcgugugcaaccaccccgaccugaaggcccacuuccacccgaaggggcgcaaccaccucaagaaggccaaggacgaccgggccuccaugcagcccgccaaggcgauccacgagcaggccgagagcucccgcgaccugugccggccgcccaagaagggcgagcugcucggguucggccgcaagggcaacauccggcccaagauggccaagaagaagcccaccgccaucgucaacaucaucuga

SEQ ID NO: 39036 - RNA, 2235 nt, Artificial Sequence
  derived and/or modified sequence opt1 from ZNF366__Homo_sapiens__NP_689838
augcagaaggagaugaagaugaucaaggacgaggacgugcacuucgaccuggccgucaagaagacccccagcuucccgcacugccuccagcccguggccucccgcggcaaggcgccccagcggcaccccuucccggaggcccugcgcgggcccuucagccaguuccgguacgagcccccgcccggcgaccuggacggguuccccggcguguucgagggggccggcucccgcaagcgcaagagcaugcccaccaagaugcccuacaaccacccggccgaggaggucacgcucgcccugcacuccgaggagaacaagaaccacggccugcccaaccucccccugcuguucccccagccgccccggcccaaguacgacagccagaugaucgaccucugcaacgugggguuccaguucuaccggucccuggagcacuucggcgggaagcccgugaagcaggagccgaucaagcccagcgcggucuggccccagcccaccccgacccccuuccugcccacccccuacccguacuaccccaaggugcaccccggccucauguucccguucuucgugcccuccagcucccccuuccccuucagccgccacacguuccugccgaagcagccgcccgagccccugcucccccggaaggccgagccccaggaguccgaggagaccaagcagaaggucgagcgcguggacgugaacguccagaucgacgacagcuacuacguggacgucgggggcucccagaagcgguggcagugcccgaccugcgagaaguccuacaccagcaaguacaaccuggugacgcacauccugggccacagcgggaucaagccccacgccugcacccacugcggcaagcuguucaagcagcugucccaccuccacacccacaugcucacccaccaggggacgcgcccccacaagugccaggugugccacaaggccuucacccagaccagccaccugaagcggcacaugaugcagcacagcgaggugaagccccacaacugccgcgucugcggccggggcuucgcguaccccuccgagcugaaggcccacgaggccaagcacgccagcgggcgcgagaacaucugcguggagugcggccucgacuuccccacccuggcccagcugaagcggcaccucacgacccaccgcgggccgauccaguacaacugcuccgagugcgacaagaccuuccaguaccccagccagcugcagaaccacaugaugaagcacaaggacauccggcccuacaucugcuccgagugcggcauggaguucgugcagccccaccaccugaagcagcacagccucacccacaagggggucaaggagcacaagugcggcaucugcggccgcgaguucacgcugcuggcgaacaugaagcggcacgugcucauccacaccaacauccgcgccuaccagugccaccugugcuacaaguccuucgugcagaagcagacccugaaggcccacaugaucguccacagcgacgugaagccguucaagugcaagcucugcgggaaggaguucaaccgcaugcacaaccugaugggccacaugcaccuccacuccgacagcaagcccuucaagugccuguacugccccuccaaguucacccugaaggggaaccugacgcggcacaugaaggucaagcacggcgugauggagcgcgggcuccacagccagggccugggccgggggcgcaucgcccuggcccagaccgcgggcgugcuccggucccuggagcaggaggagcccuucgaccugagccagaagcgccgggccaaggucccgguguuccaguccgacggggagagcgcccagggcucccacugccacgaggaggaggaggaggacaacugcuacgagguggagcccuacagccccgggcucgccccgcagucccagcagcugugcacccccgaggaccugagcaccaagagcgagcacgcccccgagguccuggaggaggcgugcaaggaggagaaggaggacgccuccaagggcgagugggagaagcgcagcaagggcgaccucggggccgagggcgggcaggagcgggacugcgccggccgcgacgagugccugucccugcgggccuuccagagcacgcgccggggccccuccuucagcgacuaccucuacuucaagcaccgcgacgagucccugaaggagcugcucgagcggaagauggagaagcaggcggugcugcuggggaucuga

SEQ ID NO: 39037 - RNA, 1053 nt, Artificial Sequence
  derived and/or modified sequence opt1 from ZNF367__Homo_sapiens__NP_710162
augauccgcggcuucgaggcccccauggccgagaacccgcccccgccgcccccgcccgugaucuucugccacgacagccccaagcggguccugguguccgugauccgcaccacccccaucaagcccacgugcgggggcgggggcgagcccgagcccccgccgccccucauccccaccagccccggguucuccgacuucauggucuaccccuggcgguggggcgagaacgcccacaacgugacccugagccccggcgccgccggggccgccgcguccgccgcccugcccgccgcggccgccgccgagcacagcggccuccgcgggcggggcgccccgccgcccgcggccuccgccagcgccgccgcguccgggggcgaggacgaggaggaggccagcucccccgacagcggccaccugaaggacgggauccgccggggccgcccccgggccgacaccgugcgcgaccugaucaacgagggggagcacuccagcucccggauccgcugcaacaucugcaaccgggucuucccccgcgagaagucccuccaggcccacaagcggacgcacaccggcgagcgccccuaccugugcgacuaccccgacugcggcaaggccuucgugcagagcgggcagcugaagacccaccagcggcuccacaccggcgagaagcccuucgugugcagcgagaacgggugccugucccgcuucacgcacgcgaaccggcacugccccaagcaccccuacgcccgccugaagcgggaggagccgaccgacacccucagcaagcaccaggccgccgacaacaaggccgcggccgaguggcuggcccgcuacugggagaugcgcgagcagcggacccccacgcugaagggcaagcucguccagaaggccgaccaggagcagcaggacccccuggaguaccugcagagcgacgaggaggacgacgagaagcgcggggcgcagcggcgccuccaggagcagcgggagcgccugcacggcgcccuggcccucaucgagcuggccaaccugaccggcgcgccccuccggcaguga

SEQ ID NO: 39038 - RNA, 1650 nt, Artificial Sequence
  derived and/or modified sequence opt1 from ZNF382__Homo_sapiens__NP_001243767
augagccagggcuccgugagcuucaaggacgucaccguggacuucacccaggaggaguggcagcagcuggaccccgcccagaaggcccucuaccgcgacgugaugcuggagaacuacugccacuucgucuccgugggguuccacauggcgaagccggacaugauccggaagcuggagcagggcgaggagcucuggacgcagcgcaucuuccccagcuacuccuaccuggaggaggacgggaagaccgaggacgugcuggucaaguucaaggaguaccaggaccggcacagccgcccccucaucuucaucaaccacaagaagcugaucaaggagcgguccaacaucuacggcaagaccuucacccuggggaagaaccgcaucagcaagacgauccucugcgaguacaagcccgacggcaaggugcugaagaacaucuccgagcuggugauccggaacaucagcccgaucaaggagaaguucggcgacuccaccgggugggagaagucccuccugaacaccaagcacgagaagauccaccccgccgucaaccugcacaagcagaccgagcgcgugcucagcggcaagcaggagcugauccagcaccagaaggugcaggcccccgagcagcccuucgaccacaacgagugcgagaaguccuuccugaugaaggggaugcuguucacgcacacccgggcccaccgcggcgagcggaccuucgaguacaacaaggacgggaucgccuucaucgagaaguccagccucagcguccacccgagcaaccugauggagaagaagcccuccgcguacaacaaguacggcaaguuccucugccgcaagcccguguucaucaugccccagcggccgcagaccgaggagaagcccuuccacugccccuacugcggcaacaacuuccgccgcaagagcuaccugaucgagcaccagcggauccacacgggggagaagcccuacgugugcaaccagugcggcaaggccuuccggcagaagaccgcccugacccuccacgagaagacccacaucgaggggaagccguucaucugcaucgacugcggcaagagcuuccgccagaaggccacgcugacccggcaccacaagacccacaccggcgagaaggcguacgagugcccccagugcggguccgccuuccgcaagaaguccuaccugaucgaccaccagcggacgcacaccggcgagaagcccuaccagugcaacgagugcgggaaggccuucauccagaagaccacccucacgguccaccagcgcacccacaccggcgagaagcccuacaucugcaacgagugcggcaagagcuucugccagaagaccacgcugacccugcaccagcgcauccacaccggggagaagccguacaucugcaacgagugcggcaagagcuuccggcagaaggccauccucaccgugcaccaccgcauccacacgggggagaaguccaacggcugcccccagugcgggaaggccuucagccggaaguccaaccugauccgccaccagaagacccacaccggcgagaagcccuacgagugcaagcagugcgggaaguucuucagcugcaaguccaaccugaucgugcaccagaagacccacaaggucgagacgaccggcauccaguga

SEQ ID NO: 39039 - RNA, 1428 nt, Artificial Sequence
  derived and/or modified sequence opt1 from ZNF383__Homo_sapiens__XP_011524892
auggccgagggcagcgugauguucuccgacgucagcaucgacuucucccaggaggagugggacugccuggaccccgugcagcgcgaccucuaccgggacgugaugcuggagaacuacgggaaccuggucagcaugggccucuacaccccgaagccccaggugaucucccugcuggagcaggggaaggagcccuggauggugggccgcgagcucacccgggggcugugcagcgaccuggaguccaugugcgagacgaagcuccugagccugaagaaggaggucuacgagaucgagcucugccagcgcgagaucaugggccugaccaagcacggccuggaguacuccagcuucggggacgugcucgaguaccggucccaccuggccaagcagcugggcuaccccaacgggcacuucagccaggagaucuucaccccggaguacaugcccaccuucauccagcagacguuccucacccugcaccagaucaucaacaacgaggaccgccccuacgagugcaagaagugcggcaaggcguucucccagaacagccaguucauccagcaccagcggauccacaucggggagaaguccuacgagugcaaggagugcggcaaguucuucagcugcggcucccacgugacccgccaccugaagauccacaccggggagaagcccuucgagugcaaggagugcggcaaggccuucagcugcuccagcuaccucagccagcaccagcggauccacacggggaagaagccguacgagugcaaggagugcggcaaggccuucuccuacugcagcaaccugaucgaccaccagcgcauccacaccggcgagaagcccuacgagugcaaggucugcgggaaggccuucaccaaguccagccagcuguuccagcacgcccggauccacaccggcgagaagcccuacgagugcaaggagugcgggaaggcguucacgcaguccagcaagcucgugcagcaccagcgcauccacaccggcgagaagcccuacgagugcaaggagugcgggaaggccuucuccagcggcuccgcccugaccaaccaccagcggauccacaccggcgagaagccguacgacugcaaggagugcgggaaggccuucacgcagagcucccagcugcgccagcaccagcggauccacgcgggcgagaagcccuucgagugccucgagugcgggaaggccuucacccagaacagccagcuguuccagcaccagcgcauccacaccgacgagaagcccuacgagugcaacgagugcggcaaggccuucaacaagugcuccaaccugacccggcaccuccgcauccacacgggggagaagcccuacaacugcaaggagugcggcaaggccuucagcuccggcagcgaccugauccggcaccaggggauccacaccaacaaguga

SEQ ID NO: 39040 - RNA, 1386 nt, Artificial Sequence
  derived and/or modified sequence opt1 from ZNF384__Homo_sapiens__NP_001035009
auggaggagagccacuucaacuccaaccccuacuucuggcccagcauccccaccguguccggccagaucgagaacaccauguucaucaacaagaugaaggaccagcugcuccccgagaaggggugcggccuggcgcccccgcacuaccccacgcugcucaccguccccgccagcgugucccugcccagcgggaucuccauggacaccgagagcaaguccgaccagcugaccccgcacagccaggccuccgugacgcagaacaucaccgucgugcccgugcccagcaccggccucaugaccgccgcccugcaggucgugcccgaccuguccaagaagguggccagcacgcucaccgaggagggcgggggcgggggcgggggcgggggcuccgucgccccgaagccgccccgcggccggaagaagaagcgcaugcuggagagcgggcugcccgagaugaacgaccccuacgugcucucccccgaggacgacgacgaccaccagaaggacggcaagaccuaccggugccgcaugugcagccugaccuucuacuccaagagcgagaugcagauccacagcaagucccacacggagaccaagccccacaagugcccccacugcagcaagaccuucgcgaacuccagcuaccuggcccagcacauccggauccacuccggggccaagccguacagcugcaacuucugcgagaaguccuuccgccagcucagccaccuccagcagcacacccggauccacacgggcgaccgccccuacaagugcgcccaccccggcugcgagaaggcguucacccagcuguccaaccugcagagccaccggcgccagcacaacaaggacaagcccuucaagugccacaacugccaccgggccuacaccgacgccgccucccuggaggugcaccugagcacccacacggucaagcacgccaagguguacacgugcaccaucugcucccgcgcguacaccagcgagaccuaccucaugaagcacaugcggaagcacaacccgcccgaccugcagcagcagguccaggccgccgccgccgcggccgccguggcccaggcccaggcgcaggcccaggcccaggcccaggcccaggcgcaggcccaggcccaggcccaggcgucccaggccagccagcagcagcagcagcagcagcagcagcagcagcagcagcagcagcagcccccgccccacuuccagucccccggggccgcgccccagggcgggggcgggggcgacagcaacccgaacccgccgccccagugcuccuucgaccugacccccuacaagaccgccgagcaccacaaggacaucugccucaccgugacgaccagcaccauccagguggagcaccuggccagcuccuga

SEQ ID NO: 39041 - RNA, 1161 nt, Artificial Sequence
  derived and/or modified sequence opt1 from ZNF385A__Homo_sapiens__NP_001124439
augauccugggcagccucucccgcgccgggccccugccgcugcuccggcagccgcccaucaugcagcccccgcuggaccugaagcagauccuccccuucccccuggagcccgccccgacccugggccucuucagcaacuacuccaccauggaccccgugcagaaggcgguccugagccacacguucgggggcccccugcucaagaccaagcgccccgugaucuccugcaacaucugccagauccgguucaacagccagucccaggccgaggcccacuacaaggggaaccgccacgcccggcgcgugaagggcaucgaggccgcgaagacccggggccgcgagccggggguccgggagcccggcgaccccgccccgcccgggagcacccccacgaacggcgacgggguggcgccccgccccguguccauggagaacggccugggccccgcccccgggagccccgagaagcagcccggcuccccgagcccgcccuccauccccgagaccgggcagggcgucaccaagggcgagggcgggacccccgcccccgccagccugcccgggggcuccaaggaggaggaggagaaggccaagcggcuccuguacugcgcccugugcaagguggccgugaacagccucucccagcuggaggcgcacaacaaggggacgaagcacaagaccauccuggaggcccgcagcggccucggcccgaucaaggccuacccccggcuggggccgcccacccccggcgagcccgaggcccccgcccaggaccgcaccuuccacugcgagaucugcaacgucaaggugaacuccgaggugcagcugaagcagcacaucagcagccggcgccaccgggacggggucgcgggcaagcccaacccgcuccugucccgccacaagaagucccgcggggccggcgagcuggccggcacgcucaccuucuccaaggagcugcccaagagccuggccgggggccuccugcccagcccccuggccguggcggccgugauggccgccgccgcggggagcccgcucucccugcggcccgcccccgccgcgccccugcuccagggcccgcccaucacccacccccugcugcaccccgccccggggcccauccggaccgcccacggccccauccucuucagccccuacuga

SEQ ID NO: 39042 - RNA, 1188 nt, Artificial Sequence
  derived and/or modified sequence opt1 from ZNF385B__Homo_sapiens__NP_001106868
auguggagcggccugcccucccgcgggagcacgugccacaccaccacccucccggcccuggugcggacccccacccugaugaugcagcccucccucgacaucaagcccuucaugagcuucccggucgacuccagcuccgccgugggccuguuccccaacuucaacacgauggaccccgugcagaaggcggucaucaaccacaccuucggggugagcaucccgcccaagaagaagcaggucaucuccugcaacgugugccagcugcgcuucaacagcgacucccaggccgaggcccacuacaagggcagcaagcacgccaagaaggugaaggcccucgacgcgaccaagaacaagcccaagauggugcccuccaaggacagcgccaaggccaaccccuccugcagcaucaccccgaucacggggaacaacuccgacaagagcgaggacaagggcaagcugaaggccuccagcagcucccagcccagcuccagcgaguccggcagcuuccugcucaaguccgggaccacgccccugcccccgggcgcggccaccagccccuccaagagcaccaacggggcccccggcaccgucguggaguccgaggaggagaaggccaagaagcugcucuacugcagccugugcaagguggccgucaacucccugagccagcucgaggcgcacaacaccggguccaagcacaagaccaugguggaggcccggaacggcgccggccccaucaagagcuacccgcgccccgggucccggcugaagaugcagaacggcagcaagggguccggccugcagaacaagacguuccacugcgagaucugcgacgugcacgucaacagcgagauccagcucaagcagcacaucagcucccgccggcacaaggaccgcguggccggcaagccccugaagcccaaguacagcccguacaacaagcugcagcggucccccagcauccucgccgcgaagcuggccuuccagaaggacaugaugaagccccuggcccccgccuuccucuccagcccgcuggccgcggccgccgccguguccagcgcccugucccucccgccccgccccagcgcgucccuguuccaggcccccgccaucccgcccgcccugcuccggcccgggcacggccccauccgcgcgacccccgccagcauccuguucgcccccuacuga

SEQ ID NO: 39043 - RNA, 1188 nt, Artificial Sequence
  derived and/or modified sequence opt1 from ZNF385D__Homo_sapiens__NP_078973
augcgcaacaucauguacuucggcgggaccugccagagccccgcccugccggcccucgugcggccgcccgcgccgccccugcagcccucccuggacaucaagcccuuccuccccuucccccuggacaccgccgccgccgucaaccuguuccccaacuucaacgccauggaccccauccagaaggcggugaucaaccacacguucggcgugccccucccgcaccgccggaagcagaucaucagcugcaacaucugccagcugcgcuucaacuccgacagccaggccgccgcccacuacaaggggaccaagcacgcgaagaagcugaaggcccucgaggccaugaagaacaagcagaaguccgucaccgccaaggacagcgccaagaccacguucaccuccaucaccaccaacacgaucaacaccagcuccgacaagaccgacggcaccgcggggacgcccgccaucagcaccaccaccacgguggagauccggaaguccagcgugaugaccaccgagaucaccuccaaggucgagaagucccccacgaccgccaccggcaacagcagcugccccuccaccgagacggaggaggagaaggccaagcgccugcuguacugcagccucugcaagguggccgugaacuccgcgagccagcuggaggcccacaacagcggcaccaagcacaagaccaugcuggaggcccggaacggguccggcaccaucaaggccuucccgcgcgccggggucaagggcaaggggcccgugaacaagggcaacacgggccuccagaacaagaccuuccacugcgagaucugcgacgugcacgucaacagcgagacccagcugaagcagcacaucuccagccggcgccacaaggaccgggcggccgggaagccgcccaagcccaaguacucccccuacaacaagcugcagaagaccgcccacccccucggcgugaagcugguguucagcaaggagcccuccaagccgcuggcgccccgcauccuccccaacccccuggccgccgccgccgccgcggccgccgucgccgugagcuccccguucagccugcggacggcccccgcggccacccucuuccagaccuccgcccugcccccggcccugcuccgccccgcccccgggcccauccggaccgcgcacacgccggugcuguucgcccccuacuga

SEQ ID NO: 39044 - RNA, 1077 nt, Artificial Sequence
  derived and/or modified sequence opt1 from ZNF391__Homo_sapiens__XP_011512871
auggagagccugcgcggcaacaccgcccaggggcccaccaacgaggaggacuacaagaacgagggccagcugucccggcagacgaagugcccggcccagaagaaguccagcuucgagaacaccgugguccgcaaggugagcgugacccugaaggagaucuucaccggggaggagggccccgaguccagcgaguucucccugagccccaaccucgacgcgcagcagaagauccccaaggggcacggcuccccgaucagccggaagaacuccaaggacaacagcgaccugaucaagcaccagcgccuguucucccagcggaagcccugcaagugcaacgagugcgagaaggccuucagcuaccaguccgaccuccugguccacagccgcauccacggcggggagaagcccuucgagugcaacaagugcggcaaguccuucagccgguccacgcaccugaucgagcaccagcgcacccacaccggggagaagcccuacgagugcaacgagugcggcaaggccuucagccggagcacccaccucucccugcaccagcgcauccacacgggggagaagccguacgagugcagcgagugcggcaaggccuucucccggagcaccaaccugucccagcaccagcgcacccacacccaggagcggcccuacaagugcaacgagugcggcaaggccuucggggaccgcagcacgaucauccagcaccagcggauccacaccggcgagaaccccuacgagugcuccaagugcgggaaggcguucagcuggaucuccagccucaccgagcaccagcgcacccacacgggcgagaaccccuacgagugcuccgagugcggcaagguguucagccgguccagcucccugaccgagcaccagcgcauccacagcggggagaagccgcacgagugccgggugugcggcaagggguucucccgcagcuccagccugaucauccaccagcggacccacaccggcgagaagcccuacaagugcaacgacugcgggaaggccuucugccagagcuccacgcucauccgccaccagcaccuccacaccaaggaguga

SEQ ID NO: 39045 - RNA, 1542 nt, Artificial Sequence
  derived and/or modified sequence opt1 from ZNF395__Homo_sapiens__NP_061130
auggccagcgugcugucccgccggcucggcaagcgcagccugcugggggcccggguccucggccccuccgcgagcgaggggccguccgccgccccgcccagcgagccccugcuggagggcgccgcgccccagcccuucaccaccuccgacgacacgcccugccaggagcagcccaaggaggugcucaaggccccgagcaccuccgggcugcagcaggucgccuuccagcccggccagaagguguacgugugguacggcgggcaggagugcaccggccugguggagcagcacagcuggauggaggggcaggucaccguguggcuccuggagcagaagcuccaggugugcugccgcgucgaggagguguggcuggccgagcugcagggccccugcccccaggccccgccccuggagcccggggcgcaggcccucgccuaccggcccgugucccgcaacaucgacgucccgaagcgcaagagcgacgccguggagauggacgagaugauggccgcgauggugcugacgucccugagcugcucccccgucgugcagagcccgcccggcaccgaggccaacuucuccgccagccgggccgccugcgaccccuggaaggaguccggcgacaucagcgacagcggguccagcaccaccuccggccacuggagcggguccagcggcguguccacgcccagcccgccccacccccaggcgucccccaaguaccucggcgacgccuucgggagcccccagaccgaccacggcuucgagaccgaccccgacccguuccugcuggacgagcccgcgccccggaagcgcaagaacuccgucaaggugauguacaagugccucuggccgaacugcgggaaggugcugcggagcaucgucggcaucaagcgccacgugaaggcccugcaccucggggacaccguggacuccgaccaguucaagcgggaggaggacuucuacuacacggagguccagcugaaggaggagagcgccgccgccgccgccgccgcggccgccggcacccccgugcccggcacccccaccuccgagccggcccccacgcccagcaugaccgggcugccccucuccgcgcugccgccgccccugcacaaggcccagagcuccggccccgagcaccccgggcccgagagcagccuccccuccggcgcccugagcaaguccgcccccgggagcuucuggcacauccaggccgaccacgcguaccaggcccugccguccuuccagauccccgucagcccccacaucuacaccuccgugagcugggccgccgcccccuccgcggccugcagccucuccccggugcgcagccggucccugagcuucuccgagccccagcagcccgcccccgccaugaagucccaccugaucgucaccagcccgccccgcgcccagagcggcgcgcggaaggcccgcggcgaggccaagaagugccggaagguguacgggaucgagcaccgcgaccaguggugcacggccugccgguggaagaaggcgugccagcgcuuccucgacuga

SEQ ID NO: 39046 - RNA, 1416 nt, Artificial Sequence
  derived and/or modified sequence opt1 from ZNF398__Homo_sapiens__NP_065832
augaagggcaacuacgagagccugaucuccauggacuacgccaucaaccagcccgacgugcucagccagauccagcccgagggggagcacaacaccgaggaccaggccggccccgaggaguccgagauccccaccgaccccagcgaggagccggggaucuccacgagcgacauccuguccuggaucaagcaggaggaggagccccaggucggcgcgccgcccgagagcaaggaguccgacguguacaagagcaccuacgccgacgaggagcuggugaucaaggccgaggggcucgcccgcuccagccugugccccgagguccccgugcccuucuccagcccgcccgccgcggccaaggacgccuucuccgacguggccuucaagagccagcaguccaccagcaugacccccuucggccggcccgcgacggaccugcccgaggccuccgagggccaggucaccuucacccagcucgggagcuacccgcugcccccgcccgugggcgagcaggucuucagcugccaccacugcgggaagaaccugucccaggacaugcuccugacccaccagugcagccacgccacggagcacccccugcccugcgcccagugccccaagcacuucacgccccaggccgaccucuccagcaccucccaggaccacgcgagcgagaccccgccgaccugcccccacugcgcccgcaccuucacccaccccucccggcugaccuaccaccuccgcgugcacaacagcacggagcggcccuuccccugccccgacugcccgaagcgcuucgccgaccaggcccggcugaccucccaccgccgggcccacgcgagcgagcgccccuuccggugcgcccagugcggccgcuccuucagccugaagaucucccugcuccugcaccagcgggggcacgcccaggagcgccccuucagcugcccccagugcggcaucgacuucaacggccacuccgcccugauccggcaccagaugauccacaccggggagcgcccguaccccugcaccgacugcagcaaguccuucaugcggaaggagcaccuccugaaccaccgccggcugcacacgggcgagcgccccuucagcugcccccacugcgggaaguccuucauccggaagcaccaccucaugaagcaccagcgcauccacaccggcgagcgcccguaccccugcagcuacugcggccggagcuuccgcuacaagcagacccugaaggaccaccuccgguccgggcacaacggcgggugcggcggggacagcgaccccuccggccagcccccgaacccgcccggcccccugaucaccgggcuggagacgagcggccugggggugaacaccgagggccucgagaccaaccagugguacggggagggcuccggcgggggcgugcuguga

SEQ ID NO: 39047 - RNA, 5448 nt, Artificial Sequence
  derived and/or modified sequence opt1 from ZNF407__Homo_sapiens__NP_001139661
augauggacagcgagaacaagcccgagaacgacgaggacgagaagaucaacaaggaggcccaggaccugaccaagcugagcagccacaacgaggacggcgggccggugagcgacgugaucgccagcuuccccgagaacuccaugggcaagcgcggguucagcgaguccagcaacuccgacagcguggugaucggcgaggaccggaacaagcacgcguccaagcgccggaagcuggacgaggccgagccccucaagagcgggaagcagggcaucugccgccucgagaccuccgagagcuccgucaccgagggcgggaucgcccuggacgagaccggcaaggagaccuuccugagcgacugcaccgucggcgggaccugccuccccaacgcccugucccccagcugcaacuucuccaccaucgacguggucagccugaagaccgacaccgagaagacgagcgcccaggagauggugucccucgaccuggagcgggagagccccuucccgcccaaggagaucuccgugagcugcaccaucgggaacgucgacaccgugcugaagugcuccaucugcgggcaccucuucagcuccugcagcgaccuggagaagcacgcggagucccacaugcagcagccgaaggagcacacgugcugccacugcagccacaaggccgaguccagcuccgcccugcacaugcacaucaagcaggcccacggcccccagaagguguucagcugcgaccucugcggguuccagugcuccgaggagaaccugcugaacgcgcacuaccucggcaagacgcaccuccgccggcagaaccuggccgcccgcgggggcuucguccagauccucaccaagcagcccuuccccaagaagucccggaccauggccaccaagaacgugcacuccaagccgcgcacgagcaaguccaucgccaagaacagcgacagcaagggccugcggaacgugggguccaccuucaaggacuuccgcggcagcaucuccaagcagagcggguccagcuccgagcugcucgucgagaugaugcccagccggaacacccugucccaggagguggagaucguggaggagcacgucaccagccugggccucgcgcagaaccccgagaaccagucccgcaagcuggacacgcuggugaccagcgaggggcuccuggagaagcuggaguccaccaagaacacccuccaggccgcccacggcaacagcgugacgucccggccccgcccggagcggaacauccugguccugggcaacagcuuccgccggcgcuccagcaccuucacccucaaggggcaggccaagaagcgguucaaccugcugggcaucaagcgcgggaccagcgagacgcagcgcauguacaugaagcaccuccggacccagaugaagacccacgacgccgaguccgugcugaagcaccuggaggcgugcagcuccgugcagcgcgucugcgugaccacgagcgagacccaggaggccgagcagggccagggguccgcccggccgcccgacagcggccuccacucccugaccgucaagcccgccagcggcucccagacccugugcgccugcacggacugcggccagguggcgaccaaccgcaccgaccucgagauccacgugaagcggugccacgcccgcgagaugaaguucuacugccggaccugcgacuucagcuccaugagccgccgggaccuggacgagcaccuccacuccaaccagcaccagcagaccgccagcguccucuccugccagugcugcagcuucaucucccuggacgagaucaaccugcgcgaccacaugaaggagaagcacaacaugcacuuccugugcacgcccugcaaccucuucuuccugagcgagaaggacguggaggagcacaaggccaccgagaagcacaucaacucccuggugcagcccaagacccuccagagcagcaacuccgaccugguccugcagacccucccccugagcacgcuggaguccgagaacgccaaggagagcauggacgacuccggcaaggcgagccaggaggagccccucaagucccgggugagccacgggaacgaggugcgccacuccagcaagccgcaguuccagugcaagaagugcuucuacaagacccgguccagcaccguccugacccgccacaucaagcugcggcacggccaggacuaccacuuccucugcaaggccugcaaccuguacucccugagcaaggaggggauggagaagcacaucaagcgcuccaagcaccucgagaacgccaagaagaacaacaucggccugagcuucgaggagugcaucgagcgggugugcaucggcgccaacgacaagaaggaggaguucgacguguccgggaacggccgcaucgaggggcacaucggcguccagcugcaggagcacagcuaccucgagaagggcaugcuggcguccgaggagcugagccagagcgggggcuccacgaaggacgacgagcucgccagcaccaccacccccaagcgggggcgccccaagggcaacaucucccgcacgugcagccacugcgggcugcuggccuccagcaucaccaaccucaccgugcacauccggcgcaagcacucccaccaguacagcuaccugugcaaggugugcaaguacuacaccgucacgaagggcgacauggagcggcacugcgccaccaagaagcacaagggccgcguggagaucgaggccuccgggaagcacagcuccgacaucaucgugggccccgagggcgggagccuggaggcggggaagaagaacgccggcuccgccgucaccaugagcgacgagcacgccaacaagccggccgagucccccaccagcgugcucgagaagcccgaccggggcaacuccaucgaggcggagguggagaacgucuuccacagccuggacggggaggugaacucccaccuccuggacaagaaggagcagaucagcagcgagccggaggacuucgcccagcccggcgacguguacucccagcgcgacgucacggggaccggcgagaacaagugccugcacugcgaguucagcgcccacuccagcgccucccuggagcugcacgugaagcggaagcacaccaaggaguucgaguucuacugcauggccugcgacuacuacgcggugacccgccgggagaugacgcgccacgccgccaccgagaagcacaagaugaagcggcagagcuaccugaacuccgccaacgucgaggcggggagcgccgacauguccaagaacaucaucaugcccgaggaggagcaccagcagaacagcgaggaguuccagaucaucuccggccagcccagcgacacccugaagucccgcaacgccgccgacugcagcauccucaacgagaacaccaaccuggacauguccaaggugcugugcgccgcggacagcguggaggucgagacggaggaggaguccaacuucaacgaggaccacagcuucugcgagaccuuccagcaggccccggugaaggacaaggugcggaagcccgaggagaugaugucccucaccaugagcagcaacuacggcucccccagccgcuuccagaacgagaacuccgggagcuccgcccugaacugcgagaccgccaagaagaaccacgagaucagcaacgacgccggcgagcugcggguccacugcgagggggagggcgggaacgcgggcgacggcgggggcguggugccccaccgccaccucugcccggucacgcuggacggggagcgguccgccgagagccccgugcugguggucacccgcaucacccgggagcagggcaaccucgaguccggcgggcagaaccgcguggcccggggccacgggcuggaggaccugaagggcgugcaggaggaccccguccucgggaacaaggagauccugaugaacagccagcacgagaccgaguucauccuggaggaggacggccccgccuccgacagcacgguggaguccagcgacguguacgagaccaucaucuccaucgacgacaagggccaggccauguacagcuucgggcgcuucgacuccagcaucauccgcaucaagaacccggaggacggcgagcucaucgaccaguccgaggaggggcugaucgcgaccggcguccggaucagcgagcugccccucaaggacugcgcccagggggugaagaagaagaaguccgagggcuccagcaucggcgaguccacccgcauccggugcgacgacugcggguuccuggccgacggccugagcgggcucaacgugcacaucgccaugaagcaccccaccaaggagaagcacuuccacugccugcugugcggcaaguccuucuacacggagagcaaccuccaccagcaccuggcguccgccgggcacaugcgcaacgagcaggccagcgucgaggagcugcccgagggcggcgccaccuucaagugcgugaagugcaccgagccguucgacuccgagcagaaccucuuccugcacaucaaggggcagcacgaggagcugcuccgggaggugaacaaguacaucgucgaggacaccgagcagaucaaccgcgagcgggaggagaaccagggcaacgugugcaaguacugcgggaagaugugccgcagcuccaacagcauggccuuccuggcgcacauccggacgcacaccggcuccaagcccuucaagugcaagaucugccacuucgccaccgcccagcugggcgacgcccgcaaccacgucaagcggcaccucgggaugcgcgaguacaagugccacgugugcggcguggccuucgucaugaagaagcaccugaacacccaccuccuggggaagcacggcguggggacgcccaaggagcggaaguucacgugccaccugugcgaccgcagcuucaccgagaagugggcgcugaacaaccacaugaagcugcacaccggcgagaagcccuucaagugcacguggccgaccugccacuacuccuuccugaccgccagcgccaugaaggaccacuaccggacccacacgggcgagaaguccuuccugugcgaccucugcggguucgccggcgggacccgccacgcccugaccaagcaccggcgccagcacaccggcgagaagcccuucaagugcgacgagugcaacuucgcgagcacgacccagagccaccugacccggcacaagcgcgugcacaccggggagaagcccuaccgcugccccuggugcgacuaccgguccaacugcgccgagaacauccgcaagcacauccuccacacgggcaagcacgagggcgucaagauguacaacugcccgaagugcgacuacgggaccaacgugcccguggaguuccggaaccaccugaaggagcagcaccccgacaucgagaacccggaccuggccuaccuccacgccggcaaggggcagaagcuguga

SEQ ID NO: 39048 - RNA, 1551 nt, Artificial Sequence
  derived and/or modified sequence opt1 from ZNF410__Homo_sapiens__NP_001229853
augcugagcgacgagcucgaguccaagcccgagcugcuggugcaguucguccagaacaccagcaucccgcucggccaggggcugguggaguccgaggccaaggacaucacgugccugagccuccugcccgugaccgaggccuccgagugcagccgccugaugcuccccgagcccgucccguggcgggaggaggacggcaaguccgggugcagcgaccugaacgacaccaccaaccacuccaacagcuccaaggaggugcccagcuccgcggugcugcgcagccuccgggucaacgugggccccgacggggaggagacccgcgcccagacggugcagaagucccccgaguuccugagcaccuccgagagcuccagccugcuccaggaccugcagccgagcgacuccaccagcuucauccugcucaaccugacccgggccggccugggcuccagcgccgagcaccucgucuucgugcaggacgaggccgaggacuccgggaacgacuuccugagcuccgagagcacggacuccagcauccccugguuccugcgcgugcaggagcucgcgcacgacucccugaucgccgccacccgggcccagcuggcgaagaacgccaagaccagcuccaacggcgagaacguccaccucgggagcggcgacgggcaguccaaggacagcggcccccugccccagguggagaagaagcugaagugcaccguggagggcugcgaccgcacguucgucuggccggcccacuucaaguaccaccucaagacccaccggaacgaccgcuccuucaucugccccgccgaggggugcggcaagagcuucuacgugcugcagcggcugaaggugcacaugcgcacccacaacggggagaagcccuucaugugccacgaguccggcugcggcaagcaguucaccacggccgggaaccucaagaaccaccggcgcauccacaccggcgagaagcccuuccugugcgaggcgcaggggugcggccggagcuucgccgaguacagcucccugcgcaagcaccucgucgugcacagcggggagaagccgcaccagugccaggugugcggcaagaccuucucccagagcggcucccggaacguccacaugcgcaagcaccaccuccagcugggggccgccggcagccaggagcaggagcagaccgccgagccccugaugggguccagccugcuggaggaggcguccgugcccagcaagaaccucguguccaugaacagccagcccucccugggcggggagagccugaaccucccgaacacgaacuccauccugggcgucgacgacgaggugcuggccgagggcagcccccggucccucagcagcguccccgacgugacccaccaccuggugaccaugcaguccgggcgccagagcuacgaggucuccgugcugaccgccgugaacccccaggagagccuggccccgcucccccggcuggagugcuccggcgccuucagcgcgcacugcaaccugugccuccccggguccagcgacucccccgccagcgccuccuga

SEQ ID NO: 39049 - RNA, 1668 nt, Artificial Sequence
  derived and/or modified sequence opt1 from ZNF415__Homo_sapiens__NP_001129510
auggacggcgacgggcugaccuuccgcgacguggccaucgaguucagccaggacgaguggaagugccucaacuccacccagcggacgcuguaccgcgacgucaugcuggagaacuaccggaaccucgugagccuggaccugucccgcaacugcgugaucaaggagcucgcgccccagcaggagggcaacccgggggaggucuuccacaccgugacccuggagcagcacgagaagcacgacaucgaggaguucugcuuccgggagaucaagaagaagauccacgacuucgacugccaguggcgcgacgacgagcggaacugcaacaaggugaccacggcccccaaggagaaccugaccugccgccgggaccagcgcgaccggcgcggcaucgggaacaagagcaucaagcaccagcucggccuguccuuccugccccacccccacgagcuccagcaguuccaggccgagggcaagaucuacgagugcaaccacgucgagaaguccgugaaccacgggagcagcguguccccgccccagaucaucagcuccaccaucaagacccacgucagcaacaaguacggcacggacuucaucugcuccagccugcugacccaggagcagaaguccugcauccgggagaagcccuaccgcuacaucgagugcgacaaggcccucaaccacgggagccacaugaccgugcgccaggugucccacagcggcgagaagggguacaagugcgaccugugcggcaaggucuucucccagaaguccaaccuggcccggcacuggcgggugcacaccggcgagaagcccuacaagugcaacgagugcgaccgcagcuucagccggaacagcugccucgcccugcaccgccgggugcacacgggggagaagccguacaagugcuacgagugcgacaaggucuucucccgcaacagcugccuggcgcuccaccagaagacccacaucggcgagaagcccuacacgugcaaggagugcgggaaggccuucuccgugcgcagcacccugaccaaccaccaggugauccacuccggcaagaagcccuacaagugcaacgagugcggcaaggucuucagccagaccuccagccuggccacccaccagcggauccacaccggggagaagcccuacaagugcaacgagugcggcaagguguucucccagacgagcucccucgcccgccacuggcggauccacaccggggagaagccguacaagugcaacgagugcggcaagguguucagcuacaacucccaccuggcgagccaccgccggguccacaccggggagaagcccuacaagugcaacgagugcggcaaggccuucuccgugcacagcaaccugaccacgcaccaggugauccacaccggcgagaagcccuacaagugcaaccagugcgggaagggcuucuccguccacagcagccucaccacccaccaggugauccacacgggggagaagcccuacaagugcaacgagugcggcaaguccuucagcguccgcccgaaccugacccggcaccagaucauccacaccgggaagaagcccuacaagugcuccgacugcggcaagagcuucuccgugcgccccaaccuguuccggcaccagaucauccacaccaaggagaagcccuacaagcgcaacuga

SEQ ID NO: 39050 - RNA, 1536 nt, Artificial Sequence
  derived and/or modified sequence opt1 from ZNF419__Homo_sapiens__NP_001091961
auggccgccgcggcccugcgcgaccccgcccaggugccggucgccgccgaccuccugaccgaccacgaggagcagggcuacgugaccuucgaggacguggcggucuacuucagccaggaggaguggcggcugcucgacgacgcccagcgccugcuguaccggaacgugaugcucgagaacuucacgcugcuggccucccucgggcuggccagcuccaagacccacgagaucacccagcuggagagcugggaggagcccuucaugcccgcgugggagguggucaccuccgccaucccccgcggcugcuggcacggggccgaggccgaggaggccccggagcagaucgcgagcgugggccuccuguccagcaacauccagcagcaccagaagcagcacugcggggagaagccccugaagcggcaggagggccgcgugcccguccuccgguccugcaaggugcaccugagcgagaagucccugcagagccgcgaggugggcaaggcccuccugaucuccagcgggguccugaagcaccaggugacgcacaccggcgagaagucccaccggagcuccaagagccgcgaggccuuccacgccgggaagcggcacuacaagugcuccgagugcggcaaggccuucgggcagaaguaccuccuggugcagcaccagcgccugcacgcgggcaagaagaccuacgagugcagcgagugcggcaagcuguuccgggacaugagcaaccucuucauccaccagaucguccacaccggggagcgccccuacggcugcuccaacugcggcaagagcuucucccggaacgcccaccugaucgagcaccagcgcgugcacacgggggagaagccguucacgugcagcgagugcggcaaggccuuccggcacaacuccacccucgugcagcaccacaagauccacaccgggguccgccccuacgagugcagcgagugcggcaagcuguucuccuucaacagcucccugaugaagcaccagcggauccacaccggggagcgccccuacaagugcagcgagugcggcaaguucuacucccacaagagcaaccucaucaagcacuggcgggugcacaccggggagcgccccuacaagugcuccgacugcggcaaguucuucacccagugcagcucccugaugcagcaccagaaggugcacaccggcgagaagccguucaagugcaacgagugcgggcgcuucuuccgggagaacagcacgcugguccgccaccagcgggugcacaccggcgccaagcccuacgagugccgcgagugcgggaaguucuucucccagagcuccacccucaugcagcaccggaaggugcacaucggcgagaagcccuucaagugcaacgagugcgggcgccuguuccgggagaacagcagccuggucaagcaccagcgcgugcacaccggcgccaagcccuacgagugccgggagugcggcaaguucuuccgccacaacuccagccucuucaagcaccggcgcauccacacgggggagaugcaguga

SEQ ID NO: 39051 - RNA, 2340 nt, Artificial Sequence
  derived and/or modified sequence opt1 from ZNF41__Homo_sapiens__NP_700359
auggccgccaacggcgacagcccgcccuggucccccgcgcuggccgccgaggggcgcggcagcuccugcgaggccagcguguccuucgaggacgucaccguggacuucagcaaggaggaguggcagcaccucgaccccgcccagcggcgccuguacugggacgugacccuggagaacuacucccaccuccugagcgucggguaccagauccccaaguccgaggcggccuucaagcuggagcagggcgaggggccguggaugcucgagggcgaggcgccccaccagagcugcuccggcgaggccaucgggaagaugcagcagcagggcauccccgggggcaucuucuuccacugcgagcgguucgaccagcccaucggggaggacagccugugcuccauccuggaggagcucuggcaggacaacgaccagcuggagcagcgccaggagaaccagaacaaccugcucagccacgugaaggugcugaucaaggagcggggcuacgagcacaagaacaucgagaagaucauccacgucacgaccaagcuggugccguccaucaagcgccuccacaacugcgacaccauccugaagcacacccugaacagccacaaccacaaccggaacuccgccacgaagaaccucggcaagaucuucgggaacggcaacaacuucccccacagccccuccagcaccaagaacgagaacgccaagaccggggccaacagcugcgagcacgaccacuacgagaagcaccugucccacaagcaggcccccacccaccaccagaagauccacccggaggagaagcuguacgugugcacggagugcgucaugggcuucacccagaagucccaccucuucgagcaccagcgcauccacgccggcgagaagucccgggagugcgacaagagcaacaagguguucccccagaagccccagguggacguccaccccagcguguacaccggggagaagccguaccugugcacccagugcggcaagguguucacgcucaagagcaaccugaucacccaccagaagauccacaccgggcagaagcccuacaagugcuccgagugcggcaaggcguucuuccagcgcagcgaccuguuccggcaccuccgcauccacaccggggagaagcccuacgagugcuccgagugcggcaagggcuucagccagaacuccgaccugagcauccaccagaagacgcacaccggggagaagcacuacgagugcaacgagugcggcaaggccuucacccggaaguccgcccugcgcaugcaccagcggauccacaccggggagaagcccuacgucugcgccgacugcggcaaggccuucauccagaagucccacuucaacacgcaccagcgcauccacaccggggagaagccguacgagugcagcgacugcggcaagagcuucaccaagaagucccagcugcacgugcaccagcggauccacaccggcgagaagcccuacaucugcacggagugcgggaagguguucacccaccgcaccaaccucaccacgcaccagaagacccacaccggcgagaagcccuacaugugcgcggagugcgggaaggccuucaccgaccagagcaaccugaucaagcaccagaagacgcacaccggcgagaagcccuacaagugcaacgggugcggcaaggccuucaucuggaagucccggcugaagauccaccagaagucccacaucggcgagcgccacuacgagugcaaggacugcgggaaggccuucauccagaaguccacccucagcguccaccagcggauccacaccggcgagaagccguacgugugccccgagugcgggaaggccuucauccagaagucccacuucaucgcgcaccaccgcauccacacgggcgagaagcccuacgagugcagcgacugcggcaagugcuucaccaagaagucccagcugcgcgugcaccagaagauccacaccggggagaagcccaacaucugcgccgagugcggcaaggccuucaccgaccggagcaaccugaucacccaccagaagauccacacgcgcgagaagccguacgagugcggggacugcggcaagaccuucaccuggaagucccggcucaacauccaccagaagucccacaccggggagcgccacuacgagugcagcaagugcggcaaggccuucauccagaaggccacgcugagcaugcaccagaucauccacaccggcaagaagcccuacgcgugcaccgagugccagaaggccuucaccgaccggagcaaccugaucaagcaccagaagaugcacagcggggagaagcgcuacaaggccagcgacuga

SEQ ID NO: 39052 - RNA, 3675 nt, Artificial Sequence
  derived and/or modified sequence opt1 from ZNF423__Homo_sapiens__NP_001258549
auggaggacgagagcaucuacacgugcgaccacugccagcaggacuucgagucccuggccgaccucaccgaccaccgcgcccaccggugccccggcgacggggacgacgacccgcagcugagcuggguggcguccagccccuccagcaaggacgucgccucccccacccagaugaucggcgacgggugcgaccugggccucggggaggaggagggcggcaccgggcugcccuacccgugccaguucugcgacaagagcuucauccgccuguccuaccucaagcggcacgagcagauccacagcgacaagcugcccuucaagugcaccuacugcucccgccuguucaagcacaagcggagccgcgaccggcacaucaagcuccacaccggcgacaagaaguaccacugccacgagugcgaggccgccuucucccgcagcgaccaccugaagauccaccugaagacgcacuccagcuccaagcccuucaagugcaccgugugcaagcggggguucagcuccaccagcagccuccagucccacaugcaggcccacaagaagaacaaggagcaccuggccaagagcgagaaggaggcgaagaaggacgacuucaugugcgacuacugcgaggacaccuucucccagacggaggagcuggagaagcacgugcucacccgccacccccagcugagcgagaaggccgaccugcagugcauccacugcccggaggucuucguggacgagaacacccuccuggcccacauccaccaggcgcacgccaaccagaagcacaagugccccaugugccccgagcaguucuccagcguggagggcgucuacugccaccuggacucccaccggcagcccgacagcuccaaccacagcguguccccggaccccgugcucgggagcgucgccuccaugagcuccgccacccccgacagcuccgccagcguggagcgcggcuccacgcccgacagcacccugaagccgcugcggggccagaagaagaugcgcgacgacgggcagggcuggaccaagguggucuacagcugccccuacugcuccaagcgggacuucaacagccucgcggugcuggagauccaccugaagaccauccacgccgacaagccccagcagucccacacgugccagaucugccucgacagcaugcccacccuguacaaccugaacgagcacgugcgcaagcuccacaagaaccacgccuacccggucaugcaguucgggaacaucuccgccuuccacugcaacuacugccccgagauguucgccgacaucaacagccugcaggagcacauccgggugucccacugcggccccaacgcgaaccccagcgacggcaacaacgccuucuucugcaaccagugcuccaugggguuccugaccgagagcucccucaccgagcacauccagcaggcccacugcagcgugggcuccgccaagcuggagagcccggucgugcagcccacgcaguccuucauggagguguacagcugccccuacugcaccaacucccccaucuucgggagcauccugaagcucaccaagcacaucaaggagaaccacaagaacaucccgcuggcccacagcaagaaguccaaggcggagcagagccccgucuccagcgacguggagguguccagccccaagcgccagcggcuguccgccagcgccaacuccaucagcaacggcgaguacccgugcaaccagugcgaccucaaguucuccaacuucgagagcuuccagacccaccugaagcugcaccucgagcugcugcuccgcaagcaggccugcccccagugcaaggaggacuucgacucccaggagagccugcugcagcaccucacgguccacuacaugaccaccuccacccacuacgugugcgagagcugcgacaagcaguucuccagcgucgacgaccugcagaagcaccuccuggacaugcacacguucgugcuguaccacugcacccugugccaggagguguucgacuccaaggucagcauccaggugcaccuggccgugaagcacagcaacgagaagaagauguaccggugcaccgcgugcaacugggacuuccgcaaggaggccgaccuccagguccacgugaagcacucccaccuggggaaccccgccaaggcccacaagugcaucuucugcggcgagaccuucagcacggagguggagcugcagugccacaucaccacccacuccaagaaguacaacugcaaguucugcagcaaggcguuccacgccaucauccuccuggagaagcaccuccgcgagaagcacugcgucuucgacgccgccaccgagaacggcacggccaacggggugcccccgauggcgaccaagaaggccgagcccgccgaccugcagggcaugcugcugaagaaccccgaggcccccaacucccacgaggccagcgaggacgacguggacgcguccgagccgauguacgggugcgacaucugcggcgccgccuacaccauggagguccuccugcagaaccaccggcugcgcgaccacaacauccggcccggggaggacgacggcagccgcaagaaggccgaguucaucaagggcucccacaagugcaacgugugcagccggaccuucuucuccgagaacgggcuccgcgagcaccuccagacccaccggggccccgccaagcacuacaugugccccaucugcggggagcgcuucccgagccugcugacgcugaccgagcacaaggugacccacuccaagagccuggacaccggcacgugccggaucugcaagaugccccuccaguccgaggaggaguucaucgagcacugccagaugcaccccgaccugcgcaacagccugaccggguuccggugcgucgugugcaugcagaccgugaccuccacgcucgagcugaagauccacggcaccuuccacaugcagaagcuggcgggcagcuccgccgccagcagccccaacgggcagggccuccagaagcuguacaagugcgcccugugccucaaggaguuccgcuccaagcaggaccuggucaagcuggacgugaacgggcucccguacggccugugcgcgggcugcauggcccggagcgccaacgggcaggucggcgggcuggccccgcccgagcccgccgaccgccccugcgcgggccuccggugccccgagugcuccgugaaguucgagagcgccgaggaccuggagucccacaugcaggucgaccaccgcgaccugacccccgagaccagcgggccccggaagggcacgcagaccuccccggugccccgcaagaagaccuaccagugcaucaagugccagaugaccuucgagaacgagcgggagauccagauccacguggccaaccacaugaucgaggagggcaucaaccacgagugcaagcucugcaaccagauguucgacagccccgccaagcugcugugccaccucaucgagcacuccuucgaggggaugggcgggacguucaagugcccggugugcuucaccguguucguccaggccaacaagcugcagcagcacaucuucgcggugcacggccaggaggacaagaucuacgacugcagccagugcccccagaaguucuucuuccagaccgagcugcagaaccacaccaugucccagcacgcccaguga

SEQ ID NO: 39053 - RNA, 1710 nt, Artificial Sequence
  derived and/or modified sequence opt1 from ZNF430__Homo_sapiens__NP_001166142
auggagaaccucaagagcggcguguacccccugaaggaggccuccgggugcccgggcgccgaccgcaaccugcuggucuacagcuucuacgagaaggggccccucaccuuccgggacguggcgaucgaguucucccuggaggaguggcagugccuggacaccgcccagcaggaccucuaccgcaaggugaugcuggagaacuaccggaaccuggucuuccucggcaucgccgugagcaagcccgaccugaucacgugccuggagcaggggaaggagcccuggaacaugaagcgccacgccaugguggaccagccgcccgucaccuacucccacuucgcccaggaccucuggcccgagcagggcaucaaggacagcuuccaggaggugauccugcggcgcuacggcaagugcgggcacgaggaccugcagcuccggaccggcugcaaguccguggacgagugcaaccugcacaaggagugcuacgacgagcugaaccagugccucaccacgacccagagcgagaucuuccaguacgacaaguacgucaacguguucuacaaguucuccaaccccaacauccagaagauccgccacaccgggaagaagccguucaagugcaagaagugcgacaagagcuucugcaugcugcugcaccucacccagcacaagcggauccacauccgcgagaacuccuaccagugcgaggagugcggcaagguguucaacugguucagcacgcugacccggcaccgccggauccacaccggggagaagcccuacaagugcgagcagugcggcaaggcguucaagcaguccagcacccugacgacccacaagaucauccacaccggcgagaagcccuaccgcugcgaggagugcgggaagaccuucaaccgguccagccaccucacgacccacaagcgcauccacaccggcgagaagcccuaccggugcgaggagugcgggcgcgccuucaaccgguccagccaccugaccacgcacaagaucauccacaccggcgagaagccguacaagugcgaggagugcggcaaggccuucaaccaguccagcacccugaccacgcacaagaucauccacgccggggagaagcccuacaagugcgaggagugcggcaaggcguucuaccgcuucagcuaccucaccaagcacaagaucauccacaccggggagaaguucuacaagugcgaggagugcggcaagggguucaacugguccagcacccugacgaagcacaagcggauccacaccggcgagaagcccuacaagugcgagcagugcggcaaggccuucaacgaguccagcaaccugaccgcccacaagaucauccacaccggggagaagcccuacaagugcgaggagugcggcaaggccuucaaccgcuccccgaagcucacggcccacaaggucauccacagcggggagaagcccuacaagugcgaggagugcggcaaggcguucaaccaguucuccaaccugaccaagcacaagaucacccacaucggggacaccagcuacaaguaccuggagugcgacaaggccuucucccagagcuccacgcucaccaagcacaaggugauccacaccggcgagaagcccuacaacugcgaggaguacggcaaggccuucaaccagagcuccaaccugaucgagcagagcaacuccuacuggcgcgagacccugcagauguga

SEQ ID NO: 39054 - RNA, 1959 nt, Artificial Sequence
  derived and/or modified sequence opt1 from ZNF432__Homo_sapiens__XP_011525850
augaucaacgcccaggagcugcucacccuggaggacgugaccgucgaguucacgugggaggaguggcagcugcucggccccuuccagaaggaccuguaccgcgacgugaugcuggagaucuacagcaaccuccuguccaugggguaccaggugagcaagccggacgcccuguccaagcucgagcggggcgaggagcccuggaccauggaggacgagcgccacagccggaucugccccgagaacaacgaggucgacgaccaccuccaggaccaccuggagaaccagcgcaugcugaaguccguggagcaguaccacgagcacaacgcguucgggaacaccgccagccagaccaagucccugugccuguuccgggagaaccacgacacguucgagcucuacaucaagacccucaagagcaaccugucccuggugaaccagaacaagagcugcgagaucaacaacuccaccaaguucagcggcgacgggaaguccuuccugcacggcaacuacgaggagcuguacagcgccgccaaguucuccgucagcaccaaggccaacuccaccaagagccagguguccaagcaccagcgcacccacgagaucgagaagaaccacgugugcagcgagugcggcaaggcguucgucaagaagucccagcucaccgaccacgagcgggugcacaccggggagaagcccuacggcugcacgcugugcgccaagguguucagccgcaagagccggcugaacgagcaccagcgcauccacaagcgggagaaguccuucaucugcagcgagugcgggaaggucuucaccaugaagucccgccucaucgagcaccagcggacccacaccggcgagaagccguacaucugcaacgagugcgggaagggcuuccccggcaagcgcaaccugaucgugcaccagcggaaccacacgggggagaaguccuacaucugcagcgagugcggcaagggguucaccggcaagagcaugcugaucauccaccagcgcacccacaccggcgagaagcccuacaucugcuccgagugcgggaagggcuucacgaccaagcacuacgugaucauccaccagcggaaccacaccggggagaagcccuacaucugcaacgagugcggcaagggguucaccaugaagucccgcaugaucgagcaccagcggacgcacaccggcgagaagccguacaucugcagcgagugcggcaagggguucccccgcaagagcaaccucaucguccaccagcggaaccacaccguggagaaguccuaccugugcagcgagugcggcaagggguucaccgugaaguccaugcugaucauccaccagcgcacgcacaccggcgagaagcccuacacgugcagcgagugcgggaagggcuucccccucaagucccgccugaucguccaccagcggacccacacgggcgagaagccguaccgcugcagcgagugcgggaagggcuucaucgugaacuccgggcugaugcuccaccagcggacccacaccggcgagaagcccuacaucugcaacgagugcgggaagggcuucgccuucaagagcaaccuggugguccaccagcgcacccacacgggcgagaagcccuucaugugcagcgagugcgggaagggcuucaccaugaagcgguaccugaucgugcaccagcagauccacaccgaggagaaguccugcaucugcagcgagugcgggcgcggcuucgccaaggagaccgagcucgcgcugcacaagcagguccacaccggcgagaagcccuacgggugcaacgagugcggcaagggguucacgaugaagucccggcugaucgugcaccagcgcacccacaccggcgagaagccguucgugugcagcgagugccggaaggccuucuccagcaagcgcaaccucaucguccaccagcggacccacaacgggaacaagcccuga

SEQ ID NO: 39055 - RNA, 2022 nt, Artificial Sequence
  derived and/or modified sequence opt1 from ZNF433__Homo_sapiens__NP_001073880
augauguuccaggacagcguggccuucgaggacgucgccgugaccuucacccaggaggagugggcgcugcucgaccccucccagaagaaccugugccgcgacgugaugcaggagacguuccggaaccuggccagcaucggcaagaaguggaagccgcagaacaucuacgucgaguacgagaaccuccgccggaaccugcgcaucgugggggagcggcuguucgaguccaaggagggccaccagcacggggagauccucacccaggugcccgacgacaugcugaagaagaccaccacgggcgucaagagcugcgaguccagcguguacggggaggugggcuccgcccacagcucccugaaccgccacauccgggacgacaccggccacaaggccuacgaguaccaggaguacgggcagaagcccuacaagugcaaguacugcaagaagcccuucaacugccucagcuccguccagacccacgagcgcgcccacagcggccggaagcuguacgugugcgaggagugcgggaagaccuucaucucccacagcaaccugcagcgccaccggaucaugcaccgcggcgacgggccguacaagugcaaguucugcggcaaggcgcucauguuccugucccuguaccucauccacaagcggacgcacaccggcgagaagcccuaccagugcaagcagugcgggaaggccuucagccacuccagcucccugcgcauccacgagcggacccacaccggcgagaagcccuacaagugcaacgagugcgggaaggccuuccacagcagcacgugccugcacgcccacaagcgcacccacaccggcgagaagcccuacgagugcaagcagugcggcaaggcguucuccagcucccacagcuuccagauccacgagcggacccacacgggggagaagccguacgagugcaaggagugcggcaaggccuucaagugccccuccagcgugcgccggcacgagcgcacccacucccggaagaagcccuacgagugcaagcacugcgggaagguccucagcuaccugaccuccuuccagaaccaccugggcaugcacaccggggagaucagccacaagugcaagaucugcggcaaggccuucuacucccccagcucccuccagacgcacgagaagacccacaccggcgagaagccguacaagugcaaccagugcgggaaggccuucaacagcuccagcuccuuccgcuaccacgagcgcacccacacgggcgagaagcccuacgagugcaagcagugcgggaaggccuuccggagcgcgucccugcugcagacccacggccgcacccacaccggggagaagcccuacgccugcaaggagugcggcaagcccuucagcaacuucagcuucuuccagauccacgagcggaugcaccgcgaggagaagccguacgagugcaagggcuacgggaagacguucucccuccccagccuguuccaccggcacgagcgcacccacaccggcgggaagaccuacgagugcaagcagugcggccgguccuucaacugcagcuccagcuuccgcuaccacgggcggacgcacaccggcgagaagcccuacgagugcaagcagugcggcaaggccuuccgcuccgccagccagcugcagauccacgggcggacccacaccggcgagaagcccuacgagugcaagcagugcgggaaggccuucggcuccgcgagccaccuccagaugcacggccgcacgcacaccggggagaagccguacgagugcaagcagugcggcaaguccuucgggugcgccagccggcugcagaugcacggccgcacccacaccggggagaagcccuacaagugcaagcagugcggcaaggccuucggcugccccuccaaccugcggcgccacgggcggacccacacgggcgagaagcccuacaagugcaaccagugcgggaagguguuccgcugcagcucccagcuccaggugcacggccgggcccacugcaucgacaccccguga

SEQ ID NO: 39056 - RNA, 2487 nt, Artificial Sequence
  derived and/or modified sequence opt1 from ZNF438__Homo_sapiens__NP_001137240
augcagaacagcguguccguccccccgaaggacgagggcgagagcaacauccccuccgggaccauccagagccgcaagggccugcagaacaagucccaguuccggaccaucgcccccaagaucgugcccaaggugcucacgagccgcaugcugccgugccacucccccagccgguccgaccaggucaaccuggggcccagcaucaacuccaagcuccugggcaugagcacccagaacuacgcccugaugcagguggcggggcaggagggcaccuucucccucguggcccugccccacgucgccagcgcccagccgauccagaagccccgcaugucccugcccgagaaccucaagcugcccaucccgcgguaccagcccccccgcaacagcaaggccucccggaagaagcccauccugaucuucccgaagagcggcugcuccaaggcgcccgcccagacccagaugugcccccagaugagccccagcccgccccaccaccccgagcuccuguacaagcccuccccguucgaggaggugcccagccuggagcaggcccccgccuccaucagcacggcggcccucaccaacggguccgaccacggcgaccugcgccccccggugaccaacacccacgggagccugaacccccccgccacgccggccuccagcacccccgaggagcccgccaagcaggaccucaccgcgcuguccggcaaggcccacuucgucagcaagaucaccuccagcaagcccuccgccguggccagcgagaaguucaaggagcagguggaccuggccaagacgaugaccaaccucuccccgaccauccuggggaacgcgguccagcugaucagcuccgugcccaagggcaagcuccccauccccccguacagccggaugaagaccauggagguguacaagaucaaguccgacgccaacaucgccggcuucagccugcccgggcccaaggccgacugcgacaagauccccagcacgaccgagggcuucaacgccgcgaccaaggucgccucccgccugccggugccccaggugagccagcaguccgccugcgagagcgccuucugcccccccaccaagcucgaccugaaccacaagacgaagcugaacuccggggccgcgaagcggaagggccgcaagcggaaggucccggacgagauccucgccuuccagggcaagcgccggaaguacaucaucaacaagugccgcgacgggaaggagcgggugaagaacgacccccaggaguuccgcgaccagaagcugggcacccugaagaaguaccggagcaucaugcccaagcccaucauggugaucccgacccucgccucccuggccagccccaccacgcugcagucccagaugcucgggggccuggggcaggacguccugcucaacaacagccugacccccaaguaccugggcugcaagcaggacaacuccagcucccccaagccgagcuccguguuccgcaacggcuucagcgggaucaagaagcccuggcaccggugccacgugugcaaccaccacuuccaguucaagcagcaccuccgcgaccacaugaacacccacaccaaccgccggcccuacuccugccgcaucugccggaagagcuacguccgcccgggcagccuguccacgcacaugaagcugcaccacggggagaaccggcucaagaagcugaugugcugcgaguucugcgcgaagguguucggccacauccgcgucuacuucgggcaccugaaggaggugcaccggguggucaucagcaccgagcccgcccccuccgagcuccagcccggcgacaucccgaagaaccgcgacaugagcgugcggggcauggaggggucccuggagcgcgagaacaagagcaaccuggaggaggacuuccugcucaaccaggccgacgaggugaagcugcagaucaagugcggccggugccagaucaccgcccaguccuucgccgagaucaaguuccaccugcucgacguccacggggaggagaucgagggccgccugcaggaggggaccuuccccggcagcaagggcacgcaggaggagcuggugcagcacgcgucccccgacuggaagcggcaccccgagcgcgggaagccggagaaggugcacagcuccagcgaggagucccacgccugcccccggcucaagcgccagcugcaccugcaccagaacggcgucgagaugcucauggagaacgaggggccccagagcggcaccaacaagccccgggagaccugccagggcccggagugccccgggcugcacaccuuccugcucuggucccacagcggcuucaacugccugcugugcgccgagaugcucgggcgcaaggaggaccugcugcaccacuggaagcaccagcacaacugcgaggaccccuccaagcucugggccauccugaacacggugagcaaccagggcgugaucgagcuguccagcgaggccgagaaguga

SEQ ID NO: 39057 - RNA, 2016 nt, Artificial Sequence
  derived and/or modified sequence opt1 from ZNF443__Homo_sapiens__NP_005806
auggccagcguggcccuggaggacgucgcggugaacuucacccgcgaggagugggcccuccugggccccugccagaagaaccuguacaaggacgugaugcaggagaccauccggaaccucgacugcgucgugaugaaguggaaggaccagaacaucgaggaccaguaccgcuacccgcggaagaaccugcgcugccggaugcuggagcgcuucguggaguccaaggacgggacgcagugcggcgagaccagcucccagauccaggacagcaucgucaccaagaacacccuccccggggugggccccugcgaguccagcaugcgcggggagaaggugaugggccacuccagccugaacugcuacauccgggucggcgccgggcacaagccccacgaguaccacgagugcggcgagaagccggacacgcacaagcagcgggggaaggccuucuccuaccacaacagcuuccagacccacgagcgccugcacaccggcaagaagcccuacgacugcaaggagugcgggaaguccuucagcucccucggcaaccugcagcggcacauggccgugcagcgcggcgacgggcccuacaagugcaagcugugcggcaaggcguucuucuggcccagccuccugcacaugcacgagcggacccacacgggggagaagccguacgagugcaagcagugcuccaaggccuucagcuucuacuccagcuaccugcgccacgagcggacccacaccggcgagaagcccuacgagugcaagcagugcuccaaggccuuccccuucuacagcagcuaccuccgccacgagcggacccacacgggcgagaagcccuacaagugcaagcagugcuccaaggccuucccggacagcuccagcugccugauccacgagcgcacccacaccggggagaagcccuacacgugcaagcagugcggcaaggcguucuccgugagcgggucccugcagcggcacgagaccacccacagcgccgagaagcccuacgccugccagcagugcggcaaggccuuccaccaccucggguccuuccagcgccacaugauccggcacaccggcaacggcccccacaagugcaagaucugcgggaagggcuucgacugcccgagcucccugcagagccacgagcgcacccacacgggggagaagcccuacgagugcaagcagugcggcaaggcccugucccaccgcagcuccuuccggagccacaugaucaugcacaccggggacggcccccacaagugcaaggucugcggcaaggcguucguguaccccuccguguuccagcgccacgagcggacccacaccgccgagaagccguacaagugcaagcagugcgggaaggccuaccgcaucagcuccagccuccggcgccacgagacgacccacaccggcgagaagcccuacaagugcaagcuggggaaggccuucaucgacuucugcagcuuccagaaccacaagaccacgcacaccggcgagaagcccuacgagugcaaggagugcgggaaggccuucucccgguuccgcuaccugagccggcacaagcgcacccacaccggcgagaagcccuacgagugcaagacgugccggaaggcguucggccacuacgacaaccucaagguccacgagcgcauccacuccggggagaagccguacgagugcaaggagugcggcaaggccuucagcuggcugaccugcuuccugcggcacgagcgcauccacaugcgggagaaguccuacgagugcccccagugcgggaaggccuucacccacagccgcuuccuccagggccacgagaagacccacacgggcgagaaccccuacgagugcaaggagugcgggaaggccuucgccucccugagcucccugcaccggcacaagaagacccacuggaagaagacccacaccggcgagaaccccuacgagugcaaggagugcgggaaggcguucgccagccucuccagccugcaccgccacaagaagacccacuga

SEQ ID NO: 39058 - RNA, 984 nt, Artificial Sequence
  derived and/or modified sequence opt1 from ZNF444__Homo_sapiens__XP_011525370
auggagguggccguccccgugaagcaggaggccgagggccuggcgcucgacagccccuggcaccgcuuccggcgcuuccaccugggggacgcccccggcccccgggaggcccuggggcuccugcgcgcccugugccgggacuggcuccgccccgaggugcacaccaaggagcagaugcuggagcugcucguccuggagcaguuccuguccgcccucccggcggacacccaggccugggugugcagccggcagccccaguccggcgaggaggccguggcccugcuggaggagcucugggggcccgcggccagccccgacggcuccagcgccacgcgcgucccgcaggacgugacccagggccccggggccaccggcgggaaggaggacuccggcaugaucccccuggccgggaccgcgcccggcgccgagggcccggcccccggggacagccaggccgugcggcccuacaagcaggagcccuccagcccgccccuggcccccggccuccccgcguuccuggccgccccggggacgaccuccugccccgagugcggcaagaccagccugaagcccgcccaccuccugcgccaccggcagucccacagcggcgagaagccccacgccugcccggagugcgggaaggcguuccgccggaaggagcaccuccgccggcaccgcgacacccaccccggcucccccgggagccccggcccggcccugcggccccugcccgcccgcgagaagccgcacgccugcugcgagugcgggaagacguucuacuggcgggagcaccugguccgccaccggaagacccacuccggcgcccgccccuucgcgugcugggagugcggcaagggguucggccgccgggagcacgugcuccgccaccagcggauccacgggcgcgccgccgccagcgcgcagggcgccguggcccccgggcccgacggcggcgggccguucccgcccuggccccugggcuga

SEQ ID NO: 39059 - RNA, 1992 nt, Artificial Sequence
  derived and/or modified sequence opt1 from ZNF44__Homo_sapiens__NP_001157748
auggcccugugcuacggcaccuucuggggguaccccaagaugcucgaggccgcgaaccugauggagggccugguggacaucgggccgugggucacccucccccgcggccagcccgaggugcuggagugggggcugcccaaggaccaggacagcguggccuucgaggacgucgccgugaacuucacgcacgaggagugggcccuccugggcccgucccagaagaaccuguaccgggacgugaugcgcgagaccauccggaaccucaacugcaucggcaugaagugggagaaccagaacaucgacgaccagcaccagaaccugcgccggaacccccgcugcgacgucguggagcgguucggcaagagcaaggacgggucccagugcggggagacccugagccagauccgcaacuccaucgugaacaagaacacccccgcccgggucgacgcgugcggcagcuccgugaacggggaggugaucaugggccacagcucccucaacugcuacauccgcgucgacacgggccacaagcaccgggagugccacgaguacgccgagaaguccuacacccacaagcagugcgggaagggccugagcuaccgccacagcuuccagaccugcgagcggccccacaccgggaagaagccguacgacugcaaggagugcggcaagacguucuccagccccggcaaccugcgccggcacaugguggugaagggcggggacgggcccuacaagugcgagcucugcggcaaggccuucuucuggcccucccugcugcgcaugcacgagcggacccacaccggggagaagccguacgagugcaagcagugcagcaaggccuuccccgucuacuccagcuaccuccgccacgagaagauccacaccggcgagaagcccuacgagugcaagcagugcuccaaggcguuccccgacuacagcagcuaccugcggcacgagcgcacgcacaccggcgagaagccguacaagugcaagcagugcgggaaggccuucuccgugagcggcucccugcgggugcacgagcgcauccacaccggggagaagcccuacacgugcaagcagugcggcaaggccuucugccaccucgggagcuuccagcgccacaugaucaugcacuccggcgacggcccccacaagugcaagaucugcgggaagggcuucgacuuccccgggagcgcccggauccacgagggcacccacacccuggagaagccguacgagugcaagcagugcgggaagcugcucucccaccgcagcuccuuccggcgccacaugauggcccacaccggcgacggcccccacaagugcaccgucugcgggaaggcguucgacagccccuccguguuccagcggcacgagcgcacgcacaccggcgagaagcccuacgagugcaagcagugcgggaaggccuuccggaccagcuccagccugcgcaagcacgagaccacgcacaccggcgagcagccguacaagugcaagugcggcaaggccuucuccgaccuguucagcuuccagucccacgagaccacccacagcgaggaggagcccuacgagugcaaggagugcgggaaggccuucuccagcuucaaguacuucugccggcacgagcgcacgcacagcgaggagaaguccuacgagugccagaucugcggcaaggccuucagccgguucuccuaccucaagacccacgagcgcacccacaccgcggagaagcccuacgagugcaagcagugccggaaggccuucuucuggcccagcuuccugcugcgccacgagcggacgcacaccggggagcgcccguacgagugcaagcacugcggcaaggccuucucccggagcuccuucugccgcgagcacgagcggacccacaccggggagaagcccuacgagugcaaggagugcggcaaggccuucagcucccucagcuccuucaaccgccacaagcgcacgcacuggaaggacauccuguga

SEQ ID NO: 39060 - RNA, 3186 nt, Artificial Sequence
  derived and/or modified sequence opt1 from ZNF451__Homo_sapiens__NP_001026794
augggcgaccccgggagcgagaucaucgaguccgugccgcccgccggccccgaggccagcgaguccaccaccgacgagaacgaggacgacauccaguucgucagcgaggggccccugcgcccggugcucgaguacaucgaccugguguccagcgacgacgaggagcccuccacgagcuacaccgacgagaacaucaagcggaaggaccacaucgacuaccagaaggacaaggucgcgcugacccucgcccgccuggcccggcacguggagguggagaagcagcagaaggaggagaagaaccgcgccuuccgggagaagaucgacuuccagcacgcccacggccugcaggagcucgaguucauccgcgggcacuccgacaccgaggcggcccggcugugcgucgaccaguggcugaagaugcccggccucaagacgggcaccaucaacugcgggaccaagagcuccuuccgccggggcgggcacaccugggugagcggcaagcccauccugugcccgaucaugcacugcaacaaggaguucgacaacgggcaccuccugcugggccaccugaagcgcuucgaccacucccccugcgaccccacgaucacccuccacggccccuucuucagcuccuucgccugcguggucugcuacaagaaguucgugacccagcagcaguaccgggaccaccuguucgacaaggaggccaccgacgacgggcacaacaacaaccugcucccgcagaucauccagugcuucgcgugccccaacugcuuccugcuguucagccgcaaggaggagugcuccaagcacaugagcggcaagaaccacuuccaccaguccuucaagcucggggacaacaagggcaucgcccaccccaucagcuuccccagcuucgccaagaagcugcugaucucccucugcaaggacgugccguuccaggucaagugcguggccugccacaagacgcugcggagccacauggagcugaccgcccacuuccgcgugcacugccggaacgcgggccccgucgccguggccgagaaguccaucacccagguggccgagaaguucauccuccgcggguacugccccgacugcaaccaggucuucguggacgagaccagcacgcagaaccacaagcagaacuccggccacaaggugcgggucaucaacagcguggaggaguccgugcugcuguacugccacagcuccgaggggaacaaggaccccagcuccgaccuccaccuccugcuggaccagagcaaguucuccagccugaagcgcaccauguccaucaaggagagcuccagccuggagugcaucgccaucccgaagaagaagaugaaccucaaggacaagucccacgagggcgucgcgugcgugcagaaggagaaguccgucgugaagaccugguucugcgagugcaaccagcgguuccccagcgaggacgccguggagaagcacgucuucuccgccaacaccaugggguacaagugcguggugugcggcaaggucugcgacgacagcggcgugauccgccugcacaugucccggauccacgggggcgcccaccugaacaacuuccucuucuggugccgcacgugcaagaaggagcugacccgcaaggacaccaucauggcccacgugaccgaguuccacaacgggcaccgguacuucuacgagauggacgaggucgagggcgagacgcugcccagcuccagcaccacccucgacaaccugaccgcgaacaagcccuccagcgccaucacggugaucgaccacuccccggccaacagcagcccccgcgggaaguggcagugccggaucugcgaggacauguucgacagccaggaguacgugaagcagcacugcaugucccuggccagccacaaguuccaccgcuacuccugcgcccacugccggaagcccuuccacaagaucgagacccucuaccgccacugccaggacgagcacgacaacgagaucaagaucaaguacuucugcggccugugcgaccugaucuucaacgucgaggaggcguuccucagccacuacgaggagcaccacuccaucgacuacguguucgugagcgagaagaccgagaccagcaucaagacggaggacgacuuccccgucaucgagaccuccaaccagcugaccugcggcugccgggagagcuacaucugcaaggugaaccgcaaggaggacuacucccggugccugcagaucaugcuggacaaggggaagcucugguuccgcugcagccugugcuccgccaccgcccagaaccugacggacaugaacacccacauccaccaggugcacaaggagaaguccgacgaggaggagcagcaguacgucaucaagugcgggaccugcaccaaggccuuccacgacccggagagcgcgcagcagcacuuccaccggaagcacugcuuccuccagaagcccagcguggcccacuucggcuccgagaaguccaaccuguacaaguucaccgccagcgccagccacacggagcgcaagcugaagcaggccaucaacuacuccaagagccucgacauggagaagggcguggagaacgaccuguccuaccagaacaucgaggaggagaucgucgagcugcccgaccucgacuaccugcggaccaugacccacaucguguucguggacuucgacaacuggagcaacuucuucgggcaccucccgggccaccugaaccagggcaccuucaucuggggguuccagggcgggaacacgaacuggaagccgccccugaacugcaagaucuacaacuaccugaaccgcaucggcugcuucuuccuccacccccggugcuccaagcgcaaggacgcggccgacuucgccaucugcaugcacgccggccggcuggacgagcagcugcccaagcagauccccuucaccauccucagcggggaccagggcuuccuggagcuggagaaccaguucaagaagacccagcgccccgcccacauccucaacccccaccaccuggagggggacaugaugugcgcgcugcucaacuccaucagcgacaccacgaaggagugcgacagcgacgacaacaugggcgccaagaacaccuccaucggggaggaguucaucagcaccgaggacgucgagcuggaggaggccauccggcgcucccuggaggagauguga

SEQ ID NO: 39061 - RNA, 2049 nt, Artificial Sequence
  derived and/or modified sequence opt1 from ZNF45__Homo_sapiens__NP_003416
augaccaagagcaaggaggccgugaccuucaaggacgucgccgugguguucuccgaggaggagcugcagcuccuggaccuggcgcagcgcaagcucuaccgggacgucaugcuggagaacuuccgcaacguggugagcgucggccaccaguccacgcccgacgggcugccgcagcucgagcgggaggagaagcuguggaugaugaagauggccacccagcgcgacaacagcuccggcgccaagaaccugaaggagauggagacccuccaggagguggggcugcgguaccugccccacgaggagcuguucugcagccagaucuggcagcagaucacccgcgagcugaucaaguaccaggacuccguggucaacauccagcggacgggcugccagcuggagaagcgcgacgaccuccacuacaaggacgagggguucagcaaccaguccagccaccuccaggugcaccgggugcacaccggcgagaagcccuacaagggcgagcacugcgucaaguccuucagcugguccagccaccuccagaucaaccagcgcgcccacgccggggagaagcccuacaagugcgagaagugcgacaacgcguuccggcgcuucuccagccugcaggcccaccagcgggugcacucccgcgccaagagcuacaccaacgacgccuccuaccggagcuucagccagcgcucccaccucccgcaccaccagcgggugcccaccggcgagaaccccuacaaguacgaggagugcgggcgcaacgucggcaagagcucccacugccaggcgccccugaucgugcacacgggggagaagccguacaagugcgaggagugcggcgugggcuucagccagcgguccuaccugcagguccaccugaaggugcacaccgggaagaagcccuacaagugcgaggagugcggcaagagcuucuccuggcgcagccggcugcaggcccacgagcgcauccacaccggggagaagcccuacaagugcaacgccugcggcaaguccuucagcuacuccagccaccucaacauccacugccgcauccacaccggcgagaagcccuacaagugcgaggagugcgggaagggcuucuccguggggagccaccuccaggcccaccagaucucccacacgggcgagaagccguacaagugcgaggagugcgggaagggcuucugccgggccagcaaccugcuggaccaccagcgcggccacaccggggagaagcccuaccagugcgacgcgugcggcaagggguucucccggagcuccgacuucaacauccacuuccgcguccacaccggcgagaagcccuacaagugcgaggagugcgggaagggcuucagccaggccagcaaccugcuggcccaccagcggggccacaccggggagaagcccuacaagugcggcacgugcgggaagggcuucucccgcagcuccgaccucaacgugcacugccggauccacaccggggagaagccguacaagugcgagcgcugcggcaaggccuucagccaguucuccagccuccaggugcaccagcggguccacaccggcgagaagcccuaccagugcgccgagugcgggaagggcuucuccguggggagccagcugcaggcgcaccagcgcugccacaccggcgagaagcccuaccagugcgaggagugcggcaagggguucugccgggccuccaacuuccuggcccaccgcggcguccacacgggggagaagcccuaccggugcgacgugugcggcaagcgcuuccggcagcgcagcuaccugcaggcccaccagcgggugcacaccggggagcgcccguacaagugcgaggagugcggcaaggucuucuccuggagcuccuaccugcaggcccaccagcgggugcacaccggcgagaagcccuacaagugcgaggagugcgggaagggcuucagcugguccagcucccucaucauccaccagcgcgugcacgcggacgacgagggggacaaggacuuccccagcagcgaggacucccaccgcaagacccgguga

SEQ ID NO: 39062 - RNA, 7521 nt, Artificial Sequence
  derived and/or modified sequence opt1 from ZNF462__Homo_sapiens__NP_067047
auggaggugcugcagugcgacggcugcgacuuccgcgcccccagcuacgaggaccucaaggcccacauccaggacgugcacaccgccuuccugcagcccaccgacguggccgaggacaacgugaacgagcugcgcugcggcuccgucaacgccagcaaccagacggagguggaguucuccagcaucaaggacgaguucgccaucgccgaggaccucuccggccagaacgcgaccagccuggggaccggcggguacuacggccacucccccggcuacuacgggcagcacaucgccgccaaccccaagcccaccaacaaguucuuccagugcaaguucugcgugcgcuacuuccggagcaagaaccugcucaucgagcacacgcgcaagguccacggcgcccaggccgagggguccagcuccggcccgcccgugcccgggagccugaacuacaacaucaugaugcacgagggcuucggcaagguguucuccugccaguucugcaccuacaagagcccccggcgcgcccggaucaucaagcaccagaagauguaccacaagaacaaccugaaggagaccaccgcgccgccgcccgcccccgcccccaugcccgaccccgucgugccgcccgugucccuccaggaccccugcaaggagcugcccgccgaggucguggagcgcagcauccuggaguccauggugaagccccucacgaagucccgggggaacuucugcugcgaguggugcuccuaccagacgccccgccgggagcgcuggugcgaccacaugaugaagaagcaccggagcauggucaagauccugagcucccugcgccagcagcaggagggcaccaaccuccccgacgugcccaacaagagcgcccccucccccaccagcaacuccaccuaccugaccaugaacgccgccagccgggagauccccaacaccaccguguccaacuuccgcgggagcaugggcaacuccaucaugcggcccaacagcuccgccagcaaguucucccccaugagcuacccccagaugaagcccaagagcccccacaacagcggccuggucaaccucacggagcgcucccgguacgggaugaccgacaugaccaacagcuccgcggaccuggagaccaacagcaugcugaacgacagcuccagcgacgaggagcucaacgagaucgacuccgagaacggccugagcgccauggaccaccagacguccgggcugagcgccgagcagcucaugggcuccgacgggaacaagcugcuggagaccaagggcauccccuuccgccgguucaugaaccgcuuccagugccccuucugccccuuccucaccaugcaccgccggagcaucucccgccacaucgagaacauccaccugagcggcaagaccgccguguacaagugcgacgagugccccuucacgugcaaguccagccugaagcucggggcccacaagcagugccacaccggcaccaccuccgacugggacgcggugaacagccaguccgagagcaucuccagcagccugaacgagggggucguguccuacgagagcuccagcaucaacggccggaaguccggggugaugcuggacccccuccagcagcagcagccgccccagcccccgcccccgcccccgcccccgccgcccagccagccccagccccugcagcagccccagccgccccagcugcagccgccccaccaggucccgccccagccccagacgcagcccccgcccacccagcagccccagccgcccacccaggccgcgccccugcaccccuacaagugcaccaugugcaacuacuccacgaccacccugaagggccugcgcgugcaccagcagcacaagcacagcuucugcgacaaccuccccaaguucgagggccagcccuccagccugccccuggagaacgagaccgacucccaccccagcuccagcaacacggucaagaagucccagaccagcauccucgggcuguccagcaagaacaacuucguggccaaggccucccggaagcuggcgaacgacuucccgcucgaccugagccccgugaagaagcgcacccggaucgacgagaucgccagcaaccugcaguccaagaucaaccagaccaagcagcaggaggacgccgucaucaacguggaggacgacgaggaggaggaggaggacaacgagguggagaucgaggucgagcucgaccgcgaggaggagcccaccgagcccaucaucgaggugccgacgagcuucuccgcccagcagaucugggugcgggacaccagcgagccccagaaggagcccaacuuccgcaacaucacccacgacuacaacgcgaccaacggcgccgagaucgagcugacgcuguccgaggacgaggaggacuacuacgggagcuccaccaaccugaaggaccaccaggucagcaacaccgcccuccugaacacccagacgcccaucuacggcaccgagcacaacuccgagaacaccgacuucggggacagcggccggcuguacuacugcaagcacugcgacuucaacaacaaguccgcccgcagcguguccacccacuaccagcggaugcaccccuacaucaaguucagcuuccgcuacauccucgaccccaacgaccacuccgccguguaccggugccuggagugcuacaucgacuacacgaacuucgaggaccugcagcagcacuacggcgagcaccaccccgaggcgaugaacguccucaacuucgaccacagcgaccugaucuaccgcugccgguucugcuccuacaccagccccaacgugcgcucccugaugccgcacuaccagcggaugcaccccaccgugaagaucaacaacgccaugaucuucagcagcuacgucguggagcagcaggaggggcucaacaccgagucccagacgcugcgcgagauccugaacagcgcccccaagaacauggccaccuccacccccguggcccgcggcgggggccucccggcgaccuucaacaagaacacgcccaagaccuucacccccgagugcgagaaccagaaggacccgcuggucaacaccgugguggucuacgacugcgacgugugcagcuucgccucccccaacaugcacagcgugcugguccacuaccagaagaagcaccccgaggagaaggccuccuacuuccggauccagaagacgaugcgcauggugagcguggaccggggcuccgcccucagccagcuguccuucgaggucggggcccccaugagcccgaagauguccaacaugggcuccccgccgccgccccagcccccgccgcccgaccuguccaccgagcucuacuacugcaagcacugcagcuacuccaaccgcagcgugguggggguccuggugcacuaccagaagcggcaccccgagaucaaggugaccgcgaaguacauccgccaggcgccgcccaccgccgccaugaugcggggcgucgaggggccccagggcagcccccggccgcccgcgccgauccagcagcugaaccggagcagcuccgagcgcgacgggccgcccguggagaacgagauguucuucugccagcacugcgacuacgggaaccggacggugaagggcguccucauccacuaccagaagaagcaccgcgacuucaaggccaacgccgacgugauccggcagcacaccgccaccauccgcagccugugcgaccggaaccagaagaagcccgccuccugcgugcuggucagcccguccaaccucgagcgcgacaagaccaagcugcgggcgcugaagugccgccagugcagcuacacgucccccuacuucuacgcccuccggaagcacaucaagaaggaccaccccgcccugaaggccaccgugaccagcaucaugcgcugggccuuccuggacgggcucaucgaggcgggcuaccacugcgaguggugcaucuacucccacaccgagcccaacgggcugcugcuccacuaccagcggcgccacccggagcacuacguggacuacacguacauggccaccaagcugugggccggccccgaccccagcccgcccucccugaccaugcccgccgaggccaagaccuaccgcugccgggacugcgucuucgaggcggugagcaucugggacaucaccaaccacuaccaggccuuccaccccugggccaugaacggcgacgaguccgugcuccuggacaucaucaaggagaaggacgccgucgagaagccgauccugagcuccgaggagcucgcggggcccgugaacugcgagaacagcauccccacgcccuucccggagcaggaggccgagugccccgaggacgcccgccugucccccgagaagucccugcagcucgccuccgccaaccccgcgaucagcagcaccccguaccagugcaccgugugccaguccgaguacaacaaccugcacggccugcucacccacuacgggaagaagcaccccggcaugaaggucaaggccgccgacuucgcccaggacaucgacaucaaccccggggccguguacaagugccggcacugccccuacaucaacacgcgcauccacggcgugcugacccacuaccagaagcggcacccgagcaucaaggucaccgcggaggacuucgugcacgacgucgagcaguccgccgacaucagccagaacgacguggaggagaccucccgcaucuucaagcagggcuacggggccuaccggugcaagcugugccccuacacgcacggcacccucgagaagcugaagauccacuacgagaaguaccacaaccagcccgaguucgacguguucagccaguccccgcccaagcugcccgucccccucgagcccgagaugaccaccgaggugagccccucccaggugagcaucacggaggaggaggucggggaggagcccguguccaccagccacuucuccaccagccaccuggugucccacaccgucuuccgcugccagcugugcaaguacuucugcagcacgcggaagggcaucgcccgccacuaccggaucaagcacaacaacgugcgcgcccagcccgaggggaagaacaaccucuucaagugcgcgcugugcgccuacaccaacccgauccggaagggccuggccgcccacuaccagaagcgccacgacaucgacgccuacuacacccacugccucgcggccucccggaccaucagcgacaagcccaacaaggugaucauccccagcccgcccaaggacgacagcccccagcugagcgaggagcugcgccgggccgucgagaagaagaagugcucccucugcagcuuccaguccuucagcaagaagggcaucgugucccacuacaugaagcgccaccccgggguguuccccaagaagcagcacgccagcaagcugggcggguacuucacggcggucuacgccgacgagcacgagaagccgacccugauggaggaggaggagcggggcaacuucgagaaggccgagguggagggcgaggcccaggagaucgaguggcuccccuuccgcugcaucaagugcuucaagcuguccuucagcaccgccgagcugcucugcaugcacuacaccgaccaccacucccgcgaccugaagcgggacuucaucauccuggggaacggcccccgccuccagaacagcacguaccagugcaagcacugcgacuccaagcugcagagcaccgcggagcugaccucccaccucaacauccacaacgaggaguuccagaagcgggccaagcgccaggagcggcgcaagcagcugcugagcaagcagaaguacgccgacggggccuucgccgacuucaagcaggagcggcccuucggccaccucgaggaggugccgaagaucaaggagcgcaaggucgugggguacaagugcaaguucugcguggagguccaccccacccugcgggcgaucugcaaccaccuccgcaagcacgugcaguacggcaacgugcccgccgucuccgccgccgugaagggccuccggagccacgagcgcucccaccuggcccuggcgauguucacgcgggaggacaaguacagcugccaguacugcagcuucguguccgccuuccgccacaaccucgaccggcacaugcagacccaccacgggcaccacaagcccuuccgcugcaagcugugcagcuucaaguccagcuacaacucccggcugaagacccacauccucaaggcccacgccggcgagcacgcguacaagugcagcuggugcuccuucagcaccaugacgaucucccagcugaaggagcacagccugaagguccacgggaaggcccucacccugccgcgcccccggaucgugucccugcucagcucccacagccaccacuccagccagaaggccacccccgccgaggagguggaggacuccaacgacagcuccuacagcgagcccccggacguccagcagcagcugaaccacuaccagagcgccgcgcuggcccgcaacaacucccgggugagccccgugccccucuccggcgccgccgccgggaccgagcagaagacggaggcgguccugcacugcgaguucugcgaguucagcuccggcuacauccagagcauccgccgccacuaccgggacaagcacggcgggaagaagcuguucaagugcaaggacugcuccuucuacaccggcuucaagagcgccuucaccaugcacguggaggccgggcacuccgccgugcccgaggagggcccgaaggaccugcgcugcccccucugccuguaccacaccaaguacaagcggaacaugaucgaccacaucguccugcaccgcgaggagcggguggugcccaucgaggucugccgcagcaagcucuccaaguaccugcagggggugguguuccggugcgacaagugcaccuucacgugcagcuccgacgagagccugcagcagcacaucgagaagcacaacgagcucaagcccuacaagugccagcugugcuacuacgagaccaagcacaccgaggagcuggacucccaccuccgcgacgagcacaaggucagccggaacuucgagcuggugggccgcgugaaccuggaccagcucgagcagaugaaggagaagauggaguccagcuccagcgacgacgaggacaaggaggaggagaugaacagcaaggccgaggaccgggagcugaugcgcuucuccgaccacggcgcggcccugaacaccgagaagcgguucccgugcgaguucugcgggcgcgccuucagccagggcuccgagugggagcggcacguccuccgccacgggauggcccugaacgacacgaagcaggucagccgggaggagauccaccccaaggagaucauggagaacuccgugaagaugcccagcaucgaggagaaggaggacgacgaggcgaucggcaucgacuucucccugaagaacgagaccgucgccaucugcguggugaccgccgacaagagccuccuggagaacgccgaggccaagaaggaguga

SEQ ID NO: 39063 - RNA, 11778 nt, Artificial Sequence
  derived and/or modified sequence opt1 from ZNF469__Homo_sapiens__NP_001120936
augcccggcgagcgcccgcggggggcccccccccccaccaugaccggcgaccugcagccgcgccagguggccagcucccccgggcaccccagccagcccccgcucgaggacaacacgcccgcgacccggaccaccaagggcgcccgcgaggccgggggccaggcccaggccauggagcugcccgaggcgcagccccggcaggcccgcgacggcgagcugaagccgcccucccuccgggggcaggcccccagcuccacgcccggcaagcgcgggagcccgcagaccccccccggccgguccccccugcaggccccgagccgccuggcggggcgggccgagggcucccccccccagcgcuacauccucggcaucgccagcucccggaccaagcccacccuggacgagacgccggagaacccccagcuggaggccgcccagcuccccgaggucgacaccccccaggggccgggcaccggggcgccccugcgccccggccugccgcggaccgaggcccagcccgccgccgaggagcucggcuuccaccgcugcuuccaggagccccccagcuccuucacgagcaccaacuacaccuccccgagcgccaccccccggccccccgcgccggggcccccccagucccgcggcacgagcccccugcagccgggguccuaccccgaguaccaggccagcggcgccgacagcuggccccccgccgccgagaacuccuucccgggggcgaacuucggcgugccccccgccgagcccgagccgauccccaagggcagccggcccgggggcuccccccgcggggugagcuuccaguucccguuccccgcccugcacggcgccuccaccaagcccuucccggccgacgucgcggggcacgccuucaccaacggcccccucguguucgccuuccaccagccccagggcgccuggcccgaggaggcgguggggaccggcccggccuacccccugcccacgcagcccgccccgagcccccugcccugcuaccaggggcagcccggcgggcucaaccggcacuccgaccugagcggcgcccuguccagcccgggcgccgcgcacuccgccccccgccccuucagcgacucccuccacaagagccugaccaagauccugcccgagcgcccgcccuccgcccaggacgggcucggcagcacccgggggccccccuccagccugccgcagcgccacuuccccggccaggccuaccgggccuccggcgucgacaccagccccgggcccccggacacggagcuggcggcccccggcccccccccggcccgccucccccagcugugggaccccaccgccgccccguaccccaccccccccgggggcccgcuggcggccacccggagcauguucuucaacgggcagcccucccccggccagcgccucugccugccccagagcgccccgcugcccuggccccaggugcuccccacggcccggccguccccccacggcauggagaugcugagccgccugcccuuccccgcggggggcccggaguggcaggggggcucccagggggcccucggcaccgccggcaagacccccgggccccgggagaagcugcccgccgugcgcagcucccagggcgggagcccggcccuguucaccuacaacggcaugacggaccccggggcgcagccccucuucuucggcgucgcccagccccagguguccccgcacggcacccccagccugccccccccgcggguggucggggccucccccagcgaguccccccugccgagccccgccaccaacaccgccggcuccacgugcagcucccucagccccaugagcuccagccccgcgaacccguccagcgaggagucccagcugcccgggccccugggccccagcgccuucuuccacccgcccacccacccccaggagaccgggucccccuucccgagccccgagcccccccacucccucccgacccacuaccagcccgagcccgccaaggccuuccccuucccggccgacggccugggcgcggagggggccuuccagugccuggaggagacccccuucccccacgagggccccgagguggggcgcggcggccuccagggguucccgcgggccccccccccguaccccacgcaccacuucagccuguccagcgccucccuggaccagcuggacgugcuccugaccugccgccagugcgaccggaacuacagcucccuggcggccuuccucgcccaccgccaguucugcggccugcugcucgcccgggccaaggacgggcaccagcgcagccccggccccccggggcugcccuccccccccgcggccccgcggguccccgccgacgcccacgccggccugcucagccacgcgaagaccuuccugcuggccggcgacgcccaggccgaggggaaggacgacccccuccgcaccggcuuccugcccucccuggccgcgacgccguucccccuccccgccagcgaccuggacauggaggacgacgccaagcuggacagccucaucaccgaggcccugaacgggauggaguaccaguccgacaaccccgagaucgacagcuccuucaucgacguguucgccgacgaggagccgagcggcccccgcgggcccuccagcggccacccccugaaguccaaggcgggcgugaccccggagagcaaggccccccccccccucccggccgccacccccgacccccagacgccccggccgggggaccgcggcugccccgcgcgggggcgccccaagacccggucccugggccuggccccgaccgaggccgacgcccccagccaggggcgccagcagcggcgcggcaagcagcucaagcuguuccggaaggaccuggacuccggcggggccgcggagggcagcggguccggcggcgggggccgcgccagcgggcuccggccccgccggaacgacggccugggggagcgccccccgccccggccccgccggccccgcacccaggccccgggcucccgggccgaccccgccccccgcgucccccgggcggccgcccugccggaggagacgcgcagcucccgccggcgccggcuccccccccgcaaggacccccggaagcgcaaggcccggggcggggccuggggcaaggagcugauccugaagaucgugcagcagaagaaccgccuccgggaguacgacuucgcgagcgaguccgaggaggacgagcagccgcccccccgcgggcccggcuuccgggggcgccggggccgcggcgagaagcggaaggagguggagcugacccaggggccgcgcgaggacgagccccagaagccccggaaggccgcccgccaggaggccggcggggacggcgcgcccgccaacccggaggagcccgggggcagccggcccggccccgggcgcagcccgcaggcccgcggccccucccggagccuggagaccggggccgccgcgcgcgagggcgggcccaagugcgccgaccggccguccgucgcccccaaggacccccuccaggugcccaccaacacggagaccagcgaggagacccgcccgucccuggacuucccccaggaggccaaggagcccgagaccgccgaggagagcgcgcccgacuccacggaguucaccgaggcccugcggagcccgcccgccgccugcgccggcgagaugggcgcgucccccgggcuccugauccccgagcagccgccccccagccgccacgacaccggcacccccaagccguccgggagccuggccaacacggccccccacggcuccagccccacccccggcguggggucccuccugggcgggccgggcgggacccaggcccccgucagccacaacuccaaggacccccccgcgcggcagccgggcgaguuccuggcccccguggccaaccccagcuccaccgccugccccaagccgagcguccucagcuccaagaucagcuccuucggcugcgaccccgccggguucaaccgcgacccccugggcgugccgguggcgaagaaggggccccagcccuacagcuccccccacagcgagcuguuccucggcccgaaggaccuggccgggugcuuccuggaggagcuccaccccaagcccuccgcccgggacgcccccccggccagcuccagcugccugugccaggacggcgaggacgcgggcucccuggagccccagcucccccgcagccccccggggacggccgagaccgagcccggccgggccgccuccccccccacccuggagagcuccagccuguucccggaccuccccgucgaccgcuucgaccccccccuguacgggucccugagcgccaaccgggacuccggccucccguucgcgugcgccgaccccccccagaagaccgugcccagcgacccgcccuaccccagcuuccugcugcucgaggagguguccccgaugcugcccagccacuuccccgaccuguccgggggcaagguccucagcaagacgugccccccggagcgcaccguggugcccggcgccgcccccucccugcccgggaagggcagcgggugcuccgucgcccugaugagccaccucuccgaggacgagcuggagauccagaagcuggugaccgagcucgagagccagcugcagcgguccaaggacacccgcggcgcgccgcgggagcuggccgaggccgagagcguggggcgcgucgagcucggcacgggcaccgagccccccucccagcggcgcaccugccaggccaccgugccccacgaggacaccuucagcgcggccgaccugacgcgggugggggaguccaccgcccaccgcgagggcgccgagagcgccgucgcgaccguggaggccgugcaggggcgcccgggcggcaccuggcccugccccgccuccuuccaccccgggcacgccgcccugcucccgugcgcgcaggaggaccuggucagcggcgcccccuucuccccccggggggccaacuuccacuuccagcccgugcagaaggccggcgccagcaagacggggcugugccaggcggagggcgacagccgcccgccccaggacgugugccuccccgagcccuccaagcagccgggcccccagcuggacgccgggagccuggccaagugcucccccgaccaggagcucagcuuccccaagaacaaggaggccgcguccagccaggaguccgaggacagccugcggcugcucccgugcgagcagcgcggcggguuccugcccgagcccggcaccgccgaccagccgcaccggggggcccccgcccccgaggccuucggcucccccgcgguccaccuggccccggaccucgccuuccagggcgacggggcccccccccuggacgccaccuggcccuucggcgcgagcccgucccacgccgcccaggggcacagcgccggccgcgccgggggccaccugcaccccaccgcgggccggcccggguucgagggcaacgaguucgcccccgccggggccuccagccucacggcgccgcgcggccgggaggccuggcuggugcccgugcccucccccgccugcgucagcaacacccacccgucccgccggagccaggaccccgcccugagcccccccauccgccagcugcagcucccgggccccgggguggccaaguccaaggacggcauccuggggcugcaggagcucacccccgcggcccagagccccccgcgggugaaccccuccggccuggaggggggcaccgucgagggcgggaagguggccugcggccccgcccaggggagccccggcggggugcaggucacgacccugccggccguggcgggccaccagcucggccuggaggccgacgggcacuggggccugcucgggcaggccgagaagacccagggccaggggaccgccaaccagcugcagcccgagaacggcgugucccccggcgggacggacaaccacgccagcgucaacgcguccccgaagaccgcccugaccggccccaccgagggggccgugcuccuggagaagugcaagggcagccgcgccgccaugucccugcaggaggaggcggagcccacgcccagcccgcccucccccaaccgggagagccucgcccuggcccugaccgccgcgcacucccgcagcggguccgagggccggacccccgagcgcgccagcuccccgggccucaacaagccccugcuggccaccggggacagccccgcccccuccgugggcgaccucgccgcgugcgccccgagccccacgagcgccgcccacaugcccugcucccuggggccccugccgcgggaggacccccucaccagccccucccgcgcccagggcggccuggggggccagcugcccgcgagcccguccugccgcgacccccccgggccccagcagcuccuggccugcagcccggccugggccccccuggaggaggccgacggcguccaggcgaccaccgacacgggggccgaggacucccccguggccccgcccagccucaccaccucccccugcgaccccaaggaggcccuggcgggcugccugcuccagggcgaggggagcccgcuggaggaccccuccagcuggccccccggcuccgugagcgccgucaccugcacgcacuccggggacaccccgaaggacagcacccugcggauccccgaggacucccgcaaggagaagcucugggagagccccggccgggccaccucccccccgcuggccggggccgugagccccagcguggcgguccgcgccacgggccuguccagcacccccaccggcgacgaggcccaggccgggcggggccuccccgggccggacccccagucccgcggcgcccccccccacaccaacccggaccggaugccccgcgggcacagcuccuacagccccuccaacaccgcgcggcugggccaccgcgagggccaggccgugacggccgugcccaccgagccgcccacccugcagggggccggccccgacagccccgccugccucgagggggagaugggcaccuccagcaaggagccggaggaccccggcacgcccgagaccgggcgguccggcgcgaccaagaugccgcgcgucaccugccccagcacggggcugggccuggggcggaccaccgcccccuccagcaccgccuccgacuuccagagcgacuccccccagagccaccgcaacgccucccaccagacgccgcagggcgacccccucggcccccaggaccugaagcagcggagccgcggguacaagaagaagcccgccagcaccgagaacggccaguggaaggggcaggcgccgcacggccccgugaccugcgaggugugcgccgccuccuuccggagcgggcccggccugucccgccacaaggcccggaagcaccgcccccacccgggcgcgcccgccgagcccagccccgccgcccucccggcccagcagccccuggagccccuggcgcagaagugccagcccccgcggaagaagucccaccgcgucagcgggaaggagcgccccaaccacucccggggcgaccccagccacgugacccagcccccgcccgcccagggguccaaggaggugcuccgcgcccccggcagcccccacucccagcagcugcacccgcccagccccacggagcacgaggucgacgugaagaccccggccuccaagccccggcccgaccaggcccgcgaggacgagcugcaccccaagcaggcggagaagcgggaggggcgccgguggcgccgggagccgaccgucgacagccccucccacagcgagggcaaguccaacaagaagcgcggcaagcuccgggggcgccggcugcgcgaggagagcauccugcccguguccgccgacgugaucagcgacggccgggggagccgccccuccccggccauggccagcuacgccgcgucccccagccacugccucuccgucgagggcgggcccgaggccgacggcgagcagcccccgcggcuggccacccugggccccggggugauggagggcgccgcggagacggaccaggaggcccucugcgccggggagaccggcgcccagaagccccccggcgaccgcaugcugugcccggggcggauggacggcgccgcgcugggggagcagcccaccggccagaagggggccagcgcccgcggcuucuggggcccccgcgagaccaaggcccucggggugugcaaggaguccggcagcgagcccgccgaggacuccagccgggcgcacucccgcagcgaggagggggucugggaggagaacacgccgccccugggcccccugggguuccccgagaccuccagcuccccggccgacagcaccaccuccagcugccuccagggccugcccgacaaccccgacacgcagggcggggugcagggcccggaggggcccacccccgacgccuccggcagcagcgccaaggaccccccgucccuguucgacgacgaggugagcuucucccagcucuucccccccgggggccggcugacccgcaagcggaacccccacgucuacggcaagcgcugcgagaagccggugcugccccuccccacccagcccagcuucgaggaggggggcgacccgacgcuggggcccgcccggcugcccaccgaccucuccgacagcuccagccugugccugugccacgaggaccccugggaggacgaggacccggcgggccuccccgaguccuuccugcuggacggcuuccucaacagccgcgugcccgggaucgaccccugggccccgggccugucccugugggcccucgagcccagccgggaggccggggcggagaagcugcccucccacugccccgaggacgaccgcccggaggccauccccgagcugcacaugguccccgccgccuggcggggccucgagaugcccgccccggcggacgacagcuccagcucccugggggacgugagccccgagcccccgagccuggagcgcgagcggugcgacggcggccuccccgggaacacccaccugcugccccuccgcgccaccgacuucgaggugcuguccacgaaguucgagaugcaggaccugugcuuccucggccccuucgaggacccggucgggcugcccggccccagcuuccuggacuucgaggggaccgccuccagccagggcccccagucccggcgcaccgaggaggccgccggcgcggggcgggcccagggccgcgggcggccggccaagggccgccgggccagcuacaagugcaaggugugcuuccagcgcuuccgcucccucggggagcuggaccugcacaagcuggcccacacccccgcgccccccccgacgugcuacaugugcguggagcggcgcuucggcagccgggagcuccugcgcggccaccugcaggagcggcacgcccaguccaaggccgggcccugggccugcggcaugugccucaaggaggucgccgacguguggauguacaacgagcaccugcgcgagcacgcggugcgguucgcccgccgggggcaggcccgccggagccugggcgaccuccccgggggccuggagggcuccagcgccgucgcgcaccugcucaacuccaucaccgagcccgccccgaagcaccaccgcgggaagcggagcgccggcaaggccgccgggucccccggcgaccccuggggccaggagggggaggcgaagaaggacagccccggcgagcgcgccaagccgcgggcccgcuccacccccagcaaccccgacggggccgccacccccgacuccgcgagcgccaccgcccuggccgacgccggcagcccggggcccccccggacgacccccuccccgagccccgaccccugggcgggcggcgagccgcugcuccaggccacccccgugcacgaggccugcaaggaccccucccgcgacugccaccacugcgggaagcgguuccccaagccguucaagcugcagcgccaccuggccgugcacagcccccagcgcgucuaccucugcccccggugcccccgcguguacccggagcacggcgagcugcuggcgcaccucgggggcgcccacgggcugcuggagcggcccgagcuccagcacaccccccuguacgccugcgagcugugcgccacggugaugcgcaucaucaagaaguccuucgccugcagcuccugcaacuacaccuucgcgaagaaggagcaguucgaccggcacaugaacaagcaccuccgcggcggccggcagcccuucgccuuccgcgggguccggcgcccgggcgcccccgggcagaaggcccgggcccuggagggcacccugcccagcaagcgccggcgcguggcgaugcccggguccgccccgggccccggcgaggaccggccccccccgcgcgggagcucccccauccucagcgagggcucccugcccgcccugcuccaccugugcagcgagguggcccccuccaccacgaagggguggccggagacccuggagcggcccgucgaccccgugacccacccgauccgcggcugcgagcuccccagcaaccaccaggagugcccccccccgucccugagccccuuccccgccgcgcuggccgacgggcggggcgacugcgcccucgacggcgcccuggagcgccccgagaacgaggcguccccggggagccccggcccccugcuccagcaggcccugccccugggggccagccucccgcggcccggcgcccgcggccaggacgccgaggggaagcgcgcgccccugguguucuccggcaagcggcgcgcccccggggcccggggccgcugcgccccggaccacuuccaggaggaccaccugcuccagaaggagaaggaggucagcuccagccacaugguguccgaggggggcccccggggcgccuuccacaaggggagcgcgaccaagcccgccggcugccaguccagcuccaaggaccgcagcgccgccuccacgcccagcaaggcccugaaguucccggugcacccccggaaggcggucgggucccuggcccccggcgagcucgcccgcgggaccgagaacggcaugaagcccgccaccccgaaggccaagcccggccccagcucccaggggagcggcuccccccggccggggaccaagacgggcgggggcagccagccccagcccgcguccggccagcugcagagcgagaccgccaccaccccggccaagcccagcuuccccucccgcagccccgccccggagcggcugcccgcgcgcgcccaggccaaguccugcacgaaggggccccgggaggccggcgagcaggggccccacggcagccucggcccgaaggagaagggggaguccagcaccaagcgcaagaagggccaggugcccgggcccgcccgguccgagagcgugggcuccuucgggcgcgcgcccagcgccccggacaagcccccccggaccccccgcaagcaggccaccccgucccggguccugcccacgaagcccaagcccaacagccagaacaagccgcgccccccccccuccgagcagcgcaaggccgagccgggccacacccagcggaaggaccgccugggcaaggccuucccccaggggcggccccuccugcgccccccgaagcggggcaccgcggugcacggggccgagcccgccgagccccacacccaccgcacggccgaggcccagagcgaccugcucucccagcuguucggccagcggcugaccggguucaagaucccgcucaagaaggacgcgagcgaguga

SEQ ID NO: 39064 - RNA, 771 nt, Artificial Sequence
  derived and/or modified sequence opt1 from ZNF483__Homo_sapiens__NP_001007170
augcaggccguggucccccugaacaagaugaccgccaucagcccggagccccagacccucgcguccacggagcagaacgaggugccccgcguggucaccagcggcgagcaggaggccauccugcgggggaacgccgccgacgccgaguccuuccgccagcgguuccgcugguucugcuacagcgagguggcgggcccccggaaggcccugucccagcucugggagcugugcaaccaguggcugcgcccggacauccacaccaaggagcagauccucgagcugcugguguucgagcaguuccucaccauccugcccggggagauccggaucugggucaagagccagcaccccgaguccagcgaggagguggugacgcugaucgaggaccucacccagaugcuggaggagaaggaccccgucucccaggacagcaccgugucccaggaggagaacagcaaggaggacaagauggugaccgucugcccgaacacggaguccugcgagagcaucacccugaaggacguggccgugaacuucucccgcggcgaguggaagaagcucgagcccuuccagaaggagcuguacaaggagguccugcucgagaaccugcggaaccuggaguuccucgacuuccccgugagcaagcuggagcugaucucccagcucaaguggguggagcugcccuggcugcucgaggaggucagcaaguccagccgccuggacauccacggggccgugaagaagaugcagauguucagcgaggcggaguga

SEQ ID NO: 39065 - RNA, 1590 nt, Artificial Sequence
  derived and/or modified sequence opt1 from ZNF490__Homo_sapiens__NP_065765
augcgccggaacagcucccugagcuuccagauggagcgcccccucgaggagcagguccaguccaaguggagcuccagccagggccggaccgggaccggcggguccgacgugcugcagaugcagaacagcgagcaccacggccaguccaucaagacccagaccgacagcaucucccuggaggacguggccgugaacuucacccucgaggagugggcccugcuggacccggggcagcgcaacaucuaccgggacgucaugcgcgcgaccuucaagaaccucgccugcaucggcgagaaguggaaggaccaggacaucgaggacgagcacaagaaccagggccggaaccugcgcagccccaugguggaggcccugugcgagaacaaggaggacugccccugcgggaaguccacgagccagauccccgaccucaacaccaaccuggagaccccgaccggccugaagcccugcgacugcuccgugugcggggaggucuucaugcaccaggugagccucaaccggcacaugcgcucccacacggagcagaagcccaacgagugccacgaguacggcgagaagccccacaagugcaaggagugcgggaagaccuucacccggagcuccagcauccgcacccacgagcggauccacacgggcgagaagccguacgagugcaaggagugcggcaaggccuucgccuuccuguucagcuuccgcaaccacauccggauccacaccggggagacccccuacgagugcaaggagugcggcaaggcguuccgcuaccugaccgcccuccggcgccacgagaagaaccacacgggggagaagcccuacaagugcaagcagugcggcaaggccuucaucuacuaccagcccuuccugacccacgagcggacccacaccggcgagaagccguacgagugcaagcagugcgggaaggccuucuccugccccacguaccugcgcagccacgagaagacccacaccggcgagaagcccuucgugugccgggagugcgggcgcgcguucuucucccacagcucccuccgcaagcacgucaagacccacacgggcgugcagcccuacacgugcaagaagugcggggaggccuucaagagcuccagcuccugcgaggugcacgagcggacccacuucggcgagaagccguacgagugcaagcagugcggcaaggccuucaacagcuccagcuaccugcagcugcacgagcgcguccacaccggggagaagaccuacgagugcaaggagugcggcaaggccuuccucuacuccacccacuuccggauccacgagcgcacccacacccgggagaagcccuacgagugcaagcagugcgggcgcguguucaucuacuucagccaccuccggcgccacgagcggucccacacgggcgugaagcccugcgagugcaagcagugcgggaaggccuucacgugccugaacagccugaagguccacaagcgcauccacaccggcgagcggcccuuccagugccgccagugcggcaaggcguucuccuacagcaagucccugcacgugcacgagcggacccacagccgccagaagccguga

SEQ ID NO: 39066 - RNA, 1596 nt, Artificial Sequence
  derived and/or modified sequence opt1 from ZNF492__Homo_sapiens__NP_065906
augcuggagaacuaccgcaaccucguguucgucggcaucgccgccagcaagcccgaccugaucacgugccuggagcaggggaaggagccguggaacgugaagcggcacgagaugguggcggagccgcccgucgugugcuccuacuucgcccgcgaccucuggcccaagcagggcaagaagaacuacuuccagaaggugauccugcggcgcuacaagaagugcgggugcgagaaccugcagcuccggaaguacugcaagagcauggacgagugcaagguccacaaggagugcuacaacggccugaaccagugccugaccaccacccagaacaagaucuuccagugcgacaaguacgugaagguguuccacaaguucuccaacagcaaccgccacaccauccggcacaccgggaagaaguccuucaagugcaaggagugcgagaaguccuucugcaugcucagccaccuggcccagcacaagcgcauccacagcggcgagaagcccuacaagugcaaggagugcggcaaggccuacaacgagacguccaaccugagcacccacaagcggauccacaccgggaagaagcccuacaagugcgaggagugcggcaaggccuucaaccgccucucccaccugaccacgcacaagaucauccacaccgggaagaagcccuacaagugcgaggagugcggcaaggcguucaaccagagcgccaaccugaccacccacaagcggauccacacgggggagaagcccuacaagugcgaggagugcggccgcgccuucucccagagcuccacccucaccgcccacaagaucauccacgcgggcgagaagccguacaagugcgaggagugcgggaaggccuucagccaguccagcacccugacgacccacaagaucauccacaccggcgagaaguucuacaagugcgaggagugcgggaaggccuucucccagcugagccaccucaccacgcacaagcggauccacagcggcgagaagcccuacaagugcgaggagugcggcaaggccuucaagcaguccagcacccugaccacccacaagcgcauccacgccggggagaaguucuacaagugcgaggucugcuccaaggcguucagccgguucucccaccugacgacccacaagcgcauccacaccggcgagaagcccuacaagugcgaggagugcgggaaggccuucaaccucagcucccagcugaccacgcacaagaucauccacaccggcgagaagcccuacaagugcgaggagugcgggaaggccuucaaccagagcuccacccugagcaagcacaaggugauccacaccggcgagaagccguacaaguacgaggagugcggcaaggccuucaaccaguccagccaccucacgacccacaagaugauccacaccggggagaagcccuacaagugcgaggagugcggcaaggccuucaacaacuccagcauccugaaccggcacaagaugauccacaccggggagaagcuguacaagcccgaguccugcaacaacgcgugcgacaacaucgccaagaucagcaaguacaagcgcaacugcgccggcgagaaguga

SEQ ID NO: 39067 - RNA, 1764 nt, Artificial Sequence
  derived and/or modified sequence opt1 from ZNF496__Homo_sapiens__NP_116141
augcccaccgcccugugcccgcgcgugcucgcccccaaggagagcgaggagccccggaagaugcgcuccccgcccggcgagaaccccagcccccagggggagcugcccuccccggagagcucccggcgccuguuccggcgcuuccgguaccaggaggcggccggcccccgcgaggcccuccagcggcugugggaccugugcgggggcuggcuccgccccgagcggcacaccaaggagcagauccuggagcugcucguccuggagcaguuccuggccauccucccccgcgagauccagagcugggugcgggcccaggagccggaguccggggagcaggcgguggccgccgucgaggcccuggagcgcgagcccggccggcccuggcaguggcugaagcacugcgaggaccccguggugaucgacgacggcgacagcccgcucgaccaggagcaggagcagcugcccgucgagccccacuccgaccuggcgaagaaccaggacgcccagcccaucacgcucgcccagugccuggggcugccgagccgcccgcccucccagcucagcggcgaccccgugcugcaggacgccuuccugcuccaggaggagaacgugcgggacacccagcaggucaccacccugcagcugccgcccucccgcgugagccccuucaaggacaugauccucugcuucuccgaggaggacuggagccugcuggaccccgcccagacgggguucuacggcgaguucaucaucggggaggacuacggcguguccaugccgcccaacgaccucgcggcccagcccgaccugagccagggcgaggagaacgagccccggguccccgagcugcaggaccuccaggggaaggaggugccccagguguccuaccuggacagccccagccugcagccguuccaggucgaggagcgccggaagcgcgaggagcuccaggugcccgaguuccaggccugcccccagaccguggucccccagaacaccuacccggccggcgggaacccccgcucccuggagaacagccuggacgaggaggugaccaucgagaucgugcucuccagcuccggcgacgaggacagccagcacggccccuacugcacggaggagcuggggucccccaccgagaagcagcggagccugccggccucccaccgcagcuccaccgaggcgggcggggagguccagaccagcaagaaguccuacgugugccccaacugcggcaagaucuuccgguggcgcgugaacuucauccggcaccuccgcagccggcgcgagcaggagaagccccacgagugcuccgucugcggggagcuguucagcgacuccgaggaccuggacggccaccucgagagccacgaggcccagaagcccuaccggugcggcgccugcgggaaguccuuccgccugaacagccaccuccugagccaccggcgcauccaccuccagccggaccggcugcagcccguggagaagcgcgagcaggccgccuccgaggacgcggacaagggccccaaggagccccuggagaacgggaaggccaagcugagcuuccagugcugcgagugcggcaaggccuuccagcggcacgaccaccuggcccgccaccggucccacuuccaccugaaggacaaggcccgcccguuccagugccgguacugcgucaagagcuucacgcagaacuacgaccuccugcgccacgagcgccugcacaugaagcggcgcuccaagcaggcgcucaacagcuacuga

SEQ ID NO: 39068 - RNA, 816 nt, Artificial Sequence
  derived and/or modified sequence opt1 from ZNF501__Homo_sapiens__NP_659481
augaacagcucccagaucagccugcgcaugaagcacggccgggugaacaugcagaagaagcccuccaagugcagcgagugcgggaaguucuucacccagcgcuccagccucacccagcaccagcggauccaccgcggcgagaagccguacgucugcuccgagugcgggagcugcuuccggaagcaguccaaccugacgcagcaccuccgcauccacaccggcgagaagcccuacaagugcaacgagugcgagaaggccuuccagaccaaggccauccuggugcagcaccuccggauccacaccggggagaagcccuacaagugcaacgagugcggcaaggcguucugccagagccccucccugaucaagcaccagcgcauccacacgggcgagaagccguacaagugcaccgagugcgggaaggccuucagccaguccaucugccugacccggcaccagcgcagccacuccggcgacaagcccuucaagugcaacgagugcgggaaggccuucaaccagagcgccugccugaugcagcaccagcggauccacuccggcgagaagcccuacacgugcaccgagugcgggaaggccuucacccagaacagcucccugguggagcacgagcgcacccacaccggcgagaagcucuacaagugcagcgagugcgagaagacguuccggaagcaggcgcaccugagcgagcacuaccgcauccacaccggcgagaagcccuacgagugcgucgggugcggcaaguccuuccggcacagcuccgcccugcuccgccaccagcggcugcacgccggggaguga

SEQ ID NO: 39069 - RNA, 2862 nt, Artificial Sequence
  derived and/or modified sequence opt1 from ZNF507__Homo_sapiens__NP_001129628
auggaggagagcuccagcguggccaugcugguccccgacaucggcgagcaggaggccauccucaccgcggaguccaucaucagcccgucccuggagaucgacgagcagcgcaagaccaagcccgacccccugauccacgugauccagaagcucagcaagaucguggagaacgagaagucccagaagugccugcugaucgggaagaagcggccccgcagcuccgccgccacgcacagccucgagacccaggagcugugcgagaucccggccaaggucauccagucccccgccgcggacacccggcgcgccgagaugagccagaccaacuucacgcccgacacccuggcccagaacgagggcaaggccauguccuaccagugcagccucugcaaguuccuguccagcuccuucagcgugcugaaggaccacaucaagcagcacgggcagcagaacgaggugauccucaugugcuccgagugccacaucaccagccggagccaggaggagcuggaggcgcacgucgugaacgaccacgacaacgacgccaacauccacacccaguccaaggcccagcagugcgugagccccuccagcucccugugccgcaagacgaccgagcggaacgagaccaucccggacauccccgucagcguggacaaccuccagacccacacggugcagaccgccuccgucgccgagaugggccgccggaagugguacgcguacgagcaguacgggauguaccgcugccuguucugcagcuacacgugcggccagcagcggaugcugaagacccacgccuggaagcacgccggcgagguggacugcuccuaccccaucuucgagaacgagaacgagccccucgggcugcuggacagcuccgccgccgcggccccgggcgggguggacgccgucgugaucgccaucggcgagagcgagcucuccauccacaacgggcccagcgugcagguccagaucugcuccagcgagcagcuguccagcuccagcccccuggagcagagcgccgagcgcggcgugcaccucucccagagcgugacccuggaccccaacgaggaggagaugcuggaggucaucuccgacgcggaggagaaccucaucccggacagccugcugaccuccgcccagaagaucaucagcuccagccccaacaagaagggccacgugaacgugaucgucgagcggcuccccuccgccgaggagacccugagccagaagcgcuuccugaugaacaccgagauggaggaggggaaggaccucucccugacggaggcccagaucggccgggaggggauggacgacguguaccgcgccgacaagugcaccgucgacaucggcggccugaucaucggguggagcuccagcgagaagaaggacgagcucaugaacaagggccuggcgaccgacgagaacgcgcccccggggcggcgccggaccaacuccgagagccugcgccuccacucccuggccgccgaggcccuggugacgaugcccauccgggccgccgagcucacccgcgccaaccugggccacuacggggacaucaaccugcucgaccccgacaccagccagcgccagguggacagcacccuggccgcguacuccaagaugaugagcccccugaagaacuccagcgacggccucacgucccugaaccagagcaacuccacccuggucgcccugccggagggccggcaggagcucagcgacggccaggugaagaccgggaucuccaugagccugcugaccgugaucgagaagcuccgcgagcggacggaccagaacgccuccgacgacgacauccugaaggagcugcaggacaacgcccagugccagcccaacagcgacaccucccucagcgggaacaacgucguggaguacauccccaacgccgagcgccccuaccggugccgccugugccacuacaccuccggcaacaagggguacaucaagcagcaccuccgggugcaccgccagcggcagccguaccagugccccaucugcgagcacaucgcggacaacagcaaggaccuggagucccacaugauccaccacugcaagacccgcaucuaccagugcaagcagugcgaggagagcuuccacuacaagucccagcugcggaaccacgagcgcgagcagcacagccugcccgacacgcucagcaucgccaccuccaacgagccgcggaucagcuccgacaccgccgacggcaagugcguccaggagggcaacaagagcuccgugcagaagcaguaccgcugcgacgugugcgacuacaccagcaccacguacgucggggugcggaaccaccgccggauccacaacuccgacaagcccuaccgcugcagccugugcggcuacgugugcucccacccgcccagccugaagucccacauguggaagcacgccagcgaccagaacuacaacuacgagcaggucaacaaggccaucaacgacgcgaucucccagagcgggcgggugcucggcaagucccccgggaagacccagcucaagagcuccgaggagagcgccgaccccgugaccggcuccagcgagaacgccgucagcuccagcgagcugaugucccagacccccagcgaggugcugggcacgaacgagaacgagaagcugucccccaccagcaacaccuccuacagccuggagaagaucuccagccucgccccgcccuccauggaguacugcgugcugcuguucugcugcugcaucugcggguucgagagcaccuccaaggagaaccuccuggaccacaugaaggagcacgagggcgagaucgucaacaucauccugaacaaggaccacaacacggcgcucaacaccaacuga

SEQ ID NO: 39070 - RNA, 2679 nt, Artificial Sequence
  derived and/or modified sequence opt1 from ZNF512B__Homo_sapiens__NP_065764
augaccgaccccuucugcgugggcgggcgccggcugcccggcagcuccaagagcgggcccggcaaggacgggucccgcaaggagguccggcuccccaugcugcacgacccgcccaagaugggcaugcccguggugcgcggcgggcagaccguccccggccaggcgccccugugcuucgacccggggagccccgccuccgacaagacggagggcaagaagaaggggcggcccaaggcggagaaccaggcccuccgcgacaucccccugagccugaugaacgacuggaaggacgaguucaaggcccacucccgggugaagugcccgaacagcggcugcuggcucgaguuccccuccaucuacggccugaaguaccacuaccagcgcugccagggcggggccaucagcgaccggcuggccuuccccugccccuucugcgaggcggccuucaccuccaagacccagcucgagaagcaccgcaucuggaaccacauggaccggccgcugcccgccagcaagcccgggcccaucucccgcccggugaccaucagccggcccgucggcguguccaagcccaucggcgugagcaagcccgucacgaucgggaagccggugggcguguccaagcccaucgggaucagcaagcccgucuccgugggccgccccaugccggugaccaaggccauccccgucacccggcccgugccggugaccaagcccgucacggugagccgccccaugcccgugaccaaggcgaugccggucaccaagcccaucaccgugacgaaguccgugcccgucaccaagcccgugccggucaccaagcccaucaccgugacgaagcuggugaccgucaccaagcccgugcccgugaccaagccggucacggugucccggcccaucguggucagcaagcccgugaccgugagccgccccaucgccaucagccggcacaccccgcccugcaagaugguccuccugacccgcuccgagaacaaggcgccccgggccacggggcgcaacagcggcaagaagcgcgccgccgacucccuggacacgugccccaucccgcccaagcaggcccggcccgagaacggcgaguacgggcccagcuccaugggccagagcuccgccuuccagcucagcgccgacaccuccagcgggucccugagcccgggcucccgccccagcgggggcauggaggcccugaaggcggccggccccgccuccccgcccgaggaggaccccgagcggaccaagcaccgccggaagcagaagacccccaagaaguucaccggggagcagccgagcaucagcggcaccuucgggcucaagggccuggugaaggccgaggacaaggcccgcgugcaccgguccaagaagcaggaggggcccggccccgaggacgcgcgcaagaagguccccgccgccccgaucaccgugagcaaggaggcccccgcccccguggcgcaccccgccccgggcgggcccgaggagcaguggcagcgggccauccacgagcgcggcgaggccgucugccccacgugcaacguggugacccggaagacccuggucgggcucaagaagcacauggaggugugccagaagcugcaggacgcgcugaagugccagcacugccgcaagcaguucaaguccaaggccggccucaacuaccacaccauggccgagcacagcgccaagcccuccgacgccgaggcgagcgagggcggggagcaggaggagcgggagcgccugcggaaggugcugaagcagaugggccgccuccggugcccgcaggaggggugcggcgccgccuucuccagccugaugggguaccaguaccaccagcgccggugcggcaagccgcccugcgaggucgacucccccagcuuccccugcacgcacugcggcaagaccuaccgcuccaaggccgggcacgacuaccacgugcgcagcgagcacaccgccccgccgcccgaggagcccaccgacaagucccccgaggcggaggacccccugggcguggagcggacccccagcgggcgcguccggcgcacguccgcccagguggccguguuccaccuccaggagaucgccgaggacgagcuggcccgggacuggaccaagcgccggaugaaggacgaccugguccccgagaccgcgcgccucaacuacacccggcccggccugcccacgcugaacccgcagcuccuggaggccuggaagaacgaggugaaggagaaggggcacgugaacugccccaacgacugcugcgaggccaucuacagcuccgucagcggccugaaggcccaccucgcgagcugcuccaagggcgcccaccuggccgggaaguaccgcugccugcucugccccaaggaguucagcuccgagagcggcgugaaguaccacauccugaagacccacgccgagaacugguuccggaccuccgccgacccgccgcccaagcaccgcagccaggacucccuggugcccaagaaggagaagaagaagaaccucgccgggggcaagaagcgggggcgcaagcccaaggagcggacccccgaggagcccgucgccaagcugccgccccgccgggacgacuggccgcccggcugccgcgacaagggcgcccgggggagcacgggccgcaagguggggguguccaaggcccccgagaaguga

SEQ ID NO: 39071 - RNA, 1617 nt, Artificial Sequence
  derived and/or modified sequence opt1 from ZNF512__Homo_sapiens__NP_001258215
augagcucccgccugggcgccgugcccgccaccagcgggcccaccacguucaagcagcagcgguccacccgcaucgucggcgcgaagaaccggacccagugcagcaucaaggacaacuccuuccaguacaccaucccccacgacgacagccucuccgggagcuccagcgccuccagcugcgagcccguguccgacuuccccgccagcuuccgcaaguccacguacuggaugaagaugcggcgcaucaagccggccgccaccagccacguggagggcuccgggggcgucagcgcgaagggcaagcggaagccccgccaggaggaggacgaggacuaccgggaguucccccagaagaagcacaagcuguacgggucccuggaggagcagugguaccucgagaucguggacaagggcagcgugagcugcccgaccugccaggccgucgggcgcaagaccaucgagggccugaagaagcacauggagaacugcaagcaggagauguucacgugccaccacugcgggaagcagcugcggucccucgccggcaugaaguaccacgugauggccaaccacaacagccugcccauccugaaggcgggcgacgagaucgacgagcccuccgagcgcgagcggcuccgcaccgugcugaagcggcuggggaagcuccgcugcaugcgggagagcugcuccagcuccuucaccagcaucaugggcuaccuguaccacguccgcaagugcgggaagggcgccgccgagcuggagaagaugacccucaagugccaccacugcggcaagcccuaccgguccaaggccgggcuggccuaccaccuccgcagcgagcacggccccaucuccuucuucccggagagcgggcagcccgagugccugaaggagaugaaccuggaguccaagagcggcgggcgggugcagcgccgcuccgcgaagaucgccguguaccaccuccaggagcuggccagcgccgagcuggccaaggaguggcccaagcggaagguccugcaggaccucgugcccgacgaccgcaagcugaaguacacgcggccgggccugcccaccuucucccaggaggugcuccacaaguggaagaccgacaucaagaaguaccaccgcauccagugccccaaccagggcugcgaggcggucuacagcuccgugagcgggcugaaggcccaccugggcagcugcacccucgggaacuucguggccggcaaguacaagugccugcugugccagaaggaguucgucuccgagagcggggugaaguaccacaucaacuccgugcacgccgaggacugguucgucgugaaccccacgaccaccaagagcuucgagaagcucaugaagaucaagcagcggcagcaggaggaggagaagcgccggcagcagcaccgcucccggcgcagccugcggcgccggcagcagccgggcaucgagcugcccgagaccgagcucucccugcgcgugggcaaggaccagcggcgcaacaacgaggagcuggucgugagcgccuccugcaaggagcccgagcaggagcccgucccggcgcaguuccagaaggugaagccgcccaagacgaaccacaagcgggggcgcaaguga

SEQ ID NO: 39072 - RNA, 1440 nt, Artificial Sequence
  derived and/or modified sequence opt1 from ZNF513__Homo_sapiens__NP_001188388
augggcuucgagcgcgacagcgagggggacucccugggcgcccggcccgggcuccccuacggccugagcgacgacgaguccgggggcggccgcgcccugagcgcggaguccgagguggaggagcccgcccgggggcccggcgaggcccgcggggagcggcccggcccggccugccagcucugcgggggccccaccggcgaggggcccugcugcggcgccgggggccccggcgggggcccgcugcugccgccccgccuccuguacagcugccggcugugcaccuucgucucccacuacagcucccaccucaagcgccacaugcagacgcacagcggggagaagcccuuccggugcggccgcugccccuacgcguccgcccagcuggugaaccugacccggcacacccgcacccacacgggggagaagcccuaccggugcccccacugccccuucgccugcagcucccucggcaaccugcgccggcaccagcgcacccacgccggcccgcccaccccgcccugcccgaccugcggguuccggugcugcacgccccgccccgcgcggccgcccagccccaccgagcaggagggcgccgugccccgccggcccgaggacgcccugcuccugcccgaccugucccuccacgucccgcccgggggcgccagcuuccugcccgacugcgggcagcugcgcggcgagggcgaggggcucugcggcaccggguccgagccccugcccgagcuccuguuccccuggaccugccgcggcugcgggcaggagcuggaggagggcgagggcagccggcugggggccgcgaugugcggccgcugcaugcgcggggaggccggcggcggggccuccggcgggccgcagggccccagcgacaagggguucgccugcagccucugccccuucgccacgcacuaccccaaccaccuggcgcggcacaugaagacccacuccggcgagaagccguuccggugcgcccgcugccccuacgccagcgcccaccuggacaaccucaagcggcaccagcgcgugcacaccggcgagaagcccuacaagugcccccugugcccguacgccugcgggaaccuggcgaaccucaagcggcacggccgcauccacuccggggacaagcccuuccggugcagccugugcaacuacuccugcaaccagagcaugaaccugaagcgccacaugcuccggcacaccggcgagaagcccuuccgcugcgccacgugcgccuacaccaccgggcacugggacaacuacaagcggcaccagaaggugcacggccacggcggggccggcgggcccggccuguccgccagcgaggggugggcgccgccccacuccccgcccagcguccuguccagccgcggcccgcccgcccucggcaccgccgggucccgggccgugcacacggacagcuccuga

SEQ ID NO: 39073 - RNA, 3492 nt, Artificial Sequence
  derived and/or modified sequence opt1 from ZNF516__Homo_sapiens__NP_055458
auggaccgcaaccgggaggccgagauggagcugcgccggggccccagccccacccgcgccgggcggggccacgagguggacggggacaaggcgaccugccacacgugcugcaucugcggcaaguccuuccccuuccagagcucccucagccagcacaugcgcaagcacaccggggagaagcccuacaagugccccuacugcgaccaccgggccucccagaagggcaaccugaagauccacauccgcagccaccggaccggcacccugauccaggggcacgagccggaggccggcgaggcgccccucggggagaugcgcgccuccgagggccuggacgccugcgccagccccacgaaguccgccagcgccugcaaccggcugcucaacggggcgucccaggccgacggcgcccgcguccugaacggcgccagccaggccgacuccgggcgggugcugcuccgcagcuccaagaagggcgcggaggggagcgccugcgcccccggcgaggccaaggccgcggugcagugcuccuucugcaagagccaguucgagcggaagaaggaccuggagcugcacguccaccaggcccacaagccguucaagugccgccucugcuccuacgccacccugcgggaggagagccugcucagccacaucgagcgcgaccacaucaccgcccagggccccggguccggcgaggccugcguggagaacgggaagcccgagcugagccccggcgaguucccgugcgaggugugcgggcaggcguucucccagaccugguuccugaaggcccacaugaagaagcaccggggcagcuucgaccacggcugccacaucugcgggcgccgguucaaggagcccugguuccucaagaaccacaugaaggcccacggccccaagacgggguccaagaaccgccccaagagcgagcuggacccgaucgccaccaucaacaacgucgugcaggaggaggugaucgucgccggccugucccucuacgaggugugcgcgaagugcgggaaccuguucaccaaccuggacagccucaacgcccacaacgccauccaccgccggguggaggccucccgcacccgggcgcccgccgaggagggcgccgagggccccagcgacacgaagcaguucuuccugcagugccugaaccuccgccccuccgccgccggggacagcugcccgggcacccaggcggggcggcgcgucgccgagcuggaccccgugaacuccuaccaggccuggcagcuggccacccggggcaagguggccgagcccgcggaguaccucaaguacggggccugggacgaggcccuggccggcgacgucgccuucgacaaggaccgccgggaguacgugcuggugagccaggagaagcgcaagcgggagcaggacgcgcccgccgcccagggcccgccccgcaagcgggccuccgggcccggcgaccccgcgccggccgggcaccucgacccccgcagcgccgcccggcccaaccgccgggccgcggccaccacgggccagggcaaguccagcgagugcuucgagugcgggaagaucuuccgcaccuaccaccagaugguccugcacucccgggugcaccgccgcgcccggcgcgagcgggacagcgacggcgaccgcgccgcccgggcgcgcugcgggagccuguccgagggcgacagcgccucccagccgagcucccccgggagcgccugcgccgccgcggacucccccggcagcggccucgccgacgaggccgccgaggacuccggggaggagggcgcgcccgagccggcccccgggggccagccccggcgcugcugcuucagcgaggaggugaccuccaccgagcugagcuccggggaccagagccacaagaugggcgacaacgccuccgagcgggacacgggcgagagcaaggccgggaucgccgcguccgucagcauccuggagaacagcucccgcgagaccagccggcgccaggagcagcaccgguucuccauggaccucaagaugcccgccuuccacccgaagcaggaggugcccgugcccggcgacggggucgaguuccccagcuccaccggcgccgaggggcagaccggccacccggccgagaagcugagcgaccugcacaacaaggagcacuccggcgggggcaagcgcgcccucgcgcccgaccugaugccccuggaccucagcgcccgguccacgcgcgacgaccccagcaacaaggagaccgccuccagccugcaggccgcccuggugguccacccgugccccuacugcucccacaagaccuacuaccccgaggugcucuggaugcacaagcggaucuggcaccgcgugagcugcaacuccgucgcgcccccguggauccagcccaacggguacaagagcauccgguccaaccugguguuccugagccgcuccggccggaccgggccgcccccggcccugggcggcaaggagugccagccccuccugcuggcccgcuucacgcgcacccaggugcccgggggcaugccggggagcaagagcggcuccagcccccucggcgucgugaccaaggccgccuccaugcccaagaacaaggagagccacuccgggggccccugcgcgcugugggccccggggcccgacggcuaccggcagaccaagcccugccacgggcaggagccccacggcgccgccacgcagggcccgcuggcgaagccccgccaggaggccagcuccaagcccgugcccgcccccgggggcgggggcuucagccgguccgccacccccacccccaccgucaucgcccgcgcgggggcccagcccagcgccaacuccaagccgguggagaaguucggcgugccgcccgccggcgccggguucgcgcccacgaacaagcacagcgcccccgacucccucaaggccaaguucagcgcccagccccagggcccgccgcccgccaagggggagggcggggcgccgccccugccgccccgggagccgcccuccaaggccgcccaggagcugcgcacccucgcgaccugcgccgccggcagccggggcgacgccgcccugcaggcccagcccggggucgcgggcgccccgcccgugcugcacuccaucaagcaggagcccguggccgaggggcacgagaagcgccucgacauccugaacaucuucaagaccuacauccccaaggacuucgccacccuguaccagggcuggggcgucagcgggcccggccucgagcaccgggggacgcugcgcacccaggcccggcccggcgaguucgugugcaucgagugcgggaaguccuuccaccagcccggccaccuccgcgcgcacaugcgggcccacagcguggucuucgagagcgacggcccccgcggguccgaggugcacaccaccagcgccgacgcccccaagcagggccgggaccacuccaacacggggaccgugcagaccgucccccugcgcaagggcaccuga

SEQ ID NO: 39074 - RNA, 1623 nt, Artificial Sequence
  derived and/or modified sequence opt1 from ZNF519__Homo_sapiens__XP_011523906
auggagcugcucaccuuccgcgacguggccaucgaguucagccccgaggaguggaagugccuggacccggcccagcagaaccuguaccgggacgucaugcucgagaacuaccgcaaccuggugucccuggcgguguacagcuacuacaaccagggcauccuccccgagcaggggauccaggacuccuucaagaaggccacccugggccgguacgggagcugcggccuggagaacaucugccucuggaagaacugggaguccaucggggagggcgagggccagaaggagugcuacaaccugugcagccaguaccugacgaccucccacaacaagcaccucaccgucaagggggacaaggaguaccgcaucuuccagaagaagccccaguuccugagcgccgcccccaccgagccgugcauccccaugaacaaguaccagcacaaguuccugaaguccguguucugcaacaagaaccagaucaacuucaaccacgacagcaacaucuccaagcaccacagcacgcacuuccucgagaacuacuacaacugcaacgagugcgagaagguguucuaccaguccagcaagcugaucuuccccgagaacauccacauccagaagaagcccuacaacuccaacgagugcggcgagaccagcgacccguucuccaagcugacccagcaccagcggaucuacaucggggagagcucccagcgcugcaacaagaagugcaucaucgucuucagccagagccaccucaagggccacaagaucaucaacaccggggagaaguccgugaaguacaaggagcggggcaaggccuucacgcgcggccugcaccuggggcaccagaagauccacaccggcgagaagcccuacaagugcaagaagugcgacaaggcguucaacaagagcucccaccucgcccagcaccagcggauccacaccggggagaagcccuucaagugcaaggagugcggcaaggccuucaaccgcggcagcuaccugacccagcaccagcggauccacacgggggagcgcgccuucaagugcgaggagugcggcaaggcguucaaccggggguccuaccugacccagcaccagcgcauccacaccggcgagaagcccuuccggugcaaggagugcgggaaggccuucaaccgcagcuccuacgugacccagcaccagcggaugcacacgggcgagaagccguucaagugcaaggagugcggcaaggccuucaaccgcgccagccaccucacccagcaccagcggauccacaccggggagaagcacuucaagugcaaggagugcggcaaggccuucaaccgcgggucccaccugacccggcaccagcgcauccacacgggcgagaaguccuucaagugcgaggagugcgggaaggcguucaucuggggcagccaccugacccagcaccagcgcguccacaccggcgagaaguucuucaagugcaaggagugcgggaaggccuucacccggagcucccaccucacgcagcaccagcgcauccacaccggcgagaagcccuucaagugcaaggagugcgggaaggccuucaaccggcgcagcacccugacccagcaccagaucauccacacgcgguga

SEQ ID NO: 39075 - RNA, 3936 nt, Artificial Sequence
  derived and/or modified sequence opt1 from ZNF521__Homo_sapiens__NP_056276
augagccgccggaagcaggccaagccccgcucccugaaggacccgaacugcaagcucgaggacaagaccgaggacggcgaggcccuggacugcaagaagcggcccgaggacggggaggagcuggaggacgaggcggugcacagcugcgacuccugccuccaggucuucgagagccuguccgacaucaccgagcacaagaucaaccagugccagcugacggacggcguggacguggaggacgacccgaccugcagcuggcccgccuccagccccuccagcaaggaccagaccucccccagccacggggagggcugcgacuucggggaggaggagggcggccccgggcuccccuacccgugccaguucugcgacaaguccuucagccgccuguccuaccugaagcaccacgagcagagccacuccgacaagcuccccuucaagugcaccuacugcagccggcuguucaagcacaagcgcucccgggaccgccacaucaagcugcacacgggcgacaagaaguaccacugcagcgagugcgacgccgccuucagccgguccgaccaccucaagauccaccugaagacccacaccagcaacaagcccuacaagugcgccaucugccgccggggguuccuguccagcuccagccuccacggccacaugcagguccacgagcgcaacaaggacgggucccagagcggcucccggauggaggacuggaagaugaaggacacccagaagugcagccagugcgaggagggcuucgacuuccccgaggaccugcagaagcacaucgcggagugccacccggagugcucccccaacgaggaccgcgccgcccugcagugcguguacugccacgagcuguucguggaggagacgagccugaugaaccacauggagcagguccacuccggggagaagaagaacagcugcuccaucugcagcgaguccuuccacaccguggaggagcuguacagccacauggacucccaccagcagcccgagagcugcaaccacagcaacucccccagccucgugaccgucggcuacaccuccgugagcuccacgaccccggacagcaaccuguccguggacagcuccaccauggucgaggccgcgccgcccauccccaagagccgggggcgcaagcgggccgcccagcagacccccgacaugacgggccccuccagcaagcaggccaaggugaccuacuccugcaucuacugcaacaagcagcuguucagcucccucgccgugcugcagauccaccugaagaccaugcaccucgacaagcccgagcaggcgcacaucugccaguacugccuggagguccugcccagccucuacaaccugaacgagcaccugaagcagguccacgaggcccaggacccgggccucaucguguccgccaugcccgccaucguguaccagugcaacuucugcagcgagguggugaacgaccugaacacccugcaggagcacauccgcugcagccacggguucgccaaccccgcggccaaggacuccaacgccuucuucugcccccacugcuacaugggcuuccucacggacagcucccuggaggagcacauccggcagguccacugcgaccugagcgggucccgcuucggcagcccggugcucgggacccccaaggagcccguggucgagguguacuccugcagcuacugcaccaacuccccgaucuucaacagcguccugaagcugaacaagcacaucaaggagaaccacaagaacaucccccucgcccugaacuacauccacaacggcaagaagucccgggcccugagcccccucucccccguggcgaucgagcagaccagccugaagaugaugcaggccgugggcggggccccggcccgccccacgggcgaguacaucugcaaccagugcggggccaaguacaccucccuggacagcuuccagacccaccucaagacccaccuggacacgguccugcccaagcugaccugcccccagugcaacaaggaguucccgaaccaggagucccuccugaagcacgugaccauccacuucaugaucaccagcacguacuacaucugcgaguccugcgacaagcaguucaccagcguggacgaccugcagaagcaccuccuggacaugcacaccuucgucuucuuccgcugcacccugugccaggagguguucgacagcaagguguccauccagcuccaccuggcggucaagcacagcaacgagaagaagguguaccggugcacguccugcaacugggacuuccgcaacgagaccgaccugcagcuccacgugaagcacaaccaccuggagaaccagggcaagguccacaagugcaucuucugcggggagagcuucggcaccgagguggagcugcagugccacaucaccacccacuccaagaaguacaacugcaaguucugcagcaaggccuuccacgccaucauccuccuggagaagcaccuccgggagaagcacugcguguucgagacgaagacccccaacugcggcaccaacggggccuccgagcagguccagaaggaggagguggagcuccagacccugcugacgaacagccaggagucccacaacagccacgacggcuccgaggaggacguggacaccagcgagcccauguacgggugcgacaucugcggcgcggccuacaccauggagacccuccugcagaaccaccagcugcgcgaccacaacauccggcccggggaguccgccaucgucaagaagaaggccgagcucaucaagggcaacuacaagugcaacgugugcagccgcacguucuucuccgagaacggccugcgggagcacaugcagacccaccuggggccggugaagcacuacaugugccccaucugcggcgagcgcuuccccagccuccugacccugaccgagcacaaggucacgcacuccaagagccucgacaccgggaacugccggaucugcaagaugccccugcaguccgaggaggaguuccuggagcacugccagaugcacccggaccuccgcaacagccugaccggcuuccggugcguggugugcaugcagaccgucacgagcacccuggagcucaagauccacggcaccuuccacaugcagaagaccgggaacggcuccgccgugcagacgaccgggcgcggccagcacgugcagaagcuguacaagugcgcgagcugccugaaggaguuccgguccaagcaggaccucgucaagcuggacaucaacgggcugcccuacggccucugcgccggcugcgugaaccugagcaaguccgccagccccgggaucaacgugcccccgggcaccaaccgccccgggcugggccagaacgagaaccucuccgccaucgaggggaagggcaaggucggcgggcugaagacccggugcagcuccugcaacgugaaguucgagagcgaguccgagcugcagaaccacauccagacgauccaccgcgagcucgugcccgacagcaacuccacccagcugaagacgccccaggucagcccgaugccccggaucucccccagccaguccgacgagaagaagaccuaccagugcaucaagugccagaugguguucuacaacgagugggacauccaggugcacgucgccaaccacaugaucgacgagggccugaaccacgagugcaagcucugcagccagaccuucgacuccccggcgaagcugcagugccaccugaucgagcacagcuucgaggggaugggcgggaccuucaagugccccgugugcuucaccguguucguccaggccaacaagcuccagcagcacaucuucagcgcccacggccaggaggacaagaucuacgacugcacccagugcccccagaaguucuucuuccagacggagcugcagaaccacaccaugacccagcacuccagcuga

SEQ ID NO: 39076 - RNA, 3903 nt, Artificial Sequence
  derived and/or modified sequence opt1 from ZNF536__Homo_sapiens__NP_055532
auggaggaggccagccugugccucggcguguccagcgccgagcccgaggcggagccgcaccuguccgggcccguccugaacggccaguacgccaugagccagaagcuccaccagaucaccucccagcugagccacgccuuccccgagcugcacccccgcccgaaccccgaggagaagccgcccgccucccucgaggagaaggcccacgugcccaugagcgggcagcccaugggcucccagauggcgcugcuggccaaccagcucgggcgggagguggacaccagccugaacggccgcgucgaccugcagcaguuccucaacggccagaaccuggggaucaugucccagaugagcgacaucgaggacgacgcccggaagaaccgcaaguaccccugcccccugugcggcaagcgguuccgcuucaacuccauccucagccugcacaugcggacgcacaccggggagaagccguucaagugccccuacugcgaccaccgcgccgcgcagaagggcaaccugaagauccaccuccggacccacaagcuggggaaccugggcaagggccgcgggcgggugcgcgaggagaaccggcuccugcacgagcuggaggagcgcgccauccuccgggacaagcagcugaagggcucccugcuccagccccgccccgaccugaagccgccgccccacgcccagcaggcgccccuggccgccugcacccucgcccugcaggccaaccacagcgugcccgacgucgcccaccccgugcccucccccaagccggccagcgugcaggaggacgcggucgcccccgccgccggguuccggugcacguucugcaagggcaaguucaagaagcgcgaggagcuggaccggcacauccgcauccuccacaagcccuacaagugcacccugugcgacuucgccgcgucccaggaggaggagcugaucagccacguggagaaggcccacaucaccgccgagagcgcccagggccaggggcccaacggcgggggcgagcaguccgccaacgaguuccggugcgaggugugcgggcaggucuucagccaggcgugguuccucaagggccacaugcgcaagcacaaggacuccuucgagcacugcugccagaucugcggccgccgguucaaggagccgugguuccugaagaaccacaugaaggugcaccugaacaagcucagcgugaagaacaagucccccagcgaccccgaggucccggugcccaugggcgggaugucccaggaggcccacgccaaccuguacagccgcuaccuguccugccuccagagcggguucaugacccccgacaaggccggccuguccgagcccagccagcuguacgggaagggcgagcucccgaugaaggagaaggaggcgcugggcaagcugcucucccccaucagcuccauggcccacggggugcccgagggcgacaagcacagccugcuggggugccugaaccucgugcccccgcugaaguccagcugcaucgagcggcugcaggccgccgccaaggcggccgagauggaccccgucaacuccuaccaggccuggcagcucauggcccgcggcauggccauggagcacggguuccugagcaaggagcacccccugcagcggaaccacgaggacacgcucgcgaacgccggcgugcuguucgacaaggagaagcgcgaguacguccuggugggcgccgacgggagcaagcagaagaugcccgccgaccucgugcacuccaccaaggucggcagccagcgggaccugccguccaagcuggacccccucgagagcucccgcgacuuccugagccacgggcugaaccagacccucgaguacaaccugcagggccccggcaacaugaaggagaagcccaccgagugcccggacugcgggcggguguuccgcacguaccaccaggucguggugcacucccggguccacaagcgcgaccggaagggcgaggaggacgggcugcacgugggccucgacgagcgccgggggagcggcuccgaccaggagagccaguccgugagccgcuccaccacccccggcagcuccaacgucaccgaggagagcggggugggcgggggccugucccagacggggagcgcccaggaggacagcccccaccccuccagcccguccagcuccgacaucggcgaggaggcgggccggagcgccggggugcagcagcccgcccugcuccgcgaccggucccugggcagcgccaugaaggacugccccuacugcgggaagaccuuccgcaccucccaccaccugaagguccaccuccgcauccacaccggcgagaagcccuacaagugcccgcacugcgacuacgcggggacgcagagcgccucccugaaguaccaccuggagcggcaccaccgcgagcggcagaacggcgccggcccccucagcgggcagcccccgaaccaggaccacaaggacgagauguccagcaaggccucccuguucauccgccccgacauccugcggggcgccuucaaggggcuccccggcaucgacuuccgcgggggccccgcgagccagcaguggaccuccggcgugcugagcuccggggaccacagcggccaggccaccgggaugagcuccgaggugccgagcgacgcccugaagggcaccgaccuccccuccaagagcacgcacuucuccgagaucggccgggccuaccagagcaucgucuccaacggggugaacuuccagggcagccugcaggccuucauggacuccuucgugcugagcucccucaagaaggagaaggacaugaaggacaaggcgcuggccgacccgcccagcaugaagguccacgggguggacggcggggaggagaagcccuccggcaagagcucccagcgcaagagcgagaagucccaguacgagccccuggaccucagcgugcggcccgacgccgccucccugcccggcagcagcgucaccgugcaggacuccaucgccuggcacgggugccuguucugcgcguucaccaccagcuccauggagcucauggcccugcaccuccaggccaaccaccugggcaaggccaagcgcaaggacaacacgaucggggugaccgucaacugcaaggaccaggcgcgggaggccagcaagauggcccugcugccgucccuccagagcaacaaggaccugggccuguccaacaugaucagcucccucgacagcgccuccgagaagauggcccaggggcagcugaaggagacccugggcgagcagaaguccggcgcguggaccgggcacguggaccccgccuucugcaacuuccccagcgacuucuacaagcaguucggcguguaccccgggauggucggcagcggggccuccagcuccugcccgaacaaggagcccgacggcaaggcccacagcgaggaggacgugcccauccucauccccgagacgaccuccaagaacaccaccgacgaccugagcgacaucgccagcuccgaggacauggacagcuccaagggcgagaacaacgacgaggaggacguggagacggagccggagaugaugaccaagccccugagcgcgcucuccaaggacagcuccagcgacgggggcgacucccugcagcccaccgggaccagccagcccguccagggccugguguccccgcucagccaggcccccgagaagcaguggcacucccagggccugcugcaggcccaggacccccucgccgggcugcccaagccggagcgcggcccccagagccuggacaagcccaugaacaugcucuccgugcugcgggccuacagcuccgacgggcuggcggccuucaacggccucgccagcuccaccgccaacagcgggugcaucaagcgcccggaccugugcggcaaguga

SEQ ID NO: 39077 - RNA, 1884 nt, Artificial Sequence
  derived and/or modified sequence opt1 from ZNF555__Homo_sapiens__NP_001166246
auggacagcguggucuucgaggacguggccguggacuucacccuggaggagugggcccuccuggacuccgcgcagcgcgaccuguaccgggacgucaugcucgagaccuuccagaaccuggccagcguggacgacgagacgcaguucaaggccuccggcagcgugucccagcaggacaucuacggggagaagauccccaaggagagcaagaucgccaccuucacccgcaacgucuccugggccagcgugcugggcaagaucugggacucccucagcaucgaggaccagaccacgaaccaggggcggaaccugcgcaaccacggccuggagcggcucugcgaguccaacgaccagugcggggaggcgcugagccagaucccgcaccugaaccucuacaagaagaucccgcccggcgugaagcaguacgaguacaacaccuacggcaaggucuucaugcaccgccggaccucccugaagucccccaucaccgugcacacggggcacaagcccuaccagugccaggagugcggccaggccuacagcugccgcagccaccuccggaugcacgugcgcacccacaacggggagcggcccuacgucugcaagcugugcggcaagaccuucccccgcaccuccagccugaaccggcacgugcgcauccacacggccgagaagaccuacgagugcaagcagugcgggaaggccuucaucgacuucuccagccugaccagccaccuccggucccacaccggcgagaagcccuacaagugcaaggagugcggcaaggcguucagcuacuccagcacguuccgccggcacaccaucacccacaccggggagaagccguacaagugcaaggagugcgccgaggccuucuccuacagcuccacguuccgccggcacaugaucagccacaccggcgagaagccccacaagugcaaggagugcggggaggccuucuccuacagcuccgccuuccgccggcacaugaucacccacaccggcgagaagcccuacgagugcaagcagugcggcaagacguucaucuaccugcagagcuuccgccgccacgagcggauccacaccggggagaagcccuacgagugcaagcagugcggcaagaccuucaucuacccgcaguccuuccgccggcacgagcgcacccacgggggcgagaagcccuacgagugcaaccagugcgggaaggcguucagccaccccuccagcuuccggggccacaugcgcgugcacacgggcgagaagcccuacgagugcaagcagugcgggaagaccuucaacuggccgaucucccugcggaagcacaugcgcacccacacccgggagaagcccuacgagugcaagcagugcggcaaggccuucagccucuccgccugcuuccgcgagcacguccggaugcaccccgaggacaagagcuacgagugcaagcugugcgggaaggccuucuacugccacaucagccugcagaagcacaugcgccggcacacggccgagaagcucuacaagugcaagcagugcggcaaggcguucuccuggcccgagcugcugcagcagcacgugcgcacccacaccguggagaagccguacgagugcaaggagugcgggaaggucuucaaguggcccagcucccuccccauccacaugcggcugcacaccggcgagaagcccuaccagugcaagcacugcggcaaggccuucaacugcagcuccagccugcgccggcacgugcgcauccacacgaccgagaagcaguacaagugcaacguggggcacccgcccgccaacgaguucaugugcuccgccagcgagaagucccaccaggagcgggaccucaucaaggucgugaacauggugcugccccuguga

SEQ ID NO: 39078 - RNA, 1809 nt, Artificial Sequence
  derived and/or modified sequence opt1 from ZNF559__Homo_sapiens__NP_001189335
augcgcaucaccgccgccauccugaccgcgcggagccgcuggcggcuccgcaacuccaucagcgccuuccuguucacggugaccuucgccuggugcccgcccggccuguccaaccucaccauccugagcugccccgaccaccugucccaggacgucuucugccuccacgagagcaaguucgaggaggagcggaugguggccggguggcugaccaacuacucccaggacagcgugacguucgaggacgucgccguggacuucacccaggaggaguggacccugcucgaccagacccagcgcaaccuguaccgggacgugaugcuggagaacuacaagaaccucgucgcgguggacugggagucccacaucaacacgaaguggagcgcgccccagcagaacuuccugcagggcaagaccuccagcguggucgagauggagcgcaaccacuucggggaggagcuguucgacuucaaccagugcgagaaggcccucuccgagcacagcugccugaagacccaccggcgcaccuacuuccggaagaagacgugcgagugcaaccagugcgagaaggccuuccgcaagcccuccaucuucacccugcacaagaagaccgacaucggcgaggagcucccgaacugcaaccagugcgagaccgccuucagccagcaccuccaccuggugugcaagaagacgucccagaaccugcaccuggugugcaagaagacccacacccaggagaagcccuacaagugcagcgacugcgagaaggggcugcccuccagcagccaccuccgggagugcguccgcaucuacggcggcgagcggcccuacacccacaaggaguacguggagacguucucccacagcaccgcccuguucgugcacaugcagacccaggacggggagaaguucuacgagugcaaggccugcggcaagccguucaccgaguccagcuaccugacgcagcaccuccgcacccacucccggguccugcccaucgagcacaagaaguucgggaaggccuucgccuucagccccgaccuggcgaagcacauccgccuccggacccgcggcaagcacuacgugugcaacgagugcgggaaggaguucacgugcuucuccaagcugaacauccacauccgggugcacaccggcgagaagcccuacgagugcaacaagugcggcaaggccuucaccgacagcuccgggcugaucaagcaccgccgcacccacaccggcgagaagccguacgagugcaaggagugcgggaaggccuucgccaacagcucccaccucacgguccacaugcggacccacaccggcgagaagcccuaccagugcaaggagugcggcaaggccuucaucaacagcuccagcuucaagucccacaugcagacccaccccggggugaagcccuacgacugccagcagugcggcaaggcguucauccgcagcuccuuccugauccggcaccuccgcagccacuccgccgagcggccguucgagugcgaggagugcgggaaggccuuccgcuacagcagccaccugucccagcacaagcggauccacacgggcgagcgccccuacaagugccagaagugcgggcaggccuucagcaucuccagcggccugaccgugcacaugcggacccacaccggcgagcgccccuucgagugccaggagugcgggaaggccuucacccgguccacguaccugauccgccaccuccggagccacuccgucgagaagcccuacaaggagugcggccagaccuucagcaacuccagcugccugaccgagugcguguga

SEQ ID NO: 39079 - RNA, 1743 nt, Artificial Sequence
  derived and/or modified sequence opt1 from ZNF568__Homo_sapiens__NP_001191766
augaagcccgcccagcgcaaccuguaccgggacgugaugcucgagaacuacagcaaccuggucaccgugggcugccaggugaccaagccggacgucaucuucaagcuggagcaggaggaggagcccugggugauggaggaggagauguucgggcgccacugccccgaggugugggaggucgacgagcagaucaagaagcagcaggagacgcucgugcggaaggugaccuccaucagcaagaagauccugaucaaggagaaggucaucgagugcaagaagguggccaagaucuucccccuguccagcgacaucgugaccucccgccagagcuucuacgacugcgacucccucgacaagggccuggagcacaaccuggaccuccugcgguacgagaaggggugcguccgcgagaagcagagcaacgaguucggcaagccguucuaccacugcgcguccuacguggugacccccuucaagugcaaccagugcgggcaggacuucagccacaaguucgaccugauccggcacgagcgcauccacgccggcgagaagcccuacgagugcaaggagugcggcaaggccuucucccggaaggagaaccucaucacgcaccagaagauccacaccggggagaagcccuacaagugcaacgagugcggcaaggccuucauccagaugagcaaccugauccgccaccaccggauccacaccggggagaagccguacgccugcaaggacugcuggaaggcguucucccagaaguccaaccugaucgagcacgagcgcauccacaccggcgagaagcccuacgagugcaaggagugcggcaagagcuucagccagaagcagaaccucaucgagcacgagaagauccacacgggggagaagcccuacgccugcaacgagugcggccgggccuucucccgcaugagcuccgucacccugcacaugcggagccacaccggggagaagcccuacaagugcaacaagugcggcaaggccuucagccagugcuccguguucaucauccacaugcgcagccacaccggggagaagccguacgugugcuccgagugcggcaaggcguucagccaguccagcucccugacgguccacaugcggaaccacaccgccgagaagcccuacgagugcaaggagugcggcaaggccuucagccgcaaggagaaccucaucacccaccagaagauccacaccggggagaagcccuacgagugcuccgagugcggcaaggccuucauccagaugagcaaccugauccggcaccagcgcauccacacgggggagaagcccuacgccugcaccgugugcggcaaggcguucucccagaaguccaaccugaccgagcacgagaagauccacaccggggagaagccguaccacugcaaccagugcggcaaggccuucagccagcggcagaaccuccuggagcacgagaagauccacacgggcgagaagcccuucaagugcaacgagugcgggaaggccuucagccgcaucuccagccugacccuccacgugcgcucccacaccggcgagaagcccuacgagugcaacaagugcgggaaggccuucagccagugcucccugcugaucauccacaugcggagccacaccggcgagaagcccuucgagugcaacgagugcgggaaggccuucagccagcgcgcgucccucagcauccacaagcggggccacacgggcgagcgccaccaggucuacuga

SEQ ID NO: 39080 - RNA, 2061 nt, Artificial Sequence
  derived and/or modified sequence opt1 from ZNF569__Homo_sapiens__NP_689697
augaccgagagccagggcaccgugacguucaaggacgucgccaucgacuucacccaggaggaguggaagcgccuggaccccgcccagcggaagcucuaccgcaacgugaugcuggagaacuacaacaaccugaucaccgugggguacccguucaccaagcccgacgucaucuucaagcucgagcaggaggaggagcccugggugauggaggaggaggugcugcggcgccacuggcagggcgagaucuggggcgucgacgagcaccagaagaaccaggaccggcugcuccgccagguggaggugaaguuccagaagacgcugaccgaggagaaggggaacgagugccagaagaaguucgcgaacgucuucccccugaacagcgacuucuucccgagccggcacaaccucuacgaguacgaccuguucgggaagugccuggagcacaacuucgacugccacaacaacgugaagugccucaugcgcaaggagcacugcgaguacaacgagcccgugaaguccuacggcaacagcuccagccacuucgucaucacccccuucaagugcaaccacugcggcaagggguucaaccagacccuggaccugauccggcaccuccgcauccacacgggcgagaagcccuacgagugcuccaacugccggaaggccuucagccacaaggagaagcugaucaagcacuacaagauccacucccgcgagcagagcuacaagugcaacgagugcgggaaggccuucaucaagauguccaaccugauccggcaccagcgcauccacaccggcgagaagccguacgccugcaaggagugcgagaaguccuucagccagaaguccaaccucaucgaccacgagaagauccacaccggggagaagcccuacgagugcaacgagugcggcaaggccuucagccagaagcagagccugaucgcgcaccagaaggugcacaccggcgagaagcccuacgccugcaacgagugcgggaaggccuucccccggaucgccucccuggcgcuccacaugcgcagccacacgggcgagaagccguacaagugcgacaagugcgggaaggccuucucccaguucagcaugcugaucauccacgugcggauccacaccggcgagaagcccuacgagugcaacgagugcggcaaggccuucagccaguccagcgcccugaccguccacaugcgcucccacaccggggagaagcccuacgagugcaaggagugccggaaggccuucagccacaagaagaacuucaucacgcaccagaagauccacacccgcgagaagcccuacgagugcaacgagugcggcaaggcguucauccagauguccaaccucgugcggcaccagcgcauccacaccggggagaagccguacaucugcaaggagugcggcaaggccuucagccagaaguccaaccugaucgcccacgagaagauccacagcggggagaagcccuacgagugcaacgagugcggcaaggccuucucccagaagcagaacuucaucacccaccagaaggugcacacgggcgagaagcccuacgacugcaacgagugcgggaaggccuucagccagaucgcgucccugacccuccaccuccgcagccacaccggcgagaagcccuacgagugcgacaagugcgggaaggccuucucccagugcagccugcugaaccugcacaugcggucccacaccggcgagaagccguacgucugcaacgagugcgggaaggccuucagccagcgcacgucccugaucgugcacaugcggggccacaccggcgagaagcccuacgagugcaacaagugcgggaaggccuucagccaguccagcagccucaccauccacauccgcggccacaccggggagaagcccuucgacugcuccaagugcggcaaggccuucagccagaucuccagccugacgcugcacaugcggaagcacaccggggagaagcccuaccacugcaucgagugcggcaaggcguucucccagaagucccaccucgugcgccaccagcggauccacacccacuga

SEQ ID NO: 39081 - RNA, 1281 nt, Artificial Sequence
  derived and/or modified sequence opt1 from ZNF577__Homo_sapiens__NP_001129062
augaagaacgccaccaucgugaugagcguccgccgggagcagggcuccagcuccggggagggcagccuguccuucgaggacguggccgugggguucacccgcgaggaguggcaguuccucgaccagagccagaagguccuguacaaggaggugaugcuggagaacuacaucaaccucguguccaucggcuaccgggggacgaagcccgacagccuguucaagcuggagcagggcgagccgcccggcaucgcggagggggccgcccacucccagaucugccccggcgggaagccccacgagugcagcgucugcggccgcgccuucucccggaaggcccagcucauccagcaccagcgcaccgagcgcggggagaagccgcacggcugcggcgagugcgggaagaccuucaugcggaagauccagcugaccgagcaccagcggacgcacaccggcgagaagccccacgagugcagcgagugcgggaaggcguucucccgcaagagccagcugauggugcaccagcggacccacaccggcgagaagcccuaccgcugcuccaagugcggcaaggccuucagccggaagugccgccucaaccggcaccagcgcucccacacgggggagaagcuguacggcugcagcgugugcgggaaggccuucucccagaaggccuaccugaccgcgcaccagcggcuccacaccggcgacaagcccuacaagugcagcgacugcgggcgcaccuucuacuucaagagcgaccugacgcggcaccagcgcauccacaccggcgagaagccguacgagugcuccgagugcgagaaggccuuccggagcaaguccaagcugauccagcaccagcgcacccacaccggcgagcgccccuacagcugccgggagugcgggaaggccuucgcccacauguccguccucaucaagcacgagaagacgcacauccgcgagaccgccaucaacagccugaccguggagaagcccuccagccggucccacaccagccuguacauguccgagcucauccaggagcagaagacggugaacaccguccccaucgagaugccgagcuccggcaccccgccccugcugaacaagagcgagcgccucguggggcggaacguggucaucguggagcagcccuucccccgcaaccaggcguucguggucaaccaggaguucgagcagcggaucucccugaccaacgaggugaacguggcccccagcgucaucaacuacauccuguaccucacggacaucguguccgaguga

SEQ ID NO: 39082 - RNA, 519 nt, Artificial Sequence
  derived and/or modified sequence opt1 from ZNF580__Homo_sapiens__NP_057286
augcugcuccugcccccgcgccccccccacccccggagcuccagcccggaggccauggaccccccccccccgaaggccccccccuuccccaaggcggagggcccguccagcacccccuccagcgccgccgggccccgccccccgcggcugggccgccaccuccugaucgacgccaacggggugcccuacaccuacacgguccagcuggaggaggagccccggggccccccgcagcgcgaggccccccccggggagcccggcccgcggaagggcuacuccugccccgagugcgcgcgcguguucgccagcccccuccggcugcagucccaccgcgugagccacuccgaccugaagcccuucaccugcggggccugcggcaaggccuucaagcggagcucccaccucagccgccaccgggcgacccaccgcgcccgggccgggccgccccacaccugcccccugugcccgcgccgguuccaggacgccgccgagcuggcgcagcacguccgccuccacuga

SEQ ID NO: 39083 - RNA, 594 nt, Artificial Sequence
  derived and/or modified sequence opt1 from ZNF581__Homo_sapiens__XP_006723303
augcuggugcuccccagcccgugcccccagccccuggccuucuccagcgucgagaccauggaggggcccccgcgccggaccugccgcucccccgagcccgggcccagcuccagcaucggcuccccgcaggccagcuccccgccccggcccaaccacuaccugcucaucgacacgcagggggugcccuacaccgugcuggucgacgaggagagccagcgcgagcccggcgcguccggggcccccggccagaagaagugcuacagcugccccgugugcucccggguguucgaguacaugagcuaccugcagcgccacuccaucacccacagcgaggucaagccguucgagugcgacaucugcggcaaggccuucaagcgggccucccaccucgcccgccaccacagcauccaccuggcgggcggcgggcggccccacggcugcccccugugcccccgccgguuccgcgacgccggggagcucgcccagcacucccgggugcacagcggcgagcgcccguuccagugcccccacugcccccggcgcuucauggagcagaacacccugcagaagcacacgcgguggaagcaccccuga

SEQ ID NO: 39084 - RNA, 1554 nt, Artificial Sequence
  derived and/or modified sequence opt1 from ZNF582__Homo_sapiens__NP_653291
augagccugggcuccgagcuguuccgcgacguggccaucgucuucagccaggaggaguggcaguggcucgcccccgcgcagcgggaccuguaccgcgacgugaugcucgagaccuacuccaaccuggugagccuggggcucgccgucuccaagccggacgugaucagcuuccuggagcagggcaaggagcccuggaugguggagcgggucguguccgggggccugugccccgugcucgagagccgcuacgacaccaaggagcuguuccccaagcagcacgucuacgagguggaguccccgcagugggagaucauggagagccugacguccuacgggcucgagugcagcuccuuccaggacgacugggagugccggaaccaguucgaccgccagcagggcaaccccgaccggcacuuccaccagaugaucauccgccacgaggagaugcccaccuucgaccagcacgccagccugaccuucuaccagaagauccacacccgggagaagcccuucggcuacaacaagugccgcaaggacuucuggcagaaggagcugcucaucaaccaccaggggaucuacacgaacgagaagccguacaagugcaaggagugcggcaaggccuucaaguacgggucccggcugauccagcacgagaacauccacagcggcaagaagcccuacgagugcaaggagugcgggaaggccuucaacuccggcagcaacuucauccagcaccagcgcgugcacaccggcgagaagcccuacgagugcaaggacugcgagaaggcguucucccggagcagccagcugaucgagcaccagcgcacccacaccggggagaagcccuaccagugcaaggagugcggcaaggccuucaaccggaucucccaccucaagguccacuaccgcauccacacgggggagaagccguacgccugcaaggagugcggcaagaccuucagccaccggucccagcugauccagcaccagaccgugcacaccggccgcaagcuguacgagugcaaggagugcgggaaggccuucaaccagggcagcacgcucauccggcaccagcgcauccacaccggggagaagcccuacgagugcaaggugugcggcaaggcguuccgggucuccagccagcugaagcagcaccagcgcauccacaccggggagaagcccuaccagugcaaggugugcggccgcgccuucaagcgggugucccaccugaccguccacuaccgcauccacacgggcgagaagcccuacgagugcaaggagugcgggaaggccuucagccacugcucccagcucauccaccaccaggugauccacaccgagaagaagccguacgaguacaaggagugcgagaagacccugagccacgacuccaccacggugcagccccagcggaugcacaaccgcgagacccacgucaacaucaucaacguggagaagcccagcaucuccagcuacccccugcucaucauccgggaguucaugcuggccuccaaccacaugaacggcagcaacggggaguccccgcuggccuga

SEQ ID NO: 39085 - RNA, 1710 nt, Artificial Sequence
  derived and/or modified sequence opt1 from ZNF583__Homo_sapiens__XP_011524819
augagcaaggaccuggugaccuucggcgacgucgccgugaacuucucccaggaggagugggaguggcucaaccccgcccagcgcaaccuguaccggaaggugaugcuggagaacuaccgcagccucgucucccugggggugagcguguccaagccggacgucaucagccugcucgagcagggcaaggagcccuggauggugaagaaggaggggacccggggccccugccccgacugggaguacguguucaagaacuccgaguucagcuccaagcaggagacguacgaggagagcuccaaggucgugaccgugggggcgcgccaccugagcuacucccuggacuacccgagccuccgggaggacugccaguccgaggacugguacaagaaccagcugggcagccaggagguccaccugucccagcucaucaucacccacaaggagauccugcccgaggugcagaacaaggaguacaacaagagcuggcagaccuuccaccaggacacgaucuucgacauccagcaguccuuccccaccaaggagaaggcccacaagcacgagccccagaagaaguccuaccgcaagaaguccguggagaugaagcaccggaaggucuacguggagaagaagcugcucaagugcaacgacugcgagaagguguucaaccagagcagcagccugacccugcaccagcgcauccacaccggcgagaagccguacgccugcgucgagugcgggaagacguucagccaguccgccaaccucgcccagcacaagcggauccacaccggcgagaagcccuacgagugcaaggagugccgcaaggcguucagccagaacgcccaccuggcccagcaccagcgggugcacaccggggagaagcccuaccagugcaaggagugcaagaaggccuucucccagaucgcgcaccugacccagcaccagcgcgugcacacgggcgagcggcccuucgagugcaucgagugcgggaaggccuucagcaacggcuccuuccucgcccagcaccagcgcauccacaccggcgagaagccguacgucugcaacgugugcgggaaggccuucagccaccggggcuaccugaucgugcaccagcgcauccacaccggggagcggcccuacgagugcaaggagugccgcaaggccuucucccaguacgcgcaccuggcccagcaccagcggguccacaccggcgagaagcccuacgagugcaaggugugccgcaaggccuucagccagaucgccuaccucgaccagcaccagcggguccacacgggcgagaagcccuacgagugcaucgagugcgggaaggccuucuccaacagcuccagccuggcgcagcaccagcgcucccacaccggcgagaagccguacaugugcaaggagugccgcaagaccuucagccagaacgccgggcuggcccagcaccagcggauccacaccggcgagaagcccuacgagugcaacgugugcgggaaggccuucuccuacagcggcagccucacgcugcaccagcgcauccacaccggcgagcggcccuacgagugcaaggacugccgcaaguccuuccggcagcgcgcccaccuggcgcaccacgagcggauccacaccauggagagcuuccucacccuguccagccccuccccgagcacguccaaccagcugccccgccccgugggguucaucagcuga

SEQ ID NO: 39086 - RNA, 2310 nt, Artificial Sequence
  derived and/or modified sequence opt1 from ZNF585B__Homo_sapiens__NP_689492
augcccgccagcuggaccuccccgcagaaguccagcgcccuggcgcccgaggaccacggcagcuccuacgaggggagcguguccuuccgcgacgucgccaucgacuucagccgggaggaguggcgccaccucgaccugucccagcggaaccuguaccgcgacgugaugcucgagaccuacagccaccuccuguccgugggcuaccagguccccaagcccgagguggugaugcuggagcaggggaaggagccgugggcccugcagggcgagcggccccgccacagcugccccggggagaagcugugggaccacaaccagcaccggaagaucaucggcuacaagcccgccuccagccaggaccagaagaucuacuccggcgagaaguccuacgagugcgccgaguucggcaagagcuucacguggaagucccaguucaagguccaccucaaggugccgaccggggagaagcuguacgugugcaucgagugcgggcgcgcguucguccagaagcccgaguucaucacccaccagaagacccacaugcgggagaagcccuacaagugcaacgagugcggcaagagcuucuuccaggugagcagccuguuccgccaccaccggauccacacgggggagaagcucuacgagugcuccgagugcggcaagggcuuccccuacaacagcgaccuguccauccacgagaagauccacaccggggagcgccaccacgagugcaccgacugcggcaaggccuucacccagaaguccacgcugaagauccaccagaagauccacaccggggagcggagcuacaucugcaucgagugcggccaggccuucauccagaagacccagcucaucgcccaccgccggauccacagcggcgagaagccguacgagugcaacaacugcgggaaguccuucaucagcaagucccagcuccaggugcaccagcgcguccacacccgggugaagcccuacaucugcacggaguacggcaagguguucagcaacaacuccaaccugaucacccacgagaagauccagagccgcgagaaguccagcaucugcaccgagugcgggaaggcguucaccuaccgguccgagcugaucauccaccagcgcauccacacgggcgagaagcccuacgagugcagcgacugcgggcgggccuucacccagaaguccgcccugaccguccaccagcgcauccacaccggcgagaaguccuacaucugcaugaagugcggccuggccuucauccgcaaggcccaccucaucacgcaccagaucauccacaccggggagaagcccuacaagugcggccacugcgggaagcuguucaccagcaagagccagcugcacgugcacaagcggauccacaccggcgagaagccguacgugugcaacaagugcgggaaggcguucacgaaccgcagcaaccucaucacccaccagaagacccacaccggcgagaaguccuacaucugcagcaagugcggcaaggccuucacgcagcgguccgaccugaucacccaccagcgcauccacaccggggagaagcccuacgagugcaacacgugcggcaaggccuucacccagaaguccaaccugaacauccaccagaagauccacaccggggagcggcaguacgagugccacgagugcggcaaggccuucaaccagaaguccauccucaucguccaccagaagauccacaccggggagaagcccuacgugugcaccgagugcggccgcgccuucauccgcaagagcaacuucaucacgcaccagcggauccacaccggcgagaagcccuacgagugcagcgacugcggcaagagcuucaccuccaagagccagcugcuggugcaccagccgguccacaccggggagaagcccuacgugugcgcggagugcgggaaggccuucuccggccggagcaaccucuccaagcaccagaagacccacacgggcgagaagcccuacaucugcagcgagugcgggaagaccuuccgccagaaguccgagcugaucacccaccaccggauccacaccggcgagaagcccuacgagugcagcgacugcgggaaguccuucacgaagaagucccagcuccaggugcaccagcgcauccacaccggcgagaagccguacgucugcgccgagugcgggaaggccuucagcaaccggagcaaccugaacaagcaccagaccacccacacgggcgacaagcccuacaagugcggcaucugcgggaagggcuucgugcagaaguccgucuucagcgugcaccagagcucccacgccuga

SEQ ID NO: 39087 - RNA, 3804 nt, Artificial Sequence
  derived and/or modified sequence opt1 from ZNF592__Homo_sapiens__NP_055445
augggcgacaugaagacccccgacuucgacgaccugcucgccgccuucgacaucccggaccccaccagccuggacgcgaaggaggccauccagacgcccuccgaggagaacgagagcccccugaagccgcccgggaucugcauggacgaguccgugagccucucccacagcggcuccgcccccgacguccccgccgugagcgugaucgucaagaacaccucccgccaggagagcuucgaggccgagaaggaccacaucaccccgucccugcugcacaacggguuccggggcagcgaccucccgcccgacccccacaacugcgggaaguucgacuccaccuucaugaacggcgacagcgcgcgcuccuuccccggcaagcuggagccgcccaagagcgagccccugcccacguucaaccaguucucccccaucagcucccccgagcccgaggacccgaucaaggacaacggguucggcaucaagcccaagcacagcgacagcuacuucccgccgccccucgggugcggcgccgucgggggccccgugcuggaggcccuggccaaguuccccgugcccgagcuccacauguucgaccacuucugcaagaaggagcccaagcccgagccccugccgcugggcucccagcaggagcacgagcagagcgggcagaacaccguggagccccacaaggaccccgacgcgacccgguucuucggcgaggcccucgaguucaacucccaccccagcaacuccaucggggagagcaagggccuggcccgcgagcuggggaccugcuccagcgugccgccccggcagcgccucaagcccgcccacuccaagcugagcuccugcgucgccgcgcugguggcccuccaggccaagcggguggccagcgucacgaaggaggaccagcccgggcacaccaaggaccuguccggcccgaccaaggagagcuccaaggggagccccaagaugcccaagucccccaagagcccgcgcagcccccuggaggccacccgcaaguccaucaagcccagcgacagcccccgcuccaucugcuccgacagcuccagcaagggcuccccgagcguggcggccuccagcccgcccgccauccccaaggugcggaucaagacgaucaagaccuccagcggggagaucaagcgcaccgucacccggauccuccccgaccccgacgaccccuccaagagccccgugggcuccccgcugggcagcgccaucgccgaggcgcccuccgagaugcccggggacgaggugccggucgaggagcacuucccggaggccggcacgaacagcggcagcccccagggcgcccggaagggggacgaguccaugaccaaggccagcgacuccagcucccccagcugcuccagcggcccgcgggugcccaagggcgccgcgcccgggucccagaccggcaagaagcagcagagcaccgcccugcaggccuccacgcucgcccccgcgaaccugcugccgaaggccgugcaccucgccaaccugaaccuggucccccacagcguggccgccuccgugaccgccaagagcuccguccagcgccggagccagccccagcucacccagauguccgugccccugguccaccaggugaagaaggcggccccgcugaucguggaggucuucaacaaggugcuccacagcuccaaccccgugccccuguacgcccccaaccugagcccgcccgccgacagccgcauccacguccccgcguccggguacugcugccucgagugcggcgacgccuucgcccuggagaagucccugagccagcacuacgggcggcgcagcgugcacaucgaggugcucugcacccugugcuccaagacgcuccuguucuucaacaagugcagccugcugcggcacgcccgcgaccacaaguccaagggccucgucaugcagugcagccagcugcuggugaagcccaucuccgccgaccagauguucgugagcgcgccggucaacuccaccgcccccgccgcccccgcgcccagcuccagcccgaagcacggccugaccuccgggagcgccuccccgccgccgcccgcccucccccuguaccccgaccccgugcgccugauccgguacagcaucaagugccucgagugccacaagcagaugcgcgacuacauggugcuggccgcccacuuccagcggaccacggaggagaccgagggccugaccugccaggucugccagaugcuccugcccaaccagugcuccuucugcgcgcaccagcgcauccacgcccacaagagccccuacugcugccccgagugcggggugcugugccggagcgccuacuuccagacccacgugaaggagaacugccuccacuacgcccgcaaggucggcuaccggugcauccacugcggcguggugcaccugacgcuggcccuccugaagucccacauccaggagcgccacugccaggucuuccacaagugcgcguucugccccauggccuucaagaccgccagcuccaccgccgaccacagcgccacccagcaccccacgcagccccaccggcccucccagcugaucuacaagugcagcugcgagaugguguucaacaagaagcgccacauccagcagcacuucuaccagaacguguccaagacccaggucgggguguucaagugcccggagugcccccuccuguucgugcagaagcccgagcugaugcagcacgucaagagcacccacggcgugccccggaacguggacgagcucuccagccugcaguccagcgcggacaccuccagcucccgcccggggagccggguccccaccgagccgcccgccacguccguggccgcccgcagcuccagccugcccagcggccggugggggcgccccgaggcgcaccggcgcguggaggcccggccccgccuccgcaacaccggcuggaccugccaggagugccaggaguggguccccgaccgggaguccuacgugagccacaugaagaagucccacggccgcacccugaagcgguacccgugccgccagugcgagcagagcuuccacacgcccaacucccugcggaagcacauccgcaacaaccacgacaccgugaagaaguucuacacgugcggguacugcaccgaggacagccccuccuucccccggccgagccuccuggagucccacaucagccugaugcacggcauccgcaaccccgaccucucccagaccagcaaggucaagccgcccgggggccacagcccccaggugaaccaccugaagcggcccguguccggggucggcgacgcccccggcaccuccaacggggccaccgugagcuccaccaagcgccacaagagccuguuccagugcgccaagugcuccuucgcgacggacagcggccucgaguuccagagccacaucccgcagcaccagguggacuccagcaccgcccagugccugcugugcgggcucugcuacaccuccgccagcucccugagccggcaccuguucaucguccacaaggugcgcgaccaggaggaggaggaggaggaggaggccgccgcggccgagauggccguggaggucgccgagcccgaggagggcuccggggaggaggugcccauggagacccgggagaacggccucgaggagugcgccggcgagccccugagcgcggacccggaggcccgccggcugcucgggcccgcccccgaggacgacggcgggcacaacgaccacucccagccccaggccagccaggaccaggacucccacacgcugagcccccagguguga

SEQ ID NO: 39088 - RNA, 1515 nt, Artificial Sequence
  derived and/or modified sequence opt1 from ZNF596__Homo_sapiens__XP_011533044
augcccagcccggacuccaugaccuucgaggacaucaucguggacuucacccaggaggagugggcccugcucgacacgagccagcgcaagcuguuccaggacgucaugcuggagaacaucucccaccucgugagcaucggcaagcagcugugcaaguccgugguccugagccagcucgagcaggucgagaagcuguccacccagcggaucagccugcuccaggggcgcgaggugggcaucaagcaccaggagauccccuucauccagcacaucuaccagaaggggaccuccaccaucagcacgaugcggucccacacccaggaggaccccuuccugugcaacgaccugggcgaggacuucacccagcacaucgcccucacccagaacgugaucacguacaugcgcaccaagcacuucgugagcaagaaguucgggaagaucuucuccgacuggcugagcuucaaccagcacaaggagauccacaccaagugcaaguccuacggcagccaccuguucgacuacgcguucauccagaacuccgcccuccggccccacagcgugacccacacgcgcgagaucacccuggagugccgggucugcggcaagaccuucuccaagaacagcaaccugcgccggcacgagaugauccacaccggggagaagccgcacggcugccaccucugcgggaaggccuucacgcacugcagcgaccugcgcaagcacgagcggacccacaccggcgagaagcccuacgggugccaccugugcggcaaggccuucuccaagagcuccaaccuccgccggcacgagaugauccacacccgcgagaaggcccagaucugccaccugugcggcaaggcguucacgcacugcagcgaccugcggaagcacgagcgcacccaccucggggacaagcccuacggcugccugcugugcgggaaggccuucuccaagugcagcuaccuccggcagcacgagcgcacccacaacggcgagaagcccuacgagugccaccugugcggcaaggccuucucccacugcagccaccuccggcagcacgagcgcucccacaacggggagaagccgcacggcugccaccugugcgggaaggccuucaccgagagcuccgugcugaagcggcacgagcgcauccacacgggcgagaagcccuacgagugccacgugugcgggaaggcguucaccgagagcuccgaccugcgccggcacgagcgcacccacaccggcgagaagcccuacgagugccaccucugcggcaaggccuucaaccacagcuccguccugcggcgccacgagcggacgcacaccggggagaagcccuacgagugcaacaucugcggcaaggccuucaaccgcagcuacaacuuccggcugcaccgccgggugcacaccggggagaagccguacgugugcccccucugcggcaaggccuucuccaaguucuucaaccugcgccagcacgagcggacccacacgaagaaggccaugaacauguga

SEQ ID NO: 39089 - RNA, 2379 nt, Artificial Sequence
  derived and/or modified sequence opt1 from ZNF606__Homo_sapiens__NP_079303
auggccgccaucaaccccugggcgagcuggggcgcccugaccgaccaguccugggggaugaccgccguggacccgugggccagcugggcccucugcccccaguaccccgcguggcacgucgagggcucccuggaggaggggcgccgggccacgggccugcccgccgcccaggugcaggagccggugaccuucaaggacgucgcgguggacuucacccaggaggagugggggcagcucgaccuggugcagcgcacccuguaccgggacgucaugcucgagacguacggccaccuccugagcgugggcaaccagaucgccaagcccgaggugaucucccugcuggagcagggggaggagcccuggagcgucgagcaggccugcccccagcggaccugcccggagugggugcgcaaccuggaguccaaggcccucauccccgcccagagcaucuucgaggaggagcagucccacggcaugaagcuggagcgcuacaucugggacgaccccugguucagccggcuggaggugcucgggugcaaggaccagcuggagauguaccacaugaaccaguccaccgcgaugcgccagauggucuucaugcagaagcagguccugagccagcgguccagcgaguucugcggccucggggccgaguucucccagaaccugaacuucgugcccagccagcgcgugucccagaucgagcacuucuacaagccggacacccacgcccagagcuggcggugcgacuccgccaucauguacgccgacaaggugacgugcgagaacaacgacuacgacaagaccguguaccagagcauccagcccaucuaccccgcgcgcauccagaccggcgacaaccuguucaagugcaccgacgccgucaagagcuucaaccacaucauccacuucggcgaccacaaggggauccacacgggcgagaagcucuacgaguacaaggagugccaccagaucuucaaccagucccccagcuucaacgagcacccgcggcugcacgugggggagaaccaguacaacuacaaggaguacgagaacaucuucuacuucuccagcuucauggagcaccagaagaucggcaccguggagaaggccuacaaguacaacgagugggagaaggucuucggcuacgacuccuuccugacccagcacaccagcacguacaccgccgagaagcccuacgacuacaacgagugcgggaccuccuucaucuggagcuccuaccucauccagcacaagaagacccacacgggcgagaagcccuacgagugcgacaagugcgggaagguguuccgcaaccggagcgcccugaccaagcacgagcgcacccacaccggcaucaagcccuacgagugcaacaagugcgggaaggcguucuccuggaacagccaccugaucgugcacaagcggauccacacgggcgagaagccguacgucugcaacgagugcggcaaguccuucaacuggaacagccaccucaucgggcaccagcgcacccacaccggcgagaagcccuucgagugcaccgagugcgggaaguccuucagcugguccagccaccugaucgcccacaugcggaugcacacgggcgagaagcccuucaagugcgacgagugcgagaaggccuuccgcgacuacuccgcccugagcaagcacgagcggacccacagcggggccaagcccuacaagugcaccgagugcggcaaguccuucagcugguccagccaccucaucgcgcaccagcgcacccacacgggcgagaagccguacaacugccaggagugcgggaaggccuuccgcgagcgguccgcccugaccaagcacgagaucauccacagcggcaucaagcccuacgagugcaacaagugcgggaaguccugcagccagauggcccaccuggugcgccaccagcggacccacaccggcgagaagcccuacgagugcaacaagugcgggaaguccuucagccaguccugccaccucgucgcgcaccgccggauccacacgggcgagaagcccuacaagugcaaccagugcgagcgcagcuucaacugcuccagccaccugaucgcccaccggcgcacccacaccggcgagaagccguaccggugcaacgagugcgggaaggccuucaacgaguccagcucccugaucgugcaccuccgcaaccacaccggcgagaagcccuacaagugcaaccacugcgagaaggccuucugcaagaacagcagccugaucauccaccagcggaugcacuccggggagaagcgcuucaucugcagcgagugcggcaaggccuucuccggccacagcgcgcugcuccagcaccagcggaaccacuccgaggagaagcugaacuga

SEQ ID NO: 39090 - RNA, 2088 nt, Artificial Sequence
  derived and/or modified sequence opt1 from ZNF607__Homo_sapiens__NP_001166148
augagcuacggcuccaucaccuucggggacguggccaucgacuucagccaccaggagugggaguaccugucccucguccagaagacccuguaccaggaggugaugauggagaacuacgacaaccuggugagccucggccacuccgucagcaagcccgaccugaucacgcugcucgagcaggggaaggagccguggaugaucgugcgcgaggagacccggggcgagugcaccgaccuggacucccgcugcgagaucaucagcgacgggaagaugcagcuguaccggaagcacuccugcgugacccuccaccagcgcauccacaacggccagaagcccuacgagugcaagcagugccagaaguccuucagccaccugacggagcugaugguccaccagaccauccacaccagcgaggagcccgaccagugcgagaaguuccggaaggccuucucccaccucaccgaccugcgcaagcaccagaagaucaacgcgcgggagaagcccuacgagugcgaggagugcggcaagguguucagcuacccggccaaccuggcccagcacgggaaggugcacgucgagaagcccuacgagugcaaggagugcggcgaggccuuccgcacgucccggcagcucaccgugcaccaccgcuuccacuacggggagaagcccuacgagugcaaggagugcggcaaggccuucagcguguacgggcggcugucccgccaccagagcauccacaccggcgagaagcccuucgagugcaacaagugcggcaaguccuuccggcugaaggcggggcucaagguccaccagagcauccacaccggcgagaagccgcacgagugcaaggagugcgggaaggccuuccgccaguucagccaccuggugggccacaagcggauccacacgggcgagaagcccuacgagugcaaggagugcgggaagggcuucacgugccgcuaccagcugaccaugcaccagcggaucuacuccggggagaagcacuacgagugcaaggagaacggcgaggccuucagcuccgggcaccagcucaccgcgccccacaccuucgagagcguggagaagcccuacaagugcgaggagugcggcaaggccuucuccguccacggccgccugacccggcaccaggggauccacagcggcaagaagccguacgagugcaacaagugcgggaaguccuuccgccugaacagcucccucaagauccaccagaacauccacaccggcgagaagcccuacaagugcaaggagugcgggaaggccuucagccagcgggcccaccuggcccaccacaaccgcauccacaccggcuacaagcccuucgagugcaaggagugcggcaaguccuuccgcugcgccagcuaccuggugauccacgagcggauccacacgggggagaagcccuacgugugccaggagugcggcaagggguucuccuacagccacaagcucaccauccaccgccggguccacaccggcgagaagccguacgagugcaaggagugcgggaaggcguucuccgugagcggccagcugacccagcaccuguccauccacagcggcaagaagcccuucgagugcaacaagugcgggaaguccuuccgcuucaucagcgugcucaaggcccaccagaacauccacagcgccgagaagcccuacgagugcaaggagugcggcaaggccuuccggcacgccacgucccugaucuaccacgaccgcacccacgcgggggagaaguccuacgagugcaaggagugcggcgagaccuucagccacgccagccaccugaucauccacgagcggauccacaccuccgacaagcccuacgagugcaagcgcugcggcaaggccuuccacugcgccagcuaccucguccggcacgaguccgugcacgccgacgggaacccguacaugugcgaggagugcggcaaggcguucaacagcucccacgagcugagcauccaccaccgcgugcacacgggggagaagcccuucaagugcaacaagugccggcgcuccuuccggcugcgcagcauccucgagguccaccagcggauccacaucuga

SEQ ID NO: 39091 - RNA, 4539 nt, Artificial Sequence
  derived and/or modified sequence opt1 from ZNF608__Homo_sapiens__NP_065798
augagcgugaacaucuccaccgccggcaagggggucgaccccaacaccguggacacguacgacagcggcgacgacugggagaucggggugggcaaccugaucaucgaccucgacgccgaccuggagaaggaccgccagaaguucgagaugaacaacuccaccaccaccacgagcuccagcaacuccaaggacugcgggggcccggcgagcuccggcgccggggccaccgccgcccuggcggacggccucaaguucgccagcguccaggccuccgcgccccaggggaacagccacaaggagaccuccaagagcaaggugaagcgguccaagaccagcaaggacgccaacaagucccugcccagcgccgcccuguacggcauccccgagaucuccagcacggggaagcgccaggaggugcagggccggccgggcgaggccaccgggaugaacagcgcccucggccaguccgucagcuccgggggcagcggcaaccccaacuccaacagcaccuccaccagcacguccgcggccaccgccggggccggcagcugcgggaaguccaaggaggagaagcccggcaagagccaguccagccgcggggccaagcgggacaaggacgcgggcaagucccgcaaggacaagcacgaccugcugcagggccaccagaacgggagcggcucccaggcccccagcgggggccaccucuacggguucggcgccaaguccaacggcgggggcgccagcccguuccacugcgggggcaccgggagcggcuccguggccgcggccggcgaggugagcaaguccgcccccgacagcgggcugaugggcaacuccaugcuggucaagaaggaggaggaggaggaggagagccaccggcgcaucaagaagcucaagaccgagaagguggacccccuguucacggugcccgccccgcccccgcccaucuccagcucccugaccccgcagauccuccccagcuacuucucccccagcuccagcaacaucgccgcgcccgucgagcagcugcuggugcggacccgcuccgugggggucaacacgugcgaggugggcguggucacggagccggagugccucggccccugcgagcccgggaccagcgugaaccuggagggcaucguguggcacgagaccgaggaggggguccugguggugaacgucaccuggcggaacaagacguacgugggcacccuccuggacugcaccaagcacgacugggcgcccccgcgcuucugcgagucccccaccagcgaccuggagaugcgcgggggccggggccgggggaagcgcgcccggagcgccgccgccgcccccggcuccgaggccagcuucacggagucccgcgggcuccagaacaagaaccggggcggggccaacggcaagggccgccgggggagccugaacgcguccggccgccgcacgcccccgaacugcgccgccgaggacaucaaggccagccccuccagcaccaacaagcggaagaacaagcccccgauggagcuggaccucaacuccagcuccgaggacaacaagcccgggaagcgcgugcggaccaacagccgcuccacccccaccacgccccagggcaagccggagaccaccuuccuggaccaggggugcagcucccccgugcugaucgacugcccccaccccaacugcaacaagaaguacaagcacaucaacggccuccgguaccaccaggcccacgcgcaccuggacccggagaacaagcuggaguucgagcccgacagcgaggacaagaucuccgacugcgaggagggccucagcaacguggcccuggagugcuccgagcccagcaccagcgucuccgccuacgaccagcugaaggcccccgccagcccgggggcgggcaacccgcccgggacccccaagggcaagcgcgagcucauguccaacgggcccggcagcaucaucggcgccaaggccgggaagaacuccggcaagaagaaggggcugaacaacgagcugaacaaccuccccgugaucagcaacaugaccgccgcgcuggacuccugcagcgccgccgacggcucccuggccgccgagaugcccaagcucgaggcggagggccugaucgacaagaagaaccugggggacaaggagaagggcaagaaggccaccaacugcaagaccgacaagaaccucagcaagcugaaguccgcccggcccaucgccccggcccccgcgcccaccccgccccagcugaucgccauccccaccgccaccuucacgaccaccaccacggggaccauccccggccuccccagccugaccaccacggugguccaggccacccccaaguccccgccccugaagcccauccagcccaagcccaccaucaugggggagcccaucaccgugaacccggcccuggugagccucaaggacaagaagaagaaggagaagcgcaagcugaaggacaaggagggcaaggagacgggcucccccaagauggacgcgaagcuggggaagcucgaggacagcaagggcgccuccaaggaccugcccgggcacuuccugaaggaccaccucaacaagaacgagggccuggccaacgggcugagcgagucccaggagagccggauggccagcaucaaggcggaggccgacaaggucuacaccuucaccgacaacgcccccuccccgagcaucggcuccgccagccgccucgagugcuccacccuggugaacggccaggcccccauggcgccccugcacgugcucacgcagaacggggccgagagcuccgccgccaagaccagcucccccgccuacagcgacaucuccgacgcggccgacgacggcgggagcgacucccggagcgagggcaugcgcuccaaggccagcuccccgagcgacaucaucuccagcaaggacagcgucgugaaggggcacuccagcaccaccgcccaguccagccagcugaaggagucccacagccccuacuaccacuccuacgaccccuacuacagccccuccuacaugcacccgggccaggugggcgcccccgcggccgggaacagcggcuccacgcaggggaugaagaucaagaaggagagcgaggaggacgccgagaagaaggacaaggccgagcagcuggacuccaagaaggucgaccacaacagcgccucccuccagccccagcaccagagcgugaucacccagcggcaccccgcgcuggcccagucccuguacuacggccaguacgccuacggccucuacauggaccagaagucccugauggccaccagcccggcguaccgccagcaguacgagaaguacuacgaggaccagcggcuggccgagcagaagauggcccagaccgggcgcggcgacugcgagcgcaagagcgagcucccccugaaggagcuggggaaggaggagacgaagcagaagaacaugcccagcgccaccaucuccaaggcccccagcaccccggagcccaacaagaaccacuccaagcucggccccagcgugccgaacaagaccgaggagacggggaagucccagcugcugagcaaccaccagcagcagcuccaggcggacuccuucaaggccaagcagauggagaaccaccagcugaucaaggaggccgucgagaugaaguccgugauggacagcaugaagcagaccggcguggaccccaccagccgguucaagcaggaccccgacucccggaccuggcaccacuacgucuaccagcccaaguaccuggaccagcagaaguccgaggagcucgaccgcgagaagaagcugaaggaggacagcccgcgcaagacgcccaacaaggagagcggcgugcccucccugcccgugagccucaccuccaucaaggaggagccgaaggaggccaagcaccccgacagccaguccauggaggagagcaagcugaagaacgacgaccggaagacccccgucaacuggaaggacagccgcgggacccggguggccguguccagccccaugucccagcaccagagcuacauccaguaccugcacgcguacccguacccccagauguacgaccccucccaccccgccuaccgcgccgucagcccggugcucaugcacuccuaccccggcgccuaccugagccccggguuccacuaccccguguacggcaagauguccgggcgggaggagaccgagaaggucaacacgagcccguccgugaacaccaagaccaccacggagagcaaggcccuggaccuccugcagcagcacgcgaaccaguaccgcuccaagagccccgcccccguggagaaggccaccgccgagcgggagcgcgaggcggagcgggagcgcgaccggcacucccccuucggccagcgccaccuccacacccaccaccacacccacgucggcaugggguacccgcugauccccggccaguacgaccccuuccaggggcugacgagcgccgcccugguggccucccagcaggucgccgcgcaggccagcgccagcggcauguuccccgggcagcggcgcgaguga

SEQ ID NO: 39092 - RNA, 2229 nt, Artificial Sequence
  derived and/or modified sequence opt1 from ZNF615__Homo_sapiens__XP_011525128
augaugcaggcccaggagagccugacccucgaggacguggccgucgacuucaccugggaggaguggcaguuccugucccccgcgcagaaggaccuguaccgcgacgugaugcucgagaacuacagcaaccugguggccgucggcuaccaggccuccaagccggacgcccugagcaagcucgagcgcggggaggagacgugcaccaccgaggacgagaucuacucccggaucugcagcgacuccggcggggccagcggcggggcguacgccgagauccggaagaucgacgacccccugcagcaccaccuccagaaccaguccauccagaaguccgugaagcagugccacgagcagaacauguucggcaacaucgugaaccagaacaagggccacuuccugcugaagcaggacugcgacaccuucgaccugcacgagaagccccucaagagcaaccugagcuucgagaaccagaagcgcuccagcgggcugaagaacuccgccgaguucaaccgggacggcaagagccucuuccacgccaaccacaagcaguucuacacggagaugaaguuccccgcgaucgccaagccgaucaacaagucccaguucaucaagcagcagcgcacccacaacaucgagaacgcccacgucugcagcgagugcgggaaggccuuccugaagcugucccaguucaucgaccaccagcgggugcacaccggcgagaagccccacgugugcagcaugugcgggaaggccuucagccgcaagucccggcucauggaccaccagcgcacccacacggagcugaagcacuacgagugcaccgagugcgacaagaccuuccugaagaagucccagcucaacauccaccagaagacccacaugggcggcaagcccuacacgugcagccagugcgggaaggcguucaucaagaagugccggcugaucuaccaccagcgcacccacaccggcgagaagccccacgggugcagcgucugcggcaaggccuucuccaccaaguucagccugacgacccaccagaagacccacaccggcgagaagccguacaucugcuccgagugcgggaagggcuucaucgagaagcggcgccucacggcccaccaccggacccacaccggggagaagcccuucaucugcaacaagugcggcaagggguucacccugaagaacagccugaucacgcaccagcagacccacaccggcgagaagcucuacacgugcuccgagugcggcaagggguucagcaugaagcacugccugauggugcaccagcgcacccacaccggcgagaagcccuacaagugcaacgagugcgggaagggcuucgcccugaaguccccgcucauccggcaccagcgcacccacaccggggagaagcccuacgugugcacggagugccggaagggcuucaccaugaaguccgaccugaucguccaccagcgcacccacaccgccgagaagcccuacaucugcaacgacugcggcaagggguucacggucaagagccggcugaucgugcaccagcgcacccacaccggcgagaagcccuacgugugcggggagugcggcaagggguuccccgcgaagauccgccucaugggccaccagcggacccacaccggcgagaagccguacaucugcaacgagugcgggaagggcuucacggagaagucccaccugaacgugcaccgccggacccacaccggggagaagcccuacgugugcagcgagugcggcaagggccugaccggcaagagcaugcucaucgcccaccagcgcacgcacaccggggagaagcccuacaucugcaacgagugcgggaagggcuucaccaugaaguccacccugagcauccaccagcagacgcacaccggggagaagcccuacaagugcaacgagugcgacaagaccuuccggaagaagaccugccugauccagcaccagcgcuuccacacgggcaagaccuccuucgccugcaccgagugcggcaaguucagccuccggaagaacgaccugaucacccaccagcgcauccacacgggggagaagccguacaagugcagcgacugcggcaaggccuucaccaccaaguccgggcugaacguccaccagcggaagcacaccggcgagcgccccuacgggugcagcgacugcggcaaggccuucgcgcaccucuccauccuggugaagcaccggcgcauccaccgguga

SEQ ID NO: 39093 - RNA, 2586 nt, Artificial Sequence
  derived and/or modified sequence opt1 from ZNF618__Homo_sapiens__NP_588615
augaaccagcccggcggggccgccgcgccgcaggccgacggcgccagcgccgccgggcgcaaguccaccgcgagccgggagcgccugaagcggucccagaaguccaccaagguggagggccccgagcccguccccgccgaggccucccucagcgccgagcaggggacgaugaccgaggugaaggugaagaccgagcugccggacgacuacauccaggaggucaucuggcagggcgaggcgaaggaggagaagaaggccguguccaaggacggcaccagcgacgugcccgccgagaucugcgucgugaucgggggcgugcgcaaccagcagacgcugggguccuacgagugcggcaucugcgggaagaaguacaaguacuacaacugcuuccagacccacguccgggcccaccgcgacaccgaggccaccagcggcgagggcgcgucccagagcaacaacuuccgguacacgugcgacaucugcgggaagaaguacaaguacuacuccugcuuccaggagcaccgcgaccuccacgccguggacguguucagcgucgagggcgcccccgagaaccgggccgaccccuucgaccagggggugguggccaccgacgaggucaaggaggagccgcccgagcccuuccagaagaucggccccaugaacaacaucaccuccgacaucuucaagaagaaggaggugcgccagugccagaagcgggagaccggcaacuacacgugcgaguucugcgggaagcaguacaaguacuacaccccguaccaggagcacguggcgcugcacgcccccaucaagagcgccuucucccgccgggucgagggcaaggcccagaaccacuucgaggagaccaacagcuccagccagaacagcuccgagcccuacacgugcggggccugcggcauccaguuccaguucuacaacaaccugcucgagcacaugcagagccacgcggccgacaacgagaacaacaucgccuccaaccagagccgcagcccgcccgccgugguggaggagaaguggaagccccaggcccagcggaacagcgcgaacaacaccaccaccuccgggcugacccccaacagcaugauccccgagaaggagcgccagaacaucgccgagcggcugcuccgcgucaugugcgccgaccugggcgcccuguccguggugagcggcaaggaguuccucaagcuggcgcagacgcuggucgacuccggggcccgguacggcgccuucagcgugaccgagauccucgggaacuucaacacccuggcccugaagcaccucccgcgcauguacaaccaggucaaggugaaggugaccugcgcccugggcuccaacgcgugccuggggaucggcgucacgugccacagccaguccgugggccccgacagcugcuacauccucaccgccuaccaggccgaggggaaccacaucaaguccuacgugcugggcgucaagggggccgacauccgggacagcggcgaccuggugcaccacugggugcagaacguccucuccgaguucgugaugagcgagauccgcaccguguacgucaccgacugccgcgugagcacguccgccuucagcaaggcggggaugugccugcggugcuccgccugcgcccugaacagcgugguccaguccgugcucagcaagcgcacccugcaggcccgguccaugcacgaggugaucgagcugcucaacgucugcgaggaccuggccggcagcaccggccuggcgaaggagaccuucgggucccucgaggagacgagcccgccgcccugcuggaacuccgugaccgacagccugcugcucgugcacgagcgcuacgagcagaucugcgaguucuacucccgggccaagaagaugaaccugauccagagccugaacaagcaccuccuguccaaccuggccgccauccucacccccgucaagcaggcggugaucgagcugagcaacgagucccagcccacccugcagcucgugcugcccacguacguccgccuggagaagcuguucaccgccaaggccaacgacgccggcaccgugagcaagcucugccaccuguuccuggaggcccucaaggagaacuucaaggugcaccccgcgcacaaggucgccaugauccuggacccccagcagaagcugcggcccgugccgcccuaccagcacgaggagaucaucgggaaggugugcgagcucaucaacgaggucaaggagagcugggccgaggaggccgacuucgagcccgccgcgaagaagccccgcuccgccgccguggagaacccggccgcccaggaggacgaccggcugggcaagaacgagguguacgacuaccugcaggagccccucuuccaggcgacccccgaccuguuccaguacuggagcugcgucacccagaagcacacgaagcuggccaagcucgccuucuggcugcuggccgugcccgcggugggcgcccgcuccgggugcgucaacaugugcgagcaggcccuccugaucaagcggcgccggcugcucagcccggaggacaugaacaagcugauguuccugaaguccaacaugcucuga

SEQ ID NO: 39094 - RNA, 1386 nt, Artificial Sequence
  derived and/or modified sequence opt1 from ZNF627__Homo_sapiens__NP_660338
auggacagcguggccuucgaggacgucgccgugaacuucacccuggaggagugggcgcuccuggaccccucccagaagaaccuguaccgcgacgugaugcgggagaccuuccgcaaccucgccagcgucggcaagcagugggaggaccagaacaucgaggacccguucaagaucccccggcgcaacaucucccacauccccgagcggcugugcgagagcaaggagggcgggcagggggaggagacguucucccagauccccgacggcauccugaacaagaagaccccgggggugaagcccugcgagagcuccgugugcggcgaggucggcauggggcccagcucccucaaccgccacauccgggaccacaccggccgcgagcccaacgaguaccaggaguacgggaagaaguccuacacccggaaccagugcggccgcgcccugagcuaccaccggagcuucccggugcgcgagcggacgcaccccgggggcaagcccuacgacugcaaggagugcggcgagaccuucaucucccuggugagcauccgccggcacaugcucacccaccgcgggggcguccccuacaagugcaaggugugcgggaaggccuucgacuacccgucccuguuccggauccacgagcgcagccacaccggcgagaagcccuacgagugcaagcagugcggcaaggccuucuccugcagcuccuacauccggauccacgagcgcacgcacaccggggacaagcccuacgagugcaagcagugcggcaaggcguucagcugcagcaaguacauccggauccacgagcgcacccacaccggggagaagcccuacgagugcaagcagugcggcaaggccuuccgcugcgccuccagcgugcggucccacgagcgcacgcacaccggggagaagcuguucgagugcaaggagugcggcaaggcccugaccugccucgcgagcguccggcgccacaugaucaagcacaccggcaacgggccguacaagugcaaggugugcggcaaggccuucgacuuccccuccagcuuccggauccacgagcgcacgcacaccggggagaagcccuacgacugcaagcagugcggcaaggccuucuccugcagcuccagcuuccggaagcacgagcgcauccacaccggggagaagcccuacaagugcaccaagugcggcaaggccuucucccggagcuccuacuuccgcauccacgagcggacgcacaccggcgagaagccguacgagugcaagcagugcgggaaggccuucagccgcuccaccuacuuccgggugcacgagaagauccacaccggcgagaagcccuacgagaaccccaaccccaacgcgagcgucgugccggugcuguccuga

SEQ ID NO: 39095 - RNA, 2610 nt, Artificial Sequence
  derived and/or modified sequence opt1 from ZNF629__Homo_sapiens__NP_001073886
auggagcccgagaccgcccuguggggcccggaccuccaggggcccgagcagagccccaacgacgcccaccgcggcgcggaguccgagaacgaggaggagagcccccggcaggaguccagcggggaggagaucaucaugggcgacccggcccagucccccgagagcaaggacuccaccgagaugagccuggagcgcuccagccaggaccccuccgugccccagaacccgcccacgccccuggggcacagcaacccccucgaccaccagaucccgcuggacccgcccgcccccgaggucgugcccacccccuccgacuggaccaaggccugcgaggccagcuggcaguggggcgcgcugaccacguggaacuccccgcccgugguccccgccaacgagcccagccuccgggagcuggugcagggccgccccgccggggccgagaagcccuacaucugcaacgagugcggcaaguccuucagccagugguccaagcugcuccggcaccagcgcauccacaccggggagcggccgaacacgugcagcgagugcggcaagagcuucacccaguccagccaccuggugcagcaccagcgcacgcacaccggggagaagcccuacaagugccccgacugcggcaagugcuucuccuggagcuccaaccugguccagcaccagcggacccacaccggcgagaagcccuacaagugcacggagugcgagaaggcguucacccagagcaccaaccucaucaagcaccagcgcucccacaccggggagaagccguacaagugcggcgagugccggcgcgccuucuaccggagcuccgaccugauccagcaccaggccacgcacaccggggagaagcccuacaagugccccgagugcggcaagcgcuucggccagaaccacaaccugcucaagcaccagaagauccacgccggggagaagccguaccggugcaccgagugcggcaagagcuucauccaguccagcgagcugacccagcaccagcgcacccacaccggggagaagcccuacgagugccuggagugcggcaaguccuucgggcacagcuccacccucaucaagcaccagcggacccaccuccgcgaggaccccuucaagugccccgugugcggcaagacguucacccugagcgccacccugcugcggcaccagcgcacccacacgggcgagcggccguacaagugccccgagugcgggaaguccuucagcguguccagcaaccugaucaaccaccagcgcauccaccgcggcgagcggcccuacaucugcgcggacugcggcaagagcuucaucauguccagcacccucauccgccaccagcggauccacaccggggagaagcccuacaagugcuccgacugcggcaagagcuucauccgcuccagccaccugauccagcaccggcgcacccacacgggggagaagccguacaagugccccgagugcggcaaguccuucagccaguccagcaaccugaucacccacguccggacccacauggacgagaaccucuucgugugcuccgacugcgggaaggccuuccuggaggcccacgagcuggagcagcaccgcgugauccacgagcggggcaagacccccgcccgccgggcccagggggacagccuccugggccugggggaccccucccuccugacgccgccgcccggcgcgaagccccacaagugccuggucugcggcaagggguucaacgacgagggcaucuucaugcagcaccagcgcauccacaucggggagaaccccuacaagaacgccgacggccucaucgcccacgccgcccccaagccgccccagcugcggagcccccgccugcccuuccggggcaacuccuaccccggggcggccgagggccgcgccgaggcccccgggcagccgcucaagccgcccgagggccaggagggguucagccagcggcgcggccugcuguccagcaagaccuacaucugcagccacugcggcgaguccuuccucgaccggagcgugcugcugcagcaccagcucacccacgggaacgagaagcccuuccuguuccccgacuaccgcaucggccugggggagggcgccgggcccucccccuuccucagcggcaagccguucaagugccccgagugcaagcaguccuucggccugagcuccgagcugcugcuccaccagaaggugcacgccgggggcaagagcucccagaagucccccgagcugggcaagagcagcuccguccugcucgagcaccuccgcagcccccugggggcgcggccguaccgcugcuccgacugccgggccagcuuccuggaccgcguggcccugacccggcaccaggagacccacacgcaggagaagccgcccaaccccgaggacccgccgcccgaggcggugacccuguccaccgaccaggagggggagggcgagacccccacgcccaccgagagcuccagccacggcgaggggcagaaccccaagacccucgucgaggagaagcccuaccugugccccgagugcggcgccggguucaccgagguggccgcccugcuccugcaccgcagcugccaccccggcgugucccuguga

SEQ ID NO: 39096 - RNA, 1458 nt, Artificial Sequence
  derived and/or modified sequence opt1 from ZNF639__Homo_sapiens__NP_001290355
augaacgaguaccccaagaagcgcaagcggaagacccugcacccgagccgcuacuccgacagcuccggcaucagccggaucgccgacggguucaacggcaucuucuccgaccacugcuacagcgugugcuccaugcgccagcccgaccugaaguacuucgacaacaaggacgacgacagcgacaccgagacguccaacgaccugcccaaguucgccgacgggaucaaggcgcggaaccgcaaccagaacuaccugguccccagcccggugcuccggauccuggaccacaccgccuucuccaccgagaaguccgccgacaucgugaucugcgacgaggagugcgacagccccgagagcgucaaccagcagacccaggaggagucccccaucgaggugcacacggccgaggacgugcccaucgccgucgaggugcacgcgaucagcgaggacuacgacaucgagaccgagaacaacuccagcgagucccugcaggaccagaccgacgaggagccgcccgccaagcucugcaagauccuggacaagagccaggcccugaacgugaccgcccagcagaaguggccccuccugcgcgcgaacagcuccggccuguacaagugcgagcucugcgaguucaacagcaaguacuucuccgaccugaagcagcacaugauccugaagcacaagcggacggacagcaacgucugccgcgugugcaaggaguccuucagcaccaacaugcuccugaucgagcacgccaagcugcacgaggaggaccccuacaucugcaaguacugcgacuacaagaccgugaucuucgagaaccucucccagcacaucgccgacacccacuucagcgaccaccuguacuggugcgagcagugcgacguccaguucuccagcuccagcgagcuguaccuccacuuccaggagcacuccugcgacgagcaguaccugugccaguucugcgagcacgagacgaacgacccggaggaccugcacagccacguggugaacgagcacgccugcaagcucaucgagcuguccgacaaguacaacaacggggagcacggccaguacagccugcucuccaagaucaccuucgacaagugcaagaacuucuucgucugccaggugugcggcuuccggagccgccugcacaccaacgugaaccggcacgucgccaucgagcacaccaagaucuucccccacgugugcgacgacugcgggaagggcuucuccagcaugcuggaguacugcaagcaccucaacagccaccuguccgaggggaucuaccugugccaguacugcgaguacagcacgggccagaucgaggaccucaagauccaccuggacuucaagcacuccgcggaccugccccacaagugcagcgacugccucaugcgcuucgggaacgagcgggagcugaucucccaccuccccgugcacgagaccaccuga

SEQ ID NO: 39097 - RNA, 4107 nt, Artificial Sequence
  derived and/or modified sequence opt1 from ZNF644__Homo_sapiens__XP_011540563
augcgcagcuuccugcagcaggacgugaacaagaccaagucccggcucaacguccugaacggccuggccaacaacauggacgaccucaagaucaacaccgacaucacgggggccaaggaggagcugcuggacgacaacaacuucaucagcgacaaggaguccggcgugcacaagcccaaggacugccagaccagcuuccagaagaacaacacccucacccugccggaggagcuguccaaggacaagagcgagaacgcgcucuccgggggccagagcucccuguucauccacgccggggcccccacggugagcuccgagaacuucauccugcccaagggcgccgccgucaacggccccgugagccacuccagccucaccaagaccuccaacaugaacaaggggagcgugucccugaccacgggccagccggucgaccagcccaccaccgagagcugcuccacccugaagguggcggccgaccuccagcugagcacgccccagaaggccagccagcaccaggugcuguuccuccuguccgacgucgcccacgcgaagaaccccacccacagcaacaagaagcugccgaccuccgccagcguggggugcgacauccagaacuccgugggcagcaacaucaaguccgacgggacccucaucaaccaggucgaggugggcgaggacggcgaggaccugcuggugaaggacgacugcgucaacacggugaccgggaucagcuccggcaccgacggguuccgcagcgagaacgacaccaacugggacccccagaaggaguucauccaguuccucaugacgaacgaggagaccguggacaaggccccgccccacuccaagaucggccuggagaagaagcggaagcgcaagauggacgucagcaagaucacccgguacaccgaggacugcuucuccgacagcaacugcgugcccaacaaguccaagaugcaggagguggacuuccuggagcagaacgaggagcuccaggccgucgacagccagaaguacgcccuguccaaggugaagcccgagagcacggacgaggaccuggaguccguggacgcguuccagcaccucaucuacaaccccgacaagugcggcgaggagagcagccccguccacaccuccaccuuccugagcaacacccugaagaagaagugcgaggaguccgacagcgaguccccggccacguucagcaccgaggagcccuccuucuaccccugcaccaagugcaacgugaacuuccgcgagaagaagcaccuccaccggcacaugauguaccaccuggacgggaacagccacuuccgccaccugaacgucccccggccguacgccugccgcgagugcggccggaccuuccgcgaccggaacucccuccugaagcacaugaucauccaccaggagcgccggcagaagcugauggaggagauccgcgagcucaaggagcugcaggacgaggggcggagcgcccgccugcagugcccccagugcguguucggcacgaacugccccaagaccuucgugcagcacgccaagacccacgagaaggacaagcgguacuacugcugcgaggagugcaacuucauggcggucaccgagaacgagcucgagugccaccgcgggaucgcccacggcgccguggugaagugccccauggucacguccgacaucgcccagcggaagacccagaagaagaccuucaugaaggacagcguggugggcuccagcaagaaguccgccaccuacaucugcaagaugugcccguucaccacgagcgcgaaguccguccugaagaagcacaccgaguaccugcacagcagcuccugcguggacagcuucgggagcccccucggccuggacaagcgcaagaacgacauccuggaggagcccguggacagcgacuccaccaagacccucacgaagcagcagagcaccaccuuccccaagaacuccgcccugaagcaggacgucaagcgcaccuucgggagcacgucccagagcuccagcuucuccaagauccacaagcggccgcaccgcauccagaaggcccgcaagagcaucgcccaguccggcgugaacaugugcaaccagaacagcagcccccacaagaacgugaccaucaagagcuccgucgaccagaagcccaaguacuuccaccaggccgcgaaggagaaguccaacgccaaggccaacagccacuaccuguaccggcacaaguacgagaacuaccggaugaucaagaaguccggggagagcuacccggugcacuucaagaaggaggaggccuccagccugaacucccuccaccuguucagcuccagcuccaacagccacaacaacuucaucuccgacccccacaagcccgacgcgaagcgccccgagagcuucaaggaccaccggcgcguggccgucaagcgggugaucaaggaguccaagaaggagagcuccgugggcggcgaggaccuggacagcuacccggacuuccuccacaagaugaccgucguggugcugcagaagcugaacuccgccgagaagaaggacagcuacgagaccgaggacgaguccagcugggacaacgucgagcucggggacuacacgacccaggccaucgaggacgagaccuacagcgacaucaaccaggagcacgugaaccuguucccccuguucaaguccaagguggagggccaggagcccggggagaacgccacccucagcuacgaccagaacgacggcuucuacuucgaguacuacgaggacacgggguccaacaacuuccugcacgagauccacgacccccagcaccuggagaccgcggacgccagccucuccaagcacagcuccgucuuccacuggaccgaccugagccuggagaagaaguccugcccguacugccccgccaccuucgagacgggcgugggccucagcaaccacgugcgcgggcaccuccaccgggccggccuguccuacgaggcccgccacgucgugagccccgagcagaucgcgaccuccgacaagaugcagcacuucaagcggaccgggaccggcacgcccgugaagcgcguccggaaggccaucgagaaguccgagaccaccuccgagcacacgugccagcugugcggcgggugguucgacaccaagaucggccugagcaaccacgugcgcgggcaccugaagcggcucggcaagaccaagugggacgcccacaaguccccgaucugcgugcugaacgagaugaugcagaacgaggagaaguacgagaagauccugaaggcccucaacagccgccggaucaucccccgccccuucgucgcccagaagcuggcguccagcgacgacuucaucagccagaacgugaucccccuggaggccuaccgcaacgggcucaagaccgaggcccuguccgugagcgccuccgaggaggagggccugaacuuccucaacgaguacgacgagaccaagccggagcugcccagcggcaagaagaaccagucccugacgcucaucgagcugcugaagaacaagcggaugggggaggagcgcaacagcgcgaucagcccccagaagauccacaaccagaccgcccggaagcgcuucguccagaagugcgugcucccccugaacgaggacagcccgcugauguaccagccccagaagauggaccucaccaugcacuccggcaugcccgugaagcugcggaccugcguccacugcaacacgaccuucaccagcgccgugucccugagcaaccaccuccgcgccuacgcccggaagaaguccgcggggcugcugaccggcaccgcccucgacugcaagcagaagaagucccgcucccggagcggguccaagaagaagaugcugacgcugccccacggcgccgacgagguguacauccuccgcugccgguucugcggccuggucuuccgcgggccgcugagcgugcaggaggacuggaucaagcaccuccagcggcacaucgugaacgccaaccugccccgcaccggcgccgggauggucgaggugaccucccugcucaagaagcccgcgagcaucaccgagacgagcuucucccugcugauggccgaggccgccagcuga

SEQ ID NO: 39098 - RNA, 1278 nt, Artificial Sequence
  derived and/or modified sequence opt1 from ZNF645__Homo_sapiens__NP_689790
augaacaagaugcccgccggcgagcaggagugcgaguacaacaaggaggggaaguacuacagcaagggcgugaagcugguccgcaagaagaagaagauccccggguaccgguggggcgacaucaagaucaacaucaucggggagaaggacgaccuccccauccacuucugcgacaagugcgaccugcccaucaagaucuacggccgcaucauccccugcaagcacgccuucugcuaccacugcgcgaaccuguacgacaaggugggcuacaaggugugcccgcggugccgcuaccccguccuccggaucgaggcccacaagcgcggguccguguucaugugcagcaucgugcagcagugcaagcggaccuaccugucccagaagucccugcaggcccacaucaagcgccggcacaagcgcgcccggaagcaggucaccagcgccagccucgagaaggugcgcccccacaucgcgcccccgcagacggagaucuccgacauccccaagcggcugcaggaccgcgaccaccugagcuacaucccgcccgagcagcacaccauggugucccuccccagcguccagcacaugcugcaggagcagcacaaccagccccacaaggacauccaggcgcccccgcccgagcugucccucagccugcccuuccccauccagugggagaccguguccaucuucacccggaagcacggcaaccugacgguggaccacauccagaacaacagcgacuccggggccaagaagcccaccccgcccgacuacuaccccgagugccagagccagcccgccgucuccagcccgcaccacaucaucccccagaagcagcacuacgccccgccgcccucccccagcagccccgugaaccaccagaugcccuacccgccccaggacguggucacccccaacuccgugcgcagccaggugcccgcccucaccacgaccuacgaccccuccagcggcuacaucaucgucaaggugccgcccgacaugaacuccccgccccugcgggcgccccagagccagaacgggaaccccuccgccagcgaguucgccucccaccacuacaaccugaacauccucccccaguucaccgagaaccaggagacccugagcccccaguucacgcagaccgacgccauggaccaccgccgguggcccgccuggaagcgccugucccccugcccgcccacccggagcccgccgcccuccacccuccacggccgcagccaccacucccaccagcgccggcaccgccgguacuga

SEQ ID NO: 39099 - RNA, 5499 nt, Artificial Sequence
  derived and/or modified sequence opt1 from ZNF646__Homo_sapiens__NP_055514
auggaggacaccccgcccagccuguccugcagcgacugccagcgccacuuccccucccugcccgagcugagccggcaccgggagcugcuccaccccucccccaaccaggacagcgaggaggccgacuccaucccccggcccuaccggugccagcagugcggccggggguaccgccaccccggcagccuggugaaccaccggcgcacccacgagaccgggcuguuccccugcacgaccugcggcaaggacuucuccaaccccauggcccucaagagccacaugcggacccacgcccccgaggggcgccggcgccaccggccgccccgccccaaggaggccacgccccaccuccagggcgagaccgucuccaccgacagcuggggccagcggcugggguccagcgagggcugggagaaccagaccaagcacaccgaggagacccccgacugcgaguccgugcccgacccccgcgccgccagcgggaccugggaggaccuccccacccggcagcgcgagggccuggccucccaccccgggcccgaggacggcgcggacggcugggggcccagcaccaacuccgcccgggcgccgccccugccgauccccgccagcagccuccuguccaaccuggagcaguaccucgcggagagcguggucaacuucaccggcgggcaggagcccacccaguccccgcccgccgaggaggagcgccgguacaagugcagccagugcggcaagaccuacaagcacgccggcucccugacgaaccaccgccagagccacacccuggggaucuaccccugcgccaucugcuucaaggaguucuccaaccucauggcccugaagaaccacagccgccugcacgcgcaguaccggcccuaccacugcccccacugcccccgcguguuccggcucccccgcgagcugcuggagcaccagcagucccacgagggcgagcggcaggagccccgcugggaggagaaggggaugccgaccaccaacggccacacggacgagagcucccaggaccagcuccccagcgcccagaugcugaacggguccgccgagcugagcaccuccggcgagcucgaggacagcggccuggaggaguaccggcccuuccgcugcggggacugcggccggaccuaccgccacgccgggucccugaucaaccaccgcaagagccaccagaccggcguguaccccugcucccucugcagcaagcagcuguucaacgccgcggcccugaagaaccacguccgcgcccaccaccggccgcgccagggggugggcgagaacggccagcccagcgugccgcccgccccgcuccugcuggccgagacgacccacaaggaggaggaggaccccaccaccacgcucgaccaccggcccuacaagugcuccgagugcgggcgcgcguaccggcaccgcggcagccuggucaaccaccggcacucccaccgcaccggggaguaccagugcagccugugcccccgcaaguacccgaaccucauggcccugcggaaccacgugcgcgugcacugcaaggccgcccggcgcuccgccgacaucggcgcggagggggcccccagccaccugaaggucgagcugccgcccgacccgguggaggccgaggccgcgccccacaccgaccaggaccacgugugcaagcacgaggaggaggccaccgacaucacgcccgccgccgacaagaccgccgcgcacaucugcuccaucugcggccugcuguucgaggacgccgagagccucgagcggcacggccugacccacggggccggcgagaaggagaacucccgcaccgagacgaccaugagcccgccccgggccuucgccugccgcgacugcgggaaguccuaccggcacagcggcucccugaucaaccaccgccagacccaccagaccggcgacuucagcugcggggcgugcgccaagcacuuccacaccauggccgccaugaagaaccaccuccggcgccacucccggcgccggagccgccggcaccgcaagcgggccggcggggcguccggcgggcgcgaggccaagcugcuggccgccgagagcuggacgcgggagcuggaggacaacgagggccucgagagcccccaggaccccuccggcgagagcccccacggggcggagggcaaccuggaguccgacggggacugccugcaggccgagagcgagggcgacaagugcgggcucgagcgcgacgagacccacuuccagggcgacaaggaguccggcgggaccggcgaggggcuggagcgcaaggacgccagccugcucgacaaccuggacauccccggcgaggagggcgggggcacccacuucugcgacucccugacgggggucgacgaggaccagaagcccgccaccggccagcccaacagcuccagccacuccgccaacgcggugaccggguggcaggccggcgccgcccacacgugcagcgacugcgggcacuccuucccgcacgccacgggccuccugagccaccggcccugccacccgcccggcaucuaccagugcucccugugcccgaaggaguucgacagccuccccgcgcugcgcucccacuuccagaaccaccggcccggggaggccaccagcgcccagcccuuccugugcugccucugcggcaugaucuucccggggcgcgccggcuaccggcugcaccgccggcaggcccacuccagcagcggcaugaccgagggguccgaggaggagggcgaggaggaggggguggcggaggccgcccccgcccgcuccccgccccugcagcucuccgaggcggagcugcugaaccagcuccagcgggaggucgaggcccuggacagcgccggcuacgggcacaucugcggcugcugcggccagaccuacgacgaccuggggucccucgagcgccaccaccagagccaguccagcggcacgaccgccgacaaggccccgagcccccuggggguggcgggcgacgccauggagaugguggucgacagcgugcuggaggacaucgugaacuccgucagcggggagggcggcgacgccaagucccaggagggggccggcacgccccugggggacagccugugcauccagggcggggagucccugcucgaggcccagccccggccguuccgcugcaaccagugcggcaagaccuaccggcacggcgggagccuggugaaccaccgcaagauccaccagacgggcgacuuccugugccccgucugcucccggugcuaccccaaccucgcggccuaccgcaaccaccuccggaaccacccccgcugcaaggggagcgagccccaggugggccccauccccgaggccgccggcuccagcgagcuccagguggggcccaucccggagggcgggagcaacaagccccagcacauggccgaggagggccccgggcaggcggaggucgagaagcuccaggaggagcugaagguggagccgcuggaggagguggcccgggucaaggaggaggugugggaggagaccaccgugaagggcgaggagaucgagccccgccucgagaccgccgagaagggcugccagacggaggccuccagcgagcgccccuucuccugcgaggucugcgggcggagcuacaagcacgccggcucccugaucaaccaccgccagagccaccagaccgggcacuucggcugccaggcgugcuccaagggguucagcaaccugaugucccucaagaaccaccggcgcauccacgccgacccccggcgcuuccggugcagcgagugcggcaaggccuuccgccugcggaagcagcuggccucccaccagcgcgugcacauggagcggcgcggcgggggcgggacccggaaggcgacccgcgaggaccggccguuccgcugcggccagugcgggcggacguaccgccacgccggcagccuccugaaccaccggcgcucccacgagaccggccaguacagcugcccgaccugccccaagaccuacuccaaccggauggcccugaaggaccaccagcgccuccacagcgagaaccgccggcgccgggccgggcgcucccggcgcacggccgugcggugcgcgcugugcggccgcagcuuccccgggcggggcucccuggagcgccaccuccgggagcacgaggagaccgagcgcgagccggccaacgggcagggcggccuggacgggaccgccgccagcgaggccaaccugaccggcagccaggggcucgagacgcagcugggcggcgcggagcccgucccccaccuggaggacggggugccccggccgggcgagcgcucccagagccccauccgggccgccuccagcgaggcccccgagccccucuccuggggcgccggcaaggcgggcggguggccggucgggggcgggcuggggaaccacagcggcgggugggugccccaguuccugacccgcuccgaggagcccgaggacagcgugcaccggucccccugccacgccggcgacugccagcucaacggcccgacccugagccacauggacuccugggacaaccgcgacaacagcucccagcugcagcccgggagccacuccagcugcucccagugcggcaagaccuacugccagagcgggucccuccugaaccacaacacgaacaagaccgaccggcacuacugccugcucugcagcaaggaguuccugaaccccguggccaccaagagccacucccacaaccacaucgacgcccagaccuucgcgugccccgacugcggcaaggccuucgagagccaccaggagcuggccucccaccuccaggcccacgcccgcgggcacagccaggucccggcgcagauggaggaggcccgcgaccccaaggccggcaccggcgaggaccagguggugcugcccgggcagggcaaggcccaggaggcccccuccgagacgccgcgggggcccggcgagagcgucgagcgcgcgcgcgggggccaggccgugaccuccauggccgccgaggacaaggagcgccccuuccggugcacccagugcggccgcagcuaccggcacgccgggucccugcucaaccaccagaaggcgcacaccacgggccuguacccgugcagccugugccccaagcuccugcccaaccugcucucccugaagaaccacagccgcacccacaccgaccccaagcggcacugcugcuccaucugcgggaaggccuuccgcaccgccgcccggcuggagggccacggccgcgugcacgcgccgcgggaggggcccuucacgugcccccacugcccccgccacuuccggcgccggaucagcuucguccagcaccagcagcagcaccaggaggaguggaccguggccggcuccggggccccgguggcccccgucaccggccgcggggaccucccccugcccccgccgcccacccccacgaccccgcugcucgaccccagcccccaguggcccgccgaccuguccuucagccuguga

SEQ ID NO: 39100 - RNA, 1821 nt, Artificial Sequence
  derived and/or modified sequence opt1 from ZNF652__Homo_sapiens__NP_001138837
augagccacaccgccuccagcugccaggagcugguggagaacugcgccguccacguggcgggcauggcccaggaggacucccgccggggccaggugcccagcuccuucuaccacggcgccaaccaggagcuggaccugagcaccaaggucuacaagcgcgaguccgggagccccuacuccgugcugguggacacgaagaugagcaagccccaccuccacgagaccgaggagcagcccuacuuccgggagacccgcgccgucuccgacgugcacgccgugaaggaggaccgggagaacagcgacgacaccgaggaggaggaggaggaggucuccuacaagcgcgagcagaucaucguggaggugaaccugaacaaccagacgcugaacgucagcaagggcgagaaggggguguccagccaguccaaggagacccccgugcucaagaccagcuccgaggaggaggaggaggagagcgaggaggaggcgaccgacgacagcaacgacuacggcgagaacgagaagcagaagaagaaggagaagaucgucgagaagguguccgugacgcagcggcgcacccggcgcgccgccagcgucgccgcggccaccaccuccccgacgccccggaccacccgcgggcggcgcaagagcguggagccgcccaagcggaagaagcgcgccaccaaggagcccaaggcccccgugcagaaggccaagugcgaggagaaggagacgcugaccugcgagaagugcccccgggucuucaacacccgcugguaccuggagaagcacaugaacgugacccaccggcgcaugcagaucugcgacaagugcgggaagaaguucgugcucgaguccgagcugagccugcaccagcagacggacugcgagaagaacauccagugcgucuccugcaacaagagcuucaagaagcucuggucccugcacgagcacaucaagaucgugcacggcuacgcggagaagaaguucagcugcgagaucugcgagaagaaguucuacaccauggcccacguccggaagcacaugguggcccacaccaaggacaugcccuucacgugcgagaccugcgggaaguccuucaagcgcagcaugucccugaaggugcacagccuccagcacuccggcgagaagccguuccgcugcgagaacugcgacgagcgguuccaguacaaguaccagcugcgcagccacauguccauccacaucgggcacaagcaguucaugugccaguggugcggcaaggacuucaacaugaagcaguacuucgacgagcacaugaagacccacaccggcgagaagcccuucaucugcgagaucugcggcaagagcuucaccucccggcccaacaugaagcgccaccggcgcacgcacaccggggagaagcccuacccgugcgacgucugcgggcagcgguuccgcuucagcaacaugcugaaggcccacaaggagaagugcuuccgggugaccagccccgugaacgucccgcccgccgugcagaucccccucaccacgucccccgcgacccccgugcccagcgucgugaacaccgccaccacgccgaccccgcccaucaacaugaaccccguguccacccugccgccccgccccaucccccaccccuucagccaccuccacauccacccccacccccaccacccgcaccaccuccccaucccgcccgucccccaccucccgcccccgcccgcccuguucaaguccgagccccugaaccaccggggccagagcgaggacaacuuccugcgccaccuggccgagaagaacuccagcgcccagcaccacuga

SEQ ID NO: 39101 - RNA, 1746 nt, Artificial Sequence
  derived and/or modified sequence opt1 from ZNF654__Homo_sapiens__NP_060763
augcugugcaacaaggaguuccucggcgggcacaucgugcgccacgcccaggcccaccagaagaagggcagcuucgcgugcgucaucugcgggcggaaguuccgcaaccggggccugaugcagaagcaccugaagaaccacgugaagaagauccagcgccagcagaucgccgccgcccagcaggacgaccaggaggugaccgcccucgaggagaucaacugcuccagcuccagcaucuccuucgagaacgggaacagcgacuccaaggaccuggaggucgagacccugacggcgagcuccgagggcaacaaggaggugauccccgagcacguggccgaguucaucgagaucccgaucagcguccccgaggacgugaucgagaacgugaucgagaacggcucccccaacaacagccucaacaacgucuucaagccccugaccgagugcggggacgacuacgaggaggaggaggacgaggagggcgacuacgaggaggacgacuacgaccugaaccaggagaccuccgugauccacaagaucaacgggaccgugugccacccgaaggacaucuacgccacggaccaggagggcaacuucaagugccccgcccucgggugcguccggaucuucaagcgcaucggcuuccugaacaagcacgcgaugaccgugcaccccaccgaccugaacgugcggcagaccgucaugaaguggagcaagggcaagugcaaguucugccagcgccaguucgaggacucccagcacuucaucgaccaccucaaccggcacagcuaccccaacguguacuucugccugcacuucaacugcaacgaguccuucaagcugccguuccagcucgcccagcacaccaagagccaccgcaucuuccaggcccagugcuccuuccccgagugccacgagcuguucgaggaccugccccuccuguacgagcacgaggcccagcacuaccugagcaagacccccgagagcuccgcccagccgagcgagaccauccucugggacgugcagaccgacuccaaccccaaccaggagaaggacagcuccagcaacgagaagcagacgaucucccugcccgucagcaccuccaagagccggaaggaguccaccgagcccaagaccugcaucgagagcauggagaagaagacggacucccuggugcagaacgggaacgagcgcagcgacgacaccguguccaacaucagccucaucgaccagaagaugccggacaucgagcccaacuccgagaacaacugcagcuccagcgacaucgucaacggccacagcgagaucgagcagacgccccugguguccagcgaccccgcgcugaagaucgacaccaaccggauccgcacggagaacggguccauccucccgagcguggucccccaggagcacaacacccugcccgugucccaggcccccagcaagccgaaccugaccuccgagcacaccagcuacggccucauccugacgaagcccuacguccggccccugcccccguccuaccucgacgagcgcuaccugagcaugcccaagcggcgcaaguuccugaccgaccggguggacgccugcuccgaccaggacaacguguacaagaaguccgucaagcgccuccggugcggcaagugccugaccaccuacugcaacgccgaggcccuggaggcgcaccucgcccagaagaagugccagacgcuguucggguucgacagcgacgacgagagcgccuga

SEQ ID NO: 39102 - RNA, 786 nt, Artificial Sequence
  derived and/or modified sequence opt1 from ZNF664__Homo_sapiens__NP_689650
augaucuacaagugccccaugugccgcgaguucuucagcgagcgggccgaccuguucaugcaccagaagauccacaccgccgagaagccgcacaagugcgacaagugcgacaagggcuucuuccacaucuccgagcuccacauccacuggcgcgaccacaccggggagaagguguacaagugcgacgacugcggcaaggacuucagcacgaccaccaagcugaaccggcacaagaagauccacaccgucgagaagcccuacaagugcuacgagugcgggaaggcguucaacugguccagccaccuccagauccacaugcgcgugcacacgggcgagaagcccuacgugugcuccgagugcgggcggggcuucagcaacuccagcaaccugugcaugcaccagcgcguccacaccggcgagaagcccuucaagugcgaggagugcgggaaggccuuccggcacaccuccagccugugcaugcaccagcgcgugcacaccggcgagaagccguacaagugcuacgagugcgggaaggccuucucccagagcuccagccugugcauccaccagcgggugcacacgggcgagaagcccuaccgcugcugcgggugcggcaaggccuucucccagagcuccagccucugcauccaccagcggguccacaccggcgagaagcccuucaagugcgacgagugcgggaaggccuucucccagagcaccagccugugcauccaccagcgcgugcacaccaaggagcggaaccaccugaagaucuccgugaucuga

SEQ ID NO: 39103 - RNA, 1833 nt, Artificial Sequence
  derived and/or modified sequence opt1 from ZNF667__Homo_sapiens__NP_071386
augcccagcgcccgcggcaaguccaagagcaaggccccgaucaccuucggggaccuggcgaucuacuucucccaggaggagugggaguggcucagccccauccagaaggaccuguacgaggacgugaugcuggagaacuaccggaaccucgucucccugggccugagcuuccgccggcccaacgugaucacccuccuggagaaggggaaggcccccuggaugguggagccgguccgccggcgccgggcccccgacuccggcagcaagugcgagacgaagaagcugccgcccaaccagugcaacaaguccgggcagagcaucugccagaagcucguguccgcccagcagaaggcccccacccgcaagagcggcugcaacaagaacuccgugcuggucaagcccaagaagggccacagcgggaagaagccccugaagugcaacgacugcggcaagaccuucucccggagcuucucccucaagcugcaccagaacauccacaccggggagaagcccuucgagugcagcaacugccgcaaggcguuccggcagaucuccagcauccugcuccaccagcgcauccacagcggcaagaagucccacgagugcaacaagugcggggagagcuucaaccagcggacgacccugauccugcacaugcgcauccacgacggcaaggagauccucgacugcggcaaggcccugucccagugccagagcuucaacauccaccagaagauccacgugguggggaacgucugccagugccggaagugcggcaaggccuucaaccagauguccagccugcuccugcacaagaagauccacaacgggaagaagacccacaaguacaacaagugcggccgcggcuucaagaagaaguccguguucgugguccacaagcggauccacgccggggagaagaucccggagaacgcgaaggcccugagccagucccuccagcagcgcagccaccaccuggagaaccccuucaagugccggaagugcggcaagcuguucaaccgcaucagcccccucaugcugcaccagcggauccacaccuccgagaagcccuacaagugcgacaagugcgacaaguucuuccgccgccuguccacgcucauccugcaccuccggauccacaacggggagaagcuguaccgcugcaacaagugcgagaaggugugcaaccggcacagcucccugauccagcaccagaaggugcacaccaagaagaagaagcuguucgagugcaaggagugcggcaagauguucagcgggaccgccaaccucaagauccaccagaacauccacuccgaggagaagccguucaagugcaacaagugcagcaaggucuucggccgccaguccuuccugaucgagcaccagcggauccacaccggcgagaagcccuaccagugcgaggagugcgggaaggccuucagccaccgcaucagccugacgcggcacaagcgcauccacaccgaggaccggcccuacgagugcgaccagugcggcaaggccuucucccagagcgcgcaccucgcccagcacgagcgcauccacaccggggagaagcccuacacgugcaagaccugcggcaaggccuucucccagcggaccagccugauccugcacgagcgcucccacaccggggagaagccguacgagugcaacgagugcggcaaggccuucagcuccggcagcgaccucauccggcaccagcgcucccacagcuccgagaagcccuacgagugcagcaagugcgggaaggccuacucccggagcuccagccugauccgccaccagaacacccacuccgaggagaaggcguga

SEQ ID NO: 39104 - RNA, 1860 nt, Artificial Sequence
  derived and/or modified sequence opt1 from ZNF668__Homo_sapiens__NP_078982
auggagguggaggccgccgaggcgcgcagccccgccccgggcuacaagcgguccgggcgccgguacaagugccugagcugcaccaagaccuuccccaacgcgccccgcgccgcccggcacgccgccacccacggccccgccgacugcuccgaggaggucgccgaggugaagccgaagcccgagaccgaggcgaaggccgaggaggccagcggggagaagguguccggcagcgccgccaagccccgccccuacgcgugcccgcucugccccaaggccuacaagaccgcccccgagcugcggucccacgggcgcagccacaccggcgagaagcccuucccgugccccgagugcggccggcgcuucaugcagcccgucugccugcgggugcaccucgccucccacgccggggagcugcccuuccgcugcgcgcacugcccgaaggccuacggcgcccugagcaagcucaagauccaccagcgggggcacacgggcgagcgccccuacgccugcgccgacugcgggaaguccuucgcggaccccagcguguuccggaagcaccgccggacccacgccggccugcgccccuacuccugcgagcggugcggcaaggccuacgccgagcugaaggaccuccgcaaccacgagcggagccacaccggggagcgcccguuccugugcuccgagugcggcaagagcuucucccgcagcuccagccugaccugccaccagcggauccacgccgcgcagaagcccuaccgcugccccgccugcgggaagggcuucacgcagcucagcuccuaccagagccacgagcggacccacuccggcgagaagcccuuccugugcccgcgcugcgggcggauguucagcgaccccuccagcuuccgccggcaccagcgcgcccacgagggcgucaagcccuaccacugcgagaagugcgggaaggacuuccggcagcccgccgaccuggcgaugcaccgccgggugcacaccggcgaccgcccguucaagugccuccagugcgacaagaccuucguggccuccugggaccugaagcggcacgcccugguccacagcgggcagcgccccuuccggugcgaggagugcggccgcgccuucgccgagcgggcgucccucacgaagcacagccgcgugcacuccggcgagcggcccuuccacugcaacgccugcggcaagagcuucguggucuccagcucccugcgcaagcacgagcgcacccaccggagcuccgaggccgccggggugccgcccgcccaggagcugguggucgggcucgcgcugcccgugggcguggccggggagagcuccgccgcccccgccgcgggcgccggccugggggacccgcccgccggccuccuggggcugccgcccgagagcggcggggucauggccacccaguggcaggucgugggcaugaccguggagcacguggagugccaggacgcgggcgugcgcgaggcccccgggccccucgagggcgccggggaggccggcggcgaggaggccgacgagaagccgccccaguucgucugccgggagugcaaggagacguucagcaccaugacccugcugcgccggcacgagcgcucccaccccgagcuccggcccuuccccugcacccagugcggcaagagcuucuccgaccgcgcggggcugcggaagcacagccgcacgcacuccagcgugcggcccuacacgugcccgcacugccccaaggccuuccuguccgccagcgaccuccgcaagcacgagcggacccaccccguccccauggggaccccgacgccccuggagccccugguggcccuccugggcaugcccgaggaggggccggccuga

SEQ ID NO: 39105 - RNA, 1728 nt, Artificial Sequence
  derived and/or modified sequence opt1 from ZNF674__Homo_sapiens__NP_001139763
auggccaugagccaggagucccugaccuucaaggacguguucgucgacuucacccucgaggaguggcagcagcuggacagcgcccagaagaaccuguaccgcgacgugaugcucgagaacuacucccaccuggugagcgucggccaccugguggggaagcccgacgugaucuuccggcucggcccgggggacgaguccuggauggcggacggcgggacgcccguccggaccugcgccgugugggagguggacgagcagaucgaccacuacaaggagagccaggacaaguuccuguggcaggccgccuucaucggcaaggagacccugaaggacgaguccggccaggagugcaagaucugccgcaagaucaucuaccucaacaccgacuucgucagcgugaagcagcgccugcccaaguacuacuccugggagcggugcagcaagcaccaccugaacuuccucgggcagaaccgcuccuacgugcggaagaaggacgacggcugcaaggccuacuggaaggucugccugcacuacaaccugcacaaggcgcagcccgccgagcgcuucuucgacccgaaccagcgggggaaggcccuccaccagaagcaggcccugcgcaagagccagcggucccagacgggcgagaagcuguacaagugcaccgagugcgggaagguguucauccagaaggcgaaccucgugguccaccagcgcacccacaccggcgagaagcccuacgagugcugcgagugcgccaaggccuucagccagaaguccacgcugaucgcccaccagcggacccacaccggcgagaagcccuacgagugcagcgagugcgggaagaccuucauccagaaguccacgcugaucaagcaccagcgcacccacaccggcgagaagcccuucgugugcgacaagugcccgaaggccuucaagagcuccuaccaccucauccggcacgagaagacccacauccgccaggcguucuacaaggggaucaagugcacgaccagcagccugaucuaccagcggauccacaccuccgagaagccccagugcagcgagcacggcaaggccuccgacgagaagcccagccccaccaagcacuggcgcacgcacaccaaggagaacaucuacgagugcuccaagugcggcaagagcuuccgggggaagucccaccugagcgugcaccagcgcauccacaccggcgagaagccguacgagugcuccaucugcgggaagaccuucagcggcaagucccaccucagcguccaccaccggacgcacaccggggagaagcccuacgagugccgccgcugcggcaaggccuucggcgagaaguccacccugaucgugcaccagcggaugcacaccggggagaagcccuacaagugcaacgagugcggcaaggccuucagcgagaaguccccgcugaucaagcaccagcgcauccacacgggggagcggcccuacgagugcaccgacugcaagaaggccuucagccgcaaguccacccucaucaagcaccagcggauccacaccggcgagaagcccuacaagugcagcgagugcgggaaggcguucuccgucaagagcacgcugaucgugcaccaccgcacccacaccggcgagaagcccuacgagugccgggacugcggcaaggccuucagcgggaaguccacccugaucaagcaccagcgcagccacacgggcgacaagaaccucuga

SEQ ID NO: 39106 - RNA, 1896 nt, Artificial Sequence
  derived and/or modified sequence opt1 from ZNF676__Homo_sapiens__XP_011526034
auguggagcgugcugugccucucccugcagcccgagggcgcccugaccuuccgcgacgucgccaucgaguucagccucgaggaguggcagugccuggacuccacccagcagaaccuguaccggaacgugaugcucgagaacuaccgcaaccugguguuccuggggaucgcggccuucaagccggaccucaucaucuuccuggagcagggcaaggagcccuggaacaugaagcggcacgagauggucgaggagccgcccgugaucugcagccacuucucccaggaguucuggcccgagcaggggaucgaggacagcuuccagaagaugauccugcgccgguacgacaagugcggccacgagaaccuccaccugaagaucuccugcacgaacguggacgagugcaacguccacaaggagggguacaacaagcugaaccagagccucaccaccacccaguccaagguguuccagugcggcaaguacgccaacguguuccacaagugcagcaacuccaaccgccacaagauccggcacacgggcgagaaggggcugaagugcaaggaguacguccgcagcuucugcaugcugucccaccucagccagcacgagcggaucuacacccgcgagaacuccuacaagugcgaggagaacggcaaggccuucaacuggagcuccacccugaccuacuacaagagcauccacacgggggagaagcccuacaagugcgaggagugcggcaaggccuucuccaaguucagcauccugaccaagcacaaggugauccacaccggggagaagcccuacaagugcgaggagugcggcaaggcguucaaccggagcuccauccucaccaagcacaagaucauccacacgggcgagaagcccuacaagugcgaggagugcgggaagggcuucagcuccgugagcacccugaacacccacaaggccauccacgccgaggagaagccguacaagugcgaggagugcgggaaggccuccaacagcuccagcaagcugauggagcacaagcgcauccacaccggcgagaagcccuacaagugcgaggagugcggcaaggcguucuccuggagcuccagccucacggagcacaagcggauccacgccggggagaagcccuacaagugcgaggagugcggcaaggccuucaaccgcuccagcauccugaccaagcacaagaucauccacaccggggagaagcccuacaagugcgagggcugcgggaaggccuucuccaaggucagcacccugaacacgcacaaggccauccacgcggaggagaagccguacaagugcgaggagugcggcaaggccuccaacagcuccagcaagcucauggagcacaagcggauccacaccggcgagaagcccuacaagugcgaggagugcgggaaggccuucagcugguccagcucccugaccgagcacaagcgcauccacgccggcgagaagcccuacaagugcgaggagugcgggaaggccuucaccuggagcuccagcuucacgaagcacaagcggauccacgcggccgagaagcccuacaagugcgaggagugcggcaagggguucuccaccuucagcauccugaccaagcacaagaucauccacaccggcgagaagcgcuacaagugcgaggagugcggcaaggccuucuccuggagcuccauccucacggagcacaagaucauccacaccggggagaagccguacaagugcgaggagugcggcaaggccuucagccgguccagcucccugacccgccacaagcggauccacaccggggagaagcccuacaagugcgaggagugcggcaaggccuucaagagcuccagcacggugagcuaccacaagaagauccacaccggggagaaccccuga

SEQ ID NO: 39107 - RNA, 1743 nt, Artificial Sequence
  derived and/or modified sequence opt1 from ZNF678__Homo_sapiens__NP_848644
augcccggccacccggagagccgcaagacccggcgcauccugaccaugcucccccggcuggugcugaacuccuucccccaggucauccuccugcccaacccgcccaaggugcugcgccuccaggggcugcuggccuucagcgacguggucaucgaguucucccccgaggagugggccugccucgaccccgcgcagcggaaccuguaccgcgacgugauguucgagaacuaccggaaccuggugagccucgccauccuguccuacagcauccaggaccugcucccggagcaggacaugaaggaccugugccagaaggucacgcugacccgccaccgguccuggggccucgacaaccugcaccuggugaaggacuggcgcaccgugaacgaggggaagggccagaaggaguacugcaaccggcucacccagugcagcuccaccaagagcaagaucuuccagugcaucgagugcgggcgcaacuucuccuggcggagcauccugacggagcacaagcgcauccacaccggcgagaagcccuacaagugcgaggagugcggcaaggucuucaaccggugcuccaaccugaccaagcacaagcgcauccacacgggggagaagcccuacaagugcgacgagugcggcaagguguucaacugguggagccagcucaccaaccacaagaagauccacaccggggagaagcccuacaagugcgacgagugcgacaagguguucaacugguggucccagcugaccagccacaagaagauccacuccggcgagaagccguaccccugcgaggagugcgggaaggccuucacgcaguucagcaaccugacccagcacaagcggauccacaccggcgagaagcccuacaagugcaaggagugcugcaaggccuucaacaaguucuccaaccucacccagcacaagcgcauccacacgggcgagaagcccuacaagugcgaggagugcgggaacgucuucaacgagugcagccaccugacccggcaccgccggauccacaccggcgagaagccguacaagugcgaggagugcgggaaggccuucacccaguucgcgagccugacgcgccacaagcgcauccacaccggcgagaagcccuaccagugcgaggagugcggcaagaccuucaaccggugcucccaccucagcucccacaagcgcauccacaccggggagaagcccuacaagugcgaggagugcggccggacguucacccaguucagcaaccugacccagcacaagcgcauccacaccggggagaagcccuacaagugcaaggagugcggcaaggccuucaacaaguucuccagccugacgcagcaccggcgcauccacaccggggugaagccguacaagugcgaggagugcggcaagguguucaagcagugcucccaccucaccagccacaagcggauccacaccggcgagaagcccuacaagugcaaggagugcgggaaggccuucuaccaguccagcauccuguccaagcacaagcgcauccacacggaggagaagcccuacaagugcgaggagugcggcaaggccuucaaccaguucagcucccugacccggcacaagcgcauccacaccggggagaagcgguacaagugcaaggagugcggcaagggguucuaccagagcuccauccacagcaaguacaagcgcaucuacaccggcgaggagcccgacaagugcaagaagugcggcucccucuga

SEQ ID NO: 39108 - RNA, 1623 nt, Artificial Sequence
  derived and/or modified sequence opt1 from ZNF683__Homo_sapiens__XP_011539498
augaucacccgcgugggcugggagguccggaucgaggggaacggcgacaugaaggaggagagcgccgcccagcuggggugcugccaccgccccauggcgcucggcgggaccggcggcucccugagcccgucccuggacuuccagcuguuccgcggggaccagguguucagcgccugccggccccugcccgacaugguggacgcccacggccccuccugcgccagcuggcugugcccgcucccccuggcccccgggcgguccgcgcugcucgccugccugcaggaccuggaccucaaccugugcacgccccagccggcgccccugggcaccgaccuccaggggcugcaggaggacgcccugagcaugaagcacgagccgcccggccuccaggccuccagcaccgacgacaagaaguucaccgucaaguacccccagaacaaggacaagcugggcaagcagcccgagcgcgccggggagggcgcccccugccccgccuucuccagccacaacuccagcuccccgccgccccugcagaaccggaagucccccagcccccucgccuucugccccugcccgcccgugaacagcaucuccaaggagcugcccuuccugcuccacgcguucuaccccggguacccccugcugcugcccccgccccaccuguucacguacggcgcccugcccagcgaccagugcccgcaccuccugaugcugccccaggaccccagcuaccccaccauggccaugccgucccuccugaugauggugaacgagcugggccaccccagcgcccgcugggagacccuccugcccuaccccggggccuuccaggcguccggccaggcccugccgagccaggcccggaaccccggggccggcgccgcgcccaccgacucccccgggcucgagcgcggcggcauggccagcccggccaagcgggucccccuguccagccagacggggaccgccgcccugcccuacccccucaagaagaagaacggcaagauccuguacgagugcaacaucugcgggaaguccuucggccagcugagcaaccucaaggugcaccuccgcgugcacuccggggagcggccguuccagugcgcgcugugccagaaguccuucacccagcucgcccaccuccagaagcaccaccugguccacaccggcgagcgcccccacaagugcagcauccccugggugcccggccggaaccacuggaaguccuuccaggccuggcgcgagcgggaggugugccacaagcgcuucagcagcuccagcaaccugaagacgcaccuccggcugcacuccggggcccgcccguuccagugcagcgucugccggagccgcuucacccagcacauccaccugaagcuccaccaccgccugcacgcgccccagcccugcggccuggugcacacccagcucccccuggccucccuggccugccucgcccaguggcaccagggggcccuggaccugauggcgguggccagcgagaagcacaugggcuacgacaucgacgaggucaagguguccagcaccucccaggggaaggcccgggccgugagccucuccagcgccggcacgccgcuggucaugggccaggaccagaacaacuga

SEQ ID NO: 39109 - RNA, 3714 nt, Artificial Sequence
  derived and/or modified sequence opt1 from ZNF687__Homo_sapiens__NP_001291693
augggcgacaugaagacccccgacuucgacgaccugcucgccgccuucgacauccccgacaucgacgcgaacgaggccauccacuccgggcccgaggagaacgagggccccgggggccccgggaagcccgagcccggcgugggcuccgagagcgaggacaccgccgccgccuccgcgggggacggccccgggguccccgcccaggccagcgaccacggccugcccccgcccgacaucuccguggugagcgucaucgugaagaacaccgugugccccgagcaguccgaggcccuggccggcgggagcgccggcgacggggcccaggccgccggcgucaccaaggaggggcccgugggcccccaccgcaugcagaacggcuucgggucccccgagcccagccuccccggcacgccccacucccccgcgccgcccagcgggggcaccuggaaggagaaggggauggagggcaagacgccccuggaccuguucgcccacuucggccccgagcccggggaccacuccgacccccugccgcccagcgcccccucccccacccgggagggcgcccugaccccgccgcccuuccccagcuccuucgagcuggcccaggagaacgggcccggcaugcagccgcccgugagcagcccgccccucggggcgcugaagcaggagagcugcagcccccaccacccccagguccuggcccagcagggcuccggcagcucccccaaggccaccgacauccccgccagcgccuccccgccgcccguggcgggggugcccuucuucaagcagagccccggccaccagagcccccucgccagccccaagguccccgugugccagccccugaaggaggaggacgacgacgaggggcccguggacaaguccagccccggcuccccgcagagccccuccagcggggccgaggccgccgacgaggacuccaacgacagccccgcguccagcuccagccgcccccugaagguccggaucaagacgaucaagaccagcugcggcaacaucacccgcaccgugacccaggugcccuccgacccggacccgcccgcgccccuggccgagggcgccuuccuggcggaggccagccugcucaagcuguccccggccacccccaccagcgaggggcccaaggucguguccgugcagcugggcgacgggacccggcucaagggcacgguccugcccguggccaccauccagaacgccagcaccgcgaugcugauggccgccuccguggcccgcaaggccgucgugcucccgggcgggaccgcgacgagccccaagaugaucgccaagaacguccugggccuggugccccaggcccuccccaaggccgacgggcgggccggccuggggaccggcggccagaaggugaacggggcguccgucgugauggugcagccgagcaagaccgccaccggccccuccaccgggggcgggaccgucaucagccgcacccaguccagccugguggaggccuucaacaagauccucaacuccaagaaccugcugcccgccuaccggcccaaccucagcccgcccgcggaggccggccuggcccugccgcccaccggcuaccgcugccucgagugcggggacgccuucucccuggagaagucccuggcccggcacuacgaccgccggagcaugcgcaucgaggugacgugcaaccacugcgcgcggcgccucgucuucuucaacaagugcucccugcugcuccacgcccgggagcacaaggacaagggccuggugaugcagugcagccaccuggugaugcgccccgucgcccucgaccagaugguggggcagcccgacaucacgccccuccugcccguggccgucccgcccguguccggcccccucgcccugcccgcgcuggggaagggcgagggcgccaucaccagcuccgccaucaccaccguggccgccgaggcgccgguccugccccucagcaccgagcccccggccgcccccgccaccuccgcguacacgugcuuccggugccuggagugcaaggagcagugccgcgacaaggccgggauggccgcccacuuccagcagcuggggccgcccgccccgggggcgacgagcaacgugugcccgaccugccccaugaugcuccccaaccggugcuccuucagcgcccaccagcgcaugcacaagaaccgcccgccccacgugugccccgagugcggcgggaacuuccugcaggccaacuuccagacccaccuccgggaggccugccugcacgucucccgccgggugggcuaccgcugccccagcugcuccguggucuucggcggggugaacagcaucaagucccacauccagaccagccacugcgagguguuccacaagugcccgaucugccccauggccuucaaguccggccccagcgcgcacgcccaccuguacucccagcaccccagcuuccagacccagcaggccaagcugaucuacaagugcgccaugugcgacacggucuucacccacaagccgcuccugagcucccacuucgaccagcaccuccucccccagcgggugagcguguucaagugccccuccugcccccugcuguucgcccagaagcgcaccaugcucgagcaccugaagaacacccaccagagcgggcggcuggaggagacggcgggcaagggcgccgggggcgcccuccugaccccgaagaccgagcccgaggagcuggccgucucccagggcggcgccgcgcccgccaccgaggagagcuccagcuccagcgaggaggaggaggugcccuccagcccggagccgccccgccccgccaagcggccgcgccgggagcucggguccaagggccugaagggcgggggcgggggccccgggggcuggacgugcggccugugccacagcugguuccccgagcgcgacgaguacguggcccacaugaagaaggagcacgggaaguccgucaagaaguucccgugccggcucugcgagcgcagcuucugcuccgcgcccagccugcggcgccacgugcgggugaaccacgagggcaucaagcgcgucuaccccugccgguacugcaccgaggggaagcgcaccuucuccagccgccugauccucgagaagcacguccaggugcggcacggccugcagcugggggcccagagccccggccgcggcaccacgcucgcccggggguccagcgcccgcgcccagggcccggggcggaagcgccggcaguccagcgacuccugcagcgaggagcccgacuccaccacgccgcccgcgaaguccccgcgcggcggccccggguccggcgggcacggcccccugcgguaccgcagcuccagcuccaccgagcagagccugaugauggggcuccggguggaggacggcgcccagcagugccuggacugcggccugugcuucgccucccccgggagccucucccgccaccgguucaucagccacaagaagcgccggggcguggggaaggccuccgcccugggccugggggacggcgaggaggaggcgccgcccagccgcagcgaccccgacggcggggacagcccccucccggccagcggcgggccccugacgugcaaggugugcggcaaguccugcgacagcccccugaaccucaagacccacuuccggacccacgggauggccuucauccgcgcccggcagggcgccgucggcgacaacuga

SEQ ID NO: 39110 - RNA, 1503 nt, Artificial Sequence
  derived and/or modified sequence opt1 from ZNF689__Homo_sapiens__NP_612456
auggcgcccccgagcgcgccccugcccgcccagggccccgggaaggcccgcccgucccggaagcgcggccggcgcccccgggcccucaaguucguggacgucgccguguacuucagccccgaggagugggggugccugcgccccgcccagcgggcccuguaccgcgacgugaugcgggagaccuacggccaccucggggcccugggcugcgccggcccgaagcccgcccugaucuccuggcucgagcgcaacaccgacgacugggagcccgcggcccuggacccccaggaguacccgcgggggcugacgguccagcgcaagagccggacccgcaagaagaacggcgagaaggagguguucccgcccaaggaggcgccccggaaggggaagcgcggccggcgccccuccaagccccggcucaucccccgccagaccagcgggggccccaucugcccggacugcggcugcaccuuccccgaccaccaggcccuggagucccacaagugcgcccagaaccugaagaagcccuaccccugcccggacugcgggcggcgcuucagcuaccccucccuccuggugagccaccgccgggcccacuccggcgagugccccuacgucugcgaccagugcgggaagcgcuucagccagcggaagaaccugucccagcaccaggugauccacacgggcgagaagcccuaccacugcccggacugcggccgcugcuuccggcgcagccggucccucgccaaccaccgcaccacccacaccggggagaagccccaccagugccccagcugcggccggcgcuucgccuacccgucccugcuggccauccaccagcggacgcacaccggggagaagcccuacacgugccucgagugcaaccgccgguuccgccagcggaccgcccuggugauccaccagcgcauccacaccggcgagaagcccuaccccugcccggacugcgagcggcgcuucagcuccagcagccggcuggucucccaccgccgcgugcacagcggggagcggcccuacgcgugcgagcacugcgaggcccgcuucucccagcggagcacccuccugcagcaccagcugcuccacaccggcgagaagcccuaccccugcccggacugcggccgcgccuuccggcgcuccgggagccuggccauccaccgguccacccacacggaggagaagcugcacgccugcgacgacugcggccgccgguucgcguaccccagccuccuggccucccaccgccgggugcacagcggggagcgccccuacgccugcgaccugugcuccaagcgguucgcccaguggagccaccucgcccagcaccagcugcugcacaccggcgagaagcccuucccgugccucgagugcgggcgcugcuuccggcagcgcuggucccuggcgguccacaagugcagccccaaggcccccaacugcagcccccgguccgccaucggcggcuccagccagcgcgggaacgcccacuga

SEQ ID NO: 39111 - RNA, 1773 nt, Artificial Sequence
  derived and/or modified sequence opt1 from ZNF703__Homo_sapiens__NP_079345
augagcgacucccccgccggcagcaacccgcgcacccccgaguccagcggguccggcagcgggggcgggggcaagcggcccgccgugcccgcggccgucucccugcucccgcccgccgacccccugcgccaggccaaccggcugcccauccgcgugcucaagaugcugagcgcccacaccggccaccuccuccacccggaguaccugcagccccuguccagcacgcccgugucccccaucgagcucgacgcgaagaaguccccgcuggcccugcucgcccagaccugcucccagaucgggaagcccgacccgcccccgagcuccaagcugaacagcgucgccgcggccgccaacggccugggggccgagaaggaccccggccgguccgcccccggggcggccagcgccgccgccgcgcucaagcagcugggcgacucccccgccgaggacaagagcagcuucaagccguacuccaagggcagcgggggcggggacucccgcaaggacagcggcuccagcuccgugagcuccaccagcuccagcuccagcuccagccccggcgacaaggccggguuccgggugcccuccgccgccugcccgcccuucccgccccacggcgcgcccgucagcgccagcagcagcuccagcucccccgggggcagccgcgggggcagcccccaccacuccgacugcaagaacggcgggggcgucgggggcggggagcuggacaagaaggaccaggagcccaagcccucccccgagcccgccgccgugagccggggcggcgggggcgagcccggggcccacggcggggcggaguccggcgccagcggccgcaaguccgagccgcccagcgcccuggugggggccggccacguggcgcccgugucccccuacaagccggggcacagcgucuucccccugccgcccuccagcaucggcuaccacggcuccaucgugggggccuacgccggcuaccccagccaguucgugcccgggcuggaccccagcaaguccggccucgucgggggccagcugagcggcgggcugggccugcccccggggaagccgcccuccagcuccccgcucaccggcgccagcccgcccuccuuccugcaggggcucugccgggaccccuacugccugggcggcuaccacggggccagccaccugggcggguccagcugcuccacgugcagcgcgcacgaccccgccggccccucccucaaggccgggggcuacccccugguguaccccggccacccccugcagcccgccgcccucagcuccagcgcggcccaggccgcccugcccgggcacccccuguacaccuacggcuucaugcuccagaacgagccgcugccccacuccugcaacuggguggccgcgagcgggcccugcgacaagcgcuucgccaccuccgaggagcugcucagccaccuccggacccacacggcccugcccggcgccgagaagcugcuggcggccuacccgggggccagcggccugggcuccgccgccgcggccgccgccgccgcggccagcugccaccuccaccucccgccgcccgccgcccccgggucccccggcagccugucccugcgcaacccccacacccuggggcugagccgguaccaccccuacggcaagucccaccugagcaccgccggcgggcucgcgguccccucccugcccaccgccggccccuacuacagccccuacgcccuguacgggcagcgccucgccuccgcgagcgcccugggcuaccaguga

SEQ ID NO: 39112 - RNA, 1239 nt, Artificial Sequence
  derived and/or modified sequence opt1 from ZNF704__Homo_sapiens__NP_001028895
augaccuucaccuuccagagcgaggaccugaagcgcgacugcggcaagaagaugucccaccagcacguguucagccucgccauggaggaggacgucaagacggccgacaccaagaaggcgucccggauccuggaccacgagaaggagaacacccgcagcaucugccugcucgagcagaagcggaaggugguguccagcaacaucgacgugcccccggcccgcaaguccagcgaggagcuggacauggacaaggucaccgccgccauggugcugacgucccucagcaccagcccccugguccggagcccgcccgugcgccccaacgagucccugagcggguccuggaaggagggcgggugcgugcccagcuccaccagcuccagcggcuacuggagcugguccgcccccagcgaccaguccaaccccagcaccccguccccgccccucagcgcggacuccuucaagcccuuccggagccccgcccagcccgacgacgggaucgacgaggccgaggccuccaaccugcuguucgacgagcccaucccccgcaagcggaagaacagcaugaaggucauguucaagugccucuggaagaacugcggcaaggugcuguccacggcggccggcauccagaagcacauccgcaccauccaccuggggcgggugggcgacagcgacuacuccgacggggaggaggacuucuacuacaccgagaucaagcucaacaccgacagcgucgccgacggccuguccagccuggccccggugucccccagccagucccucgccagcccgcccacguuccccauccccgacagcucccgcaccgagacccccugcgcgaagaccgagacgaagcugaugacgccccugagccgguccgccccgaccacccucuaccuggugcacaccgaccacgccuaccaggccaccccgcccgucaccauccccgggagcgccaaguucacccccaacggcuccagcuucuccaucagcuggcaguccccgcccgugacguucaccggcauccccgugagccccacccaccaccccgucgggaccggcgagcagcgccagcacgcgcacacggugcuguccuccccgccccgggggaccgugucccuccgcaagccccggggcgagggcaagaagugccgcaaggucuacgggauggagaaccgggacauguggugcaccgccugccgcuggaagaaggccugccagcgguuccuggacuga

SEQ ID NO: 39113 - RNA, 231 nt, Artificial Sequence
  derived and/or modified sequence opt1 from ZNF706__Homo_sapiens__NP_001254638
auggcccgcggccagcagaagauccagagccagcagaagaacgccaagaagcaggcggggcagaagaagaagcagggccacgaccagaaggccgccgccaaggccgcgcugaucuacacgugcaccgugugccggacccagaugcccgaccccaagaccuucaagcagcacuucgaguccaagcaccccaagaccccgcucccgcccgagcuggccgacguccaggccuga

SEQ ID NO: 39114 - RNA, 2286 nt, Artificial Sequence
  derived and/or modified sequence opt1 from ZNF711__Homo_sapiens__NP_068838
auggacagcggcgggggcucccuggggcuccacacccccgacagccgcauggcccacaccaugaucaugcaggacuucguggccggcauggcggggacggcccacaucgacggcgaccacaucgucguguccgugccggaggccguccuggugagcgacguggucaccgacgacggcaucacccuggaccacgggcucgccgccgagguggugcacggccccgacaucaucaccgagacggacgucgugaccgagggggugaucguccccgaggcggugcuggaggccgacguggccaucgaggaggaccuggaggaggacgacggcgaccacauccucaccuccgagcugaucaccgagacgguccgggugcccgagcaggucuucguggccgaccuggugaccgggccgaacggccaccucgagcacgugguccaggacugcgugagcggcguggacucccccaccauggucagcgaggaggugcuggucaccaacuccgacacggagaccgugauccaggcggccgggggcgugcccgggagcaccgucaccaucaagacggaggacgacgacgacgacgacgugaaguccaccagcgaggacuaccugaugaucucccucgacgacgugggcgagaagcuggagcacaugggcaacacgccccugaagaucgggagcgacggcucccaggaggacgccaaggaggacggguucggcagcgaggucaucaagguguacaucuucaaggccgaggccgaggacgacguggagaucgggggcaccgagaucgucaccgaguccgaguacaccagcggccacuccguggcgggggugcucgaccagagccgcaugcagcgggagaagauggucuacauggccgugaaggacagcucccaggaggaggacgacauccgcgacgagcggcgcgugagccggcgcuacgaggacugccaggccuccggcaacacccuggacagcgcccuggagucccggagcuccaccgccgcgcaguaccuccagaucugcgacgggaucaacacgaacaagguccugaagcagaaggccaagaagcgccggcgcggcgagacccggcaguggcagaccgccgugaucaucgggccggacggccagccccugaccguguaccccugccacaucugcacgaagaaguucaagagccgcggcuuccucaagcggcacaugaagaaccaccccgaccaccugaugcgcaagaaguaccagugcaccgacugcgacuucaccaccaacaagaaggucuccuuccacaaccaccuggagagccacaagcucaucaacaagguggacaagacgcacgaguucaccgaguacacccggcgcuaccgggaggccuccccgcugagcuccaacaagcugauccuccgcgacaaggagcccaagaugcacaagugcaaguacugcgacuacgagaccgccgagcaggggcugcugaaccggcaccuccuggcggugcacagcaagaacuucccccacgucugcguggagugcggcaagggguuccgccaccccuccgagcugaagaagcacaugcgcacgcacaccggcgagaagccguaccagugccaguacugcaucuuccggugcgccgaccagagcaaccucaagacccacaucaaguccaagcacgggaacaaccugcccuacaagugcgagcacugcccccaggccuucggcgacgagcgcgagcugcagcggcaccucgaccuguuccagggccacaagacccaccagugcccccacugcgaccacaagagcaccaacuccagcgaccugaagcgccacaucaucagcgugcacacgaaggacuucccgcacaagugcgaggucugcgacaagggguuccaccggcccuccgagcucaagaagcacagcgacauccacaagggccgcaagauccaccagugccggcacugcgacuucaagaccuccgaccccuucauccugagcgggcacauccuguccgugcacaccaaggaccagccccucaagugcaagcgcugcaagcggggcuuccgccagcagaacgagcugaagaagcacaugaagacccacacgggccggaagaucuaccagugcgaguacugcgaguacagcaccaccgacgccuccggguucaagcgccacgugaucagcauccacaccaaggacuacccgcaccggugcgaguucugcaagaagggcuuccgccggcccuccgagaagaaccagcacaucaugcgccaccacaaggaggcccugauguga

SEQ ID NO: 39115 - RNA, 1488 nt, Artificial Sequence
  derived and/or modified sequence opt1 from ZNF716__Homo_sapiens__NP_001152751
auggccaagcgccccggcccgcccgggagccgggagaugggccugcucaccuuccgcgacaucgccaucgaguucucccuggcggaguggcagugccuggaccacgcccagcagaaccucuaccgggacgugaugcuggagaacuaccgcaaccuggucagccucgggaucgccguguccaagcccgaccugaucacgugccuggagcagaacaaggagccccagaacaucaagcggaacgagaugguggccaagcacccggugaccugcagccacuucacccaggaccuccaguccgagcagggcaucaaggacagccugcagaaggucauccugcgccgguacgggaagugcggccaggaggaccuccaggugaagaagugcugcaaguccgucggcgagugcgaggugcacaagggcggguacaacuacgugaaccagugccugagcgccacccagaacaagaccuuccagacgcacaagugcgucaagguguucgggaaguucuccaacagcaaccgccacaagacccggcacaccggcaagaagcacuucaagugcaagaacgacgggaaguccuucugcaugcugagccgccucaaccagcaccagaucauccacacccgggagaaguccuacaagugcgaggagugcggcaagagcuucaacugcuccagcacgcugacccgccacaagcggauccacaccggcgagaagcccuaccgcugcgaggagugcgggaaggcguucuccuggagcgccucccugaccaagcacaagcggauccacacgggcgagaagcccuacacgugcgaggagcgcgggaagguguucagccggagcacccucaccaacuacaagcgcauccacaccggcgagaagcccuacacgugcgaggagugcggcaaggccuucucccggagcuccacccugaccaaccacaagcgcauccacaccggggagcggccguacaagugcgaggagugcggcaaggccuucagccuguccagcacccucaagaagcacaagaucguccacaccggggagaagcuguacacgugcgaggagugcggcaaggcguucaccuucuccagcacccugaacacccacaagcgcauccacaccggggagaagcccuacacgugcgaggagugcggcaaggccuucucccuccccagcaccuucaccuaccacaagcgcacccacacgggcgagaagcccuacaagugcgaggagugcgggaaggccuucaacugcuccagcacccugaagaagcacaagaucauccacaccggcgagaagcuguacaagugcaaggagugcgggaaggccuucaccuucuccagcacgcucaacacccacaagcggauccacaccggcgagaagccguacaagugcgaggagugcgaccagaccuucaaguggcacuccagccuggccaaccacaagaacaugcacaccggggagaagcccuacaaguacgaguga

SEQ ID NO: 39116 - RNA, 2745 nt, Artificial Sequence
  derived and/or modified sequence opt1 from ZNF717__Homo_sapiens__NP_001277137
auguuccccguguucagcggcugcuuccaggagcugcaggagaagaacaagucccucgagcuggucagcuucgaggagguggccgugcacuucaccugggaggaguggcaggaccuggacgacgcccagcgcacccucuaccgggacgucaugcuggagacguacuccagccuggugucccucgggcacuacaucaccaagccggagaugaucuucaagcuggagcagggcgcggagcccuggaucguggaggagacccccaaccugcgccucagcgccguccagaucaucgacgaccugaucgagcggucccacgagagccacgaccgcuucuucuggcagaucgugaucaccaacuccaacacgagcacccaggagcggguggagcuggggaagaccuucaaccucaacuccaaccacguccugaaccugaucaucaacaacggcaacagcuccgggaugaagcccggccaguucaacgacugccagaacaugcuguucccgaucaagcccggcgagacccagagcggggagaagccccacgugugcgacaucacgcgccggucccaccgccaccacgagcaccucacccagcaccacaagauccagacccugcuccagaccuuccagugcaacgagcagggcaagacguucaacaccgaggccauguucuucauccacaagcgggugcacaucguccagaccuucgggaaguacaacgaguacgagaaggccugcaacaacagcgccgugaucgugcaggucaucacccaggugggccagcccacgugcugccgcaaguccgacuucaccaagcaccagcagacccacaccggggagaagccguacgagugcguggagugcgagaagcccagcaucuccaagagcgaccugaugcugcagugcaagaugcccacggaggagaagcccuacgcgugcaacuggugcgagaagcuguucagcuacaaguccagccucaucauccaccagcggauccacaccggcgagaagccguacggcugcaacgagugcgggaagaccuuccgccggaaguccuuccugacccuccacgagcgcacgcacaccggcgacaagcccuacaagugcaucgagugcgggaagaccuuccacugcaagagccugcugacccuccaccaccggacgcacuccggcgagaagcccuaccagugcagcgagugcggcaagaccuucucccagaaguccuaccugaccauccaccaccgcacccacacgggggagaagcccuacgccugcgaccacugcgaggaggccuucagccacaagagccggcugaccguccaccagcgcacccacaccggcgagaagccguacgagugcaacgagugcgggaagcccuucaucaacaaguccaaccuccggcugcaccagcgcacgcacaccggcgagaagcccuacgagugcaacgagugcgggaagaccuuccaccgcaagagcuuccugaccauccaccaguggacccacacgggcgagaagcccuacgagugcaacgagugcggcaagaccuuccggugcaaguccuuccucaccgugcaccagcgcacccacgccggggagaagccguacgcgugcaacgagugcggcaagacguacagccacaaguccuaccugaccgugcaccaccggacccacaccggggagaagcccuacgagugcaacgagugcggcaagagcuuccacugcaaguccuuccugacgauccaccagcgcacccacgccgggaagaagcccuacgagugcaacgagugcgagaagaccuucaucaacaagcucaaccugggcauccacaagcggacccacacgggcgagcgccccuacgagugcaacgagugcgggaagaccuuccggcagaaguccaaccugagcacccaccagggcacccacacgggggagaagccguacgucugcaacgagugcggcaagaccuuccaccgcaagagcuuccucaccauccaccagcggacccacacggggaagaaccgcauggacgugaugaacguggagaagcuguucguccggaaccacacccugcucuacauccgcgagcugacccccggcaagagccccaugaacgugaugaacgucgagaaccccuucauccggcgccagaucuuccgguccaucaagguguucacccgcggccggaacccgaugaacguggccaacgucgagaagcccugccagaaguccgugcugacggugcaccaccgcacccacaccggggagaagcccuacgagugcaacgagugcggcaagaccuucugccacaagagcaaccucagcacgcaccaggggacccacuccggcgagaagccguacgagugcgacgagugccggaagaccuucuacgacaagaccguccugacgauccaccagcgcacccacaccggcgagaagcccuucgagugcaaggagugccggaagaccuucagccagaaguccaagcuguucgugcaccaccgcacgcacaccggggagaagcccuuccgcugcaacgagugccggaagaccuucagccagaaguccggccucagcauccaccagcgcacccacaccggggagaagcccuacgagugcaaggagugcggcaagacguucugccagaagucccaccugagccggcaccagcagacccacaucggggagaaguccgacguggccgaggccggcuacgucuucccgcagaaccacagcuucuuccccuga

SEQ ID NO: 39117 - RNA, 1938 nt, Artificial Sequence
  derived and/or modified sequence opt1 from ZNF746__Homo_sapiens__NP_001156946
auggccgaggccguggcggcccccaucagcccguggaccauggccgccaccauccaggccauggagcgcaagaucgagucccaggcggcccggcugcucagccuggagggccgcacggggauggccgagaagaagcuggccgacugcgagaagaccgcggucgaguucggcaaccagcucgaggggaagugggccgugcugggcacccugcuccaggaguacgggcugcugcagcggcgccucgagaacguggagaaccugcugcggaaccgcaacuucuggauccuccggcugccgcccggcuccaagggcgagagccccaaggagugggggaagcuggaggacuggcagaaggagcucuacaagcacgucaugcgcggcaacuacgagacccuggugucccuggacuacgccaucagcaagcccgaggugcucucccagaucgagcaggggaaggagcccugcaacuggcggcgccccggccccaagaucccggacguccccguggaccccagccccggguccggcccgcccgugcccgcccccgaccugcugaugcagaucaagcaggagggcgagcuccagcugcaggagcagcaggcccugggggucgaggcgugggccgccggccagccggacaucggggaggagcccuggggccucagccagcuggacuccggcgccggggacaucagcacggacgccaccuccggcgugcacagcaacuucuccaccaccaucccgcccacgagcuggcagaccgaccugccgccccaccaccccuccagcgcgugcuccgacgggacccucaagcugaacaccgccgccagcacggaggccgacgugaagaucgucaucaagaccgaggugcaggaggaggagguggucgccacccccgugcaccccaccgaccuggaggcgcacggcacgcuguucgggcccggccaggccacccgguucuuccccagccccgcccaggagggcgccugggagucccaggggagcuccuucccgagccaggaccccgugcucggccugcgcgagcccgcccggccggagcgcgacaugggggagcucucccccgcggucgcccaggaggagaccccgcccggcgacuggcuguucgggggcgugcgguggggcuggaacuuccgcugcaagccgcccguggggcugaacccccggaccggccccgaggggcuccccuacagcucccccgacaacggcgaggccauccuggaccccagccaggcgccccgcccguucaacgagcccugcaaguaccccgggcggacgaagggcuucggccacaagcccgggcugaagaagcacccggccgccccgcccggcgggcgccccuucacgugcgcgaccugcggcaaguccuuccagcuccaggucagccuguccgcccaccagcggagcugcggcgcccccgacggguccggccccgggaccggcgggggcggcagcggguccggcgggggcgggggcggcagcgggggcggguccgcccgcgacggcagcgcccugcgcugcggggagugcggccggugcuucacccgccccgcccaccucauccggcaccgcaugcugcacaccggcgagcggcccuucccgugcaccgagugcgagaagcgcuucaccgagcgguccaagcugaucgaccacuaccgcacgcacaccggggugcggcccuucacgugcaccgugugcggcaagagcuucauccgcaaggaccaccuccggaagcaccagcgcaaccacgccgccggggcgaagacccccgcccggggccagccgcugcccaccccgcccgccccgcccgaccccuucaagagccccgccuccaaggggccccuggccagcaccgaccucgucaccgacuggacgugcggccuguccgugcugggccccaccgacgggggcgacauguga

SEQ ID NO: 39118 - RNA, 1935 nt, Artificial Sequence
  derived and/or modified sequence opt1 from ZNF74__Homo_sapiens__NP_001243453
auggagauccccgcccccgagcccgagaagaccgcccugagcucccaggaccccgcgcucagccugaaggagaaccuggaggacaucuccggcugggggcuccccgaggcccgcagcaaggaguccgugagcuucaaggacgucgccguggacuucacccaggaggaguggggccagcuggacuccccgcagcgggcccuguaccgcgacgugaugcucgagaacuaccagaaccugcuggcccucgggccgccccugcacaagcccgacgucaucagccaccuggagcggggcgaggagcccugguccaugcagcgcgaggugccccgggggcccugccccgagugggagcucaaggcggugccgagccagcagcagggcaucugcaaggaggagcccgcccaggagcccaucauggagcgcccccugggcggggcccaggccuggggccggcaggcgggggcccugcagcgcucccaggccgccccgugggcccccgcgcccgccauggucugggacgugcccguggaggaguucccgcuccggugcccccuguucgcccagcagcgcguccccgagggcgggccccugcucgacacgcggaagaacgugcaggccaccgagggccgcaccaaggccccggcgcggcugugcgccggcgagaacgccagcacccccuccgagcccgagaaguucccccaggugcgccggcagcgcggggccggcgccggggagggcgaguucgucugcggcgagugcgggaaggcguuccggcagagcuccagccugacgcuccaccgccgguggcacucccgcgagaaggccuacaagugcgacgagugcggcaaggccuucaccuggagcaccaaccugcuggagcaccggcgcauccacaccggggagaagccguucuucugcggcgagugcgggaaggccuucuccugccacagcagccucaacgugcaccagcgcauccacacgggcgagcggcccuacaagugcuccgccugcgagaaggcguucagcugcuccagccugcuguccaugcaccuccgcgugcacaccggcgagaagcccuaccggugcggggagugcggcaaggccuucaaccagcgcacccaccugacccggcaccaccgcauccacacgggggagaagccguaccagugcggcagcugcgggaaggccuucacgugccacuccagccugaccguccacgagaagauccacuccggcgacaagcccuucaagugcagcgacugcgagaaggccuucaacucccggagccgccucacccugcaccagcggacccacaccggcgagaagcccuucaagugcgcggacugcgggaagggcuucuccugccacgccuaccugcucgugcaccgccggauccacagcggggagaagcccuucaagugcaacgagugcggcaaggccuucuccagccacgccuaccugaucgugcaccgccggauccacaccggggagaagccguucgacugcucccagugcuggaaggccuucagcugccacuccagccugaucguccaccagcgcauccacaccggcgagaagcccuacaagugcagcgagugcggccgggcguucucccagaaccacugccucaucaagcaccagaagauccacagcggggagaaguccuucaagugcgagaagugcggcgagauguucaacuggagcucccaccugacggagcaccagcgccugcacagcgaggggaagccccucgccauccaguucaacaagcaccuccuguccaccuacuacgugcccggcagccugcugggcgccggggacgccggccugcgggacguggacccgaucgacgcccucgacgucgcgaagcugcugugcguggugccgccccgcgccgggcggaacuucucccucggcagcaagccccgcaacuga

SEQ ID NO: 39119 - RNA, 2172 nt, Artificial Sequence
  derived and/or modified sequence opt1 from ZNF750__Homo_sapiens__NP_078978
augagccugcucaaggagcgcaagcccaagaagccgcacuacaucccccggccgcccggcaagcccuucaaguacaagugcuuccagugccccuucacgugcaacgagaagucccaccuguucaaccacaugaaguacgggcugugcaagaacagcaucacccucguguccgagcaggaccgcguccccaagugccccaagagcaacucccuggacccgaagcagaccaaccagcccgacgccaccgccaagcccgcgagcuccaagagcguggccaacggccuguccgccuucgacagcaagcuccagcacuccagcgcccgggaggacaucaaggagaaccuggagcugcaggcccgcgggacccaccggugccucggccagaagcccgcgcugcaccgcgccuccccgugcaagagccccgcccccgaggccgcgcugggggcccagcccgcccucgagggcgccgcccggccguccgcguucgugcccgucggcgagcaccgccugaaggggcccgacaacgccgaggcccccgagacccuggcccuccacaacccgacggccaaggcggugagcuuccacaccaaguccgccuuccacacccccggcuaccccuggaaggccgggagccccuuccugccgcccgaguucccccacaagaucuccagcaccaagggccugggggccaucagccccuacaugcacccgacgauccccgaguacccgccccacuucuacaccgagcacggccucgccaccaucuacucccccuaccugcuggcgggcagcucccccgagugcgacgcgccccuccugagcguguacgggacccaggacccgcggcacuuccugccccaccccggccccaucccgaagcaccucgcccccucccccgccacguacgaccacuaccgcuucuuccagcaguaccccagcaaccugccgauccccuacggguucuaccggcccgaguccgccuucagcuccuacggccugcgccugcccccggucaccggccugacccgggaccagagcucccaccuccucgaggaggccacccugguguaccccgccagcucccccagccgccugaaccccuccgacccgaaccggaagcacguggaguucgagagccccauccccgaggccaaggacuccagcaaggccgggcagcgcgacacggagggcuccaagaugagcccccgggcggggagcgccgccaccggcuccccggggcgccccagccccaccgacuucaugcagaccucccagacgugcgagggccucuacgaccugagcaacaaggccgccuccagcgcgcugggccggcucuacccgcccgagcagucccugaccgccuuccgccccgucaagaaguccaccgagugccugcccgcccaggccgccgagaccacggcggagagcccggugagccucaacguggucaacggggacccgcccgcccccaccggcuccgccagccugguguccgaggccgcccccagcucccccgacgacagcuccgggaugggcccccugaaccucagcaagaaguccgagaucaaccuggcggccacccacgagcccaccuaccaggggagcccgcaggccgagacggccagcuucuccgagcugcaggaccucccccugaaccugagcgugaaggaccccugcaacacccaggcgccccggccggccuuccccggccgcccccgcgccgccgagcccgccgcggccgucccgcagaagaccggcaccgagggguccgaggacggccccagccaccccgagacgaagcccgggucccucgacggcgacggggccccgcccaccggccccggcgaggaggcccccgacgccugcgcgguggacagcuccgaggagcagaagcagaccgccgccguggcccugugccagcuggccgcguacagcccgcggaacauccgcgucggggacggcgacgccgccgcccccgagcccgcgugccggcaggacaccccgacgcuguccagcauggagucccaggaggcccagugcgaccuccgccccaaggggcagaagcggaccagccugcgcgacgccggcaagucccagcagggcgccaagaaggccaagcugcaggacaccgcgcggguguucacccuccgccggcgcgcccgggugagcuga

SEQ ID NO: 39120 - RNA, 1194 nt, Artificial Sequence
  derived and/or modified sequence opt1 from ZNF763__Homo_sapiens__NP_001012771
augauguuccaggaccccguggccugcgaggacgucgccgugaacuucacccaggaggagugggcgcugcucgacaucagccagcgcaagcuguaccgggaggugaugcuggagaccuuccgcaaccucacguccaucggcaagaaguggaaggaccagaacaucgaguacgaguaccagaacccgcggcgcaacuuccggagccugaucgaggggaacgucaacgagaucaaggaggacucccacugcggcgagaccuucacccaggugcccgacgaccgccugaacuuccaggagaagaaggccagccccgaggccaaguccugcgacaacuucgugugcggggaggucggcaucgggaacagcuccuucaacaugaacauccggggcgacaucggccacaaggccuacgaguaccaggacuacgcccccaagccguacaagugccagcagcccaagaaggcguuccgcuaccaccccagcuuccggacccaggagcgcaaccacacgggggagaagcccuacgccugcaaggagugcggcaagaccuucaucucccacagcgggauccggcgccggauggugaugcacuccggcgacgggccguacaagugcaaguucugcggcaaggccgugcacugccuccgccuguaccugauccacgagcggacccacaccggcgagaagcccuacgagugcaagcagugcgucaagagcuucuccuacagcgccacgcaccgcauccacgagcggacccacaccggggagaagcccuacgagugccagcagugcggcaaggcguuccacuccagcuccagcuuccaggcccacaagcgcacccacaccgggggcaagcccuacgagugcaagcagugcggcaaguccuucagcuggugccacagcuuccagauccacgagcggacgcacaccggggagaagccgugcgagugcuccaagugcaacaaggccuuccgcagcuaccgguccuaccuccgccacaagcgcagccacaccggcgagaagcccuaccagugcaaggagugccggaaggccuucacguaccccuccagccugcgccggcacgagcgcacccacuccgccaagaagcccuacgagugcaagcagugcgggaaggcgcugagcuacaaguucuccaacaccccgaagaacgcccucuggcggaagacccuguga

SEQ ID NO: 39121 - RNA, 1224 nt, Artificial Sequence
  derived and/or modified sequence opt1 from ZNF764__Homo_sapiens__NP_001166150
auggcgcccccgcuggcgccccucccgccccgcgaccccaacggcgccgggcccgaguggcgggagcccggcgccgugagcuucgccgacgucgccguguacuucugccgcgaggagugggggugccugcggcccgcccagcgcgcccuguaccgggacgugaugcgcgagaccuacggccaccucuccgcccuggggaucggcggcaacaagccggcccugaucagcugggucgaggaggaggccgagcucugggggcccgcggcccaggaccccgagguggccaagugccagacccagacggaccccgacucccggaacaagaagaaggagcgccagcgggagggcaccggggcccuggagaagccggaccccguggccgcgggcagccccgggcugaaguccccgcaggcccccagcgccggcccgcccuacggcugggagcagcucuccaaggcgccccaccgcgggcggcccagccugugcgcccacccgcccgucccccgcgccgaccagcggcacggcugcuacgugugcgggaaguccuucgccuggcgcagcacccugguggagcacgucuacucccacaccggcgagaagcccuuccacugcacggacugcggcaagggguucggccacgccagcucccucagcaagcaccgggccauccaccgcggggagcggccccaccgcugccuggagugcggccgggccuucacccagcgcuccgcgcugaccagccaccuccgggugcacaccggggagaagcccuacggcugcgccgacugcggccgccgcuucucccagagcuccgcccuguaccagcaccggcgcgugcacagcggggagacgcccuucccgugccccgacugcggccgggccuucgccuaccccagcgaccugcgccggcacguccgcacccacaccggggagaagccguaccccugccccgacugcggccggugcuuccgccaguccagcgagauggcggcccaccggcgcacccacuccggggagaagcccuacccgugcccccagugcggccggcgcuucggccagaaguccgccguggccaagcaccagugggugcaccggcccggggcgggcgggcaccgcggccgggucgccgggcgccucagcgugacgcugacccccggccacggcgaccuggacccgcccgugggguuccagcucuaccccgagaucuuccaggagugcggcuga

SEQ ID NO: 39122 - RNA, 1572 nt, Artificial Sequence
  derived and/or modified sequence opt1 from ZNF765__Homo_sapiens__XP_006723529
auggcccugccccagggccuccugaccuuccgcgacguggccaucgaguucagccaggaggaguggaagugccuggacccggcgcagcggacccucuaccgcgacgucaugcuggagaacuaccggaaccuggugucccucgacaucagcuccaagugcaugaugaaggaguucagcuccacggcccaggggaaccgcgagguguuccacgccggcaccagccagcggcacgagucccaccacaacggggacuucugcuuccaggacaucgacaaggacauccacgacaucgaguuccaguggcaggaggacgagcgcaacggccacgaggcccugaugaccaagaucaagaagcugaccgggagcacggagcgguacgaccagaacuacgccggcaacaagcccgucaaguaccagcucggcuucuccuuccacagccaccuccccgagcugcacaucuuccacaccgaggagaagaucgacaaccagguggugaaguccauccacgacgcgagccuggucuccaccgcccagcgcaucagcugccggcccgagacccacaucuccaacgacuacgggaacaacuuccugaacagcucccuguucacgcagaagcaggaggugcacaugcgcgagaaguccuuccagugcaacgacagcggcaaggccuacaacugcagcagccuccugcggaagcaccagcugauccaccucggggagaagcaguacaagugcgacaucugcggcaagguguucaacuccaagcgcuacgucgcccggcaccgccggugccacaccggggagaagccguacaagugcaacgagugcggcaagaccuucagccagaccuacuaccugacgugccaccgccggcugcacaccggcgagaagcccuacaagugcgaggagugcgacaaggcguuccacuucaaguccaagcuccagauccaccgccggauccacaccggggagaagcccuacaagugcaacgagugcggcaagaccuucagccagaaguccuaccugacgugccaccgccggcugcacaccggggagaagcccuacaagugcaacgagugcggcaagaccuucagccgcaagucccacuucacgugccaccaccgcgugcacaccggcgagaagccguacaagugcaacgagugcagcaagaccuucucccacaagagcucccucaccuaccaccggcgccugcacaccgaggagaagcccuacaagugcaacgagugcgggaagacguucaaccagcagcugacccucaacaucugccggcugcacagcggcgagaagcccuacaagugcgaggagugcgacaaggccuacuccuucaagagcaaccuggagauccaccagaagauccacaccgaggagaaccccuacaagugcaacgagugcgggaagaccuucucccgcacgagcucccucaccuaccaccaccggcugcacaccggccagaagccguacaagugcgaggacugcgacgaggccuucagcuucaaguccaaccuggagcgccaccggcgcaucuacaccggggagaagcuccacguguga

SEQ ID NO: 39123 - RNA, 1548 nt, Artificial Sequence
  derived and/or modified sequence opt1 from ZNF76__Homo_sapiens__NP_001278961
auggagagccugggccuccacaccgugacccuguccgacgggacgaccgccuacguccagcaggccgugaagggcgagaagcugcucgagggccaggugauccagcuggaggacgggaccaccgcguacauccaccaggucacggugcagaaggaggcccugagcuucgaggacgggcagcccgugcagcucgaggacggcuccauggccuacauccaccgcaccccgcgggagggcuacgaccccagcacccuggaggccguccagcuggaggacggguccaccgccuacauccaccaccccguggcggugcccagcgaguccacgauccucgccguccagaccgaggugggccuggaggaccuggccgccgaggacgacgagggguucagcgcggacgccguggucgcccucgagcaguacgccuccaaggugcugcacgacagccagaucccgcgcaacggcaaggggcagcaggucggcgaccgggccuuccgcugcggcuacaaggggugcggccggcuguacaccaccgcgcaccaccucaaggugcacgagcgcgcccacacgggggaccggcccuaccgcugcgacuuccccuccugcggcaaggccuucgccaccggcuacgggcucaagagccacgugcggacccacaccggcgagaagcccuacaagugccccgaggagcugugcuccaaggccuucaagacgagcggggaccugcagaagcacgugcgcacccacaccggcgagcggcccuuccagugccccuucgaggggugcggccgcuccuucaccacgagcaacauccggaagguccacgugcgcacccacaccggcgagcggcccuacacgugcccggagccccacugcgggcgcggcuucaccuccgcgaccaacuacaagaaccacgugcggauccacaccggggagaagcccuacgucugcaccgugcccggcugcgggaagcgcuucacggaguacagcucccuguacaagcaccacgugguccacacccacugcaagccguacacgugcagcacgugcggcaagaccuaccggcagaccagcacccuggccaugcacaagcgcuccgcccacggcgagcucgaggccaccgaggagagcgagcaggcccuguacgagcagcagcagcuggaggcggccuccgccgccgaggagagcccgccgcccaagcggccccgcaucgccuaccucuccgaggugaaggaggagcgcgacgacauccccgcgcaggucgccauggugaccgaggaggacggggcgccccagguggcccugaucacccaggacggcgcccagcaggucaccaucaucaccagcggggccgugguggccgaggacuccagcgucgccucccugcggcaccagcaggucgcccuccuggcgaccgccaacggcacgcacaucgccgugcagcuggaggagcagcagacccucgaggaggccaucaacguggccaccgcggccaugcagcagggggccgugacccuggagacgaccgugagcgaguccggcugcuga

SEQ ID NO: 39124 - RNA, 1452 nt, Artificial Sequence
  derived and/or modified sequence opt1 from ZNF774__Homo_sapiens__NP_001004309
auguggcugggcaccagcgggaaguccggccuccccgggcacugccuggagaacccgcugcaggagugccaccccgcccagcucgaggagugggcccugaagggcaucagccgccccuccgugaucagccagcccgagcagaaggaggagccguggguccugccccuccagaacuucgaggcgcggaagaucccccgcgagucccacaccgacugcgagcaccagguggccaagcugaaccaggacaacagcgagacggccgagcagugcgggaccuccagcgagcggaccaacaaggaccugucccacacccucagcuggggcggcaacugggagcaggggcuggagcuggagggccagcacgggacgcuccccggcgaggggcagcuggaguccuucagccaggagcgcgaccugaacaagcuccuggacggcuacgugggcgagaagccgaugugcgccgagugcgggaaguccuucaaccagagcuccuaccugauccggcaccuccgcacccacaccggcgagcggcccuacacgugcaucgagugcgggaagggcuucaagcagagcuccgaccuggucacccaccgccggacccacaccggcgagaagcccuaccagugcaaggggugcgagaagaaguucagcgacuccagcacccugaucaagcaccagcgcacgcacaccggcgagcggcccuacgagugcccggagugcgggaagaccuucggccgcaagccccaccucaucaugcaccagcggacccacacgggggagaagcccuacgccugccuggagugccacaagagcuucucccgcagcuccaacuucaucacccaccagcggacccacaccggcgugaagcccuaccgcugcaacgacugcggcgagagcuucucccagagcuccgaccugaucaagcaccagcggacgcacaccggggagcgcccguucaagugccccgagugcggcaagggguuccgggacagcucccacuucguggcgcacaugagcacccacuccggcgagcgccccuucagcugccccgacugccacaaguccuucagccaguccagccaccucgucacccaccagcggacgcacaccggggagcgcccguucaagugcgagaacugcggcaagggcuucgccgacuccagcgcccugaucaagcaccagcgcauccacaccggggagcggcccuacaagugcggcgagugcgggaaguccuucaaccagagcagccacuucaucacccaccagcgcauccaccugggcgaccggcccuaccgcugccccgagugcgggaagacguucaaccagcggucccacuuccucacccaccagcgcacccacaccggcgagaagccguuccacugcagcaagugcaacaaguccuuccggcagaaggcccaccuccugugccaccagaacacgcaccugaucuga

SEQ ID NO: 39125 - RNA, 1557 nt, Artificial Sequence
  derived and/or modified sequence opt1 from ZNF776__Homo_sapiens__NP_775903
auggccgccgcggcccugcggcccccggcccagggcaccgugaccuucgaggacgucgccgugaacuucagccaggaggaguggucccuccugagcgaggcccagcgcugccuguaccacgacgugaugcucgagaaccugacgcugaucuccagccucgggugcugguacggcgcgaaggacgagacccccuccaagcagacccugagcauccagcaggagagcccccugcgcacccacuggacgggggucugcaccaagaaggugcaccucuggggcaugugcgggccccugcugggcgacauccuccaccagggcacccagcacaaccagaagcugaacggguucggcgccuacgagaagaagcuggacgacgacgccaaccaccaccaggaccagaagcagcacaucggggagaaguccuaccgguccaacgccaagggcaccagcuucgugaagaacugcaaguuccacaugucccacgagccguucaucuuccacgaggucgggaaggacuuccucagcucccugcgccugcuccagcaggaggacauccacacgagcggcaaguccaacuucgagaccaagcacggcaucccccugcagggcgggaagacccacuacaucugcggggagagcaccauccccuucuccaacaagcacagccuggugcuccaccagcggcugcugccccgcgagggcccguacgugugcuccgacagcggcaaguucacgagcaaguccaacagcuucaacaaccaccaggggguccggaccggcaagcgccccuaccagugcgggcagugcgacgaguccuucugguacaaggcgcaccucaccgagcaccagcgggugcacaccggcgagcgccccuacgagugcggggagugcgacaagagcuucucccacaagcacagccugguggaccaccagcggguccacacgggcgagcgccccuacgagugcgacgagugcggcaaguccuucagccacaagcggucccuggugcaccaccagcgcgugcacaccggggagcggccguaccagugcggcgagugcggcaagagcuucaaccacaagugcaaccucauccagcaccagcgcguccacaccggggagcggcccuucgagugcaccgccugcgggaagcuguuccgcuccaacagccaccugaaggagcaccagcgggugcacacgggcgagcgccccuacgagugcaaggagugccggaaguccuuccgcuacaagagccaccucaccgagcaccagcgcgugcacaccggcgagcggcccuacgagugccgcgagugcgggaagugcuuccaccagaagggcucccugauccagcaccagcagauccacagcggggagcggccgcacgagugcggcgagugcgggaagugcuuccaccagaagggcucccugauccgccaccagcagauccacagcggcgagcggccccacgagugcggggagugcggcaagugcuuccgccagaaggggaaccucaucaagcaccagcggguccacaccggcgagcgccaccacgagugcuga

SEQ ID NO: 39126 - RNA, 2274 nt, Artificial Sequence
  derived and/or modified sequence opt1 from ZNF778__Homo_sapiens__NP_001188336
auggccgcccccgaccuggcgcacggcgggcacgugagccgcgacuccgugugccuccacgaggagcagacccaggccgccggcaugguggccggguggcugaucaacugcuaccaggacgccgugaccuucgacgacgucgcgguggacuucacgcaggaggaguggacccugcucgacccgagccagcgggaccuguaccgcgacgugaugcuggagaacuacgagaaccucgccuccgucggccaccaccuguuccagcccagcgugaucuacuggcuggagcaggaggaggagcuccgggccgggcgccgggccgugcugcaggaguggcgccugaagaccaagggccccgcgcuccggcaggaccgcuccugguuccgggccagcaacgagacccagacggcccgcucccacaacggcgggcagcugugcgaccggacccagugcggcgaggccuucagcgagcacuccgggcugagcacccacguccgcacccagaacacgggcgacuccugcgugagcaaccacuacgagcgggacuucuucauccccugccagaagacccucuucaagaucggggagcaguucuccgugcugggccagugcggcaaggccuucagcuccaccccgaacgucgugagccagcaggcgugcacccgcgaccggucccuggacuacagcuccugcggggagguguuccucaaccagagcuaccugcaggcccgcgccggcagccacaacggggaggagacguggaaguggaagcccugcggcaaggcccugacccacuccaugggcugcgccacccccgucgagaugcacgcggugcggaacccccacgugugccgcgagugcgggaaggccuuccgguacaccgccuaccucacgggccgcguccaggugcacccgggggagaagcccugcgagcuggaggagugcggcaaggccagccccguguccagcucccugacccagcacguccggauccacgccgcggagaagcccugcgagugcaaggagugcgggaaggccuucaccggccucagcggccuguccaagcacgugcagaccgacccggggcagaagcccuacgagugcaaggacugcggcaaggccugcgggggcuucuaccugcucaacgagcacgggaagacgcacacccgcgagaagcccuucgccugcguggucugcggcaaguacuuccgcaacagcuccugccugaacaaccacgugcggauccacaccggcaucaagcccuacacgugcagcuacugcgggaaggccuucaccguccgcugcggccugacccggcacgugcgcacccacaccggggagaagccguacacgugcaaggacugcggcaaggcguucugcaccuccagcgggcucaccgagcacgugcggacccacacgggcgagaagcccuacgagugcaaggacugcggcaaguccuucaccgucagcuccagccugaccgagcacgcccgcauccacaccggggagaagcccuacgagugcaagcagugcggcaaggccuucacggggcgguccggccugaccaagcacaugcgcacccacaccggcgagaagcccuacgagugcaaggacugcgggaaggccuacaaccggguguaccuccugaacgagcacgugaagacccacacggaggagaagccguucaucugcaccgucugccgcaagagcuuccggaacuccagcugccugaacaagcacauccagauccacaccggcaucaagcccuacgagugcaaggacugcgggaagaccuucacggugagcuccagccucaccgagcacauccgcacccacaccggcgagaagcccuacgagugcaaggugugcgggaaggcguucacgaccuccagccaccugaucguccacauccggacccacaccggcgagaagcccuacaucugcaaggagugcggcaaggccuucgccuccagcucccaccugaucgagcaccgccggacgcacaccggggagaagccguacaucugcaacgagugcggcaaggccuuccgcgccagcucccaccuccacaagcacgggcggauccacaccggccagaagcccuacaagugcaaggagugcgggaaggcguacaaccgcuucuaccugcugaaggagcaccucaagaccuacacggaggagcaggucuucgugugcaaggacugcggcaagagcuucaagaacuccagcugccugaaccaccacacccagauccacaccgacgagaagcccuucuga

SEQ ID NO: 39127 - RNA, 972 nt, Artificial Sequence
  derived and/or modified sequence opt1 from ZNF784__Homo_sapiens__NP_976308
auggccgccgcgcgccccgaggcccagagccgguccagcccgacccccgagucccgcagccaggagccccuggaccucgugcugguccccgacgacugccggccgggcaccccgcccuccgaccugaucgagauccagguggugaaggucacggacaccacccucgugcccgagccgcccgagcccgggagcuuccacugcgcccugugccccgccgccuuccgccugguguccgagcuccuguuccacgagcacggccaccuggcgggggccgagggcgggggccagggcggggacccgagccggugccacgucugcggccacuccugccccgggcccgccagccuccgggcccacuacucccugcacaccggcgagcggcccuaccgcugcgcgcugugcccccgggccuucaaggcccucgcgccccugcugcgccaccagcaccggcacgggguggagcccggcacgagccgccggcccccggacaccgccgccguggccgagcagcgccccggcgucgcccccgagcgggccgagguggugauggccgcggccgccgccggggccgcggucggcaagcccuucgccugccgcuucugcgccaagccguuccggcgcuccagcgacaugcgggaccacgagcgcgugcacaccggggagcggcccuaccacugcggcaucugcggcaagggguucacccaguccagcgugcucuccggccacgcccgcauccacacgggggagcgccccuuccggugcacccugugcgaccgcaccuucaacaacagcuccaacuuccggaagcaccagcgcacccacuuccacggccccgggccgggccugggcgacagcgggggccagcucgggagcuccgccgcggagggcagcggguccggcugcggcgucggggaccccgccgaggagggccgcggggagacggccaaggugaagguggaggccgaccaguga

SEQ ID NO: 39128 - RNA, 1425 nt, Artificial Sequence
  derived and/or modified sequence opt1 from ZNF79__Homo_sapiens__NP_001273625
auggccgccggccugcucaccgcggggccccgcggcagcaccuucuucuccagcgugacggucgccuucgcccaggagcgguggcgcugccugguguccaccccgcgggaccgcuucaaggaggggauccccggcaagagccggucccuggugcuccuggggcugcccgucagccagcccggcaugaacucccagcucgagcagcgcgagggcgccuggaugcuggagggggaggaccugcggagcccgucccccggcuggaagaucaucagcggguccccgcccgagcaggcccucagcgaggcguccuuccaggaccccugcguggagaugccgcccggcgacagcgaccacgggaccuccgaccuggagaaguccuucaaccugcgccccgugcucagcccccagcagcggguccccguggaggcccgcccccggaagugcgagacccacacggagagcuucaagaacuccgagauccugaagccccaccgcgccaagccguacgccugcaacgagugcggcaaggcguucagcuacugcagcucccugagccagcaccagaagucccacaccggcgagaagcccuacgagugcagcgagugcgggaaggccuucucccagagcuccagccucauccagcaccagcggauccacaccggcgagaagcccuacaagugcuccgagugcgggcgcgccuucagccagaacgccaaccugaccaagcaccagcggacgcacaccggcgagaagcccuaccgcugcuccgagugcgagaaggccuucagcgacugcuccgcgcuggugcagcaccagcggauccacaccggcgagaagccguacgagugcagcgacugcgggaaggccuuccgccacuccgccaaccucaccaaccaccagcggacgcacaccggcgagaagcccuacaagugcagcgagugcgggaaggccuucuccuacugcgccgcguucauccagcaccagcgcauccacaccggcgagaagcccuaccggugcgccgccugcgggaaggccuucagccaguccgccaaccugaccaaccaccagcgcacgcacaccggcgagaagcccuacaagugcagcgagugcggcaaggcguucagccaguccaccaaccugaucauccaccagaagacccacacgggggagaagccguacaagugcaacgagugcggcaaguucuucagcgaguccagcgcccucauccgccaccacaucauccacaccggggagaagcccuacgagugcaacgagugcggcaaggccuucaaccaguccagcucccugagccagcaccagcggauccacaccggggucaagcccuacgagugcuccgagugcggcaaggccuuccgcugcagcuccgccuucgugcggcaccagcgccugcacgcgggcgaguga

SEQ ID NO: 39129 - RNA, 447 nt, Artificial Sequence
  derived and/or modified sequence opt1 from ZNF7__Homo_sapiens__NP_001269725
auggagguggucaccuucggcgacguggccgugcacuucagccgcgaggaguggcagugccuggaccccgggcagcgggcccucuaccgcgaggucaugcuggagaaccacuccagcguggcgggccuggccggguuccucguguucaagccggagcugaucucccggcuggagcagggcgaggagcccuggguccucgaccugcagggggccgagggcaccgaggcgccccgcacgagcaagaccggcuuccuggggcggcccaccaugggccaggagccgcgccacccccacgccccgcccgccacccccgugcccgggcuccccaagcacugcucccagcggcugacgcugcccccgcccggccucagcuccagcccccuggggcacuuccuggugcacgaccaggaccgccggcgcggcaccuccgccaucuggauggucuga

SEQ ID NO: 39130 - RNA, 1995 nt, Artificial Sequence
  derived and/or modified sequence opt1 from ZNF800__Homo_sapiens__XP_005250238
augccccugcgcgacaaguacugccagaccgaccaccaccaccacggcugcugcgagccgguguacauccucgagcccggggacccgccccugcugcagcagccccuccagaccagcaaguccggcauccagcagaucaucgagugcuuccggagcgggacgaagcagcugaagcacauccugcucaaggacgucgacaccaucuucgagugcaagcugugccgcucccuguuccggggccuccccaaccugaucacccacaagaaguucuacugcccgcccagccugcagauggacgacaaccuccccgacgugaacgacaagcagucccaggccaucaacgaccugcuggaggccaucuaccccagcguggacaagcgcgaguacaucaucaagcucgagcccaucgagaccaaccagaacgcggucuuccaguacaucucccggacggacaaccccaucgaggugaccgagagcuccagcaccccggagcagaccgaggugcagauccaggagacguccaccgagcagagcaagaccguccccgugaccgacacggagguggagaccgucgagccgccgcccguggagaucgugaccgacgaggucgcccccaccuccgacgagcagccccaggagagccaggccgaccuggagacguccgacaacagcgacuucgggcaccagcugaucugcugccucugccgcaaggaguucaacucccggcgcggcgugcggcgccacauccggaaggugcacaagaagaagauggaggagcugaagaaguacaucgagacccgcaagaaccccaaccagagcuccaagggccggagcaagaacguccuggugccccucagccgcuccugccccgugugcugcaagagcuucgccaccaaggccaacguccggcgccacuucgacgaggugcaccgggggcugcgccgggacuccaucacccccgacaucgcgacgaagcccggccagccgcuguuccucgacagcaucucccccaagaaguccuucaagacccgcaagcagaaguccagcagcaaggccgaguacaaccugaccgccugcaagugccugcucugcaagcggaaguacagcucccagaucaugcugaagcgccacaugcagaucgugcacaagaucacccugagcgggacgaacuccaagcgcgagaagggccccaacaacaccgccaacagcuccgagaucaaggucaagguggagcccgcggacagcguggaguccagcccgcccuccaucacccacagcccccagaacgagcucaaggggaccaaccacagcaacgagaagaagaacacgccggccgcccagaagaacaaggucaagcaggacuccgagagccccaaguccaccagccccuccgccgccggcggccagcagaagacccggaagcccaagcugagcgcgggguucgacuucaagcagcuguacugcaagcucugcaagcgccaguucaccuccaagcagaaccugacgaagcacaucgagcugcacaccgacggcaacaacaucuacgugaaguucuacaagugcccgcucugcaccuacgagacccggcgcaagcgggacgucauccgccacaucacgguggugcacaagaaguccagccgguaccuggggaagaucaccgccagccuggagauccgcgccaucaagaagcccaucgacuucguccucaacaagguggccaagcggggccccucccgcgacgaggccaagcacagcgacuccaagcacgacggcaccagcaacucccccagcaagaaguacgagguggcggacgucgggaucgaggugaaggugaccaagaacuucucccugcaccggugcaacaagugcggcaaggccuucgccaagaagaccuaccuggagcaccacaagaagacgcacaaggccaacgccagcaacagcccggaggggaacaagaccaagggccgcuccacccggagcaaggcgcucgucuga

SEQ ID NO: 39131 - RNA, 3630 nt, Artificial Sequence
  derived and/or modified sequence opt1 from ZNF804A__Homo_sapiens__NP_919226
auggagugcuacuacaucgugaucagcuccacccaccugagcaacggccacuuccgcaacaucaagggggucuuccggggcccccucuccaagaacgggaacaagacccuggacuacgccgagaaggagaacacgaucgccaaggcccuggaggaccucaaggccaacuucuacugcgagcugugcgacaagcaguacuacaagcaccaggaguucgacaaccacaucaacagcuacgaccacgcccacaagcagcgccugaaggagcucaagcagcgggaguucgcccgcaacguggccuccaagagccggaaggacgagcgcaagcaggagaaggcgcugcagcggcugcacaagcucgccgagcugcgcaaggagaccgugugcgccccgggcuccgggcccauguucaagagcaccaccgucacggugcgggagaacugcaacgagaucucccagcgcguggucguggacagcgugaacaaccagcaggacuucaaguacacccugauccacuccgaggagaacaccaaggacgccaccacggucgcggaggaccccgagagcgccaacaacuacaccgccaagaacaaccaggugggcgaccaggcccagggcauccaccggcacaagaucggguucuccuucgccuuccccaagaaggcgagcgugaagcucgaguccagcgccgccgccuucuccgaguacagcgacgacgccuccgucggcaagggguucagccgcaagagccgguucgugccguccgcgugccaccuccagcagagcucccccaccgacgugcugcugagcuccgaggagaagaccaacagcuuccacccgcccgaggccaugugccgcgacaaggagacgguccagacccaggagaucaaggagguguccagcgagaaggacgcccugcugcuccccuccuucugcaaguuccagcugcagcugagcuccgacgccgacaacugccagaacagcgugccccucgccgaccagaucccccuggaguccgucgugaucaacgaggacauccccgugagcggcaacuccuucgagcugcucgggaacaagagcaccguccuggacauguccaacgacugcaucagcgugcaggcgaccacggaggagaacgugaagcacaacgaggccuccaccaccgaggucgagaacaagaacggcccggagacccuggcccccagcaacacggaggaggugaacaucaccauccacaagaagaccaacuucugcaagcggcagugcgagcccuucguccccgugcucaacaagcaccgcagcaccgugcugcaguggccguccgagaugcuggucuacacgaccaccaagcccagcaucuccuacagcugcaacccccucugcuucgacuucaaguccaccaaggugaacaacaaccuggacaagaacaagcccgaccugaaggaccucugcagccagcagaagcaggaggacaucugcaugggcccgcuguccgacuacaaggacgugagcacggaggggcugaccgacuacgagaucggcuccagcaagaacaagugcucccaggucacgccccuccuggccgacgacauccugagcuccagcugcgacuccgggaagaacgagaacaccggccagcgguacaagaacaucagcugcaagauccgcgagaccgagaaguacaacuucaccaagucccagaucaagcaggacacccucgacgagaaguacaacaagauccggcugaaggagacccacgaguacugguuccacaagagccgccggaagaagaagcgcaagaagcugugccagcaccaccacauggagaagacgaaggagagcgagacccgcugcaagauggaggccgagaacuccuacaccgagaacgcgggcaaguaccuccuggagcccaucagcgagaagcaguaccuggccgccgagcagcuccuggacucccaccagcugcucgacaagcggcccaagagcgaguccaucagccuguccgacaacgaggagaugugcaagaccuggaacaccgaguacaacacguacgacaccaucagcuccaagaaccacugcaagaagaacaccauccugcugaacgggcagagcaacgccaccaugauccacuccggcaagcacaaccucacguacagccgcaccuacugcugcuggaagaccaagauguccagcugcucccaggaccaccggagccuggugcugcagaacgacaugaagcacaugucccagaaccaggcggugaagcgcggguacaacagcgucaugaacgaguccgagcgguucuaccgcaagcggcgccagcacagccacagcuacuccagcgacgagucccucaaccggcagaaccaccucccggaggaguuccugcgcccgcccagcaccuccguggcccccugcaagcccaagaagaagcggcgccggaagcgcggccgguuccaccccggguucgagacgcuggagcugaaggagaacaccgacuaccccgugaaggacaacagcucccugaacccgcucgaccgccugaucagcgaggacaagaaggagaagaugaagccccaggaggucgccaagaucgagcggaacuccgagcagaccaaccagcugcgcaacaagcucagcuuccaccccaacaaccugcugcccuccgagaccaacggcgagacggagcaccucgagauggagaccaccagcggcgagcuguccgacgugagcaacgacccgaccacguccgugugcgucgccagcgcccccaccaaggaggcgaucgacaacacccugcucgagcacaaggagcgguccgagaacaucaaccugaacgagaagcagauccccuuccaggugcccaacaucgagcgcaacuuccgccagagccagccgaaguccuaccugugccacuacgagcucgccgaggcccugccccaggggaagaugaacgagacccccacggaguggcugcgguacaacagcggcauccucaacacccagcccccgcugcccuucaaggaggcccacgugagcgggcacaccuucgucaccgccgagcagauccuggcgccccucgcccugcccgagcaggcccugcucaucccgcuggagaaccacgacaaguucaagaacgugcccugcgagguguaccagcacauccugcagcccaacaugcucgccaacaaggucaaguucacguucccgcccgccgcgcugcccccgcccuccacgccccugcagccccucccccugcagcagagccugugcuccaccagcgugaccaccauccaccacaccgugcuccagcagcacgccgccgccgcggccgccgccgccgcggccgccgccgccggcaccuucaagguccugcagccgcaccagcaguuccugucccagauccccgcgcucacccgcacgagccugccccagcuguccguggggcccgugggcccgcggcucugccccggcaaccagcccaccuucgucgcgcccccgcagaugcccaucauccccgccagcgugcugcaccccucccaccuggccuucccgagccucccccacgcccuguuccccucccugcucagcccccacccgaccgugaucccccugcagccccuguucuga

SEQ ID NO: 39132 - RNA, 4050 nt, Artificial Sequence
  derived and/or modified sequence opt1 from ZNF804B__Homo_sapiens__NP_857597
auggccugcuaccuggugaucagcucccgccaccucagcaacggccacuaccgggggaucaagggcgucuuccgcgggccccugugcaagaacggcuccccgagccccgacuucgccgagaagaaguccaccgcgaaggcccuggaggacgugaaggccaacuucuacugcgagcucugcgacaagcaguaccacaagcaccaggaguucgacaaccacaucaacagcuacgaccacgcccacaagcagcggcugaaggagcugaagcagcgcgaguucgcccggaacguggcguccaagagcuggaaggacgagaagaagcaggagaaggcccucaagcgccugcaccagcuggccgagcuccggcagcaguccgagugcgucagcgggaacggccccgccuacaaggcgccccgcguggccaucgagaagcagcugcagcagggcaucuucccgaucaagaacgggcggaagguguccugcaugaaguccgcccugcuccugaagggcaagaaccugccccgcaucaucuccgacaagcagcggagcaccaugcccaaccgccaccagcuccaguccgaccggcgcugccuguucgggaaccagguccugcagacgagcuccgaccucagcaacgccaaccaccggaccggcguguccuucaccuucagcaagaaggugcaccugaagcuggagagcuccgccagcgucuucuccgagaacaccgaggagacgcacgacugcaacaagagccccaucuacaagaccaagcagaccgcggacaagugcaagugcugccgcuucgccaacaaggacacccaccucacgaaggagaaggaggugaacaucuccccgagccaccuggaguccgugcugcacaacaccaucagcaucaacuccaagauccuccaggacaagcacgacagcaucgacgagacccuggaggacuccaucgggauccacgccagcuucuccaagagcaacauccaccuguccgacgucgacuucacccccacgagccgggagaaggagacccgcaacacccucaagaacacccuggagaacugcgugaaccaccccugccaggccaacgccuccuucagcccgcccaacaucuacaaccacuccgacgcgcggaucagcgagugccuggacgaguucagcucccucgagcccagcgagcagaaguccacggugcaccugaaccccaacagccgcaucgagaaccgggagaagucccuggacaagaccgagcgcgucagcaagaacgugcagcgccucgugaaggaggccugcacccacaacgucgccuccaagccccugccguuccugcacgugcagagcaaggacggccacaccacgcuccaguggcccaccgagcugcuccuguucaccaagaccgagcccugcaucagcuacggcugcaacccccuguacuucgacuucaagcugagccggaacacgaaggaggaccacaaccucgaggaccugaagaccgagcuggggaagaagccgcucgagcugaagaccaagcgcgagucccaggugagcggccugaccgaggaccagcagaagcucauccaggaggacuaccaguaccccaagcccaagacgaugaucgccaaccccgacugggagaaguuccagcggaaguacaaccuggacuacuccgacagcgagccgaacaaguccgaguacaccuucagcgccaacgaccuggagaugaagaaccccaaggucccccuguaccucaacaccucccugaaggacugcgcggggaagaacaacagcagcgagaacaagcugaaggaggccucccgcgcccacuggcagggcugccggaaggccgugcucaacgacaucgacgaggaccugagcuuccccuccuacaucagccgcuucaagaagcacaagcugaucccgugcagcccccaccucgaguucgaggacgagcggcaguucaacugcaaguccucccccugcaccgugggcgggcacagcgaccacggcaaggacuucuccgucauccucaagagcaaccacaucuccaugacgagcaagguguccgggugcggcaaccagcgcuacaagcgguacagcccgcaguccugccugagccgcuacuccagcucccuggacaccagccccagcuccaugagcucccugcgguccacgugcagcagccaccgcuucaacgggaacucccggggcaaccugcucugcuuccacaagcgcgagcaccacagcgucgagcggcacaagcgcaagugccugaagcacaacugcuucuaccuguccgacgacaucaccaagagcucccagaugcagagcgagccccagaaggagcggaacugcaagcucugggaguccuucaagaacgagaaguacagcaagcgccgguacugccacugccgcgagcgccagaagcugggcaagaaccagcagcaguucuccgggcucaagagcacccggaucaucuacugcgacuccaacagccagaucuccugcaccggcagcagcaagaagcccccgaacugccaggggacccagcacgaccgccuggacuccuacagcaucgagaagauguacuaccugaacaaguccaagcggaaccaggagagccugggcagcccccacaucugcgaccucgggaaggugcgccccaugaagugcaacuccggcaacaucuccugccugcugaagaacugcagcuccggccccagcgagaccaccgaguccaacacggccgagggggagcggaccccgcucaccgcgaagauccugcuggagcgcgugcaggccaagaagugccaggagcagagcuccaacgucgagaucagcuccaacagcugcaaguccgagcucgaggcccccagccaggugcccugcaccauccagcuggcccccuccggcugcaaccggcaggcgcugccgcucagcgagaagauccaguacgccagcgagucccgcaacgaccaggacagcgccaucccccggacgaccgagaaggacaaguccaagagcucccacaccaacaacuucaccauccuggccgacacggacugcgacaaccaccugagcaaggggaucauccaccucgugaccgagucccagagccugaacaucaagcgcgacgccaccaccaaggagcaguccaagccccugaucagcgagauccagcccuucauccaguccugcgacccgguccccaacgaguuccccggcgcguuccccagcaacaaguacacgggggugaccgacuccaccgagacccaggaggaccagaucaaccucgaccugcaggacgugagcaugcacaucaaccacgucgagggcaacaucaacuccuacuacgaccggacgaugcagaagccggacaagguggaggacggccuggagaugugccacaagagcaucuccccgccccucauccagcagcccaucaccuucagccccgacgagaucgacaaguacaagauccugcagcugcaggcccagcagcacaugcagaagcagcuccuguccaagcaccuccgcgugcugcccgccgccgggcccaccgccuucagcccggcgagcaccguccagacggugcccgugcaccagcacaccuccaucaccaccauccaccacacguuccugcagcacuucgccgucagcgccucccugagcucccacagcucccaccuccccaucgcccaccuccacccccugagccaggcccacuucuccccgaucagcuucuccacccugacccccaccaucauccccgcgcaccccacguuccuggccggccacccgcugcaccucguggccgccacccccuuccaccccagccacaucacccugcagccccugccgcccaccgcguucauccccacccucuucgggccccaccugaacccggccacgaccuccaucauccaccugaacccccucauccagcccguguuccagggccaggacuucugccaccacagcugcuccagccagaugcagcagcugaacgaggucaaggaggcccugaacguguccacccaccucaacuga

SEQ ID NO: 39133 - RNA, 822 nt, Artificial Sequence
  derived and/or modified sequence opt1 from ZNF80__Homo_sapiens__NP_009067
augagccccaagcgcgacggccuggggaccggcgacgggcuccacucccaggugcugcaggagcaggucagcaccggcgacaaccugcacgagugcgacucccaggggccgagcaaggacacgcucgugcgggagggcaagaccuacaagugcaaggagugcggcuccguguucaacaagaacagccugcugguccgccaccagcagauccacaccggggugaagcccuacgagugccaggagugcggcaaggccuuccccgagaagguggacuucguccggcccaugcgcauccacaccggggagaagccgugcaagugcguggagugcggcaagguguucaaccggcgcucccaccuccugugcuaccggcagauccacacgggggagaagcccuacgagugcagcgagugcggcaagaccuucuccuaccacagcgucuucauccagcaccgcgugacccacaccggcgagaagcuguucgggugcaaggagugcggcaagacguucuacuacaacuccagccucacccggcacaugaagauccacaccggggagaagcccugcaagugcuccgagugcggcaagaccuucacguaccgcagcguguucuuccggcacuccaugacccacaccgccggcaagcccuacgagugcaaggagugcgggaagggcuucuacuacagcuacucccugacccgccacacgcggagccacaccggggagaagccguacgagugccuggagcaccgcaaggacuucggcuaccacuccgcguucgcccagcagagcaagauccacagcgggggcaagaaccucuga

SEQ ID NO: 39134 - RNA, 1185 nt, Artificial Sequence
  derived and/or modified sequence opt1 from ZNF812__Homo_sapiens__XP_011526544
augccccugcagcgcugcgacgugggcgagcucugcgagccggggcugugcggccggcaggaggccaccgucgacgggaacagcgagaacugcggcgagguguucuccgagugguucugccugaagacccacaugcgcgcccagaacgggggcaacaucuucgagggcaacugcuacgggaaggacauccucagcgugcacaaggaggcguccaucggccaggagcugagcaaguucaaccccugcgggaaggucuucacgcugacccccgaccucgccgcccaccugggcauccugaacgcccggcagcccuacaagugcaaggagugccgcaagggguucaaguacuucgccucccucgacaaccacaugggcauccacaucggcgagaaguucugcgaguuccaggagugccggcgcgcgaucacccacagcucccaccugaagcagugcgugaccgugcacacggggaagaaguccaagaagaccaagaagcacggcaagagcuucaccaacuucagccagcuguccgcccacgucaagauccacaagggggagaaguccuucgagugcaaggagugcggccggagcuuccgcaacagcuccagcuucaacgugcacauccagauccacaccggcaucaagccgcacaaguacacggagugcgggaaggccuucacccgguccacccaccucacccagcacgugcgcacgcacaccggcaucaagcccuacgagugcaaggagugcgggcaggccuucacccaguacaccggccuggcgauccacauccggaaccacacgggggagaagcacuaccagugcaaggagugcggcaaggccuucaacggcagcuccacccugacccagcacaagaucauccacaccggggagaagcccuacggcugcgucgagugcgggaagacguucaucaccagcagcuaccgcuccaagcaccucaagacccaccacgaggagcggcccuucgugugcaagaucugcggcaaggccuuccuguacagcuccccgcugaacgugcaccuccagacccacacgcgcgagaaggcccugaucugcaaggagugcgggaaggccuucgcggucagcucccaccugagccggcacgagcgcauccacaccggcgaggagcccuacgaguacaagggcaugaacgugaccaucuga

SEQ ID NO: 39135 - RNA, 1854 nt, Artificial Sequence
  derived and/or modified sequence opt1 from ZNF813__Homo_sapiens__NP_001004301
auggcccugccccagggccuccugaccuuccgcgacguggccaucgaguucagccaggaggaguggaagugccuggacccggcgcagcggacccucuaccgcgacgucaugcuggagaacuaccggaaccuggugucccucgacaucagcuccaagugcaugaugaaggaguucagcuccacggcccaggggaaccgcgaggugauccacaccggcacccugcagcggcacgagagccaccacaccggggacuuccgcuuccaggagaucgacaaggacauccacaaccuggaguuccaguggcaggaggacgagcggaacucccacgaggcccccaugacggagaucaagaagcucaccggcagcgccgaccgcuacgaccagcggcacgccgggaacaagcccaucaaggaccagcugggcuccagcuuccacucccaccuccccgagcugcacauguuccagacccagggcaagaucgggaaccaggucgagaaguccaucaacgacgcgagcagcaucuccaccagccagcgcaucuccugccggccgaagacgcacaucagcaacaacuacggcaacaacuuccgcaacuccagccugcugacccagaagcaggaggugcacaugcgggagaaguccuuccagugcaacgagagcgggaaggccuucaacuacagcucccuccugcgcaagcaccagaucauccaccugggcgagaagcaguacaagugcgacgugugcgggaaggucuucaaccggaagcgcaaccucgugugccaccggcgcugccacaccggcgagaagcccuaccggugcaacgagugcggcaagaccuucagccagacguacucccugaccugccaccgccggcugcacaccggggagaagcccuacaagugcgaggagugcgacaaggccuucagcuucaaguccaaccucaagcgccaccgccggauccacgccggcgagaagcccuacaagugcaacgagugcgggaagaccuucagccagacguccagccugaccugccaccgccggcugcacaccggcgagaagccguucaagugcaacgagugcggcaagaccuucucccgcaagagcucccucacgugccaccaccggcugcacaccggggagaagcccuacaagugcaacgagugcggcaagaccuucagccaggagcugacccucaagugccaccgccggcugcacacgggggagaagcccuacaagugcaacgagugcggcaagguguucaacaagaaggcgaaccuggcccgccaccaccggcuccacuccggggagaagcccuacaagugcaccgagugcgucaagaccuucagccgcaacuccgcccuggugauccacaaggccauccacaucggcgagaagcgguacaagugcaacgagugcggcaagaccuucagccgcaucuccgcccuggugauccacacggcgauccacaccggggagaagccguacaagugcaacgagugcggcaagggguucaaccggaagacccaccucgccugccaccaccgccugcacaccggcgagaagcccuacaagugcaacgagugcgggaaggucuucaaccggaagacgcaccuggcccaccaccaccgccuccacaccggcgacaagcccuacaagugcaacgagugcggcaagguguucaaccagaaggcccaccuggcccggcaccaccgccugcacaccggggagaagcccuacaagugcaacgagugcggcaagguguucaaccagaaggcgaaccucgcccggcaccaccgccugcacaccggggagaagccguacaaguucaacgagugcggcaaggccuucaacuga

SEQ ID NO: 39136 - RNA, 1956 nt, Artificial Sequence
  derived and/or modified sequence opt1 from ZNF816__Homo_sapiens__NP_001189386
augcugcgcgaggaggccaccaagaaguccaaggagaaggagcccggcauggcccucccgcaggggcggcugaccuuccgcgacguggcgaucgaguucagccuggaggaguggaagugccucaaccccgcccagcgggcccuguaccgcgccgucaugcuggagaacuaccggaaccucgaguucguggacagcucccucaagagcaugauggaguucuccagcacgcgccacuccaucaccggcgaggugauccacaccgggacccugcagcggcacaagagccaccacaucggcgacuucugcuuccccgagaugaagaaggacauccaccacuucgaguuccaguggcaggaggucgagcgcaacgggcacgaggcccccaugacgaagaucaagaagcugaccggcuccaccgaccggagcgaccaccgccacgcgggcaacaagccgaucaaggaccagcuggggcuguccuuccacagccaccuccccgagcugcacauguuccagaccaagggcaagaucuccaaccagcuggacaagagcaucggggccuccagcgccuccgagagccagcggaucuccugccgccucaagacgcacaucagcaacaaguacggcaagaacuuccugcacagcuccuucacccagauccaggagaucugcaugcgggagaagcccugccagagcaacgagugcgggaaggccuucaacuacuccagccugcuccgccggcaccacaucacccacucccgcgagcgggaguacaagugcgacgugugcggcaagaucuucaaccagaagcaguacaucguguaccaccaccgcugccacaccggcgagaagacguacaagugcaacgagugcgggaagaccuucacccagaugagcucccuggucugccaccggcgccugcacaccggcgagaagcccuacaagugcaacgagugcgggaagacguucagcgagaaguccagccuccggugccaccgccgccugcacaccggcgagaagccguacaagugcaacgagugcggcaagaccuucgggcggaacuccgcgcuggugauccacaaggccauccacaccggcgagaagcccuacaagugcaacgagugcgggaagacguucagccagaaguccagccuccagugccaccacauccugcacaccggcgagaagcccuacaagugcgaggagugcgacaacguguacauccgccggucccaccuggagcgccaccggaagauccacaccggggagggcagcuacaagugcaaggucugcgacaagguguuccgcuccgacagcuaccucgccgagcaccagcgggugcacaccggcgagaagcccuacaagugcaacaagugcgggcgcuccuucagccgcaagagcucccugcaguaccaccacacgcugcacaccggcgagaagccguacacgugcaacgagugcgggaaggucuucagccggcgggagaaccucgcccgccaccaccggcugcacgccggcgagaagcccuacaagugcgaggagugcgacaagguguucucccgccggagccaccuggagcgccaccggcgcauccacaccggggagaagcccuacaagugcaaggugugcgacaaggcguuccgguccgacagcugccucgccaaccacacccgcguccacaccggcgagaagcccuacaagugcaacaagugcgccaagguguucaaccagaagggcauccuggcccagcaccagcgcgugcacaccggggagaagccguacaagugcaacgagugcggcaaggucuucaaccagaaggccucccuggcgaagcaccagcgggugcacaccgccgagaagcccuacaagugcaacgagugcgggaaggccuucacgggccagagcacccucauccaccaccaggccauccacgggugccgcgagacccugcagauguga

SEQ ID NO: 39137 - RNA, 1986 nt, Artificial Sequence
  derived and/or modified sequence opt1 from ZNF81__Homo_sapiens__XP_011542204
augcccgccaacgaggacgccccgcagcccggcgagcacgggagcgcgugcgagguguccgucagcuucgaggacgugaccguggacuucucccgcgaggaguggcagcagcuggacagcacccagcggcgccucuaccaggacgucaugcuggagaacuacucccaccuccugagcgugggcuucgaggugcccaagcccgaggucaucuucaagcuggagcagggggagggcccguggacgcuggagggggaggcgccccaccaguccugcagcgacggcaaguucggcaucaagcccucccagcggcgcaucagcgggaaguccaccuuccacagcgagauggagggcgaggacacccgggacgacucccucuacagcauccuggaggagcuguggcaggacgccgagcagaucaagcgcugccaggagaagcacaacaagcuccugucccggaccacguuccugaacaagaagauccucaacaccgagugggacuacgaguacaaggacuucgggaaguucgugcaccccagcccgaaccugauccugucccagaagcgcccccacaagcgggacagcuucggcaaguccuucaagcacaaccucgaccugcacauccacaacaagagcaacgccgccaagaaccuggacaagaccaucgggcacggccagguguucacccagaacagcuccuacagccaccacgagaacacgcacaccggcgucaaguucugcgagcgcaaccagugcgggaaggugcucucccugaagcacagccugucccagaacgugaaguuccccaucggcgagaaggccaacacgugcaccgaguucgggaagaucuucacccagcggagccacuucuucgcgccccagaagauccacaccgucgagaagccgcacgagcucuccaagugcgugaacguguucacccagaagccccugcugagcaucuaccuccgcguccaccgggacgagaagcuguacaucugcaccaagugcggcaaggccuucauccagaacuccgagcugaucaugcacgagaagacgcacacccgcgagaagcccuacaagugcaacgagugcggcaagagcuucuuccagguguccagccuccugcggcaccagaccacccacacgggggagaagcuguucgagugcuccgagugcggcaagggguucagccucaacuccgcccugaacauccaccagaagauccacaccggcgagcgccaccacaagugcagcgagugcgggaaggccuucacccagaaguccacccugcggaugcaccagcgcauccacacgggcgagcggagcuacaucugcacccagugcggccaggccuucauccagaaggcccaccucaucgcccaccagcgcauccacaccggggagaagcccuacgagugcuccgacugcggcaagagcuucccgagcaagucccagcugcagaugcacaagcggauccacaccggggagaagcccuacaucugcacggagugcggcaaggccuucaccaaccgcagcaaccugaacacccaccagaagucccacaccggggagaaguccuacaucugcgcggagugcggcaaggccuucacggaccgcagcaacuucaacaagcaccagaccauccacaccggcgagaagcccuacgugugcgccgacugcgggcgggccuucauccagaaguccgagcucaucacccaccagcgcauccacacgaccgagaagcccuacaagugcccggacugcgagaaguccuucagcaagaagccccaccugaagguccaccagcggauccacaccggcgagaagcccuacaucugcgccgagugcgggaaggcguucaccgaccgcagcaacuucaacaagcaccagaccauccacacgggcgacaagcccuacaagugcagcgacugcgggaagggcuucacccagaaguccgugcugagcaugcaccggaacauccacaccuga

SEQ ID NO: 39138 - RNA, 1833 nt, Artificial Sequence
  derived and/or modified sequence opt1 from ZNF823__Homo_sapiens__NP_001073962
auggacagcguggccuucgaggacgucgccgugaacuucacccaggaggagugggcgcugcucggccccucccagaagucccuguaccgcaacgugaugcaggagaccauccggaaccuggacugcaucgagaugaagugggaggaccagaacaucggggaccagugccagaacgccaagcgcaaccuccggagccacacgugcgagaucaaggacgacagccagugcggcgagaccuucgggcagaucccggacuccaucgucaacaagaacacgccccgcgugaaccccugcgacagcggcgagugcggggaggugguccugggccacuccagccugaacugcaacauccggguggacaccggccacaaguccugcgagcaccaggaguacggggagaagcccuacacccacaagcagcgcggcaaggccaucagccaccagcacuccuuccagacccacgagcggccgcccaccgggaagaagcccuucgacugcaaggagugcgccaagaccuucagcucccucggcaaccugcgccggcacauggccgcgcaccacggggacggccccuacaagugcaagcugugcggcaaggccuucguguggccgagccucuuccaccuccacgagcgcacgcacaccggggagaagcccuacgagugcaagcagugcuccaaggccuuccccuucuacagcuccuaccugcggcacgagcgcauccacaccggcgagaaggccuacgagugcaagcagugcagcaaggcguuccccgacuacuccaccuaccugcggcacgagcgcacgcacaccggggagaagccguacaagugcacccagugcggcaaggccuucagcugcuacuacuacacccggcugcacgagcgcacgcacaccggcgagcagcccuacgccugcaagcagugcgggaagaccuucuaccaccacaccagcuuccggcgccacaugauccggcacacgggcgacgggccccacaagugcaagaucugcggcaagggguucgacugccccuccagcguccgcaaccacgagaccacccacaccggcgagaagccguacgagugcaagcagugcggcaaggugcugucccacagcuccagcuuccggucccacaugaucacgcacaccggggacggcccccagaagugcaagaucugcgggaaggccuucggcugccccagccucuuccagcgccacgagcgcacccacaccggggagaagcccuaccagugcaagcagugcggcaaggccuucucccuggcgggcagccugcggcgccacgaggccacgcacaccggggugaagccguacaagugccagugcggcaaggccuucuccgaccucagcuccuuccagaaccacgagaccacccacacgggggagaagcccuacgagugcaaggagugcggcaaggccuucagcugcuucaaguaccugucccagcacaagcggacccacaccgucgagaagcccuacgagugcaagaccugccgcaaggccuucagccacuucuccaaccugaaggugcacgagcggauccacagcggggagaagcccuacgagugcaaggagugcggcaaggcguucuccuggcucacgugccugcugcgccacgagcggauccacaccggcgagaagccguacgagugccuccagugcgggaaggccuucacccgcagccgguuccugcgcggccacgagaagacccacaccggggagaagcuguacgagugcaaggagugcggcaaggcccucagcucccugcggagccugcaccgccacaagcggacgcacuggaaggacacccucuga

SEQ ID NO: 39139 - RNA, 3234 nt, Artificial Sequence
  derived and/or modified sequence opt1 from ZNF827__Homo_sapiens__NP_849157
augccccgccggaagcaggagcagccgaagcgccugcccagccacgugucccggcaggaggaggccgagggcgagcucagcgagggggagcacugguacggcaacuccagcgagacccccuccgaggccagcuacggggagguccaggagaacuacaagcugucccuggaggaccgcauccaggagcagagcaccucccccgacacgagccucggcuccaccaccccgagcucccacacccuggagcugguggcgcucgacagcgaggugcugcgggacucccugcagugccaggaccaccucagccccggggucuccagccugugcgacgacgaccccggcuccaacaagccccugagcagcaaccuccgccggcugcuggaggccggcucccucaagcuggacgccgccgccacggcgaacgggcgcguggagagcccggugaacgucggcuccaaccugagcuucuccccccccagccaccacgcccagcagcucuccgugcuggcccggaagcuggccgagaagcaggagcagaacgaccaguacacccccagcaaccgcuucaucuggaaccaggggaaguggcucccgaacuccaccaccacgugcagccugucccccgacagcgcgauccugaagcucaaggccgccgccaacgccgugcugcaggacaagucccugacccggaccgaggagaccaugcgcuucgagagcuucuccagccccuucuccagccaguccgcgagcagcacgcucgccgcccuguccaagaaggucagcgagcggucccugacccccggccaggagcacccgccccccgccagcuccuuccucagccuggccuccaugaccagcuccgcggcccugcucaaggagguggccgcccgcgccgcggggagccugcuggccgagaaguccagccuccugcccgaggacccgcugcccccccccccguccgagaagaagcccgagaaggugaccccccccccgccccccccgcccccccccccgcccccccccccgccccagagccucgagcugcugcuccugcccguccccaagggccggguguccaagccgagcaacuccgccagcgaggaggagagcggcaagcccuuccagugccccaucugcgggcuggugaucaagcgcaaguccuacuggaagcggcacauggucauccacacgggccucaagagccaccagugcccccugugcccguuccgcugcgcccggaaggacaaccugaagucccacaugaaggugcaccagcaccaggaccgcggggagaccuuccagugccagcucugccccuucaccagcucccggcacuucagccugaagcugcacaugcgcugccaccagcacuuccugcgcaccgaggccaaggugaaggaggagauccccgaccccgacgucaagggcuccccgcaccucagcgacuccgcgugccugggccagcagcgggaggggggcgggacggagcuggugggcaccaugaugaccagcaacacccccgagcgcacgucccaggggggcgccggcgugagcccccuccuggucaaggaggagcccaaggaggacaacgggcugccgaccuccuucacccucaacgccgccgaccggcccgcgaaccacaccaagcugaaggaccccagcgaguacguggccaacuccgccagcgcccuguucucccaggacaucagcgugaagauggccuccgacuuccucaugaagcugagcgcggccaaccagaaggagccgaugaaccugaacuucaaggucaaggaggagcccaaggagggcgagagccucuccacgacccugccccgcagcuccuacguguucagccccgaguccgaggucagcgccccggggguguccgaggacgcccugaagccccaggagggcaaggggagcgugcuccggcgcgacgucuccgugaaggccgcgagcgagcugcugaugaagcucuccgccgagagcuacaaggagacccagauggugaagaucaaggaggagcccauggaggucgacauccaggacucccacgugagcaucucccccagccggaacgugggcuacuccacccugaucggccgcgagaagacggagccgcugcagaagaugcccgaggggcgggucccccccgagcgcaaccucuucagccaggacaucuccgugaagauggccagcgagcugcuguuccagcucagcgagaagguguccaaggagcacaaccacaccaaggagaacaccauccggaccacgaccagcccguucuucuccgaggacaccuuccgccagagccccuucaccuccaacagcaaggagcugcugcccuccgacagcguccuccacggccggaucuccgcccccgagaccgagaagaucgugcuggaggccgggaacggccugccgagcuggaaguucaacgaccagcucuuccccugcgacgugugcgggaaggucuucggccgccagcagacgcugucccggcaccugagccuccacaccgaggagcgcaaguacaagugccaccugugccccuacgcggccaagugccgggccaaccugaaccagcaccucaccgugcacuccgugaagcuggucagcaccgacacggaggacaucguguccgccgugaccagcgagggcuccgacgggaagaagcaccccuacuacuacagcugccacgucugcggcuucgagaccgagcugaacgugcaguucgugucccacaugagccuccacgucgacaaggagcaguggauguucagcaucugcugcaccgcgugcgacuucgugacgauggaggaggccgagaucaagacccacaucgggaccaagcacaccggcgaggaccgcaagacgccguccgagagcaacucccccagcuccagcucccugagcgcccuguccgacagcgccaacuccaaggacgacagcgacggcucccagaagaacaaggggggcaacaaccuccuggugaucagcgucaugcccgggucccagcccagccugaacuccgaggagaagccggagaagggcuucgagugcguguucugcaacuucgugugcaagaccaagaacauguucgagcggcaccuccagauccaccugaucacccgcauguucgagugcgacgucugccacaaguucaugaagacccccgagcagcugcucgagcacaagaagugccacacggugcccaccgggggccugaaguga

SEQ ID NO: 39140 - RNA, 1542 nt, Artificial Sequence
  derived and/or modified sequence opt1 from ZNF829__Homo_sapiens__NP_001165450
augaccggcaaggggcugggcgaggacaccgaggaccgcuggggcgccggggcccucgggcccugcggccggagcggccugaagggcggcgggugcgugugggaggcggaggccggcgggucccgcggccaggagaucgagacgauccuggccaacauggagaccagccuccgguccggccagaucccgacccuggacagcuccgagcacaaccugagccccgagccccucgagcuggaccgcaugccccacuccccgcugaucagcaucccccacgucuggugccaccccgaggaggaggagcggaugcacgacgagcuccugcaggccguguccaaggggcccgugauguuccgcgacgucagcaucgacuucucccaggaggagugggagugccuggacgccgaccagaugaaccucuacaaggaggugaugcuggagaacuucagcaaccugguguccgucggccucagcaacuccaagccggcggugaucagccugcuggagcaggggaaggagcccuggaugguggaccgggagcucacccgcgggcugugcuccgaccuggagagcaugugcgagacgaagauccucucccugaagaagcggcacuucagccaggucaucaucacccgcgaggacaugagcaccuucauccagcccaccuuccugaucccgccccagaagacgauguccgaggagaagcccugggagugcaagaucugcggcaagaccuucaaccagaacagccaguucauccagcaccagcggauccacuucggggagaagcacuacgaguccaaggaguacggcaagagcuucucccgcgggagccucgugacccggcaccagcgcauccacaccggcaagaagcccuacgagugcaaggagugcgggaaggccuucuccugcagcuccuacuucagccagcaccagcggauccacacgggcgagaagcccuacgagugcaaggagugcggcaaggccuucaaguacugcuccaaccugaacgaccaccagcgcauccacaccggggagaagccguacgagugcaaggugugcggcaaggccuucaccaagagcucccagcuguuccuccaccuccggauccacaccggggagaagcccuacgagugcaaggagugcggcaaggcguucacgcagcacagccgccugauccagcaccagcggaugcacaccggggagaagcccuacgagugcaagcagugcggcaaggccuucaacuccgccagcacccugaccaaccaccaccgcauccacgccggcgagaagcuguacgagugcgaggagugccggaaggccuucauccaguccagcgagcugauccagcaccagcgcauccacacggacgagaagcccuacgagugcaacgagugcgggaaggcguucaacaagggcuccaaccucacccgccaccagcggauccacaccggggagaagccguacgacugcaaggagugcggcaaggccuucgggagccgcagcgaccugauccggcacgagggcauccacaccggcuga

SEQ ID NO: 39141 - RNA, 5034 nt, Artificial Sequence
  derived and/or modified sequence opt1 from ZNF831__Homo_sapiens__NP_848552
auggaggugcccgagcccacgugccccgcgccgcccgcccgcgaccagcccgcccccacccccgggcccccgggcgcccccggcgggcaggccagcccccaccugacccucggccccgugcugcugccgcccgagcaggggcucgcgccgcccaccguguuccugaaggcccugcccaucccccucuaccacaccgugccgcccggcggccugcagccccgggcgccccuggucaccgggucccucgacggcgggaacgugcccuucauccugucccccgugcugcagcccgagggccccgggcccacccaggucggcaagcccgccgcccccacccucaccgugaacaucgugggcacccugcccguccugucccccgggcucggccccacccuggggucccccggcaaggugcgcaacgccggcaaguaccugugcccccacugcgggcgggacugccucaagcccuccgugcuggagaagcacauccgcagccacaccggcgagcggcccuuccccugcgcgaccugcgggaucgccuucaagacccaguccaaccuguacaagcaccgccggacgcagacccaccucaacaacagccgccuguccagcgaguccgagggcgccgggggcggccugcucgaggagggggacaaggccggcgagccgccccggccggaggggcgcggcgagucccggugccaggggaugcacgagggcgccuccgagcgcccccugagccccggcgcccacgucccccugcucgccaagaaccuggacgugcggaccgaggccgccccgugccccggguccgccuucgccgaccgcgaggcccccugggacagcgcccccauggccuccccgggccugcccgccgccagcacccagcccuggcggaagcuccccgagcagaaguccccgaccgccgggaagcccugcgcccugcagcgccagcaggccaccgccgcggagaagcccugggacgccaaggcccccgagggccggcugcgcaagugcgagagcaccgacagcggguaccucucccggagcgacuccgccgagcagccgcacgcgcccugcagcccccugcacucccugagcgagcacuccgccgagagcgagggcgagggcgggccgggccccgggcccggcguggccggcgccgagcccggggcccgcgaggcgggccucgagcuggagaagaagcggcuggaggagcgcaucgcccagcucaucucccacaaccaggccgucguggacgacgcccagcuggacaacgugcgcccgcggaagaccgggcugagcaagcagggcuccaucgaccuccccacgcccuacaccuacaaggacagcuuccacuucgacauccgcgcccuggagcccgggcggcgccgggcgccgggccccguccgcuccaccuggacgccgcccgacaagagccggccgcuguucuuccacuccgugcccacgcagcucagcaccaccguggagugcguccccgugacccgcuccaacagccugcccuucguggagggcucccggacguggcuggagccgcgcgagccccgggaccccuggagccgcacccagaagccccucagcccgcggcccgggcccgcccgccugggcugccgguccgggcugagcuccaccgacguccccagcggccacccgcgcgcccuggugcggcaggccgccgucgaggaccuccccgggacccccaucggcgacgcgcuggugcccgccgaggacacggacgccaagcgcaccgccgcgcgggaggccauggccggcaaggggcgcgccggcgggcgcaagugcggccagcggcgccugaagauguucucccaggagaaguggcaggucuacggggacgagaccuucaagcggaucuaccagaagaugaaggccagcccgcacggcggcaagaaggcgcgcgaggucgggaugggcuccggggccgagcucggcuucccccugcagaaggaggccgccgggagcuccggcaccgugcccacgcaggaccggcgcaccccggugcacgaggacaucagcgccggcgcgacccccgagcccugggggaacccgcccgcccuggaggccucccucgucaccgagcccaccaagcacggcgagacgguggcccggcgcggggacagcgaccggccccgcguggaggaggccgucuccagccccgcgcugggcggccgggacucccccugcagcgggucccgcagcccccuggugagccccaacggccggcucgagcugggguggcagaugcccccggcccccggcccccugaagggcggggacguggaggcgccccggccggucuggcccgaccccaagcucgagggcggggcccggggcgugggggacgugcaggagaccugccugugggcgcagaccguccugcgcuggcccucccggggcagcggggaggacaagcucccguccgagcgcaagaagcugaagguggaggaccugcacagcuggaagcagcccgagcccguguccgccgagacccccggcggcccgacgcagcccgccagccucuccagccagaagcaggacgccgaccccggggagguccccggcggguccaaggagagcgcccgccaggugggcgagccgcuggaguccagcggggcgucccuggccgccgccagcguggcccucaagcgcgucggcccccgggacaaggcgacgccccugcacccggccgcccccgcccccgccgagcaccccucccuggcgaccccgccccaggcgccccgggugcucagcgcccuggccgacaacgccuucucccccaaguaccugcuccgccugccgcaggcggagacgccccugccccuccccaucccguggggcccccggcacagccaggacucccugugcagcagcggguggcccgaggagcgcgccuccuucgugggcagcgggcugggcacgccccucuccccgagccccgccuccggccccagccccggggaggccgacuccauccuggaggacccgagcugcucccggccccaggacggccgcaagggggcgcagcugggcggggacaagggcgaccggauggccaccagccgccccgccgcccgggagcuccccaucuccgccccgggcgcgccccgcgaggccaccagcagcccgcccacccccacgugcgaggcccaccugguccaggacauggagggggacagccaccggauccaccgccugugcaugggcuccacccucgcccgggcccgccugagcggggacgugcugaaccccugggugcccaacugggagcucggcgagccgcccgggaacgcgcccgaggaccccuccagcggcccccuggucggccccgaccccugcagcccccugcagccggggagcuuccucaccgcccugacccggccccagggcgugccgcccggguggccggagcuggcccucagcucccacagcggcacgucccgcagccacuccacccggagcccccacuccacccagaaccccuuccccagccugaaggccgagccgcgccugaccuggugcugccucucccggagcgugccccugcccgccgagcagaaggcgaaggccgccuccgucuaccuggccgugcacuuccccgggagcucccuccgcgacgagggcccgaacgggccgcccgggagcaacggcggguggacguggaccucccccggcgagggcggcccggcgcagaugagcaaguucuccuaccccaccgugcccggcgucaugccgcagcaccaggugagcgagcccgaguggaagaaggggcugcccuggcgggccaagaugucccgcggcaacagcaagcagcgcaagcugaagaucaaccccaagcgguacaaggggaacuuccuccagagcugcgugcagcugcgcgccucccggcugcgcaccccgacguggguccggcgccggagccgccacccgcccgcccucgagggccugaagcccugccggaccccgggccagaccuccagcgagaucgccgggcugaaccuccaggaggagcccuccugcgcgaccagcgagagcccgcccugcugcggcaaggaggagaagaaggagggggacugccgccagacgcugggcacccugagccucgggaccuccagccggaucgugcgcgagauggacaagcggaccgugaaggacaucuccccgagcgccggcgagcacggcgacugcacgacccacuccaccgccgccaccagcgggcugucccugcagagcgacacgugccucgccgucgugaacgacgugccccugccgcccggcaaggggcuggaccucggccugcuggagacccagcuccuggcgucccaggacagcgucuccaccgacccgaagcccuacaucuucagcgacgcccagcgccccagcuccuucgggagcaagggcaccuucccccaccacgacaucgccaccuccguggccgccgugugcaucagccugccgguccggacggaccacaucgcgcaggagauccacuccgccgagagccgcgaccacucccagaccgccggccggacccucaccagcuccagccccgacuccaaggugacggaggaggggcgcgcccagacccugcugcccggccggcccagcuccgggcagcgcaucagcgacuccgugccgcucgagagcaccgagaagacccaccuggagauccccgcguccggccccagcuccgccagcagccaccacaaggaggggcggcacaagacguucuuccccucccgcggccaguacggcugcggggagaugaccgucccgugccccagccugggcuccgacgggcgcaagcgccaggugagcggccucaucacccgcaaggacuccgugguccccagcaagccggagcagcccaucgagauccccgaggcccccuccaagagccugaagaagcggucccuggaggggaugcgcaagcagacccggguggaguucagcgacacguccagcgacgacgaggaccgccucgucaucgagaucuga

SEQ ID NO: 39142 - RNA, 3480 nt, Artificial Sequence
  derived and/or modified sequence opt1 from ZNF91__Homo_sapiens__NP_001287880
augcccggcaccccggggagccuggagaugggccuccugaccuuccgcgacguggccaucgaguucucccccgaggaguggcagugccuggacacggcccagcagaaccucuaccggaacgucaugcuggagaacuaccgcaaccuggcguuccucgggaucugcccccacuucccccaggacuucuggccggagcagagcauggaggacuccuuccagaaggugcugcugcggaaguacgagaagugcggccacgagaaccuccagcugcgcaaggggugcaagagcguggacgagugcaagguccacaaggagggcuacaacaagcugaaccagugccucaccaccgcccaguccaagguguuccagugcggcaaguaccugaagguguucuacaaguuccugaacagcaaccggcacaccauccgccacacggggaagaagugcuucaagugcaagaagugcgucaaguccuucugcauccggcuccacaagacccagcacaagugcguguacaucaccgagaaguccugcaagugcaaggagugcgagaagaccuuccacuggagcagcacgcugaccaaccacaaggagauccacaccgaggacaagcccuacaagugcgaggagugcggcaaggccuucaagcagcuguccacccucacgacccacaagaucaucugcgccaaggagaagaucuacaagugcgaggagugcgggaaggccuuccuguggagcuccacccugacccgccacaagcggauccacacgggcgagaagcccuacaagugcgaggagugcgggaaggcguucagccacuccagcacccucgccaagcacaagcgcauccacaccggcgagaagcccuacaagugcgaggagugcggcaaggccuucucccggagcuccacccuggccaagcacaagcgcauccacacgggggagaagccguacaagugcaaggagugcggcaaggcguucagcaacagcuccacccuggccaaccacaagaucacccacaccgaggagaagcccuacaagugcaaggagugcgacaaggccuucaagcggcucagcacgcugaccaagcacaagaucauccacgccggggagaagcuguacaagugcgaggagugcggcaaggccuucaaccgcuccagcaaccucaccauccacaaguucauccacaccggcgagaagcccuacaagugcgaggagugcgggaaggcguucaacugguccagcucccugacgaagcacaagcgguuccacacccgcgagaagcccuucaagugcaaggagugcggcaaggccuucaucuggagcuccacccugacccggcacaagcgcauccacacgggggagaagccguacaagugcgaggagugcggcaaggccuuccggcagagcuccacccucaccaagcacaagaucauccacaccggggagaagcccuacaaguucgaggagugcggcaaggccuuccgccagagccugacgcugaacaagcacaagaucauccacucccgggagaagcccuacaagugcaaggagugcggcaaggccuucaagcaguucagcacccucaccacccacaagaucauccacgcggggaagaagcuguacaagugcgaggagugcggcaaggccuucaaccacuccagcucccugagcacccacaagaucauccacacgggggagaaguccuacaagugcgaggagugcggcaaggccuuccucuggagcagcacccugcgccgccacaagcggauccacaccggggagaagcccuacaagugcgaggagugcggcaaggccuucucccacagcuccgcccuggcgaagcacaagcgcauccacaccggcgagaagccguacaagugcaaggagugcgggaaggccuucagcaacuccagcacgcucgccaaccacaagaucacccacaccgaggagaagcccuacaagugcaaggagugcgacaagaccuucaagcggcuguccacgcugaccaagcacaagaucauccacgccggcgagaagcucuacaagugcgaggagugcgggaaggccuucaaccgcagcuccaaccugaccauccacaaguucauccacaccggcgagaagcccuacaagugcgaggagugcgggaaggcguucaacuggagcuccagccugacgaagcacaagcggauccacacccgcgagaagcccuucaagugcaaggagugcggcaaggccuucaucugguccagcacccucacccggcacaagcgcauccacacgggcgagaagccguacaagugcgaggagugcgggaaggccuucucccggagcuccacccugaccaagcacaagaccauccacacgggcgagaagcccuacaagugcaaggagugcgggaaggccuucaagcacagcagcgcgcuggccaagcacaagaucauccacgccggcgagaagcucuacaagugcgaggagugcggcaaggccuucaaccaguccagcaaccugaccacccacaagaucauccacaccaaggagaagcccuccaagagcgaggagugcgacaaggccuucaucugguccagcacgcugaccgagcacaagcgcauccacacccgggagaagaccuacaagugcgaggagugcgggaaggcguucucccagcccagccaccugacgacccacaagcgcaugcacaccggcgagaagccguacaagugcgaggagugcgggaaggccuucucccagagcuccacccucacgacccacaagaucauccacaccggcgagaagcccuacaagugcgaggagugcgggaaggccuuccgcaagagcuccacccugacggagcacaagaucauccacaccggcgagaagcccuacaagugcgaggagugcggcaaggccuucagccaguccagcacccugacccggcacacccggaugcacacgggggagaagcccuacaagugcgaggagugcggcaaggccuucaaccgcuccagcaagcucaccacccacaagaucauccacaccggggagaagccguacaagugcgaggagugcggcaaggcguucaucuccagcagcacgcugaacgggcacaagcggauccacacccgcgagaagcccuacaagugcgaggagugcggcaaggccuucucccagagcuccacccugacccggcacaagcgccuccacacgggcgagaagcccuacaagugcggggagugcggcaaggccuucaaggagagcuccgcccugaccaagcacaagaucauccacaccggggagaagccguacaagugcgagaagugcggcaaggccuucaaccagagcuccauccugaccaaccacaagaagauccacacgaucacccccgugaucccccuccugugggaggcggaggccgggggcagccgcggccaggagauggagaccauccuggccaacaccgucaagccccuccuguacuga

SEQ ID NO: 39143 - RNA, 1665 nt, Artificial Sequence
  derived and/or modified sequence opt1 from ZNF92__Homo_sapiens__NP_001274461
augggcccccugaccuuccgcgacgugaagaucgaguucagccucgaggaguggcagugccuggacaccgcccagcggaaccuguaccgcgacgucaugcucgagaacuaccggaaccugguguuccuggugaugugcucccacuucgcccaggacgucuggccggagcacagcaucaaggacuccuuccagaaggugauccuccgcacguacgggaaguacggccacgagaaccugcagcugcggaaggaccacaagagcguggacgcgugcaaggucuacaagggcggguacaacgggcucaaccagugccugaccaccaccgacuccaagaucuuccagugcgacaaguacgugaagguguuccacaaguuccccaacgucaaccgcaacaagauccggcacacgggcaagaagcccuucaagugcaagaaccgcggcaagagcuucugcaugcugucccagcucacccagcacaagaagauccacacccgggaguacagcuacaagugcgaggagugcgggaaggccuucaacugguccagcacccugacgaagcacaagaucauccacaccggcgagaagcccuacaagugcgaggagugcgggaaggccuucaaccgcuccagcaaccugaccaagcacaagaucauccacaccggcgagaagccguacaagugcgaggagugcgggaaggccuucaaccgguccagcacgcucaccaagcacaagcgcauccacaccgaggagaagcccuacaagugcgaggagugcggcaaggccuucaaccaguucuccauccugaacaagcacaagcggauccacauggaggacaagcccuacaagugcgaggagugcggcaaggcguuccgcguguucagcauccugaagaagcacaagaucauccacaccggggagaagcccuacaagugcgaggagugcggcaaggccuucaaccaguucuccaaccucacgaagcacaagaucauccacaccggggagaagccguacaagugcgacgagugcggcaaggccuucaaccagagcuccacccugaccaagcacaagcggauccacacgggcgagaagcccuacaagugcgaggagugcgggaaggccuucaagcagagcagcacccugaccgagcacaagaucauccacaccggcgagaagcccuacaagugcgagaagugcgggaaggcguucuccuggagcuccgccuucacgaagcacaagcgcaaccacauggaggacaagcccuacaagugcgaggagugcggcaaggccuucagcguguucuccacccucaccaagcacaagaucauccacacccgggagaagccguacaagugcgaggagugcgggaaggccuucaaccagagcuccaucuucacgaagcacaagaucauccacaccgagggcaagagcuacaagugcgagaagugcggcaacgccuucaaccaguccagcaaccugaccgcgcgcaagaucaucuacaccggggagaagcccuacaaguacgaggagugcgacaaggccuucaacaaguucuccacgcugaucacccaccagaucaucuacaccggcgagaagcccugcaagcacgagugcgggcgggccuucaacaagagcuccaacuacaccaaggagaagcuccagacguga

SEQ ID NO: 39144 - RNA, 1863 nt, Artificial Sequence
  derived and/or modified sequence opt1 from ZNF93__Homo_sapiens__NP_112495
augggcccccugcaguuccgcgacguggccaucgaguucagccucgaggaguggcacugccuggacaccgcccagcggaaccuguaccgcaacgucaugcucgagaacuacuccaaccugguguuccuggggaucguggucagcaagccggaccucaucgcgcaccuggagcagggcaagaagccccugaccaugaagcggcacgagaugguggccaaccccuccgugaucugcagccacuucgcccaggaccucuggcccgagcagaacaucaaggacuccuuccagaaggucauccugcgccgguacgagaagcgcgggcacggcaaccugcagcucaucaagcggugcgagagcguggacgagugcaaggugcacaccgggggcuacaacggccugaaccagugcuccacgaccacccagagcaaggucuuccagugcgacaaguacgggaagguguuccacaaguucuccaacagcaaccgccacaacauccggcacacggagaagaagccguucaagugcaucgagugcggcaaggccuucaaccaguucuccacccugaucacccacaagaagauccacaccggggagaagcccuacaucugcgaggagugcggcaaggccuucaaguacagcuccgcgcucaacacgcacaagcgcauccacaccggggagaagcccuacaagugcgacaagugcgacaaggccuucaucgccagcuccacccugagcaagcacgagaucauccacaccggcaagaagcccuacaagugcgaggagugcggcaaggccuucaaccaguccagcacgcugaccaagcacaagaagauccacaccggggagaagccguacaagugcgaggagugcggcaaggcguucaaccaguccagcacccucacgaagcacaagaagauccacaccggggagaagcccuacgugugcgaggagugcggcaaggccuucaaguacagccggauccugaccacccacaagcgcauccacacgggcgagaagcccuacaagugcaacaagugcgggaaggccuucaucgccuccagcacccugucccggcacgaguucauccacaugggcaagaagcacuacaagugcgaggagugcgggaaggccuucaucuggagcuccguccucacccgccacaagcgggugcacaccggcgagaagcccuacaagugcgaggagugcgggaaggcguucaaguacagcuccacgcugagcucccacaagcgcagccacaccggcgagaagccguacaagugcgaggagugcggcaaggccuucguggccuccagcacccuguccaagcacgagaucauccacaccgggaagaagcccuacaagugcgaggagugcggcaaggccuucaaccagagcuccagccucacgaagcacaagaagauccacaccggggagaagcccuacaagugcgaggagugcggcaaggccuucaaccaguccagcucccugaccaagcacaagaagauccacaccggggagaagcccuacaagugcgaggagugcggcaaggcguucaaccagagcagcacgcugaucaagcacaagaagauccacacccgggagaagccguacaagugcgaggagugcggcaaggccuuccaccucuccacccaccugaccacgcacaagauccugcacaccggggagaagcccuaccgcugccgggagugcggcaaggccuucaaccacagcgccacccucuccagccacaagaagauccacuccggggagaagcccuacgagugcgacaagugcggcaaggccuucaucagccccuccagccugucccgccacgagaucauccacaccggggagaagccguga

SEQ ID NO: 39145 - RNA, 1719 nt, Artificial Sequence
  derived and/or modified sequence opt1 from ZNF98__Homo_sapiens__NP_001092096
augcccggcccgcuggggagccucgagaugggcgugcugaccuuccgcgacgucgcccuggaguucucccucgaggaguggcagugccuggacaccgcccagcagaaccuguaccggaacgugaugcucgagaacuaccgcaaccugguguucgucgggaucgcggccagcaagcccgaccugaucacgugccucgagcagggcaaggagcccuggaacgugaagcggcacgagauggugaccgagcccccggucguguacuccuacuucgcccaggaccuguggcccaagcaggggaagaagaacuacuuccagaaggugauccugcgcaccuacaagaagugcggccgggagaaccuccagcugcgcaaguacugcaagagcauggacgagugcaagguccacaaggagugcuacaacggccugaaccagugccucaccacgacccagaacaagaucuuccaguacgacaaguacgugaagguguuccacaaguucuccaacagcaaccggcacaagaucgggcacaccggcaagaaguccuucaagugcaaggagugcgagaaguccuucugcaugcugagccaccuggcccagcacaagcgcauccacagcggggagaagcccuacaagugcaaggagugcggcaaggccuacaacgaggcguccaaccucagcacccacaagcggauccacacggggaagaagcccuacaagugcgaggagugcggcaaggccuucaaccgccugucccaccugaccacccacaagaucauccacaccggcaagaagccguacaagugcgaggagugcgggaaggccuucaaccagagcgccaaccucacgacccacaagcggauccacaccggcgagaagcccuacaagugcgaggagugcgggcgcgcguucucccagagcuccacccugacggcccacaagaucauccacgccggcgagaagcccuacaagugcgaggagugcggcaaggccuucagccaguccagcacccugaccacccacaagaucauccacacgggggagaaguucuacaagugcgaggagugcggcaaggccuucagccggcucucccaccugaccacccacaagcgcauccacagcggggagaagcccuacaagugcgaggagugcggcaaggcguucaagcaguccagcacccugacgacccacaagcggauccacgccggggagaaguucuacaagugcgaggucugcuccaaggccuucagccgcuucucccaccucaccacccacaagcggauccacacgggcgagaagccguacaagugcgaggagugcggcaaggccuucaaccugagcucccagcugaccacccacaagaucauccacaccggggagaagcccuacaagugcgaggagugcggcaaggccuucaaccagagcuccacgcucagcaagcacaaggugauccacaccggggagaagcccuacaagugcgaggagugcggcaaggcguucaaccaguccagccaccugaccacccacaagaugauccacacgggggagaagcccuacaagugcgaggagugcggcaaggccuucaacaacuccagcauccugaaccgccacaagaugauccacaccggcgagaagcucuacaagccggaguccugcaacaacgccugcgacaacaucgccaagaucagcaaguacaagcggaacugcgccggggagaaguga

SEQ ID NO: 39146 - RNA, 5757 nt, Artificial Sequence
  derived and/or modified sequence opt1 from ZNFX1__Homo_sapiens__NP_066363
auggaggagcgccggccccaccuggacgcccgcccccggaacagccacaccaaccaccgcggccccguggacggcgagcugccgccccgcgcccgcaaccaggcgaacaacccgcccgccaacgcccugcggggcggggccucccaccccggccgccacccccgggccaacaaccaccccgcggccuacuggcagcgcgaggagcgguuccgcgccauggggcggaacccccaccagggccgccggaaccaggagggccacgccagcgacgaggcgcgcgaccagcggcacgaccaggagaacgacacccgcuggcggaacgggaaccaggacugccgcaaccggcggccgcccugguccaacgacaacuuccagcaguggcgcacgccccaccagaagcccaccgagcagccccagcaggccaagaagcugggcuacaaguuccucgagagccugcugcagaaggaccccuccgaggucgugaucacccucgccaccagccuggggcugaaggagcuccugucccacagcuccaugaaguccaacuuccuggagcucaucugccaggugcugcggaaggccugcuccagcaagauggaccgccaguccguccugcacgugcucggcauccugaagaacagcaaguuccugaaggugugccucccggccuacgucguggggaugaucaccgagcccauccccgacauccggaaccaguaccccgagcacaucuccaacaucaucagccugcugcaggaccucguguccgucuucccggcgagcuccgugcaggagaccagcaugcuggugagccugcuccccaccucccugaacgcccugcgcgccagcggcgucgacaucgaggaggagaccgagaagaaccucgagaaggugcagacgaucaucgagcaccuccaggagaagcggcgcgagggcacccugcggguggacaccuacacccucguccagcccgaggccgaggaccacguggaguccuaccgcacgaugcccaucuacccgaccuacaacgaggugcaccuggacgagcggcccuuccugcgccccaacaucaucagcgggaaguacgacuccaccgccaucuaccucgacacccacuuccggcugcugcgcgaggacuucguccggccccuccgcgagggcauccuggagcugcuccagagcuucgaggaccaggggcugcggaagcgcaaguucgacgacauccggaucuacuucgacacgcgcaucaucaccccgaugugcuccagcuccggcaucguguacaaggugcaguucgacaccaagccccugaaguucguccgguggcagaacagcaagcgccuccuguacggcucccuggugugcaugagcaaggacaacuucgagaccuuccucuucgcgacgguguccaaccgcgagcaggaggaccugugccgggggaucguccagcugugcuucaacgagcagagccagcagcuccuggccgaggugcagcccuccgacagcuuccugauggucgagaccaccgccuacuucgaggccuaccgccacgugcuggagggccuccaggaggugcaggaggaggacgucccguuccagcggaacaucguggagugcaacucccacgugaaggagccccgcuaccugcugaugggcgggcgguacgacuucacgccccugaucgagaaccccagcgccacgggggaguuccugcgcaacgucgagggccugcggcacccgcgcaucaacgugcucgaccccggccaguggcccuccaaggaggcgcugaagcuggacgacagccagauggaggcccuccaguucgcccugacccgggagcuggccaucauccaggggcccccgggcaccgggaagaccuacgugggccucaagaucguccaggcccugcugacgaacgagagcguguggcagaucucccuccagaaguuccccauccugguggucugcuacaccaaccacgcgcuggaccaguuccucgaggggaucuacaacugccagaagaccagcaucgugcgcgugggcggccgguccaacagcgagauccugaagcaguucacccugcgcgagcuccggaacaagcgcgaguuccggcgcaaccugcccaugcaccuccggcgcgccuacauguccaucaugacgcagaugaaggagagcgagcaggagcuccacgagggggccaagacccuggagugcaccaugcggggcguccugcgcgagcaguaccuccagaaguacaucagcccccagcacugggagagccugaugaacgggccggugcaggacuccgaguggaucugcuuccagcacuggaagcacagcaugaugcuggaguggcucggccugggggugggcuccuucacccagagcgucucccccgccggccccgagaacacggcgcaggccgagggggacgaggaggaggagggcgaggaggagagcucccugaucgagaucgccgaggaggccgaccucauccaggccgaccgggugaucgaggaggaggaggugguccgcccccagcgccggaagaaggaggagagcggggcggaccaggagcuggccaagaugcugcucgccaugcgccuggaccacugcggcaccggcaccgccgccgggcaggagcaggcgaccggcgaguggcagacccagcggaaccagaagaagaagaugaagaagcgcgugaaggacgagcugcggaagcucaacacgaugaccgccgccgaggccaacgagaucgaggacguguggcagcuggaccuguccagccgcuggcagcucuaccggcuguggcugcagcucuaccaggccgacacccgccggaagauccugagcuacgagcgccaguaccggaccuccgcggagcgcauggccgagcugcggcuccaggaggaccugcacauccugaaggacgcccaggucguggggaugacgaccaccggcgccgcgaaguaccgccagauccuccagaagguggagccgcggaucgucaucguggaggaggccgccgaggugcuggaggcccacaccaucgccacgcugagcaaggcgugccagcaccucauccugaucggggaccaccagcagcugcgccccuccgccaacgucuacgaccucgccaagaacuucaaccuggaggugagccuguucgagcggcucgugaaggucaacauccccuucgugcgccugaacuaccagcaccggaugugccccgagaucgcccgccugcucaccccgcacaucuaccaggaccuggagaaccaccccuccgugcugaaguacgagaagaucaagggcgucagcuccaaccucuucuucguggagcacaacuuccccgagcaggagauccaggagggcaagagccaccagaaccagcacgaggcccacuucguggucgagcugugcaaguacuuccugugccaggaguaccuccccucccagaucaccauccugaccacguacaccgggcagcuguucugccuccgcaagcugaugccggcgaagaccuucgccggcgugcgggugcacgucguggacaaguaccagggggaggagaacgacaucauccugcucagccuggugcgcuccaaccaggagggcaaggucggguuccugcagaucagcaaccggaucugcguggcccucucccgcgccaagaagggcauguacugcaucggcaacaugcagaugcuggccaaggugccccuguggagcaagaucauccacacccuccgggagaacaaccagaucgggcccaugcugcgccugugcugccagaaccacccggagacgcacacccucgucuccaaggcgagcgacuuccagaaggugcccgagggcgggugcucccugcccugcgaguuccggcugggcugcgggcacgugugcacccgcgccugccaccccuacgacagcucccacaaggaguuccagugcaugaagccgugccagaaggucaucugccaggagggccaccggugcccccucgugugcuuccaggagugccagcccugccaggucaaggugcccaagaccaucccgcgcugcggccacgagcagauggugcccugcagcguccccgagagcgacuucugcugccaggagcccugcuccaagagccugcggugcgggcaccgcugcucccacccgugcggcgaggacugcgugcagcugugcagcgagauggugacgaucaagcucaagugcgggcacucccagcccgucaagugcggccacguggaggggcugcuguacggcggccuccuggugaagugcaccaccaagugcgggaccauccuggacugcggccaccccugccccgggagcugccacuccugcuucgagggccgguuccacgagcgcugccagcagccgugcaagcggcugcucaucugcagccacaagugccaggagcccugcaucggcgagugcccgcccugccagcgcacgugccagaaccggugcguccacucccagugcaagaagaagugcggggagcugugcagcccgugcguggagcccugcguguggcgcugccagcacuaccagugcaccaagcugugcuccgagcccugcaaccggcccccgugcuacguccccugcaccaagcuccuggugugcggccaccccugcaucgggcugugcggcgagcccugcccgaagaagugccgcaucugccacauggacgaggugacccagaucuucuucggguucgaggacgagcccgacgcccgguucguccagcucgaggacugcagccacaucuucgaggugcaggcccuggaccgcuacaugaacgagcagaaggacgacgagguggcgauccgccugaaggucugccccaucugccaggugccgauccggaagaaccuccgcuacggcacguccaucaagcagcggcuggaggagaucgagaucaucaaggagaagauccagggcagcgccggggagaucgccaccucccaggagcgccugaaggcccuccuggagcgcaagagccugcuccaccagcugcugcccgaggacuuccucaugcugaaggagaagcuggcccagaagaaccucuccgugaaggaccugggccuggucgagaacuacaucagcuucuacgaccaccucgcgucccugugggacagccugaagaagaugcacgugcucgaggagaagcgggugcggacccgccuggagcagguccacgaguggcuggccaagaagcggcucagcuucaccucccaggagcugagcgaccugcgcuccgagauccagcggcucacguaccuggugaaccugcucacccgcuacaagaucgccgagaagaaggugaaggacagcaucgccgucgagguguacuccgugcagaacauccuggagaagaccugcaaguucacccaggaggacgagcagcugguccaggagaagauggaggcccucaaggcgacgcugcccugcagcgggcugggcaucuccgaggaggagcgggugcagaucgugagcgccaucggguacccccgcggccacugguucaagugccggaacggccacaucuacgucaucggggacugcggcggggccauggagcgcgggaccugcccggacugcaaggaggugaucgggggcaccaaccacacccucgagcgguccaaccagcuggccagcgagauggacggcgcccagcacgcggccugguccgacaccgccaacaaccugaugaacuucgaggagauccaggggaugauguga

SEQ ID NO: 39147 - RNA, 1212 nt, Artificial Sequence
  derived and/or modified sequence opt1 from ZNHIT2__Homo_sapiens__NP_055020
auggagcccgccggcccgugcggguucugccccgccggcgaggugcagcccgcccgcuacacgugcccccggugcaacgccccguacugcagccugcgcugcuaccggacccacgggacgugcgccgagaacuucuaccgcgaccagguccucggcgagcugcgggggugcuccgccccgcccagccgccuggccuccgcgcuccggcgccugcggcagcagcgcgagaccgaggacgagcccggcgaggccggccugagcuccgggcccgcccccggcgggcucagcggccugugggagcggcuggcccccggggagaaggcggccuucgagcgccuccugucccggggcgaggccggccgccugcugcccccguggcggcccuggugguggaaccgcggggccggcccccagcuccuggaggagcucgacaacgcccccgggagcgacgcggccgagcuggagcuggccccggcccggaccccgcccgacuccgugaaggacgccagcgcggccgagcccgccgccgccgagcgcgugcucggcgacguccccggcgcgugcacccccguggugcccacccggauccccgccaucgucucccugagccgcgggccggugagcccccuggugcgguuccagcuccccaacguccuguucgccuacgcccacacccuggcccucuaccacggcggggacgacgcgcugcuguccgacuucugcgccacccuccugggcguguccggggcccugggcgcccagcaggucuucgcgagcgccgaggaggcccuccaggccgccgcgcacgugcuggaggccggcgagcacccgcccgggccccugggcacccgcggggccaugcacgagguggcccgcauccuccugggcgaggggcccacgaaccagaagggcuacacccuggccgcgcucggcgaccuggcccagacccuggggcgggcccgcaagcaggccguggcccgggaggagcgcgaccaccucuaccgggcgcgcaagaagugccaguuccugcuggccuggaccaacgagaacgaggccgcccucacgccgcuggcgcuggacugcgcccgggcccaccaggcccacgccgucguggcggaggagguggccgcccucaccggcgagcuggagcgccuguggggcgggcccgucccgcccgcgccccggacccucaucgaggagcugcccuccuga

SEQ ID NO: 39148 - RNA, 468 nt, Artificial Sequence
  derived and/or modified sequence opt1 from ZNHIT3__Homo_sapiens__NP_004764
auggccagccugaagugcuccaccguggucugcgugaucugccucgagaagcccaaguaccgcugcccggccugccgggugcccuacugcagcgucgugugcuuccgcaagcacaaggagcagugcaaccccgagacccggcccguggagaagaagauccgcuccgcgcugccgacgaagaccgucaagcccguggagaacaaggacgacgacgacagcaucgccgacuuccugaacuccgacgaggaggaggaccgggugagccuccagaaccugaagaaccugggcgaguccgccacccuccgcagccugcugcucaacccccaccuccggcagcugauggucaaccuggaccagggggaggacaaggccaagcugaugcgcgccuacaugcaggagccccuguucguggaguucgcggacugcugccucggcaucguggagccgucccagaacgaggagagcuga

SEQ ID NO: 39149 - RNA, 381 nt, Artificial Sequence
  derived and/or modified sequence opt1 from ZNRD1__Homo_sapiens__NP_001265715
augagcgugauggaccuggccaacacgugcuccagcuuccaguccgaccucgacuucugcagcgacugcggcuccguccugccccugccgggggcccaggacaccgugaccugcauccgcugcggcuucaacaucaacgugcgggacuucgaggggaaggucgugaagaccagcguggucuuccaccagcucggcaccgcgaugcccauguccguggaggaggggcccgagugccagggccccguggucgaccgccggugcccgcgcugcggccacgaggggauggccuaccacacccggcagaugcgcagcgccgacgagggccagaccguguucuacacgugcaccaacugcaaguuccaggagaaggaggacuccuga

SEQ ID NO: 39150 - RNA, 2811 nt, Artificial Sequence
  derived and/or modified sequence opt1 from ZNRF3__Homo_sapiens__NP_001193927
augcgcccccggagcggcgggcgcccgggcgccaccgggcggcgccggcgccggcugcgccggcgcccccggggccuccgcugcucccggcugccgccgcccccgccccugccccuccugcuggggcuccugcuggccgcggccggccccggcgccgcccgcgccaaggagaccgcguucguggaggucguccucuucgagagcucccccagcggggacuacacgaccuacaccaccggccugacggggcgguucucccgcgccggcgccacccugagcgccgagggggagaucgugcagaugcacccccucggccugugcaacaacaacgacgaggaggaccuguacgaguacggcugggucgggguggugaagcucgagcagcccgagcuggaccccaagcccugccugaccguccucggcaaggcgaagcgggccgugcagcgcggggccaccgccgugaucuucgacgucuccgagaaccccgaggccaucgaccagcugaaccagggcagcgaggacccccugaagcggccggugguguacgucaagggcgcggacgccaucaagcucaugaacaucgugaacaagcagaagguggcccgcgcccggauccagcaccgcccgccccgccagcccacggaguacuucgacauggggaucuuccuggccuucuucgucguggugucccuggucugccucauccugcuggugaagaucaagcucaagcagcggcgcagccagaacuccaugaaccggcuggcggugcaggcccuggagaagauggagacccgcaaguucaacagcaaguccaagggccggcgcgaggggagcugcggcgcccucgacacccuguccagcuccagcaccuccgacugcgccaucugccuggagaaguacaucgacggggaggagcuccgggucauccccugcacgcaccgcuuccaccggaagugcguggaccccuggcugcugcagcaccacacgugcccccacugccgccacaacaucaucgagcagaagggcaaccccagcgccgugugcguggagaccagcaaccucucccggggccgccagcagcgggugacccugccgguccacuaccccgggcgcgugcaccggaccaacgcgauccccgccuaccccacccgcaccagcauggacucccacggcaacccggugacccugcucacgauggaccggcacggggagcagagccuguacagcccccagacccccgccuacauccgcagcuacccgccccugcaccucgaccacucccuggccgcccaccggugcggccuggagcaccgcgcguacagccccgcccaccccuuccgccggccgaagcucuccgggcgcagcuucuccaaggccgccugcuucagccaguacgagaccauguaccagcacuacuacuuccagggccuguccuaccccgagcaggagggccagagcccgcccucccuggcgccccgggggcccgcccgcgccuucccgcccagcggcuccgggagccuccuguuccccaccgucgugcacguggccccgcccucccaccuggagagcggcagcacguccagcuucuccugcuaccacgggcaccggagcgucugcuccggcuaccuggccgacugccccggcagcgacuccagcuccagcuccagcuccgggcagugccacugcagcuccagcgacuccgugguggacugcaccgaggucagcaaccagggcguguacgggagcugcuccaccuuccgcagcucccucagcuccgacuacgaccccuucaucuaccggagccgcucccccugccgggcgagcgaggccggcggcuccgggagcuccggccgcgggcccgcccugugcuucgagggcagcccgccgcccgaggagcugcccgccgugcacucccacggggccggccggggcgagcccuggcccgggcccgcgucccccuccggcgaccaggucagcacgugcucccucgagaugaacuacagcuccaacagcagccuggagcaccgcgggccgaacuccagcaccuccgaggugggccuggaggccagccccggggccgcccccgaccuccggcgcaccuggaagggcggccacgagcugcccuccugcgccugcugcugcgagccgcagcccagccccgcggggcccuccgccggcgccgccgggagcuccacccuguuccucggcccgcaccuguacgaggggagcggccccgcgggcggggagccccaguccggcagcucccaggggcuguacggccuccaccccgaccaccucccgcggaccgacggggugaaguacgagggccugcccugcugcuucuacgaggagaagcaggucgcccgcggcgggggcgggggcagcggcugcuacacggaggacuacuccgugagcgugcaguacacccugaccgaggagccgccgcccgggugcuaccccggcgcccgggaccugucccagcgcauccccaucauccccgaggacgucgacugcgaccuggggcuccccagcgacugccagggcacccacucccuggggagcuggggcggcacgcgggggcccgacacgccccgcccccaccggggccugggggccacccgcgaggaggagcgcgcccucugcugccaggcgcgggcccugcugcgcccgggcugcccgcccgaggaggccggggccgugcgggccaacuuccccagcgcgcuccaggacacccaggaguccagcaccaccgccaccgaggccgccggcccccgcucccacagcgccgacuccagcucccccggcgcguga

SEQ ID NO: 39151 - RNA, 1917 nt, Artificial Sequence
  derived and/or modified sequence opt1 from ZP1__Homo_sapiens__NP_997224
auggccggcgggagcgccaccaccuggggcuaccccguggcgcugcuccugcuggucgccacgcucgggcugggccgcuggcugcagccggaccccgggcuccccggccugcggcacuccuacgacugcggcaucaaggggaugcagcugcucguguucccccgcccgggccagacccugcgguucaagguggucgacgaguucgggaaccgcuucgacgugaacaacugcagcaucugcuaccacugggugaccucccggccccaggagcccgccgucuucagcgccgacuaccgcggcugccacgugcuggagaaggacgggcgguuccaccuccgcguguucauggaggccguccugcccaacggccggguggacguggcgcaggacgccacccugaucugcccgaagcccgaccccucccgcacgcucgacagccagcuggcgcccccggccauguucuccgucagcacgccccagacccuguccuuccuccccaccagcggccacaccucccaggggagcggccacgccuuccccuccccgcuggaccccgggcacagcuccgugcaccccacccccgcccugccgagccccggccccggccccacccucgccacccuggcccagccgcacugggggacgcuggagcacugggacgugaacaagcgggacuacaucggcacccaccucucccaggagcagugccaggucgccagcgggcaccuccccugcaucgugcgccggaccuccaaggaggcgugccagcaggccggcugcugcuacgacaacacccgcgaggugcccugcuacuacgggaacacggccaccguccagugcuuccgggacggcuacuucgugcugguggucagccaggagauggcccugacccaccgcaucacccuggccaacauccaccuggcguacgcccccacgagcugcuccccgacccagcacaccgaggccuucgugguguucuacuucccccucacccacugcggcacgaccaugcaggucgccggggaccagcugaucuacgagaacuggcuggugagcggcauccacauccagaaggggccccagggcuccaucacccgggacagcaccuuccagcuccacguccgcugcguguucaacgccuccgacuuccugccgauccaggcgagcaucuucccgccgcccucccccgcccccaugacgcagcccgggccccugcggcucgagcugcgcaucgccaaggacgagaccuucagcuccuacuacggcgaggacgacuaccccaucgugcggcugcuccgcgagcccguccacguggaggugcgccugcugcagcggaccgaccccaaccucguccugcugcuccaccagugcuggggcgcccccagcgccaacccguuccagcagccccaguggcccauccuguccgacgggugccccuucaagggcgacagcuaccgcacccagaugguggcgcuggacggggccacgccguuccagucccacuaccagcgguucaccguggccaccuucgcccuccuggacagcggcucccagcgcgcgcugcgggggcuggucuaccucuucugcagcaccuccgccugccacacgagcggccuggagaccugcuccaccgccugcagcaccggcaccacgcgccagcggcgcagcuccgggcaccggaacgacaccgcccgcccccaggacaucgugagcucccccggccccgugggguucgaggacagcuacggccaggagccgacccugggccccaccgacuccaacgggaacagcucccuccggccccugcugugggccguccuccugcugcccgcgguggcccucgugcugggcuucggggucuucgugggccugagccagacgugggcccagaagcucugggaguccaaccgccaguga

SEQ ID NO: 39152 - RNA, 1623 nt, Artificial Sequence
  derived and/or modified sequence opt1 from ZP4__Homo_sapiens__NP_067009
auguggcugcuccgcugcgugcugcugugcgucagccucucccuggccgugagcggccagcacaagcccgaggccccggacuacuccagcgugcugcacugcgggcccugguccuuccaguucgcggucaaccucaaccaggaggccaccagcccgcccgugcugaucgccugggacaaccagggccugcuccacgagcugcagaacgacuccgacugcgggaccuggauccggaagggccccgggagcuccgugguccuggaggccacguacagcuccugcuacgugaccgagugggacagccacuacaucaugcccgugggcgucgagggcgccggggcggccgagcacaagguggugaccgagcgcaagcuccugaagugccccauggaccugcucgcccgggacgcccccgacaccgacuggugcgacuccaucccggcgcgcgaccggcugcccugcgcccccagccccaucucccgcggcgacugcgaggggcugggcugcugcuacagcuccgaggaggucaacagcugcuacuacgggaacacggugacccuccacugcacccgggagggccacuucuccaucgccgugagccgcaacgucaccagcccgccccugcugcucgacuccgugcggcuggcccugcgcaacgacagcgccugcaaccccgugauggcgacgcaggccuucguccucuuccaguuccccuucaccuccugcggcaccacccggcagaucacgggggaccgcgccguguacgagaacgagcugguggccacccgggacgucaagaacggcagccgcggguccgugacccgggacagcaucuuccgccugcacguguccugcagcuacuccgucagcuccaacagccucccgaucaacgugcaggucuucacccugcccccgcccuuccccgagacgcagcccggcccccugacccucgagcugcagaucgccaaggacaagaacuacggcuccuacuacggggugggcgacuaccccguggucaagcugcuccgggacccgaucuacguggaggugagcauccugcaccgcaccgaccccuaccuggggcuccugcugcagcagugcugggcgacccccuccacggacccccucagccagccgcaguggcccauccuggucaagggcugccccuacaucggggacaacuaccagacccagcugaucccggugcagaaggcccucgaccugcccuuccccucccaccaccagcgguucagcaucuucaccuucuccuucgugaaccccaccgucgagaagcaggcccugcgcggcccggugcaccuccacugcagcgugagcgucugccagcccgccgagacgcccuccugcguggugaccugccccgaccugagccggcgccgcaacuucgacaacuccagccagaacaccaccgccuccgucagcuccaagggcccgaugauccugcuccaggcgacgaaggacccgcccgagaagcugcgggugcccguggacagcaagguccuguggguggccgggcuguccggcacccucauccugggggcccugcucgugagcuaccuggccgucaagaagcagaaguccugccccgaccagaugugccaguga

SEQ ID NO: 39153 - RNA, 951 nt, Artificial Sequence
  derived and/or modified sequence opt1 from ZPBP2__Homo_sapiens__NP_942141
augaugcggaccugcgugcugcucagcgccguccuguggugccugaccggcgacaagaucuacguggagcuccaccagaacucccccgugcugaucugcauggacuucaagcugagcaagaaggagaucgucgacccgacguaccucuggaucgggcccaacgagaagacccugaccggcaacaaccgcaucaacaucaccgagacggggcagcugauggugaaggacuuccucgagccccuguccggccuguacacgugcacccucagcuacaagaccgugaaggccgagacccaggaggagaagaccgucaagaagcgcuacgacuucaugguguucgcguaccgggagcccgacuacuccuaccagauggccgugcgcuucaccacccggagcugcaucgggcgcuacaacgacgucuucuuccgggugcugaagaagauccuggacucccucaucagcgaccuguccugccacgugaucgagccgagcuacaagugccacuccgucgagauccccgagcacggccugauccacgagcuguucaucgccuuccaggugaaccccuucgcccccggcuggaagggggccugcaacggcagcguggacugcgaggacacgaccaaccacaacauccuccaggcgcgcgaccggaucgaggacuucuuccgcucccaggccuacaucuucuaccacaacuucaacaagacccugccggccaugcacuucgucgaccacagccuccagguggugcggcuggacuccugccgccccggguucggcaagaacgagcggcugcacagcaacugcgccuccugcugcgucgugugcagccccgcgaccuucucccccgacgugaacgucacgugccagaccugcgugagcgugcucaccuacggggccaagagcugcccgcagaccuccaacaagaaccagcaguacgaggacuga

SEQ ID NO: 39154 - RNA, 1296 nt, Artificial Sequence
  derived and/or modified sequence opt1 from ZPLD1__Homo_sapiens__NP_778226
augaugcugcgcuucagcaugugccggggcaacgacgagggguucgccauggagcagaucuggcuccugcugcuccugaccauccgcgugcugcccggcuccgcccaguucaacggguacaacugcgacgcgaaccuccacagccgguucccggccgagcgcgacaucuccgucuacugcggcgugcaggccaucaccaugaagaucaacuucugcacggugcuguucagcggguacuccgagaccgaccuggcccucaacggccggcacggcgacagccacugccgcggguucaucaacaacaacaccuuccccgccgucgugaucuucaucaucaaccuguccacccuggagggcugcgggaacaaccucguggucagcacgauccccggcguguccgcguacgggaacgccaccagcgugcaggucggcaacaucuccggcuacaucgacacccccgacccgcccaccaucaucagcuaccugcccgggcugcucuacaaguucuccugcagcuacccccuggaguaccuggugaacaacacgcagcucgccuccagcuccgccgcgaucagcgugcgggagaacaacggcaccuucgucuccacccugaaccugcuccuguacaacgacagcaccuacaaccagcagcugaucaucccgagcaucgggcucccccugaagacgaagguguucgccgccgugcaggccaccaaccuggacggccgcuggaacguccucauggacuacugcuacaccacccccuccggcaaccccaacgacgacauccgguacgaccuguuccugagcugcgacaaggacccgcagacgaccgugaucgagaacgggcgcucccagcggggccgcuucagcuucgagguguuccgguucgucaagcacaagaaccagaagauguccaccguguuccuccacugcgugaccaagcugugccgcgccgacgacugccccuuccugaugcccaucugcagccaccgggagcgccgggacgcggggcgccggacgaccuggagcccccaguccuccagcggcuccgccguccucagcgccgggccgaucaucacccgcuccgacgagacccccacgaacaacagccagcugggcucccccagcaugcccccguuccagcugaacgccaucaccuccgcccucaucagcggcauggugauccugggggugaccuccuucagccugcuccugugcagccuggcgcuccugcaccggaagggccccaccucccugguccucaacgggauccgcaaccccguguucgacuga

SEQ ID NO: 39155 - RNA, 1380 nt, Artificial Sequence
  derived and/or modified sequence opt1 from ZPR1__Homo_sapiens__NP_003895
auggccgccagcggcgcgguggagcccgggccgcccggcgccgccgucgcccccucccccgccccggcgcccccgcccgcccccgaccaccuguuccgccccaucagcgccgaggacgaggagcagcagcccaccgagaucgagucccucugcaugaacugcuacugcaacgggaugacccggcugcugcucacgaagauccccuucuuccgcgagaucaucgugagcuccuucagcugcgagcacugcggcuggaacaacaccgagauccaguccgccgggcggauccaggaccagggcgugcgcuacacccugagcguccgggcgcuggaggacaugaaccgcgagguggugaagaccgacuccgccgccacgcggaucccggagcucgacuucgagauccccgccuucagccagaagggcgcccugaccaccgucgaggggcugaucacccgcgcgaucuccggccucgagcaggaccagcccgcccggcgcgccaacaaggacgccacggccgagcggaucgacgaguucaucgugaagcugaaggagcugaagcaggucgcgagccccuucacccucaucaucgacgacccguccgggaacagcuucguggagaacccccacgcgccccagaaggacgacgcccuggugaucacccacuacaaccgcacccggcagcaggaggagaugcugggccuccaggaggaggcccccgccgagaagccggaggaggaggaccugcgcaacgaggugcugcaguucuccacgaacugccccgagugcaacgcccccgcccagaccaacaugaagcucguccagaucccccacuucaaggaggugaucaucauggccaccaacugcgagaacugcgggcaccggaccaacgaggucaagagcggcggcgccguggagccgcuggggacgcgcaucacccugcacaucaccgacgccuccgacaugacccgggaccuccucaagagcgagacgugcuccguggagauccccgagcuggaguucgagcugggcauggcggugcucgggggcaaguucaccacccuggagggccugcugaaggacauccgcgagcuggucaccaagaaccccuucacgcucggggacagcagcaaccccggccagaccgagcggcugcaggaguucucccagaagauggaccagaucaucgaggggaacaugaaggcccacuucaucauggacgacccggccggcaacagcuaccugcagaacguguacgcccccgaggacgaccccgagaugaagguggagcgcuacaagcggaccuucgaccagaacgaggagcucgggcugaacgacaugaagaccgagggcuacgaggcgggccuggccccgcagcgcuga

SEQ ID NO: 39156 - RNA, 3234 nt, Artificial Sequence
  derived and/or modified sequence opt1 from ZRANB3__Homo_sapiens__NP_001273497
augccccgcgugcacaacaucaagaagucccugaccccgcacaucagcugcgucaccaacgagagcgacaaccuccuggacuuccugcccgaccggcuccgcgccaagcugcugcccuuccagaaggacggcaucaucuucgcccucaagcggaacgggcgcugcaugguggcggacgagaugggccuggggaagacgauccaggccaucggcaucaccuacuucuacaaggaggaguggccccugcucaucguggucccguccagccugcgguaccccuggaccgaggagaucgagaaguggauccccgagcugucccccgaggagaucaacgugauccagaacaagaccgacgugcgccggaugagcacguccaaggucaccgugcucggguacggccugcugaccgccgacgccaagacccucaucgacgcccugaacaaccagaacuucaagguggucaucguggacgagagccacuacaugaagucccgcaacgcgacgcggagccgcauccugcucccgaucgugcagaaggcccggcgcgccauccugcugaccggcacccccgcccucgggcggcccgaggagcuguucaugcagaucgaggcgcuguucccccagaaguucggccgcuggaccgacuacgccaagcgguacugcaacgcccacauccgcuacuucgggaagcggccgcagugggacugccgcggcgccuccaaccucaacgagcugcaccagcugcucagcgacaucaugauccggcgccugaagacggagguccugacccagcucccgcccaaggugcggcagcgcauccccuucgaccugcccuccgccgcggccaaggagcugaacaccagcuucgaggagugggagaagaucaugcgcacccccaacuccggggccauggagacggugaugggccucaucacccggauguucaagcagaccgccaucgccaaggcgggcgccgucaaggacuacaucaagaugaugcugcagaacgacagccugaaguuccucguguucgcccaccaccuguccaugcugcaggccugcaccgaggccgugaucgagaacaagacgcgcuacauccggaucgacgggagcgucuccagcagcgagcgcauccaccucgugaaccaguuccagaaggaccccgacacccggguggcgauccuguccauccaggccgccggccaggggcugaccuucaccgccgccagccacgucguguucgcggagcucuacugggaccccggccacaucaagcaggccgaggaccgcgcccaccggaucggccagugcuccagcgugaacauccacuaccugaucgccaacgggacgcuggacacccucauguggggcaugcugaaccgcaaggcgcaggucaccggguccacccugaacggccggaaggagaagauccaggccgaggagggggacaaggagaagugggacuuccuccaguucgccgaggccuggacgccgaacgacagcuccgaggagcugcgcaaggaggcccuguucacccacuucgagaaggagaagcagcacgacauccggagcuucuucgugccccagcccaagaagcgccagcugaugaccuccugcgacgagagcaagcgguuccgcgaggagaacaccgucguguccagcgaccccacgaagaccgcggcccgggacaucaucgacuacgaguccgacguggagccggagaccaagcgccucaagcuggccgccagcgaggaccacugcucccccagcgaggagacccccucccagagcaagcagauccggacgccccuggucgaguccgugcaggaggccaaggcgcagcucaccaccccggccuuccccguggagggcuggcagugcagccugugcaccuacaucaacaacagcgagcugcccuacugcgagaugugcgagaccccgcagggcuccgccgucaugcagaucgacagccucaaccacauccaggacaagaacgagaaggacgacucccagaaggacacgagcaagaaggugcagaccaucuccgacugcgagaagcaggcccuggcccagagcgagcccgggcagcuggcggacuccaaggaggagacccccaagaucgagaaggaggacggccucaccagccagcccgagcaguggaaguccagcgacacgcugccgguguacgacacccugauguucugcgccucccgcaacaccgaccggauccacaucuacaccaaggacgggaagcagaugagcugcaacuucaucccccucgacaucaagcuggaccugugggaggaccuccccgccuccuuccagcugaagcaguaccgcagccugauccuccgcuucguccgggagugguccagccugacggccaugaagcagcgcaucauccggaaguccggccagcuguucugcagccccauccucgcgcuggaggagaucaccaagcagcagaccaagcagaacugcaccaagcgcuacaucacgaaggaggacguggccguggccagcauggacaaggucaagaacgucgggggccacgugcggcugaucaccaaggagucccgcccgcgggaccccuucaccaagaagcuccuggaggacggcgccugcgugcccuuccugaaccccuacaccgugcaggccgaccucacggugaagccgagcaccuccaagggguaccugcaggcggucgacaacgagggcaacccccugugccuccgcugccagcagccgaccugccagaccaagcaggccugcaaggccaacagcugggacucccgguucugcagccugaagugccaggaggaguucuggauccgcuccaacaacagcuaccugcgggccaagguguucgagacggagcacggggugugccagcucugcaacgucaacgcccaggagcuguuccugcgccuccgggacgcgcccaagucccagcgcaagaaccugcuguacgccaccuggaccagcaagcucccccuggagcagcugaacgagaugauccggaaccccggcgaggggcacuucuggcaggucgaccacaucaagcccguguacggcggcgggggccagugcucccucgacaaccugcagacccugugcacggugugccacaaggagcgcaccgcccggcaggccaaggagcgcagccaggugcggcgccagucccucgccagcaagcacggguccgacaucacccgguuccuggugaagaaguga

SEQ ID NO: 39157 - RNA, 1449 nt, Artificial Sequence
  derived and/or modified sequence opt1 from ZRSR2__Homo_sapiens__NP_005080
auggccgcccccgagaagaugaccuucccggagaagcccagccacaagaaguaccgcgcggcccugaagaaggagaagcggaagaagcgccggcaggagcucgcccgccugcgggacuccggccugagccagaaggaggaggaggaggacaccuucaucgaggagcagcagcucgaggaggagaagcugcuggagcgcgagcggcagcgccuccacgaggaguggcugcugcgggagcagaaggcccaggaggaguuccgcaucaagaaggagaaggaggaggccgcgaagaagcggcaggaggagcaggagcgcaagcucaaggagcagugggaggagcagcagcggaaggagcgcgaggaggaggagcagaagcggcaggagaagaaggagaaggaggaggcccugcagaagaugcuggaccaggccgagaacgagcucgagaacgggacgaccuggcagaaccccgagcccccgguggacuuccgcgucauggagaaggaccgggccaacugccccuucuacuccaagaccggcgcgugccgcuucggggaccggugcagccgcaagcacaacuuccccaccuccagccccacgcugcugaucaaguccauguucaccaccuucggcauggagcagugccggcgcgacgacuacgacccggacgccagccucgaguacuccgaggaggagaccuaccagcaguuccuggacuucuacgaggacgugcugcccgaguucaagaacguggggaaggucauccaguucaaggugagcugcaaccucgagccccaccuccgcggcaacguguacguccaguaccaguccgaggaggagugccaggccgcccugagccuguucaacggccggugguacgccgggcgccagcugcagugcgaguucugccccgugacgcgguggaagauggcgaucugcggccuguucgagauccagcagugcccgcgcgggaagcacugcaacuuccuccacguguuccggaaccccaacaacgaguucugggaggccaaccgcgacaucuaccugucccccgaccggaccggcagcuccuucgggaagaacagcgagcgccgggagcgcaugggccaccacgacgacuacuacucccggcugcgcggccggcgcaaccccagcccggaccacuccuacaagcggaacggggagagcgagcgcaagagcucccggcaccgcggcaagaagucccacaagcggaccagcaagagccgcgagcgccacaacucccggagccgcgggcggaaccgcgaccggucccgcgaccggagccgcggccggggcucccgcagccggucccgcagccggucccgccggagccgccggucccgcagccaguccagcucccggagccgcagccgggggcgccgccgguccggcaaccgcgaccggaccguccagagccccaaguccaaguga

SEQ ID NO: 39158 - RNA, 1701 nt, Artificial Sequence
  derived and/or modified sequence opt1 from ZSCAN18__Homo_sapiens__NP_001139014
augcgccgggugggcgggcgcgccgacgaggacgccaccgcggccggcagccuguggguccuggcgccgcccgagcccaccgggcaccuggugauccccggcacgagcccccuggagccgcccugccccuggcucgacucccacaucuuccagugccgguucgggaagaugcugccccuggagaaggccuucgccuccccgcgcagcucccccgccccgcccgaccuccccacccccggcagcgccgccggcgugcagcaggaggagcccgagaccauccccgagcggaccccggccgaccuggaguucucccgccugcgguuccgcgaguucgucuaccaggaggcggccgggccccaccagacgcucgcccggcugcacgagcugugccgccaguggcucaugcccgaggcccggagcaaggagcagaugcuggagcugcucgugcuggagcaguuccugggcauccuccccgacaaggugcgcccgugggucguggcccaguaccccgaguccugcaagaaggcggccagccugguggaggggcuggccgacguccucgaggagcccggcaugcugcuggggucccccgccggcagcuccagcauccucuccgacggcguguacgagcggcacauggacccccugcugcuccccggggagcuggccagccccucccaggcgcugggcgccggggagauccccgccccgagcgagacccccuggcucucccccgacccgcuguuccuggagcagcgccgggugcgcgaggccaagaccgaggaggacggccccgccaacaccgagcagaagcucaagagcuuccccgaggacccccagcaccugggcgagugggggcaccuggacccggcggaggagaaccucaagagcuaccggaagcugcugcucuggggcuaccagcugucccagcccgacgccgccagccgccuggacacggaggagcuccggcuggucgagcgcgacccccagggguccagccugcccgagggcgggcggcgccaggaguccgccggcugcgccugcgaggaggcggccccggccggcgugcuccccgagcugcccaccgaggccccgcccggggacgcgcuggccgacccgcccagcggcaccaccgaggaggaggaggagcagcccgggaaggcccccgacccccaggacccccaggacgccgaguccgacagcgccacgggcucccagcgccagagcgugauccagcagcccgcgcccgaccgggggaccgccaagcucggcaccaagcgcccccaccccgaggacggcgacgggcagucccuggagggcgucagcuccagcggggacuccgccggccuggaggccgggcagggccccggcgccgacgagccggggcugagccggggcaagcccuacgcgugcggggagugcggcgaggccuucgccuggcucucccaccugauggagcaccacagcucccacggcgggcgcaagcgguacgccugccagggcugcuggaagaccuuccacuucagccuggcccucgcggagcaccagaagacgcacgagaaggagaaguccuacgcccucgggggcgcccgcgggccccagccgagcacccgggaggcccaggcgggcgcccgcgccggcgggccgcccgagagcguggagggcgaggcgccgcccgccccgcccgaggcccagcgguga

SEQ ID NO: 39159 - RNA, 1476 nt, Artificial Sequence
  derived and/or modified sequence opt1 from ZSCAN22__Homo_sapiens__NP_862829
auggccauccccaagcacagccuguccccggugcccugggaggaggacagcuuccugcaggucaagguggaggaggaggaggaggccucccugagccagggcggggaguccagccacgaccacaucgcgcacuccgaggccgcccgccugcgguuccgccacuuccgguacgaggaggccagcggcccccacgaggcccucgcgcaccuccgcgcccugugcugccaguggcugcagcccgaggcccacuccaaggagcagauccuggagcugcucgugcuggagcaguuccugggggcccucccgcccgagauccaggcgugggucggcgcccagagccccaaguccggggaggaggccgccgugcugguggaggaccugacccagguccucgacaagcggggcugggaccccggcgccgagccgaccgaggcgagcugcaagcaguccgaccugggggagagcgagcccuccaacgugacggagacccugaugggcggggugagccucggccccgccuucgucaaggccugcgagcccgagggguccagcgagcgcuccggccugagcggcgagaucuggaccaagagcgugacccagcagauccacuucaagaagacguccgggccguacaaggacgugcccaccgaccagcggggccgcgagagcggggccucccggaacagcuccagcgccuggcccaaccugaccucccaggagaagcccccgagcgaggacaaguucgaccucgucgacgcguacggcaccgagccgcccuacacguacuccggcaagcgcagcuccaagugccgggagugccgcaagauguuccagagcgccuccgcccuggaggcccaccagaagacccacagccggaagacccccuacgccugcuccgagugcgggaaggcguucagccgcuccacccaccuggcccagcaccagguggugcacacgggcgccaagccccacgagugcaaggagugcgggaaggccuucagccgggucacccaccucacccagcaccagcgcauccacaccggcgagaagcccuacaagugcggggagugcggcaagacguucucccggagcacccaccugacccagcaccagcgcgugcacaccggcgagcggcccuacgagugcgacgccugcgggaaggcguucagccaguccacgcaccugacccagcaccagcgcauccacaccggcgagaagcccuacaagugcgacgccugcgggcgggccuucagcgacugcuccgcccucauccgccaccuccgcauccacagcggcgagaagccguaccagugcaaggugugccccaaggcguucgcccaguccagcucccugaucgagcaccagcggauccacaccggggagaagcccuacaagugcagcgacugcggcaaggccuucucccgcagcuccgcccugaugguccaccuccggauccacaucacggugcugcaguga

SEQ ID NO: 39160 - RNA, 1437 nt, Artificial Sequence
  derived and/or modified sequence opt1 from ZSCAN26__Homo_sapiens__NP_001104509
auggccaccgcccuggugagcgcgcacucccucgcgccccugaaccugaagaaggagggccuccgcgucgugcgggaggaccacuacagcaccugggagcagggguucaagcugcagggcaacuccaaggggcugggccaggagccgcucugcaagcaguuccgccagcugcgguacgaggagacgaccgggccccgcgaggcccugagccggcuccgcgagcugugccagcaguggcugcagcccgagacccacaccaaggagcagauccucgagcugcuggugcucgagcaguuccugaucauccugcccaaggagcuccaggcccggguccaggagcaccacccggagucccgcgaggacgugguggucgugcuggaggaccugcagcucgaccugggcgagacgggccagcaggaccccgaccagcccaagaagcagaagauccugguggaggagauggcgccccucaaggggguccaggagcagcagguccggcacgagugcgaggugaccaagccggagaaggagaagggcgaggagacccgcaucgagaacgggaagcugaucguggugaccgacagcugcggccggguggaguccagcgggaagaucuccgagcccauggaggcccacaacgagggcagcaaccuggagcgccaccaggccaagcccaaggagaagaucgaguacaagugcuccgagcgggagcagcgcuucauccagcaccucgaccugaucgagcacgccagcacgcacaccggcaagaagcugugcgaguccgacgucugccagagcuccagccucaccgggcacaagaaggugcugucccgggagaagggccaccagugccacgagugcgggaaggccuuccagcgcagcucccaccuggugcggcaccagaagauccaccucggcgagaagcccuaccagugcaacgagugcggcaaggucuucagccagaacgccgggcugcuggagcaccuccgcauccacaccggcgagaagccguaccugugcauccacugcgggaagaacuuccggcgcagcucccaccugaaccggcaccagcgcauccacagccaggaggagcccugcgagugcaaggagugcggcaagacguucucccaggcccuccugcugacccaccaccagcgcauccacagccacuccaagagccaccagugcaacgagugcgggaaggccuucucccucaccagcgaccugauccggcaccaccgcauccacaccggcgagaagcccuucaagugcaacaucugccagaaggccuuccggcugaacucccaccucgcccagcacgugcgcauccacaacgaggagaagcccuaccagugcagcgagugcggcgaggcguuccggcagcgcuccgggcuguuccagcaccagcgguaccaccacaaggacaagcuggccuga

SEQ ID NO: 39161 - RNA, 744 nt, Artificial Sequence
  derived and/or modified sequence opt1 from ZSCAN31__Homo_sapiens__NP_001230173
auggugacccagcugcgcuacgagagcuucugccuccaccaguuccaggagcaggacggcgaguccauccccgagaaccaggagcuggccagcaagcaggagauccugaaggagauggagcaccucggggacuccaagcugcagcgggacgucagccuggacuccaaguaccgcgagaccugcaagcgggacagcaaggccgagaagcagcaggcgcacuccacgggcgagcgccggcaccgcugcaacgagugcggcaagagcuucaccaaguccagcgugcucaucgagcaccagcggauccacaccggggagaagccguacgagugcgaggagugcgggaaggccuucucccgccggagcucccugaacgagcaccgccggagccacaccggcgagaagcccuaccagugcaaggagugcggcaaggccuucuccgccagcaacgggcugacgcgccaccggcgcauccacaccggcgagaagcccuacgagugcaaggugugcgggaaggccuuccuccuguccagcugccugguccagcaccagcggauccacaccggcgagaagcgcuaccagugccgggagugcgggaaggcguucauccagaacgccggccucuuccagcaccuccgcgugcacaccggcgagaagcccuaccagugcucccagugcagcaagcuguucagcaagcggacgcugcugaagaagcaccagaagauccacaccggggagcgcccguga

SEQ ID NO: 39162 - RNA, 1227 nt, Artificial Sequence
  derived and/or modified sequence opt1 from ZSCAN32__Homo_sapiens__NP_001271458
auggccgagggccugugggagcagggguuccuccgcacccccgagcagugccggaccaaguucaagagccugcagcuguccuaccgcaaggugcggcgcggccgggucccggagcccugcaucuucuacgaggagaugaacgcccucagcggguccugggcgagcgccccgcccauggccuccgacgccgugcccggccaggaggggagcgacaucgaggccggcgagcugaaccaccagaacggcgagcccacggagguggaggacgggaccgucgacggcgcggaccgcgacgagaaggacuuccggaaccccgggcaggaggugcgcaagcuggaccuccccgugcuguucccgaaccggcugggcuucgaguucaagaacgagaucaagaaggagaaccucaagugggacgacuccgaggaggucgagaucaacaaggcccugcagcgcaagagccgcgggguguacuggcacuccgagcugcagaagggccucgagagcgagcccaccucccggcggcagugccgcaacagccccggcgaguccgaggagaagacccccagccaggagaagaugucccaccagagcuucugcgcccgggacaaggccugcacgcacauccugugcgggaagaacugcucccagagcgugcacuccccgcacaagcccgcgcugaagcucgagaaggucagccagugccccgagugcggcaagaccuucagccgcuccagcuaccuggugcggcaccagcgcauccacaccggggagaagccccacaagugcuccgagugcggcaagggcuucagcgagcgguccaaccugaccgcccaccuccgcacgcacaccggggagcggccguaccagugcggccagugcggcaagagcuucaaccaguccagcucccugaucgugcaccagcgcacccacaccggggagaagcccuaccagugcaucgucugcgggaagcgcuucaacaacagcucccaguucagcgcccaccggcgcauccacacgggcgagucccccuacaagugcgccgugugcggcaagaucuucaacaacagcucccacuucagcgcccaccggaagacccacaccggggagaagcccuaccgcugcucccacugcgagcggggcuucaccaagaacagcgcgcugacgcgccaccagaccgugcacaugaaggccguccucuccagccaggaggggcgggacgcccuguga

SEQ ID NO: 39163 - RNA, 1338 nt, Artificial Sequence
  derived and/or modified sequence opt1 from ZSCAN9__Homo_sapiens__NP_001186408
augaacaccaacagcaaggaggugcugucccucggcguccaggugcccgaggccugggaggagcugcugaccaugaagguggaggccaagagccaccuccaguggcaggagucccgccugaagcggagcaacccgcuggcgcgcgagaucuuccggcgccacuuccggcagcucugcuaccaggagacgcccgggccccgcgaggcccugacccggcugcaggagcucugcuaccaguggcugcgcccccacgucuccaccaaggagcagauccuggaccuccuggugcuggagcaguuccucagcauccugccgaaggagcugcagggcugggugcgggagcacugccccgaguccggggaggaggccgucauccuccuggaggaccuggagcgcgagcucgacgagccccagcacgagaugguggcccaccggcaccgccaggaggugcugugcaaggagauggucccccuggccgagcagaccccgcucacgcugcagagccagcccaaggagccccagcugaccugcgacuccgcgcagaagugccacagcaucggcgagaccgaccucauccggucccugcgccggcgcgccgugcugaucccccucggggcccaccuguucagcaccgacacguuccuguucuccaagccgguggucaucccccagcucaagggcggcggggagaccuggcccaacaaccggggcgugcugcgcgacgaggugaccaagaccgaggaccgggagcugguccuccgcaaggacugccccaagaucguggagccgcacgggaagauguucaacgagcagacgugggaggugagccagcaggaccccucccacggcgaggucggggagcacaaggaccggaucgagcgccaguggggcaaccugcugggcgaggggcagcacaagugcgacgagugcggcaagagcuucacccaguccagcgggcucauccgccaccagcggauccacaccggcgagcgccccuacgagugcaacgagugcggcaaggccuucucccggagcagcgggcuguucaaccaccgcggcauccacaacauccagaagcgguaccacugcaaggagugcgggaagguguucucccagagcgcgggccugauccagcaccagcgcauccacaagggggagaagcccuaccagugcucccagugcagcaaguccuacagccggcgcuccuuccucaucgagcaccagcggagccacaccggcgagcgcccgcaccagugcaucgagugcggcaaguccuucaaccggcacugcaaccugauccgccaccagaagauccacacgguggccgagcuggucuga

SEQ ID NO: 39164 - RNA, 1902 nt, Artificial Sequence
  derived and/or modified sequence opt1 from ZSWIM2__Homo_sapiens__NP_872327
augcugcgccggggcuacaaggccagcgagcgccggcgccaccucuccgagcggcugagcuggcaccaggaccaggcccuguccagcuccaucuaccuccugcgcgagauggggcccaccggcuuccugcuccgggaggaggagccggaguacauggacuuccgcguguuccuggggaacccccacgucugcaacugcagcaccuuccccaagggcggggagcugugcaagcacaucugcugggugcuccugaagaaguucaagcugccccggaaccacgaguccgcgcuccagcugggccugggcgagcgcgagaucagcgaccuccugcgggggauccaccgcgugcagacgccgcagcccggcaccaacgacgagaacgagcacgucgaggaggacggguacaucaagcagaaggagaucgacuccgaggacaucugcagcaucugccaggagcugcuccuggagaagaagcugcccgugaccuucugccgguucggcugcgggaacuccauccacaucaagugcaugaagauccucgccaacuaccagagcaccuccaacacgagcaugcugaagugcccccugugccgcaaggaguucgccccgcucaagcugauccuggaggaguucaagaacuccagcaagcucguggccgccgcggagaaggagcggcuggacaagcaccugggcauccccugcaacaacugcaagcaguuccccaucgagggcaagugcuacaagugcaccgagugcaucgaguaccaccucugccaggagugcuucgacuccugcugccaccugagccacaccuucaccuuccgcgagaagcggaaccagaaguggcgcucccuggagaagcgggccgacgaggucgugaaguacaucgacacgaagaacgagaucgaggagaagaugagccacuuccaggagaagcagggccagguguacacccccaagcacaucguccgcagccucccgcugcagcugaucaccaagaacuccaagcuccuggcccccggguaccagugccugcucugccugaaggccuuccaccuggggcagcacacccggcuccugcccugcacgcacaaguuccaccgcaagugcaucgacaacuggcuguuccacaagugcaacagcugccccaucgacggccaggugaucuacaacccgcucaccuggaagaacuccgcggugaacggccaggcccaccagagcgucuccaaccgcgacaucauccaccugagcaagcagaaggagcccgaccuguucauccccgggaccggccucgugcugaagcagaaccggcuggggauccugcccuccaucccgcagugcaacuucgacgagcucaacacgccccagagccccaaggacgccuacgagaacaccaccaucgacaaccugugcuccaucaagcuggacaacagcaacuccaagaagcucaccuacgacuacaagaucagccagcacuucccccgcuaccugcaggaccugccgaccguguccuucggcaagauccccagccagacgcuccugccgcccaucguccacaagaacaucgugugccccaccgccauggagucccccugcaucagcgggaaguuccacaccucccugagccggaugaccaagggcugcaagugcaacaaccacaaccucaagaagacgcccgccaccaagauccgcgaggacaacaagcgguccacccugcugccggaggacuucaaccucaucgugaacuggagcaccgcgaagcugagccuguccaagcgcuacagcaacugcaugggcgagaucacgcggaagugcucccaccucagccgccagcccgucucccacagcgugaacaccaaguccaccgagcugagccugaucaucgagggggugcagcucuga

SEQ ID NO: 39165 - RNA, 3648 nt, Artificial Sequence
  derived and/or modified sequence opt1 from ZSWIM6__Homo_sapiens__NP_065979
auggccgagcgcggccagcagcccccgcccgccaagcggcugugcugccgccccgggggcgggggcgggggcggcgggagcuccggcgggggcgggggcgcgggcgggggcuacagcuccgccugccggcccgggccgcgcgccggcggcgccgccgcggccgccgccugcgggggcggggcggcccucggccugcugccgcccgggaagacccagagccccgagucccuccuggacaucgccgcccggcgcguggccgagaaguggcccuuccagcgggucgaggagcgcuucgagcggauccccgagcccgugcagcgccggaucguguacuggagcuucccccgcuccgagcgggagaucugcauguacagcuccuucaacaccggcggcggggcggccggcgggccgggcgacgacagcgggggcggcgggggcgccgggggcgggggcggcgggggcuccagcuccagccccgccgccacguccgcggccgccaccagcgccgccgcggccgccgccgccgcggccgccgccgcggccgccgccgccggggcgggcgcccccuccgucggcgccgccggggccgcggacggcggggacgagacccgccugcccuuccggcgcggcaucgcccuccuggagagcgggugcguggacaacgugcugcaggucggcuuccaccucuccggcaccgugacggagccggccauccagagcgagcccgagaccgugugcaacgucgccaucagcuucgaccggugcaagaucaccuccgugaccugcagcugcgggaacaaggacaucuucuacugcgcccacguggucgcgcugucccuguaccgcauccggaagcccgaccaggugaagcuccaccuccccaucagcgagacgcuguuccagaugaaccgcgaccagcuccagaaguucgugcaguaccugaucaccguccaccacaccgaggugcugccgaccgcccagaagcucgccgacgagauccugucccagaacagcgagaucaaccaggugcacggcgcccccgaccccacggcgggggccuccaucgacgacgagaacugcuggcaccuggacgaggagcagguccaggagcaggucaagcuguuccugagccagggcggguaccacggcuccggcaagcagcugaaccuccuguucgccaaggugcgggagaugcugaagaugcgcgacagcaacggggcccgcaugcucacccugaucaccgagcaguucauggccgacccccggcugucccucuggcgccagcagggcaccgcgaugacggacaaguaccggcagcugugggacgagcugggggcccucuggaugugcaucguccugaacccgcacugcaagcuggagcagaaggccagcuggcucaagcagcugaagaaguggaacuccguggacgugugccccugggaggacggcaaccacgggagcgagcugcccaaccucaccaacgcccugccccagggcgccaacgcgaaccaggacuccagcaaccgcccgcaccggaccgucuucacccgcgccaucgaggccugcgaccugcacuggcaggacucccaccuccagcacaucaucagcuccgaccuguacacgaacuacugcuaccacgacgacaccgagaacagccuguucgacagccggggcuggccccucuggcacgagcacgugcccaccgccugcgcccgcgucgacgcgcugcggucccacggguacccgcgcgaggcccugcggcucgccaucgccaucgugaacacccugcgccggcagcagcagaagcagcuggagauguuccgcacgcagaagaaggagcugccccacaagaacaucaccagcaucaccaaccucgagggcuggguggggcacccccuggaccccgucggcacccuguucuccagccucauggaggcgugccggaucgacgacgagaaccuguccggguucagcgacuucacggagaacaugggccagugcaagucccuggaguaccagcaccucccggcccacaaguuccuggaggagggcgagagcuaccugacccucgccguggagguggcccugaucgggcugggccagcagcgcaucaugcccgacgggcucuacacccaggagaaggucugccggaacgaggagcagcugaucuccaagcugcaggagaucgagcucgacgacacccuggugaagaucuuccgcaagcaggccguguuccugcucgaggcgggccccuacagcggccugggggagaucauccaccgggaguccguccccaugcacacguucgccaaguaccuguucaccagccuccugccgcacgacgccgagcuggccuacaagaucgcccuccgcgcgaugcgccugcuggugcucgaguccaccgcccccagcggcgaccugacccggccccaccacaucgccuccgugguccccaaccgcuacccgcggugguucacgcugagccacaucgagucccagcagugcgagcucgccagcaccaugcugaccgccgcgaagggggacgugcgccggcuggagaccgugcucgagagcauccagaagaacauccacuccagcucccacaucuucaagcuggcccaggacgccuucaagaucgccacccugauggacagccuccccgacaucacgcugcugaaggucucccucgagcugggccuccaggugaugcgcaugacccugagcacccugaacuggcggcgccgggagauggugcgcuggcuggugaccugcgccacggagguggggguguacgcgcucgacuccaucaugcagaccugguucacccuguucacccccacggaggccaccagcaucgucgccaccaccgugauguccaacagcacgaucgugcggcugcaccucgacugccaccagcaggagaagcuggccuccagcgcgcgcacccuggcccuccagugcgccaugaaggacccccagaacugcgcccuguccgcccugacccucugcgagaaggaccacaucgcguucgagaccgccuaccagaucguccuggacgccgccacgaccggcaugagcuacacccagcuguucaccaucgcccgguacauggagcaccgcggcuacccgaugcgggcguacaagcucgccacgcuggccaugacccaccugaaccucuccuacaaccaggacacccaccccgccaucaacgacgugcugugggccugcgcgcugagccacucccucgggaagaacgagcuggccgccaucaucccccugguggucaagagcgugaagugcgccaccgugcucuccgacauccugcgccggugcacgcugaccacccccggcauggucgggcuccacggccgccggaacagcgggaagcugaugagccuggacaaggcgccgcuccgccagcugcuggacgccaccaucggcgccuacaucaacacgacccacucccggcucacccacaucagcccccgccacuacuccgaguucaucgaguuccugagcaaggcccgcgagaccuuccugauggcccacgacggccacauccaguucacgcaguucaucgacaaccucaagcagaucuacaaggggaagaagaagcugaugaugcuggugcgggagcgcuucggcuga

SEQ ID NO: 39166 - RNA, 2340 nt, Artificial Sequence
  derived and/or modified sequence opt1 from ZW10__Homo_sapiens__NP_004715
auggccagcuucgugaccgagguccuggcccacuccggccgccucgagaaggaggaccuggggacccggaucagccgccugacgcggcgcguggaggagaucaagggcgaggugugcaacaugaucuccaagaaguacagcgaguuccuccccuccaugcagagcgcgcaggggcugaucacccaggucgacaagcuguccgaggacaucgaccuccucaagagccggaucgaguccgaggugcgccgggaccugcacgugagcaccggcgaguucaccgaccucaagcagcagcuggagcgcgacuccgucgugcugagccuccugaagcagcugcaggaguucuccacggccaucgaggaguacaacugcgcccucaccgagaagaaguacgugaccggggcccagcggcuggaggaggcccagaagugccugaagcuccucaagagccgcaagugcuucgaccugaagauccugaagucccugagcauggagcugaccauccagaagcagaacauccucuaccaccugggcgaggaguggcagaagcugaucgucuggaaguucccgcccuccaaggacacgagcucccucgagagcuaccugcagaccgagcugcaccucuacaccgagcagagccacaaggaggagaagacccccaugcccccgaucuccagcgugcugcuggcguucuccgugcucggcgagcugcacagcaagcugaaguccuucgggcagaugcuccugaaguacauccugcggccccucgccagcugccccucccugcacgccgucaucgagagccagcccaacaucgugaucauccgcuucgaguccaucaugacgaaccuggaguacccgagccccuccgagguguucaccaagauccggcucguccuggaggugcugcagaagcagcuccuggaccugccccucgacaccgaccuggagaacgagaagaccagcacggugccccuggccgagaugcugggcgacaugaucugggaggaccucuccgagugccugaucaagaacugccuggucuacagcaucccgaccaacuccagcaagcuccagcaguacgaggagaucauccaguccaccgaggaguucgagaacgcgcugaaggagaugcgcuuccugaagggggacaccacggaccuccugaaguacgcccggaacaucaacagccacuucgccaacaagaagugccaggacgugaucguggccgcccgcaaccugaugaccuccgagauccacaacaccgucaagaucauccccgacagcaagaucaacgugcccgagcuccccaccccggacgaggacaacaagcuggaggugcagaaggucagcaacacgcaguaccacgaggugaugaaccuggagcccgagaacacccucgaccagcacuccuucagccugccgaccugccggaucuccgagagcgucaagaagcugauggagcucgcguaccagacccugcuggaggccacgaccuccagcgaccagugcgccgugcagcuguucuacuccgugcgcaacaucuuccaccuguuccacgacgucgugcccaccuaccacaaggagaaccugcagaagcucccgcagcuggccgccauccaccacaacaacugcauguacaucgcgcaccaccuccugacccugggccaccaguuccggcugcgccucgcccccauccugugcgacgggacggccaccuucguggaccugguccccggcuuccggcgccucggcaccgagugcuuccuggcccagaugcgcgcccagaagggggagcugcucgagcggcugagcuccgcgcgcaacuucagcaacauggacgacgaggagaacuacuccgccgccagcaaggccgugcgccaggugcugcaccagcucaagcggcugggcaucgucuggcaggacgugcugcccgugaacaucuacugcaaggccauggggacccuccugaacacggcgaucuccgaggucaucggcaagaucaccgcccuggaggacaucagcaccgaggacggcgaccggcucuacucccugugcaagaccgugauggacgaggggccccagguguucgcgccccugagcgaggaguccaagaacaagaaguaccaggaggagguccccguguacgugcccaaguggaugccguucaaggagcucaugaugaugcugcaggccagccugcaggagaucggcgaccgcugggccgacgggaagggcccccucgccgccgccuucagcuccagcgaggucaaggcccugauccgggcgcuguuccagaacaccgagcgccgggccgccgcccucgccaagaucaaguga

SEQ ID NO: 39167 - RNA, 1434 nt, Artificial Sequence
  derived and/or modified sequence opt1 from ZWILCH__Homo_sapiens__NP_001274752
auggcccacaaccccaacaugacccaccugaagaucaaccucccggugaccgcccugccgccccuguggguccgcugcgacagcuccgaccccgagggcacgugcuggcucggggcggagcugaucaccaccaacaacagcaucaccggcaucgugcuguacguggucuccugcaaggccgacaagaacuacagcgugaaccucgagaaccugaagaaccugcacaagaagcggcaccaccucuccacggugaccagcaagggguucgcccaguacgagcuguucaaguccagcgcccuggacgacaccaucaccgccucccagacggcgaucgcccucgacaucagcuggucccccgucgacgagauccugcagaucccgccccugagcuccaccgccacccucaacaucaagguggagagcggcgagccccgcgggccccugaaccaccuguaccgggagcucaaguuccugcuggugcucgccgacggccugcgcaccggcgucacggaguggcuggagccccucgaggcgaaguccgccguggagcuggugcaggaguuccugaacgaccucaacaagcuggacggguucggcgacagcaccaagaaggacaccgaggucgagacccugaagcacgacacggccgccguggaccgguccgugaagcgccucuucaagguccggagcgaccuggacuucgccgagcagcuguggugcaagauguccagcagcgugaucuccuaccaggaccucgugaagugcuucacccugaucauccagagccugcagcgcggggacauccagcccuggcuccacuccggcagcaacucccugcugagcaagcucauccaccaguccuaccacgggaccauggacaccgucagccuguccggcacgauccccgugcagaugcugcucgagaucggccuggacaagcugaagaaggacuacaucagcuucuucaucgggcaggagcucgcgucccugaaccaccuggaguacuucaucgccccgagcguggacauccaggagcaggucuaccgggugcagaagcuccaccacauccuggagauccugguguccugcaugcccuucaucaagagccagcacgagcuccuguucucccugacccagaucugcaucaaguacuacaagcagaacccccuggacgagcagcacaucuuccagcuccccguccgcccgaccgccgugaagaaccuguaccagagcgagaagccccagaaguggcgggucgagaucuacuccggccagaagaagaucaagaccguguggcagcugagcgacuccagccccaucgaccaccucaacuuccacaagcccgacuucagcgagcugacgcugaacgggucccucgaggagcgcaucuucuucaccaacauggugaccugcagccagguccacuucaaguga

SEQ ID NO: 39168 - RNA, 693 nt, Artificial Sequence
  derived and/or modified sequence opt1 from ZWINT__Homo_sapiens__NP_001005413
auggaggccgccgagaccgaggcggaggccgccgcccuggaggugcucgccgaggucgcgggcauccuggagcccguggggcugcaggaggaggccgagcucccggccaagauccugguggaguucgucguggacagccagaagaaggacaagcugcucugcucccagcuccagguggccgacuuccugcagaacauccucgcgcaggaggacaccgccaagggccuggacccccuggccagcgaggacacgucccgccagaaggccaucgccgcgaaggagcaguggaaggagcucaaggccaccuaccgggagcacgucgaggccaucaagaucgggcugaccaaggcccugacccagauggaggaggcccagcgcaagcggacgcagcuccgcgaggcguucgagcagcugcaggccaagaagcagauggccauggagaagcggcgcgccgugcagaaccaguggcagcugcagcaggagaagcaccuccagcaccuggccgaggugagcgcggagggcaagcugcuguuccccgaggccgaggccgaggccgagaaccugcccgacgacaagccgcagcagcccacccggccccaggagcaguccaccggggacaccaugggccgcgaccccggcgucagcuucaaggccguggggcugcagccggcgggcgacgugaaccuccccuga

SEQ ID NO: 39169 - RNA, 1719 nt, Artificial Sequence
  derived and/or modified sequence opt1 from ZYX__Homo_sapiens__NP_001010972
auggccgcgccccgcccgagccccgccaucuccgugagcgucagcgcccccgccuucuacgcgccccagaagaaguucggccccgugguggcccccaagcccaaggugaaccccuuccggcccggggacagcgagccgccgcccgcccccggcgcccagcgcgcccagauggggcgggugggcgagaucccgcccccgccgcccgaggacuucccccugccgcccccgccccuggccggggacggcgacgacgcggagggcgcccucggcggggccuucccgcccccgccgccgcccaucgaggagagcuucccgcccgcgccccuggaggaggagaucuuccccagcccgcccccgccgcccgaggaggagggcgggcccgaggcccccaucccgccgccgccccagccccgcgagaagguguccuccaucgaccucgagaucgacucccugagcucccugcucgacgacaugaccaagaacgaccccuucaaggcccgggucagcuccggguacgugcccccgcccguggccacccccuucagcuccaagagcuccacgaagcccgccgccggcggcaccgcgccccugccgcccuggaagucccccuccagcagccagccccugccccagguccccgcccccgcccagucccagacccaguuccacgugcagccccagccccagcccaagccccagguccagcuccacguccagagccagacccagcccgugucccuggccaacacccagccccgcgggccgcccgccagcucccccgcccccgcgcccaaguucagccccgugacccccaaguucacccccgucgccuccaaguucagccccggcgcccccgggggcuccggcagccagcccaaccagaagcuggggcaccccgaggcccucuccgccggcaccgggagcccccagccgcccuccuucacguacgcgcagcagcgggagaagccccgcgugcaggagaagcagcaccccgugcccccgcccgcccagaaccagaaccagguccggagccccggcgcccccgggccccugacccugaaggagguggaggagcucgagcagcugacccagcagcugaugcaggacauggagcacccccagcgccagaacguggccgucaacgagcucugcggccggugccaccagccccuggcgcgcgcccagcccgccgugcgggcccugggccagcuguuccacaucgccugcuucacgugccaccagugcgcgcagcagcuccaggggcagcaguucuacucccuggagggcgcccccuacugcgaggggugcuacaccgacacccucgagaagugcaacacgugcggcgagcccaucaccgaccgcaugcugcgggccaccgggaaggccuaccacccgcacugcuucacgugcguggucugcgcccgcccccuggagggcaccagcuucaucguggaccaggcgaaccggccccacugcguccccgacuaccacaagcaguacgccccgcgcugcuccgugugcagcgagcccaucaugcccgagcccggccgggacgagaccgugcgcgucguggcccucgacaagaacuuccacaugaagugcuacaagugcgaggacugcgggaagccgcuguccaucgaggccgacgacaacggcugcuucccccuggacgggcacgugcucugccggaagugccacacggcccgcgcgcagaccuga

SEQ ID NO: 39170 - RNA, 8886 nt, Artificial Sequence
  derived and/or modified sequence opt1 from ZZEF1__Homo_sapiens__NP_055928
augggcaacgcccccagccacagcagcgaggacgaggccgccgccgccgggggcgagggguggggcccccaccaggacugggccgccgugagcgggaccacccccggccccggcgucgccgcccccgcccugccgcccgccgcggcccuccuggagcccgcccggcugcgggaggccgccgcggcccuccugcccaccccgcccugcgagagccuggugucccgccaccgcggggcccucuuccgcuggcuggaggagcggcugggccgcggggaggagagcgugacccucgagcaguuccgggagcugcuggaggcccgcggcgccgggugcuccagcgagcaguucgaggaggcguucgcccaguucgacgccgagggcgacggcaccgucgacgccgagaacaugcucgaggcccugaagaacuccagcggggcgaaccugcagggcgagcucucccacaucauccggcagcugcaggccugcagccuggugcccggguucaccgacaucuucuccgagagcaaggagggccucgacauccacuccagcaugauccugcgcuuccugcaccggaaccgccucuccagcgccgugaugcccuaccccaugcuggagcacugcaacaacaugugcacgaugcgguccagcguccugaaggagagccucgaccagcuggugcagaaggagaaggagucccccggcgaccugacccgcagccccgagauggacaagcucaaguccguggccaagugcuacgccuacaucgagaccagcuccaacagcgcggacaucgacaagaugaccaacggggagacguccagcuacuggcaguccgacggcagcgccugcucccacuggauccggcugaagaugaagcccgacgucgugcugcgccaccucagcaucgccguggccgcgaccgaccaguccuacaugccccagcaggucaccguggccguggggcggaacgccagcgaccugcaggagguccgcgacgugcacauccccuccaacgugaccggcuacgucacgcugcucgagaacgccaacgugagccagcuguacgugcagaucaacaucaagcggugccuguccgacgggugcgacacccgcauccacggccuccgggccgucggcuuccagcgcgugaagaaguccgggguguccgucagcgacgcgagcgccaucugguacuggucccugcugaccagccucgugaccgccuccauggagacgaaccccgccuucguccagaccgugcugcacaacacccagaaggcccugcgccacaugcccccgcucagccugucccccggcagcaccgacuucuccacguuccugagccccaacgugcucgaggaggucgacuccuuccugauccggaucaccagcugcugcuccacccccgagguggagcugacccuccuggcguucgcccuggcccgcgggagcguggccaaggucauguccagccugugcacgaucaccgaccaccucgacacccaguacgacgccuccagccugauccuguccauggcgagcgugcggcagaaccuccugcugaaguacggcaagccgcuccagcugacccugcaggccugcgacgugaaggggaaggaggacaagagcggccccgagaaccuccuggucgagcccuggacgcgcgacggcuuccugaccgagaccgggaagacccgggccuccacgaucuucagcaccggcaccgaguccgccuuccaggugacccagauccgcaucauggugcggcgcgggggcaucggggcgcagugcggccucgucuucgccuacaacagcuccagcgacaaguucugcgccgaggagcacuucaagcgguucgagaaguacgacaaguggaagcugcaggagcugcgccaguucgugaagucccggaucggcugcagcuccgacgaccucggggaggacgaccccaucggcugguucgagcuggaggaggagugggacgaggccgacgugaagcugcagcagugccgcgucgccaaguaccucauggugaaguuccugugcacgcggcaggagagcgcggagcgccugggggugcagggccucaccaucuccggcuaccugcggccggcccgcgccgaggccgagcagagcgugaccugcgcccacugccggaaggacaccgaggaguccgugugcggggcgacccugcuccugcgcacgcugcaguucauccagcagcucgcccacgaccuggugcagcagaaggagagcggccugaaguacaaguccuuccucgacuucgccgggcuggaccugcagaucuucuggaacuucuacagcaagcucaagcagaacccccgggaggagugcgucuccgcccagacccugcugcuccagcugcugcagagcugcuucuccgugcuccagggcgacgugcuggccgcgagcgaggaggagaaggcccccauccagagcccgaagggggucgaggccgccaaggagcuguacacccaccucugcgacgugguggacaaggucgacggcgacuccgugcccauggagauccugaagcaggaggugcgcaacacccugcucaacggcgcggccaucuucuuccccaaccgccagacgcggcgcaaccaccuguucaccaugaugaacgucaccgagcaggagcacaagcagagccugcagcucaccuuccggucccugugcacguacuucagcgacaaggaccccgggggccugcuccugcugccggagaagaacgaccucgccaagaugaacaucuccgaggugcuggccgugauggacacccuggucagcguggccgcgcgcgagugcgagcuccugaugcuguccggggcccccggcgagguggggagcguccucuucucccuguucuggagcgugcagggcucccugcucagcuggugcuaccugcagcugaaguccaccgacagcggcgccaaggaccucgccguggaccugaucgagaaguacgucgggcaguuccuggccuccaugcgggcgauccucgagagccuguucucccaguacagcggcaagaccaucguggagcgccugugcaacuccguguucagcauggccgcccggcagcucgucaucuuccugcuggacuucugcacgcucgacaucccccacugcgugcugcugcgcgaguucagcgugcucaccgagcugcugaagaagcucugcuccgggcccgagggcgggcugcggaagcuggacgucgagaccuggcagcaggagcagccgguggugcuccacaccuggacgaaggagagcgcccacaacuacgagaacaacugccacgaggucuccguguucgugagccccggcgccaccuacuucgaggucgaguucgacgaccgcugcgagaccgagaagcgguacgacuaccuggaguucaccgacgcgcgcggccggaagacgcgcuacgacaccaagguggggaccgacaaguggcccaagaaggucaccuucaaggccggcccccggcugcaguuccucuuccacuccgacagcucccacaacgaguggggguacaaguucacggugaccgccugcggccugccggacguggccgucagcugggggcuggaccuccagcugcuggugucccgccucaugggccggcuggccagccagugcauggcgcugaaguccgugcgccagcugggcagcaacauggucgugccccaggccaagauggcccucgugcuguccagcccccuguggaagcccgucuuccggcaccaggugugcccggagcucgagcuggaggccuccuggcccacccacccccaccgcaacagcaaggaggugaagaacauccccgacgacccgugccggcacuuccugcucgacuucgcgcaguccgagcccgcccagaacuucugcgggcccuacagcgagcuguucaagggcuucauccaggccugccgcaagcaggcccccaagaccgacaucgucgccggguccacgaucgaccaggcggugaacgccaccuucgccgcccugguguaccgcaccccggaccucuacgagaagcugcagaaguacgucaacagcggcggcaagaucgcccugagcgaggaguucgcccaggucuacucccucgccgacgggauccggaucuggaugcuggagaugaagcagaagucccugaugucccucggcaacgaggccgaggagaagcacagcuccgaggccaccgaggugaaccccgagagccuggccaaggagugcaucgagaagucccugcuccugcugaaguuccuccccacggggaucagcuccaaggagagcugcgagaagcuggagaccgcggacgagaccucccaccuccagccgcucaacaagcgccagcggaccagcuccgucguggaggagcacuuccaggccagcgugucccccacggaggccgcgccgcccgcgaccggcgaccagagcccggggcugggcacccagcccaagcugcccuccagcuccggccuccccgccgccgacgucagcccggccaccgccgaggagccccugagccccuccacccccacgcgccggccgcccuucacccgcgggcggcugcgccuccugagcuuccgguccauggaggaggcgcgccuggugcccaccgugaaggagaaguaccccguccucaaggacgugauggacuucaucaaggaccagagccugucccaccggagcguggucaaggugcugucccuccgcaaggcccaggcccagagcauccuggaggugcugaagaucacccagcacugcgccgagucccucggccagccgcacugcuuccacccgcccuucauccuguuccugcucgagcugcugacgugccagaaggacuucaccaacuacuucgggcaccucgagggcugcggggccgaccugcacaaggagauccgggacaccuacuaccagcugguccucuuccuggugaaggcggugaagggcuucagcucccugaacgaccgcagccuccugcccgcccuguccugcguccagaccgcccuccugcaccuccuggacaugggcugggagccgaacgaccuggccuucuucguggacauccagcugcccgaccugcugaugaagaugagccaggagaacaucuccgugcacgacagcgucaucucccaguggagcgaggaggacgagcuggccgacgcgaagcagaacuccgaguggauggacgagugccaggacgggauguucgaggccugguacgagaagaucgcccaggaggaccccgagaagcagcggaagaugcacauguucaucgcccgcuacugcgaccuccugaacguggacaucagcugcgacggcugcgacgagaucgcgcccuggcaccgguaccgcugccugcagugcagcgacauggaccucugcaagacgugcuuccucggcggggugaagccggaggggcacggggacgaccacgagauggucaacauggaguucacgugcgaccacugccagggccugaucaucgggcggcgcaugaacugcaacgugugcgacgacuucgaccucugcuacggcugcuacgccgccaagaaguacuccuacgggcaccuccccacccacagcaucaccgcccaccccauggugacgauccgcaucuccgaccggcagcgccugauccagcccuacauccacaacuacagcuggcuccuguucgccgcgcuggcccucuacuccgcccaccuggccagcgccgaggacgucgacggcgagaagcuggacccgcagacccgguccagcgcgaccacccuccgcucccagugcaugcagcuggugggcgacugccugaugaaggcccaccaggggaagggccucaaggcccuggcccugcucggggugcugcccgacggcgacagcucccuggaggaccaggcccuccccgucacggugccgaccggggcgagcgaggagcagcuggagaagaaggccgugcagggcgccgagcuguccgaggccggcaacgggaagcgggccguccacgaggagauccgccccguggacuucaagcagcggaacaaggcggacaagggcgugagccucuccaaggaccccagcugccagacccagaucuccgacagccccgccgacgccagcccgcccaccgggcugcccgacgccgaggacuccgaggucagcucccagaagcccaucgaggagaaggcggugacgccgagccccgagcaggucuucgccgagugcucccagaagcgcauccugggccuccuggccgccaugcugccgccccucaagagcgggccgaccgugccccugaucgaccuggagcacgugcugccccugauguuccaggucgugaucuccaacgccggccaccugaacgagaccuaccaccugacccucggccugcuggggcagcucaucauccggcugcugcccgcggagguggacgccgccgucaucaaggugcucagcgccaagcacaaccuguucgccgcgggcgacuccagcaucgugccggacggguggaagacgacccaccuccuguucucccugggcgccgucugccuggacagccgcguggggcucgacugggccugcuccauggccgagauccugcggagccugaacuccgcgccccuguggcgcgacgugaucgcgaccuucaccgaccacugcaucaagcagcugcccuuccagcugaagcacacgaacaucuucacccuccugguccuggugggcuucccccaggugcucugcgucggcacccggugcguguacauggacaacgccaacgagccgcacaacgugaucauccugaagcacuucaccgagaagaaccgcgccgucaucguggacgugaagacgcggaagcgcaagaccgucaaggacuaccagcuggugcagaagggcggcgggcaggagugcggcgacagccgggcccagcucucccaguacagccagcacuucgcguucaucgccucccaccuccugcagagcagcauggacucccacugccccgaggccguggaggccaccuggguccucagccuggcccugaaggggcucuacaagacccugaaggcgcacggcuucgaggagauccgcgccacguuccugcagaccgaccuccugaagcugcucgugaagaagugcuccaagggcaccggguucagcaagaccuggcugcugcgggaccucgagauccuguccaucaugcuguacagcuccaagaaggagaucaacgcccucgccgagcacggcgaccuggagcuggacgagcgcggggaccgggaggaggagguggagcgccccgucagcucccccggcgacccggagcagaagaagcucgacccccuggagggccuggacgagcccacccgcaucugcuuccucauggcccacgacgcgcugaacgcgccccugcacauccuccgggccaucuacgagcugcagaugaagaagacggacuacuucuuccuggaggugcagaagcgcuucgacggggacgagcucaccaccgacgagcggauccgcagccuggcccagcgguggcagccguccaagagccugcgccucgaggagcaguccgccaaggcgguggacaccgacaugaucauccugcccugccugagccggcccgcccgcugcgaccaggccacggccgaguccaacccggucacccagaagcucaucagcuccaccgagagcgagcugcagcaguccuacgcgaagcagcggcgcagcaagagcgccgcccugcuccacaaggagcugaacugcaaguccaagcgggccgugcgcgacuaccuguuccgggugaacgaggccaccgcgguccucuacgcccgccacgugcuggccagccugcucgccgaguggcccucccacgugcccgucagcgaggacauccuggagcuguccggccccgcccacaugacguacauccucgacauguucaugcagcuggaggagaagcacgagugggagaagauccugcagaaggugcuccaggggugccgggaggacaugcugggcaccauggcgcuggccgccugccaguucauggaggagccggggauggaggugcagguccgcgagagcaagcaccccuacaacaacaacaccaacuucgaggacaaggugcacauccccggcgccaucuaccucuccaucaaguucgacagccagugcaacaccgaggagggcugcgacgagcuggccauguccagcuccagcgacuuccagcaggaccggcacuccuucagcgggucccagcagaaguggaaggacuucgagcugcccggcgacacgcucuacuaccgcuucaccagcgacauguccaacaccgaguggggguaccgguucaccgugacggcgggccaccuggggcgcuuccagaccggcuucgagauccugaagcagaugcucagcgaggagcgcgucgugccgcaccucccccuggccaagaucugggaguggcucgugggcgucgccugccggcagaccgggcaccagcgccugaaggccauccaccuccugcugcggaucgugcgcugcugcggccacuccgaccugugcgaccuggcccugcugaagccccucuggcagcuguucacccacauggaguacgggcuguucgaggacgugacgcagcccggcauccugcucccgcugcaccgggcgcugaccgagcuguucuucgucaccgagaaccgcgcccaggagcugggggugcugcaggacuaccuccuggcccugaccacggacgaccaccuccugcggugcgccgcgcaggcccugcagaacaucgccgccaucagccucgccaucaacuaccccaacaaggcgacccgccuguggaacguggagugcuga

SEQ ID NO: 39171 - RNA, 1515 nt, Artificial Sequence
  derived and/or modified sequence opt1 from ZZZ3__Homo_sapiens__XP_011539507
auggccgccagccgcuccacccgggugacccgcagcacggucggccugaacgggcucgacgaguccuucugcggccggacccugcgcaaccggagcaucgcgcaccccgaggagaucuccagcaacucccaggugcgcagccgguccccgaagaagcgccccgagcccgugcccauccagaaggggaacaacaacggccggaccaccgaccugaagcagcagagcacgcgcgaguccugggucagcccgcggaagcgcgggcucuccagcuccgagaaggacaacaucgagcggcaggccaucgagaacugcgagcgccggcagaccgagcccgugagccccgugcugaagcgcaucaagcggugccugcgcuccgaggcccccaacagcuccgaggaggacagcccgaucaagagcgacaaggaguccgucgagcagcggagcaccgugguggacaacgacgccgacuuccagggcaccaagcgcgccugccggugccucauccuggacgacugcgagaagcgcgagaucaagaaggucaacguguccgaggagggcccccugaacagcgcgguggucgaggagaucacgggguaccucgccgugaacggcguggacgacuccgacagcgccgucaucaacugcgacgacugccagcccgacgggaacaccaagcagaacuccaucggcagcuacgugcugcaggagaaguccguggccgagaacggggacaccgacacccagacgagcauguuccuggacucccgcaaggaggacagcuacaucgaccacaagguccccugcaccgacucccagguccaggugaagcucgaggaccacaagaucgugaccgcgugccugccgguggagcacgugaaccagcugaccacggagcccgccaccggccccuucagcgagacccaguccagccuccgggacuccgaggaggaggucgacguggucggcgacagcuccgccagcaaggagcagugcaaggagaacaccaacaacgagcuggacacgagccuggaguccaugcccgccagcggggagccggagcccucccccgugcucgacugcgugagcgcccagaugaugucccugagcgagccccaggagcaccgcuacacccugcggaccuccccgcgccgggcggcccccacccgcggcagccccacgaagaacuccagccccuaccgggagaacgggcaguucgaggagaacaaccucuccccgaacgagaccaacgccaccgucagcgacaacgugucccagagccccaccaaccccggcgagaucucccagaacgagaagggcaucugcugcgacagccagaacaacggguccgagggcgugagcaagcccccgagcgaggcccgccugaacaucgggcaccuccccuccgccaaggagagcgcgucccagcacaucacggaggaggaggacgacgaccccgacgucuacuacuucgagagcgaccacguggcccugaagcacaacaaggaguacguguga

SEQ ID NO: 39172 - RNA, 1245 nt, Artificial Sequence
  derived and/or modified sequence opt2 from 37135__Homo_sapiens__NP_443070
augucccaccacgacgacggcgccaccgucggccucggcauccagaugugcgagggcuggcgcgucgaggccgcccucuccuuccucccccaccagcgcaaguggggcgagaccgccggcgccgucauggccggcggcgucauggacaaggaguacgucggcuucgccgcccuccccaaccagcuccaccgcaaguccgucaagaagggcuucgacuucacccucauggucgccggcgaguccggccucggcaaguccacccucaucaacucccucuuccucaccaaccucuacgaggaccgccagguccccgaggccuccgcccgccucacccagacccucgccaucgagcgccgcggcgucgagaucgaggagggcggcgucaaggucaagcucacccucgucgacacccccggcuucggcgacuccgucgacugcuccgacugcuggcuccccgucgucaaguucaucgaggagcaguucgagcaguaccuccgcgacgaguccggccucaaccgcaagaacauccaggacucccgcguccacugcugccucuacuucaucucccccuucggccgcggccuccgcccccucgacgucgccuuccuccgcgccguccacgagaaggucaacaucauccccgucaucggcaaggccgacgcccucaugccccaggagacccaggcccucaagcagaagauccgcgaccagcucaaggaggaggagauccacaucuaccaguuccccgagugcgacuccgacgaggacgaggacuucaagcgccaggacgccgagaugaaggaguccauccccuucgccgucgucggcuccugcgaggucguccgcgacggcggcaaccgccccguccgcggccgccgcuacuccuggggcaccgucgaggucgagaacccccaccacugcgacuuccucaaccuccgccgcaugcucguccagacccaccuccaggaccucaaggaggucacccacgaccuccucuacgagggcuaccgcgcccgcugccuccagucccucgcccgccccggcgcccgcgaccgcgccucccgcuccaagcucucccgccaguccgccaccgagaucccccuccccaugcucccccucgccgacaccgagaagcucauccgcgagaaggacgaggagcuccgccgcaugcaggagaugcucgagaagaugcaggcccagaugcagcagucccaggcccagggcgagcaguccgacgcccucuga

SEQ ID NO: 39173 - RNA, 1086 nt, Artificial Sequence
  derived and/or modified sequence opt2 from 37500__Homo_sapiens__NP_001008492
auguccaagcagcagcccacccaguucaucaaccccgagacccccggcuacgucggcuucgccaaccuccccaaccagguccaccgcaaguccgucaagaagggcuucgaguucacccucauggucgucggcgaguccggccucggcaaguccacccucaucaacucccucuuccucaccgaccucuaccccgagcgcgucauccccggcgccgccgagaagaucgagcgcaccguccagaucgaggccuccaccgucgagaucgaggagcgcggcgucaagcuccgccucaccgucgucgacacccccggcuacggcgacgccaucaacugccgcgacugcuucaagaccaucaucuccuacaucgacgagcaguucgagcgcuaccuccacgacgaguccggccucaaccgccgccacaucaucgacaaccgcguccacugcugcuucuacuucaucucccccuucggccacggccucaagccccucgacgucgccuucaugaaggccauccacaacaaggucaacaucguccccgucaucgccaaggccgacacccucacccucaaggagcgcgagcgccucaagaagcgcauccucgacgagaucgaggagcacaacaucaagaucuaccaccuccccgacgccgaguccgacgaggacgaggacuucaaggagcagacccgccuccucaaggccuccauccccuucuccgucgucggcuccaaccagcucaucgaggccaagggcaagaagguccgcggccgccucuaccccuggggcgucgucgaggucgagaaccccgagcacaacgacuuccucaagcuccgcaccaugcucaucacccacaugcaggaccuccaggaggucacccaggaccuccacuacgagaacuuccgcuccgagcgccucaagcgcggcggccgcaaggucgagaacgaggacaugaacaaggaccagauccuccucgagaaggaggccgagcuccgccgcaugcaggagaugaucgcccgcaugcaggcccagaugcagaugcagaugcagggcggcgacggcgacggcggcgcccucggccaccacgucuga

SEQ ID NO: 39174 - RNA, 1053 nt, Artificial Sequence
  derived and/or modified sequence opt2 from 37865__Homo_sapiens__NP_061979
auguccaagggccuccccgagacccgcaccgacgccgccauguccgagcucguccccgagccccgccccaagcccgccguccccaugaagcccauguccaucaacuccaaccuccucggcuacaucggcaucgacaccaucaucgagcagaugcgcaagaagaccaugaagaccggcuucgacuucaacaucauggucgucggccaguccggccucggcaaguccacccucgucaacacccucuucaagucccaggucucccgcaaggccuccuccuggaaccgcgaggagaagauccccaagaccgucgagaucaaggccaucggccacgucaucgaggagggcggcgucaagaugaagcucaccgucaucgacacccccggcuucggcgaccagaucaacaacgagaacugcugggagcccaucgagaaguacaucaacgagcaguacgagaaguuccucaaggaggaggucaacaucgcccgcaagaagcgcauccccgacacccgcguccacugcugccucuacuucaucucccccaccggccacucccuccgcccccucgaccucgaguucaugaagcaccucuccaaggucgucaacaucauccccgucaucgccaaggccgacaccaugacccucgaggagaaguccgaguucaagcagcgcguccgcaaggagcucgaggucaacggcaucgaguucuacccccagaaggaguucgacgaggaccucgaggacaagaccgagaacgacaagauccgccaggaguccaugcccuucgccgucgucggcuccgacaaggaguaccaggucaacggcaagcgcguccucggccgcaagacccccuggggcaucaucgaggucgagaaccucaaccacugcgaguucgcccuccuccgcgacuucgucauccgcacccaccuccaggaccucaaggaggucacccacaacauccacuacgagaccuaccgcgccaagcgccucaacgacaacggcggccucccccccgucuccgucgacaccgaggagucccacgacuccaaccccuga

SEQ ID NO: 39175 - RNA, 1413 nt, Artificial Sequence
  derived and/or modified sequence opt2 from 38231__Homo_sapiens__NP_001185642
augcccggcuucuacuccgucaugaccgacgaggagaucaagcgcuuccucgaggacaccaccgacgacggcgagcucuccaaguucgucaaggacuucuccggcaacgccuccugccacccccccgaggccaagaccugggccucccgcccccagguccccgagccccgcccccaggcccccgaccucuacgacgacgaccucgaguuccgcccccccucccgcccccaguccuccgacaaccagcaguacuucugcgcccccgccccccucucccccuccgcccgcccccgcucccccuggggcaagcucgaccccuacgacuccuccgaggacgacaaggaguacgucggcuucgccacccuccccaaccagguccaccgcaaguccgucaagaagggcuucgacuucacccucauggucgccggcgaguccggccucggcaaguccacccucgucaacucccucuuccucaccgaccucuaccgcgaccgcaagcuccucggcgccgaggagcgcaucaugcagaccgucgagaucaccaagcacgccgucgacaucgaggagaagggcguccgccuccgccucaccaucgucgacacccccggcuucggcgacgccgucaacaacaccgagugcuggaagcccgucgccgaguacaucgaccagcaguucgagcaguacuuccgcgacgaguccggccucaaccgcaagaacauccaggacaaccgcguccacugcugccucuacuucaucucccccuucggccacggccuccgcccccucgacgucgaguucaugaaggcccuccaccagcgcgucaacaucguccccauccucgccaaggccgacacccucaccccccccgaggucgaccacaagaagcgcaagauccgcgaggagaucgagcacuucggcaucaagaucuaccaguuccccgacugcgacuccgacgaggacgaggacuucaagcuccaggaccaggcccucaaggaguccauccccuucgccgucaucggcuccaacaccgucgucgaggcccgcggccgccgcguccgcggccgccucuaccccuggggcaucgucgaggucgagaaccccggccacugcgacuucgucaagcuccgcaccaugcucguccgcacccacaugcaggaccucaaggacgucacccgcgagacccacuacgagaacuaccgcgcccagugcauccaguccaugacccgccucgucgucaaggagcgcaaccgcaacaagcucacccgcgaguccggcaccgacuuccccauccccgccgucccccccggcaccgaccccgagaccgagaagcucauccgcgagaaggacgaggagcuccgccgcaugcaggagaugcuccacaagauccagaagcagaugaaggagaacuacuga

SEQ ID NO: 39176 - RNA, 1041 nt, Artificial Sequence
  derived and/or modified sequence opt2 from 38596__Homo_sapiens__NP_001009939
auggacucccucgccgccccccaggaccgccucgucgagcagcuccucuccccccgcacccaggcccagcgccgccucaaggacaucgacaagcaguacgucggcuucgccacccuccccaaccagguccaccgcaaguccgucaagaagggcuucgacuucacccucauggucgccggcgaguccggccucggcaaguccacccucguccacucccucuuccucaccgaccucuacaaggaccgcaagcuccucuccgccgaggagcgcaucucccagaccgucgagauccucaagcacaccgucgacaucgaggagaagggcgucaagcucaagcucaccaucgucgacacccccggcuucggcgacgccgucaacaacaccgagugcuggaagcccaucaccgacuacgucgaccagcaguucgagcaguacuuccgcgacgaguccggccucaaccgcaagaacauccaggacaaccgcguccacugcugccucuacuucaucucccccuucggccacggccuccgccccgucgacgucggcuucaugaaggcccuccacgagaaggucaacaucgucccccucaucgccaaggccgacugccucguccccuccgagauccgcaagcucaaggagcgcauccgcgaggagaucgacaaguucggcauccacgucuaccaguuccccgagugcgacuccgacgaggacgaggacuucaagcagcaggaccgcgagcucaaggaguccgcccccuucgccgucaucggcuccaacaccgucgucgaggccaagggccagcgcguccgcggccgccucuaccccuggggcaucgucgagggcgcccuccgccuccgcgaggccgcccagcacgcccacccccacgccuacgcccgcccccagggccgcgacguccgccgcgcccuccgcgagcucccccgcgcccuccaccccgccgacgaccagcagaccgaccccggccagccccacggcgagccccaccccgaccccgccgccgcccaccccggccgccgcgacuga

SEQ ID NO: 39177 - RNA, 1305 nt, Artificial Sequence
  derived and/or modified sequence opt2 from 38961__Homo_sapiens__NP_055944
auggccgccaccgacaucgcccgccaggucggcgagggcugccgcaccgucccccucgccggccacgucggcuucgacucccuccccgaccagcucgucaacaaguccgucucccagggcuucugcuucaacauccucugcgucggcgagaccggccucggcaaguccacccucauggacacccucuucaacaccaaguucgagggcgagcccgccacccacacccagcccggcguccagcuccaguccaacaccuacgaccuccaggaguccaacguccgccucaagcucaccaucgucuccaccgucggcuucggcgaccagaucaacaaggaggacuccuacaagcccaucgucgaguucaucgacgcccaguucgaggccuaccuccaggaggagcucaagauccgccgcguccuccacaccuaccacgacucccgcauccacgucugccucuacuucaucgcccccaccggccacucccucaagucccucgaccucgucaccaugaagaagcucgacuccaaggucaacaucauccccaucaucgccaaggccgacgccaucuccaaguccgagcucaccaaguucaagaucaagaucaccuccgagcucgucuccaacggcguccagaucuaccaguuccccaccgacgacgaguccgucgccgagaucaacggcaccaugaacgcccaccuccccuucgccgucaucggcuccaccgaggagcucaagaucggcaacaagaugaugcgcgcccgccaguaccccuggggcaccguccaggucgagaacgaggcccacugcgacuucgucaagcuccgcgagaugcucauccgcgucaacauggaggaccuccgcgagcagacccacacccgccacuacgagcucuaccgccgcugcaagcucgaggagaugggcuucaaggacaccgaccccgacuccaagcccuucucccuccaggagaccuacgaggccaagcgcaacgaguuccucggcgagcuccagaagaaggaggaggagaugcgccagauguucguccagcgcgucaaggagaaggaggccgagcucaaggaggccgagaaggagcuccacgagaaguucgaccgccucaagaagcuccaccaggacgagaagaagaagcucgaggacaagaagaagucccucgacgacgaggucaacgccuucaagcagcgcaagaccgccgccgagcuccuccagucccagggcucccaggccggcggcucccagacccucaagcgcgacaaggagaagaagaacaaccccuggcucugcaccgaguga

SEQ ID NO: 39178 - RNA, 1311 nt, Artificial Sequence
  derived and/or modified sequence opt2 from 39326__Homo_sapiens__NP_001011553
auguccgucuccgcccgcuccgccgccgccgaggagcgcuccgucaacuccuccaccauggcccagcagaagaaccucgagggcuacgucggcuucgccaaccuccccaaccaggucuaccgcaaguccgucaagcgcggcuucgaguucacccucauggucgucggcgaguccggccucggcaaguccacccucaucaacucccucuuccucaccgaccucuacucccccgaguaccccggccccucccaccgcaucaagaagaccguccaggucgagcaguccaagguccucaucaaggagggcggcguccagcuccuccucaccaucgucgacacccccggcuucggcgacgccgucgacaacuccaacugcuggcagcccgucaucgacuacaucgacuccaaguucgaggacuaccucaacgccgagucccgcgucaaccgccgccagaugcccgacaaccgcguccagugcugccucuacuucaucgcccccuccggccacggccucaagccccucgacaucgaguucaugaagcgccuccacgagaaggucaacaucaucccccucaucgccaaggccgacacccucacccccgaggagugccagcaguucaagaagcagaucaugaaggagauccaggagcacaagaucaagaucuacgaguuccccgagaccgacgacgaggaggagaacaagcucgucaagaagaucaaggaccgccucccccucgccgucgucggcuccaacaccaucaucgaggucaacggcaagcgcguccgcggccgccaguaccccuggggcgucgccgaggucgagaacggcgagcacugcgacuucaccauccuccgcaacaugcucauccgcacccacaugcaggaccucaaggacgucaccaacaacguccacuacgagaacuaccgcucccgcaagcucgccgccgucaccuacaacggcgucgacaacaacaagaacaagggccagcucaccaaguccccccucgcccagauggaggaggagcgccgcgagcacgucgccaagaugaagaagauggagauggagauggagcaggucuucgagaugaaggucaaggagaagguccagaagcucaaggacuccgaggccgagcuccagcgccgccacgagcagaugaagaagaaccucgaggcccagcacaaggagcucgaggagaagcgccgccaguucgaggacgagaaggccaacugggaggcccagcagcgcauccucgagcagcagaacuccucccgcacccucgagaagaacaagaagaagggcaagaucuucuga

SEQ ID NO: 39179 - RNA, 1761 nt, Artificial Sequence
  derived and/or modified sequence opt2 from 40057__Homo_sapiens__NP_001106963
augaagaaguccuacuccggcggcacccgcaccuccuccggccgccuccgccgccucggcgacuccuccggccccgcccucaagcgcuccuucgaggucgaggaggucgagacccccaacuccacccccccccgccgcguccagaccccccuccuccgcgccaccgucgccuccuccacccagaaguuccaggaccucggcgucaagaacuccgagcccuccgcccgccacgucgacucccucucccagcgcucccccaaggccucccuccgccgcgucgagcucuccggccccaaggccgccgagcccgucucccgccgcaccgagcucuccaucgacaucuccuccaagcaggucgagaacgccggcgccaucggccccucccgcuucggccucaagcgcgccgagguccucggccacaagacccccgagcccgccccccgccgcaccgagaucaccaucgucaagccccaggaguccgcccaccgccgcauggagccccccgccuccaagguccccgagguccccaccgcccccgccaccgacgccgcccccaagcgcgucgagauccagaugcccaagcccgccgaggcccccaccgcccccucccccgcccagacccucgagaacuccgagcccgcccccgucucccagcuccagucccgccucgagcccaagccccagccccccgucgccgaggccaccccccgcucccaggaggccaccgaggccgcccccuccugcgucggcgacauggccgacaccccccgcgacgccggccucaagcaggcccccgccucccgcaacgagaaggcccccgucgacuucggcuacgucggcaucgacuccauccucgagcagaugcgccgcaaggccaugaagcagggcuucgaguucaacaucauggucgucggccaguccggccucggcaaguccacccucaucaacacccucuucaaguccaagaucucccgcaaguccguccagcccaccuccgaggagcgcauccccaagaccaucgagaucaaguccaucacccacgacaucgaggagaagggcguccgcaugaagcucaccgucaucgacacccccggcuucggcgaccacaucaacaacgagaacugcuggcagcccaucaugaaguucaucaacgaccaguacgagaaguaccuccaggaggaggucaacaucaaccgcaagaagcgcauccccgacacccgcguccacugcugccucuacuucauccccgccaccggccacucccuccgcccccucgacaucgaguucaugaagcgccucuccaaggucgucaacaucguccccgucaucgccaaggccgacacccucacccucgaggagcgcguccacuucaagcagcgcaucaccgccgaccuccucuccaacggcaucgacgucuacccccagaaggaguucgacgaggacuccgaggaccgccucgucaacgagaaguuccgcgagaugauccccuucgccgucgucggcuccgaccacgaguaccaggucaacggcaagcgcauccucggccgcaagaccaaguggggcaccaucgaggucgagaacaccacccacugcgaguucgccuaccuccgcgaccuccucauccgcacccacaugcagaacaucaaggacaucaccuccuccauccacuucgaggccuaccgcgucaagcgccucaacgagggcuccuccgccauggccaacggcauggaggagaaggagcccgaggcccccgagauguga

SEQ ID NO: 39180 - RNA, 1365 nt, Artificial Sequence
  derived and/or modified sequence opt2 from 40422__Homo_sapiens__NP_653311
auggccuccuccgaggucgcccgccaccuccucuuccagucccacauggccaccaagaccaccugcauguccucccagggcuccgacgacgagcagaucaagcgcgagaacauccgcucccucaccauguccggccacgucggcuucgagucccuccccgaccagcucgucaaccgcuccauccagcagggcuucugcuucaacauccucugcgucggcgagaccggcaucggcaaguccacccucaucgacacccucuucaacaccaacuucgaggacuacgaguccucccacuucugccccaacgucaagcucaaggcccagaccuacgagcuccaggaguccaacguccagcucaagcucaccaucgucaacaccgucggcuucggcgaccagaucaacaaggaggaguccuaccagcccaucgucgacuacaucgacgcccaguucgaggccuaccuccaggaggagcucaagaucaagcgcucccucuucaccuaccacgacucccgcauccacgucugccucuacuucaucucccccaccggccacucccucaagacccucgaccuccucaccaugaagaaccucgacuccaaggucaacaucauccccgucaucgccaaggccgacaccgucuccaagaccgagcuccagaaguucaagaucaagcucauguccgagcucgucuccaacggcguccagaucuaccaguuccccaccgacgacgacaccaucgccaaggucaacgccgccaugaacggccagcuccccuucgccgucgucggcuccauggacgaggucaaggucggcaacaagauggucaaggcccgccaguaccccuggggcgucguccaggucgagaacgagaaccacugcgacuucgucaagcuccgcgagaugcucaucugcaccaacauggaggaccuccgcgagcagacccacacccgccacuacgagcucuaccgccgcugcaagcucgaggagaugggcuucaccgacgucggccccgagaacaagcccgucuccguccaggagaccuacgaggccaagcgccacgaguuccacggcgagcgccagcgcaaggaggaggagaugaagcagauguucguccagcgcgucaaggagaaggaggccauccucaaggaggccgagcgcgagcuccaggccaaguucgagcaccucaagcgccuccaccaggaggagcgcaugaagcucgaggagaagcgccgccuccucgaggaggagaucaucgccuucuccaagaagaaggccaccuccgagaucuuccacucccaguccuuccucgccaccggcuccaaccuccgcaaggacaaggaccgcaagaacuccaacuuccucuga

SEQ ID NO: 39181 - RNA, 1290 nt, Artificial Sequence
  derived and/or modified sequence opt2 from 40787__Homo_sapiens__NP_060713
auggccgucgccgucggccgccccuccaacgaggagcuccgcaaccucucccucuccggccacgucggcuucgacucccuccccgaccagcucgucaacaaguccaccucccagggcuucugcuucaacauccucugcgucggcgagaccggcaucggcaaguccacccucauggacacccucuucaacaccaaguucgaguccgaccccgccacccacaacgagcccggcguccgccucaaggcccgcuccuacgagcuccaggaguccaacguccgccucaagcucaccaucgucgacaccgucggcuucggcgaccagaucaacaaggacgacuccuacaagcccaucgucgaguacaucgacgcccaguucgaggccuaccuccaggaggagcucaagaucaagcgcucccucuucaacuaccacgacacccgcauccacgccugccucuacuucaucgcccccaccggccacucccucaagucccucgaccucgucaccaugaagaagcucgacuccaaggucaacaucauccccaucaucgccaaggccgacaccaucgccaagaacgagcuccacaaguucaaguccaagaucauguccgagcucgucuccaacggcguccagaucuaccaguuccccaccgacgaggagaccgucgccgagaucaacgccaccauguccguccaccuccccuucgccgucgucggcuccaccgaggaggucaagaucggcaacaagauggccaaggcccgccaguaccccuggggcgucguccaggucgagaacgagaaccacugcgacuucgucaagcuccgcgagaugcucauccgcgucaacauggaggaccuccgcgagcagacccacacccgccacuacgagcucuaccgccgcugcaagcucgaggagaugggcuucaaggacaccgaccccgacuccaagcccuucucccuccaggagaccuacgaggccaagcgcaacgaguuccucggcgagcuccagaagaaggaggaggagaugcgccagauguucgucaugcgcgucaaggagaaggaggccgagcucaaggaggccgagaaggagcuccacgagaaguucgaccuccucaagcgcacccaccaggaggagaagaagaaggucgaggacaagaagaaggagcucgaggaggaggucaacaacuuccagaagaagaaggccgccgcccagcuccuccagucccaggcccagcaguccggcgcccagcagaccaagaaggacaaggacaagaagaacgccuccuucaccuga

SEQ ID NO: 39182 - RNA, 939 nt, Artificial Sequence
  derived and/or modified sequence opt2 from 41153__Homo_sapiens__NP_001147930
auggacccccuccgccgcucccccucccccugccucuccucccagcccuccucccccuccaccccccccugcgagaugcucggccccgucggcaucgaggccguccucgaccagcucaagaucaaggccaugaagaugggcuucgaguucaacaucauggucgucggccaguccggccucggcaaguccaccauggucaacacccucuucaaguccaaggucuggaaguccaacccccccggccucggcguccccaccccccagacccuccagcuccacucccucacccacgucaucgaggagaagggcgucaagcucaagcucaccgucaccgacacccccggcuucggcgaccagaucaacaacgacaacugccuccgcccccucgacaucgaguuccuccagcgccucugccgcaccgucaacgucguccccgucaucgcccgcgccgacucccucaccauggaggagcgcgaggccuuccgccgccgcauccagcagaaccuccgcacccacugcaucgacgucuacccccagaugugcuucgacgaggacaucaacgacaagauccucaacuccaagcuccgcgaccgcauccccuucgccgucgucggcgccgaccaggagcaccucgucaacggccgcugcguccucggccgcaagaccaaguggggcaucaucgaggucgagaacauggcccacugcgaguucccccuccuccgcgaccuccucauccgcucccaccuccaggaccucaaggacaucacccacaacauccacuacgagaacuaccgcgucauccgccucaacgagucccaccuccucccccgcggccccggcugggucaaccucgcccccgccucccccggccagcucaccaccccccgcaccuucaaggucugccgcggcgcccacgacgacuccgacgacgaguucuga

SEQ ID NO: 39183 - RNA, 1299 nt, Artificial Sequence
  derived and/or modified sequence opt2 from 41883__Homo_sapiens__NP_997249
auggccgagcgcaccauggccaugcccacccagauccccgccgacggcgacacccagaaggagaacaacauccgcugccucaccaccaucggccacuucggcuucgagugccuccccaaccagcucgucucccgcuccauccgccagggcuucaccuucaacauccucugcgucggcgagaccggcaucggcaaguccacccucaucgacacccucuucaacaccaaccucaaggacaacaaguccucccacuucuacuccaacgucggccuccagauccagaccuacgagcuccaggaguccaacguccagcucaagcucaccgucgucgagaccgucggcuacggcgaccagaucgacaaggaggccuccuaccagcccaucgucgacuacaucgacgcccaguucgaggccuaccuccaggaggagcucaagaucaagcgcucccucuucgaguaccacgacucccgcguccacgucugccucuacuucaucucccccaccggccacucccucaagucccucgaccuccucaccaugaagaaccucgacuccaaggucaacaucaucccccucaucgccaaggccgacaccaucuccaagaacgaccuccagaccuucaagaacaagaucauguccgagcucaucuccaacggcauccagaucuaccagcuccccaccgacgaggagaccgccgcccaggccaacuccuccgucuccggccuccuccccuucgccgucgucggcuccaccgacgaggucaaggucggcaagcgcaugguccgcggccgccacuaccccuggggcguccuccaggucgagaacgagaaccacugcgacuucgucaagcuccgcgacaugcuccucugcaccaacauggagaaccucaaggagaagacccacacccagcacuacgagugcuaccgcuaccagaagcuccagaagaugggcuucaccgacgucggccccaacaaccagcccgucuccuuccaggagaucuucgaggccaagcgccaggaguucuacgaccagugccagcgcgaggaggaggagcucaagcagcgcuucaugcagcgcgucaaggagaaggaggccaccuucaaggaggccgagaaggagcuccaggacaaguucgagcaccucaagaugauccagcaggaggagauccgcaagcucgaggaggagaagaagcagcucgagggcgagaucaucgacuucuacaagaugaaggccgccuccgaggcccuccagacccagcucuccaccgacaccaagaaggacaagcaccgcaagaaguga

SEQ ID NO: 39184 - RNA, 1488 nt, Artificial Sequence
  derived and/or modified sequence opt2 from A1BG__Homo_sapiens__NP_570602
auguccaugcucgucgucuuccuccuccucuggggcgucaccuggggccccgucaccgaggccgccaucuucuacgagacccagcccucccucugggccgaguccgagucccuccucaagccccucgccaacgucacccucaccugccaggcccaccucgagacccccgacuuccagcucuucaagaacggcgucgcccaggagcccguccaccucgacucccccgccaucaagcaccaguuccuccucaccggcgacacccagggccgcuaccgcugccgcuccggccucuccaccggcuggacccagcucuccaagcuccucgagcucaccggccccaagucccuccccgcccccuggcucuccauggcccccgucuccuggaucacccccggccucaagaccaccgccgucugccgcggcguccuccgcggcgucaccuuccuccuccgccgcgagggcgaccacgaguuccucgagguccccgaggcccaggaggacgucgaggccaccuuccccguccaccagcccggcaacuacuccugcuccuaccgcaccgacggcgagggcgcccucuccgagcccuccgccaccgucaccaucgaggagcucgccgccccccccccccccguccucaugcaccacggcgaguccucccagguccuccaccccggcaacaaggucacccucaccugcgucgccccccucuccggcgucgacuuccagcuccgccgcggcgagaaggagcuccucgucccccgcuccuccaccucccccgaccgcaucuucuuccaccucaacgccgucgcccucggcgacggcggccacuacaccugccgcuaccgccuccacgacaaccagaacggcugguccggcgacuccgcccccgucgagcucauccucuccgacgagacccuccccgcccccgaguucucccccgagcccgaguccggccgcgcccuccgccuccgcugccucgccccccucgagggcgcccgcuucgcccucguccgcgaggaccgcggcggccgccgcguccaccgcuuccagucccccgccggcaccgaggcccucuucgagcuccacaacaucuccgucgccgacuccgccaacuacuccugcgucuacgucgaccucaagccccccuucggcggcuccgcccccuccgagcgccucgagcuccacgucgacggcccccccccccgcccccagcuccgcgccaccugguccggcgccguccucgccggccgcgacgccguccuccgcugcgagggccccauccccgacgucaccuucgagcuccuccgcgagggcgagaccaaggccgucaagaccguccgcacccccggcgccgccgccaaccucgagcucaucuucgucggcccccagcacgccggcaacuaccgcugccgcuaccgcuccugggucccccacaccuucgaguccgagcucuccgaccccgucgagcuccucgucgccgaguccuga

SEQ ID NO: 39185 - RNA, 1761 nt, Artificial Sequence
  derived and/or modified sequence opt2 from A1CF__Homo_sapiens__NP_001185747
auggaguccaaccacaaguccggcgacggccucuccggcacccagaaggaggccgcccuccgcgcccucguccagcgcaccggcuacucccucguccaggagaacggccagcgcaaguacggcggccccccccccggcugggacgccgccccccccgagcgcggcugcgagaucuucaucggcaagcucccccgcgaccucuucgaggacgagcucaucccccucugcgagaagaucggcaagaucuacgagaugcgcaugaugauggacuucaacggcaacaaccgcggcuacgccuucgucaccuucuccaacaaggucgaggccaagaacgccaucaagcagcucaacaacuacgagauccgcaacggccgccuccucggcgucugcgccuccgucgacaacugccgccucuucgucggcggcauccccaagaccaagaagcgcgaggagauccucuccgagaugaagaaggucaccgagggcgucgucgacgucaucgucuaccccuccgccgccgacaagaccaagaaccgcggcuucgccuucgucgaguacgagucccaccgcgccgccgccauggcccgccgcaagcuccuccccggccgcauccagcucuggggccacggcaucgccgucgacugggccgagcccgaggucgaggucgacgaggacaccauguccuccgucaagauccucuacguccgcaaccucaugcucuccaccuccgaggagaugaucgagaaggaguucaacaacaucaagcccggcgccgucgagcgcgucaagaagauccgcgacuacgccuucguccacuucuccaaccgcgaggacgccgucgaggccaugaaggcccucaacggcaagguccucgacggcucccccaucgaggucacccucgccaagcccgucgacaaggacuccuacguccgcuacacccgcggcaccggcggccgcggcaccaugcuccagggcgaguacaccuacucccucggccaggucuacgaccccaccaccaccuaccucggcgcccccgucuucuacgccccccagaccuacgccgccauccccucccuccacuuccccgccaccaagggccaccucuccaaccgcgccaucauccgcgcccccuccguccgcggcgccgccggcguccgcggccucggcggccgcggcuaccucgccuacaccggccucggccgcggcuaccaggucaagggcgacaagcgcgaggacaagcucuacgacauccuccccggcauggagcucacccccaugaaccccgucacccucaagccccagggcaucaagcucgccccccagauccucgaggagaucugccagaagaacaacuggggccagcccgucuaccagcuccacuccgccaucggccaggaccagcgccagcucuuccucuacaagaucaccauccccgcccucgccucccagaaccccgccauccaccccuucaccccccccaagcucuccgccuucgucgacgaggccaagaccuacgccgccgaguacacccuccagacccucggcauccccaccgacggcggcgacggcaccauggccaccgccgccgccgccgccaccgccuuccccggcuacgccguccccaacgccaccgcccccgucuccgccgcccagcucaagcaggccgucacccucggccaggaccucgccgccuacaccaccuacgaggucuaccccaccuucgccgucaccgcccgcggcgacggcuacggcaccuucuga

SEQ ID NO: 39186 - RNA, 4425 nt, Artificial Sequence
  derived and/or modified sequence opt2 from A2M__Homo_sapiens__NP_000005
augggcaagaacaagcuccuccaccccucccucguccuccuccuccucguccuccuccccaccgacgccuccgucuccggcaagccccaguacaugguccucguccccucccuccuccacaccgagaccaccgagaagggcugcguccuccucuccuaccucaacgagaccgucaccgucuccgccucccucgaguccguccgcggcaaccgcucccucuucaccgaccucgaggccgagaacgacguccuccacugcgucgccuucgccguccccaaguccuccuccaacgaggaggucauguuccucaccguccaggucaagggccccacccaggaguucaagaagcgcaccaccgucauggucaagaacgaggacucccucgucuucguccagaccgacaaguccaucuacaagcccggccagaccgucaaguuccgcgucgucuccauggacgagaacuuccacccccucaacgagcucaucccccucgucuacauccaggaccccaagggcaaccgcaucgcccaguggcaguccuuccagcucgagggcggccucaagcaguucuccuucccccucuccuccgagcccuuccagggcuccuacaaggucgucguccagaagaaguccggcggccgcaccgagcaccccuucaccgucgaggaguucguccuccccaaguucgagguccaggucaccguccccaagaucaucaccauccucgaggaggagaugaacgucuccgucugcggccucuacaccuacggcaagcccguccccggccacgucaccgucuccaucugccgcaaguacuccgacgccuccgacugccacggcgaggacucccaggccuucugcgagaaguucuccggccagcucaacucccacggcugcuucuaccagcaggucaagaccaaggucuuccagcucaagcgcaaggaguacgagaugaagcuccacaccgaggcccagauccaggaggagggcaccgucgucgagcucaccggccgccaguccuccgagaucacccgcaccaucaccaagcucuccuucgucaaggucgacucccacuuccgccagggcauccccuucuucggccagguccgccucgucgacggcaagggcguccccauccccaacaaggucaucuucauccgcggcaacgaggccaacuacuacuccaacgccaccaccgacgagcacggccucguccaguucuccaucaacaccaccaacgucaugggcaccucccucaccguccgcgucaacuacaaggaccgcucccccugcuacggcuaccagugggucuccgaggagcacgaggaggcccaccacaccgccuaccucgucuucucccccuccaaguccuucguccaccucgagcccaugucccacgagcuccccugcggccacacccagaccguccaggcccacuacauccucaacggcggcacccuccucggccucaagaagcucuccuucuacuaccucaucauggccaagggcggcaucguccgcaccggcacccacggccuccucgucaagcaggaggacaugaagggccacuucuccaucuccauccccgucaaguccgacaucgcccccgucgcccgccuccucaucuacgccguccuccccaccggcgacgucaucggcgacuccgccaaguacgacgucgagaacugccucgccaacaaggucgaccucuccuucucccccucccagucccuccccgccucccacgcccaccuccgcgucaccgccgccccccaguccgucugcgcccuccgcgccgucgaccaguccguccuccucaugaagcccgacgccgagcucuccgccuccuccgucuacaaccuccuccccgagaaggaccucaccggcuuccccggcccccucaacgaccaggacgacgaggacugcaucaaccgccacaacgucuacaucaacggcaucaccuacacccccgucuccuccaccaacgagaaggacauguacuccuuccucgaggacaugggccucaaggccuucaccaacuccaagauccgcaagcccaagaugugcccccagcuccagcaguacgagaugcacggccccgagggccuccgcgucggcuucuacgaguccgacgucaugggccgcggccacgcccgccucguccacgucgaggagccccacaccgagaccguccgcaaguacuuccccgagaccuggaucugggaccucgucgucgucaacuccgccggcgucgccgaggucggcgucaccguccccgacaccaucaccgaguggaaggccggcgccuucugccucuccgaggacgccggccucggcaucuccuccaccgccucccuccgcgccuuccagcccuucuucgucgagcucaccaugcccuacuccgucauccgcggcgaggccuucacccucaaggccaccguccucaacuaccuccccaagugcauccgcgucuccguccagcucgaggccucccccgccuuccucgccguccccgucgagaaggagcaggccccccacugcaucugcgccaacggccgccagaccgucuccugggccgucacccccaagucccucggcaacgucaacuucaccgucuccgccgaggcccucgagucccaggagcucugcggcaccgagguccccuccguccccgagcacggccgcaaggacaccgucaucaagccccuccucgucgagcccgagggccucgagaaggagaccaccuucaacucccuccucugccccuccggcggcgaggucuccgaggagcucucccucaagcucccccccaacgucgucgaggaguccgcccgcgccuccgucuccguccucggcgacauccucggcuccgccaugcagaacacccagaaccuccuccagaugcccuacggcugcggcgagcagaacaugguccucuucgcccccaacaucuacguccucgacuaccucaacgagacccagcagcucacccccgagaucaaguccaaggccaucggcuaccucaacaccggcuaccagcgccagcucaacuacaagcacuacgacggcuccuacuccaccuucggcgagcgcuacggccgcaaccagggcaacaccuggcucaccgccuucguccucaagaccuucgcccaggcccgcgccuacaucuucaucgacgaggcccacaucacccaggcccucaucuggcucucccagcgccagaaggacaacggcugcuuccgcuccuccggcucccuccucaacaacgccaucaagggcggcgucgaggacgaggucacccucuccgccuacaucaccaucgcccuccucgagaucccccucaccgucacccaccccgucguccgcaacgcccucuucugccucgaguccgccuggaagaccgcccaggagggcgaccacggcucccacgucuacaccaaggcccuccucgccuacgccuucgcccucgccggcaaccaggacaagcgcaaggagguccucaagucccucaacgaggaggccgucaagaaggacaacuccguccacugggagcgcccccagaagcccaaggcccccgucggccacuucuacgagccccaggcccccuccgccgaggucgagaugaccuccuacguccuccucgccuaccucaccgcccagcccgcccccaccuccgaggaccucaccuccgccaccaacaucgucaaguggaucaccaagcagcagaacgcccagggcggcuucuccuccacccaggacaccgucgucgcccuccacgcccucuccaaguacggcgccgccaccuucacccgcaccggcaaggccgcccaggucaccauccaguccuccggcaccuucuccuccaaguuccaggucgacaacaacaaccgccuccuccuccagcaggucucccuccccgagcuccccggcgaguacuccaugaaggucaccggcgagggcugcgucuaccuccagaccucccucaaguacaacauccuccccgagaaggaggaguuccccuucgcccucggcguccagacccucccccagaccugcgacgagcccaaggcccacaccuccuuccagaucucccucuccgucuccuacaccggcucccgcuccgccuccaacauggccaucgucgacgucaagauggucuccggcuucaucccccucaagcccaccgucaagaugcucgagcgcuccaaccacgucucccgcaccgaggucuccuccaaccacguccucaucuaccucgacaaggucuccaaccagacccucucccucuucuucaccguccuccaggacguccccguccgcgaccucaagcccgccaucgucaaggucuacgacuacuacgagaccgacgaguucgccaucgccgaguacaacgcccccugcuccaaggaccucggcaacgccuga

SEQ ID NO: 39187 - RNA, 4365 nt, Artificial Sequence
  derived and/or modified sequence opt2 from A2ML1__Homo_sapiens__NP_653271
augugggcccagcuccuccucggcaugcucgcccucucccccgccaucgccgaggagcuccccaacuaccucgucacccuccccgcccgccucaacuuccccuccguccagaaggucugccucgaccucucccccggcuacuccgacgucaaguucaccgucacccucgagaccaaggacaagacccagaagcuccucgaguacuccggccucaagaagcgccaccuccacugcaucuccuuccucguccccccccccgccggcggcaccgaggaggucgccaccauccgcgucuccggcgucggcaacaacaucuccuucgaggagaagaagaagguccucauccagcgccagggcaacggcaccuucguccagaccgacaagccccucuacacccccggccagcaggucuacuuccgcaucgucaccauggacuccaacuucguccccgucaacgacaaguacuccauggucgagcuccaggaccccaacuccaaccgcaucgcccaguggcucgaggucguccccgagcagggcaucgucgaccucuccuuccagcucgcccccgaggccaugcucggcaccuacaccgucgccgucgccgagggcaagaccuucggcaccuucuccgucgaggaguacguccuccccaaguucaaggucgaggucgucgagcccaaggagcucuccaccguccaggaguccuuccucgucaagaucugcugccgcuacaccuacggcaagcccaugcucggcgccguccaggucuccgucugccagaaggccaacaccuacugguaccgcgaggucgagcgcgagcagcuccccgacaagugccgcaaccucuccggccagaccgacaagaccggcugcuucuccgcccccgucgacauggccaccuucgaccucaucggcuacgccuacucccaccagaucaacaucgucgccaccgucgucgaggagggcaccggcgucgaggccaacgccacccagaacaucuacaucuccccccagaugggcuccaugaccuucgaggacaccuccaacuucuaccaccccaacuuccccuucuccggcaagauccgcguccgcggccacgacgacuccuuccucaagaaccaccucgucuuccucgucaucuacggcaccaacggcaccuucaaccagacccucgucaccgacaacaacggccucgcccccuucacccucgagaccuccggcuggaacggcaccgacgucucccucgagggcaaguuccagauggaggaccucgucuacaaccccgagcaggucccccgcuacuaccagaacgccuaccuccaccuccgccccuucuacuccaccacccgcuccuuccucggcauccaccgccucaacggcccccucaagugcggccagccccaggagguccucgucgacuacuacaucgaccccgccgacgccucccccgaccaggagaucuccuucuccuacuaccucaucggcaagggcucccucgucauggagggccagaagcaccucaacuccaagaagaagggccucaaggccuccuucucccucucccucaccuucaccucccgccucgcccccgaccccucccucgucaucuacgccaucuuccccuccggcggcgucgucgccgacaagauccaguucuccgucgagaugugcuucgacaaccaggucucccucggcuucucccccucccagcagcuccccggcgccgaggucgagcuccagcuccaggccgcccccggcucccucugcgcccuccgcgccgucgacgaguccguccuccuccuccgccccgaccgcgagcucuccaaccgcuccgucuacggcauguuccccuucugguacggccacuaccccuaccaggucgccgaguacgaccagugccccgucuccggccccugggacuucccccagccccucaucgaccccaugccccagggccacuccucccagcgcuccaucaucuggcgccccuccuucuccgagggcaccgaccucuucuccuucuuccgcgacgucggccucaagauccucuccaacgccaagaucaagaagcccgucgacugcucccaccgcucccccgaguacuccaccgccaugggcgccggcggcggccaccccgaggccuucgaguccuccaccccccuccaccaggccgaggacucccagguccgccaguacuuccccgagaccuggcucugggaccucuuccccaucggcaacuccggcaaggaggccguccacgucaccguccccgacgccaucaccgaguggaaggccauguccuucugcaccucccagucccgcggcuucggccucucccccaccgucggccucaccgccuucaagcccuucuucgucgaccucacccuccccuacuccgucguccgcggcgaguccuuccgccucaccgccaccaucuucaacuaccucaaggacugcauccgcguccagaccgaccucgccaagucccacgaguaccagcucgaguccugggccgacucccagaccuccuccugccucugcgccgacgaggccaagacccaccacuggaacaucaccgccgucaagcucggccacaucaacuucaccaucuccaccaagauccucgacuccaacgagcccugcggcggccagaagggcuucgucccccagaagggccgcuccgacacccucaucaagcccguccucgucaagcccgagggcguccucgucgagaagacccacuccucccuccucugccccaagggcaaggucgccuccgaguccgucucccucgagcuccccgucgacaucguccccgacuccaccaaggccuacgucaccguccucggcgacaucaugggcaccgcccuccagaaccucgacggccucguccagaugcccuccggcugcggcgagcagaacaugguccucuucgcccccaucaucuacguccuccaguaccucgagaaggccggccuccucaccgaggagauccgcucccgcgccgucggcuuccucgagaucggcuaccagaaggagcucauguacaagcacuccaacggcuccuacuccgccuucggcgagcgcgacggcaacggcaacaccuggcucaccgccuucgucaccaagugcuucggccaggcccagaaguucaucuucaucgaccccaagaacauccaggacgcccucaaguggauggccggcaaccagcuccccuccggcugcuacgccaacgucggcaaccuccuccacaccgccaugaagggcggcgucgacgacgaggucucccucaccgccuacgucaccgccgcccuccucgagaugggcaaggacgucgacgaccccauggucucccagggccuccgcugccucaagaacuccgccaccuccaccaccaaccucuacacccaggcccuccucgccuacaucuucucccucgccggcgagauggacauccgcaacauccuccucaagcagcucgaccagcaggccaucaucuccggcgaguccaucuacuggucccagaagcccacccccuccuccaacgccucccccugguccgagcccgccgccgucgacgucgagcucaccgccuacgcccuccucgcccagcucaccaagcccucccucacccagaaggagaucgccaaggccaccuccaucgucgccuggcucgccaagcagcgcaacgccuacggcggcuucuccuccacccaggacaccgucgucgcccuccaggcccucgccaaguacgccaccaccgccuacaugcccuccgaggagaucaaccucgucgucaaguccaccgagaacuuccagcgcaccuucaacauccaguccgucaaccgccucgucuuccagcaggacacccuccccaacguccccggcauguacacccucgaggccuccggccagggcugcgucuacguccagaccguccuccgcuacaacauccucccccccaccaacaugaagaccuucucccucuccgucgagaucggcaaggcccgcugcgagcagcccaccuccccccgcucccucacccucaccauccacaccuccuacgucggcucccgcuccuccuccaacauggccaucgucgaggucaagaugcucuccggcuucucccccauggagggcaccaaccagcuccuccuccagcagccccucgucaagaaggucgaguucggcaccgacacccucaacaucuaccucgacgagcucaucaagaacacccagaccuacaccuucaccaucucccaguccguccucgucaccaaccucaagcccgccaccaucaaggucuacgacuacuaccuccccgacgagcaggccaccauccaguacuccgaccccugcgaguga

SEQ ID NO: 39188 - RNA, 1023 nt, Artificial Sequence
  derived and/or modified sequence opt2 from A4GNT__Homo_sapiens__NP_057245
augcgcaaggagcuccagcucucccucuccgucacccuccuccucgucugcggcuuccucuaccaguucacccucaaguccuccugccucuucugccuccccuccuucaagucccaccagggccucgaggcccuccucucccaccgccgcggcaucgucuuccucgagaccuccgagcgcauggagcccccccaccucgucuccugcuccgucgaguccgccgccaagaucuaccccgaguggcccgucgucuucuucaugaagggccucaccgacuccacccccaugcccuccaacuccaccuaccccgccuucuccuuccucuccgccaucgacaacgucuuccucuucccccucgacaugaagcgccuccucgaggacaccccccucuucuccugguacaaccagaucaacgccuccgccgagcgcaacuggcuccacaucuccuccgacgccucccgccucgccaucaucuggaaguacggcggcaucuacauggacaccgacgucaucuccauccgccccauccccgaggagaacuuccucgccgcccaggccucccgcuacuccuccaacggcaucuucggcuuccucccccaccaccccuuccucugggagugcauggagaacuucgucgagcacuacaacuccgccaucuggggcaaccagggccccgagcucaugacccgcaugcuccgcgucuggugcaagcucgaggacuuccaggaggucuccgaccuccgcugccucaacaucuccuuccuccacccccagcgcuucuaccccaucuccuaccgcgaguggcgccgcuacuacgaggucugggacaccgagcccuccuucaacgucuccuacgcccuccaccucuggaaccacaugaaccaggagggccgcgccgucauccgcggcuccaacacccucgucgagaaccucuaccgcaagcacugcccccgcaccuaccgcgaccucaucaagggccccgagggcuccgucaccggcgagcucggccccggcaacaaguga

SEQ ID NO: 39189 - RNA, 1542 nt, Artificial Sequence
  derived and/or modified sequence opt2 from AAAS__Homo_sapiens__NP_001166937
augugcucccucggccucuucccccccccccccccccgcggccaggucacccucuacgagcacaacaacgagcucgucaccggcuccuccuacgagucccccccccccgacuuccgcggccaguggaucaaccuccccguccuccagcucaccaaggacccccucaagacccccggccgccucgaccacggcacccgcaccgccuucauccaccaccgcgagcaggucuggaagcgcugcaucaacaucuggcgcgacgucggccucuucggcguccucaacgagaucgccaacuccgaggaggaggucuucgagugggucaagaccgccuccggcugggcccucgcccucugccgcugggccuccucccuccacggcucccucuucccccaccucucccuccgcuccgaggaccucaucgccgaguucgcccaggucaccaacugcaccaucguccccucccucaagcaccgccuccagcgcaacgucgccucccucgccuggaagccccucuccgccuccguccucgccgucgccugccaguccugcauccucaucuggacccucgaccccaccucccucuccacccgccccuccuccggcugcgcccagguccucucccaccccggccacacccccgucaccucccucgccugggcccccuccggcggccgccuccucuccgccucccccgucgacgccgccauccgcgucugggacgucuccaccgagaccugcgucccccuccccugguuccgcggcggcggcgucaccaaccuccucuggucccccgacggcuccaagauccucgccaccacccccuccgccgucuuccgcgucugggaggcccagauguggaccugcgagcgcuggcccacccucuccggccgcugccagaccggcugcuggucccccgacggcucccgccuccucuucaccguccucggcgagccccucaucuacucccucuccuuccccgagcgcugcggcgagggcaagggcugcgucggcggcgccaaguccgccaccaucgucgccgaccucuccgagaccaccauccagacccccgacggcgaggagcgccucggcggcgaggcccacuccauggucugggaccccuccggcgagcgccucgccguccucaugaagggcaagccccgcguccaggacggcaagcccgucauccuccucuuccgcacccgcaacucccccgucuucgagcuccuccccugcggcaucauccagggcgagcccggcgcccagccccagcucaucaccuuccaccccuccuucaacaagggcgcccuccucuccgucggcugguccaccggccgcaucgcccacaucccccucuacuucgucaacgcccaguucccccgcuucucccccguccucggccgcgcccaggagccccccgccggcggcggcggcuccauccacgaccucccccucuucaccgagaccucccccaccuccgcccccugggacccccuccccggccccccccccguccucccccacuccccccacucccaccucuga

SEQ ID NO: 39190 - RNA, 2019 nt, Artificial Sequence
  derived and/or modified sequence opt2 from AACS__Homo_sapiens__NP_076417
auguccaaggaggagcgccccggccgcgaggagauccucgagugccaggucaugugggagcccgacuccaagaagaacacccagauggaccgcuuccgcgccgccgucggcgccgccugcggccucgcccucgaguccuacgacgaccucuaccacugguccgucgaguccuacuccgacuucugggccgaguucuggaaguucuccggcaucgucuucucccgcgucuacgacgaggucgucgacaccuccaagggcaucgccgacguccccgagugguucaagggcucccgccucaacuacgccgagaaccuccuccgccacaaggagaacgaccgcgucgcccucuacaucgcccgcgagggcaaggaggagaucgucaaggucaccuucgaggagcuccgccaggaggucgcccucuucgccgccgccaugcgcaagaugggcgucaagaagggcgaccgcgucgucggcuaccuccccaacuccgagcacgccgucgaggccaugcucgccgccgccuccaucggcgccaucugguccuccaccucccccgacuucggcgucaacggcguccucgaccgcuucucccagauccagcccaagcucaucuucuccgucgaggccgucgucuacaacggcaaggagcacaaccacauggagaagcuccagcaggucgucaagggccuccccgaccucaagaaggucgucgucauccccuacgucuccucccgcgagaacaucgaccucuccaagauccccaacuccgucuuccucgacgacuuccucgccaccggcaccuccgagcaggccccccagcucgaguucgagcagcuccccuucucccacccccucuucaucauguucuccuccggcaccaccggcgcccccaagugcaugguccacuccgccggcggcacccucauccagcaccucaaggagcaccuccuccacggcaacaugaccuccuccgacauccuccucugcuacaccaccgucggcuggaugauguggaacuggauggucucccuccucgccaccggcgccgccaugguccucuacgacggcuccccccucguccccacccccaacguccucugggaccucgucgaccgcaucggcaucaccguccucgucaccggcgccaaguggcucuccguccucgaggagaaggccaugaagcccgucgagacccacucccuccagaugcuccacaccauccucuccaccggcuccccccucaaggcccaguccuacgaguacgucuaccgcugcaucaaguccuccauccuccucggcuccaucuccggcggcaccgacaucaucuccugcuucaugggccacaacuucucccuccccgucuacaagggcgagauccaggcccgcaaccucggcauggccgucgaggccuggaacgaggagggcaaggccgucuggggcgaguccggcgagcucgucugcaccaagcccauccccugccagcccacccacuucuggaacgacgagaacggcaacaaguaccgcaaggccuacuucuccaaguuccccggcaucugggcccacggcgacuacugccgcaucaaccccaagaccggcggcaucgucaugcucggccgcuccgacggcacccucaaccccaacggcguccgcuucggcuccuccgagaucuacaacaucgucgaguccuucgaggaggucgaggacucccucugcgucccccaguacaacaaguaccgcgaggagcgcgucauccucuuccucaagauggccuccggccacgccuuccagcccgaccucgucaagcgcauccgcgacgccauccgcaugggccucuccgcccgccacguccccucccucauccucgagaccaagggcauccccuacacccucaacggcaagaaggucgaggucgccgucaagcagaucaucgccggcaaggccgucgagcagggcggcgccuucuccaaccccgagacccucgaccucuaccgcgacauccccgagcuccagggcuucuga

SEQ ID NO: 39191 - RNA, 1200 nt, Artificial Sequence
  derived and/or modified sequence opt2 from AADAC__Homo_sapiens__NP_001077
augggccgcaagucccucuaccuccucaucgucggcauccucaucgccuacuacaucuacaccccccuccccgacaacgucgaggagcccuggcgcaugauguggaucaacgcccaccucaagaccauccagaaccucgccaccuucgucgagcuccucggccuccaccacuucauggacuccuucaaggucgucggcuccuucgacgaggucccccccaccuccgacgagaacgucaccgucaccgagaccaaguucaacaacauccucguccgcgucuacguccccaagcgcaaguccgaggcccuccgccgcggccucuucuacauccacggcggcggcuggugcgucggcuccgccgcccucuccggcuacgaccuccucucccgcuggaccgccgaccgccucgacgccgucgucgucuccaccaacuaccgccucgcccccaaguaccacuuccccauccaguucgaggacgucuacaacgcccuccgcugguuccuccgcaagaagguccucgccaaguacggcgucaaccccgagcgcaucggcaucuccggcgacuccgccggcggcaaccucgccgccgccgucacccagcagcuccucgacgaccccgacgucaagaucaagcucaagauccagucccucaucuaccccgcccuccagccccucgacgucgaccuccccuccuaccaggagaacuccaacuuccucuuccucuccaagucccucaugguccgcuucugguccgaguacuucaccaccgaccgcucccucgagaaggccaugcucucccgccagcacguccccgucgaguccucccaccucuucaaguucgucaacugguccucccuccuccccgagcgcuucaucaagggccacgucuacaacaaccccaacuacggcuccuccgagcucgccaagaaguaccccggcuuccucgacguccgcgccgccccccuccucgccgacgacaacaagcuccgcggccucccccucaccuacgucaucaccugccaguacgaccuccuccgcgacgacggccucauguacgucacccgccuccgcaacaccggcguccaggucacccacaaccacgucgaggacggcuuccacggcgccuucuccuuccucggccucaagaucucccaccgccucaucaaccaguacaucgaguggcucaaggagaaccucuga

SEQ ID NO: 39192 - RNA, 948 nt, Artificial Sequence
  derived and/or modified sequence opt2 from AAGAB__Homo_sapiens__NP_078942
auggccgccggcguccccugcgcccucgucaccuccugcuccuccgucuucuccggcgaccagcucguccagcacauccucggcaccgaggaccucaucgucgaggucaccuccaacgacgccguccgcuucuaccccuggaccaucgacaacaaguacuacuccgccgacaucaaccucugcgucguccccaacaaguuccucgucaccgccgagaucgccgaguccguccaggccuucgucgucuacuucgacuccacccagaaguccggccucgacuccgucuccuccuggcucccccucgccaaggccuggcuccccgaggucaugauccucgucugcgaccgcgucuccgaggacggcaucaaccgccagaaggcccaggaguggugcaucaagcacggcuucgagcucgucgagcucucccccgaggagcuccccgaggaggacgacgacuuccccgaguccaccggcgucaagcgcaucguccaggcccucaacgccaacgucugguccaacgucgucaugaagaacgaccgcaaccagggcuucucccuccucaacucccucaccggcaccaaccacuccaucggcuccgccgaccccugccaccccgagcagccccaccuccccgccgccgacuccaccgagucccucuccgaccaccgcggcggcgccuccaacaccaccgacgcccaggucgacuccaucgucgaccccaugcucgaccucgacauccaggagcucgccucccucaccaccggcggcggcgacgucgagaacuucgagcgccucuucuccaagcucaaggagaugaaggacaaggccgccacccucccccacgagcagcgcaagguccacgccgagaaggucgccaaggccuucuggauggccaucggcggcgaccgcgacgagaucgagggccucuccuccgacgaggagcacuga

SEQ ID NO: 39193 - RNA, 2886 nt, Artificial Sequence
  derived and/or modified sequence opt2 from AAK1__Homo_sapiens__NP_055726
augaagaaguucuucgacucccgccgcgagcagggcggcuccggccucggcuccggcuccuccggcggcggcggcuccaccuccggccucggcuccggcuacaucggccgcgucuucggcaucggccgccagcaggucaccgucgacgagguccucgccgagggcggcuucgccaucgucuuccucguccgcaccuccaacggcaugaagugcgcccucaagcgcauguucgucaacaacgagcacgaccuccaggucugcaagcgcgagauccagaucaugcgcgaccucuccggccacaagaacaucgucggcuacaucgacuccuccaucaacaacgucuccuccggcgacgucugggagguccucauccucauggacuucugccgcggcggccaggucgucaaccucaugaaccagcgccuccagaccggcuucaccgagaacgagguccuccagaucuucugcgacaccugcgaggccgucgcccgccuccaccagugcaagacccccaucauccaccgcgaccucaaggucgagaacauccuccuccacgaccgcggccacuacguccucugcgacuucggcuccgccaccaacaaguuccagaacccccagaccgagggcgucaacgccgucgaggacgagaucaagaaguacaccacccucuccuaccgcgcccccgagauggucaaccucuacuccggcaagaucaucaccaccaaggccgacaucugggcccucggcugccuccucuacaagcucugcuacuucacccuccccuucggcgagucccaggucgccaucugcgacggcaacuucaccauccccgacaacucccgcuacucccaggacaugcacugccucauccgcuacaugcucgagcccgaccccgacaagcgccccgacaucuaccaggucuccuacuucuccuucaagcuccucaagaaggagugccccauccccaacguccagaacucccccauccccgccaagcuccccgagcccgucaaggccuccgaggccgccgccaagaagacccagcccaaggcccgccucaccgaccccauccccaccaccgagaccuccaucgccccccgccagcgccccaaggccggccagacccagcccaaccccggcauccuccccauccagcccgcccucaccccccgcaagcgcgccaccguccagccccccccccaggccgccggcuccuccaaccagcccggccuccucgccuccgucccccagcccaagccccaggccccccccucccagccccucccccagacccaggccaagcagccccaggccccccccaccccccagcagacccccuccacccaggcccagggccuccccgcccaggcccaggccaccccccagcaccagcagcagcucuuccucaagcagcagcagcagcagcagcagcccccccccgcccagcagcagcccgccggcaccuucuaccagcagcagcaggcccagacccagcaguuccaggccguccaccccgccacccagcagcccgccaucgcccaguuccccgucgucucccagggcggcucccagcagcagcucaugcagaacuucuaccagcagcagcagcagcagcagcagcagcagcagcagcagcagcucgccaccgcccuccaccagcagcagcucaugacccagcaggccgcccuccagcagaagcccaccauggccgccggccagcagccccagccccagcccgccgccgccccccagcccgcccccgcccaggagcccgccauccaggcccccguccgccagcagcccaagguccagaccacccccccccccgccguccagggccagaaggucggcucccucaccccccccuccucccccaagacccagcgcgccggccaccgccgcauccucuccgacgucacccacuccgccgucuucggcguccccgccuccaaguccacccagcuccuccaggccgccgccgccgaggccucccucaacaaguccaaguccgccaccaccacccccuccggcuccccccgcaccucccagcagaacgucuacaaccccuccgagggcuccaccuggaaccccuucgacgacgacaacuucuccaagcucaccgccgaggagcuccucaacaaggacuucgccaagcucggcgagggcaagcaccccgagaagcucggcggcuccgccgagucccucauccccggcuuccaguccacccagggcgacgccuucgccaccaccuccuucuccgccggcaccgccgagaagcgcaagggcggccagaccgucgacuccggccucccccuccucuccgucuccgaccccuucaucccccuccagguccccgacgcccccgagaagcucaucgagggccucaagucccccgacaccucccuccuccuccccgaccuccuccccaugaccgaccccuucggcuccaccuccgacgccgucaucgagaaggccgacgucgccgucgagucccucauccccggccucgagccccccgucccccagcgccuccccucccagaccgaguccgucaccuccaaccgcaccgacucccucaccggcgaggacucccuccucgacugcucccuccucuccaaccccaccaccgaccuccucgaggaguucgcccccaccgccaucuccgcccccguccacaaggccgccgaggacuccaaccucaucuccggcuucgacguccccgagggcuccgacaaggucgccgaggacgaguucgaccccauccccguccucaucaccaagaacccccagggcggccacucccgcaacuccuccggcuccuccgaguccucccuccccaaccucgcccgcucccuccuccucgucgaccagcucaucgaccucuga

SEQ ID NO: 39194 - RNA, 759 nt, Artificial Sequence
  derived and/or modified sequence opt2 from AANAT__Homo_sapiens__NP_001160051
auggagccccaguccaugaagggccagaagcgccccuucggcggccccuggcgccucaagguccucggcggcccccccuggcuccgccgcacccuccccaagcucggccgccccaaggaggcccccgucgcccgcauguccacccaguccacccacccccucaagcccgaggccccccgccucccccccggcauccccgagucccccuccugccagcgccgccacacccuccccgccuccgaguuccgcugccucacccccgaggacgccgucuccgccuucgagaucgagcgcgaggccuucaucuccguccucggcgucugcccccucuaccucgacgagauccgccacuuccucacccucugccccgagcucucccucggcugguucgaggagggcugccucgucgccuucaucaucggcucccucugggacaaggagcgccucaugcaggagucccucacccuccaccgcuccggcggccacaucgcccaccuccacguccucgccguccaccgcgccuuccgccagcagggccgcggccccauccuccucuggcgcuaccuccaccaccucggcucccagcccgccguccgccgcgccgcccucaugugcgaggacgcccucguccccuucuacgagcgcuucuccuuccacgccgucggccccugcgccaucaccgucggcucccucaccuucauggagcuccacugcucccuccgcggccaccccuuccuccgccgcaacuccggcugcuga

SEQ ID NO: 39195 - RNA, 468 nt, Artificial Sequence
  derived and/or modified sequence opt2 from AARD__Homo_sapiens__NP_001020528
augggccccggcgacuuccgccgcugccgcgagcgcaucucccagggccuccagggccuccccggccgcgccgagcucugguuccccccccgccccgccugcgacuucuucggcgacggccgcuccaccgacauccaggaggaggcccucgccgccuccccccuccucgaggaccuccgccgccgccucacccgcgccuuccagugggccguccagcgcgccaucucccgccgcguccaggaggccgccgccgccgccgccgcccgcgaggagcaguccuggaccggcgucgaggccacccucgcccgccuccgcgccgagcucgucgagaugcacuuccagaaccaccagcucgcccgcacccuccucgaccucaacaugaagguccagcagcucaagaaggaguacgagcucgagaucaccuccgacucccagucccccaaggacgacgccgccaaccccgaguga

SEQ ID NO: 39196 - RNA, 2958 nt, Artificial Sequence
  derived and/or modified sequence opt2 from AARS2__Homo_sapiens__NP_065796
auggccgccuccgucgccgccgccgcccgccgccuccgccgcgccauccgccgcucccccgccuggcgcggccucucccaccgcccccucuccuccgagccccccgccgccaaggccuccgccguccgcgccgccuuccucaacuucuuccgcgaccgccacggccaccgccucguccccuccgccuccguccgcccccgcggcgaccccucccuccucuucgucaacgccggcaugaaccaguucaagcccaucuuccucggcaccgucgacccccgcuccgagauggccggcuuccgccgcgucgccaacucccagaagugcguccgcgccggcggccaccacaacgaccucgaggacgucggccgcgaccucucccaccacaccuucuucgagaugcucggcaacugggccuucggcggcgaguacuucaaggaggaggccugcaacauggccugggagcuccucacccaggucuacggcauccccgaggagcgccucuggaucuccuacuucgacggcgaccccaaggccggccucgaccccgaccucgagacccgcgacaucuggcucucccucggcguccccgccucccgcguccucuccuucggcccccaggagaacuucugggagaugggcgacaccggccccugcggccccugcaccgagauccacuacgaccucgccggcggcgucggcgccccccagcucgucgagcucuggaaccucgucuucaugcagcacaaccgcgaggccgacggcucccuccagccccucccccagcgccacgucgacaccggcaugggccucgagcgccucgucgccguccuccagggcaagcacuccaccuacgacaccgaccucuucuccccccuccucaacgccauccagcagggcugccgcgccccccccuaccucggccgcgucggcgucgccgacgagggccgcaccgacaccgccuaccgcgucgucgccgaccacauccgcacccucuccgucugcaucuccgacggcgucuuccccggcauguccggccccccccucguccuccgccgcauccuccgccgcgccguccgcuucuccauggagauccucaaggccccccccggcuuccucggcucccucguccccgucgucgucgagacccucggcgacgccuaccccgagcuccagcgcaacuccgcccagaucgccaaccucgucuccgaggacgaggccgccuuccucgccucccucgagcgcggccgccgcaucaucgaccgcacccuccgcacccucggccccuccgacauguuccccgccgaggucgccuggucccucucccucugcggcgaccucggccucccccucgacauggucgagcucaugcucgaggagaagggcguccagcucgacuccgccggccucgagcgccucgcccaggaggaggcccagcaccgcgcccgccaggccgagcccguccagaagcagggccucuggcucgacguccacgcccucggcgagcuccagcgccagggcgucccccccaccgacgacucccccaaguacaacuacucccuccgccccuccggcuccuacgaguucggcaccugcgaggcccagguccuccagcucuacaccgaggacggcaccgccgucgccuccgucggcaagggccagcgcugcggccuccuccucgaccgcaccaacuucuacgccgagcagggcggccaggccuccgaccgcggcuaccucguccgcgccggccaggaggacguccucuuccccgucgcccgcgcccaggucugcggcggcuucauccuccacgaggccgucgcccccgagugccuccgccucggcgaccagguccagcuccacgucgacgaggccuggcgccucggcugcauggccaagcacaccgccacccaccuccucaacugggcccuccgccagacccucggccccggcaccgagcagcagggcucccaccucaaccccgagcagcuccgccucgacgucaccacccagaccccccucacccccgagcagcuccgcgccgucgagaacaccguccaggaggccgucggccaggacgaggccgucuacauggaggaggucccccucgcccucaccgcccagguccccggccuccgcucccucgacgaggucuaccccgaccccguccgcgucgucuccgucggcguccccgucgcccacgcccucgaccccgccucccaggccgcccuccagaccuccgucgagcucugcugcggcacccaccuccuccgcaccggcgccgucggcgaccucgucaucaucggcgaccgccagcucuccaagggcaccacccgccuccucgccgucaccggcgagcaggcccagcaggcccgcgagcucggccagucccucgcccaggaggucaaggccgccaccgagcgccucucccucggcucccgcgacgucgccgaggcccuccgccucuccaaggacaucggccgccucaucgaggccgucgagaccgccgucaugccccaguggcagcgccgcgagcuccucgccaccgucaagaugcuccagcgccgcgccaacaccgccauccgcaagcuccagaugggccaggccgccaagaagacccaggagcuccucgagcgccacuccaagggcccccucaucgucgacaccgucuccgccgagucccucuccguccucgucaaggucguccgccagcucugcgagcaggcccccuccaccuccguccuccuccucuccccccagcccaugggcaagguccucugcgccugccaggucgcccagggcgccaugcccaccuucaccgccgaggccugggcccucgccgucugcucccacaugggcggcaaggccuggggcucccgcgucgucgcccagggcaccggcuccaccaccgaccucgaggccgcccucuccaucgcccagaccuacgcccucucccagcucuga

SEQ ID NO: 39197 - RNA, 2907 nt, Artificial Sequence
  derived and/or modified sequence opt2 from AARS__Homo_sapiens__NP_001596
auggacuccacccucaccgccuccgagauccgccagcgcuucaucgacuucuucaagcgcaacgagcacaccuacguccacuccuccgccaccaucccccucgacgaccccacccuccucuucgccaacgccggcaugaaccaguucaagcccaucuuccucaacaccaucgaccccucccaccccauggccaagcucucccgcgccgccaacacccagaagugcauccgcgccggcggcaagcacaacgaccucgacgacgucggcaaggacgucuaccaccacaccuucuucgagaugcucggcuccugguccuucggcgacuacuucaaggagcucgccugcaagauggcccucgagcuccucacccaggaguucggcauccccaucgagcgccucuacgucaccuacuucggcggcgacgaggccgccggccucgaggccgaccucgagugcaagcagaucuggcagaaccucggccucgacgacaccaagauccuccccggcaacaugaaggacaacuucugggagaugggcgacaccggccccugcggccccugcuccgagauccacuacgaccgcaucggcggccgcgacgccgcccaccucgucaaccaggacgaccccaacguccucgagaucuggaaccucgucuucauccaguacaaccgcgaggccgacggcauccucaagccccuccccaagaaguccaucgacaccggcaugggccucgagcgccucgucuccguccuccagaacaagauguccaacuacgacaccgaccucuucguccccuacuucgaggccauccagaagggcaccggcgcccgccccuacaccggcaaggucggcgccgaggacgccgacggcaucgacauggccuaccgcguccucgccgaccacgcccgcaccaucaccgucgcccucgccgacggcggccgccccgacaacaccggccgcggcuacguccuccgccgcauccuccgccgcgccguccgcuacgcccacgagaagcucaacgccucccgcggcuucuucgccacccucgucgacgucgucguccagucccucggcgacgccuuccccgagcucaagaaggaccccgacauggucaaggacaucaucaacgaggaggagguccaguuccucaagacccucucccgcggccgccgcauccucgaccgcaagauccagucccucggcgacuccaagaccauccccggcgacaccgccuggcuccucuacgacaccuacggcuuccccgucgaccucaccggccucaucgccgaggagaagggccucgucgucgacauggacggcuucgaggaggagcgcaagcucgcccagcucaagucccagggcaagggcgccggcggcgaggaccucaucaugcucgacaucuacgccaucgaggagcuccgcgcccgcggccucgaggucaccgacgacucccccaaguacaacuaccaccucgacuccuccggcuccuacgucuucgagaacaccgucgccaccgucauggcccuccgccgcgagaagauguucgucgaggaggucuccaccggccaggagugcggcgucguccucgacaagaccugcuucuacgccgagcagggcggccagaucuacgacgagggcuaccucgucaaggucgacgacuccuccgaggacaagaccgaguucaccgucaagaacgcccagguccgcggcggcuacguccuccacaucggcaccaucuacggcgaccucaaggucggcgaccaggucuggcucuucaucgacgagccccgccgccgccccaucauguccaaccacaccgccacccacauccucaacuucgcccuccgcuccguccucggcgaggccgaccagaagggcucccucgucgcccccgaccgccuccgcuucgacuucaccgccaagggcgccauguccacccagcagaucaagaaggccgaggagaucgccaacgagaugaucgaggccgccaaggccgucuacacccaggacugcccccucgccgccgccaaggccauccagggccuccgcgccgucuucgacgagaccuaccccgaccccguccgcgucgucuccaucggcguccccgucuccgagcuccucgacgaccccuccggccccgccggcucccucaccuccgucgaguucugcggcggcacccaccuccgcaacuccucccacgccggcgccuucgucaucgucaccgaggaggccaucgccaagggcauccgccgcaucgucgccgucaccggcgccgaggcccagaaggcccuccgcaaggccgagucccucaagaagugccucuccgucauggaggccaaggucaaggcccagaccgcccccaacaaggacguccagcgcgagaucgccgaccucggcgaggcccucgccaccgccgucaucccccaguggcagaaggacgagcuccgcgagacccucaagucccucaagaaggucauggacgaccucgaccgcgccuccaaggccgacguccagaagcgcguccucgagaagaccaagcaguucaucgacuccaaccccaaccagccccucgucauccucgagauggaguccggcgccuccgccaaggcccucaacgaggcccucaagcucuucaagaugcacuccccccagaccuccgccaugcucuucaccgucgacaacgaggccggcaagaucaccugccucugccaggucccccagaacgccgccaaccgcggccucaaggccuccgaguggguccagcaggucuccggccucauggacggcaagggcggcggcaaggacgucuccgcccaggccaccggcaagaacgucggcugccuccaggaggcccuccagcucgccaccuccuucgcccagcuccgccucggcgacgucaagaacuga

SEQ ID NO: 39198 - RNA, 2997 nt, Artificial Sequence
  derived and/or modified sequence opt2 from AASDH__Homo_sapiens__NP_001273597
augaagaagugcaaccucaaguacauccucgucgagaagaagcagaucaacaaguucaaguccuuccacgagacccuccucaacuacgacaccuucaccgucgagcacaacgaccucguccucuuccgccuccacuggaagaacaccgaggucaaccucaugcucaacgacggcaaggagaaguacgagaaggagaagaucaaguccaucuccuccgagcacgucaacgaggagaaggccgaggagcacauggaccuccgccucaagcacugccucgccuacguccuccacaccuccggcaccaccggcauccccaagaucguccgcgucccccacaagugcaucguccccaacauccagcacuuccgcguccucuucgacaucacccaggaggacguccucuuccucgccuccccccucaccuucgaccccuccgucgucgagaucuuccucgcccucuccuccggcgccucccuccucaucguccccaccuccgucaagcuccuccccuccaagcucgccuccguccucuucucccaccaccgcgucaccguccuccaggccacccccacccuccuccgccgcuucggcucccagcucaucaaguccaccguccucuccgccaccaccucccuccgcguccucgcccucggcggcgaggccuuccccucccucaccguccuccgcuccuggcgcggcgagggcaacaagacccagaucuucaacgucuacggcaucaccgaggucuccuccugggccaccaucuaccgcauccccgagaagacccucaacuccacccucaagugcgagcuccccguccagcucggcuucccccuccucggcaccgucgucgagguccgcgacaccaacggcuucaccauccaggagggcuccggccaggucuuccucggcggccgcaaccgcgucugcuuccucgacgacgaggucaccgucccccucggcaccaugcgcgccaccggcgacuucgucaccgucaaggacggcgagaucuucuuccucggccgcaaggacucccagaucaagcgccacggcaagcgccucaacaucgagcucguccagcaggucgccgaggagcuccagcaggucgaguccugcgccgucaccugguacaaccaggagaagcucauccucuucauggucuccaaggacgccuccgucaaggaguacaucuucaaggagcuccagaaguaccuccccucccacgccguccccgacgagcucguccucaucgacucccuccccuucaccucccacggcaagaucgacgucuccgagcucaacaagaucuaccucaacuacaucaaccucaaguccgagaacaagcucuccggcaaggaggaccucugggagaagcuccaguaccucuggaaguccacccucaaccuccccgaggaccuccuccgcguccccgacgagucccucuuccucaacuccggcggcgacucccucaaguccauccgccuccucuccgagaucgagaagcucgucggcaccuccguccccggccuccucgagaucauccucuccuccuccauccucgagaucuacaaccacauccuccagaccgucguccccgacgaggacgucaccuuccgcaaguccugcgccaccaagcgcaagcucuccgacaucaaccaggaggaggccuccggcaccucccuccaccagaaggccaucaugaccuucaccugccacaacgagaucaacgccuucgucguccucucccgcggcucccagauccucucccucaacuccacccgcuuccucaccaagcucggccacugcuccuccgccugccccuccgacuccgucucccagaccaacauccagaaccucaagggccucaacucccccguccucaucggcaaguccaaggaccccuccugcgucgccaaggucuccgaggagggcaagcccgccaucggcacccagaagauggagcuccacguccgcuggcgcuccgacaccggcaagugcgucgacgccuccccccucgucgucauccccaccuucgacaaguccuccaccaccgucuacaucggcucccacucccaccgcaugaaggccgucgacuucuacuccggcaaggucaagugggagcagauccucggcgaccgcaucgaguccuccgccugcgucuccaagugcggcaacuucaucgucgucggcugcuacaacggccucgucuacguccucaaguccaacuccggcgagaaguacuggauguucaccaccgaggacgccgucaaguccuccgccaccauggaccccaccaccggccucaucuacaucggcucccacgaccagcacgccuacgcccucgacaucuaccgcaagaagugcgucuggaaguccaagugcggcggcaccgucuucuccucccccugccucaaccucaucccccaccaccucuacuucgccacccucggcggccuccuccucgccgucaaccccgccaccggcaacgucaucuggaagcacuccugcggcaagccccucuucuccuccccccagugcugcucccaguacaucugcaucggcugcgucgacggcaaccuccucugcuucacccacuucggcgagcaggucuggcaguucuccaccuccggccccaucuucuccucccccugcaccucccccuccgagcagaagaucuucuucggcucccacgacugcuucaucuacugcugcaacaugaagggccaccuccaguggaaguucgagaccaccucccgcgucuacgccacccccuucgccuuccacaacuacaacggcuccaacgagaugcuccucgccgccgccuccaccgacggcaaggucuggauccucgagucccaguccggccagcuccaguccgucuacgagcuccccggcgaggucuucuccucccccgucguccucgaguccaugcucaucaucggcugccgcgacaacuacgucuacugccucgaccuccucggcggcaaccagaaguga

SEQ ID NO: 39199 - RNA, 930 nt, Artificial Sequence
  derived and/or modified sequence opt2 from AASDHPPT__Homo_sapiens__NP_056238
auggucuuccccgccaagcgcuucugccucguccccuccauggagggcguccgcugggccuucuccugcggcaccuggcuccccucccgcgccgaguggcuccucgccguccgcuccauccagcccgaggagaaggagcgcaucggccaguucgucuucgcccgcgacgccaaggccgccauggccggccgccucaugauccgcaagcucgucgccgagaagcucaacauccccuggaaccacauccgccuccagcgcaccgccaagggcaagcccguccucgccaaggacuccuccaaccccuaccccaacuucaacuucaacaucucccaccagggcgacuacgccguccucgccgccgagcccgagcuccaggucggcaucgacaucaugaagaccuccuuccccggccgcggcuccauccccgaguucuuccacaucaugaagcgcaaguucaccaacaaggagugggagaccauccgcuccuucaaggacgaguggacccagcucgacauguucuaccgcaacugggcccucaaggaguccuucaucaaggccaucggcgucggccucggcuucgagcuccagcgccucgaguucgaccucuccccccucaaccucgacaucggccaggucuacaaggagacccgccucuuccucgacggcgaggaggagaaggagugggccuucgaggaguccaagaucgacgagcaccacuucgucgccgucgcccuccgcaagcccgacggcucccgccaccaggacguccccucccaggacgacuccaagcccacccagcgccaguucaccauccucaacuucaacgaccucauguccuccgccguccccaugacccccgaggaccccuccuucugggacugcuucugcuucaccgaggagauccccauccgcaacggcaccaaguccuga

SEQ ID NO: 39200 - RNA, 2781 nt, Artificial Sequence
  derived and/or modified sequence opt2 from AASS__Homo_sapiens__NP_005754
augcuccagguccaccgcaccggccucggccgccucggcgucucccucuccaagggccuccaccacaaggccguccucgccguccgccgcgaggacgucaacgccugggagcgccgcgccccccucgcccccaagcacaucaagggcaucaccaaccucggcuacaagguccucauccagcccuccaaccgccgcgccauccacgacaaggacuacgucaaggccggcggcauccuccaggaggacaucuccgaggccugccucauccucggcgucaagcgcccccccgaggagaagcucaugucccgcaagaccuacgccuucuucucccacaccaucaaggcccaggaggccaacaugggccuccucgacgagauccucaagcaggagauccgccucaucgacuacgagaagauggucgaccaccgcggcguccgcgucgucgccuucggccagugggccggcgucgccggcaugaucaacauccuccacggcaugggccuccgccuccucgcccucggccaccacacccccuucaugcacaucggcauggcccacaacuaccgcaacuccucccaggccguccaggccguccgcgacgccggcuacgagaucucccucggccucaugcccaaguccaucggcccccucaccuucgucuucaccggcaccggcaacgucuccaagggcgcccaggccaucuucaacgagcuccccugcgaguacgucgagccccacgagcucaaggaggucucccagaccggcgaccuccgcaaggucuacggcaccguccucucccgccaccaccaccucguccgcaagaccgacgccgucuacgaccccgccgaguacgacaagcaccccgagcgcuacaucucccgcuucaacaccgacaucgcccccuacaccaccugccucaucaacggcaucuacugggagcagaacaccccccgccuccucacccgccaggacgcccagucccuccucgcccccggcaaguucucccccgccggcgucgagggcugccccgcccucccccacaagcucgucgccaucugcgacaucuccgccgacaccggcggcuccaucgaguucaugaccgagugcaccaccaucgagcaccccuucugcauguacgacgccgaccagcacaucauccacgacuccgucgagggcuccggcauccucaugugcuccaucgacaaccuccccgcccagcuccccaucgaggccaccgagugcuucggcgacaugcucuaccccuacgucgaggagaugauccucuccgacgccacccagccccucgagucccagaacuucucccccgucguccgcgacgccgucaucaccuccaacggcacccuccccgacaaguacaaguacauccagacccuccgcgagucccgcgagcgcgcccagucccucuccaugggcacccgccgcaagguccucguccucggcuccggcuacaucuccgagcccguccucgaguaccucucccgcgacggcaacaucgagaucaccgucggcuccgacaugaagaaccagaucgagcagcucggcaagaaguacaacaucaaccccgucuccauggacaucugcaagcaggaggagaagcucggcuuccucgucgccaagcaggaccucgucaucucccuccuccccuacguccuccacccccucgucgccaaggccugcaucaccaacaaggucaacauggucaccgccuccuacaucacccccgcccucaaggagcucgagaaguccgucgaggacgccggcaucaccaucaucggcgagcucggccucgaccccggccucgaccacaugcucgccauggagaccaucgacaaggccaaggaggucggcgccaccaucgaguccuacaucuccuacugcggcggccuccccgcccccgagcacuccaacaacccccuccgcuacaaguucuccuggucccccgucggcguccucaugaacgucaugcaguccgccaccuaccuccucgacggcaaggucgucaacgucgccggcggcaucuccuuccucgacgccgucaccuccauggacuucuuccccggccucaaccucgagggcuaccccaaccgcgacuccaccaaguacgccgagaucuacggcaucuccuccgcccacacccuccuccgcggcacccuccgcuacaagggcuacaugaaggcccucaacggcuucgucaagcucggccucaucaaccgcgaggcccuccccgccuuccgccccgaggccaacccccucaccuggaagcagcuccucugcgaccucgucggcaucucccccuccuccgagcacgacguccucaaggaggccguccucaagaagcucggcggcgacaacacccagcucgaggccgccgaguggcucggccuccucggcgacgagcaggucccccaggccgaguccauccucgacgcccucuccaagcaccucgucaugaagcucuccuacggccccgaggagaaggacaugaucgucaugcgcgacuccuucggcauccgccaccccuccggccaccucgagcacaagaccaucgaccucgucgccuacggcgacaucaacggcuucuccgccauggccaagaccgucggccuccccaccgccauggccgccaagaugcuccucgacggcgagaucggcgccaagggccucaugggccccuucuccaaggagaucuacggccccauccucgagcgcaucaaggccgagggcaucaucuacaccacccaguccaccaucaagcccuga

SEQ ID NO: 39201 - RNA, 1683 nt, Artificial Sequence
  derived and/or modified sequence opt2 from AATF__Homo_sapiens__NP_036270
auggccggcccccagccccucgcccuccagcucgagcagcuccucaacccccgccccuccgaggccgaccccgaggccgaccccgaggaggccaccgccgcccgcgucaucgaccgcuucgacgagggcgaggacggcgagggcgacuuccucgucgucggcuccauccgcaagcucgccuccgccucccuccucgacaccgacaagcgcuacugcggcaagaccaccucccgcaaggccuggaacgaggaccacugggagcagacccuccccggcuccuccgacgaggagaucuccgacgaggagggcuccggcgacgaggacuccgagggccucggccucgaggaguacgacgaggacgaccucggcgccgccgaggagcaggagugcggcgaccaccgcgaguccaagaagucccgcucccacuccgccaagacccccggcuucuccguccaguccaucuccgacuucgagaaguucaccaagggcauggacgaccucggcuccuccgaggaggaggaggacgaggaguccggcauggaggagggcgacgacgccgaggacucccagggcgaguccgaggaggaccgcgccggcgaccgcaacuccgaggacgacggcgucgucaugaccuucuccuccgucaaggucuccgaggaggucgagaagggccgcgccgucaagaaccagaucgcccucugggaccagcuccucgagggccgcaucaagcuccagaaggcccuccucaccaccaaccagcucccccagcccgacgucuucccccucuucaaggacaagggcggccccgaguucuccuccgcccucaagaacucccacaaggcccucaaggcccuccuccgcucccucgucggccuccaggaggagcuccucuuccaguaccccgacacccgcuaccucgucgacggcaccaagcccaacgccggcuccgaggagaucuccuccgaggacgacgagcucgucgaggagaagaagcagcagcgccgccgcguccccgccaagcgcaagcucgagauggaggacuaccccuccuucauggccaagcgcuucgccgacuucaccgucuaccgcaaccgcacccuccagaaguggcacgacaagaccaagcucgccuccggcaagcucggcaagggcuucggcgccuucgagcgcuccauccucacccagaucgaccacauccucauggacaaggagcgccuccuccgccgcacccagaccaagcgcuccgucuaccgcguccucggcaagcccgagcccgccgcccagcccguccccgagucccuccccggcgagcccgagauccucccccaggcccccgccaacgcccaccucaaggaccucgacgaggagaucuucgacgacgacgacuucuaccaccagcuccuccgcgagcucaucgagcgcaagaccuccucccucgaccccaacgaccaggucgccaugggccgccaguggcucgccauccagaagcuccgcuccaagauccacaagaaggucgaccgcaaggccuccaagggccgcaagcuccgcuuccacguccucuccaagcuccucuccuucauggcccccaucgaccacaccaccaugaacgacgacgcccgcaccgagcucuaccgcucccucuucggccagcuccacccccccgacgagggccacggcgacuga

SEQ ID NO: 39202 - RNA, 4125 nt, Artificial Sequence
  derived and/or modified sequence opt2 from AATK__Homo_sapiens__NP_001073864
auguccuccuccuucuucaaccccuccuucgccuucuccucccacuucgaccccgacggcgccccccucuccgagcucuccuggcccuccucccucgccgucgucgccgucuccuucuccggccucuucgccgucaucguccucaugcucgccugccucugcugcaagaagggcggcaucggcuucaaggaguucgagaacgccgagggcgacgaguacgccgccgaccucgcccagggcucccccgccaccgccgcccagaacggccccgacgucuacguccucccccucaccgaggucucccuccccauggccaagcagcccggccgcuccguccagcuccucaaguccaccgacgucggccgccacucccuccucuaccucaaggagaucggccgcggcugguucggcaaggucuuccucggcgaggucaacuccggcaucuccuccgcccaggucgucgucaaggagcuccaggccuccgccuccguccaggagcagaugcaguuccucgaggagguccagcccuaccgcgcccucaagcacuccaaccuccuccagugccucgcccagugcgccgaggucacccccuaccuccucgucauggaguucugcccccucggcgaccucaagggcuaccuccgcuccugccgcgucgccgaguccauggcccccgacccccgcacccuccagcgcauggccugcgaggucgccugcggcguccuccaccuccaccgcaacaacuucguccacuccgaccucgcccuccgcaacugccuccucaccgccgaccucaccgucaagaucggcgacuacggccucgcccacugcaaguaccgcgaggacuacuucgucaccgccgaccagcucugggucccccuccgcuggaucgcccccgagcucgucgacgagguccacuccaaccuccucgucgucgaccagaccaaguccggcaacgucuggucccucggcgucaccaucugggagcucuucgagcucggcacccagcccuacccccagcacuccgaccagcagguccucgccuacaccguccgcgagcagcagcucaagcuccccaagccccagcuccagcucacccucuccgaccgcugguacgaggucaugcaguucugcuggcuccagcccgagcagcgccccaccgccgaggagguccaccuccuccucuccuaccucugcgccaagggcgccaccgaggccgaggaggaguucgagcgccgcuggcgcucccuccgccccggcggcggcggcgucggccccggccccggcgccgccggccccaugcucggcggcgucgucgagcucgccgccgccuccuccuucccccuccucgagcaguucgccggcgacggcuuccacgccgacggcgacgacguccucaccgucaccgagaccucccgcggccucaacuucgaguacaagugggaggccggccgcggcgccgaggccuuccccgccacccucucccccggccgcaccgcccgccuccaggagcucugcgcccccgacggcgccccccccggcgucguccccguccucuccgcccacucccccucccucggcuccgaguacuucauccgccucgaggaggccgcccccgccgccggccacgaccccgacugcgccggcugcgcccccuccccccccgccaccgccgaccaggacgacgacuccgacggcuccaccgccgccucccucgccauggagccccuccucggccacggcccccccgucgacguccccuggggccgcggcgaccacuacccccgccgcucccucgcccgcgacccccucugccccucccgcucccccucccccuccgccggcccccucucccucgccgagggcggcgccgaggacgccgacuggggcgucgccgccuucugccccgccuucuucgaggacccccucggcaccuccccccucggcuccuccggcgcccccccccucccccucaccggcgaggacgagcucgaggaggucggcgcccgccgcgccgcccagcgcggccacuggcgcuccaacgucuccgccaacaacaacuccggcucccgcugccccgaguccugggaccccgucuccgccggcggccacgccgagggcugccccucccccaagcagaccccccgcgccucccccgagcccggcuaccccggcgagccccuccucggccuccaggccgccuccgcccaggagcccggcugcugccccggccucccccaccucugcuccgcccagggccucgcccccgcccccugccucgucacccccuccuggaccgagaccgccuccuccggcggcgaccacccccaggccgagcccaagcucgccaccgaggccgagggcaccaccggcccccgccucccccuccccuccguccccucccccucccaggagggcgccccccuccccuccgaggaggccuccgcccccgacgcccccgacgcccuccccgacucccccacccccgccaccggcggcgaggucuccgccaucaagcucgccuccgcccucaacggcuccuccuccucccccgaggucgaggcccccuccuccgaggacgaggacaccgccgaggccaccuccggcaucuucaccgacaccuccuccgacggccuccaggcccgccgccccgacgucguccccgccuuccgcucccuccagaagcaggucggcacccccgacucccucgacucccucgacauccccuccuccgccuccgacggcggcuacgaggucuucucccccuccgccaccggccccuccggcggccagccccgcgcccucgacuccggcuacgacaccgagaacuacgagucccccgaguucguccucaaggaggcccaggagggcugcgagccccaggccuucgccgagcucgccuccgagggcgagggccccggccccgagacccgccucuccaccucccucuccggccucaacgagaagaaccccuaccgcgacuccgccuacuucuccgaccucgaggccgaggccgaggccaccuccggccccgagaagaagugcggcggcgaccgcgcccccggccccgagcucggccuccccuccaccggccagcccuccgagcaggucugccuccgccccggcgucuccggcgaggcccagggcuccggccccggcgagguccuccccccccuccuccagcucgagggcuccucccccgagcccuccaccugccccuccggccucguccccgagccccccgagccccagggccccgccaagguccgccccggccccucccccuccugcucccaguucuuccuccucacccccgucccccuccgcuccgagggcaacuccuccgaguuccagggcccccccggccuccucuccggccccgccccccagaagcgcaugggcggccccggcaccccccgcgccccccuccgccucgcccuccccggccuccccgccgcccucgagggccgccccgaggaggaggaggaggacuccgaggacuccgacgaguccgacgaggagcuccgcugcuacuccguccaggagcccuccgaggacuccgaggaggaggcccccgccguccccgucgucgucgccgagucccaguccgcccgcaaccuccgcucccuccucaagaugcccucccuccucuccgagaccuucugcgaggaccucgagcgcaagaagaaggccgucuccuucuucgacgacgucaccgucuaccucuucgaccaggagucccccacccgcgagcucggcgagcccuuccccggcgccaaggaguccccccccaccuuccuccgcggcucccccggcucccccuccgcccccaaccgcccccagcaggccgacggcucccccaacggcuccaccgccgaggagggcggcggcuucgccugggacgacgacuucccccucaugaccgccaaggccgccuucgccauggcccucgaccccgccgcccccgcccccgccgcccccacccccacccccgcccccuucucccgcuucaccgucucccccgcccccaccucccgcuucuccaucacccacgucuccgacuccgacgccgaguccaagcgcggccccgaggccggcgccggcggcgaguccaaggaggccuga

SEQ ID NO: 39203 - RNA, 1503 nt, Artificial Sequence
  derived and/or modified sequence opt2 from ABAT__Homo_sapiens__XP_011520703
auggccuccaugcuccucgcccagcgccucgccugcuccuuccagcacuccuaccgccuccucguccccggcucccgccacaucucccaggccgccgccaaggucgacgucgaguucgacuacgacggcccccucaugaagaccgagguccccggcccccgcucccaggagcucaugaagcagcucaacaucauccagaacgccgaggccguccacuucuucugcaacuacgaggagucccgcggcaacuaccucgucgacgucgacggcaaccgcaugcucgaccucuacucccagaucuccuccguccccaucggcuacucccaccccgcccuccucaagcucauccagcagccccagaacgccuccauguucgucaaccgccccgcccucggcauccucccccccgagaacuucgucgagaagcuccgccagucccuccucuccgucgcccccaagggcaugucccagcucaucaccauggccugcggcuccugcuccaacgagaacgcccucaagaccaucuucaugugguaccgcuccaaggagcgcggccagcgcggcuucucccaggaggagcucgagaccugcaugaucaaccaggcccccggcugccccgacuacuccauccucuccuucaugggcgccuuccacggccgcaccaugggcugccucgccaccacccacuccaaggccauccacaagaucgacauccccuccuucgacuggcccaucgcccccuucccccgccucaaguacccccucgaggaguucgucaaggagaaccagcaggaggaggcccgcugccucgaggaggucgaggaccucaucgucaaguaccgcaagaagaagaagaccgucgccggcaucaucgucgagcccauccaguccgagggcggcgacaaccacgccuccgacgacuucuuccgcaagcuccgcgacaucgcccgcaagcacggcugcgccuuccucgucgacgagguccagaccggcggcggcugcaccggcaaguucugggcccacgagcacuggggccucgacgaccccgccgacgucaugaccuucuccaagaagaugaugaccggcggcuucuuccacaaggaggaguuccgccccaacgcccccuaccgcaucuucaacaccuggcucggcgaccccuccaagaaccuccuccucgccgaggucaucaacaucaucaagcgcgaggaccuccucaacaacgccgcccacgccggcaaggcccuccucaccggccuccucgaccuccaggcccgcuacccccaguucaucucccgcguccgcggccgcggcaccuucugcuccuucgacacccccgacgacuccauccgcaacaagcucauccucaucgcccgcaacaagggcgucguccucggcggcugcggcgacaaguccauccgcuuccgccccacccucgucuuccgcgaccaccacgcccaccucuuccucaacaucuucuccgacauccucgccgacuucaaguga

SEQ ID NO: 39204 - RNA, 6834 nt, Artificial Sequence
  derived and/or modified sequence opt2 from ABCA12__Homo_sapiens__NP_056472
auguucaccuacaucaagaucaucaccuccggcgacuccgacaacaucacccacgucuggaacgaggacgacggccagacccucucccccuccucccucgccgcccagcuccucauccucgagaacuucgaggacgcccuccucaacaucuccgccaacucccccuacauccccuaccucgccugcguccgcaacgucaccgacucccucgcccgcggcucccccgagaaccuccgccuccuccaguccaccauccgcuucaagaaguccuuccuccgcaacggcuccuacgaggacuacuucccccccguccccgagguccucaaguccaagcucucccagcuccgcaaccucaccgagcuccucugcgaguccgagaccuucucccucaucgagaaguccugccagcucuccgacauguccuucggcucccucugcgaggaguccgaguucgaccuccagcuccucgaggccgccgagcucggcaccgagaucgccgccucccuccucuaccacgacaacgucaucuccaagaagguccgcgaccuccucaccggcgaccccuccaagaucaaccucaacauggaccaguuccucgagcaggcccuccagaugaacuaccucgagaacaucacccagcucauccccaucaucgaggccaugcuccacgucaacaacuccgccgacgccuccgagaagcccggccagcuccucgagauguucaagaacgucgaggagcucaaggaggaccuccgccgcaccaccggcauguccaaccgcaccaucgacaagcuccucgccauccccauccccgacaaccgcgccgagaucaucucccaggucuucuggcuccacuccugcgacaccaacaucaccacccccaagcucgaggacgccaugaaggaguucugcaaccucucccucuccgagcgcucccgccaguccuaccucaucggccucacccuccuccacuaccucaacaucuacaacuucaccuacaaggucuucuucccccgcaaggaccagaagcccgucgagaagaugauggagcucuucauccgccucaaggagauccucaaccagauggccuccggcacccacccccuccucgacaagaugcgcucccucaagcagaugcaccucccccgcuccgucccccucacccaggccauguaccgcuccaaccgcaugaacaccccccagggcuccuucuccaccaucucccaggcccucugcucccagggcaucaccaccgaguaccucaccgccaugcuccccuccucccagcgccccaagggcaaccacaccaaggacuuccucaccuacaagcucaccaaggagcagaucgccuccaaguacggcauccccaucaacuccacccccuucugcuucucccucuacaaggacaucaucaacaugcccgccggccccgucaucugggccuuccucaagcccaugcuccucggccgcauccucuacgcccccuacaaccccgucaccaaggccaucauggagaaguccaacgucacccuccgccagcucgccgagcuccgcgagaagucccaggaguggauggacaaguccccccucuucaugaacuccuuccaccuccucaaccaggccauccccaugcuccagaacacccuccgcaaccccuucguccaggucuucgucaaguucuccgucggccucgacgccgucgagcuccucaagcagaucgacgagcucgacauccuccgccucaagcucgagaacaacaucgacaucaucgaccagcucaacacccucuccucccucaccgucaacaucuccuccugcguccucuacgaccgcauccaggccgccaagaccaucgacgagauggagcgcgaggccaagcgccucuacaaguccaacgagcucuucggcuccgucaucuucaagcuccccuccaaccgcuccuggcaccgcggcuacgacuccggcaacgucuuccucccccccgucaucaaguacaccauccgcaugucccucaagaccgcccagaccacccgcucccuccgcaccaagaucugggcccccggcccccacaacucccccucccacaaccagaucuacggccgcgccuucaucuaccuccaggacuccaucgagcgcgccaucaucgagcuccagaccggccgcaacucccaggagaucgccguccagguccaggccauccccuaccccugcuucaugaaggacaacuuccucaccuccgucuccuacucccuccccaucguccucauggucgccugggucgucuucaucgccgccuucgucaagaagcucgucuacgagaaggaccuccgccuccacgaguacaugaagaugaugggcgucaacuccugcucccacuucuucgccuggcucaucgaguccgucggcuuccuccucgucaccaucgucauccucaucaucauccucaaguucggcaacauccuccccaagaccaacggcuucauccucuuccucuacuucuccgacuacuccuucuccgucaucgccauguccuaccucaucuccgucuucuucaacaacaccaacaucgccgcccucaucggcucccucaucuacaucaucgccuucuuccccuucaucguccucgucaccgucgagaacgagcucuccuacguccucaaggucuucaugucccuccucucccccaccgccuucuccuacgccucccaguacaucgcccgcuacgaggagcagggcaucggccuccagugggagaacauguacaccucccccguccaggacgacaccaccuccuucggcuggcucugcugccucauccucgccgacuccuucaucuacuuccucaucgccugguacguccgcaacgucuuccccggcaccuacggcauggccgcccccugguacuuccccauccuccccuccuacuggaaggagcgcuucggcugcgccgaggucaagcccgagaaguccaacggccucauguucaccaacaucaugaugcagaacaccaaccccuccgccucccccgaguacauguucuccuccaacaucgagcccgagcccaaggaccucaccgucggcgucgcccuccacggcgucaccaagaucuacggcuccaaggucgccgucgacaaccucaaccucaacuucuacgagggccacaucaccucccuccucggccccaacggcgccggcaagaccaccaccaucuccaugcucaccggccucuucggcgccuccgccggcaccaucuucgucuacggcaaggacaucaagaccgaccuccacaccguccgcaagaacaugggcgucugcaugcagcacgacguccucuucuccuaccucaccaccaaggagcaccuccuccucuacggcuccaucaaggucccccacuggaccaagaagcagcuccacgaggaggucaagcgcacccucaaggacaccggccucuacucccaccgccacaagcgcgucggcacccucuccggcggcaugaagcgcaagcucuccaucuccaucgcccucaucggcggcucccgcgucgucauccucgacgagcccuccaccggcgucgaccccugcucccgccgcuccaucugggacgucaucuccaagaacaagaccgcccgcaccaucauccucuccacccaccaccucgacgaggccgagguccucuccgaccgcaucgccuuccucgagcagggcggccuccgcugcugcggcucccccuucuaccucaaggaggccuucggcgacggcuaccaccucacccucaccaagaagaagucccccaaccucaacgccaacgccgucugcgacaccauggccgucaccgccaugauccagucccaccuccccgaggccuaccucaaggaggacaucggcggcgagcucgucuacguccucccccccuucuccaccaaggucuccggcgccuaccucucccuccuccgcgcccucgacaacggcaugggcgaccucaacaucggcugcuacggcaucuccgacaccaccgucgaggaggucuuccucaaccucaccaaggagucccagaagaacuccgccaugucccucgagcaccucacccagaagaagaucggcaacuccaacgccaacggcaucuccacccccgacgaccucuccgucuccuccuccaacuucaccgaccgcgacgacaagauccucacccgcggcgagcgccucgacggcuucggccuccuccucaagaagaucauggccauccucaucaagcgcuuccaccacacccgccgcaacuggaagggccucaucgcccaggucauccuccccaucgucuucgucaccaccgccaugggccucggcacccuccgcaacuccuccaacuccuaccccgagauccagaucucccccucccucuacggcaccuccgagcagaccgccuucuacgccaacuaccaccccuccaccgaggcccucgucuccgccaugugggacuuccccggcaucgacaacaugugccucaacaccuccgaccuccagugccucaacaaggacucccucgagaaguggaacaccuccggcgagcccaucaccaacuucggcgucugcuccugcuccgagaacguccaggagugccccaaguucaacuacucccccccccaccgccgcaccuacuccucccaggucaucuacaaccucaccggccagcgcgucgagaacuaccucaucuccaccgccaacgaguucguccagaagcgcuacggcggcugguccuucggccucccccucaccaaggaccuccgcuucgacaucaccggcguccccgccaaccgcacccucgccaaggucugguacgaccccgagggcuaccacucccuccccgccuaccucaacucccucaacaacuuccuccuccgcgucaacauguccaaguacgacgccgcccgccacggcaucaucauguacucccaccccuaccccggcguccaggaccaggagcaggccaccaucuccucccucaucgacauccucgucgcccucuccauccucaugggcuacuccgucaccaccgccuccuucgucaccuacgucguccgcgagcaccagaccaaggccaagcagcuccagcacaucuccggcaucggcgucaccugcuacugggucaccaacuucaucuacgacauggucuucuaccucguccccgucgccuucuccaucggcaucaucgccaucuucaagcuccccgccuucuacuccgagaacaaccucggcgccgucucccuccuccuccuccucuucggcuacgccaccuucuccuggauguaccuccucgccggccucuuccacgagaccggcauggccuucaucaccuacgucugcgucaaccucuucuucggcaucaacuccaucgucucccucuccgucgucuacuuccucuccaaggagaagcccaacgaccccacccucgagcucaucuccgagacccucaagcgcaucuuccucaucuucccccaguucugcuucggcuacggccucaucgagcucucccagcagcaguccguccucgacuuccucaaggccuacggcgucgaguaccccaacgagaccuucgagaugaacaagcucggcgccauguucgucgcccucgucucccagggcaccauguucuucucccuccgccuccucaucaacgagucccucaucaagaagcuccgccucuucuuccgcaaguucaacuccucccacguccgcgagaccaucgacgaggacgaggacguccgcgccgagcgccuccgcgucgaguccggcgccgccgaguucgaccucguccagcucuacugccucaccaagaccuaccagcucauccacaagaagaucaucgccgucaacaacaucuccaucggcauccccgccggcgagugcuucggccuccucggcgucaacggcgccggcaagaccaccaucuucaagaugcucaccggcgacaucauccccuccuccggcaacauccucauccgcaacaagaccggcucccucggccacgucgacucccacuccucccucgucggcuacugcccccaggaggacgcccucgacgaccucgucaccgucgaggagcaccucuacuucuacgcccgcguccacggcauccccgagaaggacaucaaggagaccguccacaagcuccuccgccgccuccaccucaugcccuucaaggaccgcgccaccuccaugugcuccuacggcaccaagcgcaagcucuccaccgcccucgcccucaucggcaagcccuccauccuccuccucgacgagcccuccuccggcauggaccccaaguccaagcgccaccucuggaagaucaucuccgaggagguccagaacaagugcuccgucauccucaccucccacuccauggaggagugcgaggcccucugcacccgccucgccaucauggucaacggcaaguuccagugcaucggcucccuccagcacaucaagucccgcuucggccgcggcuucaccgucaagguccaccucaagaacaacaaggucaccauggagacccucaccaaguucaugcagcuccacuuccccaagaccuaccucaaggaccagcaccucuccaugcucgaguaccacguccccgucaccgccggcggcgucgccaacaucuucgaccuccucgagaccaacaagaccgcccucaacaucaccaacuuccucgucucccagaccacccucgaggaggucuucaucaacuucgccaaggaccagaaguccuacgagaccgccgacaccuccucccagggcuccaccaucuccgucgacucccaggacgaccagauggaguccuga

SEQ ID NO: 39205 - RNA, 15177 nt, Artificial Sequence
  derived and/or modified sequence opt2 from ABCA13__Homo_sapiens__NP_689914
augggccacgccggcugccaguucaaggcccuccucuggaagaacuggcucugccgccuccgcaaccccguccucuuccucgccgaguucuucuggcccugcauccucuucgucauccucaccguccuccgcuuccaggagcccccccgcuaccgcgacaucugcuaccuccagccccgcgaccuccccuccugcggcgucauccccuucguccagucccuccucugcaacaccggcucccgcugccgcaacuucuccuacgagggcuccauggagcaccacuuccgccucucccgcuuccagaccgccgccgaccccaagaaggucaacaaccucgccuuccucaaggagauccaggaccucgccgaggagauccacggcaugauggacaaggccaagaaccucaagcgccucugggucgagcgcuccaacacccccgacuccuccuacggcuccuccuucuucaccauggaccucaacaagaccgaggaggucauccucaagcucgagucccuccaccagcagccccacaucugggacuuccuccuccuccucccccgccuccacaccucccacgaccacgucgaggacggcauggacgucgccgucaaccuccuccagaccauccucaacucccucaucucccucgaggaccucgacuggcucccccucaaccagaccuucucccaggucuccgagcucguccucaacgucaccaucuccacccucaccuuccuccagcagcacggcgucgccgucaccgagcccgucuaccaccucuccaugcagaacaucgucugggacccccagaagguccaguacgaccucaagucccaguucggcuucgacgaccuccacaccgagcagauccucaacuccuccgccgagcucaaggagauccccaccgacaccucccucgagaagauggucugcuccguccucuccuccaccuccgaggacgaggccgagaaguggggccacgucggcggcugccaccccaagugguccgaggccaagaacuaccucguccacgccgucuccuggcuccgcgucuaccagcaggucuucguccaguggcagcagggcucccuccuccagaagacccucaccggcaugggccacucccucgaggcccuccgcaaccaguucgaggaggaguccaagcccuggaaggucgucgaggcccuccacaccgcccuccuccuccucaacgacucccucuccgccgacggccccaaggacaaccacaccuuccccaagauccuccagcaccucuggaagcuccagucccuccuccagaaccucccccaguggcccgcccucaagcgcuuccuccagcucgacggcgcccuccgcaacgccaucgcccagaaccuccacuucguccaggagguccucaucugccucgagaccuccgccaacgacuucaagugguucgagcucaaccagcucaagcucgagaaggacgucuucuucugggagcucaagcagaugcucgccaagaacgccgucugccccaacggccgcuucuccgagaaggaggucuuccucccccccggcaacuccuccaucuggggcggccuccagggccuccucugcuacugcaacuccuccgagaccuccguccucaacaagcuccucggcuccgucgaggacgccgaccgcauccuccaggaggucaucaccuggcacaagaacauguccguccucauccccgaggaguaccucgacuggcaggagcucgagaugcagcucuccgaggccucccucuccugcacccgccucuuccuccuccucggcgccgaccccucccccgagaacgacgucuucuccuccgacugcaagcaccagcucgucuccaccgucaucuuccacacccucgagaagacccaguucuuccucgagcaggccuacuacuggaaggccuucaagaaguucauccgcaagaccugcgaggucgcccaguacgucaacaugcaggaguccuuccagaaccgccuccucgccuuccccgaggagucccccugcuucgaggagaacauggacuggaagaugaucuccgacaacuacuuccaguuccucaacaaccuccucaagucccccaccgccuccaucucccgcgcccucaacuucaccaagcaccuccucaugauggagaagaagcuccacacccucgaggacgagcagaugaacuuccuccucuccuucgucgaguucuucgagaagcuccuccuccccaaccucuucgacuccuccaucguccccuccuuccacucccuccccucccucaccgaggacauccucaacaucuccucccucuggaccaaccaccucaagucccucaagcgcgaccccuccgccaccgacgcccagaagcuccucgaguucggcaacgaggucaucuggaagaugcagacccucggcucccacuggauccgcaaggagcccaagaaccuccuccgcuucaucgagcucauccucuucgagaucaaccccaagcuccucgagcucugggccuacggcaucuccaagggcaagcgcgccaagcucgagaacuucuucacccuccucaacuucuccguccccgagaacgagauccucuccaccuccuucaacuucucccagcucuuccacuccgacuggcccaagucccccgccaugaacaucgacuucguccgccucuccgaggccaucaucaccucccuccacgaguucggcuuccucgagcaggagcagaucuccgaggcccucaacaccgucuacgccauccgcaacgccuccgaccucuucuccgcccucuccgagccccagaagcaggaggucgacaagauccucacccacauccaccucaacgucuuccaggacaaggacuccgcccuccuccuccagaucuacuccuccuucuaccgcuacaucuacgagcuccucaacauccagucccgcggcuccucccucaccuuccucacccagaucuccaagcacauccucgacaucaucaagcaguucaacuuccagaacaucuccaaggccuucgccuuccucuucaagaccgccgagguccucggcggcaucuccaacgucuccuacugccagcagcuccucuccaucuucaacuuccucgagcuccaggcccaguccuucauguccaccgagggccaggagcucgaggucauccacaccacccucaccggccucaagcagcuccucaucaucgacgaggacuuccgcaucucccucuuccaguacaugucccaguucuucaacuccuccgucgaggaccuccucgacaacaagugccucaucuccgacaacaagcacaucuccuccgucaacuacuccaccuccgaggaguccuccuucgucuucccccucgcccagaucuucuccaaccucuccgccaacgucuccgucuucaacaaguucauguccauccacugcaccgucuccuggcuccagauguggaccgagaucugggagaccaucucccagcucuucaaguucgacaugaacgucuucaccucccuccaccacggcuucacccagcuccucgacgagcucgaggacgacgucaaggucuccaaguccugccagggcauccuccccacccacaacgucgcccgccucauccucaaccucuucaagaacgucacccaggccaacgacuuccacaacugggaggacuuccucgaccuccgcgacuuccucgucgcccucggcaacgcccucgucuccgucaagaagcucaaccucgagcaggucgagaagucccucuucaccauggaggccgcccuccaccagcucaagaccuuccccuucaacgaguccaccucccgcgaguuccucaacucccuccucgaggucuucaucgaguucuccuccaccuccgaguacaucguccgcaaccucgacuccaucaacgacuuccucuccaacaaccucaccaacuacggcgagaaguucgagaacaucaucaccgagcuccgcgaggccaucgucuuccuccgcaacgucucccacgaccgcgaccucuucuccugcgccgacaucuuccagaacgucaccgagugcauccucgaggacggcuuccucuacgucaacaccucccagcgcaugcuccgcauccucgacacccucaacuccaccuucuccuccgagaacaccaucuccucccucaagggcugcaucgucuggcucgacgucaucaaccaccucuaccuccucuccaacuccuccuucucccagggccaccuccagaacauccucggcaacuuccgcgacaucgagaacaagaugaacuccauccucaagaucgucaccuggguccucaacaucaagaagccccucugcuccuccaacggcucccacaucaacugcgucaacaucuaccucaaggacgucaccgacuuccucaacaucguccucaccaccgucuucgagaaggagaagaagcccaaguucgagauccuccucgcccuccucaacgacuccaccaagcagguccgcauguccaucaacaaccucaccaccgacuucgacuucgccucccaguccaacuggcgcuacuucaccgagcucauccuccgccccaucgagauguccgacgagauccccaaccaguuccagaacaucuggcuccaccucaucacccucggcaaggaguuccagaagcucgucaagggcaucuacuucaacauccucgagaacaacuccuccuccaagaccgagaaccuccucaacaucuucgccaccucccccaaggagaaggacgucaacuccgucggcaacuccaucuaccaccucgccuccuaccucgccuucucccucucccacgaccuccagaacucccccaagaucaucaucucccccgagaucaugaaggccaccggccucggcauccagcucauccgcgacgucuucaacucccucaugcccgucguccaccacaccuccccccagaacgccggcuacaugcaggcccucaagaaggucaccuccgucaugcgcacccucaagaaggccgacaucgaccuccucgucgaccagcucgagcaggucuccgucaaccucauggacuucuucaagaacaucuccuccgucggcaccggcaaccucgucgucaaccuccucgucggccucauggagaaguucgccgacuccucccacuccuggaacgucaaccaccuccuccagcucucccgccucuuccccaaggacgucgucgacgccgucaucgacgucuacuacguccucccccacgccguccgccuccuccagggcguccccggcaagaacaucaccgagggccucaaggacgucuacuccuucacccuccuccacggcaucaccaucuccaacaucaccaaggaggacuucgccaucgucaucaagauccuccucgacaccaucgagcucgucuccgacaagcccgacaucaucuccgaggcccucgccugcuuccccgucgucuggugcuggaaccacaccaacuccggcuuccgccagaacuccaagaucgaccccugcaacguccacggccucauguccuccuccuucuacggcaaggucgccuccauccucgaccacuuccaccucuccccccagggcgaggacucccccugcuccaacgaguccucccgcauggagaucacccgcaaggucgucugcaucauccacgagcucgucgacuggaacuccauccuccucgagcucuccgaggucuuccacgucaacaucucccucgucaagaccguccagaaguucuggcacaagauccuccccuucgucccccccuccaucaaccagacccgcgacuccaucuccgagcucugccccuccggcuccaucaagcaggucgcccuccagaucaucgagaagcucaagaacgucaacuucaccaaggucaccuccggcgagaacauccucgacaagcucuccucccucaacaagauccucaacaucaacgaggacaccgagaccuccguccagaacaucaucuccuccaaccucgagcgcaccguccagcucaucuccgaggacuggucccucgagaaguccacccacaaccuccucucccucuucaugaugcuccagaacgccaacgucaccggcuccucccucgaggcccucuccuccuucaucgagaaguccgagacccccuacaacuucgaggagcucuggcccaaguuccagcagaucaugaaggaccucacccaggacuuccgcauccgccaccuccucuccgagaugaacaagggcaucaaguccaucaacuccauggcccuccagaagaucacccuccaguucgcccacuuccucgagauccucgacucccccucccucaagacccucgagaucaucgaggacuuccuccucgucaccaagaacuggcuccaggaguacgccaacgaggacuacucccgcaugaucgagacccucuucauccccgucaccaacgaguccuccaccgaggacaucgcccuccucgccaaggccaucgccaccuucuggggcucccucaagaacaucucccgcgccggcaacuucgacgucgccuuccucacccaccuccucaaccaggagcagcucaccaacuucuccgucguccagcuccucuucgagaacauccucaucaaccucaucaacaaccucgccggcaacucccaggaggccgccuggaaccucaacgacaccgaccuccagaucaugaacuucaucaaccucauccucaaccacaugcaguccgagaccucccgcaagaccguccucucccuccgcuccaucgucgacuucaccgagcaguuccucaagaccuucuucucccucuuccucaaggaggacuccgagaacaagaucucccuccuccucaaguacuuccacaaggacgucaucgccgagauguccuucguccccaaggacaagauccucgagauccucaagcucgaccaguuccucacccucaugauccaggaccgccucaugaacaucuucuccucccucaaggagaccaucuaccaccucaugaaguccuccuucauccucgacaacggcgaguucuacuucgacacccaccagggccucaaguucaugcaggaccucuucaacgcccuccuccgcgagaccuccaugaagaacaagaccgagaacaacaucgacuucuucaccgucgucucccagcucuucuuccacgucaacaaguccgaggaccucuucaagcucaaccaggaccucggcuccgcccuccaccucguccgcgagugcuccaccgagauggcccgccuccucgacaccauccuccacucccccaacaaggacuucuacgcccucuaccccacccuccaggaggucauccucgccaaccucaccgaccuccucuucuucaucaacaacuccuucccccuccgcaaccgcgccacccucgagaucaccaagcgccucgucggcgccaucucccgcgccuccgaggagucccacguccucaagccccuccucgagauguccggcacccucgucaugcuccucaacgacuccgccgaccuccgcgaccucgccaccuccauggacuccaucgucaagcuccucaagcucgucaagaaggucuccggcaagauguccaccgucuucaagacccacuucaucuccaacaccaaggacuccgucaaguucuucgacacccucuacuccaucaugcagcaguccguccagaaccucgucaaggagaucgccacccucaagaagaucgaccacuucaccuucgagaagaucaacgaccuccucguccccuuccucgaccucgccuucgagaugaucggcgucgagcccuacaucuccuccaacuccgacaucuucuccaugucccccuccauccucuccuacaugaaccaguccaaggacuucuccgacauccucgaggagaucgccgaguuccucaccuccgucaagaugaaccucgaggacaugcgcucccucgccgucgccuucaacaacgagacccagaccuucuccauggacuccgucaaccuccgcgaggagauccucggcugccucguccccaucaacaacaucaccaaccagauggacuuccucuaccccaaccccaucuccacccacuccggcccccaggacaucaagugggagaucauccacgaggucauccccuuccucgacaagauccucucccagaacuccaccgagaucggcuccuuccucaagauggucaucugccucacccucgaggcccucuggaagaaccucaagaaggacaacuggaacgucuccaacguccucaugaccuucacccagcaccccaacaaccuccucaagaccaucgagaccguccucgaggccuccuccggcaucaaguccgacuacgagggcgaccucaacaagucccucuacuucgacaccccccucucccagaacaucacccaccaccagcucgagaaggccauccacaacguccucucccgcaucgcccucuggcgcaagggccuccucuucaacaacuccgaguggaucaccuccacccgcacccucuuccagccccucuucgagaucuucaucaaggccaccaccggcaagaacgucaccuccgagaaggaggagcgcaccaagaaggagaugaucgacuuccccuacuccuucaagcccuucuucugccucgagaaguaccucggcggccucuucguccucaccaaguacuggcagcagaucccccucaccgaccaguccgucgucgagaucugcgaggucuuccagcagaccgucaagcccuccgaggccauggagaugcuccagaaggucaagaugauggucguccgcguccucaccaucgucgccgagaaccccuccuggaccaaggacauccucugcgccacccucuccugcaagcagaacggcauccgccaccucauccucuccgccauccagggcgucacccucgcccaggaccacuuccaggagaucgagaagaucugguccucccccaaccagcucaacugcgagucccucuccaagaaccucuccuccacccucgaguccuucaaguccucccucgagaacgccaccggccaggacugcaccucccagccccgccucgagaccguccagcagcaccucuacaugcucgccaagucccucgaggagaccugguccuccggcaaccccaucaugaccuuccucuccaacuucaccgucaccgaggacgucaagaucaaggaccucaugaagaacaucaccaagcucaccgaggagcuccgcuccuccauccagaucuccaacgagaccauccacuccauccucgaggccaacaucucccacuccaagguccucuucuccgcccucaccgucgcccucuccggcaagugcgaccaggagauccuccaccuccuccucaccuuccccaagggcgagaaguccuggaucgccgccgaggagcucugcucccuccccggcuccaaggucuacucccucaucguccuccucucccgcaaccucgacguccgcgccuucaucuacaagacccucaugcccuccgaggccaacggccuccucaacucccuccucgacaucgucuccucccucuccgcccuccucgccaaggcccagcacgucuucgaguaccuccccgaguuccuccacaccuucaagaucaccgcccuccucgagacccucgacuuccagcaggucucccagaacguccaggcccgcuccuccgccuucggcuccuuccaguucgucaugaagauggucugcaaggaccaggccuccuuccucuccgacuccaacauguucaucaaccucccccgcgucaaggagcuccucgaggacgacaaggagaaguucaacauccccgaggacuccacccccuucugccucaagcucuaccaggagauccuccagcuccccaacggcgcccucgucuggaccuuccucaagcccauccuccacggcaagauccucuacacccccaacacccccgagaucaacaaggucauccagaaggccaacuacaccuucuacaucgucgacaagcucaagacccucuccgagacccuccucgagauguccucccucuuccagcgcuccggcuccggccagauguucaaccagcuccaggaggcccuccgcaacaaguucguccgcaacuucgucgagaaccagcuccacaucgacgucgacaagcucaccgagaagcuccagaccuacggcggccuccucgacgagauguucaaccacgccggcgccggccgcuuccgcuuccucggcuccauccucgucaaccucuccuccugcgucgcccucaaccgcuuccaggcccuccaguccgucgacauccucgagaccaaggcccacgagcuccuccagcagaacuccuuccucgccuccaucaucuucuccaacucccucuucgacaagaacuuccgcuccgaguccgucaagcuccccccccacgucuccuacaccauccgcaccaacguccucuacuccguccgcaccgacgucgucaagaaccccuccuggaaguuccacccccagaaccuccccgccgacggcuucaaguacaacuacgucuucgccccccuccaggacaugaucgagcgcgccaucauccucguccagaccggccaggaggcccucgagcccgccgcccagacccaggccgcccccuaccccugccacaccuccgaccucuuccucaacaacgucggcuucuucuucccccucaucaugaugcucaccuggauggucuccgucgccuccaugguccgcaagcucgucuacgagcaggagauccagaucgaggaguacaugcgcaugaugggcguccaccccgucauccacuuccucgccugguuccucgagaacauggccguccucaccaucuccuccgccacccucgccaucguccucaagaccuccggcaucuucgcccacuccaacaccuucaucgucuuccucuuccuccucgacuucggcauguccgucgucaugcucuccuaccuccucuccgccuucuucucccaggccaacaccgccgcccucugcaccucccucgucuacaugaucuccuuccuccccuacaucguccuccucguccuccacaaccagcucuccuucgucaaccagaccuuccucugccuccucuccaccaccgccuucggccagggcgucuucuucaucaccuuccucgagggccaggagaccggcauccaguggaacaacauguaccaggcccucgagcagggcggcaugaccuucggcugggucugcuggaugauccucuucgacuccucccucuacuuccucugcggcugguaccucuccaaccucauccccggcaccuucggccuccgcaagcccugguacuuccccuucaccgccuccuacuggaaguccgucggcuuccucgucgagaagcgccaguacuuccucuccuccucccucuucuucuucaacgagaacuucgacaacaagggcuccucccuccagaaccgcgagggcgagcucgagggcuccgcccccggcgucacccucgucuccgucaccaaggaguacgagggccacaaggccgucguccaggaccucucccucaccuucuaccgcgaccagaucaccgcccuccucggcaccaacggcgccggcaagaccaccaucaucuccaugcucaccggccuccacccccccaccuccggcaccaucaucaucaacggcaagaaccuccagaccgaccucucccgcguccgcauggagcucggcgucugcccccagcaggacauccuccucgacaaccucaccguccgcgagcaccuccuccucuucgccuccaucaaggccccccaguggaccaagaaggagcuccaccagcaggucaaccagacccuccaggacgucgaccucacccagcaccagcacaagcagacccgcgcccucuccggcggccucaagcgcaagcucucccucggcaucgccuucaugggcaugucccgcaccgucguccucgacgagcccaccuccggcgucgaccccugcucccgccacucccucugggacauccuccucaaguaccgcgagggccgcaccaucaucuucaccacccaccaccucgacgaggccgaggcccucuccgaccgcgucgccguccuccagcacggccgccuccgcugcugcggcccccccuucugccucaaggaggccuacggccagggccuccgccucacccucacccgccagcccuccguccucgaggcccacgaccucaaggacauggccugcgucaccucccucaucaagaucuacaucccccaggccuuccucaaggacuccuccggcuccgagcucaccuacaccauccccaaggacaccgacaaggccugccucaagggccucuuccaggcccucgacgagaaccuccaccagcuccaccucaccggcuacggcaucuccgacaccacccucgaggaggucuuccucaugcuccuccaggacuccaacaagaagucccacaucgcccucggcaccgaguccgagcuccagaaccaccgccccaccggccaccucuccggcuacugcggcucccucgcccgccccgccaccguccagggcguccagcuccuccgcgcccaggucgccgccauccucgcccgccgccuccgccgcacccuccgcgccggcaaguccacccucgccgaccuccuccuccccguccucuucgucgcccucgccaugggccucuucaugguccgcccccucgccaccgaguaccccccccuccgccucacccccggccacuaccagcgcgccgagaccuacuucuucuccuccggcggcgacaaccucgaccucacccgcguccuccuccgcaaguuccgcgaccaggaccuccccugcgccgaccucaacccccgccagaagaacuccuccugcuggcgcaccgaccccuucucccaccccgaguuccaggacuccugcggcugccucaagugccccaaccgcuccgccuccgcccccuaccucaccaaccaccucggccacacccuccucaaccucuccggcuucaacauggaggaguaccuccucgcccccuccgagaagccccgccucggcggcugguccuucggccucaagauccccuccgaggccggcggcgccaacggcaacaucuccaagccccccacccucgccaaggucugguacaaccagaagggcuuccacucccuccccuccuaccucaaccaccucaacaaccucauccucuggcagcaccucccccccaccgucgacuggcgccaguacggcaucacccucuacucccaccccuacggcggcgcccuccucaacgaggacaagauccucgaguccauccgccagugcggcgucgcccucugcaucguccucggcuucuccauccucuccgccuccaucggcuccuccgucguccgcgaccgcgucaucggcgccaagcgccuccagcacaucuccggccucggcuaccgcauguacugguucaccaacuuccucuacgacaugcucuucuaccucgucuccgucugccucugcgucgccgucaucgucgccuuccagcucaccgccuucaccuuccgcaagaaccucgccgccaccgcccuccuccucucccucuucggcuacgccacccuccccuggauguaccucaugucccgcaucuucuccuccuccgacgucgccuucaucuccuacgucucccucaacuucaucuucggccucugcaccaugcucaucaccaucaugccccgccuccucgccaucaucuccaaggccaagaaccuccagaacaucuacgacguccucaagugggucuucaccaucuucccccaguucugccucggccagggccucgucgagcucugcuacaaccagaucaaguacgaccucacccacaacuucggcaucgacuccuacgucucccccuucgagaugaacuuccucggcuggaucuucguccagcucgccucccagggcaccguccuccuccuccuccgcguccuccuccacugggaccuccuccgcuggccccgcggccacuccacccuccagggcaccgucaaguccuccaaggacaccgacgucgagaaggaggagaagcgcgucuucgagggccgcaccaacggcgacauccucguccucuacaaccucuccaagcacuaccgccgcuucuuccagaacaucaucgccguccaggacaucucccucggcauccccaagggcgagugcuucggccuccucggcgucaacggcgccggcaaguccaccaccuucaagaugcucaacggcgaggucucccucaccuccggccacgccaucauccgcacccccaugggcgacgccgucgaccucuccuccgccggcaccgccggcguccucaucggcuacugcccccagcaggacgcccucgacgagcuccucaccggcugggagcaccucuacuacuacugcucccuccgcggcaucccccgccagugcauccccgaggucgccggcgaccucauccgccgccuccaccucgaggcccacgccgacaagcccgucgccaccuacuccggcggcaccaagcgcaagcucuccaccgcccucgcccucgucggcaagcccgacauccuccuccucgacgagcccuccuccggcauggaccccugcuccaagcgcuaccucuggcagaccaucaugaaggagguccgcgagggcugcgccgccguccucaccucccacuccauggaggagugcgaggcccucugcacccgccucgccaucauggucaacggcuccuucaagugccucggcuccccccagcacaucaagaaccgcuucggcgacggcuacaccgucaaggucuggcucugcaaggaggccaaccagcacugcaccgucuccgaccaccucaagcucuacuuccccggcauccaguucaagggccagcaccucaaccuccucgaguaccacguccccaagcgcuggggcugccucgccgaccucuucaaggucaucgagaacaacaagaccuuccucaacaucaagcacuacuccaucaaccagaccacccucgagcaggucuucaucaacuucgccuccgagcagcagcagacccuccaguccacccucgaccccuccaccgacucccaccacacccaccaccuccccaucuga

SEQ ID NO: 39206 - RNA, 6786 nt, Artificial Sequence
  derived and/or modified sequence opt2 from ABCA1__Homo_sapiens__NP_005493
auggccugcuggccccagcuccgccuccuccucuggaagaaccucaccuuccgccgccgccagaccugccagcuccuccucgaggucgccuggccccucuucaucuuccucauccucaucuccguccgccucuccuacccccccuacgagcagcacgagugccacuuccccaacaaggccaugcccuccgccggcacccuccccuggguccagggcaucaucugcaacgccaacaaccccugcuuccgcuaccccacccccggcgaggcccccggcgucgucggcaacuucaacaaguccaucgucgcccgccucuucuccgacgcccgccgccuccuccucuacucccagaaggacaccuccaugaaggacaugcgcaagguccuccgcacccuccagcagaucaagaaguccuccuccaaccucaagcuccaggacuuccucgucgacaacgagaccuucuccggcuuccucuaccacaaccucucccuccccaaguccaccgucgacaagaugcuccgcgccgacgucauccuccacaaggucuuccuccagggcuaccagcuccaccucaccucccucugcaacggcuccaaguccgaggagaugauccagcucggcgaccaggaggucuccgagcucugcggccucccccgcgagaagcucgccgccgccgagcgcguccuccgcuccaacauggacauccucaagcccauccuccgcacccucaacuccaccucccccuuccccuccaaggagcucgccgaggccaccaagacccuccuccacucccucggcacccucgcccaggagcucuucuccaugcgcuccugguccgacaugcgccaggaggucauguuccucaccaacgucaacuccuccuccuccuccacccagaucuaccaggccgucucccgcaucgucugcggccaccccgagggcggcggccucaagaucaagucccucaacugguacgaggacaacaacuacaaggcccucuucggcggcaacggcaccgaggaggacgccgagaccuucuacgacaacuccaccacccccuacugcaacgaccucaugaagaaccucgaguccuccccccucucccgcaucaucuggaaggcccucaagccccuccucgucggcaagauccucuacacccccgacacccccgccacccgccaggucauggccgaggucaacaagaccuuccaggagcucgccgucuuccacgaccucgagggcaugugggaggagcucucccccaagaucuggaccuucauggagaacucccaggagauggaccucguccgcaugcuccucgacucccgcgacaacgaccacuucugggagcagcagcucgacggccucgacuggaccgcccaggacaucgucgccuuccucgccaagcaccccgaggacguccaguccuccaacggcuccgucuacaccuggcgcgaggccuucaacgagaccaaccaggccauccgcaccaucucccgcuucauggagugcgucaaccucaacaagcucgagcccaucgccaccgaggucuggcucaucaacaaguccauggagcuccucgacgagcgcaaguucugggccggcaucgucuucaccggcaucacccccggcuccaucgagcucccccaccacgucaaguacaagauccgcauggacaucgacaacgucgagcgcaccaacaagaucaaggacggcuacugggaccccggcccccgcgccgaccccuucgaggacaugcgcuacgucuggggcggcuucgccuaccuccaggacgucgucgagcaggccaucauccgcguccucaccggcaccgagaagaagaccggcgucuacaugcagcagaugcccuaccccugcuacgucgacgacaucuuccuccgcgucaugucccgcuccaugccccucuucaugacccucgccuggaucuacuccgucgccgucaucaucaagggcaucgucuacgagaaggaggcccgccucaaggagaccaugcgcaucaugggccucgacaacuccauccucugguucuccugguucaucuccucccucaucccccuccucgucuccgccggccuccucgucgucauccucaagcucggcaaccuccuccccuacuccgaccccuccgucgucuucgucuuccucuccgucuucgccgucgucaccauccuccagugcuuccucaucuccacccucuucucccgcgccaaccucgccgccgccugcggcggcaucaucuacuucacccucuaccuccccuacguccucugcgucgccuggcaggacuacgucggcuucacccucaagaucuucgccucccuccucucccccgucgccuucggcuucggcugcgaguacuucgcccucuucgaggagcagggcaucggcguccagugggacaaccucuucgagucccccgucgaggaggacggcuucaaccucaccaccuccgucuccaugaugcucuucgacaccuuccucuacggcgucaugaccugguacaucgaggccgucuuccccggccaguacggcaucccccgccccugguacuuccccugcaccaaguccuacugguucggcgaggaguccgacgagaagucccaccccggcuccaaccagaagcgcaucuccgagaucugcauggaggaggagcccacccaccucaagcucggcgucuccauccagaaccucgucaaggucuaccgcgacggcaugaaggucgccgucgacggccucgcccucaacuucuacgagggccagaucaccuccuuccucggccacaacggcgccggcaagaccaccaccauguccauccucaccggccucuucccccccaccuccggcaccgccuacauccucggcaaggacauccgcuccgagauguccaccauccgccagaaccucggcgucugcccccagcacaacguccucuucgacaugcucaccgucgaggagcacaucugguucuacgcccgccucaagggccucuccgagaagcacgucaaggccgagauggagcagauggcccucgacgucggccuccccuccuccaagcucaaguccaagaccucccagcucuccggcggcaugcagcgcaagcucuccgucgcccucgccuucgucggcggcuccaaggucgucauccucgacgagcccaccgccggcgucgaccccuacucccgccgcggcaucugggagcuccuccucaaguaccgccagggccgcaccaucauccucuccacccaccacauggacgaggccgacguccucggcgaccgcaucgccaucaucucccacggcaagcucugcugcgucggcuccucccucuuccucaagaaccagcucggcaccggcuacuaccucacccucgucaagaaggacgucgaguccucccucuccuccugccgcaacuccuccuccaccgucuccuaccucaagaaggaggacuccgucucccaguccuccuccgacgccggccucggcuccgaccacgaguccgacacccucaccaucgacgucuccgccaucuccaaccucauccgcaagcacgucuccgaggcccgccucgucgaggacaucggccacgagcucaccuacguccuccccuacgaggccgccaaggagggcgccuucgucgagcucuuccacgagaucgacgaccgccucuccgaccucggcaucuccuccuacggcaucuccgagaccacccucgaggagaucuuccucaaggucgccgaggaguccggcgucgacgccgagaccuccgacggcacccuccccgcccgccgcaaccgccgcgccuucggcgacaagcaguccugccuccgccccuucaccgaggacgacgccgccgaccccaacgacuccgacaucgaccccgagucccgcgagaccgaccuccucuccggcauggacggcaagggcuccuaccaggucaagggcuggaagcucacccagcagcaguucgucgcccuccucuggaagcgccuccucaucgcccgccgcucccgcaagggcuucuucgcccagaucguccuccccgccgucuucgucugcaucgcccucgucuucucccucaucgucccccccuucggcaaguaccccucccucgagcuccagcccuggauguacaacgagcaguacaccuucgucuccaacgacgcccccgaggacaccggcacccucgagcuccucaacgcccucaccaaggaccccggcuucggcacccgcugcauggagggcaaccccauccccgacacccccugccaggccggcgaggaggaguggaccaccgcccccgucccccagaccaucauggaccucuuccagaacggcaacuggaccaugcagaaccccucccccgccugccagugcuccuccgacaagaucaagaagaugcuccccgucugcccccccggcgccggcggccucccccccccccagcgcaagcagaacaccgccgacauccuccaggaccucaccggccgcaacaucuccgacuaccucgucaagaccuacguccagaucaucgccaagucccucaagaacaagaucugggucaacgaguuccgcuacggcggcuucucccucggcgucuccaacacccaggcccucccccccucccaggaggucaacgacgccaucaagcagaugaagaagcaccucaagcucgccaaggacuccuccgccgaccgcuuccucaacucccucggccgcuucaugaccggccucgacaccaagaacaacgucaaggucugguucaacaacaagggcuggcacgccaucuccuccuuccucaacgucaucaacaacgccauccuccgcgccaaccuccagaagggcgagaaccccucccacuacggcaucaccgccuucaaccacccccucaaccucaccaagcagcagcucuccgaggucgcccucaugaccaccuccgucgacguccucgucuccaucugcgucaucuucgccauguccuucguccccgccuccuucgucgucuuccucauccaggagcgcgucuccaaggccaagcaccuccaguucaucuccggcgucaagcccgucaucuacuggcucuccaacuucgucugggacaugugcaacuacgucguccccgccacccucgucaucaucaucuucaucugcuuccagcagaaguccuacgucuccuccaccaaccuccccguccucgcccuccuccuccuccucuacggcugguccaucaccccccucauguaccccgccuccuucgucuucaagauccccuccaccgccuacgucguccucaccuccgucaaccucuucaucggcaucaacggcuccgucgccaccuucguccucgagcucuucaccgacaacaagcucaacaacaucaacgacauccucaaguccgucuuccucaucuucccccacuucugccucggccgcggccucaucgacauggucaagaaccaggccauggccgacgcccucgagcgcuucggcgagaaccgcuucgucuccccccucuccugggaccucgucggccgcaaccucuucgccauggccgucgagggcgucgucuucuuccucaucaccguccucauccaguaccgcuucuucauccgcccccgccccgucaacgccaagcucuccccccucaacgacgaggacgaggacguccgccgcgagcgccagcgcauccucgacggcggcggccagaacgacauccucgagaucaaggagcucaccaagaucuaccgccgcaagcgcaagcccgccgucgaccgcaucugcgucggcaucccccccggcgagugcuucggccuccucggcgucaacggcgccggcaaguccuccaccuucaagaugcucaccggcgacaccaccgucacccgcggcgacgccuuccucaacaagaacuccauccucuccaacauccacgagguccaccagaacaugggcuacugcccccaguucgacgccaucaccgagcuccucaccggccgcgagcacgucgaguucuucgcccuccuccgcggcguccccgagaaggaggucggcaaggucggcgagugggccauccgcaagcucggccucgucaaguacggcgagaaguacgccggcaacuacuccggcggcaacaagcgcaagcucuccaccgccauggcccucaucggcggcccccccgucgucuuccucgacgagcccaccaccggcauggaccccaaggcccgccgcuuccucuggaacugcgcccucuccgucgucaaggagggccgcuccgucguccucaccucccacuccauggaggagugcgaggcccucugcacccgcauggccaucauggucaacggccgcuuccgcugccucggcuccguccagcaccucaagaaccgcuucggcgacggcuacaccaucgucguccgcaucgccggcuccaaccccgaccucaagcccguccaggacuucuucggccucgccuuccccggcuccguccucaaggagaagcaccgcaacaugcuccaguaccagcuccccuccucccucuccucccucgcccgcaucuucuccauccucucccaguccaagaagcgccuccacaucgaggacuacuccgucucccagaccacccucgaccaggucuucgucaacuucgccaaggaccaguccgacgacgaccaccucaaggaccucucccuccacaagaaccagaccgucgucgacgucgccguccucaccuccuuccuccaggacgagaaggucaaggaguccuacgucuga

SEQ ID NO: 39207 - RNA, 7311 nt, Artificial Sequence
  derived and/or modified sequence opt2 from ABCA2__Homo_sapiens__NP_001597
augggcuuccuccaccagcuccagcuccuccucuggaagaacgucacccucaagcgccgcucccccuggguccucgccuucgagaucuucaucccccucguccucuucuucauccuccucggccuccgccagaagaagcccaccaucuccgucaaggaggucuccuucuacaccgccgccccccucaccuccgccggcauccuccccgucaugcagucccucugccccgacggccagcgcgacgaguucggcuuccuccaguacgccaacuccaccgucacccagcuccucgagcgccucgaccgcgucgucgaggagggcaaccucuucgaccccgcccgccccucccucggcuccgagcucgaggcccuccgccagcaccucgaggcccucuccgccggccccggcaccuccggcucccaccucgaccgcuccaccgucuccuccuucucccucgacuccgucgcccgcaacccccaggagcucuggcgcuuccucacccagaaccucucccuccccaacuccaccgcccaggcccuccucgccgcccgcgucgacccccccgaggucuaccaccuccucuucggccccuccuccgcccucgacucccaguccggccuccacaagggccaggagcccuggucccgccucggcggcaacccccucuuccgcauggaggagcuccuccucgcccccgcccuccucgagcagcucaccugcacccccggcuccggcgagcucggccgcauccucaccguccccgagucccagaagggcgcccuccagggcuaccgcgacgccgucugcuccggccaggccgccgcccgcgcccgccgcuucuccggccucuccgccgagcuccgcaaccagcucgacgucgccaaggucucccagcagcucggccucgacgcccccaacggcuccgacuccuccccccaggccccccccccccgccgccuccaggcccuccucggcgaccuccucgacgcccagaagguccuccaggacgucgacguccucuccgcccucgcccuccuccucccccagggcgccugcaccggccgcacccccggcccccccgccuccggcgccggcggcgccgccaacggcaccggcgccggcgccgucaugggccccaacgccaccgccgaggagggcgcccccuccgccgccgcccucgccacccccgacacccuccagggccagugcuccgccuucguccagcucugggccggccuccagcccauccucugcggcaacaaccgcaccaucgagcccgaggcccuccgccgcggcaacauguccucccucggcuucaccuccaaggagcagcgcaaccucggccuccucguccaccucaugaccuccaaccccaagauccucuacgcccccgccggcuccgaggucgaccgcgucauccucaaggccaacgagaccuucgccuucgucggcaacgucacccacuacgcccaggucuggcucaacaucuccgccgagauccgcuccuuccucgagcagggccgccuccagcagcaccuccgcuggcuccagcaguacgucgccgagcuccgccuccaccccgaggcccucaaccucucccucgacgagcucccccccgcccuccgccaggacaacuucucccuccccuccggcauggcccuccuccagcagcucgacaccaucgacaacgccgccugcggcuggauccaguucauguccaaggucuccgucgacaucuucaagggcuuccccgacgaggaguccaucgucaacuacacccucaaccaggccuaccaggacaacgucaccgucuucgccuccgucaucuuccagacccgcaaggacggcucccuccccccccacguccacuacaagauccgccagaacuccuccuucaccgagaagaccaacgagauccgccgcgccuacuggcgccccggccccaacaccggcggccgcuucuacuuccucuacggcuucgucuggauccaggacaugauggagcgcgccaucaucgacaccuucgucggccacgacgucgucgagcccggcuccuacguccagauguuccccuaccccugcuacacccgcgacgacuuccucuucgucaucgagcacaugaugccccucugcauggucaucuccugggucuacuccgucgccaugaccauccagcacaucgucgccgagaaggagcaccgccucaaggaggucaugaagaccaugggccucaacaacgccguccacugggucgccugguucaucaccggcuucguccagcucuccaucuccgucaccgcccucaccgccauccucaaguacggccagguccucaugcacucccacgucgucaucaucuggcucuuccucgccgucuacgccgucgccaccaucauguucugcuuccucgucuccguccucuacuccaaggccaagcucgccuccgccugcggcggcaucaucuacuuccucuccuacguccccuacauguacgucgccauccgcgaggaggucgcccacgacaagaucaccgccuucgagaagugcaucgccucccucauguccaccaccgccuucggccucggcuccaaguacuucgcccucuacgaggucgccggcgucggcauccaguggcacaccuucucccagucccccgucgagggcgacgacuucaaccuccuccucgccgucaccaugcucauggucgacgccgucgucuacggcauccucaccugguacaucgaggccguccaccccggcauguacggccucccccgccccugguacuucccccuccagaaguccuacuggcucggcuccggccgcaccgaggccugggagugguccuggcccugggcccgcaccccccgccucuccgucauggaggaggaccaggccugcgccauggagucccgccgcuucgaggagacccgcggcauggaggaggagcccacccaccucccccucgucgucugcgucgacaagcucaccaaggucuacaaggacgacaagaagcucgcccucaacaagcucucccucaaccucuacgagaaccaggucgucuccuuccucggccacaacggcgccggcaagaccaccaccauguccauccucaccggccucuucccccccaccuccggcuccgccaccaucuacggccacgacauccgcaccgagauggacgagauccgcaagaaccucggcaugugcccccagcacaacguccucuucgaccgccucaccgucgaggagcaccucugguucuacucccgccucaaguccauggcccaggaggagauccgccgcgagauggacaagaugaucgaggaccucgagcucuccaacaagcgccacucccucguccagacccucuccggcggcaugaagcgcaagcucuccgucgccaucgccuucgucggcggcucccgcgccaucauccucgacgagcccaccgccggcgucgaccccuacgcccgccgcgccaucugggaccucauccucaaguacaagcccggccgcaccauccuccucuccacccaccacauggacgaggccgaccuccucggcgaccgcaucgccaucaucucccacggcaagcucaagugcugcggcuccccccucuuccucaagggcaccuacggcgacggcuaccgccucacccucgucaagcgccccgccgagcccggcggcccccaggagcccggccucgccuccuccccccccggccgcgccccccucuccuccugcuccgagcuccaggucucccaguucauccgcaagcacgucgccuccugccuccucgucuccgacaccuccaccgagcucuccuacauccuccccuccgaggccgccaagaagggcgccuucgagcgccucuuccagcaccucgagcgcucccucgacgcccuccaccucuccuccuucggccucauggacaccacccucgaggaggucuuccucaaggucuccgaggaggaccagucccucgagaacuccgaggccgacgucaaggagucccgcaaggacguccuccccggcgccgagggccccgccuccggcgagggccacgccggcaaccucgcccgcugcuccgagcucacccagucccaggccucccuccaguccgccuccuccgucggcuccgcccgcggcgacgagggcgccggcuacaccgacgucuacggcgacuaccgcccccucuucgacaacccccaggaccccgacaacgucucccuccaggaggucgaggccgaggcccucucccgcgucggccagggcucccgcaagcucgacggcggcuggcucaagguccgccaguuccacggccuccucgucaagcgcuuccacugcgcccgccgcaacuccaaggcccucuucucccagauccuccuccccgccuucuucgucugcgucgccaugaccgucgcccucuccguccccgagaucggcgaccuccccccccucguccucucccccucccaguaccacaacuacacccagccccgcggcaacuucauccccuacgccaacgaggagcgccgcgaguaccgccuccgccucucccccgacgccuccccccagcagcucgucuccaccuuccgccuccccuccggcgucggcgccaccugcguccucaagucccccgccaacggcucccucggccccacccucaaccucuccuccggcgagucccgccuccucgccgcccgcuucuucgacuccaugugccucgaguccuucacccagggccucccccucuccaacuucgucccccccccccccucccccgcccccuccgacucccccgccucccccgacgaggaccuccaggccuggaacgucucccucccccccaccgccggccccgagauguggaccuccgcccccucccucccccgccucguccgcgagcccguccgcugcaccugcuccgcccagggcaccggcuucuccugccccuccuccgucggcggccaccccccccagaugcgcgucgucaccggcgacauccucaccgacaucaccggccacaacgucuccgaguaccuccucuucaccuccgaccgcuuccgccuccaccgcuacggcgccaucaccuucggcaacguccucaaguccauccccgccuccuucggcacccgcgccccccccaugguccgcaagaucgccguccgccgcgccgcccaggucuucuacaacaacaagggcuaccacuccaugcccaccuaccucaacucccucaacaacgccauccuccgcgccaaccuccccaaguccaagggcaaccccgccgccuacggcaucaccgucaccaaccaccccaugaacaagaccuccgccucccucucccucgacuaccuccuccagggcaccgacgucgucaucgccaucuucaucaucgucgccauguccuucguccccgccuccuucgucgucuuccucgucgccgagaaguccaccaaggccaagcaccuccaguucgucuccggcugcaaccccaucaucuacuggcucgccaacuacgucugggacaugcucaacuaccucguccccgccaccugcugcgucaucauccucuucgucuucgaccuccccgccuacaccucccccaccaacuuccccgccguccucucccucuuccuccucuacggcugguccaucacccccaucauguaccccgccuccuucugguucgagguccccuccuccgccuacgucuuccucaucgucaucaaccucuucaucggcaucaccgccaccgucgccaccuuccuccuccagcucuucgagcacgacaaggaccucaaggucgucaacuccuaccucaaguccugcuuccucaucuuccccaacuacaaccucggccacggccucauggagauggccuacaacgaguacaucaacgaguacuacgccaagaucggccaguucgacaagaugaagucccccuucgagugggacaucgucacccgcggccucgucgccauggccgucgagggcgucgucggcuuccuccucaccaucaugugccaguacaacuuccuccgccgcccccagcgcaugcccgucuccaccaagcccgucgaggacgacgucgacgucgccuccgagcgccagcgcguccuccgcggcgacgccgacaacgacauggucaagaucgagaaccucaccaaggucuacaagucccgcaagaucggccgcauccucgccgucgaccgccucugccucggcguccgccccggcgagugcuucggccuccucggcgucaacggcgccggcaagaccuccaccuucaagaugcucaccggcgacgaguccaccaccggcggcgaggccuucgucaacggccacuccguccucaaggagcuccuccagguccagcagucccucggcuacugcccccagugcgacgcccucuucgacgagcucaccgcccgcgagcaccuccagcucuacacccgccuccgcggcaucuccuggaaggacgaggcccgcgucgucaagugggcccucgagaagcucgagcucaccaaguacgccgacaagcccgccggcaccuacuccggcggcaacaagcgcaagcucuccaccgccaucgcccucaucggcuaccccgccuucaucuuccucgacgagcccaccaccggcauggaccccaaggcccgccgcuuccucuggaaccucauccucgaccucaucaagaccggccgcuccgucguccucaccucccacuccauggaggagugcgaggcccucugcacccgccucgccaucauggucaacggccgccuccgcugccucggcuccauccagcaccucaagaaccgcuucggcgacggcuacaugaucaccguccgcaccaaguccucccaguccgucaaggacgucguccgcuucuucaaccgcaacuuccccgaggccaugcucaaggagcgccaccacaccaagguccaguaccagcucaaguccgagcacaucucccucgcccaggucuucuccaagauggagcaggucuccggcguccucggcaucgaggacuacuccgucucccagaccacccucgacaacgucuucgucaacuucgccaagaagcaguccgacaaccucgagcagcaggagaccgagccccccuccgcccuccaguccccccucggcugccuccucucccuccuccgcccccgcuccgcccccaccgagcuccgcgcccucgucgccgacgagcccgaggaccucgacaccgaggacgagggccucaucuccuucgaggaggagcgcgcccagcucuccuucaacaccgacacccucugcuga

SEQ ID NO: 39208 - RNA, 5115 nt, Artificial Sequence
  derived and/or modified sequence opt2 from ABCA3__Homo_sapiens__NP_001080
auggccguccuccgccagcucgcccuccuccucuggaagaacuacacccuccagaagcgcaagguccucgucaccguccucgagcucuuccucccccuccucuucuccggcauccucaucuggcuccgccucaagauccaguccgagaacguccccaacgccaccaucuaccccggccaguccauccaggagcucccccucuucuucaccuuccccccccccggcgacaccugggagcucgccuacauccccucccacuccgacgccgccaagaccgucaccgagaccguccgccgcgcccucgucaucaacaugcgcguccgcggcuuccccuccgagaaggacuucgaggacuacauccgcuacgacaacugcuccuccuccguccucgccgccgucgucuucgagcaccccuucaaccacuccaaggagccccucccccucgccgucaaguaccaccuccgcuucuccuacacccgccgcaacuacauguggacccagaccggcuccuucuuccucaaggagaccgagggcuggcacaccaccucccucuucccccucuuccccaaccccggcccccgcgagcccaccucccccgacggcggcgagcccggcuacauccgcgagggcuuccucgccguccagcacgccgucgaccgcgccaucauggaguaccacgccgacgccgccacccgccagcucuuccagcgccucaccgucaccaucaagcgcuuccccuacccccccuucaucgccgaccccuuccucgucgccauccaguaccagcucccccuccuccuccuccucuccuucaccuacaccgcccucaccaucgcccgcgccgucguccaggagaaggagcgccgccucaaggaguacaugcgcaugaugggccucuccuccuggcuccacugguccgccugguuccuccucuucuuccucuuccuccucaucgccgccuccuucaugacccuccucuucugcgucaaggucaagcccaacgucgccguccucucccgcuccgaccccucccucguccucgccuuccuccucugcuucgccaucuccaccaucuccuucuccuucauggucuccaccuucuucuccaaggccaacauggccgccgccuucggcggcuuccucuacuucuucaccuacauccccuacuucuucgucgccccccgcuacaacuggaugacccucucccagaagcucugcuccugccuccucuccaacgucgccauggccaugggcgcccagcucaucggcaaguucgaggccaagggcaugggcauccaguggcgcgaccuccucucccccgucaacgucgacgacgacuucugcuucggccagguccucggcaugcuccuccucgacuccguccucuacggccucgucaccugguacauggaggccgucuuccccggccaguucggcgucccccagcccugguacuucuucaucaugcccuccuacuggugcggcaagccccgcgccgucgccggcaaggaggaggaggacuccgaccccgagaaggcccuccgcaacgaguacuucgaggccgagcccgaggaccucgucgccggcaucaagaucaagcaccucuccaaggucuuccgcgucggcaacaaggaccgcgccgccguccgcgaccucaaccucaaccucuacgagggccagaucaccguccuccucggccacaacggcgccggcaagaccaccacccucuccaugcucaccggccucuucccccccaccuccggccgcgccuacaucuccggcuacgagaucucccaggacaugguccagauccgcaagucccucggccucugcccccagcacgacauccucuucgacaaccucaccgucgccgagcaccucuacuucuacgcccagcucaagggccucucccgccagaagugccccgaggaggucaagcagaugcuccacaucaucggccucgaggacaaguggaacucccgcucccgcuuccucuccggcggcaugcgccgcaagcucuccaucggcaucgcccucaucgccggcuccaagguccucauccucgacgagcccaccuccggcauggacgccaucucccgccgcgccaucugggaccuccuccagcgccagaaguccgaccgcaccaucguccucaccacccacuucauggacgaggccgaccuccucggcgaccgcaucgccaucauggccaagggcgagcuccagugcugcggcuccucccucuuccucaagcagaaguacggcgccggcuaccacaugacccucgucaaggagccccacugcaaccccgaggacaucucccagcucguccaccaccacguccccaacgccacccucgaguccuccgccggcgccgagcucuccuucauccucccccgcgaguccacccaccgcuucgagggccucuucgccaagcucgagaagaagcagaaggagcucggcaucgccuccuucggcgccuccaucaccaccauggaggaggucuuccuccgcgucggcaagcucgucgacuccuccauggacauccaggccauccagcuccccgcccuccaguaccagcacgagcgccgcgccuccgacugggccgucgacuccaaccucugcggcgccauggaccccuccgacggcaucggcgcccucaucgaggaggagcgcaccgccgucaagcucaacaccggccucgcccuccacugccagcaguucugggccauguuccucaagaaggccgccuacuccuggcgcgaguggaagauggucgccgcccagguccucgucccccucaccugcgucacccucgcccuccucgccaucaacuacuccuccgagcucuucgacgaccccaugcuccgccucacccucggcgaguacggccgcaccgucguccccuucuccguccccggcaccucccagcucggccagcagcucuccgagcaccucaaggacgcccuccaggccgagggccaggagccccgcgagguccucggcgaccucgaggaguuccucaucuuccgcgccuccgucgagggcggcggcuucaacgagcgcugccucgucgccgccuccuuccgcgacgucggcgagcgcaccgucgucaacgcccucuucaacaaccaggccuaccacucccccgccaccgcccucgccgucgucgacaaccuccucuucaagcuccucugcggcccccacgccuccaucgucgucuccaacuucccccagccccgcuccgcccuccaggccgccaaggaccaguucaacgagggccgcaagggcuucgacaucgcccucaaccuccucuucgccauggccuuccucgccuccaccuucuccauccucgccgucuccgagcgcgccguccaggccaagcacguccaguucgucuccggcguccacgucgccuccuucuggcucuccgcccuccucugggaccucaucuccuuccucauccccucccuccuccuccucgucgucuucaaggccuucgacguccgcgccuucacccgcgacggccacauggccgacacccuccuccuccuccuccucuacggcugggccaucaucccccucauguaccucaugaacuucuucuuccucggcgccgccaccgccuacacccgccucaccaucuucaacauccucuccggcaucgccaccuuccucauggucaccaucaugcgcauccccgccgucaagcucgaggagcucuccaagacccucgaccacgucuuccucguccuccccaaccacugccucggcauggccgucuccuccuucuacgagaacuacgagacccgccgcuacugcaccuccuccgaggucgccgcccacuacugcaagaaguacaacauccaguaccaggagaacuucuacgccugguccgcccccggcgucggccgcuucgucgccuccauggccgccuccggcugcgccuaccucauccuccucuuccucaucgagaccaaccuccuccagcgccuccgcggcauccucugcgcccuccgccgccgccgcacccucaccgagcucuacacccgcaugcccguccuccccgaggaccaggacgucgccgacgagcgcacccgcauccucgcccccucccccgacucccuccuccacaccccccucaucaucaaggagcucuccaaggucuacgagcagcgcgucccccuccucgccgucgaccgccucucccucgccguccagaagggcgagugcuucggccuccucggcuucaacggcgccggcaagaccaccaccuucaagaugcucaccggcgaggagucccucaccuccggcgacgccuucgucggcggccaccgcaucuccuccgacgucggcaagguccgccagcgcaucggcuacugcccccaguucgacgcccuccucgaccacaugaccggccgcgagaugcucgucauguacgcccgccuccgcggcauccccgagcgccacaucggcgccugcgucgagaacacccuccgcggccuccuccucgagccccacgccaacaagcucguccgcaccuacuccggcggcaacaagcgcaagcucuccaccggcaucgcccucaucggcgagcccgccgucaucuuccucgacgagcccuccaccggcauggaccccgucgcccgccgccuccucugggacaccgucgcccgcgcccgcgaguccggcaaggccaucaucaucaccucccacuccauggaggagugcgaggcccucugcacccgccucgccaucaugguccagggccaguucaagugccucggcuccccccagcaccucaaguccaaguucggcuccggcuacucccuccgcgccaagguccaguccgagggccagcaggaggcccucgaggaguucaaggccuucgucgaccucaccuuccccggcuccguccucgaggacgagcaccagggcaugguccacuaccaccuccccggccgcgaccucuccugggccaaggucuucggcauccucgagaaggccaaggagaaguacggcgucgacgacuacuccgucucccagaucucccucgagcaggucuuccucuccuucgcccaccuccagccccccaccgccgaggagggccgcuga

SEQ ID NO: 39209 - RNA, 4929 nt, Artificial Sequence
  derived and/or modified sequence opt2 from ABCA5__Homo_sapiens__NP_758424
auguccaccgccauccgcgaggucggcgucuggcgccagacccgcacccuccuccucaagaacuaccucaucaagugccgcaccaagaaguccuccguccaggagauccucuucccccucuucuuccucuucuggcucauccucaucuccaugaugcaccccaacaagaaguacgaggagguccccaacaucgagcucaaccccauggacaaguucacccucuccaaccucauccucggcuacacccccgucaccaacaucaccuccuccaucaugcagaaggucuccaccgaccaccuccccgacgucaucaucaccgaggaguacaccaacgagaaggagaugcucaccuccucccucuccaagcccuccaacuucgucggcgucgucuucaaggacuccauguccuacgagcuccgcuucuuccccgacaugauccccgucuccuccaucuacauggacucccgcgccggcugcuccaaguccugcgaggccgcccaguacugguccuccggcuucaccguccuccaggccuccaucgacgccgccaucauccagcucaagaccaacgucucccucuggaaggagcucgaguccaccaaggccgucaucaugggcgagaccgccgucgucgagaucgacaccuucccccgcggcgucauccucaucuaccucgucaucgccuucucccccuucggcuacuuccucgccauccacaucgucgccgagaaggagaagaagaucaaggaguuccucaagaucaugggccuccacgacaccgccuucuggcucuccuggguccuccucuacaccucccucaucuuccucaugucccuccucauggccgucaucgccaccgccucccuccucuucccccaguccuccuccaucgucaucuuccuccucuucuuccucuacggccucuccuccgucuucuucgcccucaugcucaccccccucuucaagaaguccaagcacgucggcaucgucgaguucuucgucaccgucgccuucggcuucaucggccucaugaucauccucaucgaguccuuccccaagucccucgucuggcucuucucccccuucugccacugcaccuucgucaucggcaucgcccaggucaugcaccucgaggacuucaacgagggcgccuccuucuccaaccucaccgccggccccuacccccucaucaucaccaucaucaugcucacccucaacuccaucuucuacguccuccucgccgucuaccucgaccaggucauccccggcgaguucggccuccgccgcuccucccucuacuuccucaagcccuccuacugguccaaguccaagcgcaacuacgaggagcucuccgagggcaacgucaacggcaacaucuccuucuccgagaucaucgagcccgucuccuccgaguucgucggcaaggaggccauccgcaucuccggcauccagaagaccuaccgcaagaagggcgagaacgucgaggcccuccgcaaccucuccuucgacaucuacgagggccagaucaccgcccuccucggccacuccggcaccggcaaguccacccucaugaacauccucugcggccucugcccccccuccgacggcuucgccuccaucuacggccaccgcgucuccgagaucgacgagauguucgaggcccgcaagaugaucggcaucugcccccagcucgacauccacuucgacguccucaccgucgaggagaaccucuccauccucgccuccaucaagggcauccccgccaacaacaucauccaggagguccagaagguccuccucgaccucgacaugcagaccaucaaggacaaccaggccaagaagcucuccggcggccagaagcgcaagcucucccucggcaucgccguccucggcaaccccaagauccuccuccucgacgagcccaccgccggcauggaccccugcucccgccacaucgucuggaaccuccucaaguaccgcaaggccaaccgcgucaccgucuucuccacccacuucauggacgaggccgacauccucgccgaccgcaaggccgucaucucccagggcaugcucaagugcgucggcuccuccauguuccucaaguccaaguggggcaucggcuaccgccucuccauguacaucgacaaguacugcgccaccgagucccucuccucccucgucaagcagcacauccccggcgccacccuccuccagcagaacgaccagcagcucgucuacucccuccccuucaaggacauggacaaguucuccggccucuucuccgcccucgacucccacuccaaccucggcgucaucuccuacggcgucuccaugaccacccucgaggacgucuuccucaagcucgaggucgaggccgagaucgaccaggccgacuacuccgucuucacccagcagccccucgaggaggagauggacuccaaguccuucgacgagauggagcagucccuccucauccucuccgagaccaaggccgcccucgucuccaccaugucccucuggaagcagcagauguacaccaucgccaaguuccacuucuucacccucaagcgcgaguccaaguccguccgcuccguccuccuccuccuccucaucuucuucaccguccagaucuucauguuccucguccaccacuccuucaagaacgccgucguccccaucaagcucguccccgaccucuacuuccucaagcccggcgacaagccccacaaguacaagaccucccuccuccuccagaacuccgccgacuccgacaucuccgaccucaucuccuucuucaccucccagaacaucauggucaccaugaucaacgacuccgacuacgucuccgucgccccccacuccgccgcccucaacgucaugcacuccgagaaggacuacgucuucgccgccgucuucaacuccaccauggucuacucccuccccauccucgucaacaucaucuccaacuacuaccucuaccaccucaacgucaccgagaccauccagaucugguccacccccuucuuccaggagaucaccgacaucgucuucaagaucgagcucuacuuccaggccgcccuccucggcaucaucgucaccgccaugccccccuacuucgccauggagaacgccgagaaccacaagaucaaggccuacacccagcucaagcucuccggccuccuccccuccgccuacuggaucggccaggccgucgucgacaucccccucuucuucaucauccucauccucaugcucggcucccuccucgccuuccacuacggccucuacuucuacaccgucaaguuccucgccgucgucuucugccucaucggcuacguccccuccgucauccucuucaccuacaucgccuccuucaccuucaagaagauccucaacaccaaggaguucugguccuucaucuacuccgucgccgcccucgccugcaucgccaucaccgagaucaccuucuucaugggcuacaccaucgccaccauccuccacuacgccuucugcaucaucauccccaucuacccccuccucggcugccucaucuccuucaucaagaucuccuggaagaacguccgcaagaacgucgacaccuacaaccccugggaccgccucuccgucgccgucaucucccccuaccuccagugcguccucuggaucuuccuccuccaguacuacgagaagaaguacggcggccgcuccauccgcaaggaccccuucuuccgcaaccucuccaccaaguccaagaaccgcaagcuccccgagccccccgacaacgaggacgaggacgaggacgucaaggccgagcgccucaaggucaaggagcucaugggcugccagugcugcgaggagaagcccuccaucauggucuccaaccuccacaaggaguacgacgacaagaaggacuuccuccucucccgcaaggucaagaaggucgccaccaaguacaucuccuucugcgucaagaagggcgagauccucggccuccucggccccaacggcgccggcaaguccaccaucaucaacauccucgucggcgacaucgagcccaccuccggccaggucuuccucggcgacuacuccuccgagaccuccgaggacgacgacucccucaagugcaugggcuacugcccccagaucaacccccucuggcccgacaccacccuccaggagcacuucgagaucuacggcgccgucaagggcauguccgccuccgacaugaaggaggucaucucccgcaucacccacgcccucgaccucaaggagcaccuccagaagaccgucaagaagcuccccgccggcaucaagcgcaagcucugcuucgcccucuccaugcucggcaacccccagaucacccuccucgacgagcccuccaccggcauggaccccaaggccaagcagcacauguggcgcgccauccgcaccgccuucaagaaccgcaagcgcgccgccauccucaccacccacuacauggaggaggccgaggccgucugcgaccgcgucgccaucauggucuccggccagcuccgcugcaucggcaccguccagcaccucaaguccaaguucggcaagggcuacuuccucgagaucaagcucaaggacuggaucgagaaccucgaggucgaccgccuccagcgcgagauccaguacaucuuccccaacgccucccgccaggaguccuucuccuccauccucgccuacaagauccccaaggaggacguccagucccucucccaguccuucuucaagcucgaggaggccaagcacgccuucgccaucgaggaguacuccuucucccaggccacccucgagcaggucuucgucgagcucaccaaggagcaggaggaggaggacaacuccugcggcacccucaacuccacccucuggugggagcgcacccaggaggaccgcgucgucuucuga

SEQ ID NO: 39210 - RNA, 4854 nt, Artificial Sequence
  derived and/or modified sequence opt2 from ABCA6__Homo_sapiens__NP_525023
augaacaugaagcagaaguccgucuaccagcagaccaaggcccuccucugcaagaacuuccucaagaaguggcgcaugaagcgcgagucccuccucgaguggggccucuccauccuccucggccucugcaucgcccucuucuccuccuccaugcgcaacguccaguuccccggcauggccccccagaaccucggccgcgucgacaaguucaacuccuccucccucauggucgucuacacccccaucuccaaccucacccagcagaucaugaacaagaccgcccucgccccccuccucaagggcaccuccgucaucggcgcccccaacaagacccacauggacgagauccuccucgagaaccuccccuacgccaugggcaucaucuucaacgagaccuucuccuacaagcucaucuucuuccagggcuacaacuccccccucuggaaggaggacuucuccgcccacugcugggacggcuacggcgaguucuccugcacccucaccaaguacuggaaccgcggcuucgucgcccuccagaccgccaucaacaccgccaucaucgagaucaccaccaaccaccccgucauggaggagcucauguccgucaccgccaucaccaugaagacccuccccuucaucaccaagaaccuccuccacaacgagauguucauccucuucuuccuccuccacuucuccccccucgucuacuucaucucccucaacgucaccaaggagcgcaagaaguccaagaaccucaugaagaugaugggccuccaggacuccgccuucuggcucuccuggggccucaucuacgccggcuucaucuucaucaucuccaucuucgucaccaucaucaucaccuucacccagaucaucgucaugaccggcuucauggucaucuucauccucuucuuccucuacggccucucccucgucgcccucgucuuccucauguccguccuccucaagaaggccguccucaccaaccucgucgucuuccuccucacccucuucuggggcugccucggcuucaccgucuucuacgagcagcuccccuccucccucgaguggauccucaacaucugcucccccuucgccuucaccaccggcaugauccagaucaucaagcucgacuacaaccucaacggcgucaucuuccccgaccccuccggcgacuccuacaccaugaucgccaccuucuccaugcuccuccucgacggccucaucuaccuccuccucgcccucuacuucgacaagauccuccccuacggcgacgagcgccacuacuccccccucuucuuccucaacuccuccuccugcuuccagcaccagcgcaccaacgccaaggucaucgagaaggagaucgacgccgagcaccccuccgacgacuacuucgagcccgucgcccccgaguuccagggcaaggaggccauccgcauccgcaacgucaagaaggaguacaagggcaaguccggcaaggucgaggcccucaagggccuccucuucgacaucuacgagggccagaucaccgccauccucggccacuccggcgccggcaaguccucccuccucaacauccucaacggccucuccguccccaccgagggcuccgucaccaucuacaacaagaaccucuccgagaugcaggaccucgaggagauccgcaagaucaccggcgucugcccccaguucaacguccaguucgacauccucaccgucaaggagaaccucucccucuucgccaagaucaagggcauccaccucaaggaggucgagcaggagguccagcgcauccuccucgagcucgacaugcagaacauccaggacaaccucgccaagcaccucuccgagggccagaagcgcaagcucaccuucggcaucaccauccucggcgacccccagauccuccuccucgacgagcccaccaccggccucgaccccuucucccgcgaccaggucuggucccuccuccgcgagcgccgcgccgaccacgucauccucuucuccacccaguccauggacgaggccgacauccucgccgaccgcaaggucaucauguccaacggccgccucaagugcgccggcuccuccauguuccucaagcgccgcuggggccucggcuaccaccucucccuccaccgcaacgagaucugcaaccccgagcagaucaccuccuucaucacccaccacauccccgacgccaagcucaagaccgagaacaaggagaagcucgucuacacccucccccucgagcgcaccaacaccuuccccgaccucuucuccgaccucgacaagugcuccgaccagggcgucaccggcuacgacaucuccauguccacccucaacgaggucuucaugaagcucgagggccaguccaccaucgagcaggacuucgagcaggucgagaugauccgcgacuccgagucccucaacgagauggagcucgcccacuccuccuucuccgagaugcagaccgccgucuccgacaugggccucuggcgcaugcaggucuucgccauggcccgccuccgcuuccucaagcucaagcgccagaccaagguccuccucacccuccuccucgucuucggcaucgccaucuucccccucaucgucgagaacaucauguacgccaugcucaacgagaagaucgacugggaguucaagaacgagcucuacuuccucucccccggccagcucccccaggagccccgcaccucccuccucaucaucaacaacaccgaguccaacaucgaggacuucaucaagucccucaagcaccagaacauccuccucgaggucgacgacuucgagaaccgcaacggcaccgacggccucuccuacaacggcgccaucaucgucuccggcaagcagaaggacuaccgcuucuccgucgucugcaacaccaagcgccuccacugcuuccccauccucaugaacaucaucuccaacggccuccuccagauguucaaccacacccagcacauccgcaucgaguccucccccuucccccucucccacaucggccucuggaccggccuccccgacggcuccuucuuccucuuccucguccucugcuccaucucccccuacaucaccaugggcuccaucuccgacuacaagaagaacgccaagucccagcucuggaucuccggccucuacaccuccgccuacuggugcggccaggcccucgucgacgucuccuucuucauccucauccuccuccucauguaccucaucuucuacaucgagaacaugcaguaccuccucaucaccucccagaucgucuucgcccucgucaucgucacccccggcuacgccgccucccucgucuucuucaucuacaugaucuccuucaucuuccgcaagcgccgcaagaacuccggccucugguccuucuacuucuucuucgccuccaccaucauguucuccaucacccucaucaaccacuucgaccucuccauccucaucaccaccaugguccucguccccuccuacacccuccucggcuucaagaccuuccucgagguccgcgaccaggagcacuaccgcgaguuccccgaggccaacuucgagcucuccgccaccgacuuccucgucugcuucauccccuacuuccagacccuccucuucgucuucguccuccgcugcauggagcucaagugcggcaagaagcgcaugcgcaaggaccccgucuuccgcaucuccccccagucccgcgacgccaagcccaaccccgaggagcccaucgacgaggacgaggacauccagaccgagcgcauccgcaccgccaccgcccucaccaccuccauccucgacgagaagcccgucaucaucgccuccugccuccacaaggaguacgccggccagaagaaguccugcuucuccaagcgcaagaagaagaucgccgcccgcaacaucuccuucugcguccaggagggcgagauccucggccuccucggccccaacggcgccggcaaguccuccuccauccgcaugaucuccggcaucaccaagcccaccgccggcgaggucgagcucaagggcugcuccuccguccucggccaccucggcuacugcccccaggagaacguccucuggcccaugcucacccuccgcgagcaccucgaggucuacgccgccgucaagggccuccgcaaggccgacgcccgccucgccaucgcccgccucgucuccgccuucaagcuccacgagcagcucaacguccccguccagaagcucaccgccggcaucacccgcaagcucugcuucguccucucccuccucggcaacucccccguccuccuccucgacgagcccuccaccggcaucgaccccaccggccagcagcagauguggcaggccauccaggccgucgucaagaacaccgagcgcggcguccuccucaccacccacaaccucgccgaggccgaggcccucugcgaccgcgucgccaucauggucuccggccgccuccgcugcaucggcuccauccagcaccucaagaacaagcucggcaaggacuacauccucgagcucaaggucaaggagaccucccaggucacccucguccacaccgagauccucaagcucuucccccaggccgccggccaggagcgcuacuccucccuccucaccuacaagcuccccgucgccgacgucuacccccucucccagaccuuccacaagcucgaggccgucaagcacaacuucaaccucgaggaguacucccucucccagugcacccucgagaaggucuuccucgagcucuccaaggagcaggaggucggcaacuucgacgaggagaucgacaccaccaugcgcuggaagcuccucccccacuccgacgagcccuga

SEQ ID NO: 39211 - RNA, 6441 nt, Artificial Sequence
  derived and/or modified sequence opt2 from ABCA7__Homo_sapiens__NP_061985
auggccuucuggacccagcucaugcuccuccucuggaagaacuucauguaccgccgccgccagcccguccagcuccucgucgagcuccucuggccccucuuccucuucuucauccucgucgccguccgccacucccaccccccccucgagcaccacgagugccacuuccccaacaagccccuccccuccgccggcaccguccccuggcuccagggccucaucugcaacgucaacaacaccugcuucccccagcucacccccggcgaggagcccggccgccucuccaacuucaacgacucccucgucucccgccuccucgccgacgcccgcaccguccucggcggcgccuccgcccaccgcacccucgccggccucggcaagcucaucgccacccuccgcgccgcccgcuccaccgcccagccccagcccaccaagcaguccccccucgagccccccaugcucgacgucgccgagcuccucaccucccuccuccgcaccgagucccucggccucgcccucggccaggcccaggagccccuccacucccuccucgaggccgccgaggaccucgcccaggagcuccucgcccuccgcucccucgucgagcuccgcgcccuccuccagcgcccccgcggcaccuccggcccccucgagcuccucuccgaggcccucugcuccguccgcggccccuccuccaccgucggccccucccucaacugguacgaggccuccgaccucauggagcucgucggccaggagcccgaguccgcccuccccgacuccucccucucccccgccugcuccgagcucaucggcgcccucgacucccacccccucucccgccuccucuggcgccgccucaagccccucauccucggcaagcuccucuucgcccccgacacccccuucacccgcaagcucauggcccaggucaaccgcaccuucgaggagcucacccuccuccgcgacguccgcgaggucugggagaugcucggcccccgcaucuucaccuucaugaacgacuccuccaacgucgccaugcuccagcgccuccuccagaugcaggacgagggccgccgccagccccgccccggcggccgcgaccacauggaggcccuccgcuccuuccucgaccccggcuccggcggcuacuccuggcaggacgcccacgccgacgucggccaccucgucggcacccucggccgcgucaccgagugccucucccucgacaagcucgaggccgcccccuccgaggccgcccucgucucccgcgcccuccagcuccucgccgagcaccgcuucugggccggcgucgucuuccucggccccgaggacuccuccgaccccaccgagcaccccacccccgaccucggccccggccacguccgcaucaagauccgcauggacaucgacgucgucacccgcaccaacaagauccgcgaccgcuucugggaccccggccccgccgccgacccccucaccgaccuccgcuacgucuggggcggcuucgucuaccuccaggaccucgucgagcgcgccgccguccgcguccucuccggcgccaacccccgcgccggccucuaccuccagcagaugcccuaccccugcuacgucgacgacgucuuccuccgcguccucucccgcucccucccccucuuccucacccucgccuggaucuacuccgucacccucaccgucaaggccgucguccgcgagaaggagacccgccuccgcgacaccaugcgcgccaugggccucucccgcgccguccucuggcucggcugguuccucuccugccucggccccuuccuccucuccgccgcccuccucguccucguccucaagcucggcgacauccuccccuacucccaccccggcgucgucuuccucuuccucgccgccuucgccgucgccaccgucacccaguccuuccuccucuccgccuucuucucccgcgccaaccucgccgccgccugcggcggccucgccuacuucucccucuaccuccccuacguccucugcgucgccuggcgcgaccgccuccccgccggcggccgcgucgccgccucccuccucucccccgucgccuucggcuucggcugcgagucccucgcccuccucgaggagcagggcgagggcgcccaguggcacaacgucggcacccgccccaccgccgacgucuucucccucgcccaggucuccggccuccuccuccucgacgccgcccucuacggccucgccaccugguaccucgaggccgucugccccggccaguacggcauccccgagcccuggaacuuccccuuccgccgcuccuacuggugcggcccccgcccccccaagucccccgcccccugccccaccccccucgaccccaagguccucgucgaggaggccccccccggccucucccccggcgucuccguccgcucccucgagaagcgcuuccccggcuccccccagcccgcccuccgcggccucucccucgacuucuaccagggccacaucaccgccuuccucggccacaacggcgccggcaagaccaccacccucuccauccucuccggccucuucccccccuccggcggcuccgccuucauccucggccacgacguccgcuccuccauggccgccauccgcccccaccucggcgucugcccccaguacaacguccucuucgacaugcucaccgucgacgagcacgucugguucuacggccgccucaagggccucuccgccgccgucgucggccccgagcaggaccgccuccuccaggacgucggccucgucuccaagcaguccguccagacccgccaccucuccggcggcaugcagcgcaagcucuccgucgccaucgccuucgucggcggcucccaggucgucauccucgacgagcccaccgccggcgucgaccccgccucccgccgcggcaucugggagcuccuccucaaguaccgcgagggccgcacccucauccucuccacccaccaccucgacgaggccgagcuccucggcgaccgcgucgccgucgucgccggcggccgccucugcugcugcggcuccccccucuuccuccgccgccaccucggcuccggcuacuaccucacccucgucaaggcccgccucccccucaccaccaacgagaaggccgacaccgacauggagggcuccgucgacacccgccaggagaagaagaacggcucccagggcucccgcgucggcaccccccagcuccucgcccucguccagcacuggguccccggcgcccgccucgucgaggagcucccccacgagcucguccucguccuccccuacaccggcgcccacgacggcuccuucgccacccucuuccgcgagcucgacacccgccucgccgagcuccgccucaccggcuacggcaucuccgacaccucccucgaggagaucuuccucaaggucgucgaggagugcgccgccgacaccgacauggaggacggcuccugcggccagcaccucugcaccggcaucgccggccucgacgucacccuccgccucaagaugcccccccaggagaccgcccucgagaacggcgagcccgccggcuccgcccccgagaccgaccagggcuccggccccgacgccgucggccgcguccagggcugggcccucacccgccagcagcuccaggcccuccuccucaagcgcuuccuccucgcccgccgcucccgccgcggccucuucgcccagaucguccuccccgcccucuucgucggccucgcccucgucuucucccucaucgucccccccuucggccacuaccccgcccuccgccucucccccaccauguacggcgcccaggucuccuucuucuccgaggacgcccccggcgaccccggccgcgcccgccuccucgaggcccuccuccaggaggccggccucgaggagccccccguccagcacuccucccaccgcuucuccgcccccgagguccccgccgaggucgccaagguccucgccuccggcaacuggacccccgagucccccucccccgccugccagugcucccgccccggcgcccgccgccuccuccccgacugccccgccgccgccggcggccccccccccccccaggccgucaccggcuccggcgaggucguccagaaccucaccggccgcaaccucuccgacuuccucgucaagaccuacccccgccucguccgccagggccucaagaccaagaagugggucaacgagguccgcuacggcggcuucucccucggcggccgcgaccccggccuccccuccggccaggagcucggccgcuccgucgaggagcucugggcccuccucuccccccuccccggcggcgcccucgaccgcguccucaagaaccucaccgccugggcccacucccucgacgcccaggacucccucaagaucugguucaacaacaagggcuggcacuccauggucgccuucgucaaccgcgccuccaacgccauccuccgcgcccaccucccccccggccccgcccgccacgcccacuccaucaccacccucaaccacccccucaaccucaccaaggagcagcucuccgagggcgcccucauggccuccuccgucgacguccucgucuccaucugcgucgucuucgccauguccuucguccccgccuccuucacccucguccucaucgaggagcgcgucacccgcgccaagcaccuccagcucaugggcggccucucccccacccucuacuggcucggcaacuuccucugggacaugugcaacuaccucguccccgccugcaucgucguccucaucuuccucgccuuccagcagcgcgccuacgucgcccccgccaaccuccccgcccuccuccuccuccuccuccucuacggcugguccaucaccccccucauguaccccgccuccuucuucuucuccguccccuccaccgccuacgucguccucaccugcaucaaccucuucaucggcaucaacggcuccauggccaccuucguccucgagcucuucuccgaccagaagcuccaggaggucucccgcauccucaagcaggucuuccucaucuucccccacuucugccucggccgcggccucaucgacaugguccgcaaccaggccauggccgacgccuucgagcgccucggcgaccgccaguuccaguccccccuccgcugggaggucgucggcaagaaccuccucgccauggucauccagggcccccucuuccuccucuucacccuccuccuccagcaccgcucccagcuccucccccagccccgcguccgcucccucccccuccucggcgaggaggacgaggacgucgcccgcgagcgcgagcgcgucguccagggcgccacccagggcgacguccucguccuccgcaaccucaccaaggucuaccgcggccagcgcaugcccgccgucgaccgccucugccucggcaucccccccggcgagugcuucggccuccucggcgucaacggcgccggcaagaccuccaccuuccgcauggucaccggcgacacccucgccucccgcggcgaggccguccucgccggccacuccgucgcccgcgagcccuccgccgcccaccucuccaugggcuacugcccccaguccgacgccaucuucgagcuccucaccggccgcgagcaccucgagcuccucgcccgccuccgcggcguccccgaggcccaggucgcccagaccgccggcuccggccucgcccgccucggccucuccugguacgccgaccgccccgccggcaccuacuccggcggcaacaagcgcaagcucgccaccgcccucgcccucgucggcgaccccgccgucgucuuccucgacgagcccaccaccggcauggaccccuccgcccgccgcuuccucuggaacucccuccucgccgucguccgcgagggccgcuccgucaugcucaccucccacuccauggaggagugcgaggcccucugcucccgccucgccaucauggucaacggccgcuuccgcugccucggcuccccccagcaccucaagggccgcuucgccgccggccacacccucacccuccgcguccccgccgcccgcucccagcccgccgccgccuucgucgccgccgaguuccccggcgccgagcuccgcgaggcccacggcggccgccuccgcuuccagcucccccccggcggccgcugcgcccucgcccgcgucuucggcgagcucgccguccacggcgccgagcacggcgucgaggacuucuccgucucccagaccaugcucgaggaggucuuccucuacuucuccaaggaccagggcaaggacgaggacaccgaggagcagaaggaggccggcgucggcgucgaccccgcccccggccuccagcaccccaagcgcgucucccaguuccucgacgaccccuccaccgccgagaccguccucuga

SEQ ID NO: 39212 - RNA, 4875 nt, Artificial Sequence
  derived and/or modified sequence opt2 from ABCA9__Homo_sapiens__NP_525022
auguccaagcgccgcauguccgucggccagcagaccugggcccuccucugcaagaacugccucaagaaguggcgcaugaagcgccagacccuccucgaguggcucuucuccuuccuccucguccucuuccucuaccucuucuucuccaaccuccaccagguccacgacaccccccagauguccuccauggaccucggccgcgucgacuccuucaacgacaccaacuacgucaucgccuucgcccccgaguccaagaccacccaggagaucaugaacaaggucgccuccgcccccuuccucaagggccgcaccaucaugggcuggcccgacgagaaguccauggacgagcucgaccucaacuacuccaucgacgccguccgcgucaucuucaccgacaccuucuccuaccaccucaaguucuccuggggccaccgcauccccaugaugaaggagcaccgcgaccacuccgcccacugccaggccgucaacgagaagaugaagugcgagggcuccgaguucugggagaagggcuucgucgccuuccaggccgccaucaacgccgccaucaucgagaucgccaccaaccacuccgucauggagcagcucauguccgucaccggcguccacaugaagauccuccccuucgucgcccagggcggcgucgccaccgacuucuucaucuucuucugcaucaucuccuucuccaccuucaucuacuacgucuccgucaacgucacccaggagcgccaguacaucaccucccucaugaccaugaugggccuccgcgaguccgccuucuggcucuccuggggccucauguacgccggcuucauccucaucauggccacccucauggcccucaucgucaaguccgcccagaucgucguccucaccggcuucgucauggucuucacccucuuccuccucuacggccucucccucaucacccucgccuuccucauguccguccucaucaagaagcccuuccucaccggccucgucgucuuccuccucaucgucuucuggggcauccucggcuuccccgcccucuacacccgccuccccgccuuccucgaguggacccucugccuccucucccccuucgccuucaccgucggcauggcccagcucauccaccucgacuacgacgucaacuccaacgcccaccucgacuccucccagaaccccuaccucaucaucgccacccucuucaugcucgucuucgacacccuccucuaccucguccucacccucuacuucgacaagauccuccccgccgaguacggccaccgcugcuccccccucuucuuccucaaguccugcuucugguuccagcacggccgcgccaaccacgucguccucgagaacgagaccgacuccgaccccacccccaacgacugcuucgagcccgucucccccgaguucugcggcaaggaggccauccgcaucaagaaccucaagaaggaguacgccggcaagugcgagcgcgucgaggcccucaagggcgucgucuucgacaucuacgagggccagaucaccgcccuccucggccacuccggcgccggcaagaccacccuccucaacauccucuccggccucuccguccccaccuccggcuccgucaccgucuacaaccacacccucucccgcauggccgacaucgagaacaucuccaaguucaccggcuucugcccccaguccaacguccaguucggcuuccucaccgucaaggagaaccuccgccucuucgccaagaucaagggcauccucccccacgaggucgagaaggagguccagcgcgucguccaggagcucgagauggagaacauccaggacauccucgcccagaaccucuccggcggccagaaccgcaagcucaccuucggcaucgccauccucggcgacccccagguccuccuccucgacgagcccaccgccggccucgacccccucucccgccaccgcaucuggaaccuccucaaggagggcaaguccgaccgcgucauccucuucuccacccaguucaucgacgaggccgacauccucgccgaccgcaaggucuucaucuccaacggcaagcucaagugcgccggcuccucccucuuccucaagaagaaguggggcaucggcuaccaccucucccuccaccucaacgagcgcugcgaccccgaguccaucaccucccucgucaagcagcacaucuccgacgccaagcucaccgcccaguccgaggagaagcucgucuacauccucccccucgagcgcaccaacaaguuccccgagcucuaccgcgaccucgaccgcugcuccaaccagggcaucgaggacuacggcgucuccaucaccacccucaacgaggucuuccucaagcucgagggcaaguccaccaucgacgaguccgacaucggcaucuggggccagcuccagaccgacggcgccaaggacaucggcucccucgucgagcucgagcagguccucuccuccuuccacgagacccgcaagaccaucuccggcgucgcccucuggcgccagcaggucugcgccaucgccaagguccgcuuccucaagcucaagaaggagcgcaagucccucuggaccauccuccuccucuucggcaucuccuucaucccccagcuccucgagcaccucuucuacgaguccuaccagaaguccuaccccugggagcucucccccaacaccuacuuccucucccccggccagcagccccaggacccccucacccaccuccucgucaucaacaagaccggcuccaccaucgacaacuuccuccacucccuccgccgccagaacaucgccaucgaggucgacgccuucggcacccgcaacggcaccgacgaccccuccuacaacggcgccaucaucgucuccggcgacgagaaggaccaccgcuucuccaucgccugcaacaccaagcgccucaacugcuuccccguccuccucgacgucaucuccaacggccuccucggcaucuucaacuccuccgagcacauccagaccgaccgcuccaccuucuucgaggagcacauggacuacgaguacggcuaccgcuccaacaccuucuucuggauccccauggccgccuccuucacccccuacaucgccauguccuccaucggcgacuacaagaagaaggcccacucccagcuccgcaucuccggccucuaccccuccgccuacugguucggccaggcccucgucgacgucucccucuacuuccucauccuccuccucaugcagaucauggacuacaucuucucccccgaggagaucaucuucaucauccagaaccuccucauccagauccucugcuccaucggcuacgucuccucccucgucuuccucaccuacgucaucuccuucaucuuccgcaacggccgcaagaacuccggcaucugguccuucuucuuccucaucgucgucaucuucuccaucgucgccaccgaccucaacgaguacggcuuccucggccucuucuucggcaccaugcucaucccccccuucacccucaucggcucccucuucaucuucuccgagaucucccccgacuccauggacuaccucggcgccuccgaguccgagaucgucuaccucgcccuccucauccccuaccuccacuuccucaucuuccucuucauccuccgcugccucgagaugaacugccgcaagaagcucaugcgcaaggaccccgucuuccgcaucuccccccgcuccaacgccaucuuccccaaccccgaggagcccgagggcgaggaggaggacauccagauggagcgcaugcgcaccgucaacgccauggccguccgcgacuucgacgagacccccgucaucaucgccuccugccuccgcaaggaguacgccggcaagaagaagaacugcuucuccaagcgcaagaagaagaucgccacccgcaacgucuccuucugcgucaagaagggcgaggucaucggccuccucggccacaacggcgccggcaaguccaccaccaucaagaugaucaccggcgacaccaagcccaccgccggccaggucauccucaagggcuccggcggcggcgagccccucggcuuccucggcuacugcccccaggagaacgcccucuggcccaaccucaccguccgccagcaccucgaggucuacgccgccgucaagggccuccgcaagggcgacgccaugaucgccaucacccgccucgucgacgcccucaagcuccaggaccagcucaaggcccccgucaagacccucuccgagggcaucaagcgcaagcucugcuucguccucuccauccucggcaaccccuccgucguccuccucgacgagcccuccaccggcauggaccccgagggccagcagcagauguggcaggucauccgcgccaccuuccgcaacaccgagcgcggcgcccuccucaccacccacuacauggccgaggccgaggccgucugcgaccgcgucgccaucauggucuccggccgccuccgcugcaucggcuccauccagcaccucaaguccaaguucggcaaggacuaccuccucgagaugaagcucaagaaccucgcccagauggagccccuccacgccgagauccuccgccucuucccccaggccgcccagcaggagcgcuucuccucccucauggucuacaagcuccccgucgaggacguccgcccccucucccaggccuucuucaagcucgagaucgucaagcaguccuucgaccucgaggaguacucccucucccaguccacccucgagcaggucuuccucgagcucuccaaggagcaggagcucggcgaccucgaggaggacuucgaccccuccgucaaguggaagcuccuccuccaggaggagcccuga

SEQ ID NO: 39213 - RNA, 3966 nt, Artificial Sequence
  derived and/or modified sequence opt2 from ABCB11__Homo_sapiens__NP_003733
auguccgacuccgucauccuccgcuccaucaagaaguucggcgaggagaacgacggcuucgaguccgacaaguccuacaacaacgacaagaagucccgccuccaggacgagaagaagggcgacggcguccgcgucggcuucuuccagcucuuccgcuucuccuccuccaccgacaucuggcucauguucgucggcucccucugcgccuuccuccacggcaucgcccagcccggcguccuccucaucuucggcaccaugaccgacgucuucaucgacuacgacgucgagcuccaggagcuccagauccccggcaaggccugcgucaacaacaccaucgucuggaccaacuccucccucaaccagaacaugaccaacggcacccgcugcggccuccucaacaucgaguccgagaugaucaaguucgccuccuacuacgccggcaucgccgucgccguccucaucaccggcuacauccagaucugcuucugggucaucgccgccgcccgccagauccagaagaugcgcaaguucuacuuccgccgcaucaugcgcauggagaucggcugguucgacugcaacuccgucggcgagcucaacacccgcuucuccgacgacaucaacaagaucaacgacgccaucgccgaccagauggcccucuucauccagcgcaugaccuccaccaucugcggcuuccuccucggcuucuuccgcggcuggaagcucacccucgucaucaucuccgucuccccccucaucggcaucggcgccgccaccaucggccucuccgucuccaaguucaccgacuacgagcucaaggccuacgccaaggccggcgucgucgccgacgaggucaucuccuccaugcgcaccgucgccgccuucggcggcgagaagcgcgaggucgagcgcuacgagaagaaccucgucuucgcccagcgcuggggcauccgcaagggcaucgucaugggcuucuucaccggcuucgucuggugccucaucuuccucugcuacgcccucgccuucugguacggcuccacccucguccucgacgagggcgaguacacccccggcacccucguccagaucuuccucuccgucaucgucggcgcccucaaccucggcaacgccucccccugccucgaggccuucgccaccggccgcgccgccgccaccuccaucuucgagaccaucgaccgcaagcccaucaucgacugcauguccgaggacggcuacaagcucgaccgcaucaagggcgagaucgaguuccacaacgucaccuuccacuaccccucccgccccgaggucaagauccucaacgaccucaacauggucaucaagcccggcgagaugaccgcccucgucggccccuccggcgccggcaaguccaccgcccuccagcucauccagcgcuucuacgaccccugcgagggcauggucaccgucgacggccacgacauccgcucccucaacauccaguggcuccgcgaccagaucggcaucgucgagcaggagcccguccucuucuccaccaccaucgccgagaacauccgcuacggccgcgaggacgccaccauggaggacaucguccaggccgccaaggaggccaacgccuacaacuucaucauggaccucccccagcaguucgacacccucgucggcgagggcggcggccagauguccggcggccagaagcagcgcgucgccaucgcccgcgcccucauccgcaaccccaagauccuccuccucgacauggccaccuccgcccucgacaacgaguccgaggccaugguccaggagguccucuccaagauccagcacggccacaccaucaucuccgucgcccaccgccucuccaccguccgcgccgccgacaccaucaucggcuucgagcacggcaccgccgucgagcgcggcacccacgaggagcuccucgagcgcaagggcgucuacuucacccucgucacccuccagucccagggcaaccaggcccucaacgaggaggacaucaaggacgccaccgaggacgacaugcucgcccgcaccuucucccgcggcuccuaccaggacucccuccgcgccuccauccgccagcgcuccaagucccagcucuccuaccucguccacgagcccccccucgccgucgucgaccacaaguccaccuacgaggaggaccgcaaggacaaggacauccccguccaggaggaggucgagcccgcccccguccgccgcauccucaaguucuccgcccccgaguggcccuacaugcucgucggcuccgucggcgccgccgucaacggcaccgucaccccccucuacgccuuccucuucucccagauccucggcaccuucuccauccccgacaaggaggagcagcgcucccagaucaacggcgucugccuccucuucgucgccaugggcugcgucucccucuucacccaguuccuccagggcuacgccuucgccaaguccggcgagcuccucaccaagcgccuccgcaaguucggcuuccgcgccaugcucggccaggacaucgccugguucgacgaccuccgcaacucccccggcgcccucaccacccgccucgccaccgacgccucccagguccagggcgccgccggcucccagaucggcaugaucgucaacuccuucaccaacgucaccgucgccaugaucaucgccuucuccuucuccuggaagcucucccucgucauccucugcuucuuccccuuccucgcccucuccggcgccacccagacccgcaugcucaccggcuucgccucccgcgacaagcaggcccucgagauggucggccagaucaccaacgaggcccucuccaacauccgcaccgucgccggcaucggcaaggagcgccgcuucaucgaggcccucgagaccgagcucgagaagcccuucaagaccgccauccagaaggccaacaucuacggcuucugcuucgccuucgcccagugcaucauguucaucgccaacuccgccuccuaccgcuacggcggcuaccucaucuccaacgagggccuccacuucuccuacgucuuccgcgucaucuccgccgucguccucuccgccaccgcccucggccgcgccuucuccuacacccccuccuacgccaaggccaagaucuccgccgcccgcuucuuccagcuccucgaccgccagccccccaucuccgucuacaacaccgccggcgagaagugggacaacuuccagggcaagaucgacuucgucgacugcaaguucaccuaccccucccgccccgacucccagguccucaacggccucuccgucuccaucucccccggccagacccucgccuucgucggcuccuccggcugcggcaaguccaccuccauccagcuccucgagcgcuucuacgaccccgaccagggcaaggucaugaucgacggccacgacuccaagaaggucaacguccaguuccuccgcuccaacaucggcaucgucucccaggagcccguccucuucgccugcuccaucauggacaacaucaaguacggcgacaacaccaaggagauccccauggagcgcgucaucgccgccgccaagcaggcccagcuccacgacuucgucaugucccuccccgagaaguacgagaccaacgucggcucccagggcucccagcucucccgcggcgagaagcagcgcaucgccaucgcccgcgccaucguccgcgaccccaagauccuccuccucgacgaggccaccuccgcccucgacaccgaguccgagaagaccguccaggucgcccucgacaaggcccgcgagggccgcaccugcaucgucaucgcccaccgccucuccaccauccagaacgccgacaucaucgccgucauggcccagggcgucgucaucgagaagggcacccacgaggagcucauggcccagaagggcgccuacuacaagcucgucaccaccggcucccccaucuccuga

SEQ ID NO: 39214 - RNA, 3843 nt, Artificial Sequence
  derived and/or modified sequence opt2 from ABCB1__Homo_sapiens__NP_000918
auggaccucgagggcgaccgcaacggcggcgccaagaagaagaacuucuucaagcucaacaacaaguccgagaaggacaagaaggagaagaagcccaccgucuccgucuucuccauguuccgcuacuccaacuggcucgacaagcucuacauggucgucggcacccucgccgccaucauccacggcgccggccucccccucaugaugcucgucuucggcgagaugaccgacaucuucgccaacgccggcaaccucgaggaccucauguccaacaucaccaaccgcuccgacaucaacgacaccggcuucuucaugaaccucgaggaggacaugacccgcuacgccuacuacuacuccggcaucggcgccggcguccucgucgccgccuacauccaggucuccuucuggugccucgccgccggccgccagauccacaagauccgcaagcaguucuuccacgccaucaugcgccaggagaucggcugguucgacguccacgacgucggcgagcucaacacccgccucaccgacgacgucuccaagaucaacgagggcaucggcgacaagaucggcauguucuuccaguccauggccaccuucuucaccggcuucaucgucggcuucacccgcggcuggaagcucacccucgucauccucgccaucucccccguccucggccucuccgccgccgucugggccaagauccucuccuccuucaccgacaaggagcuccucgccuacgccaaggccggcgccgucgccgaggagguccucgccgccauccgcaccgucaucgccuucggcggccagaagaaggagcucgagcgcuacaacaagaaccucgaggaggccaagcgcaucggcaucaagaaggccaucaccgccaacaucuccaucggcgccgccuuccuccucaucuacgccuccuacgcccucgccuucugguacggcaccacccucguccucuccggcgaguacuccaucggccagguccucaccgucuucuucuccguccucaucggcgccuucuccgucggccaggccucccccuccaucgaggccuucgccaacgcccgcggcgccgccuacgagaucuucaagaucaucgacaacaagcccuccaucgacuccuacuccaaguccggccacaagcccgacaacaucaagggcaaccucgaguuccgcaacguccacuucuccuaccccucccgcaaggaggucaagauccucaagggccucaaccucaagguccaguccggccagaccgucgcccucgucggcaacuccggcugcggcaaguccaccaccguccagcucaugcagcgccucuacgaccccaccgagggcauggucuccgucgacggccaggacauccgcaccaucaacguccgcuuccuccgcgagaucaucggcgucgucucccaggagcccguccucuucgccaccaccaucgccgagaacauccgcuacggccgcgagaacgucaccauggacgagaucgagaaggccgucaaggaggccaacgccuacgacuucaucaugaagcucccccacaaguucgacacccucgucggcgagcgcggcgcccagcucuccggcggccagaagcagcgcaucgccaucgcccgcgcccucguccgcaaccccaagauccuccuccucgacgaggccaccuccgcccucgacaccgaguccgaggccgucguccaggucgcccucgacaaggcccgcaagggccgcaccaccaucgucaucgcccaccgccucuccaccguccgcaacgccgacgucaucgccggcuucgacgacggcgucaucgucgagaagggcaaccacgacgagcucaugaaggagaagggcaucuacuucaagcucgucaccaugcagaccgccggcaacgaggucgagcucgagaacgccgccgacgaguccaaguccgagaucgacgcccucgagauguccuccaacgacucccgcuccucccucauccgcaagcgcuccacccgccgcuccguccgcggcucccaggcccaggaccgcaagcucuccaccaaggaggcccucgacgaguccaucccccccgucuccuucuggcgcaucaugaagcucaaccucaccgaguggcccuacuucgucgucggcgucuucugcgccaucaucaacggcggccuccagcccgccuucgccaucaucuucuccaagaucaucggcgucuucacccgcaucgacgaccccgagaccaagcgccagaacuccaaccucuucucccuccucuuccucgcccucggcaucaucuccuucaucaccuucuuccuccagggcuucaccuucggcaaggccggcgagauccucaccaagcgccuccgcuacauggucuuccgcuccaugcuccgccaggacgucuccugguucgacgaccccaagaacaccaccggcgcccucaccacccgccucgccaacgacgccgcccaggucaagggcgccaucggcucccgccucgccgucaucacccagaacaucgccaaccucggcaccggcaucaucaucuccuucaucuacggcuggcagcucacccuccuccuccucgccaucguccccaucaucgccaucgccggcgucgucgagaugaagaugcucuccggccaggcccucaaggacaagaaggagcucgagggcuccggcaagaucgccaccgaggccaucgagaacuuccgcaccgucgucucccucacccaggagcagaaguucgagcacauguacgcccagucccuccagguccccuaccgcaacucccuccgcaaggcccacaucuucggcaucaccuucuccuucacccaggccaugauguacuucuccuacgccggcugcuuccgcuucggcgccuaccucgucgcccacaagcucauguccuucgaggacguccuccucgucuucuccgccgucgucuucggcgccauggccgucggccaggucuccuccuucgcccccgacuacgccaaggccaagaucuccgccgcccacaucaucaugaucaucgagaagaccccccucaucgacuccuacuccaccgagggccucaugcccaacacccucgagggcaacgucaccuucggcgaggucgucuucaacuaccccacccgccccgacauccccguccuccagggccucucccucgaggucaagaagggccagacccucgcccucgucggcuccuccggcugcggcaaguccaccgucguccagcuccucgagcgcuucuacgacccccucgccggcaagguccuccucgacggcaaggagaucaagcgccucaacguccaguggcuccgcgcccaccucggcaucgucucccaggagcccauccucuucgacugcuccaucgccgagaacaucgccuacggcgacaacucccgcgucgucucccaggaggagaucguccgcgccgccaaggaggccaacauccacgccuucaucgagucccuccccaacaaguacuccaccaaggucggcgacaagggcacccagcucuccggcggccagaagcagcgcaucgccaucgcccgcgcccucguccgccagccccacauccuccuccucgacgaggccaccuccgcccucgacaccgaguccgagaaggucguccaggaggcccucgacaaggcccgcgagggccgcaccugcaucgucaucgcccaccgccucuccaccauccagaacgccgaccucaucgucgucuuccagaacggccgcgucaaggagcacggcacccaccagcagcuccucgcccagaagggcaucuacuucuccauggucuccguccaggccggcaccaagcgccaguga

SEQ ID NO: 39215 - RNA, 3840 nt, Artificial Sequence
  derived and/or modified sequence opt2 from ABCB4__Homo_sapiens__NP_000434
auggaccucgaggccgccaagaacggcaccgccuggcgccccaccuccgccgagggcgacuucgagcucggcaucuccuccaagcagaagcgcaagaagaccaagaccgucaagaugaucggcguccucacccucuuccgcuacuccgacuggcaggacaagcucuucaugucccucggcaccaucauggccaucgcccacggcuccggccucccccucaugaugaucgucuucggcgagaugaccgacaaguucgucgacaccgccggcaacuucuccuuccccgucaacuucucccucucccuccucaaccccggcaagauccucgaggaggagaugacccgcuacgccuacuacuacuccggccucggcgccggcguccucgucgccgccuacauccaggucuccuucuggacccucgccgccggccgccagauccgcaagauccgccagaaguucuuccacgccauccuccgccaggagaucggcugguucgacaucaacgacaccaccgagcucaacacccgccucaccgacgacaucuccaagaucuccgagggcaucggcgacaaggucggcauguucuuccaggccgucgccaccuucuucgccggcuucaucgucggcuucauccgcggcuggaagcucacccucgucaucauggccaucucccccauccucggccucuccgccgccgucugggccaagauccucuccgccuucuccgacaaggagcucgccgccuacgccaaggccggcgccgucgccgaggaggcccucggcgccauccgcaccgucaucgccuucggcggccagaacaaggagcucgagcgcuaccagaagcaccucgagaacgccaaggagaucggcaucaagaaggccaucuccgccaacaucuccaugggcaucgccuuccuccucaucuacgccuccuacgcccucgccuucugguacggcuccacccucgucaucuccaaggaguacaccaucggcaacgccaugaccgucuucuucuccauccucaucggcgccuucuccgucggccaggccgcccccugcaucgacgccuucgccaacgcccgcggcgccgccuacgucaucuucgacaucaucgacaacaaccccaagaucgacuccuucuccgagcgcggccacaagcccgacuccaucaagggcaaccucgaguucaacgacguccacuucuccuaccccucccgcgccaacgucaagauccucaagggccucaaccucaagguccaguccggccagaccgucgcccucgucggcuccuccggcugcggcaaguccaccaccguccagcucauccagcgccucuacgaccccgacgagggcaccaucaacaucgacggccaggacauccgcaacuucaacgucaacuaccuccgcgagaucaucggcgucgucucccaggagcccguccucuucuccaccaccaucgccgagaacaucugcuacggccgcggcaacgucaccauggacgagaucaagaaggccgucaaggaggccaacgccuacgaguucaucaugaagcucccccagaaguucgacacccucgucggcgagcgcggcgcccagcucuccggcggccagaagcagcgcaucgccaucgcccgcgcccucguccgcaaccccaagauccuccuccucgacgaggccaccuccgcccucgacaccgaguccgaggccgagguccaggccgcccucgacaaggcccgcgagggccgcaccaccaucgucaucgcccaccgccucuccaccguccgcaacgccgacgucaucgccggcuucgaggacggcgucaucgucgagcagggcucccacuccgagcucaugaagaaggagggcgucuacuucaagcucgucaacaugcagaccuccggcucccagauccaguccgaggaguucgagcucaacgacgagaaggccgccacccgcauggcccccaacggcuggaagucccgccucuuccgccacuccacccagaagaaccucaagaacucccagaugugccagaagucccucgacgucgagaccgacggccucgaggccaacgucccccccgucuccuuccucaagguccucaagcucaacaagaccgaguggcccuacuucgucgucggcaccgucugcgccaucgccaacggcggccuccagcccgccuucuccgucaucuucuccgagaucaucgccaucuucggccccggcgacgacgccgucaagcagcagaagugcaacaucuucucccucaucuuccucuuccucggcaucaucuccuucuucaccuucuuccuccagggcuucaccuucggcaaggccggcgagauccucacccgccgccuccgcuccauggccuucaaggccaugcuccgccaggacauguccugguucgacgaccacaagaacuccaccggcgcccucuccacccgccucgccaccgacgccgcccagguccagggcgccaccggcacccgccucgcccucaucgcccagaacaucgccaaccucggcaccggcaucaucaucuccuucaucuacggcuggcagcucacccuccuccuccucgccgucguccccaucaucgccgucuccggcaucgucgagaugaagcuccucgccggcaacgccaagcgcgacaagaaggagcucgaggccgccggcaagaucgccaccgaggccaucgagaacauccgcaccgucgucucccucacccaggagcgcaaguucgaguccauguacgucgagaagcucuacggccccuaccgcaacuccguccagaaggcccacaucuacggcaucaccuucuccaucucccaggccuucauguacuucuccuacgccggcugcuuccgcuucggcgccuaccucaucgucaacggccacaugcgcuuccgcgacgucauccucgucuucuccgccaucgucuucggcgccgucgcccucggccacgccuccuccuucgcccccgacuacgccaaggccaagcucuccgccgcccaccucuucaugcucuucgagcgccagccccucaucgacuccuacuccgaggagggccucaagcccgacaaguucgagggcaacaucaccuucaacgaggucgucuucaacuaccccacccgcgccaacguccccguccuccagggccucucccucgaggucaagaagggccagacccucgcccucgucggcuccuccggcugcggcaaguccaccgucguccagcuccucgagcgcuucuacgacccccucgccggcaccguccuccucgacggccaggaggccaagaagcucaacguccaguggcuccgcgcccagcucggcaucgucucccaggagcccauccucuucgacugcuccaucgccgagaacaucgccuacggcgacaacucccgcgucgucucccaggacgagaucgucuccgccgccaaggccgccaacauccaccccuucaucgagacccucccccacaaguacgagacccgcgucggcgacaagggcacccagcucuccggcggccagaagcagcgcaucgccaucgcccgcgcccucauccgccagccccagauccuccuccucgacgaggccaccuccgcccucgacaccgaguccgagaaggucguccaggaggcccucgacaaggcccgcgagggccgcaccugcaucgucaucgcccaccgccucuccaccauccagaacgccgaccucaucgucgucuuccagaacggccgcgucaaggagcacggcacccaccagcagcuccucgcccagaagggcaucuacuucuccauggucuccguccaggccggcacccagaaccucuga

SEQ ID NO: 39216 - RNA, 3774 nt, Artificial Sequence
  derived and/or modified sequence opt2 from ABCB5__Homo_sapiens__NP_001157413
auggagaacuccgagcgcgccgaggagaugcaggagaacuaccagcgcaacggcaccgccgaggagcagcccaagcuccgcaaggaggccgucggcuccaucgagaucuuccgcuucgccgacggccucgacaucacccucaugauccucggcauccucgccucccucgucaacggcgccugccucccccucaugccccucguccucggcgagauguccgacaaccucaucuccggcugccucguccagaccaacaccaccaacuaccagaacugcacccagucccaggagaagcucaacgaggacaugacccuccucacccucuacuacgucggcaucggcgucgccgcccucaucuucggcuacauccagaucucccucuggaucaucaccgccgcccgccagaccaagcgcauccgcaagcaguucuuccacuccguccucgcccaggacaucggcugguucgacuccugcgacaucggcgagcucaacacccgcaugaccgacgacaucgacaagaucuccgacggcaucggcgacaagaucgcccuccucuuccagaacauguccaccuucuccaucggccucgccgucggccucgucaagggcuggaagcucacccucgucacccucuccaccuccccccucaucauggccuccgccgccgccugcucccgcauggucaucucccucaccuccaaggagcucuccgccuacuccaaggccggcgccgucgccgaggagguccucuccuccauccgcaccgucaucgccuuccgcgcccaggagaaggagcuccagcgcuacacccagaaccucaaggacgccaaggacuucggcaucaagcgcaccaucgccuccaaggucucccucggcgccgucuacuucuucaugaacggcaccuacggccucgccuucugguacggcaccucccucauccucaacggcgagcccggcuacaccaucggcaccguccucgccgucuucuucuccgucauccacuccuccuacugcaucggcgccgccgucccccacuucgagaccuucgccaucgcccgcggcgccgccuuccacaucuuccaggucaucgacaagaagcccuccaucgacaacuucuccaccgccggcuacaagcccgaguccaucgagggcaccgucgaguucaagaacgucuccuucaacuaccccucccgccccuccaucaagauccucaagggccucaaccuccgcaucaaguccggcgagaccgucgcccucgucggccucaacggcuccggcaaguccaccgucguccagcuccuccagcgccucuacgaccccgacgacggcuucaucauggucgacgagaacgacauccgcgcccucaacguccgccacuaccgcgaccacaucggcgucgucucccaggagcccguccucuucggcaccaccaucuccaacaacaucaaguacggccgcgacgacgucaccgacgaggagauggagcgcgccgcccgcgaggccaacgccuacgacuucaucauggaguuccccaacaaguucaacacccucgucggcgagaagggcgcccagauguccggcggccagaagcagcgcaucgccaucgcccgcgcccucguccgcaaccccaagauccucauccucgacgaggccaccuccgcccucgacuccgaguccaaguccgccguccaggccgcccucgagaaggccuccaagggccgcaccaccaucgucgucgcccaccgccucuccaccauccgcuccgccgaccucaucgucacccucaaggacggcaugcucgccgagaagggcgcccacgccgagcucauggccaagcgcggccucuacuacucccucgucaugucccaggacaucaagaaggccgacgagcagauggaguccaugaccuacuccaccgagcgcaagaccaacucccucccccuccacuccgucaaguccaucaaguccgacuucaucgacaaggccgaggaguccacccaguccaaggagaucucccuccccgaggucucccuccucaagauccucaagcucaacaagcccgaguggcccuucgucguccucggcacccucgccuccguccucaacggcaccguccaccccgucuucuccaucaucuucgccaagaucaucaccauguucggcaacaacgacaagaccacccucaagcacgacgccgagaucuacuccaugaucuucgucauccucggcgucaucugcuucgucuccuacuucaugcagggccucuucuacggccgcgccggcgagauccucaccaugcgccuccgccaccucgccuucaaggccaugcucuaccaggacaucgccugguucgacgagaaggagaacuccaccggcggccucaccaccauccucgccaucgacaucgcccagauccagggcgccaccggcucccgcaucggcguccucacccagaacgccaccaacaugggccucuccgucaucaucuccuucaucuacggcugggagaugaccuuccucauccucuccaucgcccccguccucgccgucaccggcaugaucgagaccgccgccaugaccggcuucgccaacaaggacaagcaggagcucaagcacgccggcaagaucgccaccgaggcccucgagaacauccgcaccaucgucucccucacccgcgagaaggccuucgagcagauguacgaggagaugcuccagacccagcaccgcaacaccuccaagaaggcccagaucaucggcuccugcuacgccuucucccacgccuucaucuacuucgccuacgccgccggcuuccgcuucggcgccuaccucauccaggccggccgcaugacccccgagggcauguucaucgucuucaccgccaucgccuacggcgccauggccaucggcgagacccucguccucgcccccgaguacuccaaggccaaguccggcgccgcccaccucuucgcccuccucgagaagaagcccaacaucgacucccgcucccaggagggcaagaagcccgacaccugcgagggcaaccucgaguuccgcgaggucuccuucuucuaccccugccgccccgacgucuucauccuccgcggccucucccucuccaucgagcgcggcaagaccgucgccuucgucggcuccuccggcugcggcaaguccaccuccguccagcuccuccagcgccucuacgaccccguccagggccagguccucuucgacggcgucgacgccaaggagcucaacguccaguggcuccgcucccagaucgccaucgucccccaggagcccguccucuucaacugcuccaucgccgagaacaucgccuacggcgacaacucccgcgucgucccccucgacgagaucaaggaggccgccaacgccgccaacauccacuccuucaucgagggccuccccgagaaguacaacacccaggucggccucaagggcgcccagcucuccggcggccagaagcagcgccucgccaucgcccgcgcccuccuccagaagcccaagauccuccuccucgacgaggccaccuccgcccucgacaacgacuccgagaaggucguccagcacgcccucgacaaggcccgcaccggccgcaccugccucgucgucacccaccgccucuccgccauccagaacgccgaccucaucgucguccuccacaacggcaagaucaaggagcagggcacccaccaggagcuccuccgcaaccgcgacaucuacuucaagcucgucaacgcccaguccguccaguga

SEQ ID NO: 39217 - RNA, 2529 nt, Artificial Sequence
  derived and/or modified sequence opt2 from ABCB6__Homo_sapiens__NP_005680
auggucaccgucggcaacuacugcgaggccgagggccccgucggccccgccuggaugcaggacggccucucccccugcuucuucuucacccucguccccuccacccgcauggcccucggcacccucgcccucguccucgcccuccccugccgccgccgcgagcgccccgccggcgccgacucccucuccuggggcgccggcccccgcaucucccccuacguccuccagcuccuccucgccacccuccaggccgcccucccccucgccggccucgccggccgcgucggcaccgcccgcggcgccccccuccccuccuaccuccuccucgccuccguccucgagucccucgccggcgccugcggccucuggcuccucgucgucgagcgcucccaggcccgccagcgccucgccaugggcaucuggaucaaguuccgccacucccccggccuccuccuccucuggaccgucgccuucgccgccgagaaccucgcccucgucuccuggaacuccccccagugguggugggcccgcgccgaccucggccagcagguccaguucucccucuggguccuccgcuacgucgucuccggcggccucuucguccucggccucugggcccccggccuccgcccccaguccuacacccuccagguccacgaggaggaccaggacgucgagcgcucccagguccgcuccgccgcccagcaguccaccuggcgcgacuucggccgcaagcuccgccuccucuccggcuaccucuggccccgcggcucccccgcccuccagcucgucguccucaucugccucggccucaugggccucgagcgcgcccucaacguccucguccccaucuucuaccgcaacaucgucaaccuccucaccgagaaggcccccuggaacucccucgccuggaccgucaccuccuacgucuuccucaaguuccuccagggcggcggcaccggcuccaccggcuucgucuccaaccuccgcaccuuccucuggauccgcguccagcaguucaccucccgccgcgucgagcuccucaucuucucccaccuccacgagcucucccuccgcuggcaccucggccgccgcaccggcgagguccuccgcaucgccgaccgcggcaccuccuccgucaccggccuccucuccuaccucgucuucaacgucauccccacccucgccgacaucaucaucggcaucaucuacuucuccauguucuucaacgccugguucggccucaucgucuuccucugcaugucccucuaccucacccucaccaucgucgucaccgaguggcgcaccaaguuccgccgcgccaugaacacccaggagaacgccacccgcgcccgcgccgucgacucccuccucaacuucgagaccgucaaguacuacaacgccgaguccuacgaggucgagcgcuaccgcgaggccaucaucaaguaccagggccucgaguggaaguccuccgccucccucguccuccucaaccagacccagaaccucgucaucggccucggccuccucgccggcucccuccucugcgccuacuucgucaccgagcagaagcuccaggucggcgacuacguccucuucggcaccuacaucauccagcucuacaugccccucaacugguucggcaccuacuaccgcaugauccagaccaacuucaucgacauggagaacauguucgaccuccucaaggaggagaccgaggucaaggaccuccccggcgccggcccccuccgcuuccagaagggccgcaucgaguucgagaacguccacuucuccuacgccgacggccgcgagacccuccaggacgucuccuucaccgucaugcccggccagacccucgcccucgucggccccuccggcgccggcaaguccaccauccuccgccuccucuuccgcuucuacgacaucuccuccggcugcauccgcaucgacggccaggacaucucccaggucacccaggccucccuccgcucccacaucggcgucgucccccaggacaccguccucuucaacgacaccaucgccgacaacauccgcuacggccgcgucaccgccggcaacgacgaggucgaggccgccgcccaggccgccggcauccacgacgccaucauggccuuccccgagggcuaccgcacccaggucggcgagcgcggccucaagcucuccggcggcgagaagcagcgcgucgccaucgcccgcaccauccucaaggcccccggcaucauccuccucgacgaggccaccuccgcccucgacaccuccaacgagcgcgccauccaggccucccucgccaaggucugcgccaaccgcaccaccaucgucgucgcccaccgccucuccaccgucgucaacgccgaccagauccucgucaucaaggacggcugcaucgucgagcgcggccgccacgaggcccuccucucccgcggcggcgucuacgccgacauguggcagcuccagcagggccaggaggagaccuccgaggacaccaagccccagaccauggagcgcuga

SEQ ID NO: 39218 - RNA, 2259 nt, Artificial Sequence
  derived and/or modified sequence opt2 from ABCB7__Homo_sapiens__NP_001258625
auggcccuccucgccaugcacuccuggcgcugggccgccgccgccgccgccuucgagaagcgccgccacuccgccauccucauccgcccccucgucuccgucuccggcuccggcccccaguggcgcccccaccagcucggcgcccucggcaccgcccgcgccuaccagauccccgagucccucaaguccaucaccuggcagcgccucggcaagggcaacuccggccaguuccucgacgccgccaaggcccuccaggucuggccccucaucgagaagcgcaccugcuggcacggccacgccggcggcggccuccacaccgaccccaaggagggccucaaggacgucgacacccgcaagaucaucaaggccaugcucuccuacgucuggcccaaggaccgccccgaccuccgcgcccgcgucgccaucucccucggcuuccucggcggcgccaaggccaugaacaucgucguccccuucauguucaaguacgccgucgacucccucaaccagauguccggcaacaugcucaaccucuccgacgcccccaacaccgucgccaccauggccaccgccguccucaucggcuacggcgucucccgcgccggcgccgccuucuucaacgagguccgcaacgccgucuucggcaaggucgcccagaacuccauccgccgcaucgccaagaacgucuuccuccaccuccacaaccucgaccucggcuuccaccucucccgccagaccggcgcccucuccaaggccaucgaccgcggcacccgcggcaucuccuucguccucuccgcccucgucuucaaccuccuccccaucauguucgaggucaugcucgucuccggcguccucuacuacaagugcggcgcccaguucgcccucgucacccucggcacccucggcaccuacaccgccuucaccgucgccgucacccgcuggcgcacccgcuuccgcaucgagaugaacaaggccgacaacgacgccggcaacgccgccaucgacucccuccucaacuacgagaccgucaaguacuucaacaacgagcgcuacgaggcccagcgcuacgacggcuuccucaagaccuacgagaccgccucccucaaguccaccuccacccucgccaugcucaacuucggccaguccgccaucuucuccgucggccucaccgccaucaugguccucgccucccagggcaucgucgccggcacccucaccgucggcgaccucgucauggucaacggccuccucuuccagcucucccucccccucaacuuccucggcaccgucuaccgcgagacccgccaggcccucaucgacaugaacacccucuucacccuccucaaggucgacacccagaucaaggacaaggucauggccuccccccuccagaucaccccccagaccgccaccgucgccuucgacaacguccacuucgaguacaucgagggccagaagguccucuccggcaucuccuucgagguccccgccggcaagaaggucgccaucgucggcggcuccggcuccggcaaguccaccaucguccgccuccucuuccgcuucuacgagccccagaagggcuccaucuaccucgccggccagaacauccaggacgucucccucgagucccuccgccgcgccgucggcgucgucccccaggacgccguccucuuccacaacaccaucuacuacaaccuccucuacggcaacaucuccgccucccccgaggaggucuacgccgucgccaagcucgccggccuccacgacgccauccuccgcaugccccacggcuacgacacccaggucggcgagcgcggccucaagcucuccggcggcgagaagcagcgcgucgccaucgcccgcgccauccucaaggacccccccgucauccucuacgacgaggccaccuccucccucgacuccaucaccgaggagaccauccucggcgccaugaaggacgucgucaagcaccgcaccuccaucuucaucgcccaccgccucuccaccgucgucgacgccgacgagaucaucguccucgaccagggcaaggucgccgagcgcggcacccaccacggccuccucgccaacccccacuccaucuacuccgagauguggcacacccaguccucccgcguccagaaccacgacaaccccaagugggaggccaagaaggagaacaucuccaaggaggaggagcgcaagaagcuccaggaggagaucgucaacuccgucaagggcugcggcaacugcuccugcuga

SEQ ID NO: 39219 - RNA, 2208 nt, Artificial Sequence
  derived and/or modified sequence opt2 from ABCB8__Homo_sapiens__NP_001269220
augcucguccaccucuuccgcgucggcauccgcggcggccccuuccccggccgccuccuccccccccuccgcuuccagaccuucuccgccguccgcaacaccuggcgcaacggcaagaccggccagcuccacaaggccgagggcgaguacuccgacggcuaccgcuccuccucccuccuccgcgccgucgcccaccuccgcucccagcucugggcccaccucccccgcgccccccucgccccccgcuggucccccuccgccuggugcugggucggcggcgcccuccucggccccaugguccucuccaagcacccccaccucugccucgucgcccucugcgaggccgaggaggccccccccgccuccuccaccccccacgucgucggcucccgcuucaacuggaagcucuucuggcaguuccuccacccccaccuccucguccucggcgucgccgucguccucgcccucggcgccgcccucgucaacguccagaucccccuccuccucggccagcucgucgaggucgucgccaaguacacccgcgaccacgucggcuccuucaugaccgagucccagaaccucuccacccaccuccucauccucuacggcguccagggccuccucaccuucggcuaccucguccuccucucccacgucggcgagcgcauggccgucgacaugcgccgcgcccucuucuccucccuccuccgccaggacaucaccuucuucgacgccaacaagaccggccagcucgucucccgccucaccaccgacguccaggaguucaaguccuccuucaagcucgucaucucccagggccuccgcuccugcacccaggucgccggcugccucgucucccucuccaugcucuccacccgccucacccuccuccucauggucgccacccccgcccucaugggcgucggcacccucaugggcuccggccuccgcaagcucucccgccagugccaggagcagaucgcccgcgccaugggcgucgccgacgaggcccucggcaacguccgcaccguccgcgccuucgccauggagcagcgcgaggaggagcgcuacggcgccgagcucgaggccugccgcugccgcgccgaggagcucggccgcggcaucgcccucuuccagggccucuccaacaucgccuucaacugcaugguccucggcacccucuucaucggcggcucccucgucgccggccagcagcucaccggcggcgaccucauguccuuccucgucgccucccagaccguccagcgcuccauggccaaccucuccguccucuucggccaggucguccgcggccucuccgccggcgcccgcgucuucgaguacauggcccucaaccccugcaucccccucuccggcggcugcugcguccccaaggagcagcuccgcggcuccgucaccuuccagaacgucugcuucuccuaccccugccgccccggcuucgagguccucaaggacuucacccucacccucccccccggcaagaucgucgcccucgucggccaguccggcggcggcaagaccaccgucgccucccuccucgagcgcuucuacgaccccaccgccggcgucgucaugcucgacggccgcgaccuccgcacccucgaccccuccuggcuccgcggccaggucgucggcuucaucucccaggagcccguccucuucggcaccaccaucauggagaacauccgcuucggcaagcucgaggccuccgacgaggaggucuacaccgccgcccgcgaggccaacgcccacgaguucaucaccuccuuccccgagggcuacaacaccgucgucggcgagcgcggcaccacccucuccggcggccagaagcagcgccucgccaucgcccgcgcccucaucaagcagcccaccguccucauccucgacgaggccaccuccgcccucgacgccgaguccgagcgcgucguccaggaggcccucgaccgcgccuccgccggccgcaccguccucgucaucgcccaccgccucuccaccguccgcggcgcccacugcaucgucgucauggccgacggccgcgucugggaggccggcacccacgaggagcuccucaagaagggcggccucuacgccgagcucauccgccgccaggcccucgacgccccccgcaccgccgcccccccccccaagaagcccgagggcccccgcucccaccagcacaaguccuga

SEQ ID NO: 39220 - RNA, 2112 nt, Artificial Sequence
  derived and/or modified sequence opt2 from ABCB9__Homo_sapiens__NP_001229942
augcgccucuggaaggccgucgucgucacccucgccuucauguccgucgacaucugcgucaccaccgccaucuacgucuucucccaccucgaccgcucccuccucgaggacauccgccacuucaacaucuucgacuccguccucgaccucugggccgccugccucuaccgcuccugccuccuccucggcgccaccaucggcgucgccaagaacuccgcccucggcccccgccgccuccgcgccuccuggcucgucaucacccucgucugccucuucgucggcaucuacgccauggucaagcuccuccucuucuccgagguccgccgccccauccgcgaccccugguucugggcccucuucgucuggaccuacaucucccucggcgccuccuuccuccucugguggcuccucuccaccguccgccccggcacccaggcccucgagcccggcgccgccaccgaggccgagggcuuccccggcuccggccgccccccccccgagcaggccuccggcgccacccuccagaagcuccucuccuacaccaagcccgacgucgccuuccucgucgccgccuccuucuuccucaucgucgccgcccucggcgagaccuuccuccccuacuacaccggccgcgccaucgacggcaucgucauccagaaguccauggaccaguucuccaccgccgucgucaucgucugccuccucgccaucggcuccuccuucgccgccggcauccgcggcggcaucuucacccucaucuucgcccgccucaacauccgccuccgcaacugccucuuccgcucccucgucucccaggagaccuccuucuucgacgagaaccgcaccggcgaccucaucucccgccucaccuccgacaccaccauggucuccgaccucgucucccagaacaucaacgucuuccuccgcaacaccgucaaggucaccggcgucgucgucuucauguucucccucuccuggcagcucucccucgucaccuucaugggcuuccccaucaucaugauggucuccaacaucuacggcaaguacuacaagcgccucuccaaggagguccagaacgcccucgcccgcgccuccaacaccgccgaggagaccaucuccgccaugaagaccguccgcuccuucgccaacgaggaggaggaggccgaggucuaccuccgcaagcuccagcaggucuacaagcucaaccgcaaggaggccgccgccuacauguacuacgucuggggcuccggccucacccuccucgucguccaggucuccauccucuacuacggcggccaccucgucaucuccggccagaugaccuccggcaaccucaucgccuucaucaucuacgaguucguccucggcgacugcauggagaacgucuccuucucccucucccccggcaaggucaccgcccucgucggccccuccggcuccggcaaguccuccugcgucaacauccucgagaacuucuacccccucgagggcggccgcguccuccucgacggcaagcccaucuccgccuacgaccacaaguaccuccaccgcgucaucucccucgucucccaggagcccguccucuucgcccgcuccaucaccgacaacaucuccuacggccuccccaccguccccuucgagauggucgucgaggccgcccagaaggccaacgcccacggcuucaucauggagcuccaggacggcuacuccaccgagaccggcgagaagggcgcccagcucuccggcggccagaagcagcgcgucgccauggcccgcgcccucguccgcaacccccccguccucauccucgacgaggccaccuccgcccucgacgccgaguccgaguaccucauccagcaggccauccacggcaaccuccagaagcacaccguccucaucaucgcccaccgccucuccaccgucgagcacgcccaccucaucgucguccucgacaagggccgcgucguccagcagggcacccaccagcagcuccucgcccagggcggccucuacgccaagcucguccagcgccagaugcucggccuccagcccgccgccgacuucaccgccggccacaacgagcccgucgccaacggcucccacaaggccuga

SEQ ID NO: 39221 - RNA, 4479 nt, Artificial Sequence
  derived and/or modified sequence opt2 from ABCC10__Homo_sapiens__NP_001185863
auggagcgccuccucgcccagcucugcggcuccuccgccgccuggccccucccccucugggagggcgacaccaccggccacugcuucacccagcucguccucuccgcccucccccacgcccuccucgccguccucuccgccugcuaccucggcaccccccgcucccccgacuacauccuccccugcucccccggcuggcgccuccgccucgccgccuccuuccuccucuccgucuucccccuccucgaccuccuccccgucgcccucccccccggcgccggccccggccccaucggccucgagguccucgccggcugcgucgccgccgucgccuggaucucccacucccucgcccucuggguccucgcccacuccccccacggccacucccgcggcccccucgcccucgcccucgucgcccuccuccccgcccccgcccucguccucaccguccucuggcacugccagcgcggcacccuccuccccccccuccuccccggccccauggcccgccucugccuccucauccuccagcucgccgcccuccucgccuacgcccucggcugggccgcccccggcggcccccgcgagcccugggcccaggagccccuccuccccgaggaccaggagcccgaggucgccgaggacggcgaguccuggcucucccgcuucuccuacgccuggcucgccccccuccucgcccgcggcgccugcggcgagcuccgccagccccaggacaucugccgccucccccaccgccuccagcccaccuaccucgcccgcgucuuccaggcccacuggcaggagggcgcccgccucuggcgcgcccucuacggcgccuucggccgcugcuaccucgcccucggccuccucaagcucgucggcaccaugcucggcuucuccggcccccuccuccucucccuccucgucggcuuccucgaggagggccaggagccccucucccacggccuccucuacgcccucggccucgccggcggcgccguccucggcgccguccuccagaaccaguacggcuacgaggucuacaaggucacccuccaggcccgcggcgccguccucaacauccucuacugcaaggcccuccagcucggccccucccgcccccccaccggcgaggcccucaaccuccucggcaccgacuccgagcgccuccucaacuucgccggcuccuuccacgaggccuggggccucccccuccagcucgccaucacccucuaccuccucuaccagcaggucggcgucgccuucgucggcggccucauccucgcccuccuccucguccccgucaacaaggucaucgccacccgcaucauggccuccaaccaggagaugcuccagcacaaggacgcccgcgucaagcucgucaccgagcuccucuccggcauccgcgucaucaaguucugcggcugggagcaggcccucggcgcccgcgucgaggccugccgcgcccgcgagcucggccgccuccgcgucaucaaguaccucgacgccgccugcgucuaccucugggccgcccuccccgucgucaucuccaucgucaucuucaucaccuacguccucaugggccaccagcucaccgccaccaaggucuucaccgcccucgcccucguccgcaugcucauccucccccucaacaacuuccccugggucaucaacggccuccucgaggccaaggucucccucgaccgcauccagcucuuccucgaccuccccaaccacaacccccaggccuacuacucccccgacccccccgccgagcccuccaccguccucgagcuccacggcgcccucuucuccugggaccccgucggcaccucccucgagaccuucaucucccaccucgaggucaagaagggcaugcucgucggcaucgucggcaaggucggcugcggcaaguccucccuccucgccgccaucgccggcgagcuccaccgccuccgcggccacgucgccguccgcggccucuccaagggcuucggccucgccacccaggagcccuggauccaguucgccaccauccgcgacaacauccucuucggcaagaccuucgacgcccagcucuacaaggagguccucgaggccugcgcccucaacgacgaccucuccauccuccccgccggcgaccagaccgaggucggcgagaagggcgucacccucuccggcggccagcgcgcccgcaucgcccucgcccgcgccgucuaccaggagaaggagcucuaccuccucgacgacccccucgccgccgucgacgccgacgucgccaaccaccuccuccaccgcugcauccucggcaugcucuccuacaccacccgccuccucugcacccaccgcaccgaguaccucgagcgcgccgacgccguccuccucauggaggccggccgccucauccgcgccggcccccccuccgagauccucccccucguccaggccguccccaaggccugggccgagaacggccaggaguccgacuccgccaccgcccaguccguccagaaccccgagaagaccaaggagggccucgaggaggagcaguccaccuccggccgccuccuccaggaggaguccaagaaggagggcgccgucgcccuccacgucuaccaggccuacuggaaggccgucggccagggccucgcccucgccauccucuucucccuccuccucaugcaggccacccgcaacgccgccgacugguggcucucccacuggaucucccagcucaaggccgagaacuccucccaggaggcccagcccuccaccucccccgccuccaugggccucuucuccccccagcuccuccucuucucccccggcaaccucuacauccccgucuucccccuccccaaggccgcccccaacggcuccuccgacauccgcuucuaccucaccgucuacgccaccaucgccggcgucaacucccucugcacccuccuccgcgccguccucuucgccgccggcacccuccaggccgccgccacccuccaccgccgccuccuccaccgcguccucauggcccccgucaccuucuucaacgccacccccaccggccgcauccucaaccgcuucuccuccgacgucgccugcgccgacgacucccuccccuucauccucaacauccuccucgccaacgccgccggccuccucggccuccucgccguccucggcuccggccuccccuggcuccuccuccuccuccccccccucuccaucauguacuaccacguccagcgccacuaccgcgccuccucccgcgagcuccgccgccucggcucccucacccucuccccccucuacucccaccucgccgacacccucgccggccucuccguccuccgcgccaccggcgccaccuaccgcuucgaggaggagaaccuccgccuccucgagcucaaccagcgcugccaguucgccaccuccgccaccaugcaguggcucgacauccgccuccagcucaugggcgccgccgucgucuccgccaucgccggcaucgcccucguccagcaccagcagggccucgccaaccccggccucgucggccucucccucuccuacgcccucucccucaccggccuccucuccggccucgucuccuccuucacccagaccgaggccaugcucgucuccgucgagcgccucgaggaguacaccugcgaccucccccaggagccccagggccagccccuccagcucggcaccggcuggcucacccagggcggcgucgaguuccaggacgucguccucgccuaccgccccggccuccccaacgcccucgacggcgucaccuucugcguccagcccggcgagaagcucggcaucgucggccgcaccggcuccggcaaguccucccuccuccucguccucuuccgccuccucgagcccuccuccggccgcguccuccucgacggcgucgacaccucccagcucgagcucgcccagcuccgcucccagcucgccaucaucccccaggagcccuuccucuucuccggcaccguccgcgagaaccucgacccccagggccuccacaaggaccgcgcccucuggcaggcccucaagcagugccaccucuccgaggucaucaccuccaugggcggccucgacggcgagcucggcgagggcggccgcucccucucccucggccagcgccagcuccucugccucgcccgcgcccuccucaccgacgccaagauccucugcaucgacgaggccaccgccuccgucgaccagaagaccgaccagcuccuccagcagaccaucugcaagcgcuucgccaacaagaccguccucaccaucgcccaccgccucaacaccauccucaacuccgaccgcguccucguccuccaggccggccgcgucgucgagcucgacucccccgccacccuccgcaaccagccccacucccucuuccagcagcuccuccaguccucccagcagggcguccccgccucccucggcggccccuga

SEQ ID NO: 39222 - RNA, 4149 nt, Artificial Sequence
  derived and/or modified sequence opt2 from ABCC11__Homo_sapiens__NP_115972
augacccgcaagcgcaccuacuggguccccaacuccuccggcggccucgucaaccgcggcaucgacaucggcgacgacauggucuccggccucaucuacaagaccuacacccuccaggacggccccuggucccagcaggagcgcaaccccgaggcccccggccgcgccgccgucccccccuggggcaaguacgacgccgcccuccgcaccaugauccccuuccgccccaagccccgcuuccccgccccccagccccucgacaacgccggccucuucuccuaccucaccgucuccuggcucaccccccucaugauccagucccuccgcucccgccucgacgagaacaccauccccccccucuccguccacgacgccuccgacaagaacguccagcgccuccaccgccucugggaggaggaggucucccgccgcggcaucgagaaggccuccguccuccucgucaugcuccgcuuccagcgcacccgccucaucuucgacgcccuccucggcaucugcuucugcaucgccuccguccucggccccauccucaucauccccaagauccucgaguacuccgaggagcagcucggcaacgucguccacggcgucggccucugcuucgcccucuuccucuccgagugcgucaagucccucuccuucuccuccuccuggaucaucaaccagcgcaccgccauccgcuuccgcgccgccgucuccuccuucgccuucgagaagcucauccaguucaaguccgucauccacaucaccuccggcgaggccaucuccuucuucaccggcgacgucaacuaccucuucgagggcgucugcuacggcccccucguccucaucaccugcgccucccucgucaucugcuccaucuccuccuacuucaucaucggcuacaccgccuucaucgccauccucugcuaccuccucgucuucccccucgccgucuucaugacccgcauggccgucaaggcccagcaccacaccuccgaggucuccgaccagcgcauccgcgucaccuccgagguccucaccugcaucaagcucaucaagauguacaccugggagaagcccuucgccaagaucaucgaggaccuccgccgcaaggagcgcaagcuccucgagaagugcggccucguccagucccucaccuccaucacccucuucaucauccccaccgucgccaccgccgucuggguccucauccacaccucccucaagcucaagcucaccgccuccauggccuucuccaugcucgccucccucaaccuccuccgccucuccgucuucuucguccccaucgccgucaagggccucaccaacuccaaguccgccgucaugcgcuucaagaaguucuuccuccaggagucccccgucuucuacguccagacccuccaggaccccuccaaggcccucgucuucgaggaggccacccucuccuggcagcagaccugccccggcaucgucaacggcgcccucgagcucgagcgcaacggccacgccuccgagggcaugacccgcccccgcgacgcccucggccccgaggaggagggcaacucccucggccccgagcuccacaagaucaaccucgucgucuccaagggcaugaugcucggcgucugcggcaacaccggcuccggcaaguccucccuccucuccgccauccucgaggagaugcaccuccucgagggcuccgucggcguccagggcucccucgccuacgucccccagcaggccuggaucgucuccggcaacauccgcgagaacauccucaugggcggcgccuacgacaaggcccgcuaccuccagguccuccacugcugcucccucaaccgcgaccucgagcuccuccccuucggcgacaugaccgagaucggcgagcgcggccucaaccucuccggcggccagaagcagcgcaucucccucgcccgcgccgucuacuccgaccgccagaucuaccuccucgacgacccccucuccgccgucgacgcccacgucggcaagcacaucuucgaggagugcaucaagaagacccuccgcggcaagaccgucguccucgucacccaccagcuccaguaccucgaguucugcggccagaucauccuccucgagaacggcaagaucugcgagaacggcacccacuccgagcucaugcagaagaagggcaaguacgcccagcucauccagaagaugcacaaggaggccaccuccgacaugcuccaggacaccgccaagaucgccgagaagcccaaggucgagucccaggcccucgccaccucccucgaggagucccucaacggcaacgccguccccgagcaccagcucacccaggaggaggagauggaggagggcucccucuccuggcgcgucuaccaccacuacauccaggccgccggcggcuacauggucuccugcaucaucuucuucuucgucguccucaucgucuuccucaccaucuucuccuucugguggcucuccuacuggcucgagcagggcuccggcaccaacuccucccgcgaguccaacggcaccauggccgaccucggcaacaucgccgacaacccccagcucuccuucuaccagcucgucuacggccucaacgcccuccuccucaucugcgucggcgucugcuccuccggcaucuucaccaaggucacccgcaaggccuccaccgcccuccacaacaagcucuucaacaaggucuuccgcugccccauguccuucuucgacaccauccccaucggccgccuccucaacugcuucgccggcgaccucgagcagcucgaccagcuccuccccaucuucuccgagcaguuccucguccucucccucauggucaucgccguccuccucaucgucuccguccucucccccuacauccuccucaugggcgccaucaucauggucaucugcuucaucuacuacaugauguucaagaaggccaucggcgucuucaagcgccucgagaacuacucccgcuccccccucuucucccacauccucaacucccuccagggccucuccuccauccacgucuacggcaagaccgaggacuucaucucccaguucaagcgccucaccgacgcccagaacaacuaccuccuccucuuccucuccuccacccgcuggauggcccuccgccucgagaucaugaccaaccucgucacccucgccgucgcccucuucgucgccuucggcaucuccuccacccccuacuccuucaaggucauggccgucaacaucguccuccagcucgccuccuccuuccaggccaccgcccgcaucggccucgagaccgaggcccaguucaccgccgucgagcgcauccuccaguacaugaagaugugcgucuccgaggccccccuccacauggagggcaccuccugcccccagggcuggccccagcacggcgagaucaucuuccaggacuaccacaugaaguaccgcgacaacacccccaccguccuccacggcaucaaccucaccauccgcggccacgaggucgucggcaucgucggccgcaccggcuccggcaaguccucccucggcauggcccucuuccgccucgucgagcccauggccggccgcauccucaucgacggcgucgacaucugcuccaucggccucgaggaccuccgcuccaagcucuccgucaucccccaggaccccguccuccucuccggcaccauccgcuucaaccucgaccccuucgaccgccacaccgaccagcagaucugggacgcccucgagcgcaccuuccucaccaaggccaucuccaaguuccccaagaagcuccacaccgacgucgucgagaacggcggcaacuucuccgucggcgagcgccagcuccucugcaucgcccgcgccguccuccgcaacuccaagaucauccucaucgacgaggccaccgccuccaucgacauggagaccgacacccucauccagcgcaccauccgcgaggccuuccagggcugcaccguccucgucaucgcccaccgcgucaccaccguccucaacugcgaccacauccucgucaugggcaacggcaaggucgucgaguucgaccgccccgagguccuccgcaagaagcccggcucccucuucgccgcccucauggccaccgccaccuccucccuccgcuga

SEQ ID NO: 39223 - RNA, 4080 nt, Artificial Sequence
  derived and/or modified sequence opt2 from ABCC12__Homo_sapiens__NP_150229
auggucggcgagggccccuaccucaucuccgaccucgaccagcgcggccgccgccgcuccuucgccgagcgcuacgaccccucccucaagaccaugauccccguccgccccugcgcccgccucgcccccaaccccgucgacgacgccggccuccucuccuucgccaccuucuccuggcucacccccgucauggucaagggcuaccgccagcgccucaccgucgacacccuccccccccucuccaccuacgacuccuccgacaccaacgccaagcgcuuccgcguccucugggacgaggaggucgcccgcgucggccccgagaaggccucccucucccacgucgucuggaaguuccagcgcacccgcguccucauggacaucgucgccaacauccucugcaucaucauggccgccaucggccccgucauccucauccaccagauccuccagcagaccgagcgcaccuccggcaaggucugggucggcaucggccucugcaucgcccucuucgccaccgaguucaccaaggucuucuucugggcccucgccugggccaucaacuaccgcaccgccauccgccucaaggucgcccucuccacccucgucuucgagaaccucgucuccuucaagacccucacccacaucuccgucggcgagguccucaacauccucuccuccgacuccuacucccucuucgaggccgcccucuucugcccccuccccgccaccauccccauccucauggucuucugcgccgccuacgccuucuucauccucggccccaccgcccucaucggcaucuccgucuacgucaucuucauccccguccagauguucauggccaagcucaacuccgccuuccgccgcuccgccauccucgucaccgacaagcgcguccagaccaugaacgaguuccucaccugcauccgccucaucaagauguacgccugggagaaguccuucaccaacaccauccaggacauccgccgccgcgagcgcaagcuccucgagaaggccggcuucguccaguccggcaacuccgcccucgcccccaucgucuccaccaucgccaucguccucacccucuccugccacauccuccuccgccgcaagcucaccgcccccgucgccuucuccgucaucgccauguucaacgucaugaaguucuccaucgccauccuccccuucuccaucaaggccauggccgaggccaacgucucccuccgccgcaugaagaagauccucaucgacaaguccccccccuccuacaucacccagcccgaggaccccgacaccguccuccuccucgccaacgccacccucaccugggagcacgaggccucccgcaaguccacccccaagaagcuccagaaccagaagcgccaccucugcaagaagcagcgcuccgaggccuacuccgagcgcuccccccccgccaagggcgccaccggccccgaggagcaguccgacucccucaaguccguccuccacuccaucuccuucgucguccgcaagggcaagauccucggcaucugcggcaacgucggcuccggcaaguccucccuccucgccgcccuccucggccagaugcagcuccagaagggcgucgucgccgucaacggcacccucgccuacgucucccagcaggccuggaucuuccacggcaacguccgcgagaacauccucuucggcgagaaguacgaccaccagcgcuaccagcacaccguccgcgucugcggccuccagaaggaccucuccaaccuccccuacggcgaccucaccgagaucggcgagcgcggccucaaccucuccggcggccagcgccagcgcaucucccucgcccgcgccgucuacuccgaccgccagcucuaccuccucgacgacccccucuccgccgucgacgcccacgucggcaagcacgucuucgaggagugcaucaagaagacccuccgcggcaagaccgucguccucgucacccaccagcuccaguuccucgaguccugcgacgaggucauccuccucgaggacggcgagaucugcgagaagggcacccacaaggagcucauggaggagcgcggccgcuacgccaagcucauccacaaccuccgcggccuccaguucaaggaccccgagcaccucuacaacgccgccauggucgaggccuucaaggagucccccgccgagcgcgaggaggacgccggcaucaucguccucgcccccggcaacgagaaggacgagggcaaggaguccgagaccggcuccgaguucgucgacaccaagguccccgagcaccagcucauccagaccgaguccccccaggagggcaccgucaccuggaagaccuaccacaccuacaucaaggccuccggcggcuaccuccucucccucuucaccgucuuccucuuccuccucaugaucggcuccgccgccuucuccaacugguggcucggccucuggcucgacaagggcucccgcaugaccugcggcccccagggcaaccgcaccaugugcgaggucggcgccguccucgccgacaucggccagcacgucuaccagugggucuacaccgccuccauggucuucaugcucgucuucggcgucaccaagggcuucgucuucaccaagaccacccucauggccuccuccucccuccacgacaccgucuucgacaagauccucaagucccccauguccuucuucgacaccacccccaccggccgccucaugaaccgcuucuccaaggacauggacgagcucgacguccgccuccccuuccacgccgagaacuuccuccagcaguucuucauggucgucuucauccucgucauccucgccgccgucuuccccgccguccuccucgucgucgccucccucgccgucggcuucuucauccuccuccgcaucuuccaccgcggcguccaggagcucaagaaggucgagaacgucucccgcucccccugguucacccacaucaccuccuccaugcagggccucggcaucauccacgccuacggcaagaaggaguccugcaucaccuaccaccuccucuacuucaacugcgcccuccgcugguucgcccuccgcauggacguccucaugaacauccucaccuucaccgucgcccuccucgucacccucuccuucuccuccaucuccaccuccuccaagggccucucccucuccuacaucauccagcucuccggccuccuccaggucugcguccgcaccggcaccgagacccaggccaaguucaccuccgucgagcuccuccgcgaguacaucuccaccugcguccccgagugcacccacccccucaaggucggcaccugccccaaggacuggcccucccgcggcgagaucaccuuccgcgacuaccagaugcgcuaccgcgacaacaccccccucguccucgacucccucaaccucaacauccaguccggccagaccgucggcaucgucggccgcaccggcuccggcaaguccucccucggcauggcccucuuccgccucgucgagcccgccuccggcaccaucuucaucgacgaggucgacaucugcauccucucccucgaggaccuccgcaccaagcucaccgucaucccccaggaccccguccucuucgucggcaccguccgcuacaaccucgaccccuucgagucccacaccgacgagaugcucuggcagguccucgagcgcaccuucaugcgcgacaccaucaugaagcuccccgagaagcuccaggccgaggucaccgagaacggcgagaacuucuccgucggcgagcgccagcuccucugcgucgcccgcgcccuccuccgcaacuccaagaucauccuccucgacgaggccaccgccuccauggacuccaagaccgacacccucguccagaacaccaucaaggacgccuucaagggcugcaccguccucaccaucgcccaccgccucaacaccguccucaacugcgaccacguccucgucauggagaacggcaaggucaucgaguucgacaagcccgagguccucgccgagaagcccgacuccgccuucgccaugcuccucgccgccgagguccgccucuga

SEQ ID NO: 39224 - RNA, 4596 nt, Artificial Sequence
  derived and/or modified sequence opt2 from ABCC1__Homo_sapiens__NP_004987
auggcccuccgcggcuucugcuccgccgacggcuccgacccccucugggacuggaacgucaccuggaacaccuccaaccccgacuucaccaagugcuuccagaacaccguccucgucuggguccccugcuucuaccucugggccugcuuccccuucuacuuccucuaccucucccgccacgaccgcggcuacauccagaugaccccccucaacaagaccaagaccgcccucggcuuccuccucuggaucgucugcugggccgaccucuucuacuccuucugggagcgcucccgcggcaucuuccucgcccccgucuuccucgucucccccacccuccucggcaucaccaugcuccucgccaccuuccucauccagcucgagcgccgcaagggcguccaguccuccggcaucaugcucaccuucuggcucgucgcccucgucugcgcccucgccauccuccgcuccaagaucaugaccgcccucaaggaggacgcccaggucgaccucuuccgcgacaucaccuucuacgucuacuucucccuccuccucauccagcucguccucuccugcuucuccgaccgcuccccccucuucuccgagaccauccacgaccccaaccccugccccgaguccuccgccuccuuccucucccgcaucaccuucugguggaucaccggccucaucguccgcggcuaccgccagccccucgagggcuccgaccucuggucccucaacaaggaggacaccuccgagcaggucguccccguccucgucaagaacuggaagaaggagugcgccaagacccgcaagcagcccgucaaggucgucuacuccuccaaggaccccgcccagcccaaggaguccuccaaggucgacgccaacgaggaggucgaggcccucaucgucaaguccccccagaaggaguggaaccccucccucuucaagguccucuacaagaccuucggccccuacuuccucauguccuucuucuucaaggccauccacgaccucaugauguucuccggcccccagauccucaagcuccucaucaaguucgucaacgacaccaaggcccccgacuggcagggcuacuucuacaccguccuccucuucgucaccgccugccuccagacccucguccuccaccaguacuuccacaucugcuucgucuccggcaugcgcaucaagaccgccgucaucggcgccgucuaccgcaaggcccucgucaucaccaacuccgcccgcaaguccuccaccgucggcgagaucgucaaccucauguccgucgacgcccagcgcuucauggaccucgccaccuacaucaacaugaucugguccgccccccuccaggucauccucgcccucuaccuccucuggcucaaccucggccccuccguccucgccggcgucgccgucaugguccucaugguccccgucaacgccgucauggccaugaagaccaagaccuaccaggucgcccacaugaaguccaaggacaaccgcaucaagcucaugaacgagauccucaacggcaucaagguccucaagcucuacgccugggagcucgccuucaaggacaagguccucgccauccgccaggaggagcucaagguccucaagaaguccgccuaccucuccgccgucggcaccuucaccugggucugcacccccuuccucgucgcccucugcaccuucgccgucuacgucaccaucgacgagaacaacauccucgacgcccagaccgccuucgucucccucgcccucuucaacauccuccgcuucccccucaacauccuccccauggucaucuccuccaucguccaggccuccgucucccucaagcgccuccgcaucuuccucucccacgaggagcucgagcccgacuccaucgagcgccgccccgucaaggacggcggcggcaccaacuccaucaccguccgcaacgccaccuucaccugggcccgcuccgacccccccacccucaacggcaucaccuucuccauccccgagggcgcccucgucgccgucgucggccaggucggcugcggcaaguccucccuccucuccgcccuccucgccgagauggacaaggucgagggccacgucgccaucaagggcuccgucgccuacgucccccagcaggccuggauccagaacgacucccuccgcgagaacauccucuucggcugccagcucgaggagcccuacuaccgcuccgucauccaggccugcgcccuccuccccgaccucgagauccuccccuccggcgaccgcaccgagaucggcgagaagggcgucaaccucuccggcggccagaagcagcgcgucucccucgcccgcgccgucuacuccaacgccgacaucuaccucuucgacgacccccucuccgccgucgacgcccacgucggcaagcacaucuucgagaacgucaucggccccaagggcaugcucaagaacaagacccgcauccucgucacccacuccauguccuaccucccccaggucgacgucaucaucgucauguccggcggcaagaucuccgagaugggcuccuaccaggagcuccucgcccgcgacggcgccuucgccgaguuccuccgcaccuacgccuccaccgagcaggagcaggacgccgaggagaacggcgucaccggcgucuccggccccggcaaggaggccaagcagauggagaacggcaugcucgucaccgacuccgccggcaagcagcuccagcgccagcucuccuccuccuccuccuacuccggcgacaucucccgccaccacaacuccaccgccgagcuccagaaggccgaggccaagaaggaggagaccuggaagcucauggaggccgacaaggcccagaccggccaggucaagcucuccgucuacugggacuacaugaaggccaucggccucuucaucuccuuccucuccaucuuccucuucaugugcaaccacgucuccgcccucgccuccaacuacuggcucucccucuggaccgacgaccccaucgucaacggcacccaggagcacaccaagguccgccucuccgucuacggcgcccucggcaucucccagggcaucgccgucuucggcuacuccauggccgucuccaucggcggcauccucgccucccgcugccuccacgucgaccuccuccacuccauccuccgcucccccauguccuucuucgagcgcacccccuccggcaaccucgucaaccgcuucuccaaggagcucgacaccgucgacuccaugauccccgaggucaucaagauguucaugggcucccucuucaacgucaucggcgccugcaucgucauccuccucgccacccccaucgccgccaucaucauccccccccucggccucaucuacuucuucguccagcgcuucuacgucgccuccucccgccagcucaagcgccucgaguccgucucccgcucccccgucuacucccacuucaacgagacccuccucggcgucuccgucauccgcgccuucgaggagcaggagcgcuucauccaccaguccgaccucaaggucgacgagaaccagaaggccuacuaccccuccaucgucgccaaccgcuggcucgccguccgccucgagugcgucggcaacugcaucguccucuucgccgcccucuucgccgucaucucccgccacucccucuccgccggccucgucggccucuccgucuccuacucccuccaggucaccaccuaccucaacuggcucguccgcauguccuccgagauggagaccaacaucgucgccgucgagcgccucaaggaguacuccgagaccgagaaggaggcccccuggcagauccaggagaccgccccccccuccuccuggccccaggucggccgcgucgaguuccgcaacuacugccuccgcuaccgcgaggaccucgacuucguccuccgccacaucaacgucaccaucaacggcggcgagaaggucggcaucgucggccgcaccggcgccggcaaguccucccucacccucggccucuuccgcaucaacgaguccgccgagggcgagaucaucaucgacggcaucaacaucgccaagaucggccuccacgaccuccgcuucaagaucaccaucaucccccaggaccccguccucuucuccggcucccuccgcaugaaccucgaccccuucucccaguacuccgacgaggaggucuggaccucccucgagcucgcccaccucaaggacuucgucuccgcccuccccgacaagcucgaccacgagugcgccgagggcggcgagaaccucuccgucggccagcgccagcucgucugccucgcccgcgcccuccuccgcaagaccaagauccucguccucgacgaggccaccgccgccgucgaccucgagaccgacgaccucauccaguccaccauccgcacccaguucgaggacugcaccguccucaccaucgcccaccgccucaacaccaucauggacuacacccgcgucaucguccucgacaagggcgagauccaggaguacggcgcccccuccgaccuccuccagcagcgcggccucuucuacuccauggccaaggacgccggccucgucuga

SEQ ID NO: 39225 - RNA, 4638 nt, Artificial Sequence
  derived and/or modified sequence opt2 from ABCC2__Homo_sapiens__NP_000383
augcucgagaaguucugcaacuccaccuucuggaacuccuccuuccucgacucccccgaggccgaccucccccucugcuucgagcagaccguccucgucuggaucccccucggcuuccucuggcuccucgcccccuggcagcuccuccacgucuacaagucccgcaccaagcgcuccuccaccaccaagcucuaccucgccaagcaggucuucgucggcuuccuccucauccucgccgccaucgagcucgcccucguccucaccgaggacuccggccaggccaccguccccgccguccgcuacaccaaccccucccucuaccucggcaccuggcuccucguccuccucauccaguacucccgccaguggugcguccagaagaacuccugguuccucucccucuucuggauccucuccauccucugcggcaccuuccaguuccagacccucauccgcacccuccuccagggcgacaacuccaaccucgccuacuccugccucuucuucaucuccuacggcuuccagauccucauccucaucuucuccgccuucuccgagaacaacgaguccuccaacaaccccuccuccaucgccuccuuccucuccuccaucaccuacuccugguacgacuccaucauccucaagggcuacaagcgcccccucacccucgaggacgucugggaggucgacgaggagaugaagaccaagacccucgucuccaaguucgagacccacaugaagcgcgagcuccagaaggcccgccgcgcccuccagcgccgccaggagaaguccucccagcagaacuccggcgcccgccuccccggccucaacaagaaccagucccagucccaggacgcccucguccucgaggacgucgagaagaagaagaagaaguccggcaccaagaaggacguccccaaguccuggcucaugaaggcccucuucaagaccuucuacaugguccuccucaaguccuuccuccucaagcucgucaacgacaucuucaccuucgucuccccccagcuccucaagcuccucaucuccuucgccuccgaccgcgacaccuaccucuggaucggcuaccucugcgccauccuccucuucaccgccgcccucauccaguccuucugccuccagugcuacuuccagcucugcuucaagcucggcgucaagguccgcaccgccaucauggccuccgucuacaagaaggcccucacccucuccaaccucgcccgcaaggaguacaccgucggcgagaccgucaaccucauguccgucgacgcccagaagcucauggacgucaccaacuucaugcacaugcucugguccuccguccuccagaucguccucuccaucuucuuccucuggcgcgagcucggccccuccguccucgccggcgucggcgucaugguccucgucauccccaucaacgccauccucuccaccaaguccaagaccauccaggucaagaacaugaagaacaaggacaagcgccucaagaucaugaacgagauccucuccggcaucaagauccucaaguacuucgccugggagcccuccuuccgcgaccagguccagaaccuccgcaagaaggagcucaagaaccuccucgccuucucccagcuccagugcgucgucaucuucgucuuccagcucacccccguccucgucuccgucgucaccuucuccgucuacguccucgucgacuccaacaacauccucgacgcccagaaggccuucaccuccaucacccucuucaacauccuccgcuucccccucuccaugcuccccaugaugaucuccuccaugcuccaggccuccgucuccaccgagcgccucgagaaguaccucggcggcgacgaccucgacaccuccgccauccgccacgacugcaacuucgacaaggccaugcaguucuccgaggccuccuucaccugggagcacgacuccgaggccaccguccgcgacgucaaccucgacaucauggccggccagcucgucgccgucaucggccccgucggcuccggcaaguccucccucaucuccgccaugcucggcgagauggagaacguccacggccacaucaccaucaagggcaccaccgccuacgucccccagcaguccuggauccagaacggcaccaucaaggacaacauccucuucggcaccgaguucaacgagaagcgcuaccagcagguccucgaggccugcgcccuccuccccgaccucgagaugcuccccggcggcgaccucgccgagaucggcgagaagggcaucaaccucuccggcggccagaagcagcgcaucucccucgcccgcgccaccuaccagaaccucgacaucuaccuccucgacgacccccucuccgccgucgacgcccacgucggcaagcacaucuucaacaagguccucggccccaacggccuccucaagggcaagacccgccuccucgucacccacuccaugcacuuccucccccaggucgacgagaucgucguccucggcaacggcaccaucgucgagaagggcuccuacuccgcccuccucgccaagaagggcgaguucgccaagaaccucaagaccuuccuccgccacaccggccccgaggaggaggccaccguccacgacggcuccgaggaggaggacgacgacuacggccucaucuccuccgucgaggagauccccgaggacgccgccuccaucaccaugcgccgcgagaacuccuuccgccgcacccucucccgcuccucccgcuccaacggccgccaccucaagucccuccgcaacucccucaagacccgcaacgucaacucccucaaggaggacgaggagcucgucaagggccagaagcucaucaagaaggaguucaucgagaccggcaaggucaaguucuccaucuaccucgaguaccuccaggccaucggccucuucuccaucuucuucaucauccucgccuucgucaugaacuccgucgccuucaucggcuccaaccucuggcucuccgccuggaccuccgacuccaagaucuucaacuccaccgacuaccccgccucccagcgcgacaugcgcgucggcgucuacggcgcccucggccucgcccagggcaucuucgucuucaucgcccacuucugguccgccuucggcuucguccacgccuccaacauccuccacaagcagcuccucaacaacauccuccgcgcccccaugcgcuucuucgacaccacccccaccggccgcaucgucaaccgcuucgccggcgacaucuccaccgucgacgacacccucccccagucccuccgcuccuggaucaccugcuuccucggcaucaucuccacccucgucaugaucugcauggccacccccgucuucaccaucaucgucaucccccucggcaucaucuacgucuccguccagauguucuacgucuccaccucccgccagcuccgccgccucgacuccgucacccgcucccccaucuacucccacuucuccgagaccgucuccggccuccccgucauccgcgccuucgagcaccagcagcgcuuccucaagcacaacgagguccgcaucgacaccaaccagaagugcgucuucuccuggaucaccuccaaccgcuggcucgccauccgccucgagcucgucggcaaccucaccgucuucuucuccgcccucaugauggucaucuaccgcgacacccucuccggcgacaccgucggcuucguccucuccaacgcccucaacaucacccagacccucaacuggcucguccgcaugaccuccgagaucgagaccaacaucgucgccgucgagcgcaucaccgaguacaccaaggucgagaacgaggcccccugggucaccgacaagcgccccccccccgacuggcccuccaagggcaagauccaguucaacaacuaccagguccgcuaccgccccgagcucgaccucguccuccgcggcaucaccugcgacaucggcuccauggagaagaucggcgucgucggccgcaccggcgccggcaaguccucccucaccaacugccucuuccgcauccucgaggccgccggcggccagaucaucaucgacggcgucgacaucgccuccaucggccuccacgaccuccgcgagaagcucaccaucaucccccaggaccccauccucuucuccggcucccuccgcaugaaccucgaccccuucaacaacuacuccgacgaggagaucuggaaggcccucgagcucgcccaccucaaguccuucgucgccucccuccagcucggccucucccacgaggucaccgaggccggcggcaaccucuccaucggccagcgccagcuccucugccucggccgcgcccuccuccgcaaguccaagauccucguccucgacgaggccaccgccgccgucgaccucgagaccgacaaccucauccagaccaccauccagaacgaguucgcccacugcaccgucaucaccaucgcccaccgccuccacaccaucauggacuccgacaaggucaugguccucgacaacggcaagaucaucgagugcggcucccccgaggagcuccuccagauccccggccccuucuacuucauggccaaggaggccggcaucgagaacgucaacuccaccaaguucuga

SEQ ID NO: 39226 - RNA, 1719 nt, Artificial Sequence
  derived and/or modified sequence opt2 from ABCC3__Homo_sapiens__NP_001137542
auggacgcccucugcggcuccggcgagcucggcuccaaguucugggacuccaaccucuccguccacaccgagaaccccgaccucacccccugcuuccagaacucccuccucgccuggguccccugcaucuaccucugggucgcccuccccugcuaccuccucuaccuccgccaccacugccgcggcuacaucauccucucccaccucuccaagcucaagaugguccucggcguccuccucuggugcgucuccugggccgaccucuucuacuccuuccacggccucguccacggccgcgcccccgcccccgucuucuucgucaccccccucgucgucggcgucaccaugcuccucgccacccuccucauccaguacgagcgccuccagggcguccaguccuccggcguccucaucaucuucugguuccucugcgucgucugcgccaucguccccuuccgcuccaagauccuccucgccaaggccgagggcgagaucuccgaccccuuccgcuucaccaccuucuacauccacuucgcccucguccucuccgcccucauccucgccugcuuccgcgagaagccccccuucuucuccgccaagaacgucgaccccaaccccuaccccgagaccuccgccggcuuccucucccgccucuucuucuggugguucaccaagauggccaucuacggcuaccgccacccccucgaggagaaggaccucuggucccucaaggaggaggaccgcucccagauggucguccagcagcuccucgaggccuggcgcaagcaggagaagcagaccgcccgccacaaggccuccgccgcccccggcaagaacgccuccggcgaggacgagguccuccucggcgcccgcccccgcccccgcaagcccuccuuccucaaggcccuccucgccaccuucggcuccuccuuccucaucuccgccugcuucaagcucauccaggaccuccucuccuucaucaacccccagcuccucuccauccucauccgcuucaucuccaaccccauggcccccuccugguggggcuuccucgucgccggccucauguuccucugcuccaugaugcagucccucauccuccagcacuacuaccacuacaucuucgucaccggcgucaaguuccgcaccggcaucaugggcgucaucuaccgcaaggcccucgucaucaccaacuccgucaagcgcgccuccaccgucggcgagaucgucaaccucauguccgucgacgcccagcgcuucauggaccucgcccccuuccucaaccuccucugguccgccccccuccagaucauccucgccaucuacuuccucuggcagaaccucggccccuccguccucgccggcgucgccuucaugguccuccucaucccccucaacggcgccgucgccgucaagaugcgcgccuuccaggucaagcagaugaagcucaaggacucccgcaucaagcucauguccgagauccucaacggcaucaagguccucaagcucuacgccugggagcccuccuuccucaagcaggucgagggcauccgccagggcgagcuccagcuccuccgcaccgccgccuaccuccacaccaccaccaccuucaccuggaugugcucccccuuccucguccgccucggcaccggccucggccccugccuccagggcuccggcugccccggcauggcccgcgcccacuggacccuccccuga

SEQ ID NO: 39227 - RNA, 2580 nt, Artificial Sequence
  derived and/or modified sequence opt2 from ABCC4__Homo_sapiens__NP_001098985
augcuccccgucuaccaggaggucaagcccaacccccuccaggacgccaaccucugcucccgcgucuucuucugguggcucaacccccucuucaagaucggccacaagcgccgccucgaggaggacgacauguacuccguccuccccgaggaccgcucccagcaccucggcgaggagcuccagggcuucugggacaaggagguccuccgcgccgagaacgacgcccagaagcccucccucacccgcgccaucaucaagugcuacuggaaguccuaccucguccucggcaucuucacccucaucgaggaguccgccaaggucauccagcccaucuuccucggcaagaucaucaacuacuucgagaacuacgaccccauggacuccgucgcccucaacaccgccuacgccuacgccaccguccucaccuucugcacccucauccucgccauccuccaccaccucuacuucuaccacguccagugcgccggcaugcgccuccgcgucgccaugugccacaugaucuaccgcaaggcccuccgccucuccaacauggccaugggcaagaccaccaccggccagaucgucaaccuccucuccaacgacgucaacaaguucgaccaggucaccgucuuccuccacuuccucugggccggcccccuccaggccaucgccgucaccgcccuccucuggauggagaucggcaucuccugccucgccggcauggccguccucaucauccuccucccccuccaguccugcuucggcaagcucuucuccucccuccgcuccaagaccgccaccuucaccgacgcccgcauccgcaccaugaacgaggucaucaccggcauccgcaucaucaagauguacgccugggagaaguccuucuccaaccucaucaccaaccuccgcaagaaggagaucuccaagauccuccgcuccuccugccuccgcggcaugaaccucgccuccuucuucuccgccuccaagaucaucgucuucgucaccuucaccaccuacguccuccucggcuccgucaucaccgccucccgcgucuucgucgccgucacccucuacggcgccguccgccucaccgucacccucuucuuccccuccgccaucgagcgcgucuccgaggccaucgucuccauccgccgcauccagaccuuccuccuccucgacgagaucucccagcgcaaccgccagcuccccuccgacggcaagaagaugguccacguccaggacuucaccgccuucugggacaaggccuccgagacccccacccuccagggccucuccuucaccguccgccccggcgagcuccucgccgucgucggccccgucggcgccggcaaguccucccuccucuccgccguccucggcgagcucgcccccucccacggccucgucuccguccacggccgcaucgccuacgucucccagcagcccugggucuucuccggcacccuccgcuccaacauccucuucggcaagaaguacgagaaggagcgcuacgagaaggucaucaaggccugcgcccucaagaaggaccuccagcuccucgaggacggcgaccucaccgucaucggcgaccgcggcaccacccucuccggcggccagaaggcccgcgucaaccucgcccgcgccgucuaccaggacgccgacaucuaccuccucgacgacccccucuccgccgucgacgccgaggucucccgccaccucuucgagcucugcaucugccagauccuccacgagaagaucaccauccucgucacccaccagcuccaguaccucaaggccgccucccagauccucauccucaaggacggcaagaugguccagaagggcaccuacaccgaguuccucaaguccggcaucgacuucggcucccuccucaagaaggacaacgaggaguccgagcagccccccguccccggcacccccacccuccgcaaccgcaccuucuccgaguccuccgucuggucccagcaguccucccgccccucccucaaggacggcgcccucgagucccaggacaccgagaacguccccgucacccucuccgaggagaaccgcuccgagggcaaggucggcuuccaggccuacaagaacuacuuccgcgccggcgcccacuggaucgucuucaucuuccucauccuccucaacaccgccgcccaggucgccuacguccuccaggacugguggcucuccuacugggccaacaagcaguccaugcucaacgucaccgucaacggcggcggcaacgucaccgagaagcucgaccucaacugguaccucggcaucuacuccggccucaccgucgccaccguccucuucggcaucgcccgcucccuccucgucuucuacguccucgucaacuccucccagacccuccacaacaagauguucgaguccauccucaaggcccccguccucuucuucgaccgcaaccccaucggccgcauccucaaccgcuucuccaaggacaucggccaccucgacgaccuccucccccucaccuuccucgacuucauccagcgcugggaccucgccguccucuccuggcucgucuccaacuccuga

SEQ ID NO: 39228 - RNA, 627 nt, Artificial Sequence
  derived and/or modified sequence opt2 from ABCC5__Homo_sapiens__NP_001018881
augaaggacaucgacaucggcaaggaguacaucauccccucccccggcuaccgcuccguccgcgagcgcaccuccaccuccggcacccaccgcgaccgcgaggacuccaaguuccgccgcacccgcccccucgagugccaggacgcccucgagaccgccgcccgcgccgagggccucucccucgacgccuccaugcacucccagcuccgcauccucgacgaggagcaccccaagggcaaguaccaccacggccucuccgcccucaagcccauccgcaccaccuccaagcaccagcaccccgucgacaacgccggccucuucuccugcaugaccuucuccuggcucuccucccucgcccgcgucgcccacaagaagggcgagcucuccauggaggacgucuggucccucuccaagcacgaguccuccgacgucaacugccgccgccucgagcgccucuggcaggaggagcucaacgaggucggccccgacgccgccucccuccgccgcgucgucuggaucuucugccgcacccgccucauccucuccaucgucugccucaugaucacccagcucgccggcuucuccggccccaacuuccaggacggcugcauccuccgcuccgaguga

SEQ ID NO: 39229 - RNA, 300 nt, Artificial Sequence
  derived and/or modified sequence opt2 from ABCC6__Homo_sapiens__NP_001072996
auggccgcccccgccgagcccugcgccggccagggcgucuggaaccagaccgagcccgagcccgccgccaccucccuccucucccucugcuuccuccgcaccgccggcgucugggucccccccauguaccucuggguccucggccccaucuaccuccucuucauccaccaccacggccgcggcuaccuccgcauguccccccucuucaaggccaagauggucgccgccauccccggcucccucgagcccggcaacguccgcggccgccagggcaccggcuggaaccucgucaaguccuga

SEQ ID NO: 39230 - RNA, 4746 nt, Artificial Sequence
  derived and/or modified sequence opt2 from ABCC8__Homo_sapiens__NP_000343
augccccucgccuucugcggcuccgagaaccacuccgccgccuaccgcgucgaccagggcguccucaacaacggcugcuucgucgacgcccucaacgucgucccccacgucuuccuccucuucaucaccuuccccauccucuucaucggcuggggcucccaguccuccaagguccacauccaccacuccaccuggcuccacuuccccggccacaaccuccgcuggauccucaccuucaugcuccucuucguccucgucugcgagaucgccgagggcauccucuccgacggcgucaccgagucccaccaccuccaccucuacaugcccgccggcauggccuucauggccgccgucaccuccgucgucuacuaccacaacaucgagaccuccaacuuccccaagcuccucaucgcccuccucgucuacuggacccucgccuucaucaccaagaccaucaaguucgucaaguuccucgaccacgccaucggcuucucccagcuccgcuucugccucaccggccuccucgucauccucuacggcaugcuccuccucgucgaggucaacgucauccgcguccgccgcuacaucuucuucaagaccccccgcgaggucaagccccccgaggaccuccaggaccucggcguccgcuuccuccagcccuucgucaaccuccucuccaagggcaccuacugguggaugaacgccuucaucaagaccgcccacaagaagcccaucgaccuccgcgccaucggcaagcuccccaucgccaugcgcgcccucaccaacuaccagcgccucugcgaggccuucgacgcccagguccgcaaggacauccagggcacccagggcgcccgcgccaucuggcaggcccucucccacgccuucggccgccgccucguccucuccuccaccuuccgcauccucgccgaccuccucggcuucgccggcccccucugcaucuucggcaucgucgaccaccucggcaaggagaacgacgucuuccagcccaagacccaguuccucggcgucuacuucgucuccucccaggaguuccucgccaacgccuacguccucgccguccuccucuuccucgcccuccuccuccagcgcaccuuccuccaggccuccuacuacgucgccaucgagaccggcaucaaccuccgcggcgccauccagaccaagaucuacaacaagaucaugcaccucuccaccuccaaccucuccaugggcgagaugaccgccggccagaucugcaaccucgucgccaucgacaccaaccagcucaugugguucuucuuccucugccccaaccucugggccaugcccguccagaucaucgucggcgucauccuccucuacuacauccucggcgucuccgcccucaucggcgccgccgucaucauccuccucgcccccguccaguacuucgucgccaccaagcucucccaggcccagcgcuccacccucgaguacuccaacgagcgccucaagcagaccaacgagaugcuccgcggcaucaagcuccucaagcucuacgccugggagaacaucuuccgcacccgcgucgagaccacccgccgcaaggagaugaccucccuccgcgccuucgccaucuacaccuccaucuccaucuucaugaacaccgccauccccaucgccgccguccucaucaccuucgucggccacgucuccuucuucaaggaggccgacuucucccccuccgucgccuucgccucccucucccucuuccacauccucgucaccccccucuuccuccucuccuccgucguccgcuccaccgucaaggcccucgucuccguccagaagcucuccgaguuccucuccuccgccgagauccgcgaggagcagugcgccccccacgagcccaccccccagggccccgccuccaaguaccaggccgucccccuccgcgucgucaaccgcaagcgccccgcccgcgaggacugccgcggccucaccggcccccuccagucccucguccccuccgccgacggcgacgccgacaacugcugcguccagaucaugggcggcuacuucaccuggacccccgacggcauccccacccucuccaacaucaccauccgcaucccccgcggccagcucaccaugaucgucggccaggucggcugcggcaaguccucccuccuccucgccgcccucggcgagaugcagaaggucuccggcgccgucuucugguccucccuccccgacuccgagaucggcgaggaccccucccccgagcgcgagaccgccaccgaccucgacauccgcaagcgcggccccgucgccuacgccucccagaagcccuggcuccucaacgccaccgucgaggagaacaucaucuucgagucccccuucaacaagcagcgcuacaagauggucaucgaggccugcucccuccagcccgacaucgacauccucccccacggcgaccagacccagaucggcgagcgcggcaucaaccucuccggcggccagcgccagcgcaucuccgucgcccgcgcccucuaccagcacgccaacgucgucuuccucgacgaccccuucuccgcccucgacauccaccucuccgaccaccucaugcaggccggcauccucgagcuccuccgcgacgacaagcgcaccgucguccucgucacccacaagcuccaguaccucccccacgccgacuggaucaucgccaugaaggacggcaccauccagcgcgagggcacccucaaggacuuccagcgcuccgagugccagcucuucgagcacuggaagacccucaugaaccgccaggaccaggagcucgagaaggagaccgucaccgagcgcaaggccaccgagcccccccagggccucucccgcgccauguccucccgcgacggccuccuccaggacgaggaggaggaggaggaggaggccgccgaguccgaggaggacgacaaccucuccuccaugcuccaccagcgcgccgagauccccuggcgcgccugcgccaaguaccucuccuccgccggcauccuccuccucucccuccucgucuucucccagcuccucaagcacaugguccucgucgccaucgacuacuggcucgccaaguggaccgacuccgcccucacccucacccccgccgcccgcaacugcucccucucccaggagugcacccucgaccagaccgucuacgccauggucuucaccguccucugcucccucggcaucguccucugccucgucaccuccgucaccgucgaguggaccggccucaaggucgccaagcgccuccaccgcucccuccucaaccgcaucauccucgcccccaugcgcuucuucgagaccaccccccucggcuccauccucaaccgcuucuccuccgacugcaacaccaucgaccagcacauccccuccacccucgagugccucucccgcuccacccuccucugcgucuccgcccucgccgucaucuccuacgucacccccgucuuccucgucgcccuccucccccucgccaucgucugcuacuucauccagaaguacuuccgcgucgccucccgcgaccuccagcagcucgacgacaccacccagcucccccuccucucccacuucgccgagaccgucgagggccucaccaccauccgcgccuuccgcuacgaggcccgcuuccagcagaagcuccucgaguacaccgacuccaacaacaucgccucccucuuccucaccgccgccaaccgcuggcucgagguccgcauggaguacaucggcgccugcgucguccucaucgccgccgucaccuccaucuccaacucccuccaccgcgagcucuccgccggccucgucggccucggccucaccuacgcccucauggucuccaacuaccucaacuggaugguccgcaaccucgccgacauggagcuccagcucggcgccgucaagcgcauccacggccuccucaagaccgaggccgaguccuacgagggccuccucgcccccucccucauccccaagaacuggcccgaccagggcaagauccagauccagaaccucuccguccgcuacgacuccucccucaagcccguccucaagcacgucaacgcccucaucgcccccggccagaagaucggcaucugcggccgcaccggcuccggcaaguccuccuucucccucgccuucuuccgcauggucgacaccuucgagggccacaucaucaucgacggcaucgacaucgccaagcucccccuccacacccuccgcucccgccucuccaucauccuccaggaccccguccucuucuccggcaccauccgcuucaaccucgaccccgagcgcaagugcuccgacuccacccucugggaggcccucgagaucgcccagcucaagcucgucgucaaggcccuccccggcggccucgacgccaucaucaccgagggcggcgagaacuucucccagggccagcgccagcucuucugccucgcccgcgccuucguccgcaagaccuccaucuucaucauggacgaggccaccgccuccaucgacauggccaccgagaacauccuccagaaggucgucaugaccgccuucgccgaccgcaccgucgucaccaucgcccaccgcguccacaccauccucuccgccgaccucgucaucguccucaagcgcggcgccauccucgaguucgacaagcccgagaagcuccucucccgcaaggacuccgucuucgccuccuucguccgcgccgacaaguga

SEQ ID NO: 39231 - RNA, 4650 nt, Artificial Sequence
  derived and/or modified sequence opt2 from ABCC9__Homo_sapiens__NP_005682
augucccucuccuucugcggcaacaacaucuccuccuacaacaucaacgacggcguccuccagaacuccugcuucgucgacgcccucaaccucgucccccacgucuuccuccucuucaucaccuuccccauccucuucaucggcuggggcucccaguccuccaagguccagauccaccacaacaccuggcuccacuuccccggccacaaccuccgcuggauccucaccuucgcccuccucuucguccacgucugcgagaucgccgagggcaucgucuccgacucccgccgcgagucccgccaccuccaccucuucaugcccgccgucaugggcuucgucgccaccaccaccuccaucgucuacuaccacaacaucgagaccuccaacuuccccaagcuccuccucgcccucuuccucuacugggucauggccuucaucaccaagaccaucaagcucgucaaguacugccaguccggccucgacaucuccaaccuccgcuucugcaucaccggcaugauggucauccucaacggccuccucauggccgucgagaucaacgucauccgcguccgccgcuacgucuucuucaugaacccccagaaggucaagccccccgaggaccuccaggaccucggcguccgcuuccuccagcccuucgucaaccuccucuccaaggccaccuacugguggaugaacacccucaucaucuccgcccacaagaagcccaucgaccucaaggccaucggcaagcuccccaucgccaugcgcgccgucaccaacuacgucugccucaaggacgccuacgaggagcagaagaagaaggucgccgaccaccccaaccgcacccccuccaucuggcucgccauguaccgcgccuucggccgccccauccuccucuccuccaccuuccgcuaccucgccgaccuccucggcuucgccggcccccucugcaucuccggcaucguccagcgcgucaacgagacccagaacggcaccaacaacaccaccggcaucuccgagacccucuccuccaaggaguuccucgagaacgccuacguccucgccguccuccucuuccucgcccucauccuccagcgcaccuuccuccaggccuccuacuacgucaccaucgagaccggcaucaaccuccgcggcgcccuccucgccaugaucuacaacaagauccuccgccucuccaccuccaaccucuccaugggcgagaugacccucggccagaucaacaaccucgucgccaucgagaccaaccagcucaugugguuccucuuccucugccccaaccucugggccaugcccguccagaucaucaugggcgucauccuccucuacaaccuccucggcuccuccgcccucgucggcgccgccgucaucguccuccucgcccccauccaguacuucaucgccaccaagcucgccgaggcccagaaguccacccucgacuacuccaccgagcgccucaagaagaccaacgagauccucaagggcaucaagcuccucaagcucuacgccugggagcacaucuucugcaaguccgucgaggagacccgcaugaaggagcucuccucccucaagaccuucgcccucuacaccucccucuccaucuucaugaacgccgccauccccaucgccgccguccucgccaccuucgucacccacgccuacgccuccggcaacaaccucaagcccgccgaggccuucgccucccucucccucuuccacauccucgucaccccccucuuccuccucuccaccgucguccgcuucgccgucaaggccaucaucuccguccagaagcucaacgaguuccuccucuccgacgagaucggcgacgacuccuggcgcaccggcgaguccucccuccccuucgaguccugcaagaagcacaccggcguccagcccaagaccaucaaccgcaagcagcccggccgcuaccaccucgacuccuacgagcaguccacccgccgccuccgccccgccgagaccgaggacaucgccaucaaggucaccaacggcuacuucuccuggggcuccggccucgccacccucuccaacaucgacauccgcauccccaccggccagcucaccaugaucgucggccaggucggcugcggcaaguccucccuccuccucgccauccucggcgagaugcagacccucgagggcaagguccacugguccaacgucaacgaguccgagcccuccuucgaggccacccgcucccgcaaccgcuacuccgucgccuacgccgcccagaagcccuggcuccucaacgccaccgucgaggagaacaucaccuucggcucccccuucaacaagcagcgcuacaaggccgucaccgacgccugcucccuccagcccgacaucgaccuccuccccuucggcgaccagaccgagaucggcgagcgcggcaucaaccucuccggcggccagcgccagcgcaucugcgucgcccgcgcccucuaccagaacaccaacaucgucuuccucgacgaccccuucuccgcccucgacauccaccucuccgaccaccucaugcaggagggcauccucaaguuccuccaggacgacaagcgcacccucguccucgucacccacaagcuccaguaccucacccacgccgacuggaucaucgccaugaaggacggcuccguccuccgcgagggcacccucaaggacauccagaccaaggacgucgagcucuacgagcacuggaagacccucaugaaccgccaggaccaggagcucgagaaggacauggaggccgaccagaccacccucgagcgcaagacccuccgccgcgccauguacucccgcgaggccaaggcccagauggaggacgaggacgaggaggaggaggaggaggaggacgaggacgacaacauguccaccgucaugcgccuccgcaccaagaugcccuggaagaccugcuggcgcuaccucaccuccggcggcuucuuccuccucauccucaugaucuucuccaagcuccucaagcacuccgucaucgucgccaucgacuacuggcucgccaccuggaccuccgaguacuccaucaacaacaccggcaaggccgaccagaccuacuacgucgccggcuucuccauccucugcggcgccggcaucuuccucugccucgucaccucccucaccgucgaguggaugggccucaccgccgccaagaaccuccaccacaaccuccucaacaagaucauccucggccccauccgcuucuucgacaccaccccccucggccucauccucaaccgcuucuccgccgacaccaacaucaucgaccagcacaucccccccacccucgagucccucacccgcuccacccuccucugccucuccgccaucggcaugaucuccuacgccacccccgucuuccucgucgcccuccucccccucggcgucgccuucuacuucauccagaaguacuuccgcgucgccuccaaggaccuccaggagcucgacgacuccacccagcucccccuccucugccacuucuccgagaccgccgagggccucaccaccauccgcgccuuccgccacgagacccgcuucaagcagcgcaugcucgagcucaccgacaccaacaacaucgccuaccucuuccucuccgccgccaaccgcuggcucgagguccgcaccgacuaccucggcgccugcaucguccucaccgccuccaucgccuccaucuccggcuccuccaacuccggccucgucggccucggccuccucuacgcccucaccaucaccaacuaccucaacugggucguccgcaaccucgccgaccucgagguccagaugggcgccgucaagaaggucaacuccuuccucaccauggaguccgagaacuacgagggcaccauggaccccucccagguccccgagcacuggccccaggagggcgagaucaagauccacgaccucugcguccgcuacgagaacaaccucaagcccguccucaagcacgucaaggccuacaucaagcccggccagaaggucggcaucugcggccgcaccggcuccggcaaguccucccucucccucgccuucuuccgcauggucgacaucuucgacggcaagaucgucaucgacggcaucgacaucuccaagcucccccuccacacccuccgcucccgccucuccaucauccuccaggaccccauccucuucuccggcuccauccgcuucaaccucgaccccgagugcaagugcaccgacgaccgccucugggaggcccucgagaucgcccagcucaagaacauggucaagucccuccccggcggccucgacgccgucgucaccgagggcggcgagaacuucuccgucggccagcgccagcucuucugccucgcccgcgccuucguccgcaaguccuccauccucaucauggacgaggccaccgccuccaucgacauggccaccgagaacauccuccagaaggucgucaugaccgccuucgccgaccgcaccgucgucaccaucgcccaccgcgucuccuccaucauggacgccggccucguccucgucuucuccgagggcauccucgucgagugcgacaccguccccaaccuccucgcccacaagaacggccucuucuccacccucgucaugaccaacaaguga

SEQ ID NO: 39232 - RNA, 2238 nt, Artificial Sequence
  derived and/or modified sequence opt2 from ABCD1__Homo_sapiens__NP_000024
augcccguccucucccgcccccgccccuggcgcggcaacacccucaagcgcaccgccguccuccucgcccucgccgccuacggcgcccacaaggucuacccccucguccgccagugccucgcccccgcccgcggccuccaggcccccgccggcgagcccacccaggaggccuccggcgucgccgccgccaaggccggcaugaaccgcgucuuccuccagcgccuccucuggcuccuccgccuccucuucccccgcguccucugccgcgagaccggccuccucgcccuccacuccgccgcccucgucucccgcaccuuccucuccgucuacgucgcccgccucgacggccgccucgcccgcugcaucguccgcaaggacccccgcgccuucggcuggcagcuccuccaguggcuccucaucgcccuccccgccaccuucgucaacuccgccauccgcuaccucgagggccagcucgcccucuccuuccgcucccgccucgucgcccacgccuaccgccucuacuucucccagcagaccuacuaccgcgucuccaacauggacggccgccuccgcaaccccgaccagucccucaccgaggacgucgucgccuucgccgccuccgucgcccaccucuacuccaaccucaccaagccccuccucgacgucgccgucaccuccuacacccuccuccgcgccgcccgcucccgcggcgccggcaccgccuggcccuccgccaucgccggccucgucgucuuccucaccgccaacguccuccgcgccuucucccccaaguucggcgagcucgucgccgaggaggcccgccgcaagggcgagcuccgcuacaugcacucccgcgucgucgccaacuccgaggagaucgccuucuacggcggccacgaggucgagcucgcccuccuccagcgcuccuaccaggaccucgccucccagaucaaccucauccuccucgagcgccucugguacgucaugcucgagcaguuccucaugaaguacgucugguccgccuccggccuccucauggucgccguccccaucaucaccgccaccggcuacuccgaguccgacgccgaggccgucaagaaggccgcccucgagaagaaggaggaggagcucgucuccgagcgcaccgaggccuucaccaucgcccgcaaccuccucaccgccgccgccgacgccaucgagcgcaucauguccuccuacaaggaggucaccgagcucgccggcuacaccgcccgcguccacgagauguuccaggucuucgaggacguccagcgcugccacuucaagcgcccccgcgagcucgaggacgcccaggccggcuccggcaccaucggccgcuccggcguccgcgucgagggcccccucaagauccgcggccaggucgucgacgucgagcagggcaucaucugcgagaacauccccaucgucacccccuccggcgaggucgucgucgccucccucaacauccgcgucgaggagggcaugcaccuccucaucaccggccccaacggcugcggcaaguccucccucuuccgcauccucggcggccucuggcccaccuacggcggcguccucuacaagccccccccccagcgcauguucuacaucccccagcgccccuacauguccgucggcucccuccgcgaccaggucaucuaccccgacuccgucgaggacaugcagcgcaagggcuacuccgagcaggaccucgaggccauccucgacgucguccaccuccaccacauccuccagcgcgagggcggcugggaggccaugugcgacuggaaggacguccucuccggcggcgagaagcagcgcaucggcauggcccgcauguucuaccaccgccccaaguacgcccuccucgacgagugcaccuccgccgucuccaucgacgucgagggcaagaucuuccaggccgccaaggacgccggcaucgcccuccucuccaucacccaccgccccucccucuggaaguaccacacccaccuccuccaguucgacggcgagggcggcuggaaguucgagaagcucgacuccgccgcccgccucucccucaccgaggagaagcagcgccucgagcagcagcucgccggcauccccaagaugcagcgccgccuccaggagcucugccagauccucggcgaggccgucgcccccgcccacguccccgcccccuccccccagggccccggcggccuccagggcgccuccaccuga

SEQ ID NO: 39233 - RNA, 2223 nt, Artificial Sequence
  derived and/or modified sequence opt2 from ABCD2__Homo_sapiens__XP_011536329
augacccacaugcucaacgccgccgccgaccgcgucaaguggacccgcuccuccgccgccaagcgcgccgccugccucgucgccgccgccuacgcccucaagacccucuaccccaucaucggcaagcgccucaagcaguccggccacggcaagaagaaggccgccgccuaccccgccgccgagaacaccgagauccuccacugcaccgagaccaucugcgagaagcccucccccggcgucaacgccgacuucuucaagcagcuccucgagcuccgcaagauccucuuccccaagcucgucaccaccgagaccggcuggcucugccuccacuccgucgcccucaucucccgcaccuuccucuccaucuacgucgccggccucgacggcaagaucgucaaguccaucgucgagaagaagccccgcaccuucaucaucaagcucaucaaguggcucaugaucgccauccccgccaccuucgucaacuccgccauccgcuaccucgagugcaagcucgcccucgccuuccgcacccgccucgucgaccacgccuacgagaccuacuucaccaaccagaccuacuacaaggucaucaacauggacggccgccucgccaaccccgaccagucccucaccgaggacaucaugauguucucccaguccgucgcccaccucuacuccaaccucaccaagcccauccucgacgucaugcucaccuccuacacccucauccagaccgccaccucccgcggcgccucccccaucggccccacccuccucgccggccucgucgucuacgccaccgccaagguccucaaggccugcucccccaaguucggcaagcucgucgccgaggaggcccaccgcaagggcuaccuccgcuacguccacucccgcaucaucgccaacgucgaggagaucgccuucuaccgcggccacaaggucgagaugaagcagcuccagaaguccuacaaggcccucgccgaccagaugaaccucauccucuccaagcgccucugguacaucaugaucgagcaguuccucaugaaguacgucugguccuccuccggccucaucauggucgccauccccaucaucaccgccaccggcuucgccgacggcgaggacggccagaagcaggucauggucuccgagcgcaccgaggccuucaccaccgcccgcaaccuccucgccuccggcgccgacgccaucgagcgcaucauguccuccuacaaggaggucaccgagcucgccggcuacaccgcccgcgucuacaacauguucugggucuucgacgaggucaagcgcggcaucuacaagcgcaccgccgucauccaggaguccgagucccacuccaagaacggcgccaaggucgagcucccccucuccgacacccucgccaucaagggcaaggucaucgacgucgaccacggcaucaucugcgagaacguccccaucaucacccccgccggcgaggucgucgccucccgccucaacuucaaggucgaggagggcaugcaccuccucaucaccggccccaacggcugcggcaaguccucccucuuccgcauccucuccggccucuggcccgucuacgagggcguccucuacaagccccccccccagcacauguucuacaucccccagcgccccuacaugucccucggcucccuccgcgaccaggucaucuaccccgacuccgucgacgacaugcacgacaagggcuacaccgaccaggaccucgagcgcauccuccacaacguccaccucuaccacaucguccagcgcgagggcggcugggacgccgucauggacuggaaggacguccucuccggcggcgagaagcagcgcaugggcauggcccgcauguucuaccacaagcccaaguacgcccuccucgacgagugcaccuccgccgucuccaucgacgucgagggcaagaucuuccaggccgccaagggcgccggcaucucccuccucuccaucacccaccgccccucccucuggaaguaccacacccaccuccuccaguucgacggcgagggcggcuggcgcuucgagcagcucgacaccgccauccgccucacccucuccgaggagaagcagaagcucgagucccagcucgccggcauccccaagaugcagcagcgccucaacgagcucugcaagauccucggcgaggacuccguccucaagaccaucaagaacgaggacgagaccuccuga

SEQ ID NO: 39234 - RNA, 1044 nt, Artificial Sequence
  derived and/or modified sequence opt2 from ABCD3__Homo_sapiens__XP_011540179
augggcuucaucgacuccaucaucgccaaguaccucgccaccgucgucggcuaccucgucgucucccgccccuuccucgaccucucccacccccgccaccucaaguccacccacuccgagcuccucgaggacuacuaccaguccggccgcaugcuccuccgcaugucccaggcccucggccgcaucguccucgccggccgcgagaugacccgccucgccggcuucaccgcccgcaucaccgagcucaugcagguccucaaggaccucaaccacggcaaguacgagcgcaccauggucucccagcaggagaagggcaucgagggcguccaggucaucccccucauccccggcgccggcgagaucaucaucgccgacaacaucaucaaguucgaccacgucccccucgccacccccaacggcgacguccucauccgcgaccucaacuucgagguccgcuccggcgccaacguccucaucugcggccccaacggcugcggcaaguccucccucuuccgcguccucggcgagcucuggccccucuucggcggccgccucaccaagcccgagcgcggcaagcucuucuacgucccccagcgccccuacaugacccucggcacccuccgcgaccaggucaucuaccccgacggccgcgaggaccagaagcgcaagggcaucuccgaccucguccucaaggaguaccucgacaacguccagcucggccacauccucgagcgcgagggcggcugggacuccguccaggacuggauggacguccucuccggcggcgagaagcagcgcauggccauggcccgccucuucuaccacaagccccaguucgccauccucgacgagugcaccuccgccgucuccgucgacgucgagggcuacaucuacucccacugccgcaaggucggcaucacccucuucaccgucucccaccgcaagucccucuggaagcaccacgaguacuaccuccacauggacggccgcggcaacuacgaguucaagcagaucaccgaggacaccgucgaguucggcuccuga

SEQ ID NO: 39235 - RNA, 1821 nt, Artificial Sequence
  derived and/or modified sequence opt2 from ABCD4__Homo_sapiens__NP_005041
auggccgucgccggccccgcccccggcgccggcgcccgcccccgccucgaccuccaguuccuccagcgcuuccuccagauccucaagguccucuuccccuccugguccucccagaacgcccucauguuccucacccuccucugccucacccuccucgagcaguucgucaucuaccaggucggccucauccccucccaguacuacggcguccucggcaacaaggaccucgagggcuucaagacccucaccuuccucgccgucaugcucaucguccucaacuccacccucaaguccuucgaccaguucaccugcaaccuccucuacgucuccuggcgcaaggaccucaccgagcaccuccaccgccucuacuuccgcggccgcgccuacuacacccucaacguccuccgcgacgacaucgacaaccccgaccagcgcaucucccaggacgucgagcgcuucugccgccagcucuccuccauggccuccaagcucaucaucucccccuucacccucgucuacuacaccuaccagugcuuccaguccaccggcuggcucggccccgucuccaucuucggcuacuucauccucggcaccgucgucaacaagacccucaugggccccaucgucaugaagcucguccaccaggagaagcucgagggcgacuuccgcuucaagcacaugcagauccgcgucaacgccgagcccgccgccuucuaccgcgccggccacgucgagcacaugcgcaccgaccgccgccuccagcgccuccuccagacccagcgcgagcucauguccaaggagcucuggcucuacaucggcaucaacaccuucgacuaccucggcuccauccucuccuacgucgucaucgccauccccaucuucuccggcgucuacggcgaccucucccccgccgagcucuccacccucgucuccaagaacgccuucgucugcaucuaccucaucuccugcuucacccagcucaucgaccucuccaccacccucuccgacgucgccggcuacacccaccgcaucggccagcuccgcgagacccuccucgacaugucccucaagucccaggacugcgagauccucggcgaguccgaguggggccucgacaccccccccggcuggcccgccgccgagcccgccgacaccgccuuccuccucgagcgcgucuccaucuccgcccccuccuccgacaagccccucaucaaggaccucucccucaagaucuccgagggccagucccuccucaucaccggcaacaccggcaccggcaagaccucccuccuccgcguccucggcggccucuggaccuccacccgcggcuccguccagaugcucaccgacuucggcccccacggcguccucuuccucccccagaagcccuucuucaccgacggcacccuccgcgagcaggucaucuacccccucaaggaggucuaccccgacuccggcuccgccgacgacgagcgcauccuccgcuuccucgagcucgccggccucuccaaccucgucgcccgcaccgagggccucgaccagcaggucgacuggaacugguacgacguccucucccccggcgagaugcagcgccucuccuucgcccgccucuucuaccuccagcccaaguacgccguccucgacgaggccaccuccgcccucaccgaggaggucgaguccgagcucuaccgcaucggccagcagcucggcaugaccuucaucuccgucggccaccgccagucccucgagaaguuccacucccucguccucaagcucugcggcggcggccgcugggagcucaugcgcaucaaggucgaguga

SEQ ID NO: 39236 - RNA, 1800 nt, Artificial Sequence
  derived and/or modified sequence opt2 from ABCE1__Homo_sapiens__NP_002931
auggccgacaagcucacccgcaucgccaucgucaaccacgacaagugcaagcccaagaagugccgccaggagugcaagaaguccugccccgucguccgcaugggcaagcucugcaucgaggucaccccccaguccaagaucgccuggaucuccgagacccucugcaucggcugcggcaucugcaucaagaagugccccuucggcgcccucuccaucgucaaccuccccuccaaccucgagaaggagaccacccaccgcuacugcgccaacgccuucaagcuccaccgccuccccaucccccgccccggcgagguccucggccucgucggcaccaacggcaucggcaaguccaccgcccucaagauccucgccggcaagcagaagcccaaccucggcaaguacgacgacccccccgacuggcaggagauccucaccuacuuccgcggcuccgagcuccagaacuacuucaccaagauccucgaggacgaccucaaggccaucaucaagccccaguacgucgaccagauccccaaggccgccaagggcaccgucggcuccauccucgaccgcaaggacgagaccaagacccaggccaucgucugccagcagcucgaccucacccaccucaaggagcgcaacgucgaggaccucuccggcggcgagcuccagcgcuucgccugcgccgucgucugcauccagaaggccgacaucuucauguucgacgagcccuccuccuaccucgacgucaagcagcgccucaaggccgccaucaccauccgcucccucaucaaccccgaccgcuacaucaucgucgucgagcacgaccucuccguccucgacuaccucuccgacuucaucugcugccucuacggcguccccuccgccuacggcgucgucaccaugcccuucuccguccgcgagggcaucaacaucuuccucgacggcuacguccccaccgagaaccuccgcuuccgcgacgccucccucgucuucaaggucgccgagaccgccaacgaggaggaggucaagaagaugugcauguacaaguaccccggcaugaagaagaagaugggcgaguucgagcucgccaucgucgccggcgaguucaccgacuccgagaucauggucaugcucggcgagaacggcaccggcaagaccaccuucauccgcaugcucgccggccgccucaagcccgacgagggcggcgagguccccguccucaacgucuccuacaagccccagaagaucucccccaaguccaccggcuccguccgccagcuccuccacgagaagauccgcgacgccuacacccacccccaguucgucaccgacgucaugaagccccuccagaucgagaacaucaucgaccaggagguccagacccucuccggcggcgagcuccagcgcgucgcccucgcccucugccucggcaagcccgccgacgucuaccucaucgacgagcccuccgccuaccucgacuccgagcagcgccucauggccgcccgcgucgucaagcgcuucauccuccacgccaagaagaccgccuucgucgucgagcacgacuucaucauggccaccuaccucgccgaccgcgucaucgucuucgacggcguccccuccaagaacaccgucgccaacuccccccagacccuccucgccggcaugaacaaguuccucucccagcucgagaucaccuuccgccgcgaccccaacaacuaccgcccccgcaucaacaagcucaacuccaucaaggacgucgagcagaagaaguccggcaacuacuucuuccucgacgacuga

SEQ ID NO: 39237 - RNA, 2538 nt, Artificial Sequence
  derived and/or modified sequence opt2 from ABCF1__Homo_sapiens__NP_001020262
augcccaaggcccccaagcagcagccccccgagcccgaguggaucggcgacggcgaguccaccucccccuccgacaaggucgucaagaagggcaagaaggacaagaagaucaagaagaccuucuucgaggagcucgccgucgaggacaagcaggccggcgaggaggagaagguccucaaggagaaggagcagcagcagcagcagcagcagcagcagcagaagaagaagcgcgacacccgcaagggccgccgcaagaaggacgucgacgacgacggcgaggagaaggagcucauggagcgccucaagaagcucuccguccccaccuccgacgaggaggacgagguccccgcccccaagccccgcggcggcaagaagaccaagggcggcaacgucuucgccgcccucauccaggaccaguccgaggaggaggaggaggaggagaagcacccccccaagcccgccaagcccgagaagaaccgcaucaacaaggccgucuccgaggagcagcagcccgcccucaagggcaagaagggcaaggaggagaaguccaagggcaaggccaagccccagaacaaguucgccgcccucgacaacgaggaggaggacaaggaggaggagaucaucaaggagaaggagccccccaagcagggcaaggagaaggccaagaaggccgagcagggcuccgaggaggagggcgagggcgaggaggaggaggaggagggcggcgaguccaaggccgacgaccccuacgcccaccucuccaagaaggagaagaagaagcucaagaagcagauggaguacgagcgccaggucgccucccucaaggccgccaacgccgccgagaacgacuucuccgucucccaggccgagauguccucccgccaggccaugcucgagaacgccuccgacaucaagcucgagaaguucuccaucuccgcccacggcaaggagcucuucgucaacgccgaccucuacaucgucgccggccgccgcuacggccucgucggccccaacggcaagggcaagaccacccuccucaagcacaucgccaaccgcgcccucuccaucccccccaacaucgacguccuccucugcgagcaggaggucgucgccgacgagacccccgccguccaggccguccuccgcgccgacaccaagcgccucaagcuccucgaggaggagcgccgccuccagggccagcucgagcagggcgacgacaccgccgccgagcgccucgagaaggucuacgaggagcuccgcgccaccggcgccgccgccgccgaggccaaggcccgccgcauccucgccggccucggcuucgaccccgagaugcagaaccgccccacccagaaguucuccggcggcuggcgcaugcgcgucucccucgcccgcgcccucuucauggagcccacccuccucaugcucgacgagcccaccaaccaccucgaccucaacgccgucaucuggcucaacaacuaccuccagggcuggcgcaagacccuccucaucgucucccacgaccagggcuuccucgacgacgucugcaccgacaucauccaccucgacgcccagcgccuccacuacuaccgcggcaacuacaugaccuucaagaagauguaccagcagaagcagaaggagcuccucaagcaguacgagaagcaggagaagaagcucaaggagcucaaggccggcggcaaguccaccaagcaggccgagaagcagaccaaggaggcccucacccgcaagcagcagaagugccgccgcaagaaccaggacgaggagucccaggaggcccccgagcuccucaagcgccccaaggaguacaccguccgcuucaccuuccccgacccccccccccucuccccccccguccucggccuccacggcgucaccuucggcuaccagggccagaagccccucuucaagaaccucgacuucggcaucgacauggacucccgcaucugcaucgucggccccaacggcgucggcaaguccacccuccuccuccuccucaccggcaagcucacccccacccacggcgagaugcgcaagaaccaccgccucaagaucggcuucuucaaccagcaguacgccgagcagcuccgcauggaggagacccccaccgaguaccuccagcgcggcuucaaccuccccuaccaggacgcccgcaagugccucggccgcuucggccucgagucccacgcccacaccauccagaucugcaagcucuccggcggccagaaggcccgcgucgucuucgccgagcucgccugccgcgagcccgacguccucauccucgacgagcccaccaacaaccucgacaucgaguccaucgacgcccucggcgaggccaucaacgaguacaagggcgccgucaucgucgucucccacgacgcccgccucaucaccgagaccaacugccagcucugggucgucgaggagcaguccgucucccagaucgacggcgacuucgaggacuacaagcgcgagguccucgaggcccucggcgaggucauggucucccgcccccgcgaguga

SEQ ID NO: 39238 - RNA, 1905 nt, Artificial Sequence
  derived and/or modified sequence opt2 from ABCF2__Homo_sapiens__NP_005683
augcccuccgaccucgccaagaagaaggccgccaagaagaaggaggccgccaaggcccgccagcgcccccgcaagggccacgaggagaacggcgacgucgucaccgagccccaggucgccgagaagaacgaggccaacggccgcgagaccaccgaggucgaccuccucaccaaggagcucgaggacuucgagaugaagaaggccgccgcccgcgccgucaccggcguccucgccucccaccccaacuccaccgacguccacaucaucaaccucucccucaccuuccacggccaggagcuccucuccgacaccaagcucgagcucaacuccggccgccgcuacggccucaucggccucaacggcaucggcaaguccaugcuccucuccgccaucggcaagcgcgagguccccauccccgagcacaucgacaucuaccaccucacccgcgagaugccccccuccgacaagaccccccuccacugcgucauggaggucgacaccgagcgcgccaugcucgagaaggaggccgagcgccucgcccacgaggacgccgagugcgagaagcucauggagcucuacgagcgccucgaggagcucgacgccgacaaggccgagaugcgcgccucccgcauccuccacggccucggcuucacccccgccaugcagcgcaagaagcucaaggacuucuccggcggcuggcgcaugcgcgucgcccucgcccgcgcccucuucauccgccccuucaugcuccuccucgacgagcccaccaaccaccucgaccucgacgccugcgucuggcucgaggaggagcucaagaccuucaagcgcauccucguccucgucucccacucccaggacuuccucaacggcgucugcaccaacaucauccacaugcacaacaagaagcucaaguacuacaccggcaacuacgaccaguacgucaagacccgccucgagcucgaggagaaccagaugaagcgcuuccacugggagcaggaccagaucgcccacaugaagaacuacaucgcccgcuucggccacggcuccgccaagcucgcccgccaggcccaguccaaggagaagacccuccagaagaugauggccuccggccucaccgagcgcgucgucuccgacaagacccucuccuucuacuucccccccugcggcaagauccccccccccgucaucaugguccagaacgucuccuucaaguacaccaaggacggccccugcaucuacaacaaccucgaguucggcaucgaccucgacacccgcgucgcccucgucggccccaacggcgccggcaaguccacccuccucaagcuccucaccggcgagcuccuccccaccgacggcaugauccgcaagcacucccacgucaagaucggccgcuaccaccagcaccuccaggagcagcucgaccucgaccucuccccccucgaguacaugaugaagugcuaccccgagaucaaggagaaggaggagaugcgcaagaucaucggccgcuacggccucaccggcaagcagcaggucucccccauccgcaaccucuccgacggccagaagugccgcgucugccucgccuggcucgccuggcagaacccccacaugcucuuccucgacgagcccaccaaccaccucgacaucgagaccaucgacgcccucgccgacgccaucaacgaguucgagggcggcaugaugcucgucucccacgacuuccgccucauccagcaggucgcccaggagaucugggucugcgagaagcagaccaucaccaaguggcccggcgacauccucgccuacaaggagcaccucaaguccaagcucgucgacgaggagccccagcucaccaagcgcacccacaacgucugcacccucacccucgccucccucccccgccccuga

SEQ ID NO: 39239 - RNA, 2037 nt, Artificial Sequence
  derived and/or modified sequence opt2 from ABCG1__Homo_sapiens__NP_004906
auggccugccucauggccgccuucuccgucggcaccgccaugaacgccuccuccuacuccgccgagaugaccgagcccaaguccgucugcgucuccgucgacgaggucgucuccuccaacauggaggccaccgagaccgaccuccucaacggccaccucaagaaggucgacaacaaccucaccgaggcccagcgcuucuccucccucccccgccgcgccgccgucaacaucgaguuccgcgaccucuccuacuccguccccgagggccccugguggcgcaagaagggcuacaagacccuccucaagggcaucuccggcaaguucaacuccggcgagcucgucgccaucaugggccccuccggcgccggcaaguccacccucaugaacauccucgccggcuaccgcgagaccggcaugaagggcgccguccucaucaacggccucccccgcgaccuccgcugcuuccgcaaggucuccugcuacaucaugcaggacgacaugcuccucccccaccucaccguccaggaggccaugauggucuccgcccaccucaagcuccaggagaaggacgagggccgccgcgagauggucaaggagauccucaccgcccucggccuccucuccugcgccaacacccgcaccggcucccucuccggcggccagcgcaagcgccucgccaucgcccucgagcucgucaacaacccccccgucauguucuucgacgagcccaccuccggccucgacuccgccuccugcuuccaggucgucucccucaugaagggccucgcccagggcggccgcuccaucaucugcaccauccaccagcccuccgccaagcucuucgagcucuucgaccagcucuacguccucucccagggccagugcgucuaccgcggcaaggucugcaaccucguccccuaccuccgcgaccucggccucaacugccccaccuaccacaaccccgccgacuucgucauggaggucgccuccggcgaguacggcgaccagaacucccgccucguccgcgccguccgcgagggcaugugcgacuccgaccacaagcgcgaccucggcggcgacgccgaggucaaccccuuccucuggcaccgccccuccgaggaggucaagcagaccaagcgccucaagggccuccgcaaggacuccuccuccauggagggcugccacuccuucuccgccuccugccucacccaguucugcauccucuucaagcgcaccuuccucuccaucaugcgcgacuccguccucacccaccuccgcaucaccucccacaucggcaucggccuccucaucggccuccucuaccucggcaucggcaacgaggccaagaagguccucuccaacuccggcuuccucuucuucuccaugcucuuccucauguucgccgcccucaugcccaccguccucaccuucccccucgagaugggcgucuuccuccgcgagcaccucaacuacugguacucccucaaggccuacuaccucgccaagaccauggccgacguccccuuccagaucauguuccccgucgccuacugcuccaucgucuacuggaugaccucccagcccuccgacgccguccgcuucguccucuucgccgcccucggcaccaugaccucccucgucgcccagucccucggccuccucaucggcgccgccuccaccucccuccaggucgccaccuucgucggccccgucaccgccauccccguccuccucuucuccggcuucuucgucuccuucgacaccauccccaccuaccuccaguggauguccuacaucuccuacguccgcuacggcuucgagggcgucauccucuccaucuacggccucgaccgcgaggaccuccacugcgacaucgacgagaccugccacuuccagaaguccgaggccauccuccgcgagcucgacgucgagaacgccaagcucuaccucgacuucaucguccucggcaucuucuucaucucccuccgccucaucgccuacuucguccuccgcuacaagauccgcgccgagcgcuga

SEQ ID NO: 39240 - RNA, 1836 nt, Artificial Sequence
  derived and/or modified sequence opt2 from ABCG2__Homo_sapiens__NP_001244315
auguccuccuccaacgucgaggucuucauccccgucucccagggcaacaccaacggcuuccccgccaccgccuccaacgaccucaaggccuucaccgagggcgccguccucuccuuccacaacaucugcuaccgcgucaagcucaaguccggcuuccuccccugccgcaagcccgucgagaaggagauccucuccaacaucaacggcaucaugaagcccggccucaacgccauccucggccccaccggcggcggcaaguccucccuccucgacguccucgccgcccgcaaggaccccuccggccucuccggcgacguccucaucaacggcgccccccgccccgccaacuucaagugcaacuccggcuacgucguccaggacgacgucgucaugggcacccucaccguccgcgagaaccuccaguucuccgccgcccuccgccucgccaccaccaugaccaaccacgagaagaacgagcgcaucaaccgcgucauccaggagcucggccucgacaaggucgccgacuccaaggucggcacccaguucauccgcggcgucuccggcggcgagcgcaagcgcaccuccaucggcauggagcucaucaccgaccccuccauccucuuccucgacgagcccaccaccggccucgacuccuccaccgccaacgccguccuccuccuccucaagcgcauguccaagcagggccgcaccaucaucuucuccauccaccagccccgcuacuccaucuucaagcucuucgacucccucacccuccucgccuccggccgccucauguuccacggccccgcccaggaggcccucggcuacuucgaguccgccggcuaccacugcgaggccuacaacaaccccgccgacuucuuccucgacaucaucaacggcgacuccaccgccgucgcccucaaccgcgaggaggacuucaaggccaccgagaucaucgagcccuccaagcaggacaagccccucaucgagaagcucgccgagaucuacgucaacuccuccuucuacaaggagaccaaggccgagcuccaccagcucuccggcggcgagaagaagaagaagaucaccgucuucaaggagaucuccuacaccaccuccuucugccaccagcuccgcugggucuccaagcgcuccuucaagaaccuccucggcaacccccaggccuccaucgcccagaucaucgucaccgucguccucggccucgucaucggcgccaucuacuucggccucaagaacgacuccaccggcauccagaaccgcgccggcguccucuucuuccucaccaccaaccagugcuucuccuccgucuccgccgucgagcucuucgucgucgagaagaagcucuucauccacgaguacaucuccggcuacuaccgcgucuccuccuacuuccucggcaagcuccucuccgaccuccuccccaugcgcaugcuccccuccaucaucuucaccugcaucgucuacuucaugcucggccucaagcccaaggccgacgccuucuucgucaugauguucacccucaugauggucgccuacuccgccuccuccauggcccucgccaucgccgccggccaguccgucgucuccgucgccacccuccucaugaccaucugcuucgucuucaugauggucugcugguccaucucccagccccuccaccucggcugccacggcuucuccaccuccgccuuccacgacauggaccuccgccucugcuccaucaugaacuucugggacaagaccuccgcccaggacuccaugcagcaggagaccauccucgucaccaugcagcacguccucgccaagaacaucugguga

SEQ ID NO: 39241 - RNA, 1941 nt, Artificial Sequence
  derived and/or modified sequence opt2 from ABCG4__Homo_sapiens__NP_001135977
auggccgagaaggcccucgaggccgucggcugcggccucggccccggcgccgucgccauggccgucacccucgaggacggcgccgagccccccguccucaccacccaccucaagaaggucgagaaccacaucaccgaggcccagcgcuucucccaccuccccaagcgcuccgccgucgacaucgaguucgucgagcucuccuacuccguccgcgagggccccugcuggcgcaagcgcggcuacaagacccuccucaagugccucuccggcaaguucugccgccgcgagcucaucggcaucaugggccccuccggcgccggcaaguccaccuucaugaacauccucgccggcuaccgcgaguccggcaugaagggccagauccucgucaacggccgcccccgcgagcuccgcaccuuccgcaagauguccugcuacaucaugcaggacgacaugcuccucccccaccucaccguccucgaggccaugauggucuccgccaaccucaagcucuccgagaagcaggaggucaagaaggagcucgucaccgagauccucaccgcccucggccucauguccugcucccacacccgcaccgcccuccucuccggcggccagcgcaagcgccucgccaucgcccucgagcucgucaacaacccccccgucauguucuucgacgagcccaccuccggccucgacuccgccuccugcuuccaggucgucucccucaugaagucccucgcccagggcggccgcaccaucaucugcaccauccaccagcccuccgccaagcucuucgagauguucgacaagcucuacauccucucccagggccagugcaucuucaagggcgucgucaccaaccucauccccuaccucaagggccucggccuccacugccccaccuaccacaaccccgccgacuucaucaucgaggucgccuccggcgaguacggcgaccucaaccccaugcucuuccgcgccguccagaacggccucugcgccauggccgagaagaaguccucccccgagaagaacgagguccccgcccccugcccccccugcccccccgaggucgaccccaucgagucccacaccuucgccaccuccacccucacccaguucugcauccucuucaagcgcaccuuccucuccauccuccgcgacaccguccucacccaccuccgcuucaugucccacgucgucaucggcguccucaucggccuccucuaccuccacaucggcgacgacgccuccaaggucuucaacaacaccggcugccucuucuucuccaugcucuuccucauguucgccgcccucaugcccaccguccucaccuucccccucgagauggccgucuucaugcgcgagcaccucaacuacugguacucccucaaggccuacuaccucgccaagaccauggccgacguccccuuccaggucgucugccccgucgucuacugcuccaucgucuacuggaugaccggccagcccgccgagaccucccgcuuccuccucuucuccgcccucgccaccgccaccgcccucgucgcccagucccucggccuccucaucggcgccgccuccaacucccuccaggucgccaccuucgucggccccgucaccgccauccccguccuccucuucuccggcuucuucgucuccuucaagaccauccccaccuaccuccagugguccuccuaccucuccuacguccgcuacggcuucgagggcgucauccucaccaucuacggcauggagcgcggcgaccucaccugccucgaggagcgcugccccuuccgcgagccccaguccauccuccgcgcccucgacgucgaggacgccaagcucuacauggacuuccucguccucggcaucuucuuccucgcccuccgccuccucgccuaccucguccuccgcuaccgcgucaaguccgagcgcuga

SEQ ID NO: 39242 - RNA, 1956 nt, Artificial Sequence
  derived and/or modified sequence opt2 from ABCG5__Homo_sapiens__NP_071881
augggcgaccucuccucccucacccccggcggcuccaugggccuccaggucaaccgcggcucccaguccucccucgagggcgcccccgccaccgcccccgagccccacucccucggcauccuccacgccuccuacuccgucucccaccgcguccgccccuggugggacaucaccuccugccgccagcaguggacccgccagauccucaaggacgucucccucuacgucgaguccggccagaucaugugcauccucggcuccuccggcuccggcaagaccacccuccucgacgccauguccggccgccucggccgcgccggcaccuuccucggcgaggucuacgucaacggccgcgcccuccgccgcgagcaguuccaggacugcuucuccuacguccuccaguccgacacccuccucuccucccucaccguccgcgagacccuccacuacaccgcccuccucgccauccgccgcggcaaccccggcuccuuccagaagaaggucgaggccgucauggccgagcucucccucucccacgucgccgaccgccucaucggcaacuacucccucggcggcaucuccaccggcgagcgccgccgcgucuccaucgccgcccagcuccuccaggaccccaaggucaugcucuucgacgagcccaccaccggccucgacugcaugaccgccaaccagaucgucguccuccucgucgagcucgcccgccgcaaccgcaucgucguccucaccauccaccagccccgcuccgagcucuuccagcucuucgacaagaucgccauccucuccuucggcgagcucaucuucugcggcacccccgccgagaugcucgacuucuucaacgacugcggcuaccccugccccgagcacuccaaccccuucgacuucuacauggaccucaccuccgucgacacccaguccaaggagcgcgagaucgagaccuccaagcgcguccagaugaucgaguccgccuacaagaaguccgccaucugccacaagacccucaagaacaucgagcgcaugaagcaccucaagacccuccccaugguccccuucaagaccaaggacucccccggcgucuucuccaagcucggcguccuccuccgccgcgucacccgcaaccucguccgcaacaagcucgccgucaucacccgccuccuccagaaccucaucaugggccucuuccuccucuucuucguccuccgcguccgcuccaacguccucaagggcgccauccaggaccgcgucggccuccucuaccaguucgucggcgccacccccuacaccggcaugcucaacgccgucaaccucuuccccguccuccgcgccgucuccgaccaggagucccaggacggccucuaccagaaguggcagaugaugcucgccuacgcccuccacguccuccccuucuccgucgucgccaccaugaucuucuccuccgucugcuacuggacccucggccuccaccccgaggucgcccgcuucggcuacuucuccgccgcccuccucgccccccaccucaucggcgaguuccucacccucguccuccucggcaucguccagaaccccaacaucgucaacuccgucgucgcccuccucuccaucgccggcguccucgucggcuccggcuuccuccgcaacauccaggagaugcccauccccuucaagaucaucuccuacuucaccuuccagaaguacugcuccgagauccucgucgucaacgaguucuacggccucaacuucaccugcggcuccuccaacgucuccgucaccaccaaccccaugugcgccuucacccagggcauccaguucaucgagaagaccugccccggcgccaccucccgcuucaccaugaacuuccucauccucuacuccuucauccccgcccucgucauccucggcaucgucgucuucaagauccgcgaccaccucaucucccgcuga

SEQ ID NO: 39243 - RNA, 2022 nt, Artificial Sequence
  derived and/or modified sequence opt2 from ABCG8__Homo_sapiens__NP_071882
auggccggcaaggccgccgaggagcgcggccuccccaagggcgccaccccccaggacaccuccggccuccaggaccgccucuucuccuccgaguccgacaacucccucuacuucaccuacuccggccagcccaacacccucgagguccgcgaccucaacuaccaggucgaccucgccucccagguccccugguucgagcagcucgcccaguucaagaugcccuggaccucccccuccugccagaacuccugcgagcucggcauccagaaccucuccuucaagguccgcuccggccagaugcucgccaucaucggcuccuccggcugcggccgcgccucccuccucgacgucaucaccggccgcggccacggcggcaagaucaaguccggccagaucuggaucaacggccagcccuccuccccccagcucguccgcaagugcgucgcccacguccgccagcacaaccagcuccuccccaaccucaccguccgcgagacccucgccuucaucgcccagaugcgccucccccgcaccuucucccaggcccagcgcgacaagcgcgucgaggacgucaucgccgagcuccgccuccgccagugcgccgacacccgcgucggcaacauguacguccgcggccucuccggcggcgagcgccgccgcgucuccaucggcguccagcuccucuggaaccccggcauccucauccucgacgagcccaccuccggccucgacuccuucaccgcccacaaccucgucaagacccucucccgccucgccaagggcaaccgccucguccucaucucccuccaccagccccgcuccgacaucuuccgccucuucgaccucguccuccucaugaccuccggcacccccaucuaccucggcgccgcccagcacaugguccaguacuucaccgccaucggcuaccccugcccccgcuacuccaaccccgccgacuucuacgucgaccucaccuccaucgaccgccgcucccgcgagcaggagcucgccacccgcgagaaggcccagucccucgccgcccucuuccucgagaagguccgcgaccucgacgacuuccucuggaaggccgagaccaaggaccucgacgaggacaccugcgucgaguccuccgucaccccccucgacaccaacugccuccccucccccaccaagaugcccggcgccguccagcaguucaccacccucauccgccgccagaucuccaacgacuuccgcgaccuccccacccuccucauccacggcgccgaggccugccucauguccaugaccaucggcuuccucuacuucggccacggcuccauccagcucuccuucauggacaccgccgcccuccucuucaugaucggcgcccucauccccuucaacgucauccucgacgucaucuccaagugcuacuccgagcgcgccaugcucuacuacgagcucgaggacggccucuacaccaccggccccuacuucuucgccaagauccucggcgagcuccccgagcacugcgccuacaucaucaucuacggcaugcccaccuacuggcucgccaaccuccgccccggccuccagcccuuccuccuccacuuccuccucgucuggcucgucgucuucugcugccgcaucauggcccucgccgccgccgcccuccuccccaccuuccacauggccuccuucuucuccaacgcccucuacaacuccuucuaccucgccggcggcuucaugaucaaccucuccucccucuggaccguccccgccuggaucuccaaggucuccuuccuccgcuggugcuucgagggccucaugaagauccaguucucccgccgcaccuacaagaugccccucggcaaccucaccaucgccgucuccggcgacaagauccucuccgucauggagcucgacuccuacccccucuacgccaucuaccucaucgucaucggccucuccggcggcuucaugguccucuacuacgucucccuccgcuucaucaagcagaagcccucccaggacugguga

SEQ ID NO: 39244 - RNA, 1089 nt, Artificial Sequence
  derived and/or modified sequence opt2 from ABHD12B__Homo_sapiens__NP_001193602
auggacgcccaggacugccaggccgccgccucccccgagccccccggcccccccgcccgcuccugcgucgccgccuggugggacauggucgaccgcaaccuccgcuacuucccccacuccugcuccaugcucggccgcaagaucgccgcccucuacgacuccuucaccuccaagucccucaaggagcacgucuuccucccccucaucgacaugcucaucuacuucaacuucuucaaggcccccuuccucgucgaccucaagaagcccgagcucaagaucccccacaccgucaacuucuaccuccgcgucgagcccggcgucaugcucggcaucuggcacaccguccccuccugccgcggcgaggacgccaagggcaaggacugcugcugguacgaggccgcccuccgcgacggcaaccccaucaucgucuaccuccacggcuccgccgagcaccgcgccgccucccaccgccucaagcucgucaagguccucuccgacggcggcuuccacguccucuccgucgacuaccgcggcuucggcgacuccaccggcaagcccaccgaggagggccucaccaccgacgccaucugcgucuacgaguggaccaaggcccgcuccggcaucacccccgucugccucuggggccacucccucggcaccggcgucgccaccaacgccgccaagguccucgaggagaagggcugccccgucgacgccaucguccucgaggcccccuucaccaacaugugggucgccuccaucaacuacccccuccucaagaucuaccgcaacauccccggcuuccuccgcacccucauggacgcccuccgcaaggacaagaucaucuuccccaacgacgagaacgucaaguuccucuccuccccccuccucauccuccacggcgaggacgaccgcaccgucccccucgaguacggcaagaagcucuacgagaucgcccgcaacgccuaccgcaacaaggagcgcgucaagauggucaucuucccccccggcuuccagcacaaccuccucugcaagucccccacccuccucaucaccguccgcgacuuccucuccaagcagugguccuga

SEQ ID NO: 39245 - RNA, 1197 nt, Artificial Sequence
  derived and/or modified sequence opt2 from ABHD12__Homo_sapiens__NP_001035937
augcgcaagcgcaccgagcccgucgcccucgagcacgagcgcugcgccgccgccggcuccuccuccuccggcuccgccgccgccgcccucgacgccgacugccgccucaagcagaaccuccgccucaccggccccgccgccgccgagccccgcugcgccgccgacgccggcaugaagcgcgcccucggccgccgcaagggcgucuggcuccgccuccgcaagauccucuucugcguccucggccucuacaucgccauccccuuccucaucaagcucugccccggcauccaggccaagcucaucuuccucaacuucguccgcguccccuacuucaucgaccucaagaagccccaggaccagggccucaaccacaccugcaacuacuaccuccagcccgaggaggacgucaccaucggcgucuggcacaccguccccgccgucugguggaagaacgcccagggcaaggaccagaugugguacgaggacgcccucgccuccucccaccccaucauccucuaccuccacggcaacgccggcacccgcggcggcgaccaccgcgucgagcucuacaagguccucuccucccucggcuaccacgucgucaccuucgacuaccgcggcuggggcgacuccgucggcacccccuccgagcgcggcaugaccuacgacgcccuccacgucuucgacuggaucaaggcccgcuccggcgacaaccccgucuacaucuggggccacucccucggcaccggcgucgccaccaaccucguccgccgccucugcgagcgcgagaccccccccgacgcccucauccucgagucccccuucaccaacauccgcgaggaggccaagucccaccccuucuccgucaucuaccgcuacuuccccggcuucgacugguucuuccucgaccccaucaccuccuccggcaucaaguucgccaacgacgagaacgucaagcacaucuccugcccccuccucauccuccacgccgaggacgaccccgucguccccuuccagcucggccgcaagcucuacuccaucgccgcccccgcccgcuccuuccgcgacuucaagguccaguucguccccuuccacuccgaccucggcuaccgccacaaguacaucuacaagucccccgagcucccccgcauccuccgcgaguuccucggcaaguccgagcccgagcaccagcacuga

SEQ ID NO: 39246 - RNA, 1578 nt, Artificial Sequence
  derived and/or modified sequence opt2 from ABHD16A__Homo_sapiens__NP_001170986
augcccccccccgcccucuuccucuccucccucuacccccgccucgaguuccagaacgacuucuaccgcuccugcauccgccgcuccuccccccagcccccccccaaccucgccuggcgccccgagucccucuacuccggcgagcucgccggcggcggcuaccucucccucuccaaggucguccccuucucccacuacgccggcacccuccuccuccuccucgccggcgucgccugccuccgcggcaucggccgcuggaccaacccccaguaccgccaguucaucaccauccucgaggccacccaccgcaaccaguccuccgagaacaagcgccagcucgccaacuacaacuucgacuuccgcuccuggcccgucgacuuccacugggaggagcccuccucccgcaaggagucccgcggcggccccucccgccgcggcgucgcccuccuccgccccgagccccuccaccgcggcaccgccgacacccuccucaaccgcgucaagaagcuccccugccagaucaccuccuaccucgucgcccacacccucggccgccgcaugcucuaccccggcuccgucuaccuccuccagaaggcccucaugcccguccuccuccagggccaggcccgccucgucgaggagugcaacggccgccgcgccaagcuccucgccugcgacggcaacgagaucgacaccauguucgucgaccgccgcggcaccgccgagccccagggccagaagcucgucaucugcugcgagggcaacgccggcuucuacgaggucggcugcgucuccaccccccucgaggccggcuacuccguccucggcuggaaccaccccggcuucgccggcuccaccggcguccccuucccccagaacgaggccaacgccauggacgucgucguccaguucgccauccaccgccucggcuuccagccccaggacaucaucaucuacgccugguccaucggcggcuucaccgccaccugggccgccauguccuaccccgacgucuccgccaugauccucgacgccuccuucgacgaccucgucccccucgcccucaaggucaugcccgacuccuggcgcggccucgucacccgcaccguccgccagcaccucaaccucaacaacgccgagcagcucugccgcuaccagggccccguccuccucauccgccgcaccaaggacgagaucaucaccaccaccguccccgaggacaucauguccaaccgcggcaacgaccuccuccucaagcuccuccagcaccgcuacccccgcgucauggccgaggagggccuccgcgucguccgccaguggcucgaggccuccucccagcucgaggaggccuccaucuacucccgcugggaggucgaggaggacuggugccucuccguccuccgcuccuaccaggccgagcacggccccgacuuccccugguccgucggcgaggacauguccgccgacggccgccgccagcucgcccucuuccucgcccgcaagcaccuccacaacuucgaggccacccacugcaccccccuccccgcccagaacuuccagaugcccuggcaccucuga

SEQ ID NO: 39247 - RNA, 867 nt, Artificial Sequence
  derived and/or modified sequence opt2 from ABHD17B__Homo_sapiens__NP_001020951
augaacaaccucuccuucuccgagcucugcugccucuucugcugcccccccugccccggcaagaucgccuccaagcucgccuuccucccccccgaccccaccuacacccucaugugcgacgaguccggcucccgcuggacccuccaccucuccgagcgcgccgacuggcaguacuccucccgcgagaaggacgccaucgagugcuucaugacccgcaccuccaagggcaaccgcaucgccugcauguucguccgcugcucccccaacgccaaguacacccuccucuucucccacggcaacgccgucgaccucggccagauguccuccuucuacaucggccucggcucccgcaucaacugcaacaucuucuccuacgacuacuccggcuacggcgccuccuccggcaagcccaccgagaagaaccucuacgccgacaucgaggccgccuggcucgcccuccgcacccgcuacggcauccgccccgagaacgucaucaucuacggccaguccaucggcaccguccccuccgucgaccucgccgcccgcuacgaguccgccgccgucauccuccacuccccccucaccuccggcaugcgcgucgccuuccccgacaccaagaagaccuacugcuucgacgccuuccccaacaucgacaagaucuccaagaucaccucccccguccucaucauccacggcaccgaggacgaggucaucgacuucucccacggccucgcccucuucgagcgcugccagcgccccgucgagccccucugggucgagggcgccggccacaacgacgucgagcucuacggccaguaccucgagcgccucaagcaguucgucucccaggagcucgucaaccucuga

SEQ ID NO: 39248 - RNA, 1278 nt, Artificial Sequence
  derived and/or modified sequence opt2 from ABHD2__Homo_sapiens__XP_005254890
augaacgccaugcucgagacccccgagcuccccgccgucuucgacggcgucaagcucgccgccgucgccgccguccucuacgucaucguccgcugccucaaccucaagucccccaccgccccccccgaccucuacuuccaggacuccggccucucccgcuuccuccucaaguccugcccccuccucaccaaggaguacauccccccccucaucuggggcaaguccggccacauccagaccgcccucuacggcaagaugggccgcguccgcuccccccaccccuacggccaccgcaaguucaucaccauguccgacggcgccaccuccaccuucgaccucuucgagccccucgccgagcacugcgucggcgacgacaucaccauggucaucugccccggcaucgccaaccacuccgagaagcaguacauccgcaccuucgucgacuacgcccagaagaacggcuaccgcugcgccguccucaaccaccucggcgcccuccccaacaucgagcucaccuccccccgcauguucaccuacggcugcaccugggaguucggcgccauggucaacuacaucaagaagaccuacccccucacccagcucgucgucgucggcuucucccucggcggcaacaucgucugcaaguaccucggcgagacccaggccaaccaggagaagguccucugcugcgucuccgucugccagggcuacuccgcccuccgcgcccaggagaccuucaugcagugggaccagugccgccgcuucuacaacuuccucauggccgacaacaugaagaagaucauccucucccaccgccaggcccucuucggcgaccacgucaagaagccccagucccucgaggacaccgaccucucccgccucuacaccgccaccucccucaugcagaucgacgacaacgucaugcgcaaguuccacggcuacaacucccucaaggaguacuacgaggaggaguccugcaugcgcuaccuccaccgcaucuacgucccccucaugcucgucaacgccgccgacgacccccucguccacgagucccuccucaccauccccaagucccucuccgagaagcgcgagaacgucauguucguccucccccuccacggcggccaccucggcuucuucgagggcuccguccucuuccccgagccccucaccuggauggacaagcucgucgucgaguacgccaacgccaucugccagugggagcgcaacaagcuccagugcuccgacaccgagcaggucgaggccgaccucgaguga

SEQ ID NO: 39249 - RNA, 1050 nt, Artificial Sequence
  derived and/or modified sequence opt2 from ABHD5__Homo_sapiens__NP_057090
auggccgccgaggaggaggaggucgacuccgccgacaccggcgagcgcuccggcuggcucaccggcuggcuccccaccuggugccccaccuccaucucccaccucaaggaggccgaggagaagaugcucaagugcguccccugcaccuacaagaaggagcccguccgcaucuccaacggcaacaagaucuggacccucaaguucucccacaacaucuccaacaagaccccccucguccuccuccacggcuucggcggcggccucggccucugggcccucaacuucggcgaccucugcaccaaccgccccgucuacgccuucgaccuccucggcuucggccgcuccucccgcccccgcuucgacuccgacgccgaggaggucgagaaccaguucgucgaguccaucgaggaguggcgcugcgcccucggccucgacaagaugauccuccucggccacaaccucggcggcuuccucgccgccgccuacucccucaaguaccccucccgcgucaaccaccucauccucgucgagcccuggggcuuccccgagcgccccgaccucgccgaccaggaccgccccauccccgucuggauccgcgcccucggcgccgcccucacccccuucaacccccucgccggccuccgcaucgccggccccuucggccucucccucguccagcgccuccgccccgacuucaagcgcaaguacuccuccauguucgaggacgacaccgucaccgaguacaucuaccacugcaacguccagacccccuccggcgagaccgccuucaagaacaugaccauccccuacggcugggccaagcgccccaugcuccagcgcaucggcaagaugcaccccgacauccccgucuccgucaucuucggcgcccgcuccugcaucgacggcaacuccggcaccuccauccagucccuccgcccccacuccuacgucaagaccaucgccauccucggcgccggccacuacgucuacgccgaccagcccgaggaguucaaccagaaggucaaggagaucugcgacaccgucgacuga

SEQ ID NO: 39250 - RNA, 1014 nt, Artificial Sequence
  derived and/or modified sequence opt2 from ABHD6__Homo_sapiens__NP_065727
auggaccucgacgucgucaacauguucgucaucgccggcggcacccucgccauccccauccucgccuucgucgccuccuuccuccucuggcccuccgcccucauccgcaucuacuacugguacuggcgccgcacccucggcaugcagguccgcuacguccaccacgaggacuaccaguucugcuacuccuuccgcggccgccccggccacaagcccuccauccucaugcuccacggcuucuccgcccacaaggacauguggcucuccgucgucaaguuccuccccaagaaccuccaccucgucugcgucgacaugcccggccacgagggcaccacccgcuccucccucgacgaccucuccaucgacggccaggucaagcgcauccaccaguucgucgagugccucaagcucaacaagaagcccuuccaccucgucggcaccuccaugggcggccaggucgccggcgucuacgccgccuacuaccccuccgacgucuccucccucugccucgucugccccgccggccuccaguacuccaccgacaaccaguucguccagcgccucaaggagcuccagggcuccgccgccgucgagaagaucccccucauccccuccacccccgaggagauguccgagaugcuccagcucugcuccuacguccgcuucaaggucccccagcagauccuccagggccucgucgacguccgcaucccccacaacaacuucuaccgcaagcucuuccucgagaucgucuccgagaagucccgcuacucccuccaccagaacauggacaagaucaagguccccacccagaucaucuggggcaagcaggaccagguccucgacgucuccggcgccgacaugcucgccaaguccaucgccaacugccaggucgagcuccucgagaacugcggccacuccgucgucauggagcgcccccgcaagaccgccaagcucaucaucgacuuccucgccuccguccacaacaccgacaacaacaagaagcucgacuga

SEQ ID NO: 39251 - RNA, 1446 nt, Artificial Sequence
  derived and/or modified sequence opt2 from ABI1__Homo_sapiens__NP_001012768
auggccgagcuccagaugcuccucgaggaggagauccccuccggcaagcgcgcccucaucgaguccuaccagaaccucacccgcgucgccgacuacugcgagaacaacuacauccaggccaccgacaagcgcaaggcccucgaggagaccaaggccuacaccacccagucccucgccuccgucgccuaccagaucaacgcccucgccaacaacguccuccagcuccucgacauccaggccucccagcuccgccgcauggaguccuccaucaaccacaucucccagaccgucgacauccacaaggagaaggucgcccgccgcgagaucggcauccucaccaccaacaagaacaccucccgcacccacaagaucaucgcccccgccaacauggagcgccccguccgcuacauccgcaagcccaucgacuacaccguccucgacgacgucggccacggcgucaaguggcucaaggccaagcacggcaacaaccagcccgcccgcaccggcacccucucccgcaccaacccccccacccagaagccccccuccccccccauguccggccgcggcacccucggccgcaacacccccuacaagacccucgagcccgucaagccccccaccguccccaacgacuacaugaccucccccgcccgccucggcucccagcacucccccggccgcaccgccucccucaaccagcgcccccgcacccacuccggcuccuccggcggcuccggcucccgcgagaacuccggcuccuccuccaucggcauccccaucgccguccccacccccuccccccccaccaucggccccgccgcccccggcuccgcccccggcucccaguacggcaccaugacccgccagaucucccgccacaacuccaccaccuccuccaccuccuccggcggcuaccgccgcacccccuccgucaccgcccaguucuccgcccagccccacgucaacggcggcccccucuacucccagaacuccaucuccaucgcccccccccccccccccaugccccagcucaccccccagaucccccucaccggcuucgucgcccgcguccaggagaacaucgccgacucccccacccccccccccccccccccccccgacgacauccccauguucgacgacuccccccccccccccccccccccccccgucgacuacgaggacgaggaggccgccgucguccaguacaacgaccccuacgccgacggcgaccccgccugggcccccaagaacuacaucgagaaggucgucgccaucuacgacuacaccaaggacaaggacgacgagcucuccuucauggagggcgccaucaucuacgucaucaagaagaacgacgacggcugguacgagggcgucugcaaccgcgucaccggccucuuccccggcaacuacgucgaguccaucaugcacuacaccgacuga

SEQ ID NO: 39252 - RNA, 1542 nt, Artificial Sequence
  derived and/or modified sequence opt2 from ABI2__Homo_sapiens__NP_001269854
auggccgagcuccagaugcuccucgaggaggagauccccggcggccgccgcgcccucuucgacuccuacaccaaccucgagcgcgucgccgacuacugcgagaacaacuacauccaguccgccgacaagcagcgcgcccucgaggagaccaaggccuacaccacccagucccucgccuccgucgccuaccucaucaacacccucgccaacaacguccuccagaugcucgacauccaggccucccagcuccgccgcauggaguccuccaucaaccacaucucccagaccgucgacauccacaaggagaaggucgcccgccgcgagaucggcauccucaccaccaacaagaacaccucccgcacccacaagaucaucgcccccgccaaccucgagcgccccguccgcuacauccgcaagcccaucgacuacaccauccucgacgacaucggccacggcgucaaguggcuccuccgcuucaaggucuccacccagaacaugaagaugggcggccucccccgcaccaccccccccacccagaagccccccuccccccccauguccggcaagggcacccucggccgccacucccccuaccgcacccucgagcccguccgcccccccgucguccccaacgacuacguccccucccccacccgcaacauggcccccucccagcagucccccguccgcaccgccuccgucaaccagcgcaaccgcaccuacuccuccuccggcuccuccggcggcucccaccccuccucccgcuccuccucccgcgagaacuccggcuccggcuccgucggcguccccaucgccguccccacccccuccccccccuccgucuuccccgcccccgccggcuccgccggcacccccccccuccccgccaccuccgccuccgcccccgccccccucguccccgccaccguccccuccuccaccgcccccgacgccgccgccggcggcgcccagacccucgccgacggcuucaccucccccaccccccccgucgucuccuccaccccccccaccggccaccccguccaguucuacuccaugaaccgccccgccucccgccacaccccccccaccaucggcggcucccuccccuaccgccgcccccccuccaucaccucccagaccucccuccagaaccagaugaacggcggccccuucuacucccagaaccccgucuccgacaccccccccccccccccccccgucgaggagcccgucuucgacgagucccccccccccccccccccccccgaggacuacgaggaggaggaggccgccgucgucgaguacuccgaccccuacgccgaggaggacccccccugggccccccgcuccuaccucgagaaggucgucgccaucuacgacuacaccaaggacaaggaggacgagcucuccuuccaggagggcgccaucaucuacgucaucaagaagaacgacgacggcugguacgagggcgucaugaacggcgucaccggccucuuccccggcaacuacgucgaguccaucaugcacuacuccgaguga

SEQ ID NO: 39253 - RNA, 3228 nt, Artificial Sequence
  derived and/or modified sequence opt2 from ABI3BP__Homo_sapiens__NP_056244
augcgcggcggcaagugcaacaugcucuccucccucggcugccuccuccucugcggcuccaucacccucgcccucggcaacgcccagaagcuccccaagggcaagcgccccaaccucaagguccacaucaacaccaccuccgacuccauccuccucaaguuccuccgccccucccccaacgucaagcucgagggccuccuccucggcuacggcuccaacgucucccccaaccaguacuucccccuccccgccgagggcaaguucaccgaggccaucgucgacgccgagcccaaguaccucaucgucguccgccccgcccccccccccucccagaagaaguccugcuccggcaagacccgcucccgcaagccccuccagcucgucgucggcacccucacccccuccuccgucuuccucuccuggggcuuccucaucaacccccaccacgacuggacccuccccucccacugccccaacgaccgcuucuacaccauccgcuaccgcgagaaggacaaggagaagaaguggaucuuccagaucugccccgccaccgagaccaucgucgagaaccucaagcccaacaccgucuacgaguucggcgucaaggacaacgucgagggcggcaucugguccaagaucuucaaccacaagaccgucgucggcuccaagaaggucaacggcaagauccaguccaccuacgaccaggaccacaccguccccgccuacgucccccgcaagcucauccccaucaccaucaucaagcaggucauccagaacgucacccacaaggacuccgccaagucccccgagaaggccccccucggcggcgucauccucguccaccucaucauccccggccucaacgagaccaccgucaagcuccccgccucccucauguucgagaucuccgacgcccucaagacccagcucgccaagaacgagacccucgcccuccccgccgaguccaagacccccgaggucgagaagaucuccgcccgccccaccaccgucacccccgagaccgucccccgcuccaccaagcccaccaccuccuccgcccucgacgucuccgagaccacccucgccuccuccgagaagcccuggaucguccccaccgccaagaucuccgaggacuccaagguccuccagccccagaccgccaccuacgacgucuucuccucccccaccaccuccgacgagcccgagaucuccgacuccuacaccgccaccuccgaccgcauccucgacuccaucccccccaagaccucccgcacccucgagcagccccgcgccacccucgcccccuccgagacccccuucgucccccagaagcucgagaucuucaccucccccgagaugcagcccaccacccccgccccccagcagaccaccuccauccccuccacccccaagcgccgcccccgccccaagcccccccgcaccaagcccgagcgcaccaccuccgccggcaccaucacccccaagaucuccaagucccccgagcccaccuggaccacccccgcccccggcaagacccaguucaucucccucaagcccaagaucccccucucccccgaggucacccacaccaagcccgcccccaagcagaccccccgcgccccccccaagcccaagaccuccccccgcccccgcaucccccagacccagcccguccccaaggucccccagcgcgucaccgccaagcccaagaccucccccucccccgaggucuccuacaccacccccgcccccaaggacguccuccucccccacaagcccuaccccgaggucucccaguccgagcccgccccccucgagacccgcggcauccccuucauccccaugaucucccccucccccucccaggaggagcuccagaccacccucgaggagaccgaccaguccacccaggagcccuucaccaccaagaucccccgcaccaccgagcucgccaagaccacccaggccccccaccgcuucuacaccaccguccgcccccgcaccuccgacaagccccacauccgccccggcgucaagcaggccccccgccccuccggcgccgaccgcaacgucuccgucgacuccacccaccccaccaagaagcccggcacccgccgccccccccuccccccccgccccacccacccccgccgcaagccccucccccccaacaacgucaccggcaagcccggcuccgccggcaucaucuccuccggccccaucaccacccccccccuccgcuccaccccccgccccaccggcaccccccucgagcgcaucgagaccgacaucaagcagcccaccguccccgccuccggcgaggagcucgagaacaucaccgacuucuccuccucccccacccgcgagaccgacccccucggcaagccccgcuucaagggcccccacguccgcuacauccagaagcccgacaacucccccugcuccaucaccgacuccgucaagcgcuuccccaaggaggaggccaccgagggcaacgccaccucccccccccagaacccccccaccaaccucaccgucgucaccgucgagggcugccccuccuucgucauccucgacugggagaagccccucaacgacaccgucaccgaguacgaggucaucucccgcgagaacggcuccuucuccggcaagaacaaguccauccagaugaccaaccagaccuucuccaccgucgagaaccucaagcccaacaccuccuacgaguuccaggucaagcccaagaacccccucggcgagggccccgucuccaacaccgucgccuucuccaccgaguccgccgacccccgcgucuccgagcccgucuccgccggccgcgacgccaucuggaccgagcgccccuucaacuccgacuccuacuccgagugcaagggcaagcaguacgucaagcgcaccugguacaagaaguucgucggcguccagcucugcaacucccuccgcuacaagaucuaccucuccgacucccucaccggcaaguucuacaacaucggcgaccagcgcggccacggcgaggaccacugccaguucgucgacuccuuccucgacggccgcaccggccagcagcucaccuccgaccagcuccccaucaaggagggcuacuuccgcgccguccgccaggagcccguccaguucggcgagaucggcggccacacccagaucaacuacguccagugguacgagugcggcaccaccauccccggcaagugguga

SEQ ID NO: 39254 - RNA, 1083 nt, Artificial Sequence
  derived and/or modified sequence opt2 from ABI3__Homo_sapiens__NP_001128658
auggccgagcuccagcagcuccaggaguucgagauccccaccggccgcgaggcccuccgcggcaaccacuccgcccuccuccgcgucgccgacuacugcgaggacaacuacguccaggccaccgacaagcgcaaggcccucgaggagaccauggccuucaccacccaggcccucgccuccgucgccuaccaggucggcaaccucgccggccacacccuccgcaugcucgaccuccagggcgccgcccuccgccaggucgaggcccgcauggucaacaugcacauggagaaggucgcccgccgcgagaucggcacccucgccaccguccagcgccucccccccggccagaaggucaucgcccccgagaaccuccccccccucacccccuacugccgccgcccccucaacuucggcugccucgacgacaucggccacggcaucaaggaccucuccacccagcucucccgcaccggcacccucucccgcaaguccaucaaggcccccgccacccccgccuccgccacccucggccgccccccccgcauccccgagcccguccaccuccccgucguccccgacggccgccucuccgccgccuccuccgccuccucccucgccuccgccggcuccgccgagggcgucggcggcgcccccacccccaagggccaggccgccccccccgcccccccccuccccuccucccucgaccccccccccccccccgccgccgucgaggucuuccagcgcccccccacccucgaggagcucuccccccccccccccgacgaggagcucccccucccccucgaccucccccccccccccccccucgacggcgacgagcucggccuccccccccccccccccggcuucggccccgacgagcccuccuggguccccgccuccuaccucgagaaggucgucacccucuaccccuacaccucccagaaggacaacgagcucuccuucuccgagggcaccgucaucugcgucacccgccgcuacuccgacggcuggugcgagggcgucuccuccgagggcaccggcuucuuccccggcaacuacgucgagcccuccugcuga

SEQ ID NO: 39255 - RNA, 3393 nt, Artificial Sequence
  derived and/or modified sequence opt2 from ABL1__Homo_sapiens__NP_005148
augcucgagaucugccucaagcucgucggcugcaaguccaagaagggccucuccuccuccuccuccugcuaccucgaggaggcccuccagcgccccgucgccuccgacuucgagccccagggccucuccgaggccgcccgcuggaacuccaaggagaaccuccucgccggccccuccgagaacgaccccaaccucuucgucgcccucuacgacuucgucgccuccggcgacaacacccucuccaucaccaagggcgagaagcuccgcguccucggcuacaaccacaacggcgaguggugcgaggcccagaccaagaacggccagggcuggguccccuccaacuacaucacccccgucaacucccucgagaagcacuccugguaccacggccccgucucccgcaacgccgccgaguaccuccucuccuccggcaucaacggcuccuuccucguccgcgaguccgaguccucccccggccagcgcuccaucucccuccgcuacgagggccgcgucuaccacuaccgcaucaacaccgccuccgacggcaagcucuacgucuccuccgagucccgcuucaacacccucgccgagcucguccaccaccacuccaccgucgccgacggccucaucaccacccuccacuaccccgcccccaagcgcaacaagcccaccgucuacggcgucucccccaacuacgacaagugggagauggagcgcaccgacaucaccaugaagcacaagcucggcggcggccaguacggcgaggucuacgagggcgucuggaagaaguacucccucaccgucgccgucaagacccucaaggaggacaccauggaggucgaggaguuccucaaggaggccgccgucaugaaggagaucaagcaccccaaccucguccagcuccucggcgucugcacccgcgagccccccuucuacaucaucaccgaguucaugaccuacggcaaccuccucgacuaccuccgcgagugcaaccgccaggaggucaacgccgucguccuccucuacauggccacccagaucuccuccgccauggaguaccucgagaagaagaacuucauccaccgcgaccucgccgcccgcaacugccucgucggcgagaaccaccucgucaaggucgccgacuucggccucucccgccucaugaccggcgacaccuacaccgcccacgccggcgccaaguuccccaucaaguggaccgcccccgagucccucgccuacaacaaguucuccaucaaguccgacgucugggccuucggcguccuccucugggagaucgccaccuacggcaugucccccuaccccggcaucgaccucucccaggucuacgagcuccucgagaaggacuaccgcauggagcgccccgagggcugccccgagaaggucuacgagcucaugcgcgccugcuggcaguggaaccccuccgaccgccccuccuucgccgagauccaccaggccuucgagaccauguuccaggaguccuccaucuccgacgaggucgagaaggagcucggcaagcagggcguccgcggcgccgucuccacccuccuccaggcccccgagcuccccaccaagacccgcaccucccgccgcgccgccgagcaccgcgacaccaccgacguccccgagaugccccacuccaagggccagggcgaguccgacccccucgaccacgagcccgccgucuccccccuccucccccgcaaggagcgcggcccccccgagggcggccucaacgaggacgagcgccuccuccccaaggacaagaagaccaaccucuucuccgcccucaucaagaagaagaagaagaccgcccccaccccccccaagcgcuccuccuccuuccgcgagauggacggccagcccgagcgccgcggcgccggcgaggaggagggccgcgacaucuccaacggcgcccucgccuucaccccccucgacaccgccgaccccgccaagucccccaagcccuccaacggcgccggcguccccaacggcgcccuccgcgaguccggcggcuccggcuuccgcuccccccaccucuggaagaaguccuccacccucaccuccucccgccucgccaccggcgaggaggagggcggcggcuccuccuccaagcgcuuccuccgcuccugcuccgccuccugcgucccccacggcgccaaggacaccgaguggcgcuccgucacccucccccgcgaccuccaguccaccggccgccaguucgacuccuccaccuucggcggccacaaguccgagaagcccgcccucccccgcaagcgcgccggcgagaaccgcuccgaccaggucacccgcggcaccgucaccccccccccccgccucgucaagaagaacgaggaggccgccgacgaggucuucaaggacaucauggaguccucccccggcuccuccccccccaaccucacccccaagccccuccgccgccaggucaccgucgcccccgccuccggccucccccacaaggaggaggccggcaagggcuccgcccucggcacccccgccgccgccgagcccgucacccccaccuccaaggccggcuccggcgcccccggcggcaccuccaagggccccgccgaggagucccgcguccgccgccacaagcacuccuccgagucccccggccgcgacaagggcaagcucucccgccucaagcccgcccccccccccccccccgccgccuccgccggcaaggccggcggcaagcccucccagucccccucccaggaggccgccggcgaggccguccucggcgccaagaccaaggccaccucccucgucgacgccgucaacuccgacgccgccaagcccucccagcccggcgagggccucaagaagcccguccuccccgccacccccaagccccaguccgccaagcccuccggcacccccaucucccccgcccccguccccuccacccuccccuccgccuccuccgcccucgccggcgaccagcccuccuccaccgccuucaucccccucaucuccacccgcgucucccuccgcaagacccgccagccccccgagcgcaucgccuccggcgccaucaccaagggcgucguccucgacuccaccgaggcccucugccucgccaucucccgcaacuccgagcagauggccucccacuccgccguccucgaggccggcaagaaccucuacaccuucugcgucuccuacgucgacuccauccagcagaugcgcaacaaguucgccuuccgcgaggccaucaacaagcucgagaacaaccuccgcgagcuccagaucugccccgccaccgccggcuccggccccgccgccacccaggacuucuccaagcuccucuccuccgucaaggagaucuccgacaucguccagcgcuga

SEQ ID NO: 39256 - RNA, 3195 nt, Artificial Sequence
  derived and/or modified sequence opt2 from ABL2__Homo_sapiens__NP_001129472
augguccucggcaccguccuccucccccccaacuccuacggccgcgaccaggacaccucccucugcugccucugcaccgaggccuccgaguccgcccuccccgaccucaccgaccacuucgccuccugcgucgaggacggcuucgagggcgacaagaccggcggcuccucccccgaggcccuccaccgccccuacggcugcgacgucgagccccaggcccucaacgaggccauccgcugguccuccaaggagaaccuccucggcgccaccgaguccgaccccaaccucuucgucgcccucuacgacuucgucgccuccggcgacaacacccucuccaucaccaagggcgagaagcuccgcguccucggcuacaaccagaacggcgagugguccgagguccgcuccaagaacggccagggcuggguccccuccaacuacaucacccccgucaacucccucgagaagcacuccugguaccacggccccgucucccgcuccgccgccgaguaccuccucuccucccucaucaacggcuccuuccucguccgcgaguccgaguccucccccggccagcucuccaucucccuccgcuacgagggccgcgucuaccacuaccgcaucaacaccaccgccgacggcaaggucuacgucaccgccgagucccgcuucuccacccucgccgagcucguccaccaccacuccaccgucgccgacggccucgucaccacccuccacuaccccgcccccaagugcaacaagcccaccgucuacggcgucucccccauccacgacaagugggagauggagcgcaccgacaucaccaugaagcacaagcucggcggcggccaguacggcgaggucuacgucggcgucuggaagaaguacucccucaccgucgccgucaagacccucaaggaggacaccauggaggucgaggaguuccucaaggaggccgccgucaugaaggagaucaagcaccccaaccucguccagcuccucggcgucugcacccucgagccccccuucuacaucgucaccgaguacaugcccuacggcaaccuccucgacuaccuccgcgagugcaaccgcgaggaggucaccgccgucguccuccucuacauggccacccagaucuccuccgccauggaguaccucgagaagaagaacuucauccaccgcgaccucgccgcccgcaacugccucgucggcgagaaccacgucgucaaggucgccgacuucggccucucccgccucaugaccggcgacaccuacaccgcccacgccggcgccaaguuccccaucaaguggaccgcccccgagucccucgccuacaacaccuucuccaucaaguccgacgucugggccuucggcguccuccucugggagaucgccaccuacggcaugucccccuaccccggcaucgaccucucccaggucuacgaccuccucgagaagggcuaccgcauggagcagcccgagggcugcccccccaaggucuacgagcucaugcgcgccugcuggaaguggucccccgccgaccgccccuccuucgccgagacccaccaggccuucgagaccauguuccacgacuccuccaucuccgaggaggucgccgaggagcucggccgcgccgccuccuccuccuccgucguccccuaccucccccgccuccccauccuccccuccaagacccgcacccucaagaagcaggucgagaacaaggagaacaucgagggcgcccaggacgccaccgagaacuccgccuccucccucgcccccggcuucauccgcggcgcccaggccuccuccggcucccccgcccucccccgcaagcagcgcgacaagucccccuccucccuccucgaggacgccaaggagaccugcuucacccgcgaccgcaagggcggcuucuucuccuccuucaugaagaagcgcaacgcccccaccccccccaagcgcuccuccuccuuccgcgagauggagaaccagccccacaagaaguacgagcucaccggccuccccgagcaggaccgcauggccaugacccucccccgcaacugccagcgcuccaagcuccagcucgagcgcaccgucuccaccuccucccagcccgaggagaacgucgaccgcgccaacgacaugcuccccaagaaguccgaggaguccgccgcccccucccgcgagcgccccaaggccaagcuccucccccgcggcgccaccgcccucccccuccgcacccccuccggcgaccucgccaucaccgagaaggacccccccggcgucggcgucgccggcgucgccgccgcccccaagggcaaggagaagaacggcggcgcccgccucggcauggccggcguccccgaggacggcgagcagcccggcuggcccucccccgccaaggccgcccccguccuccccaccacccacaaccacaagguccccguccucaucucccccacccucaagcacacccccgccgacguccagcucaucggcaccgacucccagggcaacaaguucaagcuccucuccgagcaccaggucaccuccuccggcgacaaggaccgcccccgccgcgucaagcccaagugcgcccccccccccccccccgucaugcgccuccuccagcaccccuccaucugcuccgaccccaccgaggagcccaccgcccucaccgccggccaguccaccuccgagacccaggagggcggcaagaaggccgcccucggcgccguccccaucuccggcaaggccggccgccccgucaugccccccccccaggucccccuccccaccuccuccaucucccccgccaagauggccaacggcaccgccggcaccaaggucgcccuccgcaagaccaagcaggccgccgagaagaucuccgccgacaagaucuccaaggaggcccuccucgagugcgccgaccuccucuccuccgcccucaccgagcccguccccaacucccagcucgucgacaccggccaccagcuccucgacuacugcuccggcuacgucgacugcaucccccagacccgcaacaaguucgccuuccgcgaggccgucuccaagcucgagcucucccuccaggagcuccaggucuccuccgccgccgccggcguccccggcaccaaccccguccucaacaaccuccucuccugcguccaggagaucuccgacgucguccagcgcuga

SEQ ID NO: 39257 - RNA, 2157 nt, Artificial Sequence
  derived and/or modified sequence opt2 from ABLIM1__Homo_sapiens__NP_001003407
augcucaugacccucgagaugaccgagcucaccgacccccaccacaccaugggcgacuacaaggucgcccacccccaggacccccaccaccccuccgagaagcccgucauccacugccacaagugcggcgagcccugcaagggcgagguccuccgcguccagaccaagcacuuccacaucaagugcuucaccugcaaggucugcggcugcgaccucgcccagggcggcuucuucaucaagaacggcgaguaccucugcacccucgacuaccagcgcauguacggcacccgcugccacggcugcggcgaguucgucgagggcgaggucgucaccgcccucggcaagaccuaccaccccaacugcuucgccugcaccaucugcaagcgccccuucccccccggcgaccgcgucaccuucaacggccgcgacugccucugccagcucugcgcccagcccauguccuccucccccaaggagaccaccuucuccuccaacugcgccggcugcggccgcgacaucaagaacggccaggcccuccucgcccucgacaagcaguggcaccucggcugcuucaagugcaaguccugcggcaagguccucaccggcgaguacaucuccaaggacggcgcccccuacugcgagaaggacuaccagggccucuucggcgucaagugcgaggccugccaccaguucaucaccggcaagguccucgaggccggcgacaagcacuaccaccccuccugcgcccgcugcucccgcugcaaccagauguucaccgagggcgaggagauguaccuccagggcuccaccgucuggcaccccgacugcaagcaguccaccaagaccgaggagaagcuccgccccacccgcaccuccuccgaguccaucuacucccgccccggcuccuccauccccggcucccccggccacaccaucuacgccaaggucgacaacgagauccucgacuacaaggaccucgccgccauccccaaggucaaggccaucuacgacaucgagcgccccgaccucaucaccuacgagcccuucuacaccuccggcuacgacgacaagcaggagcgccagucccucggcgaguccccccgcacccucucccccacccccuccgccgagggcuaccaggacguccgcgaccgcaugauccaccgcuccaccucccagggcuccaucaacucccccgucuacucccgccacuccuacacccccaccaccucccgcuccccccagcacuuccaccgccccggcaacgagcccuccuccggccgcaacuccccccuccccuaccgccccgacucccgcccccucacccccaccuacgcccaggcccccaagcacuuccacguccccgaccagggcaucaacaucuaccgcaagccccccaucuacaagcagcacgccgcccucgccgcccaguccaaguccuccgaggacaucaucaaguucuccaaguuccccgccgcccaggcccccgaccccuccgagacccccaagaucgagaccgaccacuggcccggcccccccuccuucgccgucgucggccccgacaugaagcgccgcuccuccggccgcgaggaggacgacgaggagcuccuccgccgccgccagcuccaggaggagcagcucaugaagcucaacuccggccucggccagcucauccucaaggaggagauggagaaggagucccgcgagcgcuccucccuccucgccucccgcuacgacucccccaucaacuccgccucccacauccccuccuccaagaccgccucccuccccggcuacggccgcaacggccuccaccgccccgucuccaccgacuucgcccaguacaacuccuacggcgacgucuccggcggcguccgcgacuaccagacccuccccgacggccacaugcccgccaugcgcauggaccgcggcgucuccaugcccaacaugcucgagcccaagaucuuccccuacgagaugcucauggucaccaaccgcggccgcaacaagauccuccgcgaggucgaccgcacccgccucgagcgccaccucgcccccgaggucuuccgcgagaucuucggcauguccauccaggaguucgaccgccucccccucuggcgccgcaacgacaugaagaagaaggccaagcucuucuga

SEQ ID NO: 39258 - RNA, 1938 nt, Artificial Sequence
  derived and/or modified sequence opt2 from ABLIM2__Homo_sapiens__NP_001123555
auguccgccgucucccagccccaggccgcccccuccccccucgagaagucccccuccaccgccauccucugcaacaccugcggcaacgucugcaagggcgagguccuccgcguccaggacaaguacuuccacaucaagugcuucgucugcaaggccugcggcugcgaccucgccgagggcggcuucuucguccgccagggcgaguacaucugcacccucgacuaccagcgccucuacggcacccgcugcuucuccugcgaccaguucaucgagggcgaggucgucuccgcccucggcaagaccuaccaccccgacugcuucgucugcgccgucugccgccuccccuucccccccggcgaccgcgucaccuucaacggcaaggagugcaugugccagaagugcucccuccccgucuccgucggcuccuccgcccaccucucccagggccuccgcuccugcggcggcugcggcaccgagaucaagaacggccaggcccucgucgcccucgacaagcacuggcaccucggcugcuucaagugcaaguccugcggcaagcuccucaacgccgaguacaucuccaaggacggccuccccuacugcgaggccgacuaccacgccaaguucggcauccgcugcgacuccugcgagaaguacaucaccggccgcguccucgaggccggcgagaagcacuaccaccccuccugcgcccucugcguccgcugcggccagauguucgccgagggcgaggagauguaccuccagggcuccuccaucuggcaccccgccugccgccaggccgcccgcaccgaggaccgcaacaaggagacccgcaccuccuccgaguccaucaucuccguccccgccuccuccaccuccggcucccccucccgcgucaucuacgccaagcucggcggcgagauccucgacuaccgcgaccucgccgcccuccccaaguccaaggccaucuacgacaucgaccgccccgacaugaucuccuacucccccuacaucucccacuccgccggcgaccgccaguccuacggcgagggcgaccaggacgaccgcuccuacaagcagugccgcaccuccucccccuccuccaccggcuccgucucccucggccgcuacacccccaccucccgcuccccccagcacuacucccgccccgccggcaccgucuccgucggcaccuccuccugccucucccucucccagcaccccucccccaccuccgucuuccgccaccacuacauccccuacuuccgcggcuccgaguccggccgcuccacccccucccucuccguccucuccgacuccaagcccccccccuccaccuaccagcaggccccccgccacuuccacguccccgacaccggcgucaaggacaacaucuaccgcaagccccccaucuaccgccagcacgccgcccgccgcuccgacggcgaggacggcucccucgaccaggacaaccgcaagcagaaguccuccuggcucaugcucaagggcgacgccgacacccgcaccaacucccccgaccucgacacccagucccucucccacuccuccggcaccgaccgcgacccccuccagcgcauggccggcgacuccuuccacucccgcuuccccuacuccaaguccgacccccuccccggccacggcaagaacggccucgaccagcgcaacgccaaccucgcccccugcggcgccgaccccgacgccuccuggggcaugcgcgaguacaagaucuaccccuacgacucccucaucgucaccaaccgcauccgcgucaagcuccccaaggacgucgaccgcacccgccucgagcgccaccucucccccgaggaguuccaggaggucuucggcauguccaucgaggaguucgaccgccucgcccucuggaagcgcaacgaccucaagaagaaggcccuccucuucuga

SEQ ID NO: 39259 - RNA, 1065 nt, Artificial Sequence
  derived and/or modified sequence opt2 from ABO__Homo_sapiens__NP_065202
auggccgagguccuccgcacccucgccggcaagcccaagugccacgcccuccgccccaugauccucuuccucaucaugcucguccucguccucuucggcuacggcguccucuccccccgcucccucaugcccggcucccucgagcgcggcuucugcauggccguccgcgagcccgaccaccuccagcgcgucucccucccccgcauggucuacccccagcccaagguccucacccccugccgcaaggacguccucgucgucacccccuggcucgcccccaucgucugggagggcaccuucaacaucgacauccucaacgagcaguuccgccuccagaacaccaccaucggccucaccgucuucgccaucaagaaguacgucgccuuccucaagcucuuccucgagaccgccgagaagcacuucauggucggccaccgcguccacuacuacgucuucaccgaccagcccgccgccgucccccgcgucacccucggcaccggccgccagcucuccguccucgagguccgcgccuacaagcgcuggcaggacgucuccaugcgccgcauggagaugaucuccgacuucugcgagcgccgcuuccucuccgaggucgacuaccucgucugcgucgacgucgacauggaguuccgcgaccacgucggcgucgagauccucaccccccucuucggcacccuccaccccggcuucuacggcuccucccgcgaggccuucaccuacgagcgccgcccccagucccaggccuacauccccaaggacgagggcgacuucuacuaccucggcggcuucuucggcggcuccguccaggagguccagcgccucacccgcgccugccaccaggccaugauggucgaccaggccaacggcaucgaggccgucuggcacgacgagucccaccucaacaaguaccuccuccgccacaagcccaccaagguccucucccccgaguaccucugggaccagcagcuccucggcuggcccgccguccuccgcaagcuccgcuucaccgccguccccaagaaccaccaggccguccgcaaccccuga

SEQ ID NO: 39260 - RNA, 1146 nt, Artificial Sequence
  derived and/or modified sequence opt2 from ABRA__Homo_sapiens__NP_631905
auggcccccggcgagaaggaguccggcgagggccccgccaaguccgcccuccgcaagauccgcaccgccacccucgucaucucccucgcccgcggcuggcagcagugggccaacgagaacuccauccgccaggcccaggagcccaccggcuggcuccccggcggcacccaggacuccccccaggcccccaagcccaucaccccccccaccucccaccagaaggcccaguccgcccccaagucccccccccgccuccccgagggccacggcgacggccaguccuccgagaaggcccccgaggucucccacaucaagaagaaggaggucuccaagaccgucgucuccaagaccuacgagcgcggcggcgacgucucccaccucucccaccgcuacgagcgcgacgccggcguccucgagcccggccagcccgagaacgacaucgaccgcauccuccacucccacggcucccccacccgccgccgcaagugcgccaaccucgucuccgagcucaccaagggcuggcgcgucauggagcaggaggagcccaccuggcgcuccgacuccgucgacaccgaggacuccggcuacggcggcgaggccgaggagcgccccgagcaggacggcguccaggucgccgucguccgcaucaagcgcccccuccccucccaggucaaccgcuucaccgagaagcucaacugcaaggcccagcagaaguacucccccgucggcaaccucaagggccgcuggcagcagugggccgacgagcacauccagucccagaagcucaaccccuucuccgaggaguucgacuacgagcucgccauguccacccgccuccacaagggcgacgagggcuacggccgccccaaggagggcaccaagaccgccgagcgcgccaagcgcgccgaggagcacaucuaccgcgagaugauggacaugugcuucaucaucugcaccauggcccgccaccgccgcgacggcaagauccaggucaccuucggcgaccucuucgaccgcuacguccgcaucuccgacaaggucgucggcauccucaugcgcgcccgcaagcacggccucgucgacuucgagggcgagaugcucuggcagggccgcgacgaccacgucgucaucacccuccucaaguga

SEQ ID NO: 39261 - RNA, 2442 nt, Artificial Sequence
  derived and/or modified sequence opt2 from ABR__Homo_sapiens__NP_001153218
augcccuacaucgacgagucccccaccauguccccccagcucuccgcccgcucccagggcggcggcgacggcgucucccccaccccccccgagggccucgcccccggcgucgaggccggcaagggccucgagaugcgcaagcucguccucuccggcuuccucgccuccgaggagaucuacaucaaccagcucgaggcccuccuccuccccaugaagccccucaaggccaccgccaccaccucccagcccguccucaccauccagcagaucgagaccaucuucuacaagauccaggacaucuacgagauccacaaggaguucuacgacaaccucugccccaagguccagcagugggacucccaggucaccaugggccaccucuuccagaagcucgccucccagcucggcgucuacaaggccuucgucgacaacuacaaggucgcccucgagaccgccgagaagugcucccaguccaacaaccaguuccagaagaucuccgaggagcucaaggucaagggccccaaggacuccaaggacucccacaccuccgucaccauggaggcccuccucuacaagcccaucgaccgcgucacccgcuccacccucguccuccacgaccuccucaagcacacccccgucgaccaccccgacuacccccuccuccaggacgcccuccgcaucucccagaacuuccucuccuccaucaacgaggacaucgacccccgccgcaccgccgucaccacccccaagggcgagacccgccagcucgucaaggacggcuuccucgucgaggucuccgaguccucccgcaagcuccgccacgucuuccucuucaccgacguccuccucugcgccaagcucaagaagaccuccgccggcaagcaccagcaguacgacugcaagugguacaucccccucgccgaccucgucuuccccucccccgaggaguccgaggccuccccccagguccaccccuuccccgaccacgagcucgaggacaugaagaugaagaucuccgcccucaaguccgagauccagaaggagaaggccaacaagggccagucccgcgccaucgagcgccucaagaagaagauguucgagaacgaguuccuccuccuccucaacucccccaccauccccuuccgcauccacaaccgcaacggcaaguccuaccucuuccuccucuccuccgacuacgagcgcuccgaguggcgcgaggccauccagaagcuccagaagaaggaccuccaggccuucguccucuccuccgucgagcuccagguccucaccggcuccugcuucaagcuccgcaccguccacaacauccccgucaccuccaacaaggacgacgacgagucccccggccucuacggcuuccuccacgucaucguccacuccgccaagggcuucaagcaguccgccaaccucuacugcacccucgaggucgacuccuucggcuacuucgucuccaaggccaagacccgcgucuuccgcgacaccgccgagcccaagugggacgaggaguucgagaucgagcucgagggcucccagucccuccgcauccucugcuacgagaagugcuacgacaagaccaaggucaacaaggacaacaacgagaucgucgacaagaucaugggcaagggccagauccagcucgacccccagaccgucgagaccaagaacuggcacaccgacgucaucgagaugaacggcaucaaggucgaguucuccaugaaguucaccucccgcgacaugucccucaagcgcacccccuccaagaagcagaccggcgucuucggcgucaagaucuccgucgucaccaagcgcgagcgcuccaagguccccuacaucguccgccagugcgucgaggaggucgagaagcgcggcaucgaggaggucggcaucuaccgcaucuccggcgucgccaccgacauccaggcccucaaggccgucuucgacgccaacaacaaggacauccuccucaugcucuccgacauggacaucaacgccaucgccggcacccucaagcucuacuuccgcgagcuccccgagccccuccucaccgaccgccucuaccccgccuucauggagggcaucgcccucuccgaccccgccgccaaggagaacugcaugaugcaccuccuccgcucccuccccgaccccaaccucaucaccuuccucuuccuccucgagcaccucaagcgcgucgccgagaaggagcccaucaacaagaugucccuccacaaccucgccaccgucuucggccccacccuccuccgccccuccgaggucgaguccaaggcccaccucaccuccgccgccgacaucuggucccacgacgucauggcccagguccagguccuccucuacuaccuccagcacccccccaucuccuucgccgagcucaagcgcaacacccucuacuucuccaccgacgucuga

SEQ ID NO: 39262 - RNA, 819 nt, Artificial Sequence
  derived and/or modified sequence opt2 from ABT1__Homo_sapiens__NP_037507
auggaggccgaggaguccgagaaggccgccaccgagcaggagccccucgagggcaccgagcagacccucgacgccgaggaggagcaggaggaguccgaggaggccgccugcggcuccaagaagcgcgucguccccggcaucgucuaccucggccacauccccccccgcuuccgcccccuccacguccgcaaccuccucuccgccuacggcgaggucggccgcgucuucuuccaggccgaggaccgcuucguccgccgcaagaagaaggccgccgccgccgccggcggcaagaagcgcuccuacaccaaggacuacaccgagggcugggucgaguuccgcgacaagcgcaucgccaagcgcgucgccgccucccuccacaacacccccaugggcgcccgccgccgcucccccuuccgcuacgaccucuggaaccucaaguaccuccaccgcuucaccuggucccaccucuccgagcaccucgccuucgagcgccagguccgccgccagcgccuccgcgccgaggucgcccaggccaagcgcgagaccgacuucuaccuccaguccgucgagcgcggccagcgcuuccucgccgccgacggcgaccccgcccgccccgacggcuccuggaccuucgcccagcgccccaccgagcaggagcuccgcgcccgcaaggccgcccgccccggcggccgcgagcgcgcccgccucgccaccgcccaggacaaggcccgcuccaacaagggccuccucgcccgcaucuucggcgcccccccccccuccgaguccauggagggccccucccucguccgcgacuccuga

SEQ ID NO: 39263 - RNA, 996 nt, Artificial Sequence
  derived and/or modified sequence opt2 from ACAA1__Homo_sapiens__NP_001123882
augcagcgccuccaggucguccucggccaccuccgcggccccgccgacuccggcuggaugccccaggccgcccccugccucuccggcgccccccaggccuccgccgccgacgucgucgucguccacggccgccgcaccgccaucugccgcgccggccgcggcggcuucaaggacaccacccccgacgagcuccucuccgccgucaugaccgccguccucaaggacgucaaccuccgccccgagcagcucggcgacaucugcgucggcaacguccuccagcccggcgccggcgccaucauggcccgcaucgcccaguuccucuccgacauccccgagaccgucccccucuccaccgucaaccgccagugcuccuccggccuccaggccgucgccuccaucgccggcggcauccgcaacggcuccuacgacaucggcauggccugcggcaucaccuccgagaacgucgccgagcgcuucggcaucucccgcgagaagcaggacaccuucgcccucgccucccagcagaaggccgcccgcgcccaguccaagggcugcuuccaggccgagaucguccccgucaccaccaccguccacgacgacaagggcaccaagcgcuccaucaccgucacccaggacgagggcauccgccccuccaccaccauggagggccucgccaagcucaagcccgccuucaagaaggacggcuccaccaccgccggccucaccgucuccgacgucgacaucuucgagaucaacgaggccuucgccucccaggccgccuacugcgucgagaagcuccgccucccccccgagaaggucaacccccucggcggcgccgucgcccucggccacccccucggcugcaccggcgcccgccaggucaucacccuccucaacgagcucaagcgccgcggcaagcgcgccuacggcgucgucuccaugugcaucggcaccggcaugggcgccgccgccgucuucgaguaccccggcaacuga

SEQ ID NO: 39264 - RNA, 1194 nt, Artificial Sequence
  derived and/or modified sequence opt2 from ACAA2__Homo_sapiens__NP_006102
auggcccuccuccgcggcgucuucgucgucgccgccaagcgcacccccuucggcgccuacggcggccuccucaaggacuucaccgccaccgaccucuccgaguucgccgccaaggccgcccucuccgccggcaaggucucccccgagaccgucgacuccgucaucaugggcaacguccuccaguccuccuccgacgccaucuaccucgcccgccacgucggccuccgcgucggcauccccaaggagacccccgcccucaccaucaaccgccucugcggcuccggcuuccaguccaucgucaacggcugccaggagaucugcgucaaggaggccgaggucguccucugcggcggcaccgaguccaugucccaggcccccuacugcguccgcaacguccgcuucggcaccaagcucggcuccgacaucaagcucgaggacucccucugggucucccucaccgaccagcacguccagcuccccauggccaugaccgccgagaaccucgccgucaagcacaagaucucccgcgaggagugcgacaaguacgcccuccagucccagcagcgcuggaaggccgccaacgacgccggcuacuucaacgacgagauggcccccaucgaggucaagaccaagaagggcaagcagaccaugcaggucgacgagcacgcccgcccccagaccacccucgagcagcuccagaagcucccccccgucuucaagaaggacggcaccgucaccgccggcaacgccuccggcgucgccgacggcgccggcgccgucaucaucgccuccgaggacgccgucaagaagcacaacuucaccccccucgcccgcaucgucggcuacuucgucuccggcugcgaccccuccaucaugggcaucggccccguccccgccaucuccggcgcccucaagaaggccggccucucccucaaggacauggaccucgucgaggucaacgaggccuucgccccccaguaccucgccgucgagcgcucccucgaccucgacaucuccaagaccaacgucaacggcggcgccaucgcccucggccacccccucggcggcuccggcucccgcaucaccgcccaccucguccacgagcuccgccgccgcggcggcaaguacgccgucggcuccgccugcaucggcggcggccagggcaucgccgucaucauccaguccaccgccuga

SEQ ID NO: 39265 - RNA, 7152 nt, Artificial Sequence
  derived and/or modified sequence opt2 from ACACA__Homo_sapiens__NP_942131
auguggugguccacccucauguccauccuccgcgcccgcuccuucuggaaguggaucuccacccagaccguccgcaucauccgcgccguccgcgcccacuucggcggcaucauggacgagcccuccccccucgcccagccccucgagcucaaccagcacucccgcuucaucaucggcuccgucuccgaggacaacuccgaggacgagaucuccaaccucgucaagcucgaccuccucgaggagaaggagggcucccucucccccgccuccgucggcuccgacacccucuccgaccucggcaucuccucccuccaggacggccucgcccuccacauccgcuccuccauguccggccuccaccucgucaagcagggccgcgaccgcaagaagaucgacucccagcgcgacuucaccgucgccucccccgccgaguucgucacccgcuucggcggcaacaaggucaucgagaagguccucaucgccaacaacggcaucgccgccgucaagugcaugcgcuccauccgccgcugguccuacgagauguuccgcaacgagcgcgccauccgcuucgucgucauggucacccccgaggaccucaaggccaacgccgaguacaucaagauggccgaccacuacguccccguccccggcggccccaacaacaacaacuacgccaacgucgagcucauccucgacaucgccaagcgcauccccguccaggccgucugggccggcuggggccacgccuccgagaaccccaagcuccccgagcuccuccucaagaacggcaucgccuucaugggcccccccucccaggccaugugggcccucggcgacaagaucgccuccuccaucgucgcccagaccgccggcauccccacccuccccugguccggcuccggccuccgcgucgacuggcaggagaacgacuucuccaagcgcauccucaacgucccccaggagcucuacgagaagggcuacgucaaggacgucgacgacggccuccaggccgccgaggaggucggcuaccccgucaugaucaaggccuccgagggcggcggcggcaagggcauccgcaaggucaacaacgccgacgacuuccccaaccucuuccgccagguccaggccgagguccccggcucccccaucuucgucaugcgccucgccaagcagucccgccaccucgagguccagauccucgccgaccaguacggcaacgccaucucccucuucggccgcgacugcuccguccagcgccgccaccagaagaucaucgaggaggcccccgccaccaucgccacccccgccgucuucgagcacauggagcagugcgccgucaagcucgccaagauggucggcuacgucuccgccggcaccgucgaguaccucuacucccaggacggcuccuucuacuuccucgagcucaacccccgccuccaggucgagcaccccugcaccgagauggucgccgacgucaaccuccccgccgcccagcuccagaucgccaugggcaucccccucuaccgcaucaaggacauccgcaugauguacggcgucucccccuggggcgacucccccaucgacuucgaggacuccgcccacguccccugcccccgcggccacgucaucgccgcccgcaucaccuccgagaaccccgacgagggcuucaagcccuccuccggcaccguccaggagcucaacuuccgcuccaacaagaacgucuggggcuacuucuccgucgccgccgccggcggccuccacgaguucgccgacucccaguucggccacugcuucuccuggggcgagaaccgcgaggaggccaucuccaacauggucgucgcccucaaggagcucuccauccgcggcgacuuccgcaccaccgucgaguaccucaucaagcuccucgagaccgaguccuuccagaugaaccgcaucgacaccggcuggcucgaccgccucaucgccgagaagguccaggccgagcgccccgacaccaugcucggcgucgucugcggcgcccuccacgucgccgacgucucccuccgcaacuccgucuccaacuuccuccacucccucgagcgcggccagguccuccccgcccacacccuccucaacaccgucgacgucgagcucaucuacgagggcgucaaguacguccucaaggucacccgccagucccccaacuccuacgucgucaucaugaacggcuccugcgucgaggucgacguccaccgccucuccgacggcggccuccuccucuccuacgacggcuccuccuacaccaccuacaugaaggaggaggucgaccgcuaccgcaucaccaucggcaacaagaccugcgucuucgagaaggagaacgaccccuccgucaugcgcucccccuccgccggcaagcucauccaguacaucgucgaggacggcggccacgucuucgccggccagugcuacgccgagaucgaggucaugaagauggucaugacccucaccgccgucgaguccggcugcauccacuacgucaagcgccccggcgccgcccucgaccccggcugcguccucgccaagaugcagcucgacaaccccuccaagguccagcaggccgagcuccacaccggcucccucccccgcauccaguccaccgcccuccgcggcgagaagcuccaccgcgucuuccacuacguccucgacaaccucgucaacgucaugaacggcuacugccuccccgaccccuucuucuccuccaaggucaaggacugggucgagcgccucaugaagacccuccgcgaccccucccucccccuccucgagcuccaggacaucaugaccuccgucuccggccgcaucccccccaacgucgagaaguccaucaagaaggagauggcccaguacgccuccaacaucaccuccguccucugccaguuccccucccagcagaucgccaacauccucgacucccacgccgccacccucaaccgcaaguccgagcgcgaggucuucuucaugaacacccaguccaucguccagcucguccagcgcuaccgcuccggcauccgcggccacaugaaggccgucgucauggaccuccuccgccaguaccuccgcgucgagacccaguuccagaacggccacuacgacaagugcgucuucgcccuccgcgaggagaacaaguccgacaugaacaccguccucaacuacaucuucucccacgcccaggucaccaagaagaaccuccucgucaccaugcucaucgaccagcucugcggccgcgaccccacccucaccgacgagcuccucaacauccucaccgagcucacccagcucuccaagaccaccaacgccaaggucgcccuccgcgcccgccagguccucaucgccucccaccuccccuccuacgagcuccgccacaaccaggucgaguccaucuuccucuccgccaucgacauguacggccaccaguucugcaucgagaaccuccagaagcucauccucuccgagaccuccaucuucgacguccuccccaacuucuucuaccacuccaaccaggucguccgcauggccgcccucgaggucuacguccgccgcgccuacaucgccuacgagcucaacuccguccagcaccgccagcucaaggacaacaccugcgucgucgaguuccaguucaugcuccccaccucccaccccaaccgcggcaacauccccacccucaaccgcauguccuucuccuccaaccucaaccacuacggcaugacccacgucgccuccgucuccgacguccuccucgacaacuccuucaccccccccugccagcgcaugggcggcauggucuccuuccgcaccuucgaggacuucguccgcaucuucgacgaggucaugggcugcuucuccgacucccccccccagucccccaccuuccccgaggccggccacaccucccucuacgacgaggacaaggucccccgcgacgagcccauccacauccucaacgucgccaucaagaccgacugcgacaucgaggacgaccgccucgccgccauguuccgcgaguucacccagcagaacaaggccacccucgucgaccacggcauccgccgccucaccuuccucgucgcccagaaggacuuccgcaagcaggucaacuacgaggucgaccgccgcuuccaccgcgaguuccccaaguucuucaccuuccgcgcccgcgacaaguucgaggaggaccgcaucuaccgccaccucgagcccgcccucgccuuccagcucgagcucaaccgcaugcgcaacuucgaccucaccgccauccccugcgccaaccacaagaugcaccucuaccucggcgccgccaaggucgaggucggcaccgaggucaccgacuaccgcuucuucguccgcgccaucauccgccacuccgaccucgucaccaaggaggccuccuucgaguaccuccagaacgagggcgagcgccuccuccucgaggccauggacgagcucgaggucgccuucaacaacaccaacguccgcaccgacugcaaccacaucuuccucaacuucguccccaccgucaucauggaccccuccaagaucgaggaguccguccgcuccauggucaugcgcuacggcucccgccucuggaagcuccgcguccuccaggccgagcucaagaucaacauccgccucacccccaccggcaaggccauccccauccgccucuuccucaccaacgaguccggcuacuaccucgacaucucccucuacaaggaggucaccgacucccgcaccgcccagaucauguuccaggccuacggcgacaagcagggcccccuccacggcaugcucaucaacacccccuacgucaccaaggaccuccuccaguccaagcgcuuccaggcccagucccucggcaccaccuacaucuacgacauccccgagauguuccgccagucccucaucaagcucugggaguccauguccacccaggccuuccuccccucccccccccuccccuccgacaugcucaccuacaccgagcucguccucgacgaccagggccagcucguccacaugaaccgccuccccggcggcaacgagaucggcauggucgccuggaagaugaccuucaagucccccgaguaccccgagggccgcgacaucaucgucaucggcaacgacaucaccuaccgcaucggcuccuucggcccccaggaggaccuccucuuccuccgcgccuccgagcucgcccgcgccgagggcaucccccgcaucuacgucuccgccaacuccggcgcccgcaucggccucgccgaggagauccgccacauguuccacgucgccugggucgaccccgaggaccccuacaagggcuaccgcuaccucuaccucaccccccaggacuacaagcgcgucuccgcccucaacuccguccacugcgagcacgucgaggacgagggcgagucccgcuacaagaucaccgacaucaucggcaaggaggagggcaucggccccgagaaccuccgcggcuccggcaugaucgccggcgaguccucccucgccuacaacgagaucaucaccaucucccucgucaccugccgcgccaucggcaucggcgccuaccucguccgccucggccagcgcaccauccaggucgagaacucccaccucauccucaccggcgccggcgcccucaacaagguccucggccgcgaggucuacaccuccaacaaccagcucggcggcauccagaucaugcacaacaacggcgucacccacugcaccgucugcgacgacuucgagggcgucuucaccguccuccacuggcucuccuacaugcccaaguccguccacuccuccgucccccuccucaacuccaaggaccccaucgaccgcaucaucgaguucguccccaccaagacccccuacgacccccgcuggaugcucgccggccgcccccaccccacccagaagggccaguggcucuccggcuucuucgacuacggcuccuucuccgagaucaugcagcccugggcccagaccgucgucgucggccgcgcccgccucggcggcauccccgucggcgucgucgccgucgagacccgcaccgucgagcucuccauccccgccgaccccgccaaccucgacuccgaggccaagaucauccagcaggccggccaggucugguuccccgacuccgccuucaagaccuaccaggccaucaaggacuucaaccgcgagggccucccccucauggucuucgccaacuggcgcggcuucuccggcggcaugaaggacauguacgaccagguccucaaguucggcgccuacaucgucgacggccuccgcgagugcugccagcccguccucgucuacauccccccccaggccgagcuccgcggcggcuccugggucgucaucgacuccuccaucaacccccgccacauggagauguacgccgaccgcgagucccgcggcuccguccucgagcccgagggcaccgucgagaucaaguuccgccgcaaggaccucgucaagaccaugcgccgcgucgaccccgucuacauccaccucgccgagcgccucggcacccccgagcucuccaccgccgagcgcaaggagcucgagaacaagcucaaggagcgcgaggaguuccucauccccaucuaccaccaggucgccguccaguucgccgaccuccacgacacccccggccgcaugcaggagaagggcgucaucuccgacauccucgacuggaagaccucccgcaccuucuucuacuggcgccuccgccgccuccuccucgaggaccucgucaagaagaagauccacaacgccaaccccgagcucaccgacggccagauccaggccaugcuccgccgcugguucgucgaggucgagggcaccgucaaggccuacgucugggacaacaacaaggaccucgccgaguggcucgagaagcagcucaccgaggaggacggcguccacuccgucaucgaggagaacaucaagugcaucucccgcgacuacguccucaagcagauccgcucccucguccaggccaaccccgaggucgccauggacuccaucauccacaugacccagcacaucucccccacccagcgcgccgaggucauccgcauccucuccaccauggacucccccuccaccuga

SEQ ID NO: 39266 - RNA, 7377 nt, Artificial Sequence
  derived and/or modified sequence opt2 from ACACB__Homo_sapiens__XP_011536564
augguccuccuccucugccucuccugccucaucuucuccugccucaccuucuccuggcucaagaucuggggcaagaugaccgacuccaagcccaucaccaaguccaaguccgaggccaaccucauccccucccaggagcccuuccccgccuccgacaacuccggcgagaccccccagcgcaacggcgagggccacacccuccccaagacccccucccaggccgagcccgccucccacaagggccccaaggacgccggccgccgccgcaacucccucccccccucccaccagaagcccccccgcaacccccucuccuccuccgacgccgcccccucccccgagcuccaggccaacggcaccggcacccagggccucgaggccaccgacaccaacggccucuccuccuccgcccgcccccagggccagcaggccggcucccccuccaaggaggacaagaagcaggccaacaucaagcgccagcucaugaccaacuucauccucggcuccuucgacgacuacuccuccgacgaggacuccgucgccggcuccucccgcgaguccacccgcaagggcucccgcgccucccucggcgcccucucccucgaggccuaccucaccaccggcgaggccgagacccgcguccccaccaugcgccccuccauguccggccuccaccucgucaagcgcggccgcgagcacaagaagcucgaccuccaccgcgacuucaccgucgccucccccgccgaguucgucacccgcuucggcggcgaccgcgucaucgagaagguccucaucgccaacaacggcaucgccgccgucaagugcaugcgcuccauccgccgcugggccuacgagauguuccgcaacgagcgcgccauccgcuucgucgucauggucacccccgaggaccucaaggccaacgccgaguacaucaagauggccgaccacuacguccccguccccggcggccccaacaacaacaacuacgccaacgucgagcucaucgucgacaucgccaagcgcauccccguccaggccgucugggccggcuggggccacgccuccgagaaccccaagcuccccgagcuccucugcaagaacggcgucgccuuccucggcccccccuccgaggccaugugggcccucggcgacaagaucgccuccaccgucgucgcccagacccuccagguccccacccuccccugguccggcuccggccucaccgucgaguggaccgaggacgaccuccagcagggcaagcgcaucuccguccccgaggacgucuacgacaagggcugcgucaaggacgucgacgagggccucgaggccgccgagcgcaucggcuucccccucaugaucaaggccuccgagggcggcggcggcaagggcauccgcaaggccgaguccgccgaggacuuccccauccucuuccgccagguccaguccgagauccccggcucccccaucuuccucaugaagcucgcccagcacgcccgccaccucgagguccagauccucgccgaccaguacggcaacgccgucucccucuucggccgcgacugcuccauccagcgccgccaccagaagaucgucgaggaggcccccgccaccaucgccccccucgccaucuucgaguucauggagcagugcgccauccgccucgccaagaccgucggcuacgucuccgccggcaccgucgaguaccucuacucccaggacggcuccuuccacuuccucgagcucaacccccgccuccaggucgagcaccccugcaccgagaugaucgccgacgucaaccuccccgccgcccagcuccagaucgccaugggcgucccccuccaccgccucaaggacauccgccuccucuacggcgagucccccuggggcgucacccccaucuccuucgagacccccuccaaccccccccucgcccgcggccacgucaucgccgcccgcaucaccuccgagaaccccgacgagggcuucaagcccuccuccggcaccguccaggagcucaacuuccgcuccuccaagaacgucuggggcuacuucuccgucgccgccaccggcggccuccacgaguucgccgacucccaguucggccacugcuucuccuggggcgagaaccgcgaggaggccaucuccaacauggucgucgcccucaaggagcucuccauccgcggcgacuuccgcaccaccgucgaguaccucaucaaccuccucgagaccgaguccuuccagaacaacgacaucgacaccggcuggcucgacuaccucaucgccgagaagguccaggccgagaagcccgacaucaugcucggcgucgucugcggcgcccucaacgucgccgacgccauguuccgcaccugcaugaccgacuuccuccacucccucgagcgcggccagguccuccccgccgacucccuccucaaccucgucgacgucgagcucaucuacggcggcgucaaguacauccucaaggucgcccgccagucccucaccauguucguccucaucaugaacggcugccacaucgagaucgacgcccaccgccucaacgacggcggccuccuccucuccuacaacggcaacuccuacaccaccuacaugaaggaggaggucgacuccuaccgcaucaccaucggcaacaagaccugcgucuucgagaaggagaacgaccccaccguccuccgcucccccuccgccggcaagcucacccaguacaccgucgaggacggcggccacgucgaggccggcuccuccuacgccgagauggaggucaugaagaugaucaugacccucaacguccaggagcgcggccgcgucaaguacaucaagcgccccggcgccguccucgaggccggcugcgucgucgcccgccucgagcucgacgaccccuccaagguccaccccgccgagcccuucaccggcgagcuccccgcccagcagacccuccccauccucggcgagaagcuccaccaggucuuccacuccguccucgagaaccucaccaacgucauguccggcuucugccuccccgagcccgucuucuccaucaagcucaaggaguggguccagaagcucaugaugacccuccgccaccccucccucccccuccucgagcuccaggagaucaugaccuccgucgccggccgcauccccgcccccgucgagaaguccguccgccgcgucauggcccaguacgccuccaacaucaccuccguccucugccaguuccccucccagcagaucgccaccauccucgacugccacgccgccacccuccagcgcaaggccgaccgcgaggucuucuucaucaacacccaguccaucguccagcucguccagcgcuaccgcuccggcauccgcggcuacaugaagaccgucguccucgaccuccuccgccgcuaccuccgcgucgagcaccacuuccagcaggcccacuacgacaagugcgucaucaaccuccgcgagcaguucaagcccgacaugucccagguccucgacugcaucuucucccacgcccaggucgccaagaagaaccagcucgucaucaugcucaucgacgagcucugcggccccgaccccucccucuccgacgagcucaucuccauccucaacgagcucacccagcucuccaaguccgagcacugcaaggucgcccuccgcgcccgccagauccucaucgccucccaccuccccuccuacgagcuccgccacaaccaggucgaguccaucuuccucuccgccaucgacauguacggccaccaguucugccccgagaaccucaagaagcucauccucuccgagaccaccaucuucgacguccuccccaccuucuucuaccacgccaacaaggucgucugcauggccucccucgaggucuacguccgccgcggcuacaucgccuacgagcucaacucccuccagcaccgccagcuccccgacggcaccugcgucgucgaguuccaguucaugcuccccuccucccaccccaaccgcaugaccguccccaucuccaucaccaaccccgaccuccuccgccacuccaccgagcucuucauggacuccggcuucuccccccucugccagcgcaugggcgccauggucgccuuccgccgcuucgaggacuucacccgcaacuucgacgaggucaucuccugcuucgccaacguccccaaggacaccccccucuucuccgaggcccgcaccucccucuacuccgaggacgacugcaagucccuccgcgaggagcccauccacauccucaacgucuccauccagugcgccgaccaccucgaggacgaggcccucguccccauccuccgcaccuucguccaguccaagaagaacauccucgucgacuacggccuccgccgcaucaccuuccucaucgcccaggagaaggaguuccccaaguucuucaccuuccgcgcccgcgacgaguucgccgaggaccgcaucuaccgccaccucgagcccgcccucgccuuccagcucgagcucaaccgcaugcgcaacuucgaccucaccgccguccccugcgccaaccacaagaugcaccucuaccucggcgccgccaaggucaaggagggcgucgaggucaccgaccaccgcuucuucauccgcgccaucauccgccacuccgaccucaucaccaaggaggccuccuucgaguaccuccagaacgagggcgagcgccuccuccucgaggccauggacgagcucgaggucgccuucaacaacaccuccguccgcaccgacugcaaccacaucuuccucaacuucguccccaccgucaucauggaccccuucaagaucgaggaguccguccgcuacauggucaugcgcuacggcucccgccucuggaagcuccgcguccuccaggccgaggucaagaucaacauccgccagaccaccaccggcuccgccguccccauccgccucuucaucaccaacgaguccggcuacuaccucgacaucucccucuacaaggaggucaccgacucccgcuccggcaacaucauguuccacuccuucggcaacaagcagggcccccagcacggcaugcucaucaacacccccuacgucaccaaggaccuccuccaggccaagcgcuuccaggcccagacccucggcaccaccuacaucuacgacuuccccgagauguuccgccaggcccucuucaagcucuggggcucccccgacaaguaccccaaggacauccucaccuacaccgagcucguccucgacucccagggccagcucgucgagaugaaccgccuccccggcggcaacgaggucggcauggucgccuucaagaugcgcuucaagacccaggaguaccccgagggccgcgacgucaucgucaucggcaacgacaucaccuuccgcaucggcuccuucggccccggcgaggaccuccucuaccuccgcgccuccgagauggcccgcgccgagggcauccccaagaucuacgucgccgccaacuccggcgcccgcaucggcauggccgaggagaucaagcacauguuccacgucgccugggucgaccccgaggacccccacaagggcuucaaguaccucuaccucaccccccaggacuacacccgcaucuccucccucaacuccguccacugcaagcacaucgaggagggcggcgagucccgcuacaugaucaccgacaucaucggcaaggacgacggccucggcgucgagaaccuccgcggcuccggcaugaucgccggcgaguccucccucgccuacgaggagaucgucaccaucucccucgucaccugccgcgccaucggcaucggcgccuaccucguccgccucggccagcgcgucauccaggucgagaacucccacaucauccucaccggcgccuccgcccucaacaagguccucggccgcgaggucuacaccuccaacaaccagcucggcggcguccagaucaugcacuacaacggcgucucccacaucaccguccccgacgacuucgagggcgucuacaccauccucgaguggcucuccuacaugcccaaggacaaccacucccccguccccaucaucacccccaccgaccccaucgaccgcgagaucgaguuccuccccucccgcgcccccuacgacccccgcuggaugcucgccggccgcccccaccccacccucaagggcaccuggcaguccggcuucuucgaccacggcuccuucaaggagaucauggcccccugggcccagaccgucgucaccggccgcgcccgccucggcggcauccccgucggcgucaucgccgucgagacccgcaccgucgaggucgccguccccgccgaccccgccaaccucgacuccgaggccaagaucauccagcaggccggccaggucugguuccccgacuccgccuacaagaccgcccaggccgucaaggacuucaaccgcgagaagcucccccucaugaucuucgccaacuggcgcggcuucuccggcggcaugaaggacauguacgaccagguccucaaguucggcgccuacaucgucgacggccuccgccaguacaagcagcccauccucaucuacaucccccccuacgccgagcuccgcggcggcuccugggucgucaucgacgccaccaucaacccccucugcaucgagauguacgccgacaaggagucccgcggcggcguccucgagcccgagggcaccgucgagaucaaguuccgcaagaaggaccucaucaaguccaugcgccgcaucgaccccgccuacaagaagcucauggagcagcucggcgagcccgaccucuccgacaaggaccgcaaggaccucgagggccgccucaaggcccgcgaggaccuccuccuccccaucuaccaccaggucgccguccaguucgccgacuuccacgacacccccggccgcaugcucgagaagggcgucaucuccgacauccucgaguggaagaccgcccgcaccuuccucuacuggcgccuccgccgccuccuccucgaggaccaggucaagcaggagauccuccaggccuccggcgagcucucccacguccacauccaguccaugcuccgccgcugguucgucgagaccgagggcgccgucaaggccuaccucugggacaacaaccaggucgucguccaguggcucgagcagcacuggcaggccggcgacggcccccgcuccaccauccgcgagaacaucaccuaccucaagcacgacuccguccucaagaccauccgcggccucgucgaggagaaccccgaggucgccgucgacugcgucaucuaccucucccagcacaucucccccgccgagcgcgcccaggucguccaccuccucuccaccauggacucccccgccuccaccuga

SEQ ID NO: 39267 - RNA, 3273 nt, Artificial Sequence
  derived and/or modified sequence opt2 from ACAD10__Homo_sapiens__NP_001130010
augugcguccgcuccugcuuccaguccccccgccuccagugggucuggcgcaccgccuuccucaagcacacccagcgccgccaccagggcucccaccgcuggacccaccucggcggcuccaccuaccgcgccgucaucuucgacaugggcggcguccucauccccucccccggccgcgucgccgccgagugggagguccagaaccgcauccccuccggcaccauccucaaggcccucauggagggcggcgagaacggccccuggaugcgcuucaugcgcgccgagaucaccgccgagggcuuccuccgcgaguucggccgccucugcuccgagaugcucaagaccuccguccccgucgacuccuucuucucccuccucaccuccgagcgcgucgccaagcaguuccccgucaugaccgaggccaucacccagauccgcgccaagggccuccagaccgccguccucuccaacaacuucuaccuccccaaccagaaguccuuccucccccucgaccgcaagcaguucgacgucaucgucgaguccugcauggagggcaucugcaagcccgacccccgcaucuacaagcucugccucgagcagcucggccuccagcccuccgaguccaucuuccucgacgaccucggcaccaaccucaaggaggccgcccgccucggcauccacaccaucaagcgccagggcuucgccguccuccccaagcucgucuccaacuccugggcccaggccaucuacccccccuacccccccaaggucguccgccuccaggucaacgaccccgagaccgccgucaaggagcucgaggcccuccucggcuucacccuccgcgucggcguccccaacacccgccccgucaagaagaccauggagauccccaaggacucccuccagaaguaccucaaggaccuccucggcauccagaccaccggcccccucgagcuccuccaguucgaccacggccaguccaaccccaccuacuacauccgccucgccaaccgcgaccucguccuccgcaagaagccccccggcacccuccuccccuccgcccacgccaucgagcgcgaguuccgcaucaugaaggcccucgccaacgccggcguccccguccccaacguccucgaccucugcgaggacuccuccgucaucggcacccccuucuacgucauggaguacugccccggccucaucuacaaggaccccucccuccccggccucgagcccucccaccgccgcgccaucuacaccgccaugaacaccguccucugcaagauccacuccgucgaccuccaggccgucggccucgaggacuacggcaagcagggcgacuacaucccccgccagguccgcaccugggucaagcaguaccgcgccuccgagaccuccaccauccccgccauggagcgccucaucgaguggcucccccuccaccucccccgccagcagcgcaccaccgucguccacggcgacuuccgccucgacaaccucgucuuccaccccgaggagcccgagguccucgccguccucgacugggagcucuccacccucggcgacccccucgccgacgucgccuacuccugccucgcccacuaccuccccuccuccuuccccguccuccgcggcaucaacgacugcgaccucacccagcucggcauccccgccgccgaggaguacuuccgcauguacugccuccagaugggccucccccccaccgagaacuggaacuucuacauggccuucuccuucuuccgcgucgccgccauccuccagggcgucuacaagcgcucccucaccggccaggccuccuccaccuacgccgagcagaccggcaagcucaccgaguucgucuccaaccucgccugggacuucgccgucaaggagggcuuccgcgucuucaaggagaugcccuucaccaacccccucacccgcuccuaccacaccugggcccgcccccagucccaguggugccccaccggcucccgcuccuacuccuccguccccgaggccucccccgcccacaccucccgcggcggccucgucaucucccccgagucccucuccccccccguccgcgagcucuaccaccgccucaagcacuucauggagcagcgcgucuaccccgccgagcccgagcuccagucccaccaggccuccgccgcccgcuggucccccuccccccucaucgaggaccucaaggagaaggccaaggccgagggccucuggaaccucuuccucccccucgaggccgaccccgagaagaaguacggcgccggccucaccaacgucgaguacgcccaccucugcgagcucaugggcaccucccucuacgcccccgaggucugcaacugcuccgcccccgacaccggcaacauggagcuccucguccgcuacggcaccgaggcccagaaggcccgcuggcucaucccccuccucgagggcaaggcccgcuccugcuucgccaugaccgagccccaggucgccuccuccgacgccaccaacaucgaggccuccauccgcgaggaggacuccuucuacgucaucaacggccacaagugguggaucaccggcauccucgacccccgcugccagcucugcgucuucaugggcaagaccgacccccacgccccccgccaccgccagcaguccguccuccucguccccauggacacccccggcaucaagaucauccgcccccucaccgucuacggccucgaggacgcccccggcggccacggcgagguccgcuucgagcacguccgcguccccaaggagaacaugguccucggccccggccgcggcuucgagaucgcccagggccgccucggccccggccgcauccaccacugcaugcgccucaucggcuucuccgagcgcgcccucgcccucaugaaggcccgcgucaagucccgccucgccuucggcaagccccucgucgagcagggcaccguccucgccgacaucgcccagucccgcgucgagaucgagcaggcccgccuccucguccuccgcgccgcccaccucauggaccucgccggcaacaaggccgccgcccucgacaucgccaugaucaagauggucgcccccuccauggccucccgcgucaucgaccgcgccauccaggccuucggcgccgccggccucuccuccgacuacccccucgcccaguucuucaccugggcccgcgcccuccgcuucgccgacggccccgacgagguccaccgcgccaccgucgccaagcucgagcucaagcaccgcaucuga

SEQ ID NO: 39268 - RNA, 1248 nt, Artificial Sequence
  derived and/or modified sequence opt2 from ACAD8__Homo_sapiens__NP_055199
augcucugguccggcugccgccgcuucggcgcccgccucggcugccuccccggcggccuccgcguccucguccagaccggccaccgcucccucaccuccugcaucgaccccuccaugggccucaacgaggagcagaaggaguuccagaaggucgccuucgacuucgccgcccgcgagauggcccccaacauggccgagugggaccagaaggagcucuuccccgucgacgucaugcgcaaggccgcccagcucggcuucggcggcgucuacauccagaccgacgucggcggcuccggccucucccgccucgacaccuccgucaucuucgaggcccucgccaccggcugcaccuccaccaccgccuacaucuccauccacaacaugugcgccuggaugaucgacuccuucggcaacgaggagcagcgccacaaguucugccccccccucugcaccauggagaaguucgccuccuacugccucaccgagcccggcuccggcuccgacgccgccucccuccucaccuccgccaagaagcagggcgaccacuacauccucaacggcuccaaggccuucaucuccggcgccggcgaguccgacaucuacgucgucaugugccgcaccggcggccccggccccaagggcaucuccugcaucgucgucgagaagggcacccccggccucuccuucggcaagaaggagaagaaggucggcuggaacucccagcccacccgcgccgucaucuucgaggacugcgccguccccgucgccaaccgcaucggcuccgagggccagggcuuccucaucgccguccgcggccucaacggcggccgcaucaacaucgccuccugcucccucggcgccgcccacgccuccgucauccucacccgcgaccaccucaacguccgcaagcaguucggcgagccccucgccuccaaccaguaccuccaguucacccucgccgacauggccacccgccucgucgccgcccgccucaugguccgcaacgccgccgucgcccuccaggaggagcgcaaggacgccgucgcccucugcuccauggccaagcucuucgccaccgacgagugcuucgccaucugcaaccaggcccuccagaugcacggcggcuacggcuaccucaaggacuacgccguccagcaguacguccgcgacucccgcguccaccagauccucgagggcuccaacgaggucaugcgcauccucaucucccgcucccuccuccaggaguga

SEQ ID NO: 39269 - RNA, 1866 nt, Artificial Sequence
  derived and/or modified sequence opt2 from ACAD9__Homo_sapiens__NP_054768
auguccggcugcggccucuuccuccgcaccaccgccgccgcccgcgccugccgcggccucgucgucuccaccgccaaccgccgccuccuccgcaccuccccccccguccgcgccuucgccaaggagcucuuccucggcaagaucaagaagaaggaggucuuccccuuccccgaggucucccaggacgagcucaacgagaucaaccaguuccucggccccgucgagaaguucuucaccgaggaggucgacucccgcaagaucgaccaggagggcaagauccccgacgagacccucgagaagcucaagucccucggccucuucggccuccagguccccgaggaguacggcggccucggcuucuccaacaccauguacucccgccucggcgagaucaucuccauggacggcuccaucaccgucacccucgccgcccaccaggccaucggccucaagggcaucauccucgccggcaccgaggagcagaaggccaaguaccuccccaagcucgccuccggcgagcacaucgccgccuucugccucaccgagcccgccuccggcuccgacgccgccuccauccgcucccgcgccacccucuccgaggacaagaagcacuacauccucaacggcuccaaggucuggaucaccaacggcggccucgccaacaucuucaccgucuucgccaagaccgaggucgucgacuccgacggcuccgucaaggacaagaucaccgccuucaucgucgagcgcgacuucggcggcgucaccaacggcaagcccgaggacaagcucggcauccgcggcuccaacaccugcgagguccacuucgagaacaccaagauccccgucgagaacauccucggcgaggucggcgacggcuucaaggucgccaugaacauccucaacuccggccgcuucuccaugggcuccgucgucgccggccuccucaagcgccucaucgagaugaccgccgaguacgccugcacccgcaagcaguucaacaagcgccucuccgaguucggccucauccaggagaaguucgcccucauggcccagaaggccuacgucauggaguccaugaccuaccucaccgccggcaugcucgaccagcccggcuuccccgacugcuccaucgaggccgccauggucaaggucuucuccuccgaggccgccuggcagugcgucuccgaggcccuccagauccucggcggccucggcuacacccgcgacuaccccuacgagcgcauccuccgcgacacccgcauccuccucaucuucgagggcaccaacgagauccuccgcauguacaucgcccucaccggccuccagcacgccggccgcauccucaccacccgcauccacgagcucaagcaggccaaggucuccaccgucauggacaccgucggccgccgccuccgcgacucccucggccgcaccgucgaccucggccucaccggcaaccacggcgucguccaccccucccucgccgacuccgccaacaaguucgaggagaacaccuacugcuucggccgcaccgucgagacccuccuccuccgcuucggcaagaccaucauggaggagcagcucguccucaagcgcgucgccaacauccucaucaaccucuacggcaugaccgccguccucucccgcgccucccgcuccauccgcaucggccuccgcaaccacgaccacgagguccuccucgccaacaccuucugcgucgaggccuaccuccagaaccucuucucccucucccagcucgacaaguacgcccccgagaaccucgacgagcagaucaagaaggucucccagcagauccucgagaagcgcgccuacaucugcgcccacccccucgaccgcaccugcuga

SEQ ID NO: 39270 - RNA, 1293 nt, Artificial Sequence
  derived and/or modified sequence opt2 from ACADL__Homo_sapiens__NP_001599
auggccgcccgccuccuccgcggcucccuccgcguccucggcggccaccgcgccccccgccagcuccccgccgcccgcugcucccacuccggcggcgaggagcgccucgagacccccuccgccaagaagcucaccgacaucggcauccgccgcaucuucucccccgagcacgacaucuuccgcaaguccguccgcaaguucuuccaggaggaggucaucccccaccacuccgagugggagaaggccggcgaggucucccgcgaggucugggagaaggccggcaagcagggccuccucggcgucaacaucgccgagcaccucggcggcaucggcggcgaccucuacuccgccgccaucgucugggaggagcaggccuacuccaacugcuccggccccggcuucuccauccacuccggcaucgucauguccuacaucaccaaccacggcuccgaggagcagaucaagcacuucaucccccagaugaccgccggcaagugcaucggcgccaucgccaugaccgagcccggcgccggcuccgaccuccagggcaucaagaccaacgccaagaaggacggcuccgacuggauccucaacggcuccaaggucuucaucuccaacggcucccucuccgacgucgucaucgucgucgccgucaccaaccacgaggcccccucccccgcccacggcaucucccucuuccucgucgagaacggcaugaagggcuucaucaagggccgcaagcuccacaagaugggccucaaggcccaggacaccgccgagcucuucuucgaggacauccgccuccccgccuccgcccuccucggcgaggagaacaagggcuucuacuacaucaugaaggagcucccccaggagcgccuccucaucgccgacgucgccaucuccgccuccgaguucauguucgaggagacccgcaacuacgucaagcagcgcaaggccuucggcaagaccgucgcccaccuccagaccguccagcacaagcucgccgagcucaagacccacaucugcgucacccgcgccuucgucgacaacugccuccagcuccacgaggccaagcgccucgacuccgccaccgccugcauggccaaguacugggccuccgagcuccagaacuccgucgccuacgacugcguccagcuccacggcggcuggggcuacaugugggaguaccccaucgccaaggccuacgucgacgcccgcguccagcccaucuacggcggcaccaacgagaucaugaaggagcucaucgcccgcgagaucgucuucgacaaguga

SEQ ID NO: 39271 - RNA, 1299 nt, Artificial Sequence
  derived and/or modified sequence opt2 from ACADSB__Homo_sapiens__NP_001600
auggagggccucgccguccgccuccuccgcggcucccgccuccuccgccgcaacuuccucaccugccucuccuccuggaagauccccccccacgucuccaaguccucccaguccgaggcccuccucaacaucaccaacaacggcauccacuucgccccccuccagaccuucaccgacgaggagaugaugaucaaguccuccgucaagaaguucgcccaggagcagaucgccccccucgucuccaccauggacgagaacuccaagauggagaaguccgucauccagggccucuuccagcagggccucaugggcaucgaggucgaccccgaguacggcggcaccggcgccuccuuccucuccaccguccucgucaucgaggagcucgccaaggucgacgccuccgucgccgucuucugcgagauccagaacacccucaucaacacccucauccgcaagcacggcaccgaggagcagaaggccaccuaccucccccagcucaccaccgagaaggucggcuccuucugccucuccgaggccggcgccggcuccgacuccuucgcccucaagacccgcgccgacaaggagggcgacuacuacguccucaacggcuccaagauguggaucuccuccgccgagcacgccggccucuuccucgucauggccaacgucgaccccaccaucggcuacaagggcaucaccuccuuccucgucgaccgcgacacccccggccuccacaucggcaagcccgagaacaagcucggccuccgcgccuccuccaccugcccccucaccuucgagaacgucaagguccccgaggccaacauccucggccagaucggccacggcuacaaguacgccaucggcucccucaacgagggccgcaucggcaucgccgcccagaugcucggccucgcccagggcugcuucgacuacaccauccccuacaucaaggagcgcauccaguucggcaagcgccucuucgacuuccagggccuccagcaccaggucgcccacgucgccacccagcucgaggccgcccgccuccucaccuacaacgccgcccgccuccucgaggccggcaagcccuucaucaaggaggccuccauggccaaguacuacgccuccgagaucgccggccagaccaccuccaagugcaucgaguggaugggcggcgucggcuacaccaaggacuaccccgucgagaaguacuuccgcgacgccaagaucggcaccaucuacgagggcgccuccaacauccagcucaacaccaucgccaagcacaucgacgccgaguacuga

SEQ ID NO: 39272 - RNA, 1239 nt, Artificial Sequence
  derived and/or modified sequence opt2 from ACADS__Homo_sapiens__NP_000008
auggccgccgcccuccucgcccgcgccuccggccccgcccgccgcgcccucugcccccgcgccuggcgccagcuccacaccaucuaccaguccgucgagcuccccgagacccaccagaugcuccuccagaccugccgcgacuucgccgagaaggagcucuuccccaucgccgcccaggucgacaaggagcaccucuuccccgccgcccaggucaagaagaugggcggccucggccuccucgccauggacguccccgaggagcucggcggcgccggccucgacuaccucgccuacgccaucgccauggaggagaucucccgcggcugcgccuccaccggcgucaucauguccgucaacaacucccucuaccucggccccauccucaaguucggcuccaaggagcagaagcaggccugggucacccccuucaccuccggcgacaagaucggcugcuucgcccucuccgagcccggcaacggcuccgacgccggcgccgccuccaccaccgcccgcgccgagggcgacuccuggguccucaacggcaccaaggccuggaucaccaacgccugggaggccuccgccgccgucgucuucgccuccaccgaccgcgcccuccagaacaagggcaucuccgccuuccucguccccaugcccacccccggccucacccucggcaagaaggaggacaagcucggcauccgcggcuccuccaccgccaaccucaucuucgaggacugccgcauccccaaggacuccauccucggcgagcccggcaugggcuucaagaucgccaugcagacccucgacaugggccgcaucggcaucgccucccaggcccucggcaucgcccagaccgcccucgacugcgccgucaacuacgccgagaaccgcauggccuucggcgccccccucaccaagcuccaggucauccaguucaagcucgccgacauggcccucgcccucgaguccgcccgccuccucaccuggcgcgccgccaugcucaaggacaacaagaagcccuucaucaaggaggccgccauggccaagcucgccgccuccgaggccgccaccgccaucucccaccaggccauccagauccucggcggcaugggcuacgucaccgagaugcccgccgagcgccacuaccgcgacgcccgcaucaccgagaucuacgagggcaccuccgagauccagcgccucgucaucgccggccaccuccuccgcuccuaccgcuccuga

SEQ ID NO: 39273 - RNA, 1968 nt, Artificial Sequence
  derived and/or modified sequence opt2 from ACADVL__Homo_sapiens__NP_000009
augcaggccgcccgcauggccgccucccucggccgccagcuccuccgccucggcggcggcuccucccgccucaccgcccuccucggccagccccgccccggccccgcccgccgccccuacgccggcggcgccgcccagcucgcccucgacaaguccgacucccaccccuccgacgcccucacccgcaagaagcccgccaaggccgaguccaaguccuucgccgucggcauguucaagggccagcucaccaccgaccaggucuuccccuaccccuccguccucaacgaggagcagacccaguuccucaaggagcucgucgagcccgucucccgcuucuucgaggaggucaacgaccccgccaagaacgacgcccucgagauggucgaggagaccaccuggcagggccucaaggagcucggcgccuucggccuccagguccccuccgagcucggcggcgucggccucugcaacacccaguacgcccgccucgucgagaucgucggcaugcacgaccucggcgucggcaucacccucggcgcccaccaguccaucggcuucaagggcauccuccucuucggcaccaaggcccagaaggagaaguaccuccccaagcucgccuccggcgagaccgucgccgccuucugccucaccgagcccuccuccggcuccgacgccgccuccauccgcaccuccgccguccccucccccugcggcaaguacuacacccucaacggcuccaagcucuggaucuccaacggcggccucgccgacaucuucaccgucuucgccaagacccccgucaccgaccccgccaccggcgccgucaaggagaagaucaccgccuucgucgucgagcgcggcuucggcggcaucacccacggcccccccgagaagaagaugggcaucaaggccuccaacaccgccgaggucuucuucgacggcguccgcguccccuccgagaacguccucggcgaggucggcuccggcuucaaggucgccaugcacauccucaacaacggccgcuucggcauggccgccgcccucgccggcaccaugcgcggcaucaucgccaaggccgucgaccacgccaccaaccgcacccaguucggcgagaagauccacaacuucggccucauccaggagaagcucgcccgcauggucaugcuccaguacgucaccgaguccauggccuacauggucuccgccaacauggaccagggcgccaccgacuuccagaucgaggccgccaucuccaagaucuucggcuccgaggccgccuggaaggucaccgacgagugcauccagaucaugggcggcaugggcuucaugaaggagcccggcgucgagcgcguccuccgcgaccuccgcaucuuccgcaucuucgagggcaccaacgacauccuccgccucuucgucgcccuccagggcugcauggacaagggcaaggagcucuccggccucggcuccgcccucaagaaccccuucggcaacgccggccuccuccucggcgaggccggcaagcagcuccgccgccgcgccggccucggcuccggccucucccucuccggccucguccaccccgagcucucccgcuccggcgagcucgccguccgcgcccucgagcaguucgccaccgucgucgaggccaagcucaucaagcacaagaagggcaucgucaacgagcaguuccuccuccagcgccucgccgacggcgccaucgaccucuacgccauggucgucguccucucccgcgccucccgcucccucuccgagggccaccccaccgcccagcacgagaagaugcucugcgacaccuggugcaucgaggccgccgcccgcauccgcgagggcauggccgcccuccaguccgaccccuggcagcaggagcucuaccgcaacuucaaguccaucuccaaggcccucgucgagcgcggcggcgucgucaccuccaacccccucggcuucuga

SEQ ID NO: 39274 - RNA, 7296 nt, Artificial Sequence
  derived and/or modified sequence opt2 from ACAN__Homo_sapiens__NP_001126
augaccacccuccucugggucuucgucacccuccgcgucaucaccgccgccgucaccgucgagaccuccgaccacgacaacucccucuccgucuccaucccccagcccuccccccuccgcguccuccucggcaccucccucaccauccccugcuacuucaucgaccccaugcaccccgucaccaccgcccccuccaccgccccccucgccccccgcaucaaguggucccgcgucuccaaggagaaggaggucguccuccucgucgccaccgagggccgcguccgcgucaacuccgccuaccaggacaaggucucccuccccaacuaccccgccauccccuccgacgccacccucgagguccagucccuccgcuccaacgacuccggcgucuaccgcugcgaggucaugcacggcaucgaggacuccgaggccacccucgaggucgucgucaagggcaucgucuuccacuaccgcgccaucuccacccgcuacacccucgacuucgaccgcgcccagcgcgccugccuccagaacuccgccaucaucgccacccccgagcagcuccaggccgccuacgaggacggcuuccaccagugcgacgccggcuggcucgccgaccagaccguccgcuaccccauccacaccccccgcgagggcugcuacggcgacaaggacgaguuccccggcguccgcaccuacggcauccgcgacaccaacgagaccuacgacgucuacugcuucgccgaggagauggagggcgaggucuucuacgccaccucccccgagaaguucaccuuccaggaggccgccaacgagugccgccgccucggcgcccgccucgccaccaccggccagcucuaccucgccuggcaggccggcauggacaugugcuccgccggcuggcucgccgaccgcuccguccgcuaccccaucuccaaggcccgccccaacugcggcggcaaccuccucggcguccgcaccgucuacguccacgccaaccagaccggcuaccccgaccccuccucccgcuacgacgccaucugcuacaccggcgaggacuucgucgacauccccgagaacuucuucggcgucggcggcgaggaggacaucaccguccagaccgucaccuggcccgacauggagcucccccucccccgcaacaucaccgagggcgaggcccgcggcuccgucauccucaccgucaagcccaucuucgaggucucccccuccccccucgagcccgaggagcccuucaccuucgcccccgagaucggcgccaccgccuucgccgaggucgagaacgagaccggcgaggccacccgccccuggggcuuccccacccccggccucggccccgccaccgccuucaccuccgaggaccucgucguccaggucaccgccguccccggccagccccaccuccccggcggcgucgucuuccacuaccgccccggccccacccgcuacucccucaccuucgaggaggcccagcaggccugccuccgcaccggcgccgucaucgccucccccgagcagcuccaggccgccuacgaggccggcuacgagcagugcgacgccggcuggcuccgcgaccagaccguccgcuaccccaucgucuccccccgcacccccugcgucggcgacaaggacuccucccccggcguccgcaccuacggcguccgccccuccaccgagaccuacgacgucuacugcuucgucgaccgccucgagggcgaggucuucuucgccacccgccucgagcaguucaccuuccaggaggcccucgaguucugcgagucccacaacgccacccucgccaccaccggccagcucuacgccgccuggucccgcggccucgacaagugcuacgccggcuggcucgccgacggcucccuccgcuaccccaucgucaccccccgccccgccugcggcggcgacaagcccggcguccgcaccgucuaccucuaccccaaccagaccggccuccccgacccccucucccgccaccacgccuucugcuuccgcggcaucuccgccguccccucccccggcgaggaggagggcggcacccccaccucccccuccggcgucgaggaguggaucgucacccaggucguccccggcgucgccgccguccccgucgaggaggagaccaccgccguccccuccggcgagaccaccgccauccucgaguucaccaccgagcccgagaaccagaccgagugggagcccgccuacacccccgucggcaccuccccccuccccggcauccuccccaccuggccccccaccggcgccgccaccgaggaguccaccgagggccccuccgccaccgagguccccuccgccuccgaggagcccucccccuccgagguccccuuccccuccgaggagcccucccccuccgaggagcccuuccccuccguccgccccuuccccuccgucgagcucuuccccuccgaggagcccuuccccuccaaggagcccucccccuccgaggagcccuccgccuccgaggagcccuacacccccuccccccccguccccuccuggaccgagcuccccuccuccggcgaggaguccggcgcccccgacgucuccggcgacuucaccggcuccggcgacgucuccggccaccucgacuucuccggccagcucuccggcgaccgcgccuccggccuccccuccggcgaccucgacuccuccggccucaccuccaccgucggcuccggccuccccgucgaguccggccuccccuccggcgacgaggagcgcaucgaguggcccuccacccccaccgucggcgagcuccccuccggcgccgagauccucgagggcuccgccuccggcgucggcgaccucuccggccuccccuccggcgagguccucgagaccuccgccuccggcgucggcgaccucuccggccuccccuccggcgagguccucgagaccaccgcccccggcgucgaggacaucuccggccuccccuccggcgagguccucgagaccaccgcccccggcgucgaggacaucuccggccuccccuccggcgagguccucgagaccaccgcccccggcgucgaggacaucuccggccuccccuccggcgagguccucgagaccaccgcccccggcgucgaggacaucuccggccuccccuccggcgagguccucgagaccaccgcccccggcgucgaggacaucuccggccuccccuccggcgagguccucgagaccaccgcccccggcgucgaggacaucuccggccuccccuccggcgagguccucgagaccgccgcccccggcgucgaggacaucuccggccuccccuccggcgagguccucgagaccgccgcccccggcgucgaggacaucuccggccuccccuccggcgagguccucgagaccgccgcccccggcgucgaggacaucuccggccuccccuccggcgagguccucgagaccgccgcccccggcgucgaggacaucuccggccuccccuccggcgagguccucgagaccgccgcccccggcgucgaggacaucuccggccuccccuccggcgagguccucgagaccgccgcccccggcgucgaggacaucuccggccuccccuccggcgagguccucgagaccgccgcccccggcgucgaggacaucuccggccuccccuccggcgagguccucgagaccgccgcccccggcgucgaggacaucuccggccuccccuccggcgagguccucgagaccgccgcccccggcgucgaggacaucuccggccuccccuccggcgagguccucgagaccgccgcccccggcgucgaggacaucuccggccuccccuccggcgagguccucgagaccgccgcccccggcgucgaggacaucuccggccuccccuccggcgagguccucgagaccgccgcccccggcgucgaggacaucuccggccuccccuccggcgagguccucgagaccgccgcccccggcgucgaggacaucuccggccuccccuccggcgagguccucgagaccgccgcccccggcgucgaggacaucuccggccuccccuccggcgagguccucgagaccgccgcccccggcgucgaggacaucuccggccuccccuccggcgagguccucgagaccgccgcccccggcgucgaggacaucuccggccuccccuccggcgagguccucgagaccaccgcccccggcgucgaggagaucuccggccuccccuccggcgagguccucgagaccaccgcccccggcgucgacgagaucuccggccuccccuccggcgagguccucgagaccaccgcccccggcgucgaggagaucuccggccuccccuccggcgagguccucgagaccuccaccuccgccgucggcgaccucuccggccuccccuccggcggcgagguccucgagaucuccgucuccggcgucgaggacaucuccggccuccccuccggcgaggucgucgagaccuccgccuccggcaucgaggacgucuccgagcuccccuccggcgagggccucgagaccuccgccuccggcgucgaggaccucucccgccuccccuccggcgaggagguccucgagaucuccgccuccggcuucggcgaccucuccggccuccccuccggcggcgagggccucgagaccuccgccuccgaggucggcaccgaccucuccggccuccccuccggccgcgagggccucgagaccuccgccuccggcgccgaggaccucuccggccuccccuccggcaaggaggaccucgucggcuccgccuccggcgaccucgaccucggcaagcuccccuccggcacccucggcuccggccaggcccccgagaccuccggccuccccuccggcuucuccggcgaguacuccggcgucgaccucggcuccggcccccccuccggccuccccgacuucuccggccuccccuccggcuuccccaccgucucccucgucgacuccacccucgucgaggucgucaccgccuccaccgccuccgagcucgagggccgcggcaccaucggcaucuccggcgccggcgagaucuccggccuccccuccuccgagcucgacaucuccggccgcgccuccggccuccccuccggcaccgagcucuccggccaggccuccggcucccccgacgucuccggcgagauccccggccucuucggcgucuccggccagcccuccggcuuccccgacaccuccggcgagaccuccggcgucaccgagcucuccggccucuccuccggccagcccggcaucuccggcgaggccuccggcguccucuacggcaccucccagcccuucggcaucaccgaccucuccggcgagaccuccggcguccccgaccucuccggccagcccuccggccuccccggcuucuccggcgccaccuccggcguccccgaccucgucuccggcaccaccuccggcuccggcgaguccuccggcaucaccuucgucgacaccucccucgucgaggucgcccccaccaccuucaaggaggaggagggccucggcuccgucgagcucuccggccuccccuccggcgaggccgaccucuccggcaaguccggcauggucgacgucuccggccaguucuccggcaccgucgacuccuccggcuucaccucccagacccccgaguucuccggccuccccuccggcaucgccgaggucuccggcgaguccucccgcgccgagaucggcuccucccuccccuccggcgccuacuacggcuccggcacccccuccuccuuccccaccgucucccucgucgaccgcacccucgucgaguccgucacccaggcccccaccgcccaggaggccggcgagggccccuccggcauccucgagcucuccggcgcccacuccggcgcccccgacauguccggcgagcacuccggcuuccucgaccucuccggccuccaguccggccucaucgagcccuccggcgagccccccggcacccccuacuucuccggcgacuucgccuccaccaccaacgucuccggcgaguccuccgucgccaugggcaccuccggcgaggccuccggccuccccgaggucacccucaucaccuccgaguucgucgagggcgucaccgagcccaccaucucccaggagcucggccagcgcccccccgucacccacaccccccagcucuucgaguccuccggcaaggucuccaccgccggcgacaucuccggcgccacccccguccuccccggcuccggcgucgaggucuccuccguccccgaguccuccuccgagaccuccgccuaccccgaggccggcuucggcgccuccgccgcccccgaggccucccgcgaggacuccggcucccccgaccucuccgagaccaccuccgccuuccacgaggccaaccucgagcgcuccuccggccucggcgucuccggcuccacccucaccuuccaggagggcgaggccuccgccgcccccgaggucuccggcgaguccaccaccaccuccgacgucggcaccgaggcccccggccuccccuccgccacccccaccgccuccggcgaccgcaccgagaucuccggcgaccucuccggccacaccucccagcucggcgucgucaucuccaccuccauccccgaguccgaguggacccagcagacccagcgccccgccgagacccaccucgagaucgaguccuccucccuccucuacuccggcgaggagacccacaccgucgagaccgccaccucccccaccgacgccuccauccccgccucccccgaguggaagcgcgaguccgaguccaccgccgccgaccaggaggucugcgaggagggcuggaacaaguaccagggccacugcuaccgccacuuccccgaccgcgagaccugggucgacgccgagcgccgcugccgcgagcagcagucccaccucuccuccaucgucacccccgaggagcaggaguucgucaacaacaacgcccaggacuaccaguggaucggccucaacgaccgcaccaucgagggcgacuuccgcugguccgacggccaccccaugcaguucgagaacuggcgccccaaccagcccgacaacuucuucgccgccggcgaggacugcgucgucaugaucuggcacgagaagggcgaguggaacgacguccccugcaacuaccaccuccccuucaccugcaagaagggcaccgccaccaccuacaagcgccgccuccagaagcgcuccucccgccacccccgccgcucccgccccuccaccgcccacuga

SEQ ID NO: 39275 - RNA, 1284 nt, Artificial Sequence
  derived and/or modified sequence opt2 from ACAT1__Homo_sapiens__NP_000010
auggccguccucgccgcccuccuccgcuccggcgcccgcucccgcuccccccuccuccgccgccucguccaggagauccgcuacgucgagcgcuccuacgucuccaagcccacccucaaggaggucgucaucgucuccgccacccgcacccccaucggcuccuuccucggcucccucucccuccuccccgccaccaagcucggcuccaucgccauccagggcgccaucgagaaggccggcauccccaaggaggaggucaaggaggccuacaugggcaacguccuccagggcggcgagggccaggcccccacccgccaggccguccucggcgccggccuccccaucuccacccccugcaccaccaucaacaaggucugcgccuccggcaugaaggccaucaugauggccucccagucccucaugugcggccaccaggacgucauggucgccggcggcauggaguccauguccaacguccccuacgucaugaaccgcggcuccacccccuacggcggcgucaagcucgaggaccucaucgucaaggacggccucaccgacgucuacaacaagauccacaugggcuccugcgccgagaacaccgccaagaagcucaacaucgcccgcaacgagcaggacgccuacgccaucaacuccuacacccgcuccaaggccgccugggaggccggcaaguucggcaacgaggucauccccgucaccgucaccgucaagggccagcccgacgucgucgucaaggaggacgaggaguacaagcgcgucgacuucuccaagguccccaagcucaagaccgucuuccagaaggagaacggcaccgucaccgccgccaacgccuccacccucaacgacggcgccgccgcccucguccucaugaccgccgacgccgccaagcgccucaacgucaccccccucgcccgcaucgucgccuucgccgacgccgccgucgagcccaucgacuuccccaucgcccccgucuacgccgccuccaugguccucaaggacgucggccucaagaaggaggacaucgccaugugggaggucaacgaggccuucucccucgucguccucgccaacaucaagaugcucgagaucgacccccagaaggucaacaucaacggcggcgccgucucccucggccaccccaucggcauguccggcgcccgcaucgucggccaccucacccacgcccucaagcagggcgaguacggccucgccuccaucugcaacggcggcggcggcgccuccgccaugcucauccagaagcucuga

SEQ ID NO: 39276 - RNA, 1281 nt, Artificial Sequence
  derived and/or modified sequence opt2 from ACAT2__Homo_sapiens__NP_001290182
augggcucccaccccguccuccgcaucuggggcaaccgccgcgccaccgccgccucccucggccgcuccggcggccgccucuccuccccccgccuccuccgcgucgucgcccccacccucaccuucgcccagaccucccgcugcuccuucaacggcgcccucgccgccguccccguccaggaccucggcuccaccgucaucaaggagguccucaagcgcgccaccgucgcccccgaggacgucuccgaggucaucuucggccacguccucgccgccggcugcggccagaaccccguccgccaggccuccgucggcgccggcauccccuacuccguccccgccugguccugccagaugaucugcggcuccggccucaaggccgucugccucgccguccaguccaucggcaucggcgacuccuccaucgucgucgccggcggcauggagaacauguccaaggccccccaccucgccuaccuccgcaccggcgucaagaucggcgagaugccccucaccgacuccauccucugcgacggccucaccgacgccuuccacaacugccacaugggcaucaccgccgagaacgucgccaagaaguggcaggucucccgcgaggaccaggacaaggucgccguccucucccagaaccgcaccgagaacgcccagaaggccggccacuucgacaaggagaucguccccguccucgucuccacccgcaagggccucaucgaggucaagaccgacgaguucccccgccacggcuccaacaucgaggccauguccaagcucaagcccuacuuccucaccgacggcaccggcaccgucacccccgccaacgccuccggcaucaacgacggcgccgccgccgucguccucaugaagaaguccgaggccgacaagcgcggccucaccccccucgcccgcaucgucuccuggucccaggucggcgucgagcccuccaucaugggcaucggccccauccccgccaucaagcaggccgucaccaaggccggcuggucccucgaggacgucgacaucuucgagaucaacgaggccuucgccgccgucuccgccgccaucgucaaggagcucggccucaaccccgagaaggucaacaucgagggcggcgccaucgcccucggccacccccucggcgccuccggcugccgcauccucgucacccuccuccacacccucgagcgcaugggccgcucccgcggcgucgccgcccucugcaucggcggcggcaugggcaucgccaugugcguccagcgcgaguga

SEQ ID NO: 39277 - RNA, 1587 nt, Artificial Sequence
  derived and/or modified sequence opt2 from ACBD3__Homo_sapiens__NP_073572
auggccgccguccucaacgccgagcgccucgaggucuccgucgacggccucacccucucccccgaccccgaggagcgccccggcgccgagggcgccccccuccucccccccccccuccccccccccuccccccccggcuccggccgcggccccggcgccuccggcgagcagcccgagcccggcgaggccgccgccggcggcgccgccgaggaggcccgccgccucgagcagcgcuggggcuucggccucgaggagcucuacggccucgcccuccgcuucuucaaggagaaggacggcaaggccuuccaccccaccuacgaggagaagcucaagcucgucgcccuccacaagcagguccucaugggccccuacaaccccgacaccugccccgaggucggcuucuucgacguccucggcaacgaccgccgccgcgagugggccgcccucggcaacauguccaaggaggacgccauggucgaguucgucaagcuccucaaccgcugcugccaccucuucuccaccuacgucgccucccacaagaucgagaaggaggagcaggagaagaagcgcaaggaggaggaggagcgccgccgccgcgaggaggaggagcgcgagcgccuccagaaggaggaggagaagcgccgccgcgaggaggaggagcgccuccgccgcgaggaggaggagcgccgccgcaucgaggaggagcgccuccgccucgagcagcagaagcagcagaucauggccgcccucaacucccagaccgccguccaguuccagcaguacgccgcccagcaguaccccggcaacuacgagcagcagcagauccucauccgccagcuccaggagcagcacuaccagcaguacaugcagcagcucuaccagguccagcucgcccagcagcaggccgcccuccagaagcagcaggaggucgucgucgccggcuccucccuccccaccuccuccaaggucaacgccaccguccccuccaacaugauguccgucaacggccaggccaagacccacaccgacuccuccgagaaggagcucgagcccgaggccgccgaggaggcccucgagaacggccccaaggagucccuccccgucaucgccgcccccuccauguggacccgcccccagaucaaggacuucaaggagaagauccagcaggacgccgacuccgucaucaccgucggccgcggcgaggucgucaccguccgcguccccacccacgaggagggcuccuaccucuucugggaguucgccaccgacaacuacgacaucggcuucggcgucuacuucgaguggaccgacucccccaacaccgccgucuccguccacgucuccgaguccuccgacgacgacgaggaggaggaggagaacaucggcugcgaggagaaggccaagaagaacgccaacaagccccuccucgacgagaucguccccgucuaccgccgcgacugccacgaggaggucuacgccggcucccaccaguaccccggccgcggcgucuaccuccucaaguucgacaacuccuacucccucuggcgcuccaaguccgucuacuaccgcgucuacuacacccgcuga

SEQ ID NO: 39278 - RNA, 1026 nt, Artificial Sequence
  derived and/or modified sequence opt2 from ACBD4__Homo_sapiens__NP_001129176
augggcaccgagaaggagucccccgagcccgacugccagaagcaguuccaggccgccgucuccgucauccagaaccuccccaagaacggcuccuaccgccccuccuacgaggagaugcuccgcuucuacuccuacuacaagcaggccaccaugggccccugccucgucccccgccccggcuucugggaccccaucggccgcuacaagugggacgccuggaacucccucggcaagaugucccgcgaggaggccauguccgccuacaucaccgagaugaagcucgucgcccagaaggucaucgacaccgucccccucggcgaggucgccgaggacauguucggcuacuucgagccccucuaccaggucauccccgacaugccccgcccccccgagaccuuccuccgccgcgucaccggcuggaaggagcaggucgucaacggcgacgucggcgccgucuccgagccccccugccuccccaaggagcccgccccccccucccccgccucccucugggccgucacccuccccacccccccccagucccccauccaccccggcaccuggaccccccgcuucuccgucauccccugguccuccuggucccucuccugguucggccaguccuccggccagcaccucgaggaguccgucauccccggcaccgcccccugccccccccagcgcaagcgcggcugcggcgccgcccgccgcggcccccgcuccuggaccugcggcugcuggggccaguucgagcacuaccgccgcgccugccgccgcugccgccgcggcugccgcgccuggcgcgccugccccggcccccucucccgcggccgcucccccggccccguccucggccacggcccccucggcucccgcggcccccgcugcuccuccuccuccugcggccccuccuccuccuccggcuccuccgagugcuucggccccaagcgcggcgacugccaguggcgcggccucugcucccagcuccgccucuccugcugcgcccucucccucccccgcgucuga

SEQ ID NO: 39279 - RNA, 1473 nt, Artificial Sequence
  derived and/or modified sequence opt2 from ACBD5__Homo_sapiens__NP_001035938
auggccgacacccgcuccguccacgagacccgcuucgaggccgccgucaaggucauccagucccuccccaagaacggcuccuuccagcccaccaacgagaugaugcucaaguucuacuccuucuacaagcaggccaccgagggccccugcaagcucucccgccccggcuucugggaccccaucggccgcuacaagugggacgccugguccucccucggcgacaugaccaaggaggaggccaugaucgccuacgucgaggagaugaagaagaucaucgagaccaugcccaugaccgagaaggucgaggagcuccuccgcgucaucggccccuucuacgagaucgucgaggacaagaaguccggccgcuccuccgacaucaccuccgaccucggcaacguccucaccuccacccccaacgccaagaccgucaacggcaaggccgaguccuccgacuccggcgccgaguccgaggaggaggaggcccaggaggaggucaagggcgccgagcaguccgacaacgacaagaagaugaugaagaaguccgccgaccacaagaaccucgaggucaucgucaccaacggcuacgacaaggacggcuucguccaggacauccagaacgacauccacgccuccuccucccucaacggccgcuccaccgaggaggucaagcccaucgacgagaaccucggccagaccggcaaguccgccgucugcauccaccaggacaucaacgacgaccacgucgaggacgucaccggcauccagcaccucaccuccgacuccgacuccgaggucuacugcgacuccauggagcaguucggccaggaggagucccucgacuccuucaccuccaacaacggccccuuccaguacuaccucggcggccacuccucccagcccauggagaacuccggcuuccgcgaggacauccaggucccccccggcaacggcaacaucggcaacaugcaggucgucgccgucgagggcaagggcgaggucaagcacggcggcgaggacggccgcaacaacuccggcgccccccaccgcgagaagcgcggcggcgagaccgacgaguucuccaacguccgccgcggccgcggccaccgcaugcagcaccucuccgagggcaccaagggccgccaggucggcuccggcggcgacggcgagcgcuggggcuccgaccgcggcucccgcggcucccucaacgagcagaucgcccucguccucaugcgccuccaggaggacaugcagaacguccuccagcgccuccagaagcucgagacccucaccgcccuccaggccaaguccuccaccuccacccuccagaccgccccccagcccaccucccagcgccccuccugguggcccuucgagaugucccccggcguccucaccuucgccaucaucuggcccuucaucgcccaguggcucgucuaccucuacuaccagcgccgccgccgcaagcucaacuga

SEQ ID NO: 39280 - RNA, 849 nt, Artificial Sequence
  derived and/or modified sequence opt2 from ACBD6__Homo_sapiens__NP_115736
auggccuccuccuuccuccccgccggcgccaucaccggcgacuccggcggcgagcucuccuccggcgacgacuccggcgaggucgaguucccccacucccccgagaucgaggagaccuccugccucgccgagcucuucgagaaggccgccgcccaccuccagggccucauccaggucgccucccgcgagcagcuccucuaccucuacgcccgcuacaagcaggucaaggucggcaacugcaacacccccaagcccuccuucuucgacuucgagggcaagcagaagugggaggccuggaaggcccucggcgacuccucccccucccaggccaugcaggaguacaucgccgucgucaagaagcucgaccccggcuggaacccccagauccccgagaagaagggcaaggaggccaacaccggcuucggcggccccgucaucuccucccucuaccacgaggagaccauccgcgaggaggacaagaacaucuucgacuacugccgcgagaacaacaucgaccacaucaccaaggccaucaaguccaagaacgucgacgucaacgucaaggacgaggagggccgcgcccuccuccacugggccugcgaccgcggccacaaggagcucgucaccguccuccuccagcaccgcgccgacaucaacugccaggacaacgagggccagaccgcccuccacuacgccuccgccugcgaguuccucgacaucgucgagcuccuccuccaguccggcgccgaccccacccuccgcgaccaggacggcugccuccccgaggaggucaccggcugcaagaccgucucccucguccuccagcgccacaccaccggcaaggccuga

SEQ ID NO: 39281 - RNA, 1506 nt, Artificial Sequence
  derived and/or modified sequence opt2 from ACCS__Homo_sapiens__NP_115981
auguucacccucccccagaaggacuuccgcgcccccaccaccugccucggccccaccugcaugcaggaccucggcuccucccacggcgaggaccucgagggcgagugcucccgcaagcucgaccagaagcuccccgagcuccgcggcgucggcgaccccgccaugaucuccuccgacaccuccuaccucuccucccgcggccgcaugaucaagugguucugggacuccgccgaggagggcuaccgcaccuaccacauggacgaguacgacgaggacaagaaccccuccggcaucaucaaccucggcaccuccgagaacaagcucugcuucgaccuccucuccuggcgccucucccagcgcgacaugcagcgcgucgagcccucccuccuccaguacgccgacuggcgcggccaccucuuccuccgcgaggaggucgccaaguuccucuccuucuacugcaagucccccgucccccuccgccccgagaacgucgucguccucaacggcggcgccucccucuucuccgcccucgccaccguccucugcgaggccggcgaggccuuccucauccccacccccuacuacggcgccaucacccagcacgucugccucuacggcaacauccgccucgccuacgucuaccucgacuccgaggucaccggccucgacacccgccccuuccagcucaccgucgagaagcucgagauggcccuccgcgaggcccacuccgagggcgucaaggucaagggccucauccucaucuccccccagaacccccucggcgacgucuacucccccgaggagcuccaggaguaccucgucuucgccaagcgccaccgccuccacgucaucgucgacgaggucuacaugcucuccgucuucgagaaguccgucggcuaccgcuccguccucucccucgagcgccuccccgacccccagcgcacccacgucaugugggccaccuccaaggacuucggcauguccggccuccgcuucggcacccucuacaccgagaaccaggacgucgccaccgccgucgccucccucugccgcuaccacggccucuccggccucguccaguaccagauggcccagcuccuccgcgaccgcgacuggaucaaccaggucuaccuccccgagaaccacgcccgccucaaggccgcccacaccuacgucuccgaggagcuccgcgcccucggcauccccuuccucucccgcggcgccggcuucuucaucugggucgaccuccgcaaguaccuccccaagggcaccuucgaggaggagaugcuccucuggcgccgcuuccucgacaacaagguccuccucuccuucggcaaggccuucgagugcaaggagcccggcugguuccgcuucgucuucuccgaccagguccaccgccucugccucggcaugcagcgcguccagcagguccucgccggcaagucccaggucgccgaggacccccgccccucccagucccaggagcccuccgaccagcgccgcuga

SEQ ID NO: 39282 - RNA, 1635 nt, Artificial Sequence
  derived and/or modified sequence opt2 from ACD__Homo_sapiens__NP_001075955
augcccggccgcugccaguccgacgccgccaugcgcgucaacggccccgccucccgcgcccccgccggcuggaccuccggcucccuccacaccggcccccgcgccggccgcccccgcgcccaggcccgcggcguccgcggccgcggccuccuccuccgcccccgccccgccaaggagcucccccucccccgcaagggcggcgccugggcccccgccggcaaccccggcccccuccacccccucggcgucgccgucggcauggccggcuccggccgccucguccuccgccccuggauccgcgagcucauccucggcuccgagacccccuccuccccccgcgccggccagcuccucgagguccuccaggacgccgaggccgccgucgccggccccucccacgcccccgacaccuccgacgucggcgccacccuccucgucuccgacggcacccacuccguccgcugccucgucacccgcgaggcccucgacaccuccgacugggaggagaaggaguucggcuuccgcggcaccgagggccgccuccuccuccuccaggacugcggcguccacguccaggucgccgagggcggcgcccccgccgaguucuaccuccaggucgaccgcuucucccuccuccccaccgagcagccccgccuccgcguccccggcugcaaccaggaccucgacguccagaagaagcucuacgacugccucgaggagcaccucuccgaguccaccuccuccaacgccggccucucccucucccagcuccucgacgagaugcgcgaggaccaggagcaccagggcgcccucgucugccucgccgaguccugccucacccucgagggccccugcaccgccccccccgucacccacugggccgccucccgcugcaaggccaccggcgaggccgucuacaccguccccuccuccaugcucugcaucuccgagaacgaccagcucauccucuccucccucggccccugccagcgcacccagggccccgagcuccccccccccgaccccgcccuccaggaccucucccucacccucaucgccuccccccccuccucccccuccuccuccggcacccccgcccuccccggccacauguccuccgaggaguccggcaccuccaucucccuccuccccgcccucucccucgccgcccccgaccccggccagcgcuccuccucccagcccucccccgccaucugcuccgcccccgccacccucaccccccgcuccccccacgccucccgcacccccuccuccccccuccaguccugcacccccucccucuccccccgcucccacguccccuccccccaccaggcccucgucacccgcccccagaagcccucccucgaguucaaggaguucgucggccuccccugcaagaaccgcccccccuucccccgcaccggcgccacccgcggcgcccaggagcccugcuccgucugggagccccccaagcgccaccgcgacggcuccgccuuccaguacgaguacgagccccccugcaccucccucugcgcccgcguccaggccguccgccuccccccccagcucauggccugggcccuccacuuccucauggacgcccagcccggcuccgagcccacccccauguga

SEQ ID NO: 39283 - RNA, 2418 nt, Artificial Sequence
  derived and/or modified sequence opt2 from ACE2__Homo_sapiens__NP_068576
auguccuccuccuccuggcuccuccucucccucgucgccgucaccgccgcccaguccaccaucgaggagcaggccaagaccuuccucgacaaguucaaccacgaggccgaggaccucuucuaccaguccucccucgccuccuggaacuacaacaccaacaucaccgaggagaacguccagaacaugaacaacgccggcgacaagugguccgccuuccucaaggagcaguccacccucgcccagauguacccccuccaggagauccagaaccucaccgucaagcuccagcuccaggcccuccagcagaacggcuccuccguccucuccgaggacaaguccaagcgccucaacaccauccucaacaccauguccaccaucuacuccaccggcaaggucugcaaccccgacaacccccaggagugccuccuccucgagcccggccucaacgagaucauggccaacucccucgacuacaacgagcgccucugggccugggaguccuggcgcuccgaggucggcaagcagcuccgcccccucuacgaggaguacgucguccucaagaacgagauggcccgcgccaaccacuacgaggacuacggcgacuacuggcgcggcgacuacgaggucaacggcgucgacggcuacgacuacucccgcggccagcucaucgaggacgucgagcacaccuucgaggagaucaagccccucuacgagcaccuccacgccuacguccgcgccaagcucaugaacgccuaccccuccuacaucucccccaucggcugccuccccgcccaccuccucggcgacauguggggccgcuucuggaccaaccucuacucccucaccguccccuucggccagaagcccaacaucgacgucaccgacgccauggucgaccaggccugggacgcccagcgcaucuucaaggaggccgagaaguucuucgucuccgucggccuccccaacaugacccagggcuucugggagaacuccaugcucaccgaccccggcaacguccagaaggccgucugccaccccaccgccugggaccucggcaagggcgacuuccgcauccucaugugcaccaaggucaccauggacgacuuccucaccgcccaccacgagaugggccacauccaguacgacauggccuacgccgcccagcccuuccuccuccgcaacggcgccaacgagggcuuccacgaggccgucggcgagaucaugucccucuccgccgccacccccaagcaccucaaguccaucggccuccucucccccgacuuccaggaggacaacgagaccgagaucaacuuccuccucaagcaggcccucaccaucgucggcacccuccccuucaccuacaugcucgagaaguggcgcuggauggucuucaagggcgagauccccaaggaccaguggaugaagaaguggugggagaugaagcgcgagaucgucggcgucgucgagcccgucccccacgacgagaccuacugcgaccccgccucccucuuccacgucuccaacgacuacuccuucauccgcuacuacacccgcacccucuaccaguuccaguuccaggaggcccucugccaggccgccaagcacgagggcccccuccacaagugcgacaucuccaacuccaccgaggccggccagaagcucuucaacaugcuccgccucggcaaguccgagcccuggacccucgcccucgagaacgucgucggcgccaagaacaugaacguccgcccccuccucaacuacuucgagccccucuucaccuggcucaaggaccagaacaagaacuccuucgucggcugguccaccgacuggucccccuacgccgaccaguccaucaagguccgcaucucccucaaguccgcccucggcgacaaggccuacgaguggaacgacaacgagauguaccucuuccgcuccuccgucgccuacgccaugcgccaguacuuccucaaggucaagaaccagaugauccucuucggcgaggaggacguccgcgucgccaaccucaagccccgcaucuccuucaacuucuucgucaccgcccccaagaacgucuccgacaucaucccccgcaccgaggucgagaaggccauccgcaugucccgcucccgcaucaacgacgccuuccgccucaacgacaacucccucgaguuccucggcauccagcccacccucggcccccccaaccagccccccgucuccaucuggcucaucgucuucggcgucgucaugggcgucaucgucgucggcaucgucauccucaucuucaccggcauccgcgaccgcaagaagaagaacaaggcccgcuccggcgagaaccccuacgccuccaucgacaucuccaagggcgagaacaaccccggcuuccagaacaccgacgacguccagaccuccuucuga

SEQ ID NO: 39284 - RNA, 3921 nt, Artificial Sequence
  derived and/or modified sequence opt2 from ACE__Homo_sapiens__NP_000780
augggcgccgccuccggccgccgcggccccggccuccuccucccccucccccuccuccuccuccuccccccccagcccgcccucgcccucgaccccggccuccagcccggcaacuucuccgccgacgaggccggcgcccagcucuucgcccaguccuacaacuccuccgccgagcagguccucuuccaguccgucgccgccuccugggcccacgacaccaacaucaccgccgagaacgcccgccgccaggaggaggccgcccuccucucccaggaguucgccgaggccuggggccagaaggccaaggagcucuacgagcccaucuggcagaacuucaccgacccccagcuccgccgcaucaucggcgccguccgcacccucggcuccgccaaccucccccucgccaagcgccagcaguacaacgcccuccucuccaacaugucccgcaucuacuccaccgccaaggucugccuccccaacaagaccgccaccugcuggucccucgaccccgaccucaccaacauccucgccuccucccgcuccuacgccaugcuccucuucgccugggagggcuggcacaacgccgccggcaucccccucaagccccucuacgaggacuucaccgcccucuccaacgaggccuacaagcaggacggcuucaccgacaccggcgccuacuggcgcuccugguacaacucccccaccuucgaggacgaccucgagcaccucuaccagcagcucgagccccucuaccucaaccuccacgccuucguccgccgcgcccuccaccgccgcuacggcgaccgcuacaucaaccuccgcggccccauccccgcccaccuccucggcgacaugugggcccaguccugggagaacaucuacgacauggucguccccuuccccgacaagcccaaccucgacgucaccuccaccaugcuccagcagggcuggaacgccacccacauguuccgcgucgccgaggaguucuucaccucccucgagcucucccccaugccccccgaguucugggagggcuccaugcucgagaagcccgccgacggccgcgaggucgucugccacgccuccgccugggacuucuacaaccgcaaggacuuccgcaucaagcagugcacccgcgucaccauggaccagcucuccaccguccaccacgagaugggccacauccaguacuaccuccaguacaaggaccuccccgucucccuccgccgcggcgccaaccccggcuuccacgaggccaucggcgacguccucgcccucuccgucuccacccccgagcaccuccacaagaucggccuccucgaccgcgucaccaacgacaccgaguccgacaucaacuaccuccucaagauggcccucgagaagaucgccuuccuccccuucggcuaccucgucgaccaguggcgcuggggcgucuucuccggccgcaccccccccucccgcuacaacuucgacuggugguaccuccgcaccaaguaccagggcaucugcccccccgucacccgcaacgagacccacuucgacgccggcgccaaguuccacguccccaacgucacccccuacauccgcuacuucgucuccuucguccuccaguuccaguuccacgaggcccucugcaaggaggccggcuacgagggcccccuccaccagugcgacaucuaccgcuccaccaaggccggcgccaagcuccgcaagguccuccaggccggcuccucccgccccuggcaggagguccucaaggacauggucggccucgacgcccucgacgcccagccccuccucaaguacuuccagcccgucacccaguggcuccaggagcagaaccagcagaacggcgagguccucggcuggcccgaguaccaguggcaccccccccuccccgacaacuaccccgagggcaucgaccucgucaccgacgaggccgaggccuccaaguucgucgaggaguacgaccgcaccucccaggucgucuggaacgaguacgccgaggccaacuggaacuacaacaccaacaucaccaccgagaccuccaagauccuccuccagaagaacaugcagaucgccaaccacacccucaaguacggcacccaggcccgcaaguucgacgucaaccagcuccagaacaccaccaucaagcgcaucaucaagaagguccaggaccucgagcgcgccgcccuccccgcccaggagcucgaggaguacaacaagauccuccucgacauggagaccaccuacuccgucgccaccgucugccaccccaacggcuccugccuccagcucgagcccgaccucaccaacgucauggccaccucccgcaaguacgaggaccuccucugggccugggagggcuggcgcgacaaggccggccgcgccauccuccaguucuaccccaaguacgucgagcucaucaaccaggccgcccgccucaacggcuacgucgacgccggcgacuccuggcgcuccauguacgagacccccucccucgagcaggaccucgagcgccucuuccaggagcuccagccccucuaccucaaccuccacgccuacguccgccgcgcccuccaccgccacuacggcgcccagcacaucaaccucgagggccccauccccgcccaccuccucggcaacaugugggcccagaccugguccaacaucuacgaccucgucguccccuuccccuccgcccccuccauggacaccaccgaggccaugcucaagcagggcuggaccccccgccgcauguucaaggaggccgacgacuucuucaccucccucggccuccuccccgucccccccgaguucuggaacaaguccaugcucgagaagcccaccgacggccgcgaggucgucugccacgccuccgccugggacuucuacaacggcaaggacuuccgcaucaagcagugcaccaccgucaaccucgaggaccucgucgucgcccaccacgagaugggccacauccaguacuucaugcaguacaaggaccuccccgucgcccuccgcgagggcgccaaccccggcuuccacgaggccaucggcgacguccucgcccucuccgucuccacccccaagcaccuccacucccucaaccuccucuccuccgagggcggcuccgacgagcacgacaucaacuuccucaugaagauggcccucgacaagaucgccuucauccccuucuccuaccucgucgaccaguggcgcuggcgcgucuucgacggcuccaucaccaaggagaacuacaaccaggagugguggucccuccgccucaaguaccagggccucugcccccccgucccccgcacccagggcgacuucgaccccggcgccaaguuccacauccccuccuccguccccuacauccgcuacuucgucuccuucaucauccaguuccaguuccacgaggcccucugccaggccgccggccacaccggcccccuccacaagugcgacaucuaccaguccaaggaggccggccagcgccucgccaccgccaugaagcucggcuucucccgccccuggcccgaggccaugcagcucaucaccggccagcccaacauguccgccuccgccaugcucuccuacuucaagccccuccucgacuggcuccgcaccgagaacgagcuccacggcgagaagcucggcuggccccaguacaacuggacccccaacuccgcccgcuccgagggcccccuccccgacuccggccgcgucuccuuccucggccucgaccucgacgcccagcaggcccgcgucggccaguggcuccuccucuuccucggcaucgcccuccucgucgccacccucggccucucccagcgccucuucuccauccgccaccgcucccuccaccgccacucccacggcccccaguucggcuccgaggucgagcuccgccacuccuga

SEQ ID NO: 39285 - RNA, 828 nt, Artificial Sequence
  derived and/or modified sequence opt2 from ACER2__Homo_sapiens__NP_001010887
augggcgccccccacuggugggaccagcuccaggccggcuccuccgaggucgacuggugcgaggacaacuacaccaucguccccgccaucgccgaguucuacaacaccaucuccaacguccucuucuucauccucccccccaucugcaugugccucuuccgccaguacgccaccugcuucaacuccggcaucuaccucaucuggacccuccucgucgucgucggcaucggcuccgucuacuuccacgccacccucuccuuccucggccagaugcucgacgagcucgccguccucuggguccucaugugcgcccucgccaugugguucccccgccgcuaccuccccaagaucuuccgcaacgaccgcggccgcuucaaggucgucgucuccguccucuccgccgucaccaccugccucgccuucgucaagcccgccaucaacaacaucucccucaugacccucggcguccccugcaccgcccuccucaucgccgagcucaagcgcugcgacaacaugcgcgucuucaagcucggccucuucuccggccucugguggacccucgcccucuucugcuggaucuccgaccgcgccuucugcgagcuccucuccuccuucaacuuccccuaccuccacugcauguggcacauccucaucugccucgccgccuaccucggcugcgucugcuucgccuacuucgacgccgccuccgagauccccgagcagggccccgucaucaaguucuggcccaacgagaagugggccuucaucggcguccccuacgucucccuccucugcgccaacaagaaguccuccgucaagaucaccuga

SEQ ID NO: 39286 - RNA, 693 nt, Artificial Sequence
  derived and/or modified sequence opt2 from ACER3__Homo_sapiens__NP_001287882
auggcccccgccgccgaccgcgagggcuacuggggccccaccaccuccacccucgacuggugcgaggagaacuacuccgucaccugguacaucgccgaguuccucgucggcaugggcuccuggugcuuccacaugacccucaaguacgagaugcagcuccucgacgagcuccccaugaucuacuccugcugcaucuucgucuacugcauguucgagugcuucaagaucaagaacuccgucaacuaccaccuccucuucacccucguccucuucucccucaucgucaccaccgucuaccucaaggucaaggagcccaucuuccaccaggucauguacggcaugcucgucuucacccucguccuccgcuccaucuacaucgucaccugggucuaccccuggcuccgcggccucggcuacaccucccucggcaucuuccuccucggcuuccucuucuggaacaucgacaacaucuucugcgagucccuccgcaacuuccgcaagaaggucccccccaucaucggcaucaccacccaguuccacgccugguggcacauccucaccggccucggcuccuaccuccacauccucuucucccucuacacccgcacccucuaccuccgcuaccgccccaaggucaaguuccucuucggcaucuggcccgucauccucuucgagccccuccgcaagcacuga

SEQ ID NO: 39287 - RNA, 1581 nt, Artificial Sequence
  derived and/or modified sequence opt2 from ACHE__Homo_sapiens__NP_001269378
augcgccccccccagugccuccuccacacccccucccucgccuccccccuccuccuccuccuccucuggcuccucggcggcggcgucggcgccgagggccgcgaggacgccgagcuccucgucaccguccgcggcggccgccuccgcggcauccgccucaagacccccggcggccccgucuccgccuuccucggcauccccuucgccgagccccccaugggcccccgccgcuuccucccccccgagcccaagcagcccugguccggcgucgucgacgccaccaccuuccaguccgucugcuaccaguacgucgacacccucuaccccggcuucgagggcaccgagauguggaaccccaaccgcgagcucuccgaggacugccucuaccucaacgucuggacccccuacccccgccccaccucccccacccccguccucgucuggaucuacggcggcggcuucuacuccggcgccuccucccucgacgucuacgacggccgcuuccucguccaggccgagcgcaccguccucgucuccaugaacuaccgcgucggcgccuucggcuuccucgcccuccccggcucccgcgaggcccccggcaacgucggccuccucgaccagcgccucgcccuccaguggguccaggagaacgucgccgccuucggcggcgaccccaccuccgucacccucuucggcgaguccgccggcgccgccuccgucggcaugcaccuccucuccccccccucccgcggccucuuccaccgcgccguccuccaguccggcgcccccaacggccccugggccaccgucggcaugggcgaggcccgccgccgcgccacccagcucgcccaccucgucggcugcccccccggcggcaccggcggcaacgacaccgagcucgucgccugccuccgcacccgccccgcccagguccucgucaaccacgaguggcacguccucccccaggaguccgucuuccgcuucuccuucguccccgucgucgacggcgacuuccucuccgacacccccgaggcccucaucaacgccggcgacuuccacggccuccagcucgccggccgccucgccgcccagggcgcccgcgucuacgccuacgucuucgagcaccgcgccuccacccucuccuggccccucuggaugggcgucccccacggcuacgagaucgaguucaucuucggcaucccccucgaccccucccgcaacuacaccgccgaggagaagaucuucgcccagcgccucaugcgcuacugggccaacuucgcccgcaccggcgaccccaacgagccccgcgaccccaaggccccccaguggccccccuacaccgccggcgcccagcaguacgucucccucgaccuccgcccccucgagguccgccgcggccuccgcgcccaggccugcgccuucuggaaccgcuuccuccccaagcuccucuccgccaccgacacccucgacgaggccgagcgccaguggaaggccgaguuccaccgcugguccuccuacaugguccacuggaagaaccaguucgaccacuacuccaagcaggaccgcugcuccgaccucuga

SEQ ID NO: 39288 - RNA, 3987 nt, Artificial Sequence
  derived and/or modified sequence opt2 from ACIN1__Homo_sapiens__NP_001158286
auguggcgccgcaagcacccccgcaccuccggcggcacccgcggcguccucuccggcaaccgcggcgucgaguacggcuccggccgcggccaccucggcaccuucgagggccgcuggcgcaagcuccccaagaugcccgaggccgucggcaccgaccccuccaccucccgcaagauggccgagcucgaggaggucacccucgacggcaagccccuccaggcccuccgcgucaccgaccucaaggccgcccucgagcagcgcggccucgccaaguccggccagaaguccgcccucgucaagcgccucaagggcgcccucaugcucgagaaccuccagaagcacuccaccccccacgccgccuuccagcccaacucccagaucggcgaggagaugucccagaacuccuucaucaagcaguaccucgagaagcagcaggagcuccuccgccagcgccucgagcgcgaggcccgcgaggccgccgagcucgaggaggccuccgccgaguccgaggacgagaugauccaccccgagggcgucgccucccuccucccccccgacuuccaguccucccucgagcgccccgagcucgagcucucccgccacuccccccgcaaguccuccuccaucuccgaggagaagggcgacuccgacgacgagaagccccgcaagggcgagcgccgcuccucccgcguccgccaggcccgcgccgccaagcucuccgagggcucccagcccgccgaggaggaggaggaccaggagacccccucccgcaaccuccgcguccgcgccgaccgcaaccucaagaccgaggaggaggaggaggaggaggaggaggaggaggaggacgacgaggaggaggagggcgacgacgagggccagaagucccgcgaggcccccauccucaaggaguucaaggaggagggcgaggagaucccccgcgucaagcccgaggagaugauggacgagcgccccaagacccgcucccaggagcaggagguccucgagcgcggcggccgcuucacccgcucccaggaggaggcccgcaagucccaccucgcccgccagcagcaggagaaggagaugaagaccaccuccccccucgaggaggaggagcgcgagaucaaguccucccagggccucaaggagaaguccaagucccccucccccccccgccucaccgaggaccgcaagaaggccucccucgucgcccuccccgagcagaccgccuccgaggaggagaccccccccccccuccucaccaaggaggccuccuccccccccccccacccccagcuccacuccgaggaggagaucgagcccauggagggccccgccccccccguccucauccagcucuccccccccaacaccgacgccgacacccgcgagcuccucgucucccagcacaccguccagcucgucggcggccucuccccccucuccucccccuccgacaccaaggccgagucccccgccgagaagguccccgaggaguccguccucccccucguccagaaguccacccucgccgacuacuccgcccagaaggaccucgagcccgaguccgaccgcuccgcccagccccucccccucaagaucgaggagcucgcccucgccaagggcaucaccgaggagugccucaagcagcccucccucgagcagaaggagggccgccgcgccucccacacccuccuccccucccaccgccucaagcaguccgccgacuccuccuccucccgcuccuccuccuccuccuccuccuccucccgcucccgcucccgcucccccgacuccuccggcucccgcucccacuccccccuccgcuccaagcagcgcgacgucgcccaggcccgcacccacgccaacccccgcggccgccccaagaugggcucccgcuccaccuccgagucccgcucccgcucccgcucccgcucccgcuccgccuccuccaacucccgcaagucccucucccccggcgucucccgcgacuccuccaccuccuacaccgagaccaaggaccccuccuccggccaggaggucgccaccccccccgucccccagcuccaggucugcgagcccaaggagcgcaccuccaccuccuccuccuccguccaggcccgccgccucucccagcccgaguccgccgagaagcacgucacccagcgccuccagcccgagcgcggcucccccaagaagugcgaggccgaggaggccgagccccccgccgccacccagccccagaccuccgagacccagaccucccaccuccccgaguccgagcgcauccaccacaccgucgaggagaaggaggaggucaccauggacaccuccgagaaccgccccgagaacgacguccccgagccccccaugcccaucgccgaccaggucuccaacgacgaccgccccgagggcuccgucgaggacgaggagaagaaggaguccucccuccccaaguccuucaagcgcaagaucuccgucgucuccaccaagggcguccccgccggcaacuccgacaccgagggcggccagcccggccgcaagcgccgcuggggcgccuccaccgccaccacccagaagaagcccuccaucuccaucaccaccgagucccucaaggaggccgucgucgaccuccacgccgacgacucccgcaucuccgaggacgagaccgagcgcaacggcgacgacggcacccacgacaagggccucaagaucugccgcaccgucacccaggucguccccgccgagggccaggagaacggccagcgcgaggaggaggaggaggagaaggagcccgaggccgagccccccguccccccccaggucuccgucgaggucgcccuccccccccccgccgagcacgaggucaagaaggucacccucggcgacacccucacccgccgcuccaucucccagcagaaguccggcgucuccaucaccaucgacgaccccguccgcaccgcccagguccccucccccccccgcggcaagaucuccaacaucguccacaucuccaaccucguccgccccuucacccucggccagcucaaggagcuccucggccgcaccggcacccucgucgaggaggccuucuggaucgacaagaucaagucccacugcuucgucaccuacuccaccgucgaggaggccgucgccacccgcaccgcccuccacggcgucaaguggccccaguccaaccccaaguuccucugcgccgacuacgccgagcaggacgagcucgacuaccaccgcggccuccucgucgaccgccccuccgagaccaagaccgaggagcagggcaucccccgcccccuccacccccccccccccccccccguccagcccccccagcacccccgcgccgagcagcgcgagcaggagcgcgccguccgcgagcagugggccgagcgcgagcgcgagauggagcgccgcgagcgcacccgcuccgagcgcgagugggaccgcgacaagguccgcgagggcccccgcucccgcucccgcucccgcgaccgccgccgcaaggagcgcgccaaguccaaggagaagaaguccgagaagaaggagaaggcccaggaggagccccccgccaagcuccucgacgaccucuuccgcaagaccaaggccgcccccugcaucuacuggcucccccucaccgacucccagaucguccagaaggaggccgagcgcgccgagcgcgccaaggagcgcgagaagcgccgcaaggagcaggaggaggaggagcagaaggagcgcgagaaggaggccgagcgcgagcgcaaccgccagcucgagcgcgagaagcgccgcgagcacucccgcgagcgcgaccgcgagcgcgagcgcgagcgcgagcgcgaccgcggcgaccgcgaccgcgaccgcgagcgcgaccgcgagcgcggccgcgagcgcgaccgccgcgacaccaagcgccacucccgcucccgcucccgcuccacccccguccgcgaccgcggcggccgccgcuga

SEQ ID NO: 39289 - RNA, 1017 nt, Artificial Sequence
  derived and/or modified sequence opt2 from ACKR1__Homo_sapiens__NP_001116423
auggccuccuccggcuacguccuccaggccgagcucucccccuccaccgagaacuccucccagcucgacuucgaggacgucuggaacuccuccuacggcgucaacgacuccuuccccgacggcgacuacggcgccaaccucgaggccgccgcccccugccacuccugcaaccuccucgacgacuccgcccuccccuucuucauccucaccuccguccucggcauccucgccuccuccaccguccucuucaugcucuuccgcccccucuuccgcuggcagcucugccccggcuggcccguccucgcccagcucgccgucggcuccgcccucuucuccaucgucguccccguccucgcccccggccucggcuccacccgcuccuccgcccucugcucccucggcuacugcgucugguacggcuccgccuucgcccaggcccuccuccucggcugccacgccucccucggccaccgccucggcgccggccagguccccggccucacccucggccucaccgucggcaucuggggcgucgccgcccuccucacccuccccgucacccucgccuccggcgccuccggcggccucugcacccucaucuacuccaccgagcucaaggcccuccaggccacccacaccgucgccugccucgccaucuucguccuccucccccucggccucuucggcgccaagggccucaagaaggcccucggcaugggccccggccccuggaugaacauccucugggccugguucaucuucugguggccccacggcgucguccucggccucgacuuccucguccgcuccaagcuccuccuccucuccaccugccucgcccagcaggcccucgaccuccuccucaaccucgccgaggcccucgccauccuccacugcgucgccaccccccuccuccucgcccucuucugccaccaggccacccgcacccuccuccccucccucccccuccccgagggcugguccucccaccucgacacccucggcuccaaguccuga

SEQ ID NO: 39290 - RNA, 1155 nt, Artificial Sequence
  derived and/or modified sequence opt2 from ACKR2__Homo_sapiens__NP_001287
auggccgccaccgccuccccccagccccucgccaccgaggacgccgacuccgagaacuccuccuucuacuacuacgacuaccucgacgaggucgccuucaugcucugccgcaaggacgccgucgucuccuucggcaaggucuuccuccccgucuucuacucccucaucuucguccucggccucuccggcaaccuccuccuccucaugguccuccuccgcuacgucccccgccgccgcauggucgagaucuaccuccucaaccucgccaucuccaaccuccucuuccucgucacccuccccuucuggggcaucuccgucgccuggcacugggucuucggcuccuuccucugcaagauggucuccacccucuacaccaucaacuucuacuccggcaucuucuucaucuccugcaugucccucgacaaguaccucgagaucguccacgcccagcccuaccaccgccuccgcacccgcgccaagucccuccuccucgccaccaucgucugggccgucucccucgccgucuccauccccgacauggucuucguccagacccacgagaaccccaagggcgucuggaacugccacgccgacuucggcggccacggcaccaucuggaagcucuuccuccgcuuccagcagaaccuccucggcuuccuccucccccuccucgccaugaucuucuucuacucccgcaucggcugcguccucguccgccuccgccccgccggccagggccgcgcccucaagaucgccgccgcccucgucgucgccuucuucguccucugguuccccuacaaccucacccucuuccuccacacccuccucgaccuccaggucuucggcaacugcgaggucucccagcaccucgacuacgcccuccaggucaccgaguccaucgccuuccuccacugcugcuucucccccauccucuacgccuucuccucccaccgcuuccgccaguaccucaaggccuuccucgccgccguccucggcuggcaccucgcccccggcaccgcccaggccucccucuccuccugcuccgaguccuccauccucaccgcccaggaggagaugaccggcaugaacgaccucggcgagcgccaguccgagaacuaccccaacaaggaggacgucggcaacaaguccgccuga

SEQ ID NO: 39291 - RNA, 1089 nt, Artificial Sequence
  derived and/or modified sequence opt2 from ACKR3__Homo_sapiens__XP_005246155
auggaccuccaccucuucgacuacuccgagcccggcaacuucuccgacaucuccuggcccugcaacuccuccgacugcaucgucgucgacaccgucaugugccccaacaugcccaacaaguccguccuccucuacacccucuccuucaucuacaucuucaucuucgucaucggcaugaucgccaacuccgucgucgucugggucaacauccaggccaagaccaccggcuacgacacccacugcuacauccucaaccucgccaucgccgaccucugggucguccucaccauccccgucugggucgucucccucguccagcacaaccaguggcccaugggcgagcucaccugcaaggucacccaccucaucuucuccaucaaccucuucggcuccaucuucuuccucaccugcauguccgucgaccgcuaccucuccaucaccuacuucaccaacacccccuccucccgcaagaagaugguccgccgcgucgucugcauccucgucuggcuccucgccuucugcgucucccuccccgacaccuacuaccucaagaccgucaccuccgccuccaacaacgagaccuacugccgcuccuucuaccccgagcacuccaucaaggaguggcucaucggcauggagcucgucuccgucguccucggcuucgccguccccuucuccaucaucgccgucuucuacuuccuccucgcccgcgccaucuccgccuccuccgaccaggagaagcacuccucccgcaagaucaucuucuccuacgucgucgucuuccucgucugcuggcuccccuaccacgucgccguccuccucgacaucuucuccauccuccacuacauccccuucaccugccgccucgagcacgcccucuucaccgcccuccacgucacccagugccucucccucguccacugcugcgucaaccccguccucuacuccuucaucaaccgcaacuaccgcuacgagcucaugaaggccuucaucuucaaguacuccgccaagaccggccucaccaagcucaucgacgccucccgcgucuccgagaccgaguacuccgcccucgagcaguccaccaaguga

SEQ ID NO: 39292 - RNA, 1053 nt, Artificial Sequence
  derived and/or modified sequence opt2 from ACKR4__Homo_sapiens__NP_848540
auggcccucgagcagaaccaguccaccgacuacuacuacgaggagaacgagaugaacggcaccuacgacuacucccaguacgagcucaucugcaucaaggaggacguccgcgaguucgccaaggucuuccuccccgucuuccucaccaucgucuucgucaucggccucgccggcaacuccauggucgucgccaucuacgccuacuacaagaagcagcgcaccaagaccgacgucuacauccucaaccucgccgucgccgaccuccuccuccucuucacccuccccuucugggccgucaacgccguccacggcuggguccucggcaagaucaugugcaagaucaccuccgcccucuacacccucaacuucgucuccggcaugcaguuccucgccugcaucuccaucgaccgcuacgucgccgucaccaagguccccucccaguccggcgucggcaagcccugcuggaucaucugcuucugcgucuggauggccgccauccuccucuccaucccccagcucgucuucuacaccgucaacgacaacgcccgcugcauccccaucuucccccgcuaccucggcaccuccaugaaggcccucauccagaugcucgagaucugcaucggcuucgucguccccuuccucaucaugggcgucugcuacuucaucaccgcccgcacccucaugaagaugcccaacaucaagaucucccgcccccucaagguccuccucaccgucgucaucgucuucaucgucacccagcuccccuacaacaucgucaaguucugccgcgccaucgacaucaucuacucccucaucaccuccugcaacauguccaagcgcauggacaucgccauccaggucaccgaguccaucgcccucuuccacuccugccucaaccccauccucuacgucuucaugggcgccuccuucaagaacuacgucaugaaggucgccaagaaguacggcuccuggcgccgccagcgccaguccgucgaggaguuccccuucgacuccgagggccccaccgagcccaccuccaccuucuccaucuga

SEQ ID NO: 39293 - RNA, 3468 nt, Artificial Sequence
  derived and/or modified sequence opt2 from ACLY__Homo_sapiens__NP_001290203
augggcgccggcaagucccccgccggccccggccagaagcccgaccccggcaagcuccccgccgccggcguccuccgcauccuccgcggcuccuccggccucuggaagaagcgccgcgcccgcaccuccgccgagaccggccgcgccggccucuccgccgccauguccgccaaggccaucuccgagcagaccggcaaggagcuccucuacaaguucaucugcaccaccuccgccauccagaaccgcuucaaguacgcccgcgucacccccgacaccgacugggcccgccuccuccaggaccaccccuggcuccucucccagaaccucgucgucaagcccgaccagcucaucaagcgccgcggcaagcucggccucgucggcgucaaccucacccucgacggcgucaaguccuggcucaagccccgccucggccaggaggccaccgucggcaaggccaccggcuuccucaagaacuuccucaucgagcccuucgucccccacucccaggccgaggaguucuacgucugcaucuacgccacccgcgagggcgacuacguccucuuccaccacgagggcggcgucgacgucggcgacgucgacgccaaggcccagaagcuccucgucggcgucgacgagaagcucaaccccgaggacaucaagaagcaccuccucguccacgcccccgaggacaagaaggagauccucgccuccuucaucuccggccucuucaacuucuacgaggaccucuacuucaccuaccucgagaucaacccccucgucgucaccaaggacggcgucuacguccucgaccucgccgccaaggucgacgccaccgccgacuacaucugcaaggucaaguggggcgacaucgaguuccccccccccuucggccgcgaggccuaccccgaggaggccuacaucgccgaccucgacgccaaguccggcgccucccucaagcucacccuccucaaccccaagggccgcaucuggaccauggucgccggcggcggcgccuccgucgucuacuccgacaccaucugcgaccucggcggcgucaacgagcucgccaacuacggcgaguacuccggcgcccccuccgagcagcagaccuacgacuacgccaagaccauccucucccucaugacccgcgagaagcaccccgacggcaagauccucaucaucggcggcuccaucgccaacuucaccaacgucgccgccaccuucaagggcaucguccgcgccauccgcgacuaccagggcccccucaaggagcacgaggucaccaucuucguccgccgcggcggccccaacuaccaggagggccuccgcgucaugggcgaggucggcaagaccaccggcauccccauccacgucuucggcaccgagacccacaugaccgccaucgucggcauggcccucggccaccgccccauccccaaccagccccccaccgccgcccacaccgccaacuuccuccucaacgccuccggcuccaccuccacccccgcccccucccgcaccgccuccuucuccgagucccgcgccgacgaggucgcccccgccaagaaggccaagcccgccaugccccaggacuccguccccuccccccgcucccuccagggcaaguccaccacccucuucucccgccacaccaaggccaucgucuggggcaugcagacccgcgccguccagggcaugcucgacuucgacuacgucugcucccgcgacgagcccuccgucgccgccauggucuaccccuucaccggcgaccacaagcagaaguucuacuggggccacaaggagauccucauccccgucuucaagaacauggccgacgccaugcgcaagcaccccgaggucgacguccucaucaacuucgccucccuccgcuccgccuacgacuccaccauggagaccaugaacuacgcccagauccgcaccaucgccaucaucgccgagggcauccccgaggcccucacccgcaagcucaucaagaaggccgaccagaagggcgucaccaucaucggccccgccaccgucggcggcaucaagcccggcugcuucaagaucggcaacaccggcggcaugcucgacaacauccucgccuccaagcucuaccgccccggcuccgucgccuacgucucccgcuccggcggcauguccaacgagcucaacaacaucaucucccgcaccaccgacggcgucuacgagggcgucgccaucggcggcgaccgcuaccccggcuccaccuucauggaccacguccuccgcuaccaggacacccccggcgucaagaugaucgucguccucggcgagaucggcggcaccgaggaguacaagaucugccgcggcaucaaggagggccgccucaccaagcccaucgucugcuggugcaucggcaccugcgccaccauguucuccuccgagguccaguucggccacgccggcgccugcgccaaccaggccuccgagaccgccgucgccaagaaccaggcccucaaggaggccggcgucuucgucccccgcuccuucgacgagcucggcgagaucauccaguccgucuacgaggaccucgucgccaacggcgucaucguccccgcccaggagguccccccccccaccguccccauggacuacuccugggcccgcgagcucggccucauccgcaagcccgccuccuucaugaccuccaucugcgacgagcgcggccaggagcucaucuacgccggcaugcccaucaccgaggucuucaaggaggagaugggcaucggcggcguccucggccuccucugguuccagaagcgccuccccaaguacuccugccaguucaucgagaugugccucauggucaccgccgaccacggccccgccgucuccggcgcccacaacaccaucaucugcgcccgcgccggcaaggaccucgucuccucccucaccuccggccuccucaccaucggcgaccgcuucggcggcgcccucgacgccgccgccaagauguucuccaaggccuucgacuccggcaucauccccauggaguucgucaacaagaugaagaaggagggcaagcucaucaugggcaucggccaccgcgucaaguccaucaacaaccccgacaugcgcguccagauccucaaggacuacguccgccagcacuuccccgccaccccccuccucgacuacgcccucgaggucgagaagaucaccaccuccaagaagcccaaccucauccucaacgucgacggccucaucggcgucgccuucgucgacaugcuccgcaacugcggcuccuucacccgcgaggaggccgacgaguacaucgacaucggcgcccucaacggcaucuucguccucggccgcuccaugggcuucaucggccacuaccucgaccagaagcgccucaagcagggccucuaccgccaccccugggacgacaucuccuacguccuccccgagcacauguccauguga

SEQ ID NO: 39294 - RNA, 1011 nt, Artificial Sequence
  derived and/or modified sequence opt2 from ACMSD__Homo_sapiens__NP_612199
augaagaucgacauccacucccacauccuccccaaggaguggcccgaccucaagaagcgcuucggcuacggcggcuggguccagcuccagcaccacuccaagggcgaggccaagcuccucaaggacggcaaggucuuccgcgucguccgcgagaacugcugggaccccgagguccgcauccgcgagauggaccagaagggcgucaccguccaggcccucuccaccguccccgucauguucuccuacugggccaagcccgaggacacccucaaccucugccagcuccucaacaacgaccucgccuccaccgucgucuccuacccccgccgcuucgucggccucggcacccuccccaugcaggcccccgagcucgccgucaaggagauggagcgcugcgucaaggagcucggcuuccccggcguccagaucggcacccacgucaacgagugggaccucaacgcccaggagcucuuccccgucuacgccgccgccgagcgccucaagugcucccucuucguccaccccugggacaugcagauggacggccgcauggccaaguacuggcuccccuggcucgucggcaugcccgccgagaccaccaucgccaucugcuccaugaucaugggcggcgucuucgagaaguuccccaagcucaaggucugcuucgcccacggcggcggcgccuuccccuucaccgucggccgcaucucccacggcuucuccaugcgccccgaccucugcgcccaggacaaccccaugaaccccaagaaguaccucggcuccuucuacaccgacgcccucguccacgacccccucucccucaagcuccucaccgacgucaucggcaaggacaaggucauccucggcaccgacuaccccuucccccucggcgagcucgagcccggcaagcucaucgaguccauggaggaguucgacgaggagaccaagaacaagcucaaggccggcaacgcccucgccuuccucggccucgagcgcaagcaguucgaguga

SEQ ID NO: 39295 - RNA, 2670 nt, Artificial Sequence
  derived and/or modified sequence opt2 from ACO1__Homo_sapiens__NP_002188
auguccaaccccuucgcccaccucgccgagccccucgaccccguccagcccggcaagaaguucuucaaccucaacaagcucgaggacucccgcuacggccgccuccccuucuccauccgcguccuccucgaggccgccauccgcaacugcgacgaguuccucgucaagaagcaggacaucgagaacauccuccacuggaacgucacccagcacaagaacaucgagguccccuucaagcccgcccgcgucauccuccaggacuucaccggcguccccgccgucgucgacuucgccgccaugcgcgacgccgucaagaagcucggcggcgaccccgagaagaucaaccccgucugccccgccgaccucgucaucgaccacuccauccaggucgacuucaaccgccgcgccgacucccuccagaagaaccaggaccucgaguucgagcgcaaccgcgagcgcuucgaguuccucaaguggggcucccaggccuuccacaacaugcgcaucaucccccccggcuccggcaucauccaccaggucaaccucgaguaccucgcccgcgucgucuucgaccaggacggcuacuacuaccccgacucccucgucggcaccgacucccacaccaccaugaucgacggccucggcauccucggcuggggcgucggcggcaucgaggccgaggccgucaugcucggccagcccaucuccaugguccucccccaggucaucggcuaccgccucaugggcaagccccacccccucgucaccuccaccgacaucguccucaccaucaccaagcaccuccgccaggucggcgucgucggcaaguucgucgaguucuucggccccggcgucgcccagcucuccaucgccgaccgcgccaccaucgccaacaugugccccgaguacggcgccaccgccgccuucuuccccgucgacgaggucuccaucaccuaccucguccagaccggccgcgacgaggagaagcucaaguacaucaagaaguaccuccaggccgucggcauguuccgcgacuucaacgaccccucccaggaccccgacuucacccaggucgucgagcucgaccucaagaccgucguccccugcugcuccggccccaagcgcccccaggacaaggucgccgucuccgacaugaagaaggacuucgaguccugccucggcgccaagcagggcuucaagggcuuccaggucgcccccgagcaccacaacgaccacaagaccuucaucuacgacaacaccgaguucacccucgcccacggcuccgucgucaucgccgccaucaccuccugcaccaacaccuccaaccccuccgucaugcucggcgccggccuccucgccaagaaggccgucgacgccggccucaacgucaugcccuacaucaagaccucccucucccccggcuccggcgucgucaccuacuaccuccaggaguccggcgucaugcccuaccucucccagcucggcuucgacgucgucggcuacggcugcaugaccugcaucggcaacuccggcccccuccccgagcccgucgucgaggccaucacccagggcgaccucgucgccgucggcguccucuccggcaaccgcaacuucgagggccgcguccaccccaacacccgcgccaacuaccucgccucccccccccucgucaucgccuacgccaucgccggcaccauccgcaucgacuucgagaaggagccccucggcgucaacgccaagggccagcaggucuuccucaaggacaucuggcccacccgcgacgagauccaggccgucgagcgccaguacgucauccccggcauguucaaggaggucuaccagaagaucgagaccgucaacgaguccuggaacgcccucgccacccccuccgacaagcucuucuucuggaacuccaaguccaccuacaucaaguccccccccuucuucgagaaccucacccucgaccuccagccccccaaguccaucgucgacgccuacguccuccucaaccucggcgacuccgucaccaccgaccacaucucccccgccggcaacaucgcccgcaacucccccgccgcccgcuaccucaccaaccgcggccucaccccccgcgaguucaacuccuacggcucccgccgcggcaacgacgccgucauggcccgcggcaccuucgccaacauccgccuccucaaccgcuuccucaacaagcaggccccccagaccauccaccuccccuccggcgagauccucgacgucuucgacgccgccgagcgcuaccagcaggccggccucccccucaucguccucgccggcaaggaguacggcgccggcuccucccgcgacugggccgccaagggccccuuccuccucggcaucaaggccguccucgccgaguccuacgagcgcauccaccgcuccaaccucgucggcaugggcgucaucccccucgaguaccuccccggcgagaacgccgacgcccucggccucaccggccaggagcgcuacaccaucaucauccccgagaaccucaagccccagaugaagguccaggucaagcucgacaccggcaagaccuuccaggccgucaugcgcuucgacaccgacgucgagcucaccuacuuccucaacggcggcauccucaacuacaugauccgcaagauggccaaguga

SEQ ID NO: 39296 - RNA, 2343 nt, Artificial Sequence
  derived and/or modified sequence opt2 from ACO2__Homo_sapiens__NP_001089
auggcccccuacucccuccucgucacccgccuccagaaggcccucggcguccgccaguaccacgucgccuccguccucugccagcgcgccaaggucgccaugucccacuucgagcccaacgaguacauccacuacgaccuccucgagaagaacaucaacaucguccgcaagcgccucaaccgcccccucacccucuccgagaagaucgucuacggccaccucgacgaccccgccucccaggagaucgagcgcggcaaguccuaccuccgccuccgccccgaccgcgucgccaugcaggacgccaccgcccagauggccaugcuccaguucaucuccuccggccucuccaaggucgccguccccuccaccauccacugcgaccaccucaucgaggcccaggucggcggcgagaaggaccuccgccgcgccaaggacaucaaccaggaggucuacaacuuccucgccaccgccggcgccaaguacggcgucggcuucuggaagcccggcuccggcaucauccaccagaucauccucgagaacuacgccuaccccggcguccuccucaucggcaccgacucccacacccccaacggcggcggccucggcggcaucugcaucggcgucggcggcgccgacgccgucgacgucauggccggcauccccugggagcucaagugccccaaggucaucggcgucaagcucaccggcucccucuccggcugguccucccccaaggacgucauccucaaggucgccggcauccucaccgucaagggcggcaccggcgccaucgucgaguaccacggccccggcgucgacuccaucuccugcaccggcauggccaccaucugcaacaugggcgccgagaucggcgccaccaccuccgucuuccccuacaaccaccgcaugaagaaguaccucuccaagaccggccgcgaggacaucgccaaccucgccgacgaguucaaggaccaccucguccccgaccccggcugccacuacgaccagcucaucgagaucaaccucuccgagcucaagccccacaucaacggccccuucacccccgaccucgcccaccccgucgccgaggucggcaaggucgccgagaaggagggcuggccccucgacauccgcgucggccucaucggcuccugcaccaacuccuccuacgaggacaugggccgcuccgccgccgucgccaagcaggcccucgcccacggccucaagugcaagucccaguucaccaucacccccggcuccgagcagauccgcgccaccaucgagcgcgacggcuacgcccagauccuccgcgaccucggcggcaucguccucgccaacgccugcggccccugcaucggccagugggaccgcaaggacaucaagaagggcgagaagaacaccaucgucaccuccuacaaccgcaacuucaccggccgcaacgacgccaaccccgagacccacgccuucgucaccucccccgagaucgucaccgcccucgccaucgccggcacccucaaguucaaccccgagaccgacuaccucaccggcaccgacggcaagaaguuccgccucgaggcccccgacgccgacgagcuccccaagggcgaguucgaccccggccaggacaccuaccagcacccccccaaggacuccuccggccagcacgucgacgucucccccaccucccagcgccuccagcuccucgagcccuucgacaagugggacggcaaggaccucgaggaccuccagauccucaucaaggucaagggcaagugcaccaccgaccacaucuccgccgccggccccuggcucaaguuccgcggccaccucgacaacaucuccaacaaccuccucaucggcgccaucaacaucgagaacggcaaggccaacuccguccgcaacgccgucacccaggaguucggccccguccccgacaccgcccgcuacuacaagaagcacggcauccgcugggucgucaucggcgacgagaacuacggcgagggcuccucccgcgagcacgccgcccucgagccccgccaccucggcggccgcgccaucaucaccaaguccuucgcccgcauccacgagaccaaccucaagaagcagggccuccucccccucaccuucgccgaccccgccgacuacaacaagauccaccccgucgacaagcucaccauccagggccucaaggacuucacccccggcaagccccucaagugcaucaucaagcaccccaacggcacccaggagaccauccuccucaaccacaccuucaacgagacccagaucgagugguuccgcgccggcuccgcccucaaccgcaugaaggagcuccagcaguga

SEQ ID NO: 39297 - RNA, 354 nt, Artificial Sequence
  derived and/or modified sequence opt2 from ACOT13__Homo_sapiens__NP_001153566
augguccgcaagaucacccucgucuccgccgcccccggcaaggucaucugcgagaugaaggucgaggaggagcacaccaacgccaucggcacccuccacggcggccucaccgccacccucgucgacaacaucuccaccauggcccuccucugcaccgagcgcggcgcccccggcgucuccgucgacaugaacaucaccuacaugucccccgccaagcucggcgaggacaucgucaucaccgcccacguccucaagcagggcaagacccucgccuucaccuccgucgaccucaccaacaaggccaccggcaagcucaucgcccagggccgccacaccaagcaccucggcaacuga

SEQ ID NO: 39298 - RNA, 1266 nt, Artificial Sequence
  derived and/or modified sequence opt2 from ACOT1__Homo_sapiens__NP_001032238
auggccgccacccucauccucgagcccgccggccgcugcugcugggacgagcccguccgcaucgccguccgcggccucgcccccgagcagcccgucacccuccgcgccucccuccgcgacgagaagggcgcccucuuccaggcccacgcccgcuaccgcgccgacacccucggcgagcucgaccucgagcgcgcccccgcccucggcggcuccuucgccggccucgagcccaugggccuccucugggcccucgagcccgagaagccccucguccgccucgucaagcgcgacguccgcaccccccucgccgucgagcucgagguccucgacggccacgaccccgaccccggccgccuccucugccgcguccgccacgagcgcuacuuccucccccccggcguccgccgcgagcccguccgcgccggccgcguccgcggcacccucuuccucccccccgagcccggccccuuccccggcaucgucgacauguucggcaccggcggcggccuccucgaguaccgcgccucccuccucgccggcaagggcuucgccgucauggcccucgccuacuacaacuacgaggaccuccccaagaccauggagacccuccaccucgaguacuucgaggaggccgucaacuaccuccucucccaccccgaggucaagggccccggcgucggccuccucggcaucuccaagggcggcgagcucugccucuccauggccuccuuccucaagggcaucaccgccgccgucgucaucaacggcuccgucgccaacgucggcggcacccuccgcuacaagggcgagacccucccccccgucggcgucaaccgcaaccgcaucaaggucaccaaggacggcuacgccgacaucgucgacguccucaacuccccccucgagggccccgaccagaaguccuucauccccgucgagcgcgccgaguccaccuuccucuuccucgucggccaggacgaccacaacuggaaguccgaguucuacgccaacgaggccugcaagcgccuccaggcccacggccgccgcaagccccagaucaucugcuaccccgagaccggccacuacaucgagccccccuacuucccccucugccgcgccucccuccacgcccucgucggcucccccaucaucuggggcggcgagccccgcgcccacgccauggcccaggucgacgccuggaagcagcuccagaccuucuuccacaagcaccucggcggccacgagggcaccauccccuccaaggucuga

SEQ ID NO: 39299 - RNA, 1452 nt, Artificial Sequence
  derived and/or modified sequence opt2 from ACOT2__Homo_sapiens__NP_006812
auguccaacaagcuccucuccccccacccccacuccgucguccuccgcuccgaguucaagauggccuccucccccgccguccuccgcgccucccgccucuaccaguggucccucaaguccuccgcccaguuccucggcuccccccagcuccgccaggucggccagaucauccgcguccccgcccgcauggccgccacccucauccucgagcccgccggccgcugcugcugggacgagcccguccgcaucgccguccgcggccucgcccccgagcagcccgucacccuccgcgccucccuccgcgacgagaagggcgcccucuuccaggcccacgcccgcuaccgcgccgacacccucggcgagcucgaccucgagcgcgcccccgcccucggcggcuccuucgccggccucgagcccaugggccuccucugggcccucgagcccgagaagccccucguccgccucgucaagcgcgacguccgcaccccccucgccgucgagcucgagguccucgacggccacgaccccgaccccggccgccuccucugccagacccgccacgagcgcuacuuccucccccccggcguccgccgcgagcccguccgcgucggccgcguccgcggcacccucuuccucccccccgagcccggccccuuccccggcaucgucgacauguucggcaccggcggcggccuccucgaguaccgcgccucccuccucgccggcaagggcuucgccgucauggcccucgccuacuacaacuacgaggaccuccccaagaccauggagacccuccaccucgaguacuucgaggaggccaugaacuaccuccucucccaccccgaggucaagggccccggcgucggccuccucggcaucuccaagggcggcgagcucugccucuccauggccuccuuccucaagggcaucaccgccgccgucgucaucaacggcuccgucgccaacgucggcggcacccuccacuacaagggcgagacccucccccccgucggcgucaaccgcaaccgcaucaaggucaccaaggacggcuacgccgacaucgucgacguccucaacuccccccucgagggccccgaccagaaguccuucauccccgucgagcgcgccgaguccaccuuccucuuccucgucggccaggacgaccacaacuggaaguccgaguucuacgccaacgaggccugcaagcgccuccaggcccacggccgccgcaagccccagaucaucugcuaccccgagaccggccacuacaucgagccccccuacuucccccucugccgcgccucccuccacgcccucgucggcucccccaucaucuggggcggcgagccccgcgcccacgccauggcccaggucgacgccuggaagcagcuccagaccuucuuccacaagcaccucggcggccacgagggcaccauccccuccaaggucuga

SEQ ID NO: 39300 - RNA, 1320 nt, Artificial Sequence
  derived and/or modified sequence opt2 from ACOT9__Homo_sapiens__NP_001028755
augcgccgcgccgcccuccgccucugcgcccucggcaagggccagcucacccccggccgcggccucacccagggcccccagaaccccaagaagcagggcaucuuccacauccacgagguccgcgacaagcuccgcgagaucgucggcgccuccaccaacuggcgcgaccacgucaaggccauggaggagcgcaagcuccuccacuccuuccucgccaagucccaggacggccuccccccccgccgcaugaaggacuccuacaucgagguccuccucccccucggcuccgagcccgagcuccgcgagaaguaccucaccguccagaacaccguccgcuucggccgcauccucgaggaccucgacucccucggcguccucaucugcuacaugcacaacaagauccacuccgccaagauguccccccucuccaucgucaccgcccucgucgacaagaucgacaugugcaagaagucccucucccccgagcaggacaucaaguucuccggccacgucuccugggucggcaagaccuccauggaggucaagaugcagauguuccagcuccacggcgacgaguucugccccguccucgacgccaccuucgucauggucgcccgcgacuccgagaacaagggccccgccuucgucaacccccucauccccgagucccccgaggaggaggagcucuuccgccagggcgagcucaacaagggccgccgcaucgccuucuccuccaccucccuccucaagauggcccccuccgccgaggagcgcaccaccauccacgagauguuccucuccacccucgaccccaagaccaucuccuuccgcucccgcguccuccccuccaacgccgucuggauggagaacuccaagcucaagucccucgagaucugccacccccaggagcgcaacaucuucaaccgcaucuucggcggcuuccucaugcgcaaggccuacgagcucgccugggccaccgccugcuccuucggcggcucccgccccuucgucgucgccgucgacgacaucauguuccagaagcccgucgaggucggcucccuccucuuccucuccucccaggucugcuucacccagaacaacuacauccagguccgcguccacuccgaggucgccucccuccaggagaagcagcacaccaccaccaacgucuuccacuucaccuucauguccgagaaggaggucccccucgucuuccccaagaccuacggcgaguccaugcucuaccucgacggccagcgccacuucaacuccauguccggccccgccacccuccgcaaggacuaccucgucgagcccuga

SEQ ID NO: 39301 - RNA, 1869 nt, Artificial Sequence
  derived and/or modified sequence opt2 from ACOX1__Homo_sapiens__NP_001171968
augauccucaacgaccccgacuuccagcacgaggaccucaacuuccucacccgcucccagcgcuacgaggucgccguccgcaaguccgccaucauggucaagaagaugcgcgaguucggcaucgccgaccccgacgagaucaugugguucaagaacuucguccaccgcggccgccccgagccccucgaccuccaccucggcauguuccuccccacccuccuccaccaggccaccgccgagcagcaggagcgcuucuucaugcccgccuggaaccucgagaucaucggcaccuacgcccagaccgagaugggccacggcacccaccuccgcggccucgagaccaccgccaccuacgaccccgagacccaggaguucauccucaacucccccaccgucaccuccaucaagugguggcccggcggccucggcaagaccuccaaccacgccaucguccucgcccagcucaucaccaagggcaagugcuacggccuccacgccuucaucguccccauccgcgagaucggcacccacaagccccuccccggcaucaccgucggcgacaucggccccaaguucggcuacgacgagaucgacaacggcuaccucaagauggacaaccaccgcaucccccgcgagaacaugcucaugaaguacgcccaggucaagcccgacggcaccuacgucaagccccucuccaacaagcucaccuacggcaccauggucuucguccgcuccuuccucgucggcgaggccgcccgcgcccucuccaaggccugcaccaucgccauccgcuacuccgccguccgccaccaguccgagaucaagcccggcgagcccgagccccagauccucgacuuccagacccagcaguacaagcucuucccccuccucgccaccgccuacgccuuccaguucgucggcgccuacaugaaggagaccuaccaccgcaucaacgagggcaucggccagggcgaccucuccgagcuccccgagcuccacgcccucaccgccggccucaaggccuucaccuccuggaccgccaacaccggcaucgaggccugccgcauggccugcggcggccacggcuacucccacugcuccggccuccccaacaucuacgucaacuucacccccuccugcaccuucgagggcgagaacaccgucaugaugcuccagaccgcccgcuuccucaugaaguccuacgaccagguccacuccggcaagcucgucugcggcauggucuccuaccucaacgaccuccccucccagcgcauccagccccagcaggucgccgucuggcccaccauggucgacaucaacucccccgagucccucaccgaggccuacaagcuccgcgccgcccgccucgucgagaucgccgccaagaaccuccagaaggaggucauccaccgcaaguccaaggaggucgccuggaaccucaccuccgucgaccucguccgcgccuccgaggcccacugccacuacgucgucgucaagcucuucuccgagaagcuccucaagauccaggacaaggccauccaggccguccuccgcucccucugccuccucuacucccucuacggcaucucccagaacgccggcgacuuccuccagggcuccaucaugaccgagccccagaucacccaggucaaccagcgcgucaaggagcuccucacccucauccgcuccgacgccgucgcccucgucgacgccuucgacuuccaggacgucacccucggcuccguccucggccgcuacgacggcaacgucuacgagaaccucuucgagugggccaagaacuccccccucaacaaggccgagguccacgaguccuacaagcaccucaagucccuccaguccaagcucuga

SEQ ID NO: 39302 - RNA, 2046 nt, Artificial Sequence
  derived and/or modified sequence opt2 from ACOX2__Homo_sapiens__NP_003491
augggcucccccguccaccgcgucucccucggcgacaccuggucccgccagaugcaccccgacaucgaguccgagcgcuacaugcaguccuucgacgucgagcgccucaccaacauccucgacggcggcgcccagaacaccgcccuccgccgcaaggucgaguccaucauccacuccuaccccgaguucuccugcaaggacaacuacuucaugacccagaacgagcgcuacaaggccgccaugcgccgcgccuuccacauccgccucaucgcccgccgccucggcuggcucgaggacggccgcgagcucggcuacgccuaccgcgcccucuccggcgacgucgcccucaacauccaccgcgucuucguccgcgcccuccgcucccucggcuccgaggagcagaucgccaagugggacccccucugcaagaacauccagaucaucgccaccuacgcccagaccgagcucggccacggcaccuaccuccagggccucgagaccgaggccaccuacgacgccgccacccaggaguucgucauccacucccccacccucaccgccaccaagugguggcccggcgaccucggccgcuccgccacccacgcccucguccaggcccagcucaucugcuccggcgcccgccgcggcaugcacgccuucaucguccccauccgcucccuccaggaccacaccccccuccccggcaucaucaucggcgacaucggccccaagauggacuucgaccagaccgacaacggcuuccuccagcucaaccacguccgcgucccccgcgagaacaugcucucccgcuucgcccagguccuccccgacggcaccuacgucaagcucggcaccgcccaguccaacuaccuccccauggucgucguccgcgucgagcuccucuccggcgagauccuccccauccuccagaaggccugcgucaucgccaugcgcuacuccgucauccgccgccagucccgccuccgccccuccgaccccgaggccaagguccucgacuaccagacccagcagcagaagcucuucccccagcucgccaucuccuacgccuuccacuuccucgccgucucccuccucgaguucuuccagcacuccuacaccgccauccucaaccaggacuucuccuuccuccccgagcuccacgcccucuccaccggcaugaaggccaugauguccgaguucugcacccagggcgccgagaugugccgccgcgccugcggcggccacggcuacuccaagcucuccggccuccccucccucgucaccaagcucuccgccuccugcaccuacgagggcgagaacaccguccucuaccuccaggucgcccgcuuccucgucaaguccuaccuccagacccagaugucccccggcuccaccccccagcgcucccucucccccuccgucgccuaccucaccgcccccgaccucgcccgcugccccgcccagcgcgccgccgacuuccucugccccgagcucuacaccaccgccugggcccacgucgccguccgccucaucaaggacuccguccagcaccuccagacccucacccaguccggcgccgaccagcacgaggccuggaaccagaccaccgucauccaccuccaggccgccaagguccacugcuacuacgucaccgucaagggcuucaccgaggcccucgagaagcucgagaacgagcccgccauccagcagguccucaagcgccucugcgaccuccacgccauccacggcauccucaccaacuccggcgacuuccuccacgacgccuuccucuccggcgcccaggucgacauggcccgcaccgccuaccucgaccuccuccgccucauccgcaaggacgccauccuccucaccgacgccuucgacuucaccgaccagugccucaacuccgcccucggcugcuacgacggcaacgucuacgagcgccucuuccagugggcccagaagucccccaccaacacccaggagaaccccgccuacgaggaguacauccgcccccuccuccaguccuggcgcuccaagcucuga

SEQ ID NO: 39303 - RNA, 1875 nt, Artificial Sequence
  derived and/or modified sequence opt2 from ACOX3__Homo_sapiens__NP_001095137
auggccuccaccgucgagggcggcgacaccgcccuccuccccgaguucccccgcggcccccucgacgccuaccgcgcccgcgccuccuucuccuggaaggagcucgcccucuucaccgagggcgagggcaugcuccgcuucaagaagaccaucuucuccgcccucgagaacgacccccucuucgcccgcucccccggcgccgaccucucccucgagaaguaccgcgagcucaacuuccuccgcugcaagcgcaucuucgaguacgacuuccucuccgucgaggacauguucaaguccccccucaagguccccgcccucauccagugccucggcauguacgacuccucccucgccgccaaguaccuccuccacucccucgucuucggcuccgccgucuacuccuccggcuccgagcgccaccucaccuacauccagaagaucuuccgcauggagaucuucggcugcuucgcccucaccgagcucucccacggcuccaacaccaaggccauccgcaccaccgcccacuacgaccccgccaccgaggaguucaucauccacucccccgacuucgaggccgccaaguucugggucggcaacaugggcaagaccgccacccacgccgucgucuucgccaagcucugcguccccggcgaccagugccacggccuccaccccuucaucguccagauccgcgaccccaagacccuccuccccaugcccggcgucauggucggcgacaucggcaagaagcucggccagaacggccucgacaacggcuucgccauguuccacaagguccgcgucccccgccagucccuccucaaccgcaugggcgacgucacccccgagggcaccuacgucucccccuucaaggacguccgccagcgcuucggcgccucccucggcucccucuccuccggccgcgucuccaucgucucccucgccauccucaaccucaagcucgccgucgccaucgcccuccgcuucuccgccacccgccgccaguucggccccaccgaggaggaggagauccccguccucgaguaccccaugcagcaguggcgccuccuccccuaccucgccgccgucuacgcccucgaccacuucuccaagucccucuuccucgaccucgucgagcuccagcgcggccucgccuccggcgaccgcuccgcccgccaggccgagcucggccgcgagauccacgcccucgccuccgccuccaagccccucgccuccuggaccacccagcagggcauccaggagugccgcgaggccugcggcggccacggcuaccucgccaugaaccgccucggcguccuccgcgacgacaacgaccccaacugcaccuacgagggcgacaacaacauccuccuccagcagaccuccaacuaccuccucggccuccucgcccaccagguccacgacggcgccugcuuccgcuccccccucaaguccgucgacuuccucgacgccuaccccggcauccucgaccagaaguucgaggucuccuccgucgccgacugccucgacuccgccgucgcccucgccgccuacaaguggcucgucugcuaccuccuccgcgagaccuaccagaagcucaaccaggagaagcgcuccggcuccuccgacuucgaggcccgcaacaagugccaggucucccacggccgcccccucgcccucgccuucgucgagcucaccgucguccagcgcuuccacgagcacguccaccagcccuccgucccccccucccuccgcgccguccucggccgccucuccgcccucuacgcccucuggucccucucccgccacgccgcccuccucuaccgcgccgagcgccgcugcuccugccccggccgccgcgaccgcuccuccuga

SEQ ID NO: 39304 - RNA, 1743 nt, Artificial Sequence
  derived and/or modified sequence opt2 from ACOXL__Homo_sapiens__NP_001136279
augcgcgcccucaccguccagcgcgucaaguucgccauggaccucccccuccucaagcgcgccggccaggaccucgccgagaagaccaagaacuucgucucccgcucccucgucaucggcgagguccucuccauggccgacauggccaccggcgucaagugcggcaucaucuacuggcucuucggcggcgccauccgcaaccucggcucccccgagcacgucaccaagugguuccagccccuccaggagcagaaguacaccggcauguucgccaugaccgagcgcggccacggcuccaacgcccgcggcauccagaccgaggccaccuucgaccucuccgcccaggaguucgucaucgacacccccugcgagaacgccgagaagauguacaucggcaacgccauguacggcaacuacgccgccgucuucgcccagcucaucaucgacggccgcucccagggcccccacugcuucaucguccccguccgcgacgagaacggcucccucuaccccggcgucaccgccaucgacaugauguacaaggagggccuccacggcgucgacaacggcauccucaucuucgacaagguccgcaucccccgcgagaaccuccucgacaaguucggcuccgucgcccccgacggccaguaccacucccccauccgcaacaaguccgcccgcuucaacgccaugcucgccgcccucacccccucccgccucgccgucgccuuccaggccaugggcgccaugaagcucggccucaccaucgccauccgcuacucccacucccgccgccaguucggccccaagaccaaggaggaggucaagaucaucgagcaccagacccagacccuccgccucaugccccaccucgccaccgcccucgcccucaccuucgucucccgcuacgccggcgcccuccucgacgaggacgucuuccagggcaaggagcucgucaacucccgcucccuccaggcccucgucgccggccucaaggccuacuccaccugggagaacauccgcugccuccaggacugccgcgagugcaccggcggcauggucgucggccgcgagcuccucgcccaguacaccaagcaguacgaggagaagccccucuucggccuccuccagaacugggccgaguccgucggcgacaagcuccgcaccuccuuccucgccuucaacauggacaccgucgacgaccucgccuuccuccucaaggccgucaaguuccgcgagcgcguccuccagcgcggccucgucgcccgcaucuacuacaaggucaagaccaagaaggaggacuucuuccacgccuggaacuccugccuccaccacgucgccucccucucccucgcccacacccaccgcgucacccucgagcaguucucccucgccgucaaguccugccccgaccaggaggaccagacccuccucaugaaguucugccuccucuacggcaccaagcucgucuuccaggagcgcgccugguaccucgagcacaaguaccucacccccauggccuccacccgcauccgcaaccagcuccucgaccucugcgacuccgucaaggacgacgcccgccgcgucaucuccaccuucaacaucccccacaccuaccuccacgcccccaucgccggcaucuccaacccccgcgccgccugggccuucuaccccgccccccuccagccccgcccccgcgaggaggcccgcucccgccgccccaagcucggcgccaagcucuga

SEQ ID NO: 39305 - RNA, 339 nt, Artificial Sequence
  derived and/or modified sequence opt2 from ACP1__Homo_sapiens__NP_001035739
auggccgagcaggccaccaaguccguccucuucgucugccucggcaacaucugccgcucccccaucgccgaggccgucuuccgcaagcucgucaccgaccagaacaucuccgagaacuggcgcgucgacuccgccgccaccuccggcuacgagaucggcaacccccccgacuaccgcggccaguccugcaugaagcgccacggcauccccaugucccacgucgcccgccagguccccucccucgaccucaagcucugcguccucugcuucuccggcucccucaccgccguccucuuccucaccggcaccugggccggcccccagacccaggagcucuga

SEQ ID NO: 39306 - RNA, 1176 nt, Artificial Sequence
  derived and/or modified sequence opt2 from ACP2__Homo_sapiens__NP_001289419
auggccggcaagcgcuccggcuggucccgcgccgcccuccuccagcuccuccucggcgucaaccucgucgucaugccccccacccgcgcccgcucccuccgcuucgucacccucgagggcaugcuccagcacugggagcucggccaggcccuccgccagcgcuaccacggcuuccucaacaccuccuaccaccgccaggaggucuacguccgcuccaccgacuucgaccgcacccucauguccgccgaggccaaccucgccggccucuucccccccaacggcaugcagcgcuucaaccccaacaucuccuggcagcccauccccguccacaccguccccaucaccgaggaccgccuccucaaguucccccucggccccugcccccgcuacgagcagcuccagaacgagacccgccagacccccgaguaccagaacgaguccucccgcaacgcccaguuccucgacauggucgccaacgagaccggccucaccgaccucacccucgagaccgucuggaacgucuacgacacccucuucugcgagcagacccacggccuccgccucccccccugggccuccccccagaccaugcagcgccucucccgccucaaggacuucuccuuccgcuuccucuucggcaucuaccagcaggccgagaaggcccgccuccagggcggcguccuccucgcccagauccgcaagaaccucacccucauggccaccaccucccagcuccccaagcuccucgucuacuccgcccacgacaccacccucgucgcccuccagauggcccucgacgucuacaacggcgagcaggcccccuacgccuccugccacaucuucgagcucuaccaggaggacuccggcaacuucuccgucgagauguacuuccgcaacgaguccgacaaggcccccuggccccucucccuccccggcugcccccaccgcugcccccuccaggacuuccuccgccucaccgagcccgucguccccaaggacuggcagcaggagugccagcucgccuccggccccgccgacaccgaggucaucgucgcccucgccgucugcggcuccauccucuuccuccucaucguccuccuccucaccguccucuuccgcaugcaggcccagccccccggcuaccgccacgucgccgacggcgaggaccacgccuga

SEQ ID NO: 39307 - RNA, 978 nt, Artificial Sequence
  derived and/or modified sequence opt2 from ACP5__Homo_sapiens__NP_001104506
auggacauguggaccgcccuccucauccuccaggcccuccuccuccccucccucgccgacggcgccacccccgcccuccgcuucgucgccgucggcgacuggggcggcguccccaacgcccccuuccacaccgcccgcgagauggccaacgccaaggagaucgcccgcaccguccagauccucggcgccgacuucauccucucccucggcgacaacuucuacuucaccggcguccaggacaucaacgacaagcgcuuccaggagaccuucgaggacgucuucuccgaccgcucccuccgcaagguccccugguacguccucgccggcaaccacgaccaccucggcaacgucuccgcccagaucgccuacuccaagaucuccaagcgcuggaacuuccccucccccuucuaccgccuccacuucaagaucccccagaccaacgucuccgucgccaucuucaugcucgacaccgucacccucugcggcaacuccgacgacuuccucucccagcagcccgagcgcccccgcgacgucaagcucgcccgcacccagcucuccuggcucaagaagcagcucgccgccgcccgcgaggacuacguccucgucgccggccacuaccccgucugguccaucgccgagcacggccccacccacugccucgucaagcagcuccgcccccuccucgccaccuacggcgucaccgccuaccucugcggccacgaccacaaccuccaguaccuccaggacgagaacggcgucggcuacguccucuccggcgccggcaacuucauggaccccuccaagcgccaccagcgcaagguccccaacggcuaccuccgcuuccacuacggcaccgaggacucccucggcggcuucgccuacgucgagaucuccuccaaggagaugaccgucaccuacaucgaggccuccggcaagucccucuucaagacccgccucccccgccgcgcccgccccuga

SEQ ID NO: 39308 - RNA, 1206 nt, Artificial Sequence
  derived and/or modified sequence opt2 from ACP6__Homo_sapiens__XP_011507903
augaucaccggcgucuucuccaugcgccucuggacccccgucggcguccucaccucccucgccuacugccuccaccagcgccgcgucgcccucgccgagcuccaggaggccgacggccagugccccgucgaccgcucccuccucaagcucaagaugguccaggucgucuuccgccacggcgcccgcuccccccucaagccccucccccucgaggagcaggucgaguggaacccccagcuccucgagguccccccccagacccaguucgacuacaccgucaccaaccucgccggcggccccaagcccuacucccccuacgacucccaguaccacgagaccacccucaagggcggcauguucgccggccagcucaccaaggucggcaugcagcagauguucgcccucggcgagcgccuccgcaagaacuacgucgaggacauccccuuccucucccccaccuucaacccccaggaggucuucauccgcuccaccaacaucuuccgcaaccucgaguccacccgcugccuccucgccggccucuuccagugccagaaggagggccccaucaucauccacaccgacgaggccgacuccgagguccucuaccccaacuaccaguccugcuggucccuccgccagcgcacccgcggccgccgccagaccgccucccuccagcccggcaucuccgaggaccucaagaaggucaaggaccgcaugggcaucgacuccuccgacaaggucgacuucuucauccuccucgacaacgucgccgccgagcaggcccacaaccuccccuccugccccaugcucaagcgcuucgcccgcaugaucgagcagcgcgccgucgacaccucccucuacauccuccccaaggaggaccgcgagucccuccagauggccgucggccccuuccuccacauccucgaguccaaccuccucaaggccauggacuccgccaccgcccccgacaagauccgcaagcucuaccucuacgccgcccacgacgucaccuucaucccccuccucaugacccucggcaucuucgaccacaaguggccccccuucgccgucgaccucaccauggagcucuaccagcaccucgaguccaaggagugguucguccagcucuacuaccacggcaaggaccuccaggucgccuccaucaccggcaugaagaagauccucggccucuuccagccccacuga

SEQ ID NO: 39309 - RNA, 1161 nt, Artificial Sequence
  derived and/or modified sequence opt2 from ACPP__Homo_sapiens__NP_001090
augcgcgccgccccccuccuccucgcccgcgccgccucccucucccucggcuuccucuuccuccucuucuucuggcucgaccgcuccguccucgccaaggagcucaaguucgucacccucgucuuccgccacggcgaccgcucccccaucgacaccuuccccaccgaccccaucaaggaguccuccuggccccagggcuucggccagcucacccagcucggcauggagcagcacuacgagcucggcgaguacauccgcaagcgcuaccgcaaguuccucaacgaguccuacaagcacgagcaggucuacauccgcuccaccgacgucgaccgcacccucauguccgccaugaccaaccucgccgcccucuucccccccgagggcgucuccaucuggaaccccauccuccucuggcagcccauccccguccacaccgucccccucuccgaggaccagcuccucuaccuccccuuccgcaacugcccccgcuuccaggagcucgaguccgagacccucaaguccgaggaguuccagaagcgccuccaccccuacaaggacuucaucgccacccucggcaagcucuccggccuccacggccaggaccucuucggcaucugguccaaggucuacgacccccucuacugcgaguccguccacaacuucacccuccccuccugggccaccgaggacaccaugaccaagcuccgcgagcucuccgagcucucccuccucucccucuacggcauccacaagcagaaggagaagucccgccuccagggcggcguccucgucaacgagauccucaaccacaugaagcgcgccacccagauccccuccuacaagaagcucaucauguacuccgcccacgacaccaccgucuccggccuccagauggcccucgacgucuacaacggccuccucccccccuacgccuccugccaccucaccgagcucuacuucgagaagggcgaguacuucgucgagauguacuaccgcaacgagacccagcacgagcccuacccccucaugcuccccggcugcucccccuccugcccccucgagcgcuucgccgagcucgucggccccgucaucccccaggacugguccaccgagugcaugaccaccaacucccaccagggcaccgaggacuccaccgacuga

SEQ ID NO: 39310 - RNA, 1632 nt, Artificial Sequence
  derived and/or modified sequence opt2 from ACRBP__Homo_sapiens__NP_115878
augcgcaagcccgccgccggcuuccuccccucccuccucaagguccuccuccucccccucgcccccgccgccgcccaggacuccacccaggccuccacccccggcuccccccucucccccaccgaguacgagcgcuucuucgcccuccucacccccaccuggaaggccgagaccaccugccgccuccgcgccacccacggcugccgcaaccccacccucguccagcucgaccaguacgagaaccacggccucguccccgacggcgccgucugcuccaaccuccccuacgccuccugguucgaguccuucugccaguucacccacuaccgcugcuccaaccacgucuacuacgccaagcgcguccucugcucccagcccgucuccauccucucccccaacacccucaaggagaucgaggccuccgccgaggucucccccaccaccaugaccucccccaucuccccccacuucaccgucaccgagcgccagaccuuccagcccuggcccgagcgccucuccaacaacgucgaggagcuccuccaguccucccucucccucggcggccaggagcaggcccccgagcacaagcaggagcagggcgucgagcaccgccaggagcccacccaggagcacaagcaggaggagggccagaagcaggaggagcaggaggaggagcaggaggaggagggcaagcaggaggagggccagggcaccaaggagggccgcgaggccgucucccagcuccagaccgacuccgagcccaaguuccacuccgagucccucuccuccaaccccuccuccuucgccccccgcguccgcgaggucgaguccacccccaugaucauggagaacauccaggagcucauccgcuccgcccaggagaucgacgagaugaacgagaucuacgacgagaacuccuacuggcgcaaccagaaccccggcucccuccuccagcucccccacaccgaggcccuccucguccucugcuacuccaucgucgagaacaccugcaucaucacccccaccgccaaggccuggaaguacauggaggaggagauccucggcuucggcaaguccgucugcgacucccucggccgccgccacauguccaccugcgcccucugcgacuucugcucccucaagcucgagcagugccacuccgaggccucccuccagcgccagcagugcgacaccucccacaagacccccuucgucuccccccuccucgccucccagucccucuccaucggcaaccaggucggcucccccgaguccggccgcuucuacggccucgaccucuacggcggccuccacauggacuucuggugcgcccgccucgccaccaagggcugcgaggacguccgcgucuccggcuggcuccagaccgaguuccucuccuuccaggacggcgacuuccccaccaagaucugcgacaccgacuacauccaguaccccaacuacugcuccuucaagucccagcagugccucaugcgcaaccgcaaccgcaaggucucccgcaugcgcugccuccagaacgagaccuacuccgcccucucccccggcaaguccgaggacgucguccuccgcuggucccaggaguucuccacccucacccucggccaguucggcuga

SEQ ID NO: 39311 - RNA, 2076 nt, Artificial Sequence
  derived and/or modified sequence opt2 from ACRC__Homo_sapiens__XP_011529367
auggacggcugcaagaaggagcucccccgccuccaggagcccgaggaggacgaggacugcuacauccucaacguccaguccuccuccgacgacaccuccggcuccuccgucgcccgccgcgcccccaagcgccaggccuccugcauccucaacguccagucccgcuccggcgacaccuccggcuccuccgucgcccgccgcgcccccaagcgccaggccuccuccgucgucgucaucgacuccgacuccgacgaggagugccacacccacgaggagaagaaggccaagcuccucgagaucaacuccgacgacgagucccccgagugcugccacgucaagcccgccauccaggagccccccaucgucaucuccgacgacgacaacgacgacgacaacggcaacgaccucgagguccccgacgacaacuccgacgacuccgaggcccccgacgacaacuccgacgacuccgaggcccccgacgacaacuccgacgacuccgaggcccccgacgacaacuccgacgacuccgaggcccccgacgacaacuccgacgacuccgacguccccgacgacaacuccgacgacuccuccgacgacaacuccgacgacuccuccgacgacaacuccgacgacuccgacguccccgacgacaaguccgacgacuccgacguccccgacgacuccuccgacgacuccgacguccccgacgacuccuccgacgacuccgaggcccccgacgacuccuccgacgacuccgaggcccccgacgacuccuccgacgacuccgaggcccccgacgacuccuccgacgacuccgaggcccccgacgacuccuccgacgacuccgaggccuccgacgacuccuccgacgacuccgaggccuccgacgacuccuccgacgacuccgaggcccccgacgacaaguccgacgacuccgacguccccgaggacaaguccgacgacuccgacguccccgacgacaacuccgacgaccucgagguccccguccccgccgaggaccucugcaacgagggccagaucgccuccgacgaggaggagcucgucgaggccgccgccgccgucucccagcacgacuccuccgacgacgccggcgagcaggaccucggcgagaaccucuccaagccccccuccgaccccgaggccaaccccgaggucuccgagcgcaagcuccccaccgaggaggagcccgcccccgucgucgagcaguccggcaagcgcaaguccaagaccaagaccaucgucgagcccccccgcaagcgccagaccaagaccaagaacaucgucgagcccccccgcaagcgccagaccaagaccaagaacaucgucgagccccuccgcaagcgcaaggccaagaccaagaacgucuccgucacccccggccacaagaagcgcggccccuccaagaagaagcccggcgccgccaaggucgagaagcgcaagacccgcacccccaagugcaagguccccggcugcuuccuccaggaccucgagaaguccaagaaguacuccggcaagaaccucaagcgcaacaaggacgagcucguccagcgcaucuacgaccucuucaaccgcuccgucugcgacaagaagcuccccgagaagcuccgcaucggcuggaacaacaagauggucaagaccgccggccucugcuccaccggcgagaugugguaccccaaguggcgccgcuucgccaagauccagaucggccucaaggucugcgacuccgccgaccgcauccgcgacacccucauccacgagaugugccacgccgccuccuggcucaucgacggcauccacgacucccacggcgacgccuggaaguacuacgcccgcaaguccaaccgcauccaccccgagcucccccgcgucacccgcugccacaacuacaagaucaacuacaagguccacuacgagugcaccggcugcaagacccgcaucggcugcuacaccaagucccucgacaccucccgcuucaucugcgccaagugcaagggcucccucgucauggucccccucacccagaaggacggcacccgcaucgucccccacgucuga

SEQ ID NO: 39312 - RNA, 1266 nt, Artificial Sequence
  derived and/or modified sequence opt2 from ACR__Homo_sapiens__NP_001088
auggucgagaugcuccccaccgccauccuccucguccucgccgucuccgucgucgccaaggacaacgccaccugcgacggccccugcggccuccgcuuccgccagaacccccagggcggcguccgcaucgucggcggcaaggccgcccagcacggcgccuggcccuggauggucucccuccagaucuucaccuacaacucccaccgcuaccacaccugcggcggcucccuccucaacucccgcuggguccucaccgccgcccacugcuucgucggcaagaacaacguccacgacuggcgccucgucuucggcgccaaggagaucaccuacggcaacaacaagcccgucaaggccccccuccaggagcgcuacgucgagaagaucaucauccacgagaaguacaacuccgccaccgagggcaacgacaucgcccucgucgagaucaccccccccaucuccugcggccgcuucaucggccccggcugccucccccacuucaaggccggccucccccgcggcucccaguccugcugggucgccggcuggggcuacaucgaggagaaggccccccgccccuccuccauccucauggaggcccgcgucgaccucaucgaccucgaccucugcaacuccacccagugguacaacggccgcguccagcccaccaacgucugcgccggcuaccccgucggcaagaucgacaccugccagggcgacuccggcggcccccucaugugcaaggacuccaaggaguccgccuacgucgucgucggcaucaccuccuggggcgucggcugcgcccgcgccaagcgccccggcaucuacaccgccaccuggcccuaccucaacuggaucgccuccaagaucggcuccaacgcccuccgcaugauccaguccgccaccccccccccccccaccacccgccccccccccauccgcccccccuucucccaccccaucuccgcccaccuccccugguacuuccagccccccccccgcccccuccccccccgcccccccgccgcccagccccgccccccccccuccccccccccccccccccccccccccgccuccccccuccccccccccccccccccccccccccccacccccuccuccaccaccaagcucccccagggccucuccuucgccaagcgccuccagcagcucaucgagguccucaagggcaagaccuacuccgacggcaagaaccacuacgacauggagaccaccgagcuccccgagcucaccuccaccuccuga

SEQ ID NO: 39313 - RNA, 798 nt, Artificial Sequence
  derived and/or modified sequence opt2 from ACRV1__Homo_sapiens__NP_001603
augaaccgcuuccuccuccucaugucccucuaccuccucggcuccgcccgcggcaccuccucccagcccaacgagcucuccggcuccaucgaccaccagaccuccguccagcagcuccccggcgaguucuucucccucgagaaccccuccgacgccgaggcccucuacgagaccuccuccggccucaacacccucuccgagcacggcuccuccgagcacggcuccuccaagcacaccgucgccgagcacaccuccggcgagcacgccgaguccgagcacgccuccggcgagcccgccgccaccgagcacgccgagggcgagcacaccgucggcgagcagcccuccggcgagcagcccuccggcgagcaccucuccggcgagcagccccucuccgagcucgaguccggcgagcagcccuccgacgagcagcccuccggcgagcacggcuccggcgagcagcccuccggcgagcaggccuccggcgagcagcccuccggcgagcacgccuccggcgagcaggccuccggcgcccccaucuccuccaccuccaccggcaccauccucaacugcuacaccugcgccuacaugaacgaccagggcaagugccuccgcggcgagggcaccugcaucacccagaacucccagcagugcaugcucaagaagaucuucgagggcggcaagcuccaguucaugguccagggcugcgagaacaugugccccuccaugaaccucuucucccacggcacccgcaugcagaucaucugcugccgcaaccaguccuucugcaacaagaucuga

SEQ ID NO: 39314 - RNA, 2175 nt, Artificial Sequence
  derived and/or modified sequence opt2 from ACSBG1__Homo_sapiens__NP_055977
augccccgcaacuccggcgccggcuacggcugcccccacggcgaccccuccaugcucgacucccgcgagaccccccaggagucccgccaggacaugaucguccgcaccacccaggagaagcucaagaccuccucccucaccgaccgccagccccucuccaaggagucccucaaccacgcccucgagcucuccguccccgagaaggucaacaacgcccagugggacgcccccgaggaggcccucuggaccacccgcgccgacggccgcguccgccuccgcaucgaccccuccugcccccagcuccccuacaccguccaccgcauguucuacgaggcccucgacaaguacggcgaccucaucgcccucggcuucaagcgccaggacaagugggagcacaucuccuacucccaguacuaccuccucgcccgccgcgccgccaagggcuuccucaagcucggccucaagcaggcccacuccgucgccauccucggcuucaacucccccgagugguucuucuccgccgucggcaccgucuucgccggcggcaucgucaccggcaucuacaccaccuccucccccgaggccugccaguacaucgccuacgacugcugcgccaacgucaucauggucgacacccagaagcagcucgagaagauccucaagaucuggaagcagcucccccaccucaaggccgucgucaucuacaaggagcccccccccaacaagauggccaacgucuacaccauggaggaguucauggagcucggcaacgagguccccgaggaggcccucgacgccaucaucgacacccagcagcccaaccagugcugcguccucgucuacaccuccggcaccaccggcaaccccaagggcgucaugcucucccaggacaacaucaccuggaccgcccgcuacggcucccaggccggcgacauccgccccgccgagguccagcaggaggucgucgucuccuaccucccccucucccacaucgccgcccagaucuacgaccucuggaccggcauccaguggggcgcccaggucugcuucgccgagcccgacgcccucaagggcucccucgucaacacccuccgcgaggucgagcccaccucccacaugggcgucccccgcgucugggagaagaucauggagcgcauccaggaggucgccgcccaguccggcuucauccgccgcaagaugcuccucugggccauguccgucacccucgagcagaaccucaccugccccggcuccgaccucaagcccuucaccacccgccucgccgacuaccucguccucgccaagguccgccaggcccucggcuucgccaagugccagaagaacuucuacggcgccgcccccaugauggccgagacccagcacuucuuccucggccucaacauccgccucuacgccggcuacggccucuccgagaccuccggcccccacuucauguccucccccuacaacuaccgccucuacuccuccggcaagcucguccccggcugccgcgucaagcucgucaaccaggacgccgagggcaucggcgagaucugccucuggggccgcaccaucuucaugggcuaccucaacauggaggacaagaccugcgaggccaucgacgaggagggcuggcuccacaccggcgacgccggccgccucgacgccgacggcuuccucuacaucaccggccgccucaaggagcucaucaucaccgccggcggcgagaacgucccccccguccccaucgaggaggccgucaagauggagcuccccaucaucuccaacgccaugcucaucggcgaccagcgcaaguuccucuccaugcuccucacccucaagugcacccucgaccccgacaccuccgaccagaccgacaaccucaccgagcaggccauggaguucugccagcgcgucggcucccgcgccaccaccgucuccgagaucaucgagaagaaggacgaggccgucuaccaggccaucgaggagggcauccgccgcgucaacaugaacgccgccgcccgccccuaccacauccagaagugggccauccucgagcgcgacuucuccaucuccggcggcgagcucggccccaccaugaagcucaagcgccucaccguccucgagaaguacaagggcaucaucgacuccuucuaccaggagcagaagauguga

SEQ ID NO: 39315 - RNA, 2001 nt, Artificial Sequence
  derived and/or modified sequence opt2 from ACSBG2__Homo_sapiens__NP_001276107
augaccggcacccccaagacccaggagggcgccaaggaccucgaggucgacaugaacaagaccgaggucaccccccgccucuggaccaccugccgcgacggcgagguccuccuccgccucuccaagcacggccccggccacgagacccccaugaccauccccgaguucuuccgcgaguccgucaaccgcuucggcaccuaccccgcccucgccuccaagaacggcaagaagugggagauccucaacuucaaccaguacuacgaggccugccgcaaggccgccaagucccucaucaagcucggccucgagcgcuuccacggcgucggcauccucggcuucaacuccgccgagugguucaucaccgccgucggcgccauccucgccggcggccucugcgucggcaucuacgccaccaacuccgccgaggucugccaguacgucaucacccacgccaaggucaacauccuccucgucgagaacgaccagcagcuccagaagauccucuccaucccccaguccucccucgagccccucaaggccaucauccaguaccgccuccccaugaagaagaacaacaaccucuacuccugggacgacuucauggagcucggccgcuccauccccgacacccagcucgagcaggucaucgagucccagaaggccaaccagugcgccguccucaucuacaccuccggcaccaccggcauccccaagggcgucaugcucucccacgacaacaucaccuggaucgccggcgccgucaccaaggacuucaagcucaccgacaagcacgagaccgucgucuccuaccucccccucucccacaucgccgcccagaugauggacaucuggguccccaucaagaucggcgcccucaccuacuucgcccaggccgacgcccucaagggcacccucgucuccacccucaaggaggucaagcccaccgucuucaucggcgucccccagaucugggagaagauccacgagauggucaagaagaacuccgccaaguccaugggccucaagaagaaggccuucgucugggcccgcaacaucggcuucaaggucaacuccaagaagaugcucggcaaguacaacacccccgucuccuaccgcauggccaagacccucgucuucuccaaggucaagaccucccucggccucgaccacugccacuccuucaucuccggcaccgccccccucaaccaggagaccgccgaguucuuccucucccucgacauccccaucggcgagcucuacggccucuccgaguccuccggcccccacaccaucuccaaccagaacaacuaccgccuccucuccugcggcaagauccucaccggcugcaagaacaugcucuuccagcagaacaaggacggcaucggcgagaucugccucuggggccgccacaucuucaugggcuaccucgaguccgagaccgagaccaccgaggccaucgacgacgagggcuggcuccacuccggcgaccucggccagcucgacggccucggcuuccucuacgucaccggccacaucaaggagauccucaucaccgccggcggcgagaacgucccccccauccccgucgagacccucgucaagaagaagauccccaucaucuccaacgccaugcucgucggcgacaagcucaaguuccucuccaugcuccucacccucaagugcgagaugaaccagauguccggcgagccccucgacaagcucaacuucgaggccaucaacuucugccgcggccucggcucccaggccuccaccgucaccgagaucgucaagcagcaggacccccucgucuacaaggccauccagcagggcaucaacgccgucaaccaggaggccaugaacaacgcccagcgcaucgagaagugggucauccucgagaaggacuucuccaucuacggcggcgagcucggccccaugaugaagcucaagcgccacuucgucgcccagaaguacaagaagcagaucgaccacauguaccacuga

SEQ ID NO: 39316 - RNA, 1731 nt, Artificial Sequence
  derived and/or modified sequence opt2 from ACSF3__Homo_sapiens__NP_777577
augcucccccacgucguccucaccuuccgccgccucggcugcgcccucgccuccugccgccucgcccccgcccgccaccgcggcuccggccuccuccacaccgcccccgucgcccgcuccgaccgcuccgcccccgucuucacccgcgcccucgccuucggcgaccgcaucgcccucgucgaccagcacggccgccacaccuaccgcgagcucuacucccgcucccuccgccucucccaggagaucugccgccucugcggcugcgucggcggcgaccuccgcgaggagcgcgucuccuuccucugcgccaacgacgccuccuacgucgucgcccagugggccuccuggauguccggcggcgucgccgucccccucuaccgcaagcaccccgccgcccagcucgaguacgucaucugcgacucccaguccuccgucguccucgccucccaggaguaccucgagcuccucucccccgucguccgcaagcucggcgucccccuccucccccucacccccgccaucuacaccggcgccgucgaggagcccgccgagguccccguccccgagcagggcuggcgcaacaagggcgccaugaucaucuacaccuccggcaccaccggccgccccaagggcguccucuccacccaccagaacauccgcgccgucgucaccggccucguccacaagugggccuggaccaaggacgacgucauccuccacguccucccccuccaccacguccacggcgucgucaacgcccuccucugcccccucugggucggcgccaccugcgucaugaugcccgaguucuccccccagcaggucugggagaaguuccucuccuccgagaccccccgcaucaacgucuucauggccguccccaccaucuacaccaagcucauggaguacuacgaccgccacuucacccagccccacgcccaggacuuccuccgcgccgucugcgaggagaagauccgccucauggucuccggcuccgccgcccucccccuccccguccucgagaaguggaagaacaucaccggccacacccuccucgagcgcuacggcaugaccgagaucggcauggcccucuccggcccccucaccaccgccguccgccuccccggcuccgucggcaccccccuccccggcguccagguccgcaucgucuccgagaacccccagcgcgaggccugcuccuacaccauccacgccgagggcgacgagcgcggcaccaaggucacccccggcuucgaggagaaggagggcgagcuccucguccgcggccccuccgucuuccgcgaguacuggaacaagcccgaggagaccaaguccgccuucacccucgacggcugguucaagaccggcgacaccgucgucuucaaggacggccaguacuggauccgcggccgcaccuccgucgacaucaucaagaccggcggcuacaaggucuccgcccucgaggucgaguggcaccuccucgcccaccccuccaucaccgacgucgccgucaucggcguccccgacaugaccuggggccagcgcgucaccgccgucgucacccuccgcgagggccacucccucucccaccgcgagcucaaggagugggcccgcaacguccucgcccccuacgccguccccuccgagcucguccucgucgaggagaucccccgcaaccagaugggcaagaucgacaagaaggcccucauccgccacuuccaccccuccuga

SEQ ID NO: 39317 - RNA, 1995 nt, Artificial Sequence
  derived and/or modified sequence opt2 from ACSL1__Homo_sapiens__NP_001273640
augcaggcccacgagcucuuccgcuacuuccgcaugcccgagcucgucgacuuccgccaguacguccgcacccuccccaccaacacccucaugggcuucggcgccuucgccgcccucaccaccuucugguacgccacccgccccaagccccucaagccccccugcgaccucuccaugcaguccgucgaggucgccggcuccggcggcgcccgccgcuccgcccuccucgacuccgacgagccccucgucuacuucuacgacgacgucaccacccucuacgagggcuuccagcgcggcauccaggucuccaacaacggccccugccucggcucccgcaagcccgaccagcccuacgaguggcucuccuacaagcagugggucaucaucgagcagggcugcuucgccuacuccauggucaucgucccccucuacgacacccucggcaacgaggccaucaccuacaucgucaacaaggccgagcucucccucgucuucgucgacaagcccgagaaggccaagcuccuccucgagggcgucgagaacaagcucauccccggccucaagaucaucgucgucauggacgccuacggcuccgagcucgucgagcgcggccagcgcugcggcgucgaggucaccuccaugaaggccauggaggaccucggccgcgccaaccgccgcaagcccaagccccccgcccccgaggaccucgccgucaucugcuucaccuccggcaccaccggcaaccccaagggcgccauggucacccaccgcaacaucgucuccgacugcuccgccuucgucaaggccaccgagaacaccgucaaccccugccccgacgacacccucaucuccuuccucccccucgcccacauguucgagcgcgucgucgagugcgucaugcucugccacggcgccaagaucggcuucuuccagggcgacauccgccuccucauggacgaccucaagguccuccagcccaccgucuuccccgucgucccccgccuccucaaccgcauguucgaccgcaucuucggccaggccaacaccacccucaagcgcuggcuccucgacuucgccuccaagcgcaaggaggccgagcuccgcuccggcaucauccgcaacaacucccucugggaccgccucaucuuccacaagguccaguccucccucggcggccgcguccgccucauggucaccggcgccgcccccgucuccgccaccguccucaccuuccuccgcgccgcccucggcugccaguucuacgagggcuacggccagaccgagugcaccgccggcugcugccucaccaugcccggcgacuggaccgccggccacgucggcgcccccaugcccugcaaccucaucaagcucgucgacgucgaggagaugaacuacauggccgccgagggcgagggcgaggucugcgucaagggccccaacgucuuccagggcuaccucaaggaccccgccaagaccgccgaggcccucgacaaggacggcuggcuccacaccggcgacaucggcaaguggcuccccaacggcacccucaagaucaucgaccgcaagaagcacaucuucaagcucgcccagggcgaguacaucgcccccgagaagaucgagaacaucuacaugcgcuccgagcccgucgcccaggucuucguccacggcgagucccuccaggccuuccucaucgccaucgucguccccgacgucgagacccucugcuccugggcccagaagcgcggcuucgagggcuccuucgaggagcucugccgcaacaaggacgucaagaaggccauccucgaggacaugguccgccucggcaaggacuccggccucaagcccuucgagcaggucaagggcaucacccuccaccccgagcucuucuccaucgacaacggccuccucacccccaccaugaaggccaagcgccccgagcuccgcaacuacuuccgcucccagaucgacgaccucuacuccaccaucaaggucuga

SEQ ID NO: 39318 - RNA, 2163 nt, Artificial Sequence
  derived and/or modified sequence opt2 from ACSL3__Homo_sapiens__NP_976251
augaacaaccacgucuccuccaagcccuccaccaugaagcucaagcacaccaucaaccccauccuccucuacuucauccacuuccucaucucccucuacaccauccucaccuacauccccuucuacuucuucuccgagucccgccaggagaaguccaaccgcaucaaggccaagcccgucaacuccaagcccgacuccgccuaccgcuccgucaacucccucgacggccucgccuccguccucuaccccggcugcgacacccucgacaaggucuucaccuacgccaagaacaaguucaagaacaagcgccuccucggcacccgcgagguccucaacgaggaggacgagguccagcccaacggcaagaucuucaagaaggucauccucggccaguacaacuggcucuccuacgaggacgucuucguccgcgccuucaacuucggcaacggccuccagaugcucggccagaagcccaagaccaacaucgccaucuucugcgagacccgcgccgaguggaugaucgccgcccaggccugcuucauguacaacuuccagcucgucacccucuacgccacccucggcggccccgccaucguccacgcccucaacgagaccgaggucaccaacaucaucaccuccaaggagcuccuccagaccaagcucaaggacaucgucucccucgucccccgccuccgccacaucaucaccgucgacggcaagccccccaccugguccgaguuccccaagggcaucaucguccacaccauggccgccgucgaggcccucggcgccaaggccuccauggagaaccagccccacuccaagccccuccccuccgacaucgccgucaucauguacaccuccggcuccaccggccuccccaagggcgucaugaucucccacuccaacaucaucgccggcaucaccggcauggccgagcgcauccccgagcucggcgaggaggacgucuacaucggcuaccucccccucgcccacguccucgagcucuccgccgagcucgucugccucucccacggcugccgcaucggcuacuccuccccccagacccucgccgaccaguccuccaagaucaagaagggcuccaagggcgacaccuccaugcucaagcccacccucauggccgccguccccgagaucauggaccgcaucuacaagaacgucaugaacaaggucuccgagauguccuccuuccagcgcaaccucuucauccucgccuacaacuacaagauggagcagaucuccaagggccgcaacaccccccucugcgacuccuucgucuuccgcaagguccgcucccuccucggcggcaacauccgccuccuccucugcggcggcgccccccucuccgccaccacccagcgcuucaugaacaucugcuucugcugccccgucggccagggcuacggccucaccgaguccgccggcgccggcaccaucuccgaggucugggacuacaacaccggccgcgucggcgccccccucgucugcugcgagaucaagcucaagaacugggaggagggcggcuacuucaacaccgacaagccccacccccgcggcgagauccucaucggcggccaguccgucaccaugggcuacuacaagaacgaggccaagaccaaggccgacuucuucgaggacgagaacggccagcgcuggcucugcaccggcgacaucggcgaguucgagcccgacggcugccucaagaucaucgaccgcaagaaggaccucgucaagcuccaggccggcgaguacgucucccucggcaaggucgaggccgcccucaagaaccucccccucgucgacaacaucugcgccuacgccaacuccuaccacuccuacgucaucggcuucgucguccccaaccagaaggagcucaccgagcucgcccgcaagaagggccucaagggcaccugggaggagcucugcaacuccugcgagauggagaacgagguccucaagguccucuccgaggccgccaucuccgccucccucgagaaguucgagauccccgucaagauccgccucucccccgagcccuggacccccgagaccggccucgucaccgacgccuucaagcucaagcgcaaggagcucaagacccacuaccaggccgacaucgagcgcauguacggccgcaaguga

SEQ ID NO: 39319 - RNA, 2220 nt, Artificial Sequence
  derived and/or modified sequence opt2 from ACSL5__Homo_sapiens__NP_057318
auggacgcccucaagccccccugccucuggcgcaaccacgagcgcggcaagaaggaccgcgacuccugcggccgcaagaacuccgagcccggcuccccccacucccucgaggcccuccgcgacgccgcccccucccagggccucaacuuccuccuccucuucaccaagaugcucuucaucuucaacuuccucuucuccccccuccccacccccgcccucaucugcauccucaccuucggcgccgccaucuuccucuggcucaucacccgcccccagcccguccucccccuccucgaccucaacaaccaguccgucggcaucgagggcggcgcccgcaagggcgucucccagaagaacaacgaccucaccuccugcugcuucuccgacgccaagaccauguacgaggucuuccagcgcggccucgccgucuccgacaacggccccugccucggcuaccgcaagcccaaccagcccuaccgcuggcucuccuacaagcaggucuccgaccgcgccgaguaccucggcuccugccuccuccacaagggcuacaaguccucccccgaccaguucgucggcaucuucgcccagaaccgccccgaguggaucaucuccgagcucgccugcuacaccuacuccauggucgccgucccccucuacgacacccucggccccgaggccaucguccacaucgucaacaaggccgacaucgccauggucaucugcgacaccccccagaaggcccucguccucaucggcaacgucgagaagggcuucacccccucccucaaggucaucauccucauggaccccuucgacgacgaccucaagcagcgcggcgagaaguccggcaucgagauccucucccucuacgacgccgagaaccucggcaaggagcacuuccgcaagcccgucccccccucccccgaggaccucuccgucaucugcuucaccuccggcaccaccggcgaccccaagggcgccaugaucacccaccagaacaucgucuccaacgccgccgccuuccucaagugcgucgagcacgccuacgagcccacccccgacgacgucgccaucuccuaccucccccucgcccacauguucgagcgcaucguccaggccgucgucuacuccugcggcgcccgcgucggcuucuuccagggcgacauccgccuccucgccgacgacaugaagacccucaagcccacccucuuccccgccgucccccgccuccucaaccgcaucuacgacaagguccagaacgaggccaagaccccccucaagaaguuccuccucaagcucgccgucuccuccaaguucaaggagcuccagaagggcaucauccgccacgacuccuucugggacaagcucaucuucgccaagauccaggacucccucggcggccgcguccgcgucaucgucaccggcgccgcccccauguccaccuccgucaugaccuucuuccgcgccgccaugggcugccaggucuacgaggccuacggccagaccgagugcaccggcggcugcaccuucacccuccccggcgacuggaccuccggccacgucggcgucccccucgccugcaacuacgucaagcucgaggacgucgccgacaugaacuacuucaccgucaacaacgagggcgaggucugcaucaagggcaccaacgucuucaagggcuaccucaaggaccccgagaagacccaggaggcccucgacuccgacggcuggcuccacaccggcgacaucggccgcuggcuccccaacggcacccucaagaucaucgaccgcaagaagaacaucuucaagcucgcccagggcgaguacaucgcccccgagaagaucgagaacaucuacaaccgcucccagcccguccuccagaucuucguccacggcgagucccuccgcuccucccucgucggcgucgucguccccgacaccgacguccuccccuccuucgccgccaagcucggcgucaagggcuccuucgaggagcucugccagaaccaggucguccgcgaggccauccucgaggaccuccagaagaucggcaaggaguccggccucaagaccuucgagcaggucaaggccaucuuccuccaccccgagcccuucuccaucgagaacggccuccucacccccacccucaaggccaagcgcggcgagcucuccaaguacuuccgcacccagaucgacucccucuacgagcacauccaggacuga

SEQ ID NO: 39320 - RNA, 2169 nt, Artificial Sequence
  derived and/or modified sequence opt2 from ACSL6__Homo_sapiens__NP_001009185
augcucaccuucuuccucgucuccggcggcucccucuggcucuucgucgaguucguccucucccuccucgagaagaugcagacccaggagauccuccgcauccuccgccuccccgagcucggcgaccucggccaguucuuccgcucccucuccgccaccacccucgucuccaugggcgcccucgccgccauccucgccuacugguucacccaccgccccaaggcccuccagccccccugcaaccuccucaugcaguccgaggaggucgaggacuccggcggcgcccgccgcuccgucaucggcuccggcccccagcuccucacccacuacuacgacgacgcccgcaccauguaccaggucuuccgccgcggccucuccaucuccggcaacggccccugccucggcuuccgcaagcccaagcagcccuaccaguggcucuccuaccaggaggucgccgaccgcgccgaguuccucggcuccggccuccuccagcacaacugcaaggccugcaccgaccaguucaucggcgucuucgcccagaaccgccccgaguggaucaucgucgagcucgccugcuacaccuacuccauggucgucgucccccucuacgacacccucggccccggcgccauccgcuacaucaucaacaccgccgacaucuccaccgucaucgucgacaagccccagaaggccguccuccuccucgagcacgucgagcgcaaggagacccccggccucaagcucaucauccucauggaccccuucgaggaggcccucaaggagcgcggccagaagugcggcgucgucaucaaguccaugcaggccgucgaggacugcggccaggagaaccaccaggcccccguccccccccagcccgacgaccucuccaucgucugcuucaccuccggcaccaccggcaaccccaagggcgccaugcucacccacggcaacgucgucgccgacuucuccggcuuccucaaggucaccgagaaggucaucuucccccgccaggacgacguccucaucuccuuccucccccucgcccacauguucgagcgcgucauccaguccgucgucuacugccacggcggccgcgucggcuucuuccagggcgacauccgccuccucuccgacgacaugaaggcccucugccccaccaucuuccccgucgucccccgccuccucaaccgcauguacgacaagaucuucucccaggccaacaccccccucaagcgcuggcuccucgaguucgccgccaagcgcaagcaggccgagguccgcuccggcaucauccgcaacgacuccaucugggacgagcucuucuucaacaagauccaggccucccucggcggcugcguccgcaugaucgucaccggcgccgcccccgccucccccaccguccucggcuuccuccgcgccgcccucggcugccaggucuacgagggcuacggccagaccgagugcaccgccggcugcaccuucaccacccccggcgacuggaccuccggccacgucggcgccccccuccccugcaaccacaucaagcucgucgacgucgaggagcucaacuacugggccugcaagggcgagggcgagaucugcguccgcggccccaacgucuucaagggcuaccucaaggaccccgaccgcaccaaggaggcccucgacuccgacggcuggcuccacaccggcgacaucggcaaguggcuccccgccggcacccucaagaucaucgaccgcaagaagcacaucuucaagcucgcccagggcgaguacgucgcccccgagaagaucgagaacaucuacauccgcucccagcccgucgcccagaucuacguccacggcgacucccucaaggccuuccucgucggcaucgucguccccgaccccgaggucaugcccuccugggcccagaagcgcggcaucgagggcaccuacgccgaccucugcaccaacaaggaccucaagaaggccauccucgaggacaugguccgccucggcaaggaguccggccuccacuccuucgagcaggucaaggccauccacauccacuccgacauguucuccguccagaacggccuccucacccccacccucaaggccaagcgccccgagcuccgcgaguacuucaagaagcagaucgaggagcucuacuccaucuccauguga

SEQ ID NO: 39321 - RNA, 1734 nt, Artificial Sequence
  derived and/or modified sequence opt2 from ACSM1__Homo_sapiens__NP_001305819
augcaguggcucaugcgcuuccgcacccucuggggcauccacaaguccuuccacaacauccaccccgcccccucccagcuccgcugccgcucccucuccgaguucggcgccccccgcuggaacgacuacgagguccccgaggaguucaacuucgccuccuacguccucgacuacugggcccagaaggagaaggagggcaagcgcggccccaaccccgccuucuggugggucaacggccagggcgacgaggucaagugguccuuccgcgagaugggcgaccucacccgccgcgucgccaacgucuucacccagaccugcggccuccagcagggcgaccaccucgcccucaugcucccccgcguccccgagugguggcucgucgccgucggcugcaugcgcaccggcaucaucuucauccccgccaccauccuccucaaggccaaggacauccucuaccgccuccagcucuccaaggccaagggcaucgucaccaucgacgcccucgccuccgaggucgacuccaucgccucccagugccccucccucaagaccaagcuccucgucuccgaccacucccgcgagggcuggcucgacuuccgcucccucgucaaguccgccucccccgagcacaccugcgucaaguccaagacccucgaccccauggucaucuucuucaccuccggcaccaccggcuuccccaagauggccaagcacucccacggccucgcccuccagcccuccuuccccggcucccgcaagcuccgcucccucaagaccuccgacgucuccuggugccucuccgacuccggcuggaucgucgccaccaucuggacccucgucgagcccuggaccgccggcugcaccgucuucauccaccaccucccccaguucgacaccaaggucaucauccagacccuccucaaguaccccaucaaccacuucuggggcgucuccuccaucuaccgcaugauccuccagcaggacuucaccuccauccgcuuccccgcccucgagcacugcuacaccggcggcgaggucguccuccccaaggaccaggaggaguggaagcgccgcaccggccuccuccucuacgagaacuacggccaguccgagaccggccucaucugcgccaccuacuggggcaugaagaucaagcccggcuucaugggcaaggccaccccccccuacgacguccaggucaucgacgacaagggcuccauccucccccccaacaccgagggcaacaucggcauccgcaucaagcccguccgccccgucucccucuucaugugcuacgagggcgaccccgagaagaccgccaaggucgagugcggcgacuucuacaacaccggcgaccgcggcaagauggacgaggagggcuacaucugcuuccucggccgcuccgacgacaucaucaacgccuccggcuaccgcaucggccccgccgaggucgaguccgcccucgucgagcaccccgccgucgccgaguccgccgucgucggcucccccgaccccauccgcggcgaggucgucaaggccuucaucguccucaccccccaguuccucucccacgacaaggaccagcucaccaaggagcuccagcagcacgucaaguccgucaccgcccccuacaaguacccccgcaaggucgaguucgucuccgagcuccccaagaccaucaccggcaagaucgagcgcaaggagcuccgcaagaaggagaccggccagauguga

SEQ ID NO: 39322 - RNA, 1734 nt, Artificial Sequence
  derived and/or modified sequence opt2 from ACSM2B__Homo_sapiens__NP_001098539
augcacuggcuccgcaagguccagggccucugcacccucuggggcacccagauguccucccgcacccucuacaucaacucccgccagcucgucucccuccaguggggccaccaggagguccccgccaaguucaacuucgccuccgacguccucgaccacugggccgacauggagaaggccggcaagcgccuccccucccccgcccucuggugggucaacggcaagggcaaggagcucauguggaacuuccgcgagcucuccgagaacucccagcaggccgccaacauccucuccggcgccugcggccuccagcgcggcgaccgcgucgccgucaugcucccccgcguccccgagugguggcucgucauccucggcugcauccgcgccggccucaucuucaugcccggcaccauccagaugaaguccaccgacauccucuaccgccuccagauguccaaggccaaggccaucgucgccggcgacgaggucauccaggaggucgacaccgucgccuccgagugccccucccuccgcaucaagcuccucgucuccgagaaguccugcgacggcuggcucaacuucaagaagcuccucaacgaggccuccaccacccaccacugcgucgagaccggcucccaggaggccuccgccaucuacuucaccuccggcaccuccggccuccccaagauggccgagcacuccuacuccucccucggccucaaggccaagauggacgccggcuggaccggccuccaggccuccgacaucauguggaccaucuccgacaccggcuggauccucaacauccucggcucccuccucgaguccuggacccucggcgccugcaccuucguccaccuccuccccaaguucgacccccucgucauccucaagacccucuccuccuaccccaucaaguccaugaugggcgcccccaucgucuaccgcaugcuccuccagcaggaccucuccuccuacaaguucccccaccuccagaacugccucgccggcggcgagucccuccuccccgagacccucgagaacuggcgcgcccagaccggccucgacauccgcgaguucuacggccagaccgagaccggccucaccugcauggucuccaagaccaugaagaucaagcccggcuacaugggcaccgccgccuccugcuacgacguccaggucaucgacgacaagggcaacguccucccccccggcaccgagggcgacaucggcauccgcgucaagcccauccgccccaucggcaucuucuccggcuacgucgagaaccccgacaagaccgccgccaacauccgcggcgacuucuggcuccucggcgaccgcggcaucaaggacgaggacggcuacuuccaguucaugggccgcgccgacgacaucaucaacuccuccggcuaccgcaucggccccuccgaggucgagaacgcccucaugaagcaccccgccgucgucgagaccgccgucaucuccucccccgaccccguccgcggcgaggucgucaaggccuucgucauccucgccucccaguuccucucccacgaccccgagcagcucaccaaggagcuccagcagcacgucaaguccgucaccgcccccuacaaguacccccgcaagaucgaguucguccucaaccuccccaagaccgucaccggcaagauccagcgcaccaagcuccgcgacaaggaguggaagauguccggcaaggcccgcgcccaguga

SEQ ID NO: 39323 - RNA, 1761 nt, Artificial Sequence
  derived and/or modified sequence opt2 from ACSM3__Homo_sapiens__NP_005613
augcucgcccgcgucacccgcaagaugcuccgccacgccaagugcuuccagcgccucgccaucuucggcuccguccgcgcccuccacaaggacaaccgcaccgccaccccccagaacuucuccaacuacgaguccaugaagcaggacuucaagcucggcauccccgaguacuucaacuucgccaaggacguccucgaccaguggaccgacaaggagaaggccggcaagaagcccuccaaccccgccuucugguggaucaaccgcaacggcgaggagaugcgcugguccuucgaggagcucggcucccucucccgcaaguucgccaacauccucuccgaggccugcucccuccagcgcggcgaccgcgucauccucauccucccccgcguccccgagugguggcucgccaacgucgccugccuccgcaccggcaccguccucauccccggcaccacccagcucacccagaaggacauccucuaccgccuccaguccuccaaggccaacugcaucaucaccaacgacguccucgcccccgccgucgacgccgucgccuccaagugcgagaaccuccacuccaagcucaucgucuccgagaacucccgcgagggcuggggcaaccucaaggagcucaugaagcacgccuccgacucccacaccugcgucaagaccaagcacaacgagaucauggccaucuucuucaccuccggcaccuccggcuaccccaagaugaccgcccacacccacuccuccuucggccucggccucuccgucaacggccgcuucuggcucgaccucacccccuccgacgucauguggaacaccuccgacaccggcugggccaaguccgccugguccuccgucuucucccccuggauccagggcgccugcgucuucacccaccaccucccccgcuucgagcccaccuccauccuccagacccucuccaaguaccccaucaccgucuucugcuccgcccccaccgucuaccgcaugcucguccagaacgacaucaccuccuacaaguucaagucccucaagcacugcgucuccgccggcgagcccaucacccccgacgucaccgagaaguggcgcaacaagaccggccucgacaucuacgagggcuacggccagaccgagaccguccucaucugcggcaacuucaagggcaugaagaucaagcccggcuccaugggcaagcccucccccgccuucgacgucaagaucgucgacgucaacggcaacguccucccccccggccaggagggcgacaucggcauccagguccuccccaaccgccccuucggccucuucacccacuacgucgacaaccccuccaagaccgccuccacccuccgcggcaacuucuacaucaccggcgaccgcggcuacauggacaaggacggcuacuucugguucgucgcccgcgccgacgacgucauccucuccuccggcuaccgcaucggccccuucgaggucgagaacgcccucaacgagcaccccuccgucgccgaguccgccgucgucuccucccccgaccccauccgcggcgaggucgucaaggccuucgucguccucaaccccgacuacaagucccacgaccaggagcagcucaucaaggagauccaggagcacgucaagaagaccaccgcccccuacaaguacccccgcaaggucgaguucauccaggagcuccccaagaccaucuccggcaagaccaagcgcaacgagcuccgcaagaaggaguggaagaccaucuga

SEQ ID NO: 39324 - RNA, 1707 nt, Artificial Sequence
  derived and/or modified sequence opt2 from ACSS1__Homo_sapiens__NP_001239605
augcgccgccgcaaggagcgccagcccugggaccgcuuccacuuccuccacuucgccccccacggccgcgagcuccucgagaccaccugccgccucgccaacacccucaagcgccacggcguccaccgcggcgaccgcgucgccaucuacaugcccgucuccccccucgccgucgccgccaugcucgccugcgcccgcaucggcgccguccacaccgucaucuucgccggcuucuccgccgagucccucgccggccgcaucaacgacgccaagugcaaggucgucaucaccuucaaccagggccuccgcggcggccgcgucgucgagcucaagaagaucgucgacgaggccgucaagcacugccccaccguccagcacguccucgucgcccaccgcaccgacaacaagguccacaugggcgaccucgacgucccccucgagcaggagauggccaaggaggaccccgucugcgcccccgaguccaugggcuccgaggacaugcucuucaugcucuacaccuccggcuccaccggcaugcccaagggcaucguccacacccaggccggcuaccuccucuacgccgcccucacccacaagcucgucuucgaccaccagcccggcgacaucuucggcugcgucgccgacaucggcuggaucaccggccacuccuacgucgucuacggcccccucugcaacggcgccaccuccguccucuucgaguccacccccgucuaccccaacgccggccgcuacugggagaccgucgagcgccucaagaucaaccaguucuacggcgcccccaccgccguccgccuccuccucaaguacggcgacgccugggucaagaaguacgaccgcuccucccuccgcacccucggcuccgucggcgagcccaucaacugcgaggccugggaguggcuccaccgcgucgucggcgacucccgcugcacccucgucgacaccugguggcagaccgagaccggcggcaucugcaucgccccccgccccuccgaggagggcgccgagauccuccccgccauggccaugcgccccuucuucggcaucguccccguccucauggacgagaagggcuccgucgucgagggcuccaacgucuccggcgcccucugcaucucccaggccuggcccggcauggcccgcaccaucuacggcgaccaccagcgcuucgucgacgccuacuucaaggccuaccccggcuacuacuucaccggcgacggcgccuaccgcaccgagggcggcuacuaccagaucaccggccgcauggacgacgucaucaacaucuccggccaccgccucggcaccgccgagaucgaggacgccaucgccgaccaccccgccguccccgaguccgccgucaucggcuacccccacgacaucaagggcgaggccgccuucgccuucaucgucgucaaggacuccgccggcgacuccgacgucgucguccaggagcucaaguccauggucgccaccaagaucgccaaguacgccguccccgacgagauccucgucgucaagcgccuccccaagacccgcuccggcaaggucaugcgccgccuccuccgcaagaucaucaccuccgaggcccaggagcucggcgacaccaccacccucgaggaccccuccaucaucgccgagauccucuccgucuaccagaagugcaaggacaagcaggccgccgccaaguga

SEQ ID NO: 39325 - RNA, 2145 nt, Artificial Sequence
  derived and/or modified sequence opt2 from ACSS2__Homo_sapiens__NP_001070020
augggccuccccgaggagcgcguccgcuccggcuccggcucccgcggccaggaggaggccggcgccggcggccgcgcccgcuccuggucccccccccccgaggucucccgcuccgcccacguccccucccuccagcgcuaccgcgagcuccaccgccgcuccgucgaggagccccgcgaguucuggggcgacaucgccaaggaguucuacuggaagacccccugccccggccccuuccuccgcuacaacuucgacgucaccaagggcaagaucuucaucgaguggaugaagggcgccaccaccaacaucugcuacaacguccucgaccgcaacguccacgagaagaagcucggcgacaaggucgccuucuacugggagggcaacgagcccggcgagaccacccagaucaccuaccaccagcuccucguccaggucugccaguucuccaacguccuccgcaagcagggcauccagaagggcgaccgcgucgccaucuacaugcccaugauccccgagcucgucgucgccaugcucgccugcgcccgcaucggcgcccuccacuccaucgucuucgccggcuucuccuccgagucccucugcgagcgcauccucgacuccuccugcucccuccucaucaccaccgacgccuucuaccgcggcgagaagcucgucaaccucaaggagcucgccgacgaggcccuccagaagugccaggagaagggcuuccccguccgcugcugcaucgucgucaagcaccucggccgcgccgagcucggcaugggcgacuccaccucccaguccccccccaucaagcgcuccugccccgacguccagggcaagcucaaggagaaguccaagcgcguccagccccagaucuccuggaaccagggcaucgaccucugguggcacgagcucaugcaggaggccggcgacgagugcgagcccgaguggugcgacgccgaggacccccucuucauccucuacaccuccggcuccaccggcaagcccaagggcgucguccacaccgucggcggcuacaugcucuacgucgccaccaccuucaaguacgucuucgacuuccacgccgaggacgucuucuggugcaccgccgacaucggcuggaucaccggccacuccuacgucaccuacggcccccucgccaacggcgccaccuccguccucuucgagggcauccccaccuaccccgacgucaaccgccucugguccaucgucgacaaguacaaggucaccaaguucuacaccgcccccaccgccauccgccuccucaugaaguucggcgacgagcccgucaccaagcacucccgcgccucccuccagguccucggcaccgucggcgagcccaucaaccccgaggccuggcucugguaccaccgcgucgucggcgcccagcgcugccccaucgucgacaccuucuggcagaccgagaccggcggccacaugcucaccccccuccccggcgccacccccaugaagcccggcuccgccaccuuccccuucuucggcgucgcccccgccauccucaacgaguccggcgaggagcucgagggcgaggccgagggcuaccucgucuucaagcagcccuggcccggcaucaugcgcaccgucuacggcaaccacgagcgcuucgagaccaccuacuucaagaaguuccccggcuacuacgucaccggcgacggcugccagcgcgaccaggacggcuacuacuggaucaccggccgcaucgacgacaugcucaacgucuccggccaccuccucuccaccgccgaggucgaguccgcccucgucgagcacgaggccgucgccgaggccgccgucgucggccacccccaccccgucaagggcgagugccucuacugcuucgucacccucugcgacggccacaccuucucccccaagcucaccgaggagcucaagaagcagauccgcgagaagaucggccccaucgccacccccgacuacauccagaacgcccccggccuccccaagacccgcuccggcaagaucaugcgccgcguccuccgcaagaucgcccagaacgaccacgaccucggcgacauguccaccgucgccgaccccuccgucaucucccaccucuucucccaccgcugccucaccauccaguga

SEQ ID NO: 39326 - RNA, 2061 nt, Artificial Sequence
  derived and/or modified sequence opt2 from ACSS3__Homo_sapiens__NP_078836
augaagcccuccuggcuccagugccgcaaggucaccuccgccggcggccucggcggcccccuccccggcuccucccccgcccgcggcgccggcgccgcccuccgcgcccucgucguccccggcccccgcggcggccucggcggccgcggcugccgcgcccucuccuccggcuccggcuccgaguacaagacccacuucgccgccuccgucaccgaccccgagcgcuucuggggcaaggccgccgagcagaucuccugguacaagcccuggaccaagacccucgagaacaagcacucccccuccacccgcugguucgucgagggcaugcucaacaucugcuacaacgccgucgaccgccacaucgagaacggcaagggcgacaagaucgccaucaucuacgacucccccgucaccaacaccaaggccaccuucaccuacaaggagguccucgagcaggucuccaagcucgccggcguccucgucaagcacggcaucaagaagggcgacaccgucgucaucuacaugcccaugaucccccaggccauguacaccaugcucgccugcgcccgcaucggcgccauccacucccucaucuucggcggcuucgccuccaaggagcucuccucccgcaucgaccacgucaagcccaaggucgucgucaccgccuccuucggcaucgagcccggccgccgcgucgaguacgucccccucgucgaggaggcccucaagaucggccagcacaagcccgacaagauccucaucuacaaccgccccaacauggaggccgucccccucgcccccggccgcgaccucgacugggacgaggagauggccaaggcccagucccacgacugcguccccguccucuccgagcacccccucuacauccucuacaccuccggcaccaccggccuccccaagggcgucauccgccccaccggcggcuacgccgucaugcuccacugguccauguccuccaucuacggccuccagcccggcgaggucuggugggccgccuccgaccucggcugggucgucggccacuccuacaucugcuacggcccccuccuccacggcaacaccaccguccucuacgagggcaagcccgucggcacccccgacgccggcgccuacuuccgcguccucgccgagcacggcgucgccgcccucuucaccgcccccaccgccauccgcgccauccgccagcaggaccccggcgccgcccucggcaagcaguacucccucacccgcuucaagacccucuucgucgccggcgagcgcugcgacgucgagacccucgagugguccaagaacgucuuccgcguccccguccucgaccacugguggcagaccgagaccggcucccccaucaccgccuccugcgucggccucggcaacuccaagacccccccccccggccaggccggcaaguccguccccggcuacaacgucaugauccucgacgacaacaugcagaagcucaaggcccgcugccucggcaacaucgucgucaagcucccccucccccccggcgccuucuccggccucuggaagaaccaggaggccuucaagcaccucuacuucgagaaguuccccggcuacuacgacaccauggacgccggcuacauggacgaggagggcuaccucuacgucaugucccgcgucgacgacgucaucaacgucgccggccaccgcaucuccgccggcgccaucgaggaguccauccucucccacggcaccgucgccgacugcgccgucgucggcaaggaggacccccucaagggccacgucccccucgcccucugcguccuccgcaaggacaucaacgccaccgaggagcagguccucgaggagaucgucaagcacguccgccagaacaucggccccgucgccgccuuccgcaacgccgucuucgucaagcagcuccccaagacccgcuccggcaagaucccccgcuccgcccucuccgccaucgucaacggcaagcccuacaagaucaccuccaccaucgaggaccccuccaucuucggccacgucgaggagaugcucaagcaggccuga

SEQ ID NO: 39327 - RNA, 1134 nt, Artificial Sequence
  derived and/or modified sequence opt2 from ACTA1__Homo_sapiens__NP_001091
augugcgacgaggacgagaccaccgcccucgucugcgacaacggcuccggccucgucaaggccggcuucgccggcgacgacgccccccgcgccgucuuccccuccaucgucggccgcccccgccaccagggcgucauggucggcaugggccagaaggacuccuacgucggcgacgaggcccaguccaagcgcggcauccucacccucaaguaccccaucgagcacggcaucaucaccaacugggacgacauggagaagaucuggcaccacaccuucuacaacgagcuccgcgucgcccccgaggagcaccccacccuccucaccgaggccccccucaaccccaaggccaaccgcgagaagaugacccagaucauguucgagaccuucaacguccccgccauguacgucgccauccaggccguccucucccucuacgccuccggccgcaccaccggcaucguccucgacuccggcgacggcgucacccacaacguccccaucuacgagggcuacgcccucccccacgccaucaugcgccucgaccucgccggccgcgaccucaccgacuaccucaugaagauccucaccgagcgcggcuacuccuucgucaccaccgccgagcgcgagaucguccgcgacaucaaggagaagcucugcuacgucgcccucgacuucgagaacgagauggccaccgccgccuccuccuccucccucgagaaguccuacgagcuccccgacggccaggucaucaccaucggcaacgagcgcuuccgcugccccgagacccucuuccagcccuccuucaucggcauggaguccgccggcauccacgagaccaccuacaacuccaucaugaagugcgacaucgacauccgcaaggaccucuacgccaacaacgucauguccggcggcaccaccauguaccccggcaucgccgaccgcaugcagaaggagaucaccgcccucgcccccuccaccaugaagaucaagaucaucgccccccccgagcgcaaguacuccgucuggaucggcggcuccauccucgccucccucuccaccuuccagcagauguggaucaccaagcaggaguacgacgaggccggccccuccaucguccaccgcaagugcuucuga

SEQ ID NO: 39328 - RNA, 1134 nt, Artificial Sequence
  derived and/or modified sequence opt2 from ACTA2__Homo_sapiens__XP_011538318
augugcgaggaggaggacuccaccgcccucgucugcgacaacggcuccggccucugcaaggccggcuucgccggcgacgacgccccccgcgccgucuuccccuccaucgucggccgcccccgccaccagggcgucauggucggcaugggccagaaggacuccuacgucggcgacgaggcccaguccaagcgcggcauccucacccucaaguaccccaucgagcacggcaucaucaccaacugggacgacauggagaagaucuggcaccacuccuucuacaacgagcuccgcgucgcccccgaggagcaccccacccuccucaccgaggccccccucaaccccaaggccaaccgcgagaagaugacccagaucauguucgagaccuucaacguccccgccauguacgucgccauccaggccguccucucccucuacgccuccggccgcaccaccggcaucguccucgacuccggcgacggcgucacccacaacguccccaucuacgagggcuacgcccucccccacgccaucaugcgccucgaccucgccggccgcgaccucaccgacuaccucaugaagauccucaccgagcgcggcuacuccuucgucaccaccgccgagcgcgagaucguccgcgacaucaaggagaagcucugcuacgucgcccucgacuucgagaacgagauggccaccgccgccuccuccuccucccucgagaaguccuacgagcuccccgacggccaggucaucaccaucggcaacgagcgcuuccgcugccccgagacccucuuccagcccuccuucaucggcauggaguccgccggcauccacgagaccaccuacaacuccaucaugaagugcgacaucgacauccgcaaggaccucuacgccaacaacguccucuccggcggcaccaccauguaccccggcaucgccgaccgcaugcagaaggagaucaccgcccucgcccccuccaccaugaagaucaagaucaucgccccccccgagcgcaaguacuccgucuggaucggcggcuccauccucgccucccucuccaccuuccagcagauguggaucuccaagcaggaguacgacgaggccggccccuccaucguccaccgcaagugcuucuga

SEQ ID NO: 39329 - RNA, 1128 nt, Artificial Sequence
  derived and/or modified sequence opt2 from ACTB__Homo_sapiens__NP_001092
auggacgacgacaucgccgcccucgucgucgacaacggcuccggcaugugcaaggccggcuucgccggcgacgacgccccccgcgccgucuuccccuccaucgucggccgcccccgccaccagggcgucauggucggcaugggccagaaggacuccuacgucggcgacgaggcccaguccaagcgcggcauccucacccucaaguaccccaucgagcacggcaucgucaccaacugggacgacauggagaagaucuggcaccacaccuucuacaacgagcuccgcgucgcccccgaggagcaccccguccuccucaccgaggccccccucaaccccaaggccaaccgcgagaagaugacccagaucauguucgagaccuucaacacccccgccauguacgucgccauccaggccguccucucccucuacgccuccggccgcaccaccggcaucgucauggacuccggcgacggcgucacccacaccguccccaucuacgagggcuacgcccucccccacgccauccuccgccucgaccucgccggccgcgaccucaccgacuaccucaugaagauccucaccgagcgcggcuacuccuucaccaccaccgccgagcgcgagaucguccgcgacaucaaggagaagcucugcuacgucgcccucgacuucgagcaggagauggccaccgccgccuccuccuccucccucgagaaguccuacgagcuccccgacggccaggucaucaccaucggcaacgagcgcuuccgcugccccgaggcccucuuccagcccuccuuccucggcauggaguccugcggcauccacgagaccaccuucaacuccaucaugaagugcgacgucgacauccgcaaggaccucuacgccaacaccguccucuccggcggcaccaccauguaccccggcaucgccgaccgcaugcagaaggagaucaccgcccucgcccccuccaccaugaagaucaagaucaucgccccccccgagcgcaaguacuccgucuggaucggcggcuccauccucgccucccucuccaccuuccagcagauguggaucuccaagcaggaguacgacgaguccggccccuccaucguccaccgcaagugcuucuga

SEQ ID NO: 39330 - RNA, 1131 nt, Artificial Sequence
  derived and/or modified sequence opt2 from ACTBL2__Homo_sapiens__NP_001017992
augaccgacaacgagcucuccgcccucgucgucgacaacggcuccggcaugugcaaggccggcuucggcggcgacgacgccccccgcgccgucuuccccuccaugaucggccgcccccgccaccagggcgucauggucggcaugggccagaaggacugcuacgucggcgacgaggcccaguccaagcgcggcguccucacccucaaguaccccaucgagcacggcgucgucaccaacugggacgacauggagaagaucugguaccacaccuucuacaacgagcuccgcgucgcccccgacgagcaccccauccuccucaccgaggccccccucaaccccaagaucaaccgcgagaagaugacccagaucauguucgaggccuucaacacccccgccauguacgucgccauccaggccguccucucccucuacgccuccggccgcaccaccggcaucgucauggacuccggcgacggcgucacccacaucguccccaucuacgagggcuacgcccucccccacgccauccuccgccucgaccucgccggccgcgaccucaccgacuaccucaugaagauccucaccgagcgcggcuacaacuucaccaccaccgccgagcgcgagaucguccgcgacgucaaggagaagcucugcuacgucgcccucgacuucgagcaggagaugguccgcgccgccgccuccuccucccccgagcgcuccuacgagcuccccgacggccaggucaucaccaucggcaacgagcgcuuccgcugccccgaggccaucuuccagcccuccuuccucggcaucgaguccuccggcauccacgagaccaccuucaacuccaucaugaagugcgacgucgacauccgcaaggaccucuacgccaacaccguccucuccggcggcuccaccauguaccccggcaucgccgaccgcaugcagaaggagaucaucacccucgcccccuccaccaugaagaucaagaucaucgccccccccgagcgcaaguacuccgucuggaucggcggcuccauccucgccucccucuccaccuuccagcagauguggaucuccaagcaggaguacgacgaggccggcccccccaucguccaccgcaagugcuucuga

SEQ ID NO: 39331 - RNA, 1134 nt, Artificial Sequence
  derived and/or modified sequence opt2 from ACTC1__Homo_sapiens__NP_005150
augugcgacgacgaggagaccaccgcccucgucugcgacaacggcuccggccucgucaaggccggcuucgccggcgacgacgccccccgcgccgucuuccccuccaucgucggccgcccccgccaccagggcgucauggucggcaugggccagaaggacuccuacgucggcgacgaggcccaguccaagcgcggcauccucacccucaaguaccccaucgagcacggcaucaucaccaacugggacgacauggagaagaucuggcaccacaccuucuacaacgagcuccgcgucgcccccgaggagcaccccacccuccucaccgaggccccccucaaccccaaggccaaccgcgagaagaugacccagaucauguucgagaccuucaacguccccgccauguacgucgccauccaggccguccucucccucuacgccuccggccgcaccaccggcaucguccucgacuccggcgacggcgucacccacaacguccccaucuacgagggcuacgcccucccccacgccaucaugcgccucgaccucgccggccgcgaccucaccgacuaccucaugaagauccucaccgagcgcggcuacuccuucgucaccaccgccgagcgcgagaucguccgcgacaucaaggagaagcucugcuacgucgcccucgacuucgagaacgagauggccaccgccgccuccuccuccucccucgagaaguccuacgagcuccccgacggccaggucaucaccaucggcaacgagcgcuuccgcugccccgagacccucuuccagcccuccuucaucggcauggaguccgccggcauccacgagaccaccuacaacuccaucaugaagugcgacaucgacauccgcaaggaccucuacgccaacaacguccucuccggcggcaccaccauguaccccggcaucgccgaccgcaugcagaaggagaucaccgcccucgcccccuccaccaugaagaucaagaucaucgccccccccgagcgcaaguacuccgucuggaucggcggcuccauccucgccucccucuccaccuuccagcagauguggaucuccaagcaggaguacgacgaggccggccccuccaucguccaccgcaagugcuucuga

SEQ ID NO: 39332 - RNA, 1128 nt, Artificial Sequence
  derived and/or modified sequence opt2 from ACTG1__Homo_sapiens__NP_001605
auggaggaggagaucgccgcccucgucaucgacaacggcuccggcaugugcaaggccggcuucgccggcgacgacgccccccgcgccgucuuccccuccaucgucggccgcccccgccaccagggcgucauggucggcaugggccagaaggacuccuacgucggcgacgaggcccaguccaagcgcggcauccucacccucaaguaccccaucgagcacggcaucgucaccaacugggacgacauggagaagaucuggcaccacaccuucuacaacgagcuccgcgucgcccccgaggagcaccccguccuccucaccgaggccccccucaaccccaaggccaaccgcgagaagaugacccagaucauguucgagaccuucaacacccccgccauguacgucgccauccaggccguccucucccucuacgccuccggccgcaccaccggcaucgucauggacuccggcgacggcgucacccacaccguccccaucuacgagggcuacgcccucccccacgccauccuccgccucgaccucgccggccgcgaccucaccgacuaccucaugaagauccucaccgagcgcggcuacuccuucaccaccaccgccgagcgcgagaucguccgcgacaucaaggagaagcucugcuacgucgcccucgacuucgagcaggagauggccaccgccgccuccuccuccucccucgagaaguccuacgagcuccccgacggccaggucaucaccaucggcaacgagcgcuuccgcugccccgaggcccucuuccagcccuccuuccucggcauggaguccugcggcauccacgagaccaccuucaacuccaucaugaagugcgacgucgacauccgcaaggaccucuacgccaacaccguccucuccggcggcaccaccauguaccccggcaucgccgaccgcaugcagaaggagaucaccgcccucgcccccuccaccaugaagaucaagaucaucgccccccccgagcgcaaguacuccgucuggaucggcggcuccauccucgccucccucuccaccuuccagcagauguggaucuccaagcaggaguacgacgaguccggccccuccaucguccaccgcaagugcuucuga

SEQ ID NO: 39333 - RNA, 1002 nt, Artificial Sequence
  derived and/or modified sequence opt2 from ACTG2__Homo_sapiens__NP_001186822
augugcgaggaggagaccaccgcccucgucugcgacaacggcuccggccucugcaaggccggcuucgccggcgacgacgccccccgcgccgucuuccccuccaucgucggccgcccccgccaccagaucuggcaccacuccuucuacaacgagcuccgcgucgcccccgaggagcaccccacccuccucaccgaggccccccucaaccccaaggccaaccgcgagaagaugacccagaucauguucgagaccuucaacguccccgccauguacgucgccauccaggccguccucucccucuacgccuccggccgcaccaccggcaucguccucgacuccggcgacggcgucacccacaacguccccaucuacgagggcuacgcccucccccacgccaucaugcgccucgaccucgccggccgcgaccucaccgacuaccucaugaagauccucaccgagcgcggcuacuccuucgucaccaccgccgagcgcgagaucguccgcgacaucaaggagaagcucugcuacgucgcccucgacuucgagaacgagauggccaccgccgccuccuccuccucccucgagaaguccuacgagcuccccgacggccaggucaucaccaucggcaacgagcgcuuccgcugccccgagacccucuuccagcccuccuucaucggcauggaguccgccggcauccacgagaccaccuacaacuccaucaugaagugcgacaucgacauccgcaaggaccucuacgccaacaacguccucuccggcggcaccaccauguaccccggcaucgccgaccgcaugcagaaggagaucaccgcccucgcccccuccaccaugaagaucaagaucaucgccccccccgagcgcaaguacuccgucuggaucggcggcuccauccucgccucccucuccaccuuccagcagauguggaucuccaagcccgaguacgacgaggccggccccuccaucguccaccgcaagugcuucuga

SEQ ID NO: 39334 - RNA, 1290 nt, Artificial Sequence
  derived and/or modified sequence opt2 from ACTL6A__Homo_sapiens__NP_004292
auguccggcggcgucuacggcggcgacgaggucggcgcccucgucuucgacaucggcuccuacaccguccgcgccggcuacgccggcgaggacugccccaaggucgacuuccccaccgccaucggcauggucgucgagcgcgacgacggcuccacccucauggagaucgacggcgacaagggcaagcagggcggccccaccuacuacaucgacaccaacgcccuccgcgucccccgcgagaacauggaggccaucuccccccucaagaacggcauggucgaggacugggacuccuuccaggccauccucgaccacaccuacaagaugcacgucaaguccgaggccucccuccaccccguccucauguccgaggcccccuggaacacccgcgccaagcgcgagaagcucaccgagcucauguucgagcacuacaacauccccgccuucuuccucugcaagaccgccguccucaccgccuucgccaacggccgcuccaccggccucauccucgacuccggcgccacccacaccaccgccauccccguccacgacggcuacguccuccagcagggcaucgucaaguccccccucgccggcgacuucaucaccaugcagugccgcgagcucuuccaggagaugaacaucgagcucgucccccccuacaugaucgccuccaaggaggccguccgcgagggcucccccgccaacuggaagcgcaaggagaagcucccccaggucacccgcuccuggcacaacuacaugugcaacugcgucauccaggacuuccaggccuccguccuccaggucuccgacuccaccuacgacgagcaggucgccgcccagaugcccaccguccacuacgaguuccccaacggcuacaacugcgacuucggcgccgagcgccucaagauccccgagggccucuucgaccccuccaacgucaagggccucuccggcaacaccaugcucggcgucucccacgucgucaccaccuccgucggcaugugcgacaucgacauccgccccggccucuacggcuccgucaucgucgccggcggcaacacccucauccaguccuucaccgaccgccucaaccgcgagcucucccagaagaccccccccuccaugcgccucaagcucaucgccaacaacaccaccgucgagcgccgcuucuccuccuggaucggcggcuccauccucgccucccucggcaccuuccagcagauguggaucuccaagcaggaguacgaggagggcggcaagcagugcgucgagcgcaagugccccuga

SEQ ID NO: 39335 - RNA, 1281 nt, Artificial Sequence
  derived and/or modified sequence opt2 from ACTL6B__Homo_sapiens__NP_057272
auguccggcggcgucuacggcggcgacgaggucggcgcccucgucuucgacaucggcuccuucuccguccgcgccggcuacgccggcgaggacugccccaaggccgacuuccccaccaccgucggccuccucgccgccgaggagggcggcggccucgagcucgagggcgacaaggagaagaagggcaagaucuuccacaucgacaccaacgcccuccacgucccccgcgacggcgccgaggucauguccccccucaagaacggcaugaucgaggacugggagugcuuccgcgccauccucgaccacaccuacuccaagcacgucaaguccgagcccaaccuccaccccguccucauguccgaggcccccuggaacacccgcgccaagcgcgagaagcucaccgagcucauguucgagcaguacaacauccccgccuucuuccucugcaagaccgccguccucaccgccuucgccaacggccgcuccaccggccucguccucgacuccggcgccacccacaccaccgccauccccguccacgacggcuacguccuccagcagggcaucgucaaguccccccucgccggcgacuucaucuccaugcagugccgcgagcucuuccaggagauggccaucgacaucaucccccccuacaugaucgccgccaaggagcccguccgcgagggcgccccccccaacuggaagaagaaggagaagcucccccaggucuccaaguccuggcacaacuacaugugcaacgaggucauccaggacuuccaggccuccguccuccaggucuccgacucccccuacgacgagcaggucgccgcccagaugcccaccguccacuacgagaugcccaacggcuacaacaccgacuacggcgccgagcgccuccgcauccccgagggccucuucgaccccuccaacgucaagggccucuccggcaacaccaugcucggcgucggccacgucgucaccaccuccaucggcaugugcgacaucgacauccgccccggccucuacggcuccgucaucgucaccggcggcaacacccuccuccagggcuucaccgaccgccucaaccgcgagcucucccagaagaccccccccuccaugcgccucaagcucaucgccuccaacuccaccauggagcgcaaguucucccccuggaucggcggcuccauccucgccucccucggcaccuuccagcagauguggaucuccaagcaggaguacgaggagggcggcaagcagugcgucgagcgcaagugccccuga

SEQ ID NO: 39336 - RNA, 1176 nt, Artificial Sequence
  derived and/or modified sequence opt2 from ACTL8__Homo_sapiens__XP_011540513
augucccuccuccccccccgcgagucccccgccgccuccuccuccaccuccgucccccccaccuccgccuccgccauggccgcccgcaccgucaucaucgaccacggcuccggcuuccucaaggccggcaccgccggcuggaacgagccccagauggucuuccccaacaucgucaacuaccuccccugcaaggagaaccccggccccuccuacgcccgccgccgcgucucccucggcaucgacaucugccaccccgacaccuucuccuaccccaucgagcgcggccgcauccucaacugggagggcguccaguaccucugguccuucguccucgagaaccaccgccgcgagcaggaggucccccccgucaucaucaccgagaccccccuccgcgagcccgccgaccgcaagaagaugcucgagauccucuucgagcuccuccacguccccuccguccuccucgccgaccagcuccagaugucccucuacgccuccggccuccucaccggcgucgucgucgacuccggcuacggccucacccgcguccagcccuuccaccagggccgcccccuccccgccuccggcaagacccucgaguucgccggccaggaccucuccgccuaccuccucaagucccucuucaaggaggacugcgaccgccgcugccucuuccagcucgagaccgucgccgucacccagaugaacaagugcuacgucccccagaaccucggcgaggcccucgacuuccgcgagcgccagcaguccgcccucgacgaguccaacaccuaccagcuccccgacggcucccgcgucgagcucacccccaugcagcgcgucgcccccgagauguucuucuccccccaggucuucgagcagcccggccccuccaucccccgcgccaucgucgaguccgucgaguccugcgagaucucccuccgcccccuccucgucucccacgucauggccugcggcggcaacacccucuaccccggcuucaccaagcgccucuuccgcgagcucaugggcgaccacgucuccuccaccaaggccaccgucugggagggcuccaaccgcaacuucuccgucuggcucggcgccuccgucgucgcccaccucuccaccuaccaguccgaguggaugucccgcgaggaguacggcgagcacaugcgcauguga

SEQ ID NO: 39337 - RNA, 1251 nt, Artificial Sequence
  derived and/or modified sequence opt2 from ACTL9__Homo_sapiens__NP_848620
auggacgccucccgccccaaguccuccgagucccaguccucccucgaggccccccgccccggccccaaccccucccccaacgucgucaacaagccccuccagcgcgacucccccggcauggucgccgaccgccucccccccaagaccggcgccgucgucaucgacaugggcaccggcaccugcaaggucggcuucgccggccaggccucccccaccuacaccgucgccaccauccucggcugccagcccaagaagcccgccaccuccggccaguccggccuccagaccuucaucggcgaggccgcccgcguccuccccgagcucacccucguccagccccuccgcuccggcaucgucgucgacugggacgccgccgagcucaucuggcgccaccuccucgagcacgaccuccgcgucgccacccacgaccacccccuccucuucuccgacccccccuucucccccgccaccaaccgcgagaagcucgucgaggucgccuucgagucccuccgcucccccgccauguacgucgccucccaguccguccucuccgucuacgcccacggccgcgucuccggccucgucgucgacaccggccacggcgucaccuacaccguccccgucuuccagggcuacaaccuccuccacgccaccgagcgccucgaccucgccggcaacaaccucaccgccuuccucgccgagaugcuccuccaggccggccucccccucggccagcaggaccucgaccucgucgagaacaucaagcaccacuacugcuacgucgccuccgacuuccagaaggagcaggcccgccccgagcaggaguacaagcgcacccucaagcuccccgacggccgcaccgucacccucggcaaggagcucuuccagugccccgagcuccucuucaacccccccgagguccccggccucucccccgucggccucuccaccauggccaagcagucccuccgcaagcucucccucgagaugcgcgccgaccucgcccagaacguccuccucugcggcggcuccucccucuucaccggcuucgagggccgcuuccgcgccgagcuccuccgcgcccuccccgccgagacccacgucgucgucgccgcccagcccacccgcaacuucuccgucuggaucggcggcuccauccucgccucccuccgcgccuuccaguccugcuggguccuccgcgagcaguacgaggagcagggccccuacaucgucuaccgcaagugcuacuga

SEQ ID NO: 39338 - RNA, 2679 nt, Artificial Sequence
  derived and/or modified sequence opt2 from ACTN1__Homo_sapiens__NP_001093
auggaccacuacgacucccagcagaccaacgacuacaugcagcccgaggaggacugggaccgcgaccuccuccucgaccccgccugggagaagcagcagcgcaagaccuucaccgccuggugcaacucccaccuccgcaaggccggcacccagaucgagaacaucgaggaggacuuccgcgacggccucaagcucaugcuccuccucgaggucaucuccggcgagcgccucgccaagcccgagcgcggcaagaugcgcguccacaagaucuccaacgucaacaaggcccucgacuucaucgccuccaagggcgucaagcucgucuccaucggcgccgaggagaucgucgacggcaacgucaagaugacccucggcaugaucuggaccaucauccuccgcuucgccauccaggacaucuccgucgaggagaccuccgccaaggagggccuccuccucuggugccagcgcaagaccgcccccuacaagaacgucaacauccagaacuuccacaucuccuggaaggacggccucggcuucugcgcccucauccaccgccaccgccccgagcucaucgacuacggcaagcuccgcaaggacgacccccucaccaaccucaacaccgccuucgacgucgccgagaaguaccucgacauccccaagaugcucgacgccgaggacaucgucggcaccgcccgccccgacgagaaggccaucaugaccuacgucuccuccuucuaccacgccuucuccggcgcccagaaggccgagaccgccgccaaccgcaucugcaagguccucgccgucaaccaggagaacgagcagcucauggaggacuacgagaagcucgccuccgaccuccucgaguggauccgccgcaccauccccuggcucgagaaccgcguccccgagaacaccaugcacgccaugcagcagaagcucgaggacuuccgcgacuaccgccgccuccacaagccccccaagguccaggagaagugccagcucgagaucaacuucaacacccuccagaccaagcuccgccucuccaaccgccccgccuucaugcccuccgagggccgcauggucuccgacaucaacaacgccuggggcugccucgagcaggucgagaagggcuacgaggaguggcuccucaacgagauccgccgccucgagcgccucgaccaccucgccgagaaguuccgccagaaggccuccauccacgaggccuggaccgacggcaaggaggccaugcuccgccagaaggacuacgagaccgccacccucuccgagaucaaggcccuccucaagaagcacgaggccuucgaguccgaccucgccgcccaccaggaccgcgucgagcagaucgccgccaucgcccaggagcucaacgagcucgacuacuacgacucccccuccgucaacgcccgcugccagaagaucugcgaccagugggacaaccucggcgcccucacccagaagcgccgcgaggcccucgagcgcaccgagaagcuccucgagaccaucgaccagcucuaccucgaguacgccaagcgcgccgcccccuucaacaacuggauggagggcgccauggaggaccuccaggacaccuucaucguccacaccaucgaggagauccagggccucaccaccgcccacgagcaguucaaggccacccuccccgacgccgacaaggagcgccucgccauccucggcauccacaacgaggucuccaagaucguccagaccuaccacgucaacauggccggcaccaaccccuacaccaccaucaccccccaggagaucaacggcaagugggaccacguccgccagcucgucccccgccgcgaccaggcccucaccgaggagcacgcccgccagcagcacaacgagcgccuccgcaagcaguucggcgcccaggccaacgucaucggccccuggauccagaccaagauggaggagaucggccgcaucuccaucgagaugcacggcacccucgaggaccagcucucccaccuccgccaguacgagaaguccaucgucaacuacaagcccaagaucgaccagcucgagggcgaccaccagcucauccaggaggcccucaucuucgacaacaagcacaccaacuacaccauggagcacauccgcgucggcugggagcagcuccucaccaccaucgcccgcaccaucaacgaggucgagaaccagauccucacccgcgacgccaagggcaucucccaggagcagaugaacgaguuccgcgccuccuucaaccacuucgaccgcgaccacuccggcacccucggccccgaggaguucaaggccugccucaucucccucggcuacgacaucggcaacgacccccagggcgaggccgaguucgcccgcaucauguccaucgucgaccccaaccgccucggcgucgucaccuuccaggccuucaucgacuucaugucccgcgagaccgccgacaccgacaccgccgaccaggucauggccuccuucaagauccucgccggcgacaagaacuacaucaccauggacgagcuccgccgcgagcucccccccgaccaggccgaguacugcaucgcccgcauggcccccuacaccggccccgacuccguccccggcgcccucgacuacauguccuucuccaccgcccucuacggcgaguccgaccucuga

SEQ ID NO: 39339 - RNA, 2685 nt, Artificial Sequence
  derived and/or modified sequence opt2 from ACTN2__Homo_sapiens__NP_001094
augaaccagaucgagcccggcguccaguacaacuacgucuacgacgaggacgaguacaugauccaggaggaggagugggaccgcgaccuccuccucgaccccgccugggagaagcagcagcgcaagaccuucaccgccuggugcaacucccaccuccgcaaggccggcacccagaucgagaacaucgaggaggacuuccgcaacggccucaagcucaugcuccuccucgaggucaucuccggcgagcgccuccccaagcccgaccgcggcaagaugcgcuuccacaagaucgccaacgucaacaaggcccucgacuacaucgccuccaagggcgucaagcucgucuccaucggcgccgaggagaucgucgacggcaacgucaagaugacccucggcaugaucuggaccaucauccuccgcuucgccauccaggacaucuccgucgaggagaccuccgccaaggagggccuccuccucuggugccagcgcaagaccgcccccuaccgcaacgucaacauccagaacuuccacaccuccuggaaggacggccucggccucugcgcccucauccaccgccaccgccccgaccucaucgacuacuccaagcucaacaaggacgaccccaucggcaacaucaaccucgccauggagaucgccgagaagcaccucgacauccccaagaugcucgacgccgaggacaucgucaacacccccaagcccgacgagcgcgccaucaugaccuacgucuccugcuucuaccacgccuucgccggcgccgagcaggccgagaccgccgccaaccgcaucugcaagguccucgccgucaaccaggagaacgagcgccucauggaggaguacgagcgccucgccuccgagcuccucgaguggauccgccgcaccauccccuggcucgagaaccgcacccccgagaagaccaugcaggccaugcagaagaagcucgaggacuuccgcgacuaccgccgcaagcacaagccccccaagguccaggagaagugccagcucgagaucaacuucaacacccuccagaccaagcuccgcaucuccaaccgccccgccuucaugcccuccgagggcaagauggucuccgacaucgccggcgccuggcagcgccucgagcaggccgagaagggcuacgaggaguggcuccucaacgagauccgccgccucgagcgccucgagcaccucgccgagaaguuccgccagaaggccuccacccacgagaccugggccuacggcaaggagcagauccuccuccagaaggacuacgaguccgccucccucaccgagguccgcgcccuccuccgcaagcacgaggccuucgaguccgaccucgccgcccaccaggaccgcgucgagcagaucgccgccaucgcccaggagcucaacgagcucgacuaccacgacgccgucaacgucaacgaccgcugccagaagaucugcgaccagugggaccgccucggcacccucacccagaagcgccgcgaggcccucgagcgcauggagaagcuccucgagaccaucgaccagcuccaccucgaguucgccaagcgcgccgcccccuucaacaacuggauggagggcgccauggaggaccuccaggacauguucaucguccacuccaucgaggagauccagucccucaucaccgcccacgagcaguucaaggccacccuccccgaggccgacggcgagcgccaguccaucauggccauccagaacgaggucgagaaggucauccaguccuacaacauccgcaucuccuccuccaaccccuacuccaccgucaccauggacgagcuccgcaccaagugggacaaggucaagcagcucguccccauccgcgaccagucccuccaggaggagcucgcccgccagcacgccaacgagcgccuccgccgccaguucgccgcccaggccaacgccaucggccccuggauccagaacaagauggaggagaucgcccgcuccuccauccagaucaccggcgcccucgaggaccagaugaaccagcucaagcaguacgagcacaacaucaucaacuacaagaacaacaucgacaagcucgagggcgaccaccagcucauccaggaggcccucgucuucgacaacaagcacaccaacuacaccauggagcacauccgcgucggcugggagcuccuccucaccaccaucgcccgcaccaucaacgaggucgagacccagauccucacccgcgacgccaagggcaucacccaggagcagaugaacgaguuccgcgccuccuucaaccacuucgaccgccgcaagaacggccucauggaccacgaggacuuccgcgccugccucaucuccaugggcuacgaccucggcgaggccgaguucgcccgcaucaugacccucgucgaccccaacggccagggcaccgucaccuuccaguccuucaucgacuucaugacccgcgagaccgccgacaccgacaccgccgagcaggucaucgccuccuuccgcauccucgccuccgacaagcccuacauccucgccgaggagcuccgccgcgagcucccccccgaccaggcccaguacugcaucaagcgcaugcccgccuacuccggccccggcuccguccccggcgcccucgacuacgccgccuucuccuccgcccucuacggcgaguccgaccucuga

SEQ ID NO: 39340 - RNA, 2706 nt, Artificial Sequence
  derived and/or modified sequence opt2 from ACTN3__Homo_sapiens__NP_001095
augaugauggucaugcagcccgagggccucggcgccggcgagggccgcuucgccggcggcggcggcggcggcgaguacauggagcaggaggaggacugggaccgcgaccuccuccucgaccccgccugggagaagcagcagcgcaagaccuucaccgccuggugcaacucccaccuccgcaaggccggcacccagaucgagaacaucgaggaggacuuccgcaacggccucaagcucaugcuccuccucgaggucaucuccggcgagcgccucccccgccccgacaagggcaagaugcgcuuccacaagaucgccaacgucaacaaggcccucgacuucaucgccuccaagggcgucaagcucgucuccaucggcgccgaggagaucgucgacggcaaccucaagaugacccucggcaugaucuggaccaucauccuccgcuucgccauccaggacaucuccgucgaggagaccuccgccaaggagggccuccuccucuggugccagcgcaagaccgcccccuaccgcaacgucaacguccagaacuuccacaccuccuggaaggacggccucgcccucugcgcccucauccaccgccaccgccccgaccucaucgacuacgccaagcuccgcaaggacgaccccaucggcaaccucaacaccgccuucgaggucgccgagaaguaccucgacauccccaagaugcucgacgccgaggacaucgucaacacccccaagcccgacgagaaggccaucaugaccuacgucuccugcuucuaccacgccuucgccggcgccgagcaggccgagaccgccgccaaccgcaucugcaagguccucgccgucaaccaggagaacgagaagcucauggaggaguacgagaagcucgccuccgagcuccucgaguggauccgccgcaccguccccuggcucgagaaccgcgucggcgagcccuccauguccgccaugcagcgcaagcucgaggacuuccgcgacuaccgccgccuccacaagcccccccgcauccaggagaagugccagcucgagaucaacuucaacacccuccagaccaagcuccgccucucccaccgccccgccuucaugcccuccgagggcaagcucgucuccgacaucgccaacgccuggcgcggccucgagcaggucgagaagggcuacgaggacuggcuccucuccgagauccgccgccuccagcgccuccagcaccucgccgagaaguuccgccagaaggccucccuccacgaggccuggacccgcggcaaggaggagaugcucucccagcgcgacuacgacuccgcccuccuccaggagguccgcgcccuccuccgccgccacgaggccuucgaguccgaccucgccgcccaccaggaccgcgucgagcacaucgccgcccucgcccaggagcucaacgagcucgacuaccacgaggccgccuccgucaacucccgcugccaggccaucugcgaccagugggacaaccucggcacccucacccagaagcgccgcgacgcccucgagcgcauggagaagcuccucgagaccaucgaccgccuccagcucgaguucgcccgccgcgccgcccccuucaacaacuggcucgacggcgccgucgaggaccuccaggacgucuggcucguccacuccgucgaggagacccagucccuccucaccgcccacgaccaguucaaggccacccuccccgaggccgaccgcgagcgcggcgccaucaugggcauccagggcgagauccagaagaucugccagaccuacggccuccgccccugcuccaccaaccccuacaucacccucuccccccaggacaucaacaccaagugggacaugguccgcaagcucguccccuccugcgaccagacccuccaggaggagcucgcccgccagcaggucaacgagcgccuccgccgccaguucgccgcccaggccaacgccaucggccccuggauccaggccaaggucgaggaggucggccgccucgccgccggccucgccggcucccucgaggagcagauggccggccuccgccagcaggagcagaacaucaucaacuacaagaccaacaucgaccgccucgagggcgaccaccagcuccuccaggagucccucgucuucgacaacaagcacaccgucuacuccauggagcacauccgcgucggcugggagcagcuccucaccuccaucgcccgcaccaucaacgaggucgagaaccagguccucacccgcgacgccaagggccucucccaggagcagcucaacgaguuccgcgccuccuucaaccacuucgaccgcaagcagaacggcaugauggagcccgacgacuuccgcgccugccucaucuccaugggcuacgaccucggcgaggucgaguucgcccgcaucaugaccauggucgaccccaacgccgccggcgucgucaccuuccaggccuucaucgacuucaugacccgcgagaccgccgagaccgacaccaccgagcaggucgucgccuccuucaagauccucgccggcgacaagaacuacaucacccccgaggagcuccgccgcgagcuccccgccaagcaggccgaguacugcauccgccgcaugguccccuacaagggcuccggcgcccccgccggcgcccucgacuacgucgccuucuccuccgcccucuacggcgaguccgaccucuga

SEQ ID NO: 39341 - RNA, 2736 nt, Artificial Sequence
  derived and/or modified sequence opt2 from ACTN4__Homo_sapiens__NP_004915
auggucgacuaccacgccgccaaccaguccuaccaguacggccccuccuccgccggcaacggcgccggcggcggcggcuccaugggcgacuacauggcccaggaggacgacugggaccgcgaccuccuccucgaccccgccugggagaagcagcagcgcaagaccuucaccgccuggugcaacucccaccuccgcaaggccggcacccagaucgagaacaucgacgaggacuuccgcgacggccucaagcucaugcuccuccucgaggucaucuccggcgagcgccuccccaagcccgagcgcggcaagaugcgcguccacaagaucaacaacgucaacaaggcccucgacuucaucgccuccaagggcgucaagcucgucuccaucggcgccgaggagaucgucgacggcaacgccaagaugacccucggcaugaucuggaccaucauccuccgcuucgccauccaggacaucuccgucgaggagaccuccgccaaggagggccuccuccucuggugccagcgcaagaccgcccccuacaagaacgucaacguccagaacuuccacaucuccuggaaggacggccucgccuucaacgcccucauccaccgccaccgccccgagcucaucgaguacgacaagcuccgcaaggacgaccccgucaccaaccucaacaacgccuucgaggucgccgagaaguaccucgacauccccaagaugcucgacgccgaggacaucgucaacaccgcccgccccgacgagaaggccaucaugaccuacgucuccuccuucuaccacgccuucuccggcgcccagaaggccgagaccgccgccaaccgcaucugcaagguccucgccgucaaccaggagaacgagcaccucauggaggacuacgagaagcucgccuccgaccuccucgaguggauccgccgcaccauccccuggcucgaggaccgcgucccccagaagaccauccaggagaugcagcagaagcucgaggacuuccgcgacuaccgccgcguccacaagccccccaagguccaggagaagugccagcucgagaucaacuucaacacccuccagaccaagcuccgccucuccaaccgccccgccuucaugcccuccgagggcaagauggucuccgacaucaacaacggcuggcagcaccucgagcaggccgagaagggcuacgaggaguggcuccucaacgagauccgccgccucgagcgccucgaccaccucgccgagaaguuccgccagaaggccuccauccacgaggccuggaccgacggcaaggaggccaugcucaagcaccgcgacuacgagaccgccacccucuccgacaucaaggcccucauccgcaagcacgaggccuucgaguccgaccucgccgcccaccaggaccgcgucgagcagaucgccgccaucgcccaggagcucaacgagcucgacuacuacgacucccacaacgucaacacccgcugccagaagaucugcgaccagugggacgcccucggcucccucacccacucccgccgcgaggcccucgagaagaccgagaagcagcucgaggccaucgaccagcuccaccucgaguacgccaagcgcgccgcccccuucaacaacuggauggaguccgccauggaggaccuccaggacauguucaucguccacaccaucgaggagaucgagggccucaucuccgcccacgaccaguucaaguccacccuccccgacgccgaccgcgagcgcgaggccauccucgccauccacaaggaggcccagcgcaucgccgaguccaaccacaucaagcucuccggcuccaaccccuacaccaccgucaccccccagaucaucaacuccaagugggagaagguccagcagcucguccccaagcgcgaccacgcccuccucgaggagcaguccaagcagcaguccaacgagcaccuccgccgccaguucgccucccaggccaacgucgucggccccuggauccagaccaagauggaggagaucggccgcaucuccaucgagaugaacggcacccucgaggaccagcucucccaccucaagcaguacgagcgcuccaucgucgacuacaagcccaaccucgaccuccucgagcagcagcaccagcucauccaggaggcccucaucuucgacaacaagcacaccaacuacaccauggagcacauccgcgucggcugggagcagcuccucaccaccaucgcccgcaccaucaacgaggucgagaaccagauccucacccgcgacgccaagggcaucucccaggagcagaugcaggaguuccgcgccuccuucaaccacuucgacaaggaccacggcggcgcccucggccccgaggaguucaaggccugccucaucucccucggcuacgacgucgagaacgaccgccagggcgaggccgaguucaaccgcaucaugucccucgucgaccccaaccacuccggccucgucaccuuccaggccuucaucgacuucaugucccgcgagaccaccgacaccgacaccgccgaccaggucaucgccuccuucaagguccucgccggcgacaagaacuucaucaccgccgaggagcuccgccgcgagcucccccccgaccaggccgaguacugcaucgcccgcauggcccccuaccagggccccgacgccguccccggcgcccucgacuacaaguccuucuccaccgcccucuacggcgaguccgaccucuga

SEQ ID NO: 39342 - RNA, 1131 nt, Artificial Sequence
  derived and/or modified sequence opt2 from ACTR1A__Homo_sapiens__NP_005727
auggaguccuacgacgucaucgccaaccagcccgucgucaucgacaacggcuccggcgucaucaaggccggcuucgccggcgaccagauccccaaguacugcuuccccaacuacgucggccgccccaagcacguccgcgucauggccggcgcccucgagggcgacaucuucaucggccccaaggccgaggagcaccgcggccuccucuccauccgcuaccccauggagcacggcaucgucaaggacuggaacgacauggagcgcaucuggcaguacgucuacuccaaggaccagcuccagaccuucuccgaggagcaccccguccuccucaccgaggccccccucaacccccgcaagaaccgcgagcgcgccgccgaggucuucuucgagaccuucaacguccccgcccucuucaucuccaugcaggccguccucucccucuacgccaccggccgcaccaccggcgucguccucgacuccggcgacggcgucacccacgccguccccaucuacgagggcuucgccaugccccacuccaucaugcgcaucgacaucgccggccgcgacgucucccgcuuccuccgccucuaccuccgcaaggagggcuacgacuuccacuccuccuccgaguucgagaucgucaaggccaucaaggagcgcgccugcuaccucuccaucaacccccagaaggacgagacccucgagaccgagaaggcccaguacuaccuccccgacggcuccaccaucgagaucggccccucccgcuuccgcgcccccgagcuccucuuccgccccgaccucaucggcgaggaguccgagggcauccacgagguccucgucuucgccauccagaaguccgacauggaccuccgccgcacccucuucuccaacaucguccucuccggcggcuccacccucuucaagggcuucggcgaccgccuccucuccgaggucaagaagcucgcccccaaggacgucaagauccgcaucuccgccccccaggagcgccucuacuccaccuggaucggcggcuccauccucgccucccucgacaccuucaagaagaugugggucuccaagaaggaguacgaggaggacggcgcccgcuccauccaccgcaagaccuucuga

SEQ ID NO: 39343 - RNA, 1131 nt, Artificial Sequence
  derived and/or modified sequence opt2 from ACTR1B__Homo_sapiens__NP_005726
auggaguccuacgacaucaucgccaaccagcccgucgucaucgacaacggcuccggcgucaucaaggccggcuucgccggcgaccagauccccaaguacugcuuccccaacuacgucggccgccccaagcacaugcgcgucauggccggcgcccucgagggcgaccucuucaucggccccaaggccgaggagcaccgcggccuccucaccauccgcuaccccauggagcacggcgucguccgcgacuggaacgacauggagcgcaucuggcaguacgucuacuccaaggaccagcuccagaccuucuccgaggagcaccccguccuccucaccgaggccccccucaaccccuccaagaaccgcgagaaggccgccgaggucuucuucgagaccuucaacguccccgcccucuucaucuccaugcaggccguccucucccucuacgccaccggccgcaccaccggcgucguccucgacuccggcgacggcgucacccacgccguccccaucuacgagggcuucgccaugccccacuccaucaugcgcgucgacaucgccggccgcgacgucucccgcuaccuccgccuccuccuccgcaaggagggcgucgacuuccacaccuccgccgaguucgaggucguccgcaccaucaaggagcgcgccugcuaccucuccaucaacccccagaaggacgaggcccucgagaccgagaagguccaguacacccuccccgacggcuccacccucgacgucggccccgcccgcuuccgcgcccccgagcuccucuuccagcccgaccucgucggcgacgaguccgagggccuccacgaggucgucgccuucgccauccacaaguccgacauggaccuccgccgcacccucuucgccaacaucguccucuccggcggcuccacccucuucaagggcuucggcgaccgccuccucuccgaggucaagaagcucgcccccaaggacaucaagaucaagaucuccgccccccaggagcgccucuacuccaccuggaucggcggcuccauccucgccucccucgacaccuucaagaagaugugggucuccaagaaggaguacgaggaggacggcucccgcgccauccaccgcaagaccuucuga

SEQ ID NO: 39344 - RNA, 1200 nt, Artificial Sequence
  derived and/or modified sequence opt2 from ACTR2__Homo_sapiens__NP_001005386
auggacucccagggccgcaaggucgucgucugcgacaacggcaccggcuucgucaagugcggcuacgccggcuccaacuuccccgagcacaucuuccccgcccucgucggccgccccaucauccgcuccaccaccaaggucggcaacaucgagaucaagaacaacaagaagauggaccucauggucggcgacgaggccuccgagcuccgcuccaugcucgaggucaacuaccccauggagaacggcaucguccgcaacugggacgacaugaagcaccucugggacuacaccuucggccccgagaagcucaacaucgacacccgcaacugcaagauccuccucaccgagccccccaugaaccccaccaagaaccgcgagaagaucgucgaggucauguucgagaccuaccaguucuccggcgucuacgucgccauccaggccguccucacccucuacgcccagggccuccucaccggcgucgucgucgacuccggcgacggcgucacccacaucugccccgucuacgagggcuucucccucccccaccucacccgccgccucgacaucgccggccgcgacaucacccgcuaccucaucaagcuccuccuccuccgcggcuacgccuucaaccacuccgccgacuucgagaccguccgcaugaucaaggagaagcucugcuacgucggcuacaacaucgagcaggagcagaagcucgcccucgagaccaccguccucgucgaguccuacacccuccccgacggccgcaucaucaaggucggcggcgagcgcuucgaggcccccgaggcccucuuccagccccaccucaucaacgucgagggcgucggcgucgccgagcuccucuucaacaccauccaggccgccgacaucgacacccgcuccgaguucuacaagcacaucguccucuccggcggcuccaccauguaccccggccuccccucccgccucgagcgcgagcucaagcagcucuaccucgagcgcguccucaagggcgacgucgagaagcucuccaaguucaagauccgcaucgaggaccccccccgccgcaagcacauggucuuccucggcggcgccguccucgccgacaucaugaaggacaaggacaacuucuggaugacccgccaggaguaccaggagaagggcguccgcguccucgagaagcucggcgucaccguccgcuga

SEQ ID NO: 39345 - RNA, 1047 nt, Artificial Sequence
  derived and/or modified sequence opt2 from ACTR3B__Homo_sapiens__NP_001035225
auggccggcucccucccccccugcgucgucgacugcggcaccggcuacaccaagcucggcuacgccggcaacaccgagccccaguucaucauccccuccugcaucgccauccgcgaguccgccaaggucgucgaccaggcccagcgccgcguccuccgcggcgucgacgaccucgacuucuucaucggcgacgaggccaucgacaagcccaccuacgccaccaaguggcccauccgccacggcaucaucgaggacugggaccucauggagcgcuucauggagcaggucgucuucaaguaccuccgcgccgagcccgaggaccacuacuuccucaugaccgagcccccccucaacacccccgagaaccgcgaguaccucgccgagaucauguucgaguccuucaacguccccggccucuacaucgccguccaggccguccucgcccucgccgccuccuggaccucccgccaggucggcgagcgcacccucaccggcaucgucaucgacuccggcgacggcgucacccacgucauccccgucgccgagggcuacgucaucggcuccugcaucaagcacauccccaucgccggccgcgacaucaccuacuucauccagcagcuccuccgcgagcgcgaggucggcaucccccccgagcagucccucgagaccgccaaggccaucaaggagaaguacugcuacaucugccccgacaucgucaaggaguucgccaaguacgacgucgacccccgcaaguggaucaagcaguacaccggcaucaacgccaucaaccagaagaaguucgucaucgacgucggcuacgagcgcuuccucggccccgagaucuucuuccaccccgaguucgccaaccccgacuucauggaguccaucuccgacgucgucgacgaggucauccagaacugccccaucgacguccgccgcccccucuacaagcccgaguucuuccaggucugccacaccaagaaggacuacgaggaguacggccccuccaucugccgccacaaccccgucuucggcgucauguccuga

SEQ ID NO: 39346 - RNA, 1104 nt, Artificial Sequence
  derived and/or modified sequence opt2 from ACTR3__Homo_sapiens__NP_001264069
augaagggcgucgacgaccucgacuucuucaucggcgacgaggccaucgagaagcccaccuacgccaccaaguggcccauccgccacggcaucgucgaggacugggaccucauggagcgcuucauggagcaggucaucuucaaguaccuccgcgccgagcccgaggaccacuacuuccuccucaccgagcccccccucaacacccccgagaaccgcgaguacaccgccgagaucauguucgaguccuucaacguccccggccucuacaucgccguccaggccguccucgcccucgccgccuccuggaccucccgccaggucggcgagcgcacccucaccggcaccgucaucgacuccggcgacggcgucacccacgucauccccgucgccgagggcuacgucaucggcuccugcaucaagcacauccccaucgccggccgcgacaucaccuacuucauccagcagcuccuccgcgaccgcgaggucggcaucccccccgagcagucccucgagaccgccaaggccgucaaggagcgcuacuccuacgucugccccgaccucgucaaggaguucaacaaguacgacaccgacggcuccaaguggaucaagcaguacaccggcaucaacgccaucuccaagaaggaguucuccaucgacgucggcuacgagcgcuuccucggccccgagaucuucuuccaccccgaguucgccaaccccgacuucacccagcccaucuccgaggucgucgacgaggucauccagaacugccccaucgacguccgccgcccccucuacaagaacaucguccucuccggcggcuccaccauguuccgcgacuucggccgccgccuccagcgcgaccucaagcgcaccgucgacgcccgccucaagcucuccgaggagcucuccggcggccgccucaagcccaagcccaucgacguccaggucaucacccaccacaugcagcgcuacgccgucugguucggcggcuccaugcucgccuccacccccgaguucuaccaggucugccacaccaagaaggacuacgaggagaucggccccuccaucugccgccacaaccccgucuucggcgucauguccuga

SEQ ID NO: 39347 - RNA, 1824 nt, Artificial Sequence
  derived and/or modified sequence opt2 from ACTR5__Homo_sapiens__NP_079131
auggccgccaacgucuuccccuuccgcgacgcccgcgccgcccccgaccccguccucgaggccggccccgucgcccacggcccccuccccgucccccucguccucgacaacggcuccuuccagguccgcgccggcugggccugccccggccaggaccccggccccgagccccgccuccaguuccgcgccgucugcgcccgcggccgcggcggcgcccgcggcgccuccggcccccaggucggcaacgcccucggcucccucgagccccuccgcuggaugcuccgcucccccuucgaccgcaacguccccgucaaccucgagcuccaggagcuccuccucgacuacuccuuccagcaccucggcgucuccucccagggcugcgucgaccaccccaucguccucaccgaggccgucugcaacccccucuacucccgccagaugauguccgagcuccucuucgagugcuacggcauccccaaggucgccuacggcaucgacucccucuucuccuucuaccacaacaagcccaagaacuccaugugcuccggccucaucaucuccuccggcuaccagugcacccacguccuccccauccucgagggccgccucgacgccaagaacugcaagcgcaucaaccucggcggcucccaggccgccggcuaccuccagcgccuccuccagcucaaguaccccggccaccucgccgccaucacccucucccgcauggaggagauccuccacgagcacuccuacaucgccgaggacuacgucgaggagcuccacaaguggcgcugccccgacuacuacgagaacaacguccacaagaugcagcuccccuucuccuccaagcuccucggcuccacccucaccuccgaggagaagcaggagcgccgccagcagcagcuccgccgccuccaggagcucaacgcccgccgccgcgaggagaagcuccagcucgaccaggagcgccucgaccgccuccucuacguccaggagcuccucgaggacggccagauggaccaguuccacaaggcccucaucgagcucaacauggacucccccgaggagcuccaguccuacauccagaagcucuccaucgccgucgagcaggccaagcagaagauccuccaggccgaggucaaccucgaggucgacgucgucgacuccaagcccgagacccccgaccucgagcagcucgagcccucccucgaggacgucgaguccaugaacgacuucgacccccucuucuccgaggagacccccggcgucgagaagcccgucaccaccguccagcccgucuucaaccucgccgccuaccaccagcucuucgucggcaccgagcgcauccgcgcccccgagaucaucuuccagcccucccucaucggcgaggagcaggccggcaucgccgagacccuccaguacauccucgaccgcuaccccaaggacauccaggagaugcucguccagaacgucuuccucaccggcggcaacaccauguaccccggcaugaaggcccgcauggagaaggagcuccucgagaugcgccccuuccgcuccuccuuccagguccagcucgccuccaaccccguccucgacgccugguacggcgcccgcgacugggcccucaaccaccucgacgacaacgaggucuggaucacccgcaaggaguacgaggagaagggcggcgaguaccucaaggagcacugcgccuccaacaucuacguccccauccgccuccccaagcaggccucccgcuccuccgacgcccaggccuccuccaagggcuccgccgccggcggcggcggcgccggcgagcaggccuga

SEQ ID NO: 39348 - RNA, 1131 nt, Artificial Sequence
  derived and/or modified sequence opt2 from ACTRT1__Homo_sapiens__NP_612146
auguucaacccccacgcccucgacguccccgccgucaucuucgacaacggcuccggccucugcaaggccggccucuccggcgagaucggcccccgccacgucaucuccuccguccucggccacugcaaguucaacgucccccucgcccgccucaaccagaaguacuucgucggccaggaggcccucuacaaguacgaggcccuccaccuccacuaccccaucgagcgcggccucgucaccggcugggacgacauggagaagcucuggaagcaccucuucgagcgcgagcucggcgucaagcccucccagcagcccguccucaugaccgagcccucccucaacccccgcgagauccgcgagaagcucgccgagaugauguucgagaccuucuccguccccggcuucuaccucuccaaccacgccgucgccgcccucuacgccuccgccugcgucaccggccucgucgucgacuccggcgacggcgucaccugcaccguccccaucuucgagggcuacucccucccccacgccgucaccaagcucugcauggccggccgcgacaucaccgagcaccucacccgccuccucuucgccuccggcuucaacuuccccugcauccucaacaaggccgucgucaacaacaucaaggagaagcucugcuacaucgcccucgagcccgagaaggagcuccgcaagucccgcggcgagguccucggcgccuaccgccuccccgacggccacgucauccacuucggcgacgagcucuaccagguccccgagguccucuucgcccccgaccagcucggcauccacucccccggccucuccaagauggucuccuccuccaucaugaagugcgacaccgacauccagaacaagcucuacgccgacaucguccucuccggcggcaccacccuccuccccggccucgaggagcgccucaugaaggaggucgagcagcucgccuccaagggcacccccaucaagaucaccgccucccccgaccgcugcuucuccgccuggaucggcgccuccaucaugaccuccauguccuccuucaagcagaugugggucaccuccgccgacuucaaggaguacggcaccuccgucguccagcgccgcugcuucuga

SEQ ID NO: 39349 - RNA, 1518 nt, Artificial Sequence
  derived and/or modified sequence opt2 from ACVR1B__Homo_sapiens__NP_004293
auggccgaguccgccggcgccuccuccuucuucccccucgucguccuccuccucgccggcuccggcggcuccggcccccgcggcguccaggcccuccucugcgccugcaccuccugccuccaggccaacuacaccugcgagaccgacggcgccugcauggucuccaucuucaaccucgacggcauggagcaccacguccgcaccugcauccccaaggucgagcucguccccgccggcaagcccuucuacugccucuccuccgaggaccuccgcaacacccacugcugcuacaccgacuacugcaaccgcaucgaccuccgcguccccuccggccaccucaaggagcccgagcaccccuccauguggggccccgucgagcucgucggcaucaucgccggccccgucuuccuccucuuccucaucaucaucaucgucuuccucgucaucaacuaccaccagcgcgucuaccacaaccgccagcgccucgacauggaggaccccuccugcgagaugugccucuccaaggacaagacccuccaggaccucgucuacgaccucuccaccuccggcuccggcuccggccucccccucuucguccagcgcaccgucgcccgcaccaucguccuccaggagaucaucggcaagggccgcuucggcgaggucuggcgcggccgcuggcgcggcggcgacgucgccgucaagaucuucuccucccgcgaggagcgcuccugguuccgcgaggccgagaucuaccagaccgucaugcuccgccacgagaacauccucggcuucaucgccgccgacaacaaggacaacggcaccuggacccagcucuggcucgucuccgacuaccacgagcacggcucccucuucgacuaccucaaccgcuacaccgucaccaucgagggcaugaucaagcucgcccucuccgccgccuccggccucgcccaccuccacauggagaucgucggcacccagggcaagcccggcaucgcccaccgcgaccucaaguccaagaacauccucgucaagaagaacggcaugugcgccaucgccgaccucggccucgccguccgccacgacgccgucaccgacaccaucgacaucgcccccaaccagcgcgucggcaccaagcgcuacauggcccccgagguccucgacgagaccaucaacaugaagcacuucgacuccuucaagugcgccgacaucuacgcccucggccucgucuacugggagaucgcccgccgcugcaacuccggcggcguccacgaggaguaccagcuccccuacuacgaccucguccccuccgaccccuccaucgaggagaugcgcaaggucgucugcgaccagaagcuccgccccaacauccccaacugguggcaguccuacgaggcccuccgcgucaugggcaagaugaugcgcgagugcugguacgccaacggcgccgcccgccucaccgcccuccgcaucaagaagacccucucccagcucuccguccaggaggacgucaagaucuga

SEQ ID NO: 39350 - RNA, 1332 nt, Artificial Sequence
  derived and/or modified sequence opt2 from ACVR1C__Homo_sapiens__NP_001104501
augcucaccaacggcaaggagcaggucaucaaguccugcgucucccuccccgagcucaacgcccaggucuucugccacuccuccaacaacgucaccaagaccgagugcugcuucaccgacuucugcaacaacaucacccuccaccuccccaccgccucccccaacgcccccaagcucggccccauggagcucgccaucaucaucaccguccccgucugccuccucuccaucgccgccaugcucaccgucugggccugccagggccgccagugcuccuaccgcaagaagaagcgccccaacgucgaggagccccucuccgagugcaaccucgucaacgccggcaagacccucaaggaccucaucuacgacgucaccgccuccggcuccggcuccggccucccccuccucguccagcgcaccaucgcccgcaccaucguccuccaggagaucgucggcaagggccgcuucggcgaggucuggcacggccgcuggugcggcgaggacgucgccgucaagaucuucuccucccgcgacgagcgcuccugguuccgcgaggccgagaucuaccagaccgucaugcuccgccacgagaacauccucggcuucaucgccgccgacaacaaggacaacggcaccuggacccagcucuggcucgucuccgaguaccacgagcagggcucccucuacgacuaccucaaccgcaacaucgucaccgucgccggcaugaucaagcucgcccucuccaucgccuccggccucgcccaccuccacauggagaucgucggcacccagggcaagcccgccaucgcccaccgcgacaucaaguccaagaacauccucgucaagaagugcgagaccugcgccaucgccgaccucggccucgccgucaagcacgacuccauccucaacaccaucgacaucccccagaaccccaaggucggcaccaagcgcuacauggcccccgagaugcucgacgacaccaugaacgucaacaucuucgaguccuucaagcgcgccgacaucuacuccgucggccucgucuacugggagaucgcccgccgcugcuccgucggcggcaucgucgaggaguaccagcuccccuacuacgacaugguccccuccgaccccuccaucgaggagaugcgcaaggucgucugcgaccagaaguuccgccccuccauccccaaccaguggcaguccugcgaggcccuccgcgucaugggccgcaucaugcgcgagugcugguacgccaacggcgccgcccgccucaccgcccuccgcaucaagaagaccaucucccagcucugcgucaaggaggacugcaaggccuga

SEQ ID NO: 39351 - RNA, 1530 nt, Artificial Sequence
  derived and/or modified sequence opt2 from ACVR1__Homo_sapiens__NP_001096
auggucgacggcgucaugauccuccccguccucaucaugaucgcccuccccucccccuccauggaggacgagaagcccaaggucaaccccaagcucuacaugugcgucugcgagggccucuccugcggcaacgaggaccacugcgagggccagcagugcuucuccucccucuccaucaacgacggcuuccacgucuaccagaagggcugcuuccaggucuacgagcagggcaagaugaccugcaagaccccccccucccccggccaggccgucgagugcugccagggcgacuggugcaaccgcaacaucaccgcccagcuccccaccaagggcaaguccuuccccggcacccagaacuuccaccucgaggucggccucaucauccucuccgucgucuucgccgucugccuccucgccugccuccucggcgucgcccuccgcaaguucaagcgccgcaaccaggagcgccucaacccccgcgacgucgaguacggcaccaucgagggccucaucaccaccaacgucggcgacuccacccucgccgaccuccucgaccacuccugcaccuccggcuccggcuccggccuccccuuccucguccagcgcaccgucgcccgccagaucacccuccucgagugcgucggcaagggccgcuacggcgaggucuggcgcggcuccuggcagggcgagaacgucgccgucaagaucuucuccucccgcgacgagaaguccugguuccgcgagaccgagcucuacaacaccgucaugcuccgccacgagaacauccucggcuucaucgccuccgacaugaccucccgccacuccuccacccagcucuggcucaucacccacuaccacgagaugggcucccucuacgacuaccuccagcucaccacccucgacaccgucuccugccuccgcaucguccucuccaucgccuccggccucgcccaccuccacaucgagaucuucggcacccagggcaagcccgccaucgcccaccgcgaccucaaguccaagaacauccucgucaagaagaacggccagugcugcaucgccgaccucggccucgccgucaugcacucccaguccaccaaccagcucgacgucggcaacaacccccgcgucggcaccaagcgcuacauggcccccgagguccucgacgagaccauccaggucgacugcuucgacuccuacaagcgcgucgacaucugggccuucggccucguccucugggaggucgcccgccgcauggucuccaacggcaucgucgaggacuacaagccccccuucuacgacgucguccccaacgaccccuccuucgaggacaugcgcaaggucgucugcgucgaccagcagcgccccaacauccccaaccgcugguucuccgaccccacccucaccucccucgccaagcucaugaaggagugcugguaccagaaccccuccgcccgccucaccgcccuccgcaucaagaagacccucaccaagaucgacaacucccucgacaagcucaagaccgacugcuga

SEQ ID NO: 39352 - RNA, 1542 nt, Artificial Sequence
  derived and/or modified sequence opt2 from ACVR2A__Homo_sapiens__NP_001265508
augggcgccgccgccaagcucgccuucgccgucuuccucaucuccugcuccuccggcgccauccucggccgcuccgagacccaggagugccucuucuucaacgccaacugggagaaggaccgcaccaaccagaccggcgucgagcccugcuacggcgacaaggacaagcgccgccacugcuucgccaccuggaagaacaucuccggcuccaucgagaucgucaagcagggcugcuggcucgacgacaucaacugcuacgaccgcaccgacugcgucgagaagaaggacucccccgaggucuacuucugcugcugcgagggcaacaugugcaacgagaaguucuccuacuuccccgagauggaggucacccagcccaccuccaaccccgucacccccaagccccccuacuacaacauccuccucuacucccucgucccccucaugcucaucgccggcaucgucaucugcgccuucugggucuaccgccaccacaagauggccuacccccccguccucguccccacccaggaccccggcccccccccccccuccccccuccucggccucaagccccuccagcuccucgaggucaaggcccgcggccgcuucggcugcgucuggaaggcccagcuccucaacgaguacgucgccgucaagaucuuccccauccaggacaagcaguccuggcagaacgaguacgaggucuacucccuccccggcaugaagcacgagaacauccuccaguucaucggcgccgagaagcgcggcaccuccgucgacgucgaccucuggcucaucaccgccuuccacgagaagggcucccucuccgacuuccucaaggccaacgucgucuccuggaacgagcucugccacaucgccgagaccauggcccgcggccucgccuaccuccacgaggacauccccggccucaaggacggccacaagcccgccaucucccaccgcgacaucaaguccaagaacguccuccucaagaacaaccucaccgccugcaucgccgacuucggccucgcccucaaguucgaggccggcaaguccgccggcgacacccacggccaggucggcacccgccgcuacauggcccccgagguccucgagggcgccaucaacuuccagcgcgacgccuuccuccgcaucgacauguacgccaugggccucguccucugggagcucgccucccgcugcaccgccgccgacggccccgucgacgaguacaugcuccccuucgaggaggagaucggccagcaccccucccucgaggacaugcaggaggucgucguccacaagaagaagcgccccguccuccgcgacuacuggcagaagcacgccggcauggccaugcucugcgagaccaucgaggagugcugggaccacgacgccgaggcccgccucuccgccggcugcgucggcgagcgcaucacccagaugcagcgccucaccaacaucaucaccaccgaggacaucgucaccgucgucaccauggucaccaacgucgacuucccccccaaggaguccucccucuga

SEQ ID NO: 39353 - RNA, 1539 nt, Artificial Sequence
  derived and/or modified sequence opt2 from ACVR2B__Homo_sapiens__NP_001097
augaccgcccccugggucgcccucgcccuccucuggggcucccucugcgccggcuccggccgcggcgaggccgagacccgcgagugcaucuacuacaacgccaacugggagcucgagcgcaccaaccaguccggccucgagcgcugcgagggcgagcaggacaagcgccuccacugcuacgccuccuggcgcaacuccuccggcaccaucgagcucgucaagaagggcugcuggcucgacgacuucaacugcuacgaccgccaggagugcgucgccaccgaggagaacccccaggucuacuucugcugcugcgagggcaacuucugcaacgagcgcuucacccaccuccccgaggccggcggccccgaggucaccuacgagcccccccccaccgcccccacccuccucaccguccucgccuacucccuccuccccaucggcggccucucccucaucguccuccucgccuucuggauguaccgccaccgcaagccccccuacggccacgucgacauccacgaggaccccggcccccccccccccuccccccucgucggccucaagccccuccagcuccucgagaucaaggcccgcggccgcuucggcugcgucuggaaggcccagcucaugaacgacuucgucgccgucaagaucuucccccuccaggacaagcaguccuggcaguccgagcgcgagaucuucuccacccccggcaugaagcacgagaaccuccuccaguucaucgccgccgagaagcgcggcuccaaccucgaggucgagcucuggcucaucaccgccuuccacgacaagggcucccucaccgacuaccucaagggcaacaucaucaccuggaacgagcucugccacgucgccgagaccaugucccgcggccucuccuaccuccacgaggacguccccuggugccgcggcgagggccacaagcccuccaucgcccaccgcgacuucaaguccaagaacguccuccucaaguccgaccucaccgccguccucgccgacuucggccucgccguccgcuucgagcccggcaagccccccggcgacacccacggccaggucggcacccgccgcuacauggcccccgagguccucgagggcgccaucaacuuccagcgcgacgccuuccuccgcaucgacauguacgccaugggccucguccucugggagcucgucucccgcugcaaggccgccgacggccccgucgacgaguacaugcuccccuucgaggaggagaucggccagcaccccucccucgaggagcuccaggaggucgucguccacaagaagaugcgccccaccaucaaggaccacuggcucaagcaccccggccucgcccagcucugcgucaccaucgaggagugcugggaccacgacgccgaggcccgccucuccgccggcugcgucgaggagcgcgucucccucauccgccgcuccgucaacggcaccaccuccgacugccucgucucccucgucaccuccgucaccaacgucgaccucccccccaaggaguccuccaucuga

SEQ ID NO: 39354 - RNA, 1512 nt, Artificial Sequence
  derived and/or modified sequence opt2 from ACVRL1__Homo_sapiens__NP_001070869
augacccucggcuccccccgcaagggccuccucaugcuccucauggcccucgucacccagggcgaccccgucaagcccucccgcggcccccucgucaccugcaccugcgaguccccccacugcaagggccccaccugccgcggcgccuggugcaccgucguccucguccgcgaggagggccgccacccccaggagcaccgcggcugcggcaaccuccaccgcgagcucugccgcggccgccccaccgaguucgucaaccacuacugcugcgacucccaccucugcaaccacaacgucucccucguccucgaggccacccagccccccuccgagcagcccggcaccgacggccagcucgcccucauccucggccccguccucgcccuccucgcccucgucgcccucggcguccucggccucuggcacguccgccgccgccaggagaagcagcgcggccuccacuccgagcucggcgaguccucccucauccucaaggccuccgagcagggcgacuccaugcucggcgaccuccucgacuccgacugcaccaccggcuccggcuccggccuccccuuccucguccagcgcaccgucgcccgccaggucgcccucgucgagugcgucggcaagggccgcuacggcgaggucuggcgcggccucuggcacggcgaguccgucgccgucaagaucuucuccucccgcgacgagcaguccugguuccgcgagaccgagaucuacaacaccguccuccuccgccacgacaacauccucggcuucaucgccuccgacaugaccucccgcaacuccuccacccagcucuggcucaucacccacuaccacgagcacggcucccucuacgacuuccuccagcgccagacccucgagccccaccucgcccuccgccucgccgucuccgccgccugcggccucgcccaccuccacgucgagaucuucggcacccagggcaagcccgccaucgcccaccgcgacuucaagucccgcaacguccucgucaaguccaaccuccagugcugcaucgccgaccucggccucgccgucaugcacucccagggcuccgacuaccucgacaucggcaacaacccccgcgucggcaccaagcgcuacauggcccccgagguccucgacgagcagauccgcaccgacugcuucgaguccuacaaguggaccgacaucugggccuucggccucguccucugggagaucgcccgccgcaccaucgucaacggcaucgucgaggacuaccgcccccccuucuacgacgucguccccaacgaccccuccuucgaggacaugaagaaggucgucugcgucgaccagcagacccccaccauccccaaccgccucgccgccgaccccguccucuccggccucgcccagaugaugcgcgagugcugguaccccaaccccuccgcccgccucaccgcccuccgcaucaagaagacccuccagaagaucuccaacucccccgagaagcccaaggucauccaguga

SEQ ID NO: 39355 - RNA, 1227 nt, Artificial Sequence
  derived and/or modified sequence opt2 from ACY1__Homo_sapiens__NP_001185824
augaccuccaagggccccgaggaggagcaccccuccgucacccucuuccgccaguaccuccgcauccgcaccguccagcccaagcccgacuacggcgccgccgucgccuucuucgaggagaccgcccgccagcucggccucggcugccagaaggucgaggucgcccccggcuacgucgucaccguccucaccuggcccggcaccaaccccacccucuccuccauccuccucaacucccacaccgacgucguccccgucuucaaggagcacuggucccacgaccccuucgaggccuucaaggacuccgagggcuacaucuacgcccgcggcgcccaggacaugaagugcgucuccauccaguaccucgaggccguccgccgccucaaggucgagggccaccgcuucccccgcaccauccacaugaccuucguccccgacgaggaggucggcggccaccagggcauggagcucuucguccagcgccccgaguuccacgcccuccgcgccggcuucgcccucgacgagggcaucgccaaccccaccgacgccuucaccgucuucuacuccgagcgcucccccugguggguccgcgucaccuccaccggccgccccggccacgccucccgcuucauggaggacaccgccgccgagaagcuccacaaggucgucaacuccauccucgccuuccgcgagaaggaguggcagcgccuccaguccaacccccaccucaaggagggcuccgucaccuccgucaaccucaccaagcucgagggcggcgucgccuacaacgucauccccgccaccauguccgccuccuucgacuuccgcgucgcccccgacgucgacuucaaggccuucgaggagcagcuccaguccuggugccaggccgccggcgagggcgucacccucgaguucgcccagaaguggaugcacccccaggucacccccaccgacgacuccaaccccuggugggccgccuucucccgcgucugcaaggacaugaaccucacccucgagcccgagaucaugcccgccgccaccgacaaccgcuacauccgcgccgucggcguccccgcccucggcuucucccccaugaaccgcacccccguccuccuccacgaccacgacgagcgccuccacgaggccgucuuccuccgcggcgucgacaucuacacccgccuccuccccgcccucgccuccguccccgcccuccccuccgacuccuga

SEQ ID NO: 39356 - RNA, 960 nt, Artificial Sequence
  derived and/or modified sequence opt2 from ACY3__Homo_sapiens__NP_542389
augugcucccuccccgucccccgcgagccccuccgccgcgucgccgucaccggcggcacccacggcaacgagauguccggcgucuaccucgcccgccacuggcuccacgcccccgccgagcuccagcgcgccuccuucuccgccguccccguccucgccaaccccgccgccaccuccggcugccgccgcuacgucgaccacgaccucaaccgcaccuucaccuccuccuuccucaacucccgccccacccccgacgaccccuacgaggucacccgcgcccgcgagcucaaccagcuccucggccccaaggccuccggccaggccuucgacuucguccucgaccuccacaacaccaccgccaacaugggcaccugccucaucgccaaguccucccacgaggucuucgccaugcaccucugccgccaccuccagcuccaguaccccgagcucuccugccaggucuuccucuaccagcgcuccggcgaggaguccuacaaccucgacuccgucgccaagaacggccucggccucgagcucggcccccagccccagggcguccuccgcgccgacaucuucucccgcaugcgcacccucgucgccaccguccucgacuucaucgagcucuucaaccagggcaccgccuuccccgccuucgagauggaggccuaccgccccgucggcgucgucgacuucccccgcaccgaggccggccaccucgccggcaccguccacccccagcuccaggaccgcgacuuccagccccuccagcccggcgcccccaucuuccagauguucuccggcgaggaccuccucuacgagggcgaguccaccgucuaccccgucuucaucaacgaggccgccuacuacgagaagggcgucgccuucguccagaccgagaaguucaccuucaccguccccgccaugcccgcccucacccccgcccccucccccgccuccuga

SEQ ID NO: 39357 - RNA, 300 nt, Artificial Sequence
  derived and/or modified sequence opt2 from ACYP2__Homo_sapiens__NP_612457
auguccaccgcccagucccucaaguccgucgacuacgaggucuucggccgcguccagggcgucugcuuccgcauguacaccgaggacgaggcccgcaagaucggcgucgucggcugggucaagaacaccuccaagggcaccgucaccggccagguccagggccccgaggacaaggucaacuccaugaaguccuggcucuccaaggucggcucccccuccucccgcaucgaccgcaccaacuucuccaacgagaagaccaucuccaagcucgaguacuccaacuucuccauccgcuacuga

SEQ ID NO: 39358 - RNA, 1698 nt, Artificial Sequence
  derived and/or modified sequence opt2 from ADAD1__Homo_sapiens__NP_001152757
auggccuccaacaaccacugguuccaguccucccagguccccuccuucgcccagaugcucaagaagaaccuccccguccagcccgccaccaagaccaucaccacccccaccggcugguccuccgaguccuacggccucuccaagauggccuccaaggucacccaggucaccggcaacuuccccgagccccuccucuccaagaaccucuccuccaucuccaaccccguccucccccccaagaagauccccaaggaguucaucaugaaguacaagcgcggcgagaucaaccccgucuccgcccuccaccaguucgcccagaugcagcgcguccagcucgaccucaaggagaccgucaccaccggcaacgucaugggccccuacuucgccuucugcgccgucgucgacggcauccaguacaagaccggccucggccagaacaagaaggagucccgcuccaacgccgccaagcucgcccucgacgagcuccuccagcucgacgagcccgagccccgcauccucgagaccuccggccccccccccuuccccgccgagcccgucguccucuccgagcucgccuacgucuccaagguccacuacgagggccgccacauccaguacgccaagaucucccagaucgucaaggagcgcuucaaccagcucaucuccaaccgcuccgaguaccucaaguacuccuccucccucgccgccuucaucaucgagcgcgccggccagcacgaggucgucgccaucggcaccggcgaguacaacuacucccaggacaucaagcccgacggccgcguccuccacgacacccacgccgucgucaccgcccgccgcucccuccucuccaagaaccccgccaugauggagaaguccaucuucugcaccgagcccaccuccaaccuccucacccucaagcagaacaucaacaucugccucuacaugaaccagcuccccaagggcuccgcccagaucaagucccagcuccgccucaacccccacuccaucuccgccuucgaggccaacgaggagcucugccuccacgucgccgucgagggcaagaucuaccucaccgucuacugccccaaggacggcgucaaccgcaucuccuccauguccuccuccgacaagcucacccgcugggagguccucggcguccagggcgcccuccucucccacuucauccagcccgucuacaucuccuccauccucaucggcgacggcaacugcuccgacacccgcggccucgagaucgccaucaagcagcgcgucgacgacgcccucaccuccaagcuccccauguucuaccucgucaaccgcccccacaucucccucguccccuccgccuacccccuccagaugaaccucgaguacaaguuccucucccucaacugggcccagggcgacgucucccucgagaucgucgacggccucuccggcaagaucaccgaguccucccccuucaaguccggcauguccauggccucccgccucugcaaggccgccaugcucucccgcuucaaccuccucgccaaggaggccaagaaggagcuccucgaggccggcaccuaccacgccgccaagugcauguccgccuccuaccaggaggccaagugcaagcucaaguccuaccuccagcagcacggcuacggcuccuggaucgucaagucccccugcaucgagcaguucaacauguga

SEQ ID NO: 39359 - RNA, 1092 nt, Artificial Sequence
  derived and/or modified sequence opt2 from ADA__Homo_sapiens__NP_000013
auggcccagacccccgccuucgacaagcccaaggucgagcuccacguccaccucgacggcuccaucaagcccgagaccauccucuacuacggccgccgccgcggcaucgcccuccccgccaacaccgccgagggccuccucaacgucaucggcauggacaagccccucacccuccccgacuuccucgccaaguucgacuacuacaugcccgccaucgccggcugccgcgaggccaucaagcgcaucgccuacgaguucgucgagaugaaggccaaggagggcgucgucuacgucgagguccgcuacuccccccaccuccucgccaacuccaaggucgagcccauccccuggaaccaggccgagggcgaccucacccccgacgaggucgucgcccucgucggccagggccuccaggagggcgagcgcgacuucggcgucaaggcccgcuccauccucugcugcaugcgccaccagcccaacuggucccccaaggucgucgagcucugcaagaaguaccagcagcagaccgucgucgccaucgaccucgccggcgacgagaccauccccggcuccucccuccuccccggccacguccaggccuaccaggaggccgucaaguccggcauccaccgcaccguccacgccggcgaggucggcuccgccgaggucgucaaggaggccgucgacauccucaagaccgagcgccucggccacggcuaccacacccucgaggaccaggcccucuacaaccgccuccgccaggagaacaugcacuucgagaucugccccugguccuccuaccucaccggcgccuggaagcccgacaccgagcacgccgucauccgccucaagaacgaccaggccaacuacucccucaacaccgacgacccccucaucuucaaguccacccucgacaccgacuaccagaugaccaagcgcgacaugggcuucaccgaggaggaguucaagcgccucaacaucaacgccgccaaguccuccuuccuccccgaggacgagaagcgcgagcuccucgaccuccucuacaaggccuacggcaugccccccuccgccuccgccggccagaaccucuga

SEQ ID NO: 39360 - RNA, 2247 nt, Artificial Sequence
  derived and/or modified sequence opt2 from ADAM10__Homo_sapiens__NP_001101
augguccuccuccgcguccucauccuccuccucuccugggccgccggcaugggcggccaguacggcaacccccucaacaaguacauccgccacuacgagggccucuccuacaacgucgacucccuccaccagaagcaccagcgcgccaagcgcgccgucucccacgaggaccaguuccuccgccucgacuuccacgcccacggccgccacuucaaccuccgcaugaagcgcgacaccucccucuucuccgacgaguucaaggucgagaccuccaacaagguccucgacuacgacaccucccacaucuacaccggccacaucuacggcgaggagggcuccuucucccacggcuccgucaucgacggccgcuucgagggcuucauccagacccgcggcggcaccuucuacgucgagcccgccgagcgcuacaucaaggaccgcacccuccccuuccacuccgucaucuaccacgaggacgacaucaacuacccccacaaguacggcccccagggcggcugcgccgaccacuccgucuucgagcgcaugcgcaaguaccagaugaccggcgucgaggaggucacccagaucccccaggaggagcacgccgccaacggccccgagcuccuccgcaagaagcgcaccaccuccgccgagaagaacaccugccagcucuacauccagaccgaccaccucuucuucaaguacuacggcacccgcgaggccgucaucgcccagaucuccucccacgucaaggccaucgacaccaucuaccagaccaccgacuucuccggcauccgcaacaucuccuucauggucaagcgcauccgcaucaacaccaccgccgacgagaaggaccccaccaaccccuuccgcuuccccaacaucggcgucgagaaguuccucgagcucaacuccgagcagaaccacgacgacuacugccucgccuacgucuucaccgaccgcgacuucgacgacggcguccucggccucgccugggucggcgcccccuccggcuccuccggcggcaucugcgagaaguccaagcucuacuccgacggcaagaagaagucccucaacaccggcaucaucaccguccagaacuacggcucccacgucccccccaaggucucccacaucaccuucgcccacgaggucggccacaacuucggcuccccccacgacuccggcaccgagugcacccccggcgaguccaagaaccucggccagaaggagaacggcaacuacaucauguacgcccgcgccaccuccggcgacaagcucaacaacaacaaguucucccucugcuccauccgcaacaucucccagguccucgagaagaagcgcaacaacugcuucgucgaguccggccagcccaucugcggcaacggcauggucgagcagggcgaggagugcgacugcggcuacuccgaccagugcaaggacgagugcugcuucgacgccaaccagcccgagggccgcaagugcaagcucaagcccggcaagcagugcucccccucccagggccccugcugcaccgcccagugcgccuucaaguccaaguccgagaagugccgcgacgacuccgacugcgcccgcgagggcaucugcaacggcuucaccgcccucugccccgccuccgaccccaagcccaacuucaccgacugcaaccgccacacccaggucugcaucaacggccagugcgccggcuccaucugcgagaaguacggccucgaggagugcaccugcgccuccuccgacggcaaggacgacaaggagcucugccacgucugcugcaugaagaagauggaccccuccaccugcgccuccaccggcuccguccaguggucccgccacuucuccggccgcaccaucacccuccagcccggcucccccugcaacgacuuccgcggcuacugcgacgucuucaugcgcugccgccucgucgacgccgacggcccccucgcccgccucaagaaggccaucuucucccccgagcucuacgagaacaucgccgaguggaucgucgcccacuggugggccguccuccucaugggcaucgcccucaucaugcucauggccggcuucaucaagaucugcuccguccacacccccuccuccaaccccaagcuccccccccccaagccccuccccggcacccucaagcgccgccgccccccccagcccauccagcagccccagcgccagcgcccccgcgaguccuaccagaugggccacaugcgccgcuga

SEQ ID NO: 39361 - RNA, 2310 nt, Artificial Sequence
  derived and/or modified sequence opt2 from ADAM11__Homo_sapiens__NP_002381
augcgccuccuccgccgcugggccuucgccgcccuccuccucucccuccuccccacccccggccucggcacccagggccccgccggcgcccuccgcuggggcggccucccccagcucggcggccccggcgcccccgaggucaccgagcccucccgccucguccgcgaguccuccggcggcgagguccgcaagcagcagcucgacacccgcguccgccaggagccccccggcggcccccccguccaccucgcccaggucuccuucgucauccccgccuucaacuccaacuucacccucgaccucgagcucaaccaccaccuccucuccucccaguacgucgagcgccacuucucccgcgagggcaccacccagcacuccaccggcgccggcgaccacugcuacuaccagggcaagcuccgcggcaacccccacuccuucgccgcccucuccaccugccagggccuccacggcgucuucuccgacggcaaccucaccuacaucgucgagccccaggaggucgccggccccuggggcgccccccagggcccccucccccaccucaucuaccgcaccccccuccuccccgacccccucggcugccgcgagcccggcugccucuucgccguccccgcccaguccgccccccccaaccgcccccgccuccgccgcaagcgccagguccgccgcggccaccccaccguccacuccgagaccaaguacgucgagcucaucgucaucaacgaccaccagcucuucgagcagaugcgccaguccgucguccucaccuccaacuucgccaaguccgucgucaaccucgccgacgucaucuacaaggagcagcucaacacccgcaucguccucgucgccauggagaccugggccgacggcgacaagauccagguccaggacgaccuccucgagacccucgcccgccucauggucuaccgccgcgagggccuccccgagcccuccgacgccacccaccucuucuccggccgcaccuuccaguccaccuccuccggcgccgccuacgucggcggcaucugcucccucucccacggcggcggcgucaacgaguacggcaacaugggcgccauggccgucacccucgcccagacccucggccagaaccucggcaugauguggaacaagcaccgcuccuccgccggcgacugcaagugccccgacaucuggcucggcugcaucauggaggacaccggcuucuaccucccccgcaaguucucccgcugcuccaucgacgaguacaaccaguuccuccaggagggcggcggcuccugccucuucaacaagccccucaagcuccucgacccccccgagugcggcaacggcuucgucgaggccggcgaggagugcgacugcggcuccguccaggagugcucccgcgccggcggcaacugcugcaagaagugcacccucacccacgacgccaugugcuccgacggccucugcugccgccgcugcaaguacgagccccgcggcgucuccugccgcgaggccgucaacgagugcgacaucgccgagaccugcaccggcgacuccucccagugcccccccaaccuccacaagcucgacggcuacuacugcgaccacgagcagggccgcugcuacggcggccgcugcaagacccgcgaccgccagugccagguccucuggggccacgccgccgccgaccgcuucugcuacgagaagcucaacgucgagggcaccgagcgcggcuccugcggccgcaagggcuccggcuggguccagugcuccaagcaggacguccucugcggcuuccuccucugcgucaacaucuccggcgccccccgccucggcgaccucgucggcgacaucuccuccgucaccuucuaccaccagggcaaggagcucgacugccgcggcggccacguccagcucgccgacggcuccgaccucuccuacgucgaggacggcaccgccugcggccccaacaugcucugccucgaccaccgcugccuccccgccuccgccuucaacuucuccaccugccccggcuccggcgagcgccgcaucugcucccaccacggcgucugcuccaacgagggcaagugcaucugccagcccgacuggaccggcaaggacugcuccauccacaacccccuccccaccuccccccccaccggcgagaccgagcgcuacaagggccccuccggcaccaacaucaucaucggcuccaucgccggcgccguccucgucgccgccaucguccucggcggcaccggcuggggcuucaagaacauccgccgcggccgcuccggcggcgccuga

SEQ ID NO: 39362 - RNA, 2208 nt, Artificial Sequence
  derived and/or modified sequence opt2 from ADAM12__Homo_sapiens__NP_001275904
auggccgcccgcccccuccccgucucccccgcccgcgcccuccuccucgcccucgccggcgcccuccucgcccccugcgaggcccgcggcgucucccucuggaaccagggccgcgccgacgaggucgucuccgccuccgucggcuccggcgaccucuggauccccgucaaguccuucgacuccaagaaccaccccgagguccucaacauccgccuccagcgcgaguccaaggagcucaucaucaaccucgagcgcaacgagggccucaucgccuccuccuucaccgagacccacuaccuccaggacggcaccgacgucucccucgcccgcaacuacaccggccacugcuacuaccacggccacguccgcggcuacuccgacuccgccgucucccucuccaccugcuccggccuccgcggccucaucgucuucgagaacgaguccuacguccucgagcccaugaaguccgccaccaaccgcuacaagcucuuccccgccaagaagcucaaguccguccgcggcuccugcggcucccaccacaacacccccaaccucgccgccaagaacgucuuccccccccccucccagaccugggcccgccgccacaagcgcgagacccucaaggccaccaaguacgucgagcucgucaucgucgccgacaaccgcgaguuccagcgccagggcaaggaccucgagaaggucaagcagcgccucaucgagaucgccaaccacgucgacaaguucuaccgcccccucaacauccgcaucguccucgucggcgucgaggucuggaacgacauggacaagugcuccgucucccaggaccccuucaccucccuccacgaguuccucgacuggcgcaagaugaagcuccucccccgcaagucccacgacaacgcccagcucgucuccggcgucuacuuccagggcaccaccaucggcauggcccccaucauguccaugugcaccgccgaccaguccggcggcaucgucauggaccacuccgacaacccccucggcgccgccgucacccucgcccacgagcucggccacaacuucggcaugaaccacgacacccucgaccgcggcugcuccugccagauggccgucgagaagggcggcugcaucaugaacgccuccaccggcuaccccuuccccauggucuucuccuccugcucccgcaaggaccucgagaccucccucgagaagggcaugggcgucugccucuucaaccuccccgagguccgcgaguccuucggcggccagaagugcggcaaccgcuucgucgaggagggcgaggagugcgacugcggcgagcccgaggagugcaugaaccgcugcugcaacgccaccaccugcacccucaagcccgacgccgucugcgcccacggccucugcugcgaggacugccagcucaagcccgccggcaccgccugccgcgacuccuccaacuccugcgaccuccccgaguucugcaccggcgccuccccccacugccccgccaacgucuaccuccacgacggccacuccugccaggacgucgacggcuacugcuacaacggcaucugccagacccacgagcagcagugcgucacccucuggggccccggcgccaagcccgcccccggcaucugcuucgagcgcgucaacuccgccggcgaccccuacggcaacugcggcaaggucuccaaguccuccuucgccaagugcgagaugcgcgacgccaagugcggcaagauccagugccagggcggcgccucccgccccgucaucggcaccaacgccgucuccaucgagaccaacaucccccuccagcagggcggccgcauccucugccgcggcacccacgucuaccucggcgacgacaugcccgaccccggccucguccucgccggcaccaagugcgccgacggcaagaucugccucaaccgccagugccagaacaucuccgucuucggcguccacgagugcgccaugcagugccacggccgcggcgucugcaacaaccgcaagaacugccacugcgaggcccacugggccccccccuucugcgacaaguucggcuucggcggcuccaccgacuccggccccauccgccaggccgaggcccgccaggaggccgccgaguccaaccgcgagcgcggccagggccaggagcccgucggcucccaggagcacgccuccaccgccucccucacccucaucuga

SEQ ID NO: 39363 - RNA, 2475 nt, Artificial Sequence
  derived and/or modified sequence opt2 from ADAM15__Homo_sapiens__NP_001248393
augcgccucgcccuccucugggcccucggccuccucggcgccggcuccccccuccccuccuggccccuccccaacaucguccucuccuggggcguccucggccccgccggcggcaccgaggagcagcaggccgaguccgagaaggccccccgcgagccccucgagccccagguccuccaggacgaccuccccaucucccucaagaagguccuccagaccucccuccccgagccccuccgcaucaagcucgagcucgacggcgacucccacauccucgagcuccuccagaaccgcgagcucguccccggccgccccacccucgucugguaccagcccgacggcacccgcgucgucuccgagggccacacccucgagaacugcugcuaccagggccgcguccgcggcuacgccggcuccugggucuccaucugcaccugcuccggccuccgcggccucgucguccucacccccgagcgcuccuacacccucgagcagggccccggcgaccuccagggcccccccaucaucucccgcauccaggaccuccaccuccccggccacaccugcgcccucuccuggcgcgaguccguccacacccagaagccccccgagcacccccucggccagcgccacauccgccgccgccgcgacgucgucaccgagaccaagaccgucgagcucgucaucgucgccgaccacuccgaggcccagaaguaccgcgacuuccagcaccuccucaaccgcacccucgaggucgcccuccuccucgacaccuucuuccgcccccucaacguccgcgucgcccucgucggccucgaggccuggacccagcgcgaccucgucgagaucucccccaaccccgccgucacccucgagaacuuccuccacuggcgccgcgcccaccuccucccccgccucccccacgacuccgcccagcucgucaccggcaccuccuucuccggccccaccgucggcauggccauccagaacuccaucugcucccccgacuucuccggcggcgucaacauggaccacuccaccuccauccucggcgucgccuccuccaucgcccacgagcucggccacucccucggccucgaccacgaccuccccggcaacuccugccccugccccggccccgcccccgccaagaccugcaucauggaggccuccaccgacuuccuccccggccucaacuucuccaacugcucccgccgcgcccucgagaaggcccuccucgacggcaugggcuccugccucuucgagcgccuccccucccucccccccauggccgccuucugcggcaacauguucgucgagcccggcgagcagugcgacugcggcuuccucgacgacugcgucgaccccugcugcgacucccucaccugccagcuccgccccggcgcccagugcgccuccgacggccccugcugccagaacugccagcuccgccccuccggcuggcagugccgccccacccgcggcgacugcgaccuccccgaguucugccccggcgacuccucccagugcccccccgacgucucccucggcgacggcgagcccugcgccggcggccaggccgucugcaugcacggccgcugcgccuccuacgcccagcagugccagucccucuggggccccggcgcccagcccgccgccccccucugccuccagaccgccaacacccgcggcaacgccuucggcuccugcggccgcaaccccuccggcuccuacgucuccugcaccccccgcgacgccaucugcggccagcuccagugccagaccggccgcacccagccccuccucggcuccauccgcgaccuccucugggagaccaucgacgucaacggcaccgagcucaacugcuccuggguccaccucgaccucggcuccgacgucgcccagccccuccucacccuccccggcaccgccugcggccccggccucgucugcaucgaccaccgcugccagcgcgucgaccuccucggcgcccaggagugccgcuccaagugccacggccacggcgucugcgacuccaaccgccacugcuacugcgaggagggcugggccccccccgacugcaccacccagcucaaggccaccuccucccucaccaccggccuccuccucucccuccucguccuccucguccucgucaugcucggcgccuccuacugguaccgcgcccgccuccaccagcgccucugccagcucaagggccccaccugccaguaccgcgccgcccaguccggccccuccgagcgccccggccccccccagcgcgcccuccucgcccgcggcaccaagucccagggccccgccaagcccccccccccccgcaagccccuccccgccgacccccagggccgcugccccuccggcgaccuccccggccccggcgccggcauccccccccucgucguccccucccgccccgccccccccccccccaccgucuccucccucuaccucuga

SEQ ID NO: 39364 - RNA, 2475 nt, Artificial Sequence
  derived and/or modified sequence opt2 from ADAM17__Homo_sapiens__NP_003174
augcgccagucccuccucuuccucaccuccgucguccccuucguccucgccccccgcccccccgacgaccccggcuucggcccccaccagcgccucgagaagcucgacucccuccucuccgacuacgacauccucucccucuccaacauccagcagcacuccguccgcaagcgcgaccuccagaccuccacccacgucgagacccuccucaccuucuccgcccucaagcgccacuucaagcucuaccucaccuccuccaccgagcgcuucucccagaacuucaaggucgucgucgucgacggcaagaacgaguccgaguacaccgucaaguggcaggacuucuucaccggccacgucgucggcgagcccgacucccgcguccucgcccacauccgcgacgacgacgucaucauccgcaucaacaccgacggcgccgaguacaacaucgagccccucuggcgcuucgucaacgacaccaaggacaagcgcaugcucgucuacaaguccgaggacaucaagaacgucucccgccuccagucccccaaggucugcggcuaccucaaggucgacaacgaggagcuccuccccaagggccucgucgaccgcgagccccccgaggagcucguccaccgcgucaagcgccgcgccgaccccgaccccaugaagaacaccugcaagcuccucgucgucgccgaccaccgcuucuaccgcuacaugggccgcggcgaggaguccaccaccaccaacuaccucaucgagcucaucgaccgcgucgacgacaucuaccgcaacaccuccugggacaacgccggcuucaagggcuacggcauccagaucgagcagauccgcauccucaaguccccccaggaggucaagcccggcgagaagcacuacaacauggccaaguccuaccccaacgaggagaaggacgccugggacgucaagaugcuccucgagcaguucuccuucgacaucgccgaggaggccuccaaggucugccucgcccaccucuucaccuaccaggacuucgacaugggcacccucggccucgccuacgucggcuccccccgcgccaacucccacggcggcgucugccccaaggccuacuacucccccgucggcaagaagaacaucuaccucaacuccggccucaccuccaccaagaacuacggcaagaccauccucaccaaggaggccgaccucgucaccacccacgagcucggccacaacuucggcgccgagcacgaccccgacggccucgccgagugcgcccccaacgaggaccagggcggcaaguacgucauguaccccaucgccgucuccggcgaccacgagaacaacaagauguucuccaacugcuccaagcaguccaucuacaagaccaucgaguccaaggcccaggagugcuuccaggagcgcuccaacaaggucugcggcaacucccgcgucgacgagggcgaggagugcgaccccggcaucauguaccucaacaacgacaccugcugcaacuccgacugcacccucaaggagggcguccagugcuccgaccgcaacucccccugcugcaagaacugccaguucgagaccgcccagaagaagugccaggaggccaucaacgccaccugcaagggcgucuccuacugcaccggcaacuccuccgagugccccccccccggcaacgccgaggacgacaccgucugccucgaccucggcaagugcaaggacggcaagugcauccccuucugcgagcgcgagcagcagcucgaguccugcgccugcaacgagaccgacaacuccugcaaggucugcugccgcgaccucuccggccgcugcguccccuacgucgacgccgagcagaagaaccucuuccuccgcaagggcaagcccugcaccgucggcuucugcgacaugaacggcaagugcgagaagcgcguccaggacgucaucgagcgcuucugggacuucaucgaccagcucuccaucaacaccuucggcaaguuccucgccgacaacaucgucggcuccguccucgucuucucccucaucuucuggauccccuucuccauccucguccacugcgucgacaagaagcucgacaagcaguacgagucccucucccucuuccaccccuccaacgucgagaugcucuccuccauggacuccgccuccguccgcaucaucaagcccuuccccgccccccagacccccggccgccuccagcccgcccccgucauccccuccgcccccgccgcccccaagcucgaccaccagcgcauggacaccauccaggaggaccccuccaccgacucccacauggacgaggacggcuucgagaaggaccccuuccccaacuccuccaccgccgccaaguccuucgaggaccucaccgaccaccccgucacccgcuccgagaaggccgccuccuucaagcuccagcgccagaaccgcgucgacuccaaggagaccgagugcuga

SEQ ID NO: 39365 - RNA, 2757 nt, Artificial Sequence
  derived and/or modified sequence opt2 from ADAM19__Homo_sapiens__NP_150377
augcccggcggcgccggcgccgcccgccucugccuccucgccuucgcccuccagccccuccgcccccgcgccgcccgcgagcccggcuggacccgcggcuccgaggagggcucccccaagcuccagcacgagcucaucaucccccaguggaagaccuccgagucccccguccgcgagaagcacccccucaaggccgagcuccgcgucauggccgagggccgcgagcucauccucgaccucgagaagaacgagcagcucuucgcccccuccuacaccgagacccacuacaccuccuccggcaacccccagaccaccacccgcaagcucgaggaccacugcuucuaccacggcaccguccgcgagaccgagcucuccuccgucacccucuccaccugccgcggcauccgcggccucaucaccgucuccuccaaccucuccuacgucaucgagccccuccccgacuccaagggccagcaccucaucuaccgcuccgagcaccucaagcccccccccggcaacugcggcuucgagcacuccaagcccaccacccgcgacugggcccuccaguucacccagcagaccaagaagcgcccccgccgcaugaagcgcgaggaccucaacuccaugaaguacgucgagcucuaccucgucgccgacuaccucgaguuccagaagaaccgccgcgaccaggacgccaccaagcacaagcucaucgagaucgccaacuacgucgacaaguucuaccgcucccucaacauccgcaucgcccucgucggccucgaggucuggacccacggcaacaugugcgaggucuccgagaaccccuacuccacccucugguccuuccucuccuggcgccgcaagcuccucgcccagaaguaccacgacaacgcccagcucaucaccggcauguccuuccacggcaccaccaucggccucgccccccucauggccaugugcuccgucuaccaguccggcggcgucaacauggaccacuccgagaacgccaucggcgucgccgccaccauggcccacgagaugggccacaacuucggcaugacccacgacuccgccgacugcugcuccgccuccgccgccgacggcggcugcaucauggccgccgccaccggccaccccuuccccaaggucuucaacggcugcaaccgccgcgagcucgaccgcuaccuccaguccggcggcggcaugugccucuccaacaugcccgacacccgcaugcucuacggcggccgccgcugcggcaacggcuaccucgaggacggcgaggagugcgacugcggcgaggaggaggagugcaacaaccccugcugcaacgccuccaacugcacccuccgccccggcgccgagugcgcccacggcuccugcugccaccagugcaagcuccucgcccccggcacccucugccgcgagcaggcccgccagugcgaccuccccgaguucugcaccggcaaguccccccacugccccaccaacuucuaccagauggacggcacccccugcgagggcggccaggccuacugcuacaacggcaugugccucaccuaccaggagcagugccagcagcucuggggccccggcgcccgccccgcccccgaccucugcuucgagaaggucaacgucgccggcgacaccuucggcaacugcggcaaggacaugaacggcgagcaccgcaagugcaacaugcgcgacgccaagugcggcaagauccagugccaguccuccgaggcccgcccccucgaguccaacgccguccccaucgacaccaccaucaucaugaacggccgccagauccagugccgcggcacccacgucuaccgcggccccgaggaggagggcgacaugcucgaccccggccucgucaugaccggcaccaagugcggcuacaaccacaucugcuucgagggccagugccgcaacaccuccuucuucgagaccgagggcugcggcaagaagugcaacggccacggcgucugcaacaacaaccagaacugccacugccuccccggcugggccccccccuucugcaacacccccggccacggcggcuccaucgacuccggccccaugccccccgaguccgucggccccgucgucgccggcguccucgucgccauccucguccucgccguccucaugcucauguacuacugcugccgccagaacaacaagcucggccagcucaagcccuccgcccuccccuccaagcuccgccagcaguucuccugccccuuccgcgucucccagaacuccggcaccggccacgccaaccccaccuucaagcuccagaccccccagggcaagcgcaaggucaucaacacccccgagauccuccgcaagcccucccagccccccccccgccccccccccgacuaccuccgcggcggcuccccccccgccccccuccccgcccaccucucccgcgccgcccgcaacucccccggccccggcucccagaucgagcgcaccgaguccucccgccgccccccccccucccgccccaucccccccgcccccaacugcaucgucucccaggacuucucccgcccccgccccccccagaaggcccuccccgccaaccccguccccggccgccgcucccucccccgccccggcggcgccuccccccuccgcccccccggcgccggcccccagcagucccgcccccucgccgcccucgcccccaaguuccccgaguaccgcucccagcgcgccggcggcaugaucuccuccaagaucuga

SEQ ID NO: 39366 - RNA, 2331 nt, Artificial Sequence
  derived and/or modified sequence opt2 from ADAM20__Homo_sapiens__XP_005268209
augguccagcuccaccaggacaccgacccccagauccccaagggccagcccugcacccucaacuccuccgagggcggcgcccgccccgccgucccccacacccucuucuccuccgcccucgaccgcuggcuccacaacgacuccuucaucauggccgucggcgagccccucguccacauccgcgucacccuccuccuccucugguucggcauguuccucuccaucuccggccacucccaggcccgccccucccaguacuucaccucccccgaggucgucaucccccucaaggucaucucccgcggccgcggcgccaaggcccccggcuggcucuccuacucccuccgcuucggcggccagcgcuacaucguccacaugcgcgucaacaagcuccucuucgccgcccaccuccccgucuucaccuacaccgagcagcacgcccuccuccaggaccagcccuucauccaggacgacugcuacuaccacggcuacgucgagggcguccccgagucccucgucgcccucuccaccugcuccggcggcuuccucggcaugcuccagaucaacgaccucgucuacgagaucaagcccaucuccgucuccgccaccuucgagcaccucgucuacaagaucgacuccgacgacacccaguucccccccaugcgcugcggccucaccgaggagaagaucgcccaccagauggagcuccagcucuccuacaacuucacccucaagcaguccuccuucgucggcugguggacccaccagcgcuucgucgagcucgucgucgucgucgacaacauccgcuaccucuucucccaguccaacgccaccaccguccagcacgaggucuucaacgucgucaacaucgucgacuccuucuaccacccccucgaggucgacgucauccucaccggcaucgacaucuggaccgccuccaacccccuccccaccuccggcgaccucgacaacguccucgaggacuucuccaucuggaagaacuacaaccucaacaaccgccuccagcacgacgucgcccaccucuucaucaaggacacccagggcaugaagcucggcgucgccuacgucaagggcaucugccagaaccccuucaacaccggcgucgacgucuucgaggacaaccgccucgucgucuucgccaucacccucggccacgagcucggccacaaccucggcaugcagcacgacacccaguggugcgucugcgagcuccaguggugcaucaugcacgccuaccgcaaggucaccaccaaguucuccaacugcuccuacgcccaguacugggacuccaccaucuccuccggccucugcauccagcccccccccuaccccggcaacaucuuccgccucaaguacugcggcaaccucgucgucgaggagggcgaggagugcgacugcggcaccauccgccagugcgccaaggaccccugcugccuccucaacugcacccuccaccccggcgccgccugcgccuucggcaucugcugcaaggacugcaaguuccuccccuccggcacccucugccgccagcaggucggcgagugcgaccuccccgaguggugcaacggcaccucccaccagugccccgacgacgucuacguccaggacggcaucuccugcaacgucaacgccuucugcuacgagaagaccugcaacaaccacgacauccagugcaaggagaucuucggccaggacgcccgcuccgccucccaguccugcuaccaggagaucaacacccagggcaaccgcuucggccacugcggcaucgucggcaccaccuacgucaagugcuggacccccgacaucaugugcggccgcguccagugcgagaacgucggcgucauccccaaccucaucgagcacuccaccguccagcaguuccaccucaacgacaccaccugcuggggcaccgacuaccaccucggcauggccauccccgacaucggcgaggucaaggacggcaccgucugcggccccgagaagaucugcauccgcaagaagugcgccuccaugguccaccucucccaggccugccagcccaagaccugcaacaugcgcggcaucugcaacaacaagcagcacugccacugcaaccacgagugggccccccccuacugcaaggacaagggcuacggcggcuccgccgacuccggccccccccccaagaacaacauggagggccucaacgucaugggcaagcuccgcuaccucucccuccucugccuccucccccucgucgccuuccuccucuucugccuccacguccucuucaagaagcgcaccaaguccaaggaggacgaggagggcuga

SEQ ID NO: 39367 - RNA, 2169 nt, Artificial Sequence
  derived and/or modified sequence opt2 from ADAM21__Homo_sapiens__NP_003804
auggccgucgacggcacccucgucuacauccgcgucacccuccuccuccucuggcucggcgucuuccucuccaucuccggcuacugccaggccggccccucccagcacuucaccucccccgaggucgucaucccccucaaggucaucucccgcggccgcuccgccaaggcccccggcuggcucuccuacucccuccgcuucggcggccagaagcacgucguccacaugcgcgucaagaagcuccucgucucccgccaccuccccgucuucaccuacaccgacgaccgcgcccuccucgaggaccagcucuucauccccgacgacugcuacuaccacggcuacgucgaggccgcccccgagucccucgucgucuucuccgccugcuucggcggcuuccgcggcguccucaagaucuccggccucaccuacgagaucgagcccauccgccacuccgccaccuucgagcaccucgucuacaagaucaacuccaacgagacccaguuccccgccaugcgcugcggccucaccgagaaggaggucgcccgccagcagcucgaguucgaggaggccgagaacuccgcccucgagcccaaguccgccggcgacugguggacccacgccugguuccucgagcucgucgucgucgucaaccacgacuucuucaucuacucccaguccaacaucuccaagguccaggaggacgucuuccucgucgucaacaucgucgacuccauguacaagcagcucggcaccuacaucauccucaucggcaucgagaucuggaaccagggcaacgucuuccccaugaccuccaucgagcagguccucaacgacuucucccaguggaagcagaucucccucucccagcuccagcacgacgccgcccacauguucaucaagaacucccucaucuccauccucggccucgccuacgucgccggcaucugccgcccccccaucgacugcggcgucgacaacuuccagggcgacaccuggucccucuucgccaacaccgucgcccacgagcucggccacacccucggcaugcagcacgacgaggaguucugcuucugcggcgagcgcggcugcaucaugaacaccuuccgcguccccgccgagaaguucaccaacugcuccuacgccgacuucaugaagaccacccucaaccagggcuccugccuccacaaccccccccgccucggcgagaucuucaugcucaagcgcugcggcaacggcgucgucgagcgcgaggagcagugcgacugcggcuccguccagcagugcgagcaggacgccugcugccuccucaacugcacccuccgccccggcgccgccugcgccuucggccucugcugcaaggacugcaaguucaugcccuccggcgagcucugccgccaggaggucaacgagugcgaccuccccgaguggugcaacggcaccucccaccagugccccgaggaccgcuacguccaggacggcauccccugcuccgacuccgccuacugcuaccagaagcgcugcaacaaccacgaccagcacugccgcgagaucuucggcaaggacgccaaguccgccucccagaacugcuacaaggagaucaacucccagggcaaccgcuucggccacugcggcaucaacggcaccaccuaccucaagugccacaucuccgacgucuucugcggccgcguccagugcgagaacguccgcgacaucccccuccuccaggaccacuucacccuccagcacacccacaucaacggcgucaccugcuggggcaucgacuaccaccuccgcaugaacaucuccgacaucggcgaggucaaggacggcaccgucugcggccccggcaagaucugcauccacaagaagugcgucucccucuccguccucucccacgucugccuccccgagaccugcaacaugaagggcaucugcaacaacaagcaccacugccacugcggcuacggcugguccccccccuacugccagcaccgcggcuacggcggcuccaucgacuccggccccgccuccgccaagcgcggcgucuuccucccccucaucgucauccccucccucuccguccucaccuuccucuucaccgucggccuccucauguaccuccgccagugcuccggccccaaggagaccaaggcccacuccuccggcuga

SEQ ID NO: 39368 - RNA, 2613 nt, Artificial Sequence
  derived and/or modified sequence opt2 from ADAM22__Homo_sapiens__NP_057435
augcaggccgccgucgccgucuccguccccuuccuccuccucugcguccucggcaccugcccccccgcccgcugcggccaggccggcgacgccucccucauggagcucgagaagcgcaaggagaaccgcuucgucgagcgccaguccaucgucccccuccgccucaucuaccgcuccggcggcgaggacgagucccgccacgacgcccucgacacccgcguccgcggcgaccucggcggcccccagcucacccacgucgaccaggccuccuuccaggucgacgccuucggcaccuccuucauccucgacgucguccucaaccacgaccuccucuccuccgaguacaucgagcgccacaucgagcacggcggcaagaccgucgaggucaagggcggcgagcacugcuacuaccagggccacauccgcggcaaccccgacuccuucgucgcccucuccaccugccacggccuccacggcauguucuacgacggcaaccacaccuaccucaucgagcccgaggagaacgacaccacccaggaggacuuccacuuccacuccgucuacaagucccgccucuucgaguucucccucgacgaccuccccuccgaguuccagcaggucaacaucacccccuccaaguucauccucaagccccgccccaagcgcuccaagcgccagcuccgccgcuacccccgcaacgucgaggaggagaccaaguacaucgagcucaugaucgucaacgaccaccucauguucaagaagcaccgccucuccgucguccacaccaacaccuacgccaaguccgucgucaacauggccgaccucaucuacaaggaccagcucaagacccgcaucguccucgucgccauggagaccugggccaccgacaacaaguucgccaucuccgagaacccccucaucacccuccgcgaguucaugaaguaccgccgcgacuucaucaaggagaaguccgacgccguccaccucuucuccggcucccaguucgaguccucccgcuccggcgccgccuacaucggcggcaucugcucccuccucaagggcggcggcgucaacgaguucggcaagaccgaccucauggccgucacccucgcccagucccucgcccacaacaucggcaucaucuccgacaagcgcaagcucgccuccggcgagugcaagugcgaggacaccugguccggcugcaucaugggcgacaccggcuacuaccuccccaagaaguucacccagugcaacaucgaggaguaccacgacuuccucaacuccggcggcggcgccugccucuucaacaagcccuccaagcuccucgacccccccgagugcggcaacggcuucaucgagaccggcgaggagugcgacugcggcacccccgccgagugcguccucgagggcgccgagugcugcaagaagugcacccucacccaggacucccagugcuccgacggccucugcugcaagaagugcaaguuccagcccaugggcaccgucugccgcgaggccgucaacgacugcgacauccgcgagaccugcuccggcaacuccucccagugcgcccccaacauccacaagauggacggcuacuccugcgacggcguccagggcaucugcuucggcggccgcugcaagacccgcgaccgccagugcaaguacaucuggggccagaaggucaccgccuccgacaaguacugcuacgagaagcucaacaucgagggcaccgagaagggcaacugcggcaaggacaaggacaccuggauccagugcaacaagcgcgacguccucugcggcuaccuccucugcaccaacaucggcaacaucccccgccucggcgagcucgacggcgagaucaccuccacccucgucguccagcagggccgcacccucaacugcuccggcggccacgucaagcucgaggaggacgucgaccucggcuacgucgaggacggcacccccugcggcccccagaugaugugccucgagcaccgcugccuccccgucgccuccuucaacuucuccaccugccucuccuccaaggagggcaccaucugcuccggcaacggcgucugcuccaacgagcucaagugcgucugcaaccgccacuggaucggcuccgacugcaacaccuacuucccccacaacgacgacgccaagaccggcaucacccucuccggcaacggcgucgccggcaccaacaucaucaucggcaucaucgccggcaccauccucguccucgcccucauccucggcaucaccgccuggggcuacaagaacuaccgcgagcagcgcuccaacggccucucccacuccugguccgagcgcauccccgacaccaagcacaucuccgacaucugcgagaacggccgcccccgcuccaacuccuggcagggcaaccucggcggcaacaagaagaagauccgcggcaagcgcuuccgcccccgcuccaacuccaccgagacccucucccccgccaagucccccuccuccuccaccggcuccaucgccuccucccgcaaguaccccuaccccaugcccccccuccccgacgaggacaagaaggucaaccgccaguccgcccgccucugggagaccuccaucuga

SEQ ID NO: 39369 - RNA, 2499 nt, Artificial Sequence
  derived and/or modified sequence opt2 from ADAM23__Homo_sapiens__NP_003803
augaagccccccggcuccuccucccgccagcccccccucgccggcugcucccucgccggcgccuccugcggcccccagcgcggccccgccggcuccguccccgccuccgcccccgcccgcaccccccccugccgccuccuccucguccuccuccuccuccccccccucgccgccuccucccgcccccgcgccuggggcgccgccgcccccuccgccccccacuggaacgagaccgccgagaagaaccucggcguccucgccgacgaggacaacacccuccagcagaacuccuccuccaacaucuccuacuccaacgccaugcagaaggagaucacccuccccucccgccucaucuacuacaucaaccaggacuccgagucccccuaccacguccucgacaccaaggcccgccaccagcagaagcacaacaaggccguccaccucgcccaggccuccuuccagaucgaggccuucggcuccaaguucauccucgaccucauccucaacaacggccuccucuccuccgacuacgucgagauccacuacgagaacggcaagccccaguacuccaagggcggcgagcacugcuacuaccacggcuccauccgcggcgucaaggacuccaaggucgcccucuccaccugcaacggccuccacggcauguucgaggacgacaccuucgucuacaugaucgagccccucgagcucguccacgacgagaaguccaccggccgcccccacaucauccagaagacccucgccggccaguacuccaagcagaugaagaaccucaccauggagcgcggcgaccaguggcccuuccucuccgagcuccaguggcucaagcgccgcaagcgcgccgucaaccccucccgcggcaucuucgaggagaugaaguaccucgagcucaugaucgucaacgaccacaagaccuacaagaagcaccgcuccucccacgcccacaccaacaacuucgccaaguccgucgucaaccucgucgacuccaucuacaaggagcagcucaacacccgcgucguccucgucgccgucgagaccuggaccgagaaggaccagaucgacaucaccaccaaccccguccagaugcuccacgaguucuccaaguaccgccagcgcaucaagcagcacgccgacgccguccaccucaucucccgcgucaccuuccacuacaagcgcuccucccucuccuacuucggcggcgucugcucccgcacccgcggcgucggcgucaacgaguacggccuccccauggccgucgcccagguccucucccagucccucgcccagaaccucggcauccagugggagcccuccucccgcaagcccaagugcgacugcaccgaguccuggggcggcugcaucauggaggagaccggcgucucccacucccgcaaguucuccaagugcuccauccucgaguaccgcgacuuccuccagcgcggcggcggcgccugccucuucaaccgccccaccaagcucuucgagcccaccgagugcggcaacggcuacgucgaggccggcgaggagugcgacugcggcuuccacgucgagugcuacggccucugcugcaagaagugcucccucuccaacggcgcccacugcuccgacggccccugcugcaacaacaccuccugccucuuccagccccgcggcuacgagugccgcgacgccgucaacgagugcgacaucaccgaguacugcaccggcgacuccggccagugcccccccaaccuccacaagcaggacggcuacgccugcaaccagaaccagggccgcugcuacaacggcgagugcaagacccgcgacaaccagugccaguacaucuggggcaccaaggccgccggcuccgacaaguucugcuacgagaagcucaacaccgagggcaccgagaagggcaacugcggcaaggacggcgaccgcuggauccagugcuccaagcacgacgucuucugcggcuuccuccucugcaccaaccucacccgcgccccccgcaucggccagcuccagggcgagaucauccccaccuccuucuaccaccagggccgcgucaucgacugcuccggcgcccacgucguccucgacgacgacaccgacgucggcuacgucgaggacggcacccccugcggccccuccaugaugugccucgaccgcaagugccuccagauccaggcccucaacauguccuccugcccccucgacuccaagggcaaggucugcuccggccacggcgucugcuccaacgaggccaccugcaucugcgacuucaccugggccggcaccgacugcuccauccgcgaccccguccgcaaccuccacccccccaaggacgagggccccaagggccccuccgccaccaaccucaucaucggcuccaucgccggcgccauccucgucgccgccaucguccucggcggcaccggcuggggcuucaagaacgucaagaagcgccgcuucgaccccacccagcagggccccaucuga

SEQ ID NO: 39370 - RNA, 2328 nt, Artificial Sequence
  derived and/or modified sequence opt2 from ADAM28__Homo_sapiens__NP_055080
augcuccagggccuccuccccgucucccuccuccucuccgucgccgucuccgccaucaaggagcuccccggcgucaagaaguacgaggucgucuaccccauccgccuccacccccuccacaagcgcgaggccaaggagcccgagcagcaggagcaguucgagaccgagcucaaguacaagaugaccaucaacggcaagaucgccguccucuaccucaagaagaacaagaaccuccucgcccccggcuacaccgagaccuacuacaacuccaccggcaaggagaucaccaccuccccccagaucauggacgacugcuacuaccagggccacauccucaacgagaaggucuccgacgccuccaucuccaccugccgcggccuccgcggcuacuucucccagggcgaccagcgcuacuucaucgagccccucucccccauccaccgcgacggccaggagcacgcccucuucaaguacaaccccgacgagaagaacuacgacuccaccugcggcauggacggcguccucugggcccacgaccuccagcagaacaucgcccuccccgccaccaagcucgucaagcucaaggaccgcaagguccaggagcacgagaaguacaucgaguacuaccucguccucgacaacggcgaguucaagcgcuacaacgagaaccaggacgagauccgcaagcgcgucuucgagauggccaacuacgucaacaugcucuacaagaagcucaacacccacgucgcccucgucggcauggagaucuggaccgacaaggacaagaucaagaucacccccaacgccuccuucacccucgagaacuucuccaaguggcgcggcuccguccucucccgccgcaagcgccacgacaucgcccagcucaucaccgccaccgagcucgccggcaccaccgucggccucgccuucauguccaccaugugcucccccuacuccgucggcgucguccaggaccacuccgacaaccuccuccgcgucgccggcaccauggcccacgagaugggccacaacuucggcauguuccacgacgacuacuccugcaagugccccuccaccaucugcgucauggacaaggcccucuccuucuacauccccaccgacuucuccuccugcucccgccucuccuacgacaaguucuucgaggacaagcucuccaacugccucuucaacgccccccuccccaccgacaucaucuccacccccaucugcggcaaccagcucgucgagaugggcgaggacugcgacugcggcaccuccgaggagugcaccaacaucugcugcgacgccaagaccugcaagaucaaggccaccuuccagugcgcccucggcgagugcugcgagaagugccaguucaagaaggccggcauggucugccgccccgccaaggacgagugcgaccuccccgagaugugcaacggcaaguccggcaacugccccgacgaccgcuuccaggucaacggcuuccccugccaccacggcaagggccacugccucaugggcaccugccccacccuccaggagcagugcaccgagcucuggggccccggcaccgaggucgccgacaaguccugcuacaaccgcaacgagggcggcuccaaguacggcuacugccgccgcgucgacgacacccucauccccugcaaggccaacgacaccaugugcggcaagcucuucugccagggcggcuccgacaaccuccccuggaagggccgcaucgucaccuuccucaccugcaagaccuucgaccccgaggacaccucccaggagaucggcauggucgccaacggcaccaagugcggcgacaacaaggucugcaucaacgccgagugcgucgacaucgagaaggccuacaaguccaccaacugcuccuccaagugcaagggccacgccgucugcgaccacgagcuccagugccagugcgaggagggcuggaucccccccgacugcgacgacuccuccgucgucuuccacuucuccaucgucgucggcguccucuuccccauggccgucaucuucgucgucgucgccauggucauccgccaccaguccucccgcgagaagcagaagaaggaccagcgcccccucuccaccaccggcacccgcccccacaagcagaagcgcaagccccagauggucaaggccguccagccccaggagaugucccagaugaagccccacgucuacgaccuccccgucgagggcaacgagccccccgccuccuuccacaaggacaccaacgcccucccccccaccgucuucaaggacaaccccgucuccacccccaaggacuccaaccccaaggccuga

SEQ ID NO: 39371 - RNA, 2463 nt, Artificial Sequence
  derived and/or modified sequence opt2 from ADAM29__Homo_sapiens__NP_001265056
augaagaugcuccuccuccuccacugccucggcgucuuccucuccugcuccggccacauccaggacgagcacccccaguaccacuccccccccgacgucgucauccccguccgcaucaccggcaccacccgcggcaugaccccccccggcuggcucuccuacauccuccccuucggcggccagaagcacaucauccacaucaaggucaagaagcuccucuucuccaagcaccuccccgucuucaccuacaccgaccagggcgccauccucgaggaccagcccuucguccagaacaacugcuacuaccacggcuacgucgagggcgaccccgagucccucgucucccucuccaccugcuucggcggcuuccagggcauccuccagaucaacgacuucgccuacgagaucaagccccucgccuucuccaccaccuucgagcaccucgucuacaagauggacuccgaggagaagcaguucuccaccaugcgcuccggcuucaugcagaacgagaucaccugccgcauggaguucgaggagaucgacaacuccacccagaagcaguccuccuacgucggcugguggauccacuuccgcaucgucgagaucgucgucgucaucgacaacuaccucuacauccgcuacgagcgcaacgacuccaagcuccucgaggaccucuacgucaucgucaacaucgucgacuccauccucgacgucaucggcgucaagguccuccucuucggccucgagaucuggaccaacaagaaccucaucgucgucgacgacguccgcaaguccguccaccucuacugcaaguggaaguccgagaacaucaccccccgcaugcagcacgacaccucccaccucuucaccacccucggccuccgcggccucuccggcaucggcgccuuccgcggcaugugcaccccccaccgcuccugcgccaucgucaccuucaugaacaagacccucggcaccuucuccaucgccgucgcccaccaccucggccacaaccucggcaugaaccacgacgaggacaccugccgcugcucccagccccgcugcaucaugcacgagggcaacccccccaucaccaaguucuccaacugcuccuacggcgacuucugggaguacaccgucgagcgcaccaagugccuccucgagaccguccacaccaaggacaucuucaacgucaagcgcugcggcaacggcgucgucgaggagggcgaggagugcgacugcggcccccucaagcacugcgccaaggaccccugcugccucuccaacugcacccucaccgacggcuccaccugcgccuucggccucugcugcaaggacugcaaguuccuccccuccggcaaggucugccgcaaggaggucaacgagugcgaccuccccgaguggugcaacggcaccucccacaagugccccgacgacuucuacgucgaggacggcauccccugcaaggagcgcggcuacugcuacgagaaguccugccacgaccgcaacgagcagugccgccgcaucuucggcgccggcgccaacaccgccuccgagaccugcuacaaggagcucaacacccucggcgaccgcgucggccacugcggcaucaagaacgccaccuacaucaagugcaacaucuccgacguccagugcggccgcauccagugcgagaacgucaccgagauccccaacauguccgaccacaccaccguccacugggcccgcuucaacgacaucaugugcugguccaccgacuaccaccucggcaugaagggccccgacaucggcgaggucaaggacggcaccgagugcggcaucgaccacaucugcauccaccgccacugcguccacaucaccauccucaacuccaacugcucccccgccuucugcaacaagcgcggcaucugcaacaacaagcaccacugccacugcaacuaccucugggacccccccaacugccucaucaagggcuacggcggcuccgucgacuccggccccccccccaagcgcaagaagaagaagaaguucugcuaccucugcauccuccuccucaucguccucuucauccuccucugcugccucuaccgccucugcaagaaguccaagcccaucaagaagcagcaggacguccagacccccuccgccaaggaggaggagaagauccagcgccgcccccacgagcuccccccccagucccagcccugggucaugcccucccagucccagccccccgucacccccucccagucccacccccaggucaugcccucccagucccagccccccgucacccccucccagucccagccccgcgucaugcccucccagucccagccccccgucaugcccucccagucccacccccagcucacccccucccagucccagccccccgucacccccucccagcgccagccccagcucaugcccucccagucccagccccccgucacccccuccuga

SEQ ID NO: 39372 - RNA, 2151 nt, Artificial Sequence
  derived and/or modified sequence opt2 from ADAM2__Homo_sapiens__NP_001265042
auguggcgcguccucuuccuccucuccggccucggcggccuccgcauggacuccaacuucgacucccuccccguccagaucaccguccccgagaagauccgcuccaucaucaaggagggcaucgagucccaggccuccuacaagaucgucaucgagggcaagcccuacaccgucaaccucaugcagaagaacuuccucccccacaacuuccgcgucuacuccuacuccggcaccggcaucaugaagccccucgaccaggacuuccagaacuucugccacuaccagggcuacaucgagggcuaccccaaguccgucgucauggucuccaccugcaccggccuccgcggcguccuccaguucgagaacgucuccuacggcaucgagccccucgaguccuccgucggcuucgagcacgucaucuaccaggucaagcacaagaaggccgacgucucccucuacaacgagaaggacaucgagucccgcgaccucuccuucaagcuccaguccgucgaguacaaccacaugggcuccgacaccaccgucgucgcccagaaggucuuccagcucaucggccucaccaacgccaucuucgucuccuucaacaucaccaucauccucuccucccucgagcucuggaucgacgagaacaagaucgccaccaccggcgaggccaacgagcuccuccacaccuuccuccgcuggaagaccuccuaccucguccuccgcccccacgacgucgccuuccuccucgucuaccgcgagaaguccaacuacgucggcgccaccuuccagggcaagaugugcgacgccaacuacgccggcggcgucguccuccacccccgcaccaucucccucgagucccucgccgucauccucgcccagcuccucucccucuccaugggcaucaccuacgacgacaucaacaagugccagugcuccggcgccgucugcaucaugaaccccgaggccauccacuucuccggcgucaagaucuucuccaacugcuccuucgaggacuucgcccacuucaucuccaagcagaagucccagugccuccacaaccagccccgccucgaccccuucuucaagcagcaggccgucugcggcaacgccaagcucgaggccggcgaggagugcgacugcggcaccgagcaggacugcgcccucaucggcgagaccugcugcgacaucgccaccugccgcuucaaggccggcuccaacugcgccgagggccccugcugcgagaacugccucuucauguccaaggagcgcaugugccgccccuccuucgaggagugcgaccuccccgaguacugcaacggcuccuccgccuccugccccgagaaccacuacguccagaccggccaccccugcggccucaaccaguggaucugcaucgacggcgucugcauguccggcgacaagcagugcaccgacaccuucggcaaggaggucgaguucggccccuccgagugcuacucccaccucaacuccaagaccgacgucuccggcaacugcggcaucuccgacuccggcuacacccagugcgaggccgacaaccuccagugcggcaagcucaucugcaaguacgucggcaaguuccuccuccagaucccccgcgccaccaucaucuacgccaacaucuccggccaccucugcaucgccgucgaguucgccuccgaccacgccgacucccagaagauguggaucaaggacggcaccuccugcggcuccaacaaggucugccgcaaccagcgcugcgucuccuccuccuaccucggcuacgacugcaccaccgacaagugcaacgaccgcggcgucugcaacaacaagaagcacugccacugcuccgccuccuaccucccccccgacugcuccguccaguccgaccucuggcccggcggcuccaucgacuccggcaacuucccccccgucgccauccccgcccgccuccccgagcgccgcuacaucgagaacaucuaccacuccaagcccaugcgcuggcccuucuuccucuucauccccuucuucaucaucuucugcguccucaucgccaucauggucaaggucaacuuccagcgcaagaaguggcgcaccgaggacuacuccuccgacgagcagcccgaguccgaguccgagcccaagggcuga

SEQ ID NO: 39373 - RNA, 2439 nt, Artificial Sequence
  derived and/or modified sequence opt2 from ADAM33__Homo_sapiens__NP_001269376
augggcuggcgcccccgccgcgcccgcggcaccccccuccuccuccuccuccuccuccuccuccucuggcccguccccggcgccggcguccuccagggccacauccccggccagcccgucaccccccacuggguccucgacggccagcccuggcgcaccgucucccucgaggagcccgucuccaagcccgacaugggccucgucgcccucgaggccgagggccaggagcuccuccucgagcucgagaagaaccaccgccuccucgcccccggcuacaucgagacccacuacggccccgacggccagcccgucguccucgcccccaaccacaccgaccacugccacuaccagggccgcguccgcggcuuccccgacuccugggucguccucugcaccugcuccggcauguccggccucaucacccucucccgcaacgccuccuacuaccuccgccccuggcccccccgcggcuccaaggacuucuccacccacgagaucuuccgcauggagcagcuccucaccuggaagggcaccugcggccaccgcgaccccggcaacaaggccggcaugaccucccuccccggcggcccccagucccgcggccgccgcgaggcccgccgcacccgcaaguaccucgagcucuacaucgucgccgaccacacccucuuccucacccgccaccgcaaccucaaccacaccaagcagcgccuccucgaggucgccaacuacgucgaccagcuccuccgcacccucgacauccaggucgcccucaccggccucgaggucuggaccgagcgcgaccgcucccgcgucacccaggacgccaacgccacccucugggccuuccuccaguggcgccgcggccucugggcccagcgcccccacgacuccgcccagcuccucaccggccgcgccuuccagggcgccaccgucggccucgcccccgucgagggcaugugccgcgccgaguccuccggcggcgucuccaccgaccacuccgagcuccccaucggcgccgccgccaccauggcccacgagaucggccacucccucggccucucccacgaccccgacggcugcugcgucgaggccgccgccgaguccggcggcugcgucauggccgccgccaccggccaccccuucccccgcgucuucuccgccugcucccgccgccagcuccgcgccuucuuccgcaagggcggcggcgccugccucuccaacgcccccgaccccggccuccccgucccccccgcccucugcggcaacggcuucgucgaggccggcgaggagugcgacugcggccccggccaggagugccgcgaccucugcugcuucgcccacaacugcucccuccgccccggcgcccagugcgcccacggcgacugcugcguccgcugccuccucaagcccgccggcgcccucugccgccaggccaugggcgacugcgaccuccccgaguucugcaccggcaccuccucccacugcccccccgacgucuaccuccucgacggcucccccugcgcccgcggcuccggcuacugcugggacggcgccugccccacccucgagcagcagugccagcagcucuggggccccggcucccaccccgcccccgaggccugcuuccaggucgucaacuccgccggcgacgcccacggcaacugcggccaggacuccgagggccacuuccuccccugcgccggccgcgacgcccucugcggcaagcuccagugccagggcggcaagcccucccuccucgccccccacaugguccccgucgacuccaccguccaccucgacggccaggaggucaccugccgcggcgcccucgcccuccccuccgcccagcucgaccuccucggccucggccucgucgagcccggcacccagugcggcccccgcauggucugccagucccgccgcugccgcaagaacgccuuccaggagcuccagcgcugccucaccgccugccacucccacggcgucugcaacuccaaccacaacugccacugcgcccccggcugggccccccccuucugcgacaagcccggcuucggcggcuccauggacuccggccccguccaggccgagaaccacgacaccuuccuccucgccaugcuccucuccguccuccucccccuccuccccggcgccggccucgccuggugcugcuaccgccuccccggcgcccaccuccagcgcugcuccuggggcugccgccgcgaccccgccugcuccggccccaaggacggcccccaccgcgaccacccccucggcggcguccaccccauggagcucggccccaccgccaccggccagcccuggccccucgaccccgagaacucccacgagcccuccucccaccccgagaagccccuccccgccgucucccccgacccccaggaccagguccagaugccccgcuccugccucugguga

SEQ ID NO: 39374 - RNA, 2265 nt, Artificial Sequence
  derived and/or modified sequence opt2 from ADAM7__Homo_sapiens__NP_003808
augcuccccggcugcaucuuccucaugauccuccucaucccccaggucaaggagaaguucauccucggcgucgagggccagcagcucguccgccccaagaagcucccccucauccagaagcgcgacaccggccacacccacgacgacgacauccucaagaccuacgaggaggagcuccucuacgagaucaagcucaaccgcaagacccucguccuccaccuccuccgcucccgcgaguuccucggcuccaacuacuccgagaccuucuacuccaugaagggcgaggccuucacccgccacccccagaucauggaccacugcuucuaccagggcuccaucguccacgaguacgacuccgccgccuccaucuccaccugcaacggccuccgcggcuucuuccgcaucaacgaccagcgcuaccucaucgagcccgucaaguacuccgacgagggcgagcaccucgucuucaaguacaaccuccgcguccccuacggcgccaacuacuccugcaccgagcucaacuucacccgcaagaccguccccggcgacaacgaguccgaggaggacuccaagaucaagggcauccacgacgagaaguacgucgagcucuucaucgucgccgacgacaccgucuaccgccgcaacggccacccccacaacaagcuccgcaaccgcaucuggggcauggucaacuucgucaacaugaucuacaagacccucaacauccacgucacccucgucggcaucgagaucuggacccacgaggacaagaucgagcucuacuccaacaucgagaccacccuccuccgcuucuccuucuggcaggagaagauccucaagacccgcaaggacuucgaccacgucguccuccucuccggcaaguggcucuacucccacguccagggcaucuccuaccccggcggcaugugccuccccuacuacuccaccuccaucaucaaggaccuccuccccgacaccaacaucaucgccaaccgcauggcccaccagcucggccacaaccucggcaugcagcacgacgaguuccccugcaccugccccuccggcaagugcgucauggacuccgacggcuccauccccgcccucaaguucuccaagugcucccagaaccaguaccaccaguaccucaaggacuacaagcccaccugcaugcucaacauccccuuccccuacaacuuccacgacuuccaguucugcggcaacaagaagcucgacgagggcgaggagugcgacugcggccccgcccaggagugcaccaaccccugcugcgacgcccacaccugcguccucaagcccggcuucaccugcgccgagggcgagugcugcgaguccugccagaucaagaaggccggcuccaucugccgccccgccaaggacgagugcgacuuccccgagaugugcaccggccacucccccgccugccccaaggaccaguuccgcgucaacggcuuccccugcaagaacuccgagggcuacugcuucaugggcaagugccccacccgcgaggaccagugcuccgagcucuucgacgacgaggccaucgagucccacgacaucugcuacaagaugaacaccaagggcaacaaguucggcuacugcaagaacaaggagaaccgcuuccuccccugcgaggagaaggacguccgcugcggcaagaucuacugcaccggcggcgagcucuccucccuccucggcgaggacaagaccuaccaccucaaggacccccagaagaacgccaccgucaagugcaagaccaucuuccucuaccacgacuccaccgacaucggccucgucgccuccggcaccaagugcggcgagggcauggucugcaacaacggcgagugccucaacauggagaaggucuacaucuccaccaacugccccucccagugcaacgagaaccccgucgacggccacggccuccagugccacugcgaggagggccaggcccccgucgccugcgaggagacccuccacgucaccaacaucaccauccucgucgucguccucguccucgucaucgucggcaucggcguccucauccuccucguccgcuaccgcaagugcaucaagcucaagcagguccaguccccccccaccgagacccucggcgucgagaacaagggcuacuucggcgacgagcagcagauccgcaccgagcccauccuccccgagauccacuuccucaacaagcccgccuccaaggacucccgcggcaucgccgaccccaaccaguccgccaaguga

SEQ ID NO: 39375 - RNA, 2475 nt, Artificial Sequence
  derived and/or modified sequence opt2 from ADAM8__Homo_sapiens__NP_001100
augcgcggccucggccucuggcuccucggcgccaugaugcuccccgccaucgcccccucccgccccugggcccucauggagcaguacgaggucguccuccccuggcgccuccccggcccccgcguccgccgcgcccuccccucccaccucggccuccaccccgagcgcgucuccuacguccucggcgccaccggccacaacuucacccuccaccuccgcaagaaccgcgaccuccucggcuccggcuacaccgagaccuacaccgccgccaacggcuccgaggucaccgagcagccccgcggccaggaccacugcuucuaccagggccacgucgagggcuaccccgacuccgccgccucccucuccaccugcgccggccuccgcggcuucuuccaggucggcuccgaccuccaccucaucgagccccucgacgagggcggcgagggcggccgccacgccgucuaccaggccgagcaccuccuccagaccgccggcaccugcggcgucuccgacgacucccucggcucccuccucggcccccgcaccgccgccgucuuccgcccccgccccggcgacucccuccccucccgcgagacccgcuacgucgagcucuacgucgucgucgacaacgccgaguuccagaugcucggcuccgaggccgccguccgccaccgcguccucgaggucgucaaccacgucgacaagcucuaccagaagcucaacuuccgcgucguccucgucggccucgagaucuggaacucccaggaccgcuuccacgucucccccgaccccuccgucacccucgagaaccuccucaccuggcaggcccgccagcgcacccgccgccaccuccacgacaacguccagcucaucaccggcgucgacuucaccggcaccaccgucggcuucgcccgcgucuccgccaugugcucccacuccuccggcgccgucaaccaggaccacuccaagaaccccgucggcgucgccugcaccauggcccacgagaugggccacaaccucggcauggaccacgacgagaacguccagggcugccgcugccaggagcgcuucgaggccggccgcugcaucauggccggcuccaucggcuccuccuucccccgcauguucuccgacugcucccaggccuaccucgaguccuuccucgagcgcccccaguccgucugccucgccaacgcccccgaccucucccaccucgucggcggccccgucugcggcaaccucuucgucgagcgcggcgagcagugcgacugcggcccccccgaggacugccgcaaccgcugcugcaacuccaccaccugccagcucgccgagggcgcccagugcgcccacggcaccugcugccaggagugcaaggucaagcccgccggcgagcucugccgccccaagaaggacaugugcgaccucgaggaguucugcgacggccgccaccccgagugccccgaggacgccuuccaggagaacggcacccccugcuccggcggcuacugcuacaacggcgccugccccacccucgcccagcagugccaggccuucuggggccccggcggccaggccgccgaggaguccugcuucuccuacgacauccuccccggcugcaaggccucccgcuaccgcgccgacaugugcggcguccuccagugcaagggcggccagcagccccucggccgcgccaucugcaucgucgacgucugccacgcccucaccaccgaggacggcaccgccuacgagcccguccccgagggcacccgcugcggccccgagaaggucugcuggaagggccgcugccaggaccuccacgucuaccgcuccuccaacugcuccgcccagugccacaaccacggcgucugcaaccacaagcaggagugccacugccacgccggcugggcccccccccacugcgccaagcuccucaccgagguccacgccgccuccggcucccuccccgucuucgucgucgucguccucguccuccucgccgucguccucgucacccucgccggcaucaucgucuaccgcaaggcccgcucccgcauccucucccgcaacgucgcccccaagaccaccaugggccgcuccaacccccucuuccaccaggccgccucccgcguccccgccaagggcggcgcccccgcccccucccgcggcccccaggagcucguccccaccacccaccccggccagcccgcccgccaccccgccuccuccgucgcccucaagcgccccccccccgccccccccgucaccgucuccuccccccccuuccccguccccgucuacacccgccaggcccccaagcaggucaucaagcccaccuucgccccccccgucccccccgucaagcccggcgccggcgccgccaaccccggccccgccgagggcgccgucggccccaaggucgcccucaagccccccauccagcgcaagcagggcgccggcgcccccaccgcccccuga

SEQ ID NO: 39376 - RNA, 2460 nt, Artificial Sequence
  derived and/or modified sequence opt2 from ADAM9__Homo_sapiens__NP_003807
augggcuccggcgcccgcuuccccuccggcacccuccgcguccgcuggcuccuccuccucggccucgucggccccguccucggcgccgcccgccccggcuuccagcagaccucccaccucuccuccuacgagaucaucacccccuggcgccucacccgcgagcgccgcgaggccccccgccccuacuccaagcaggucuccuacgucauccaggccgagggcaaggagcacaucauccaccucgagcgcaacaaggaccuccuccccgaggacuucgucgucuacaccuacaacaaggagggcacccucaucaccgaccaccccaacauccagaaccacugccacuaccgcggcuacgucgagggcguccacaacuccuccaucgcccucuccgacugcuucggccuccgcggccuccuccaccucgagaacgccuccuacggcaucgagccccuccagaacuccucccacuucgagcacaucaucuaccgcauggacgacgucuacaaggagccccucaagugcggcgucuccaacaaggacaucgagaaggagaccgccaaggacgaggaggaggagccccccuccaugacccagcuccuccgccgccgccgcgccguccucccccagacccgcuacgucgagcucuucaucgucgucgacaaggagcgcuacgacaugaugggccgcaaccagaccgccguccgcgaggagaugauccuccucgccaacuaccucgacuccauguacaucaugcucaacauccgcaucguccucgucggccucgagaucuggaccaacggcaaccucaucaacaucgucggcggcgccggcgacguccucggcaacuucguccaguggcgcgagaaguuccucaucacccgccgccgccacgacuccgcccagcucguccucaagaagggcuucggcggcaccgccggcauggccuucgucggcaccgucugcucccgcucccacgccggcggcaucaacgucuucggccagaucaccgucgagaccuucgccuccaucgucgcccacgagcucggccacaaccucggcaugaaccacgacgacggccgcgacugcuccugcggcgccaaguccugcaucaugaacuccggcgccuccggcucccgcaacuucuccuccugcuccgccgaggacuucgagaagcucacccucaacaagggcggcaacugccuccucaacauccccaagcccgacgaggccuacuccgcccccuccugcggcaacaagcucgucgacgccggcgaggagugcgacugcggcacccccaaggagugcgagcucgaccccugcugcgagggcuccaccugcaagcucaaguccuucgccgagugcgccuacggcgacugcugcaaggacugccgcuuccuccccggcggcacccucugccgcggcaagaccuccgagugcgacguccccgaguacugcaacggcuccucccaguucugccagcccgacgucuucauccagaacggcuaccccugccagaacaacaaggccuacugcuacaacggcaugugccaguacuacgacgcccagugccaggucaucuucggcuccaaggccaaggccgcccccaaggacugcuucaucgaggucaacuccaagggcgaccgcuucggcaacugcggcuucuccggcaacgaguacaagaagugcgccaccggcaacgcccucugcggcaagcuccagugcgagaacguccaggagauccccgucuucggcaucguccccgccaucauccagacccccucccgcggcaccaagugcuggggcgucgacuuccagcucggcuccgacguccccgaccccggcauggucaacgagggcaccaagugcggcgccggcaagaucugccgcaacuuccagugcgucgacgccuccguccucaacuacgacugcgacguccagaagaagugccacggccacggcgucugcaacuccaacaagaacugccacugcgagaacggcugggccccccccaacugcgagaccaagggcuacggcggcuccgucgacuccggccccaccuacaacgagaugaacaccgcccuccgcgacggccuccucgucuucuucuuccucaucgucccccucaucgucugcgccaucuucaucuucaucaagcgcgaccagcucuggcgcuccuacuuccgcaagaagcgcucccagaccuacgaguccgacggcaagaaccaggccaaccccucccgccagcccggcuccgucccccgccacgucucccccgucacccccccccgcgagguccccaucuacgccaaccgcuucgccguccccaccuacgccgccaagcagccccagcaguuccccucccgccccccccccccccagcccaaggucuccucccagggcaaccucauccccgcccgccccgcccccgcccccccccucuacuccucccucaccuga

SEQ ID NO: 39377 - RNA, 1176 nt, Artificial Sequence
  derived and/or modified sequence opt2 from ADAMDEC1__Homo_sapiens__NP_001138743
augauccucaacggcgaggagaucauccucucccuccagaagaccaagcaccuccucggccccgacuacaccgagacccucuacuccccccgcggcgaggagaucaccaccaagcccgagaacauggagcacugcuacuacaagggcaacauccucaacgagaagaacuccgucgccuccaucuccaccugcgacggccuccgcggcuacuucacccaccaccaccagcgcuaccagaucaagccccucaaguccaccgacgagaaggagcacgccgucuucaccuccaaccaggaggagcaggaccccgccaaccacaccugcggcgucaaguccaccgacggcaagcagggccccauccgcaucucccgcucccucaagucccccgagaaggaggacuuccuccgcgcccagaaguacaucgaccucuaccucguccucgacaacgccuucuacaagaacuacaacgagaaccucacccucauccgcuccuucgucuucgacgucaugaaccuccucaacgucaucuacaacaccaucgacguccaggucgcccucgucggcauggagaucugguccgacggcgacaagaucaaggucguccccuccgccuccaccaccuucgacaacuuccuccgcuggcacuccuccaaccucggcaagaagauccacgaccacgcccagcuccucuccggcaucuccuucaacaaccgccgcgucggccucgccgccuccaacucccucugcucccccuccuccgucgccgucaucgaggccaagaagaagaacaacgucgcccucgucggcgucaugucccacgagcucggccacguccucggcaugcccgacguccccuucaacaccaagugccccuccggcuccugcgucaugaaccaguaccucuccuccaaguuccccaaggacuucuccaccuccugccgcgcccacuucgagcgcuaccuccucucccagaagcccaagugccuccuccaggcccccauccccaccaacaucaugaccacccccgucugcggcaaccaccuccucgaggucggcgaggacugcgacugcggcucccccaaggagugcaccaaccucugcugcgaggcccucaccugcaagcucaagcccggcaccgacugcggcggcgacgcccccaaccacaccaccgaguga

SEQ ID NO: 39378 - RNA, 3312 nt, Artificial Sequence
  derived and/or modified sequence opt2 from ADAMTS10__Homo_sapiens__NP_112219
auggcccccgccugccagauccuccgcugggcccucgcccucggccucggccucauguucgaggucacccacgccuuccgcucccaggacgaguuccucuccucccucgaguccuacgagaucgccuuccccacccgcgucgaccacaacggcgcccuccucgccuucucccccccccccccccgccgccagcgccgcggcaccggcgccaccgccgagucccgccucuucuacaaggucgccucccccuccacccacuuccuccucaaccucacccgcuccucccgccuccucgccggccacgucuccgucgaguacuggacccgcgagggccucgccuggcagcgcgccgcccgcccccacugccucuacgccggccaccuccagggccaggccuccuccucccacgucgccaucuccaccugcggcggccuccacggccucaucgucgccgacgaggaggaguaccucaucgagccccuccacggcggccccaagggcucccgcucccccgaggaguccggcccccacgucgucuacaagcgcuccucccuccgccacccccaccucgacaccgccugcggcguccgcgacgagaagcccuggaagggccgccccugguggcuccgcacccucaagcccccccccgcccgcccccucggcaacgagaccgagcgcggccagcccggccucaagcgcuccgucucccgcgagcgcuacgucgagacccucgucgucgccgacaagaugauggucgccuaccacggccgccgcgacgucgagcaguacguccucgccaucaugaacaucgucgccaagcucuuccaggacuccucccucggcuccaccgucaacauccucgucacccgccucauccuccucaccgaggaccagcccacccucgagaucacccaccacgccggcaagucccucgacuccuucugcaaguggcagaaguccaucgucaaccacuccggccacggcaacgccauccccgagaacggcgucgccaaccacgacaccgccguccucaucacccgcuacgacaucugcaucuacaagaacaagcccugcggcacccucggccucgcccccgucggcggcaugugcgagcgcgagcgcuccugcuccgucaacgaggacaucggccucgccaccgccuucaccaucgcccacgagaucggccacaccuucggcaugaaccacgacggcgucggcaacuccugcggcgcccgcggccaggaccccgccaagcucauggccgcccacaucaccaugaagaccaaccccuucgucugguccuccugcucccgcgacuacaucaccuccuuccucgacuccggccucggccucugccucaacaaccgccccccccgccaggacuucgucuaccccaccgucgcccccggccaggccuacgacgccgacgagcagugccgcuuccagcacggcgucaagucccgccagugcaaguacggcgaggucugcuccgagcucuggugccucuccaaguccaaccgcugcaucaccaacuccauccccgccgccgagggcacccucugccagacccacaccaucgacaagggcuggugcuacaagcgcgucugcguccccuucggcucccgccccgagggcgucgacggcgccuggggccccuggacccccuggggcgacugcucccgcaccugcggcggcggcgucuccuccuccucccgccacugcgacuccccccgccccaccaucggcggcaaguacugccucggcgagcgccgccgccaccgcuccugcaacaccgacgacugcccccccggcucccaggacuuccgcgagguccagugcuccgaguucgacuccauccccuuccgcggcaaguucuacaaguggaagaccuaccgcggcggcggcgucaaggccugcucccucaccugccucgccgagggcuucaacuucuacaccgagcgcgccgccgccgucgucgacggcacccccugccgccccgacaccgucgacaucugcgucuccggcgagugcaagcacgucggcugcgaccgcguccucggcuccgaccuccgcgaggacaagugccgcgucugcggcggcgacggcuccgccugcgagaccaucgagggcgucuucucccccgccucccccggcgccggcuacgaggacgucgucuggauccccaagggcuccguccacaucuucauccaggaccucaaccucucccucucccaccucgcccucaagggcgaccaggagucccuccuccucgagggccuccccggcaccccccagccccaccgccucccccucgccggcaccaccuuccagcuccgccagggccccgaccagguccagucccucgaggcccucggccccaucaacgccucccucaucgucaugguccucgcccgcaccgagcuccccgcccuccgcuaccgcuucaacgcccccaucgcccgcgacucccucccccccuacuccuggcacuacgcccccuggaccaagugcuccgcccagugcgccggcggcucccagguccaggccgucgagugccgcaaccagcucgacuccuccgccgucgccccccacuacugcuccgcccacuccaagcuccccaagcgccagcgcgccugcaacaccgagcccugcccccccgacugggucgucggcaacuggucccucugcucccgcuccugcgacgccggcguccgcucccgcuccgucgucugccagcgccgcgucuccgccgccgaggagaaggcccucgacgacuccgccugcccccagccccgcccccccguccucgaggccugccacggccccaccugcccccccgagugggccgcccucgacugguccgagugcacccccuccugcggccccggccuccgccaccgcgucguccucugcaaguccgccgaccaccgcgccacccucccccccgcccacugcucccccgccgccaagccccccgccaccaugcgcugcaaccuccgccgcugcccccccgcccgcugggucgccggcgaguggggcgagugcuccgcccagugcggcgucggccagcgccagcgcuccguccgcugcaccucccacaccggccaggccucccacgagugcaccgaggcccuccgcccccccaccacccagcagugcgaggccaagugcgacucccccacccccggcgacggccccgaggagugcaaggacgucaacaaggucgccuacugcccccucguccucaaguuccaguucugcucccgcgccuacuuccgccagaugugcugcaagaccugccacggccacuga

SEQ ID NO: 39379 - RNA, 4785 nt, Artificial Sequence
  derived and/or modified sequence opt2 from ADAMTS12__Homo_sapiens__NP_112217
augcccugcgcccagcgcuccuggcucgccaaccucuccgucgucgcccagcuccucaacuucggcgcccucugcuacggccgccagccccagcccggccccguccgcuuccccgaccgccgccaggagcacuucaucaagggccuccccgaguaccacgucgucggccccguccgcgucgacgccuccggccacuuccucuccuacggccuccacuaccccaucaccuccucccgccgcaagcgcgaccucgacggcuccgaggacugggucuacuaccgcaucucccacgaggagaaggaccucuucuucaaccucaccgucaaccagggcuuccucuccaacuccuacaucauggagaagcgcuacggcaaccucucccacgucaagaugauggccuccuccgccccccucugccaccucuccggcaccguccuccagcagggcacccgcgucggcaccgccgcccucuccgccugccacggccucaccggcuucuuccagcucccccacggcgacuucuucaucgagcccgucaagaagcacccccucgucgagggcggcuaccacccccacaucgucuaccgccgccagaagguccccgagaccaaggagcccaccugcggccucaaggacuccgucaacaucucccagaagcaggagcucuggcgcgagaagugggagcgccacaaccuccccucccgcucccucucccgccgcuccaucuccaaggagcgcugggucgagacccucgucgucgccgacaccaagaugaucgaguaccacggcuccgagaacgucgaguccuacauccucaccaucaugaacauggucaccggccucuuccacaaccccuccaucggcaacgccauccacaucgucgucguccgccucauccuccucgaggaggaggagcagggccucaagaucguccaccacgccgagaagacccucuccuccuucugcaaguggcagaaguccaucaaccccaaguccgaccucaaccccguccaccacgacgucgccguccuccucacccgcaaggacaucugcgccggcuucaaccgccccugcgagacccucggccucucccaccucuccggcaugugccagccccaccgcuccugcaacaucaacgaggacuccggccucccccucgccuucaccaucgcccacgagcucggccacuccuucggcauccagcacgacggcaaggagaacgacugcgagcccgucggccgccaccccuacaucaugucccgccagcuccaguacgaccccaccccccucaccugguccaagugcuccgaggaguacaucacccgcuuccucgaccgcggcuggggcuucugccucgacgacauccccaagaagaagggccucaaguccaaggucaucgcccccggcgucaucuacgacguccaccaccagugccagcuccaguacggccccaacgccaccuucugccaggaggucgagaacgucugccagacccucuggugcuccgucaagggcuucugccgcuccaagcucgacgccgccgccgacggcacccagugcggcgagaagaaguggugcauggccggcaagugcaucaccgucggcaagaagcccgaguccauccccggcggcuggggccgcuggucccccuggucccacugcucccgcaccugcggcgccggcguccaguccgccgagcgccucugcaacaaccccgagcccaaguucggcggcaaguacugcaccggcgagcgcaagcgcuaccgccucugcaacguccaccccugccgcuccgaggcccccaccuuccgccagaugcagugcuccgaguucgacaccguccccuacaagaacgagcucuaccacugguuccccaucuucaaccccgcccaccccugcgagcucuacugccgccccaucgacggccaguucuccgagaagaugcucgacgccgucaucgacggcacccccugcuucgagggcggcaacucccgcaacgucugcaucaacggcaucugcaagauggucggcugcgacuacgagaucgacuccaacgccaccgaggaccgcugcggcgucugccucggcgacggcuccuccugccagaccguccgcaagauguucaagcagaaggagggcuccggcuacgucgacaucggccucauccccaagggcgcccgcgacauccgcgucauggagaucgagggcgccggcaacuuccucgccauccgcuccgaggaccccgagaaguacuaccucaacggcggcuucaucauccaguggaacggcaacuacaagcucgccggcaccgucuuccaguacgaccgcaagggcgaccucgagaagcucauggccaccggccccaccaacgaguccgucuggauccagcuccucuuccaggucaccaaccccggcaucaaguacgaguacaccauccagaaggacggccucgacaacgacgucgagcagcagauguacuucuggcaguacggccacuggaccgagugcuccgucaccugcggcaccggcauccgccgccagaccgcccacugcaucaagaagggccgcggcauggucaaggccaccuucugcgaccccgagacccagcccaacggccgccagaagaagugccacgagaaggccugccccccccgcuggugggccggcgagugggaggccugcuccgccaccugcggcccccacggcgagaagaagcgcaccguccucugcauccagaccauggucuccgacgagcaggcccucccccccaccgacugccagcaccuccucaagcccaagacccuccucuccugcaaccgcgacauccucugccccuccgacuggaccgucggcaacugguccgagugcuccgucuccugcggcggcggcguccgcauccgcuccgucaccugcgccaagaaccacgacgagcccugcgacgucacccgcaagcccaacucccgcgcccucugcggccuccagcagugccccuccucccgccgcguccucaagcccaacaagggcaccaucuccaacggcaagaacccccccacccucaagcccguccccccccccaccucccgcccccgcaugcucaccacccccaccggccccgaguccauguccaccuccacccccgccaucuccucccccucccccaccaccgccuccaaggagggcgaccucggcggcaagcaguggcaggacuccuccacccagcccgagcucuccucccgcuaccucaucuccaccggcuccaccucccagcccauccucaccucccagucccucuccauccagcccuccgaggagaacgucuccuccuccgacaccggccccaccuccgagggcggccucgucgccaccaccaccuccggcuccggccucuccuccucccgcaaccccaucaccuggcccgucacccccuucuacaacacccucaccaagggccccgagauggagauccacuccggcuccggcgaggagcgcgagcagcccgaggacaaggacgaguccaaccccgucaucuggaccaagauccgcguccccggcaacgacgcccccgucgaguccaccgagaugccccucgcccccccccucacccccgaccucucccgcgaguccugguggccccccuucuccaccgucauggagggccuccuccccucccagcgccccaccaccuccgagaccggcaccccccgcgucgagggcauggucaccgagaagcccgccaacacccuccucccccucggcggcgaccaccagcccgagcccuccggcaagaccgccaaccgcaaccaccucaagcuccccaacaacaugaaccagaccaaguccuccgagcccguccucaccgaggaggacgccaccucccucaucaccgagggcuuccuccucaacgccuccaacuacaagcagcucaccaacggccacggcuccgcccacuggaucgucggcaacugguccgagugcuccaccaccugcggccucggcgccuacuggcgccgcgucgagugcuccacccagauggacuccgacugcgccgccauccagcgccccgaccccgccaagcgcugccaccuccgccccugcgccggcuggaaggucggcaacugguccaagugcucccgcaacugcuccggcggcuucaagauccgcgagauccagugcgucgacucccgcgaccaccgcaaccuccgccccuuccacugccaguuccucgccggcaucccccccccccucuccauguccugcaaccccgagcccugcgaggccuggcaggucgagcccuggucccagugcucccgcuccugcggcggcggcguccaggagcgcggcgucuucugccccggcggccucugcgacuggaccaagcgccccaccuccaccauguccugcaacgagcaccucugcugccacugggccaccggcaacugggaccucugcuccaccuccugcggcggcggcuuccagaagcgcaccguccagugcguccccuccgagggcaacaagaccgaggaccaggaccagugccucugcgaccacaagccccgcccccccgaguucaagaagugcaaccagcaggccugcaagaaguccgccgaccuccucugcaccaaggacaagcucuccgccuccuucugccagacccucaaggccaugaagaagugcuccguccccaccguccgcgccgagugcugcuucuccugcccccagacccacaucacccacacccagcgccagcgccgccagcgccuccuccagaaguccaaggagcucuga

SEQ ID NO: 39380 - RNA, 4284 nt, Artificial Sequence
  derived and/or modified sequence opt2 from ADAMTS13__Homo_sapiens__NP_620594
augcaccagcgccacccccgcgcccgcugccccccccucugcgucgccggcauccucgccugcggcuuccuccucggcugcuggggccccucccacuuccagcaguccugccuccaggcccucgagccccaggccgucuccuccuaccucucccccggcgccccccucaagggccgcccccccucccccggcuuccagcgccagcgccagcgccagcgccgcgccgccggcggcauccuccaccucgagcuccucgucgccgucggccccgacgucuuccaggcccaccaggaggacaccgagcgcuacguccucaccaaccucaacaucggcgccgagcuccuccgcgaccccucccucggcgcccaguuccgcguccaccucgucaagauggucauccucaccgagcccgagggcgcccccaacaucaccgccaaccucaccuccucccuccucuccgucugcggcuggucccagaccaucaaccccgaggacgacaccgaccccggccacgccgaccucguccucuacaucacccgcuucgaccucgagcuccccgacggcaaccgccagguccgcggcgucacccagcucggcggcgccugcucccccaccugguccugccucaucaccgaggacaccggcuucgaccucggcgucaccaucgcccacgagaucggccacuccuucggccucgagcacgacggcgcccccggcuccggcugcggccccuccggccacgucauggccuccgacggcgccgccccccgcgccggccucgccuggucccccugcucccgccgccagcuccucucccuccucuccgccggccgcgcccgcugcgucugggaccccccccgcccccagcccggcuccgccggccacccccccgacgcccagcccggccucuacuacuccgccaacgagcagugccgcgucgccuucggccccaaggccgucgccugcaccuucgcccgcgagcaccucgacaugugccaggcccucuccugccacaccgacccccucgaccaguccuccugcucccgccuccucgucccccuccucgacggcaccgagugcggcgucgagaaguggugcuccaagggccgcugccgcucccucgucgagcucacccccaucgccgccguccacggccgcugguccuccuggggcccccgcucccccugcucccgcuccugcggcggcggcgucgucacccgccgccgccagugcaacaacccccgccccgccuucggcggccgcgccugcgucggcgccgaccuccaggccgagaugugcaacacccaggccugcgagaagacccagcucgaguucaugucccagcagugcgcccgcaccgacggccagccccuccgcuccucccccggcggcgccuccuucuaccacuggggcgccgccgucccccacucccagggcgacgcccucugccgccacaugugccgcgccaucggcgaguccuucaucaugaagcgcggcgacuccuuccucgacggcacccgcugcaugcccuccggcccccgcgaggacggcacccucucccucugcgucuccggcuccugccgcaccuucggcugcgacggccgcauggacucccagcaggucugggaccgcugccaggucugcggcggcgacaacuccaccugcuccccccgcaagggcuccuucaccgccggccgcgcccgcgaguacgucaccuuccucaccgucacccccaaccucaccuccgucuacaucgccaaccaccgcccccucuucacccaccucgccguccgcaucggcggccgcuacgucgucgccggcaagauguccaucucccccaacaccaccuaccccucccuccucgaggacggccgcgucgaguaccgcgucgcccucaccgaggaccgccucccccgccucgaggagauccgcaucuggggcccccuccaggaggacgccgacauccaggucuaccgccgcuacggcgaggaguacggcaaccucacccgccccgacaucaccuucaccuacuuccagcccaagccccgccaggccugggucugggccgccguccgcggccccugcuccgucuccugcggcgccggccuccgcugggucaacuacuccugccucgaccaggcccgcaaggagcucgucgagaccguccagugccagggcucccagcagccccccgccuggcccgaggccugcguccucgagcccugcccccccuacugggccgucggcgacuucggccccugcuccgccuccugcggcggcggccuccgcgagcgccccguccgcugcgucgaggcccagggcucccuccucaagacccucccccccgcccgcugccgcgccggcgcccagcagcccgccgucgcccucgagaccugcaacccccagcccugccccgcccgcugggaggucuccgagcccuccuccugcaccuccgccggcggcgccggccucgcccucgagaacgagaccugcguccccggcgccgacggccucgaggcccccgucaccgagggccccggcuccgucgacgagaagcuccccgcccccgagcccugcgucggcauguccugcccccccggcuggggccaccucgacgccaccuccgccggcgagaaggcccccucccccuggggcuccauccgcaccggcgcccaggccgcccacgucuggacccccgccgccggcuccugcuccgucuccugcggccgcggccucauggagcuccgcuuccucugcauggacuccgcccuccgcguccccguccaggaggagcucugcggccucgccuccaagcccggcucccgccgcgaggucugccaggccguccccugccccgcccgcuggcaguacaagcucgccgccugcuccgucuccugcggccgcggcgucguccgccgcauccucuacugcgcccgcgcccacggcgaggacgacggcgaggagauccuccucgacacccagugccagggccucccccgccccgagccccaggaggccugcucccucgagcccugccccccccgcuggaaggucaugucccucggccccugcuccgccuccugcggccucggcaccgcccgccgcuccgucgccugcguccagcucgaccagggccaggacgucgaggucgacgaggccgccugcgccgcccucguccgccccgaggccuccguccccugccucaucgccgacugcaccuaccgcuggcacgucggcaccuggauggagugcuccgucuccugcggcgacggcauccagcgccgccgcgacaccugccucggcccccaggcccaggcccccguccccgccgacuucugccagcaccuccccaagcccgucaccguccgcggcugcugggccggccccugcgucggccagggcacccccucccucgucccccacgaggaggccgccgcccccggccgcaccaccgccacccccgccggcgccucccucgaguggucccaggcccgcggccuccucuucucccccgccccccagccccgccgccuccuccccggcccccaggagaacuccguccaguccuccgccugcggccgccagcaccucgagcccaccggcaccaucgacaugcgcggccccggccaggccgacugcgccgucgccaucggccgcccccucggcgaggucgucacccuccgcguccucgaguccucccucaacugcuccgccggcgacaugcuccuccucuggggccgccucaccuggcgcaagaugugccgcaagcuccucgacaugaccuucuccuccaagaccaacacccucgucguccgccagcgcugcggccgccccggcggcggcguccuccuccgcuacggcucccagcucgcccccgagaccuucuaccgcgagugcgacaugcagcucuucggccccuggggcgagaucgucucccccucccucucccccgccaccuccaacgccggcggcugccgccucuucaucaacgucgccccccacgcccgcaucgccauccacgcccucgccaccaacaugggcgccggcaccgagggcgccaacgccuccuacauccucauccgcgacacccacucccuccgcaccaccgccuuccacggccagcagguccucuacugggaguccgaguccucccaggccgagauggaguucuccgagggcuuccucaaggcccaggccucccuccgcggccaguacuggacccuccaguccuggguccccgagaugcaggacccccaguccuggaagggcaaggagggcaccuga

SEQ ID NO: 39381 - RNA, 3672 nt, Artificial Sequence
  derived and/or modified sequence opt2 from ADAMTS14__Homo_sapiens__NP_542453
auggccccccuccgcgcccuccucuccuaccuccucccccuccacugcgcccucugcgccgccgccggcucccgcacccccgagcuccaccucuccggcaagcucuccgacuacggcgucaccguccccugcuccaccgacuuccgcggccgcuuccucucccacgucgucuccggccccgccgccgccuccgccggcuccauggucgucgacaccccccccacccucccccgccacuccucccaccuccgcgucgcccgcuccccccuccaccccggcggcacccucuggcccggccgcgucggccgccacucccucuacuucaacgucaccgucuucggcaaggagcuccaccuccgccuccgccccaaccgccgccucgucguccccggcuccuccgucgaguggcaggaggacuuccgcgagcucuuccgccagccccuccgccaggagugcgucuacaccggcggcgucaccggcaugcccggcgccgccgucgccaucuccaacugcgacggccucgccggccucauccgcaccgacuccaccgacuucuucaucgagccccucgagcgcggccagcaggagaaggaggccuccggccgcacccacgucgucuaccgccgcgaggccguccagcaggagugggccgagcccgacggcgaccuccacaacgaggccuucggccucggcgaccuccccaaccuccucggccucgucggcgaccagcucggcgacaccgagcgcaagcgccgccacgccaagcccggcuccuacuccaucgagguccuccucgucgucgacgacuccgucguccgcuuccacggcaaggagcacguccagaacuacguccucacccucaugaacaucgucgacgagaucuaccacgacgagucccucggcguccacaucaacaucgcccucguccgccucaucauggucggcuaccgccagucccucucccucaucgagcgcggcaaccccucccgcucccucgagcaggucugccgcugggcccacucccagcagcgccaggaccccucccacgccgagcaccacgaccacgucgucuuccucacccgccaggacuucggccccuccggcuacgcccccgucaccggcaugugccacccccuccgcuccugcgcccucaaccacgaggacggcuucuccuccgccuucgucaucgcccacgagaccggccacguccucggcauggagcacgacggccagggcaacggcugcgccgacgagaccucccucggcuccgucauggccccccucguccaggccgccuuccaccgcuuccacuggucccgcugcuccaagcucgagcucucccgcuaccuccccuccuacgacugccuccucgacgaccccuucgaccccgccuggccccagccccccgagcuccccggcaucaacuacuccauggacgagcagugccgcuucgacuucggcuccggcuaccagaccugccucgccuuccgcaccuucgagcccugcaagcagcucuggugcucccaccccgacaaccccuacuucugcaagaccaagaagggccccccccucgacggcaccgagugcgcccccggcaaguggugcuucaagggccacugcaucuggaagucccccgagcagaccuacggccaggacggcggcugguccuccuggaccaaguucggcuccugcucccgcuccugcggcggcggcguccgcucccgcucccgcuccugcaacaaccccucccccgccuacggcggccgccucugccucggccccauguucgaguaccaggucugcaacuccgaggagugccccggcaccuacgaggacuuccgcgcccagcagugcgccaagcgcaacuccuacuacguccaccagaacgccaagcacuccuggguccccuacgagcccgacgacgacgcccagaagugcgagcucaucugccaguccgccgacaccggcgacgucgucuucaugaaccaggucguccacgacggcacccgcugcuccuaccgcgaccccuacuccgucugcgcccgcggcgagugcguccccgucggcugcgacaaggaggucggcuccaugaaggccgacgacaagugcggcgucugcggcggcgacaacucccacugccgcaccgucaagggcacccucggcaaggccuccaagcaggccggcgcccucaagcucguccagauccccgccggcgcccgccacauccagaucgaggcccucgagaaguccccccaccgcaucgucgucaagaaccaggucaccggcuccuucauccucaaccccaagggcaaggaggccaccucccgcaccuucaccgccaugggccucgagugggaggacgccgucgaggacgccaaggagucccucaagaccuccggcccccuccccgaggccaucgccauccucgcccucccccccaccgagggcggcccccgcuccucccucgccuacaaguacgucauccacgaggaccuccucccccucaucggcuccaacaacguccuccucgaggagauggacaccuacgagugggcccucaaguccugggcccccugcuccaaggccugcggcggcggcauccaguucaccaaguacggcugccgccgccgccgcgaccaccacaugguccagcgccaccucugcgaccacaagaagcgccccaagcccauccgccgccgcugcaaccagcaccccugcucccagcccgucugggucaccgaggaguggggcgccugcucccgcuccugcggcaagcucggcguccagacccgcggcauccagugccuccucccccucuccaacggcacccacaaggucaugcccgccaaggccugcgccggcgaccgccccgaggcccgccgccccugccuccgcguccccugccccgcccaguggcgccucggcgccuggucccagugcuccgccaccugcggcgagggcauccagcagcgccaggucgucugccgcaccaacgccaacucccucggccacugcgagggcgaccgccccgacaccguccaggucugcucccuccccgccugcggcggcaaccaccagaacuccaccguccgcgccgacgucugggagcucggcacccccgagggccagugggucccccaguccgagccccuccaccccaucaacaagaucuccuccaccgagcccugcaccggcgaccgcuccgucuucugccagauggagguccucgaccgcuacugcuccauccccggcuaccaccgccucugcugcgucuccugcaucaagaaggccuccggccccaaccccggccccgaccccggccccaccucccucccccccuucuccacccccggcuccccccuccccggcccccaggaccccgccgacgccgccgagccccccggcaagcccaccggcuccgaggaccaccagcacggccgcgccacccagcuccccggcgcccucgacaccuccucccccggcacccagcaccccuucgcccccgagacccccauccccggcgccuccugguccaucucccccaccacccccggcggccuccccuggggcuggacccagacccccacccccguccccgaggacaagggccagcccggcgaggaccuccgccaccccggcaccucccuccccgccgccucccccgucaccuga

SEQ ID NO: 39382 - RNA, 2853 nt, Artificial Sequence
  derived and/or modified sequence opt2 from ADAMTS15__Homo_sapiens__NP_620686
augcuccuccucggcauccucacccucgccuucgccggccgcaccgccggcggcuccgagcccgagcgcgaggucgucguccccauccgccucgaccccgacaucaacggccgccgcuacuacuggcgcggccccgaggacuccggcgaccagggccucaucuuccagaucaccgccuuccaggaggacuucuaccuccaccucacccccgacgcccaguuccucgcccccgccuucuccaccgagcaccucggcgucccccuccagggccucaccggcggcuccuccgaccuccgccgcugcuucuacuccggcgacgucaacgccgagcccgacuccuucgccgccgucucccucugcggcggccuccgcggcgccuucggcuaccgcggcgccgaguacgucaucuccccccuccccaacgccuccgcccccgccgcccagcgcaacucccagggcgcccaccuccuccagcgccgcggcguccccggcggccccuccggcgaccccaccucccgcugcggcgucgccuccggcuggaaccccgccauccuccgcgcccucgaccccuacaagccccgccgcgccggcuucggcgagucccgcucccgccgccgcuccggccgcgccaagcgcuucgucuccaucccccgcuacgucgagacccucgucgucgccgacgaguccauggucaaguuccacggcgccgaccucgagcacuaccuccucacccuccucgccaccgccgcccgccucuaccgccaccccuccauccucaaccccaucaacaucgucgucgucaagguccuccuccuccgcgaccgcgacuccggccccaaggucaccggcaacgccgcccucacccuccgcaacuucugcgccuggcagaagaagcucaacaaggucuccgacaagcaccccgaguacugggacaccgccauccucuucacccgccaggaccucugcggcgccaccaccugcgacacccucggcauggccgacgucggcaccaugugcgaccccaagcgcuccugcuccgucaucgaggacgacggccuccccuccgccuucaccaccgcccacgagcucggccacgucuucaacaugccccacgacaacgucaaggucugcgaggaggucuucggcaagcuccgcgccaaccacaugaugucccccacccucauccagaucgaccgcgccaaccccugguccgccugcuccgccgccaucaucaccgacuuccucgacuccggccacggcgacugccuccucgaccagcccuccaagcccaucucccuccccgaggaccuccccggcgccuccuacacccucucccagcagugcgagcucgccuucggcgucggcuccaagcccugccccuacaugcaguacugcaccaagcucuggugcaccggcaaggccaagggccagauggucugccagacccgccacuuccccugggccgacggcaccuccugcggcgagggcaagcucugccucaagggcgccugcgucgagcgccacaaccucaacaagcaccgcgucgacggcuccugggccaagugggaccccuacggccccugcucccgcaccugcggcggcggcguccagcucgcccgccgccagugcaccaaccccacccccgccaacggcggcaaguacugcgagggcguccgcgucaaguaccgcuccugcaaccucgagcccugccccuccuccgccuccggcaaguccuuccgcgaggagcagugcgaggccuucaacggcuacaaccacuccaccaaccgccucacccucgccgucgccuggguccccaaguacuccggcgucuccccccgcgacaagugcaagcucaucugccgcgccaacggcaccggcuacuucuacguccucgcccccaaggucgucgacggcacccucugcucccccgacuccaccuccgucugcguccagggcaagugcaucaaggccggcugcgacggcaaccucggcuccaagaagcgcuucgacaagugcggcgucugcggcggcgacaacaaguccugcaagaaggucaccggccucuucaccaagcccaugcacggcuacaacuucgucgucgccauccccgccggcgccuccuccaucgacauccgccagcgcggcuacaagggccucaucggcgacgacaacuaccucgcccucaagaacucccagggcaaguaccuccucaacggccacuucgucgucuccgccgucgagcgcgaccucgucgucaagggcucccuccuccgcuacuccggcaccggcaccgccgucgagucccuccaggccucccgccccauccucgagccccucaccgucgagguccucuccgucggcaagaugacccccccccgcguccgcuacuccuucuaccuccccaaggagccccgcgaggacaaguccucccaccccaaggacccccgcggccccuccguccuccacaacuccguccucucccucuccaaccaggucgagcagcccgacgaccgcccccccgcccgcugggucgccggcuccuggggccccugcuccgccuccugcggcuccggccuccagaagcgcgccgucgacugccgcggcuccgccggccagcgcaccguccccgccugcgacgccgcccaccgccccgucgagacccaggccugcggcgagcccugccccaccugggagcucuccgccuggucccccugcuccaaguccugcggccgcggcuuccagcgccgcucccucaagugcgucggccacggcggccgccuccucgcccgcgaccagugcaaccuccaccgcaagccccaggagcucgacuucugcguccuccgccccugcuga

SEQ ID NO: 39383 - RNA, 3675 nt, Artificial Sequence
  derived and/or modified sequence opt2 from ADAMTS16__Homo_sapiens__NP_620687
augaagccccgcgcccgcggcuggcgcggccucgccgcccucuggaugcuccucgcccaggucgccgagcaggcccccgccugcgccaugggccccgccgccgccgcccccggcucccccuccgucccccgcccccccccccccgccgagcgccccggcuggauggagaagggcgaguacgaccucgucuccgccuacgaggucgaccaccgcggcgacuacgucucccacgagaucaugcaccaccagcgccgccgccgcgccguccccgucuccgaggucgagucccuccaccuccgccucaagggcucccgccacgacuuccacauggaccuccgcaccuccuccucccucgucgcccccggcuucaucguccagacccucggcaagaccggcaccaaguccguccagacccucccccccgaggacuucugcuucuaccagggcucccuccgcucccaccgcaacuccuccgucgcccucuccaccugccagggccucuccggcaugauccgcaccgaggaggccgacuacuuccuccgcccccuccccucccaccucuccuggaagcucggccgcgccgcccagggcuccucccccucccacguccucuacaagcgcuccaccgagccccacgcccccggcgccuccgagguccucgucaccucccgcaccugggagcucgcccaccagccccuccacuccuccgaccuccgccucggccucccccagaagcagcacuucugcggccgccgcaagaaguacaugccccagccccccaaggaggaccucuucauccuccccgacgaguacaaguccugccuccgccacaagcgcucccuccuccgcucccaccgcaacgaggagcucaacgucgagacccucgucgucgucgacaagaagaugaugcagaaccacggccacgagaacaucaccaccuacguccucaccauccucaacauggucuccgcccucuucaaggacggcaccaucggcggcaacaucaacaucgccaucgucggccucauccuccucgaggacgagcagcccggccucgucaucucccaccacgccgaccacacccucuccuccuucugccaguggcaguccggccucaugggcaaggacggcacccgccacgaccacgccauccuccucaccggccucgacaucugcuccuggaagaacgagcccugcgacacccucggcuucgcccccaucuccggcaugugcuccaaguaccgcuccugcaccaucaacgaggacaccggccucggccucgccuucaccaucgcccacgaguccggccacaacuucggcaugauccacgacggcgagggcaacaugugcaagaaguccgagggcaacaucaugucccccacccucgccggccgcaacggcgucuucuccuggucccccugcucccgccaguaccuccacaaguuccucuccaccgcccaggccaucugccucgccgaccagcccaagcccgucaaggaguacaaguaccccgagaagcuccccggcgagcucuacgacgccaacacccagugcaaguggcaguucggcgagaaggccaagcucugcaugcucgacuucaagaaggacaucugcaaggcccucuggugccaccgcaucggccgcaagugcgagaccaaguucaugcccgccgccgagggcaccaucugcggccacgacauguggugccgcggcggccagugcgucaaguacggcgacgagggccccaagcccacccacggccacugguccgacugguccuccuggucccccugcucccgcaccugcggcggcggcgucucccaccgcucccgccucugcaccaaccccaagcccucccacggcggcaaguucugcgagggcuccacccgcacccucaagcucugcaacucccagaagugcccccgcgacuccgucgacuuccgcgccgcccagugcgccgagcacaacucccgccgcuuccgcggccgccacuacaaguggaagcccuacacccaggucgaggaccaggaccucugcaagcucuacugcaucgccgagggcuucgacuucuucuucucccucuccaacaaggucaaggacggcacccccugcuccgaggacucccgcaacgucugcaucgacggcaucugcgagcgcgucggcugcgacaacguccucggcuccgacgccgucgaggacgucugcggcgucugcaacggcaacaacuccgccugcaccauccaccgcggccucuacaccaagcaccaccacaccaaccaguacuaccacauggucaccauccccuccggcgcccgcuccauccgcaucuacgagaugaacgucuccaccuccuacaucuccguccgcaacgcccuccgccgcuacuaccucaacggccacuggaccgucgacuggcccggccgcuacaaguucuccggcaccaccuucgacuaccgccgcuccuacaacgagcccgagaaccucaucgccaccggccccaccaacgagacccucaucgucgagcuccucuuccagggccgcaaccccggcgucgccugggaguacuccaugccccgccucggcaccgagaagcagccccccgcccagcccuccuacaccugggccaucguccgcuccgagugcuccgucuccugcggcggcggccagaugaccguccgcgagggcugcuaccgcgaccucaaguuccaggucaacauguccuucugcaaccccaagacccgccccgucaccggccucguccccugcaaggucuccgccugcccccccuccugguccgucggcaacugguccgccugcucccgcaccugcggcggcggcgcccagucccgccccguccagugcacccgccgcguccacuacgacuccgagcccguccccgccucccucugcccccagcccgcccccuccucccgccaggccugcaacucccaguccugcccccccgccugguccgccggccccugggccgagugcucccacaccugcggcaagggcuggcgcaagcgcgccgucgccugcaaguccaccaaccccuccgcccgcgcccagcuccuccccgacgccgucugcaccuccgagcccaagccccgcaugcacgaggccugccuccuccagcgcugccacaagcccaagaagcuccaguggcucgucuccgccuggucccagugcuccgucaccugcgagcgcggcacccagaagcgcuuccucaagugcgccgagaaguacgucuccggcaaguaccgcgagcucgccuccaagaagugcucccaccuccccaagcccucccucgagcucgagcgcgccugcgccccccuccccugcccccgccacccccccuucgccgccgccggccccucccgcggcuccugguucgccucccccuggucccagugcaccgccuccugcggcggcggcguccagacccgcuccguccagugccucgccggcggccgccccgccuccggcugccuccuccaccagaagcccuccgccucccucgccugcaacacccacuucugccccaucgccgagaagaaggacgccuucugcaaggacuacuuccacuggugcuaccucgucccccagcacggcaugugcucccacaaguucuacggcaagcagugcugcaagaccugcuccaaguccaaccucuga

SEQ ID NO: 39384 - RNA, 3288 nt, Artificial Sequence
  derived and/or modified sequence opt2 from ADAMTS17__Homo_sapiens__NP_620688
augugcgacggcgcccuccuccccccccucguccuccccguccuccuccuccucgucuggggccucgaccccggcaccgccgucggcgacgccgccgccgacgucgaggucguccuccccuggcgcguccgccccgacgacguccaccuccccccccuccccgccgcccccggcccccgccgccgccgccgcccccgcaccccccccgccgccccccgcgcccgccccggcgagcgcgcccuccuccuccaccuccccgccuucggccgcgaccucuaccuccagcuccgccgcgaccuccgcuuccucucccgcggcuucgaggucgaggaggccggcgccgcccgccgccgcggccgccccgccgagcucugcuucuacuccggccgcguccucggccaccccggcucccucgucucccucuccgccugcggcgccgccggcggccucgucggccucauccagcucggccaggagcagguccucauccagccccucaacaacucccagggccccuucuccggccgcgagcaccucauccgccgcaaguggucccucacccccucccccuccgccgaggcccagcgccccgagcagcucugcaagguccucaccgagaagaagaagcccaccuggggccgccccucccgcgacuggcgcgagcgccgcaacgccauccgccucaccuccgagcacaccgucgagacccucgucgucgccgacgccgacaugguccaguaccacggcgccgaggccgcccagcgcuucauccucaccgucaugaacauggucuacaacauguuccagcaccagucccucggcaucaagaucaacauccaggucaccaagcucguccuccuccgccagcgccccgccaagcucuccaucggccaccacggcgagcgcucccucgaguccuucugccacuggcagaacgaggaguacggcggcgcccgcuaccucggcaacaaccagguccccggcggcaaggacgaccccccccucgucgacgccgccgucuucgucacccgcaccgacuucugcguccacaaggacgagcccugcgacaccgucggcaucgccuaccucggcggcgucugcuccgccaagcgcaagugcguccucgccgaggacaacggccucaaccucgccuucaccaucgcccacgagcucggccacaaccucggcaugaaccacgacgacgaccacuccuccugcgccggccgcucccacaucauguccggcgagugggucaagggccgcaaccccuccgaccucuccugguccuccugcucccgcgacgaccucgagaacuuccucaaguccaaggucuccaccugccuccucgucaccgacccccgcucccagcacaccguccgccucccccacaagcuccccggcaugcacuacuccgccaacgagcagugccagauccucuucggcaugaacgccaccuucugccgcaacauggagcaccucaugugcgccggccucuggugccucgucgagggcgacaccuccugcaagaccaagcucgaccccccccucgacggcaccgagugcggcgccgacaaguggugccgcgccggcgagugcgucuccaagacccccauccccgagcacgucgacggcgacuggucccccuggggcgccugguccaugugcucccgcaccugcggcaccggcgcccgcuuccgccagcgcaagugcgacaaccccccccccggccccggcggcacccacugccccggcgccuccgucgagcacgccgucugcgagaaccuccccugccccaagggccuccccuccuuccgcgaccagcagugccaggcccacgaccgccucucccccaagaagaagggccuccucaccgccgucgucgucgacgacaagcccugcgagcucuacugcuccccccucggcaaggaguccccccuccucgucgccgaccgcguccucgacggcacccccugcggccccuacgagaccgaccucugcguccacggcaagugccagaagaucggcugcgacggcaucaucggcuccgccgccaaggaggaccgcugcggcgucugcuccggcgacggcaagaccugccaccucgucaagggcgacuucucccacgcccgcggcaccgcccucaaggacuccggcaagggcuccaucaacuccgacuggaagaucgagcuccccggcgaguuccagaucgccggcaccaccguccgcuacguccgccgcggccucugggagaagaucuccgccaagggccccaccaagcucccccuccaccucaugguccuccucuuccacgaccaggacuacggcauccacuacgaguacaccguccccgucaaccgcaccgccgagaaccaguccgagcccgagaagccccaggacucccucuucaucuggacccacuccggcugggagggcugcuccguccagugcggcggcggcgagcgccgcaccaucgucuccugcacccgcaucgucaacaagaccaccacccucgucaacgacuccgacugcccccaggccucccgccccgagccccagguccgccgcugcaaccuccaccccugccagucccgcugggucgccggccccuggucccccugcuccgccaccugcgagaagggcuuccagcaccgcgaggucaccugcgucuaccagcuccagaacggcacccacgucgccacccgcccccucuacugccccggcccccgccccgccgccguccaguccugcgagggccaggacugccucuccaucugggaggccuccgaguggucccagugcuccgccuccugcggcaagggcgucuggaagcgcaccgucgccugcaccaacucccagggcaagugcgacgccuccacccgcccccgcgccgaggaggccugcgaggacuacuccggcugcuacgaguggaagaccggcgacugguccaccugcuccuccaccugcggcaagggccuccagucccgcgucguccagugcaugcacaaggucaccggccgccacggcuccgagugccccgcccucuccaagcccgcccccuaccgccagugcuaccaggaggucugcaacgaccgcaucaacgccaacaccaucaccuccccccgccucgccgcccucaccuacaagugcacccgcgaccaguggaccgucuacugccgcgucauccgcgagaagaaccucugccaggacaugcgcugguaccagcgcugcugccagaccugccgcgacuucuacgccaacaagaugcgccagcccccccccaacuccuga

SEQ ID NO: 39385 - RNA, 3666 nt, Artificial Sequence
  derived and/or modified sequence opt2 from ADAMTS18__Homo_sapiens__NP_955387
auggagugcgcccuccuccucgccugcgccuuccccgccgccggcuccggccccccccgcggccucgccggccucggccgcgucgccaaggcccuccagcucugcugccucugcugcgccuccgucgccgccgcccucgccuccgacuccuccuccggcgccuccggccucaacgacgacuacgucuucgucacccccgucgaggucgacuccgccggcuccuacaucucccacgacauccuccacaacggccgcaagaagcgcuccgcccagaacgcccgcuccucccuccacuaccgcuucuccgccuucggccaggagcuccaccucgagcucaagcccuccgccauccucuccucccacuucaucguccagguccucggcaaggacggcgccuccgagacccagaagcccgagguccagcagugcuucuaccagggcuucauccgcaacgacuccuccuccuccgucgccgucuccaccugcgccggccucuccggccucauccgcacccgcaagaacgaguuccucaucuccccccucccccagcuccucgcccaggagcacaacuacuccucccccgccggccaccacccccacguccucuacaagcgcaccgccgaggagaagauccagcgcuaccgcggcuaccccggcuccggccgcaacuaccccggcuacucccccucccacaucccccacgccucccagucccgcgagaccgaguaccaccaccgccgccuccagaagcagcacuucugcggccgccgcaagaaguacgcccccaagccccccaccgaggacaccuaccuccgcuucgacgaguacggcuccuccggccgcccccgccgcuccgccggcaagucccagaagggccucaacgucgagacccucgucgucgccgacaagaagauggucgagaagcacggcaagggcaacgucaccaccuacauccucaccgucaugaacauggucuccggccucuucaaggacggcaccaucggcuccgacaucaacgucgucgucgucucccucauccuccucgagcaggagcccggcggccuccucaucaaccaccacgccgaccagucccucaacuccuucugccaguggcaguccgcccucaucggcaagaacggcaagcgccacgaccacgccauccuccucaccggcuucgacaucugcuccuggaagaacgagcccugcgacacccucggcuucgcccccaucuccggcaugugcuccaaguaccgcuccugcaccaucaacgaggacaccggccucggccucgccuucaccaucgcccacgaguccggccacaacuucggcaugauccacgacggcgagggcaaccccugccgcaaggccgagggcaacaucaugucccccacccucaccggcaacaacggcgucuucuccugguccuccugcucccgccaguaccucaagaaguuccucuccaccccccaggccggcugccucgucgacgagcccaagcaggccggccaguacaaguaccccgacaagcuccccggccagaucuacgacgccgacacccagugcaaguggcaguucggcgccaaggccaagcucugcucccucggcuucgucaaggacaucugcaagucccucuggugccaccgcgucggccaccgcugcgagaccaaguucaugcccgccgccgagggcaccgucugcggccucuccauguggugccgccagggccagugcgucaaguucggcgagcucggcccccgccccauccacggccagugguccgccugguccaagugguccgagugcucccgcaccugcggcggcggcgucaaguuccaggagcgccacugcaacaaccccaagccccaguacggcggccucuucugccccggcuccucccgcaucuaccagcucugcaacaucaaccccugcaacgagaacucccucgacuuccgcgcccagcagugcgccgaguacaacuccaagcccuuccgcggcugguucuaccaguggaagcccuacaccaaggucgaggaggaggaccgcugcaagcucuacugcaaggccgagaacuucgaguucuucuucgccauguccggcaaggucaaggacggcacccccugcucccccaacaagaacgacgucugcaucgacggcgucugcgagcucgucggcugcgaccacgagcucggcuccaaggccgucuccgacgccugcggcgucugcaagggcgacaacuccaccugcaaguucuacaagggccucuaccucaaccagcacaaggccaacgaguacuaccccgucguccucauccccgccggcgcccgcuccaucgagauccaggagcuccaggucuccuccuccuaccucgccguccgcucccucucccagaaguacuaccucaccggcggcugguccaucgacuggcccggcgaguuccccuucgccggcaccaccuucgaguaccagcgcuccuucaaccgccccgagcgccucuacgcccccggccccaccaacgagacccucgucuucgagauccucaugcagggcaagaaccccggcaucgccuggaaguacgcccuccccaaggucaugaacggcaccccccccgccaccaagcgccccgccuacaccugguccaucguccaguccgagugcuccgucuccugcggcggcggcuacaucaacgucaaggccaucugccuccgcgaccagaacacccaggucaacuccuccuucugcuccgccaagaccaagcccgucaccgagcccaagaucugcaacgccuucuccugccccgccuacuggaugcccggcgagugguccaccugcuccaaggccugcgccggcggccagcagucccgcaagauccagugcguccagaagaagcccuuccagaaggaggaggccguccuccacucccucugccccgucuccacccccacccagguccaggccugcaacucccacgccugccccccccaguggucccucggccccuggucccagugcuccaagaccugcggccgcggcguccgcaagcgcgagcuccucugcaagggcuccgccgccgagacccuccccgagucccagugcaccucccucccccgccccgagcuccaggagggcugcguccucggccgcugccccaagaacucccgccuccagugggucgccuccuccugguccgagugcuccgccaccugcggccucggcguccgcaagcgcgagaugaagugcuccgagaagggcuuccagggcaagcucaucaccuuccccgagcgccgcugccgcaacaucaagaagcccaaccucgaccucgaggagaccugcaaccgccgcgccugccccgcccaccccgucuacaacauggucgccggcugguacucccuccccuggcagcagugcaccgucaccugcggcggcggcguccagacccgcuccguccacugcguccagcagggccgccccuccuccuccugccuccuccaccagaagccccccguccuccgcgccugcaacaccaacuucugccccgcccccgagaagcgcgaggaccccuccugcgucgacuucuucaacuggugccaccucgucccccagcacggcgucugcaaccacaaguucuacggcaagcagugcugcaaguccugcacccgcaagaucuga

SEQ ID NO: 39386 - RNA, 3624 nt, Artificial Sequence
  derived and/or modified sequence opt2 from ADAMTS19__Homo_sapiens__NP_598377
augcgccucacccacaucugcugcugcugccuccucuaccagcucggcuuccucuccaacggcaucgucuccgagcuccaguucgcccccgaccgcgaggagugggaggucgucuuccccgcccucuggcgccgcgagcccgucgaccccgccggcggcuccggcggcuccgccgaccccggcuggguccgcggcgucggcggcggcggcuccgcccgcgcccaggccgccggcuccucccgcgagguccgcuccgucgcccccgucccccucgaggagcccgucgagggccgcuccgagucccgccuccgcccccccccccccuccgagggcgaggaggacgaggagcucgagucccaggagcucccccgcggcuccuccggcgccgccgcccucucccccggcgcccccgccuccuggcagccccccccccccccccagcccccccccucccccccccccgcccagcacgccgagcccgacggcgacgagguccuccuccgcauccccgccuucucccgcgaccucuaccuccuccuccgccgcgacggccgcuuccucgccccccgcuucgccgucgagcagcgccccaaccccggccccggccccaccggcgccgccuccgccccccagccccccgccccccccgacgccggcugcuucuacaccggcgccguccuccgccaccccggcucccucgccuccuucuccaccugcggcggcggccucaugggcuucauccagcucaacgaggacuucaucuucaucgagccccucaacgacaccauggccaucaccggccacccccaccgcgucuaccgccagaagcgcuccauggaggagaaggucaccgagaaguccgcccuccacucccacuacugcggcaucaucuccgacaagggccgcccccgcucccgcaagaucgccgaguccggccgcggcaagcgcuacuccuacaagcucccccaggaguacaacaucgagaccgucgucgucgccgaccccgccauggucuccuaccacggcgccgacgccgcccgccgcuucauccucaccauccucaacauggucuucaaccucuuccagcacaagucccucuccguccaggucaaccuccgcgucaucaagcucauccuccuccacgagaccccccccgagcucuacaucggccaccacggcgagaagaugcucgaguccuucugcaaguggcagcacgaggaguucggcaagaagaacgacauccaccucgagauguccaccaacuggggcgaggacaugaccuccgucgacgccgccauccucaucacccgcaaggacuucugcguccacaaggacgagcccugcgacaccgucggcaucgccuaccucuccggcaugugcuccgagaagcgcaagugcaucaucgccgaggacaacggccucaaccucgccuucaccaucgcccacgagaugggccacaacaugggcaucaaccacgacaacgaccaccccuccugcgccgacggccuccacaucauguccggcgaguggaucaagggccagaaccucggcgacgucuccuggucccgcugcuccaaggaggaccucgagcgcuuccuccgcuccaaggccuccaacugccuccuccagaccaacccccaguccgucaacuccgucaugguccccuccaagcuccccggcaugaccuacaccgccgacgagcagugccagauccucuucggcccccucgccuccuucugccaggagaugcagcacgucaucugcaccggccucuggugcaaggucgagggcgagaaggagugccgcaccaagcucgacccccccauggacggcaccgacugcgaccucggcaaguggugcaaggccggcgagugcaccucccgcaccuccgcccccgagcaccucgccggcgaguggucccucuggucccccugcucccgcaccugcuccgccggcaucuccucccgcgagcgcaagugccccggccucgacuccgaggcccgcgacugcaacggcccccgcaagcaguaccgcaucugcgagaacccccccugccccgccggccuccccggcuuccgcgacuggcagugccaggccuacuccguccgcaccuccucccccaagcacauccuccaguggcaggccguccucgacgaggagaagcccugcgcccucuucugcucccccgucggcaaggagcagcccauccuccucuccgagaaggucauggacggcaccuccugcggcuaccagggccucgacaucugcgccaacggccgcugccagaaggucggcugcgacggccuccucggcucccucgcccgcgaggaccacugcggcgucugcaacggcaacggcaaguccugcaagaucaucaagggcgacuucaaccacacccgcggcgccggcuacgucgagguccucgucauccccgccggcgcccgccgcaucaaggucgucgaggagaagcccgcccacuccuaccucgcccuccgcgacgccggcaagcaguccaucaacuccgacuggaagaucgagcacuccggcgccuucaaccucgccggcaccaccguccacuacguccgccgcggccucugggagaagaucuccgccaagggccccaccaccgccccccuccaccuccucguccuccucuuccaggaccagaacuacggccuccacuacgaguacaccauccccuccgacccccuccccgagaaccaguccuccaaggcccccgagccccucuucauguggacccacaccuccugggaggacugcgacgccaccugcggcggcggcgagcgcaagaccaccgucuccugcaccaagaucauguccaagaacaucuccaucgucgacaacgagaagugcaaguaccucaccaagcccgagccccagauccgcaagugcaacgagcagcccugccagacccgcuggaugaugaccgaguggacccccugcucccgcaccugcggcaagggcaugcagucccgccaggucgccugcacccagcagcucuccaacggcacccucauccgcgcccgcgagcgcgacugcaucggccccaagcccgccuccgcccagcgcugcgagggccaggacugcaugaccgucugggaggccggcgucugguccgagugcuccgucaagugcggcaagggcauccgccaccgcaccguccgcugcaccaacccccgcaagaagugcguccucuccacccgcccccgcgaggccgaggacugcgaggacuacuccaagugcuacgucuggcgcaugggcgacugguccaagugcuccaucaccugcggcaagggcaugcagucccgcgucauccagugcaugcacaagaucaccggccgccacggcaacgagugcuucuccuccgagaagcccgccgccuaccgccccugccaccuccagcccugcaacgagaagaucaacgucaacaccaucaccuccccccgccucgccgcccucaccuucaagugccucggcgaccaguggcccgucuacugccgcgucauccgcgagaagaaccucugccaggacaugcgcugguaccagcgcugcugcgagaccugccgcgacuucuacgcccagaagcuccagcagaaguccuga

SEQ ID NO: 39387 - RNA, 2904 nt, Artificial Sequence
  derived and/or modified sequence opt2 from ADAMTS1__Homo_sapiens__NP_008919
augcagcgcgccguccccgagggcuucggccgccgcaagcucggcuccgacaugggcaacgccgagcgcgcccccggcucccgcuccuucggccccguccccacccuccuccuccucgccgccgcccuccucgccgucuccgacgcccucggccgccccuccgaggaggacgaggagcucgucguccccgagcucgagcgcgcccccggccacggcaccacccgccuccgccuccacgccuucgaccagcagcucgaccucgagcuccgccccgacuccuccuuccucgcccccggcuucacccuccagaacgucggccgcaaguccggcuccgagaccccccuccccgagaccgaccucgcccacugcuucuacuccggcaccgucaacggcgaccccuccuccgccgccgcccucucccucugcgagggcguccgcggcgccuucuaccuccucggcgaggccuacuucauccagccccuccccgccgccuccgagcgccucgccaccgccgcccccggcgagaagccccccgccccccuccaguuccaccuccuccgccgcaaccgccagggcgacgucggcggcaccugcggcgucgucgacgacgagccccgccccaccggcaaggccgagaccgaggacgaggacgagggcaccgagggcgaggacgagggcgcccagugguccccccaggaccccgcccuccagggcgucggccagcccaccggcaccggcuccauccgcaagaagcgcuucgucuccucccaccgcuacgucgagaccaugcucgucgccgaccaguccauggccgaguuccacggcuccggccucaagcacuaccuccucacccucuucuccgucgccgcccgccucuacaagcaccccuccauccgcaacuccgucucccucgucgucgucaagauccucgucauccacgacgagcagaagggccccgaggucaccuccaacgccgcccucacccuccgcaacuucugcaacuggcagaagcagcacaacccccccuccgaccgcgacgccgagcacuacgacaccgccauccucuucacccgccaggaccucugcggcucccagaccugcgacacccucggcauggccgacgucggcaccgucugcgaccccucccgcuccugcuccgucaucgaggacgacggccuccaggccgccuucaccaccgcccacgagcucggccacgucuucaacaugccccacgacgacgccaagcagugcgccucccucaacggcgucaaccaggacucccacaugauggccuccaugcucuccaaccucgaccacucccagcccuggucccccugcuccgccuacaugaucaccuccuuccucgacaacggccacggcgagugccucauggacaagccccagaaccccauccagcuccccggcgaccuccccggcaccuccuacgacgccaaccgccagugccaguucaccuucggcgaggacuccaagcacugccccgacgccgccuccaccugcuccacccucuggugcaccggcaccuccggcggcguccucgucugccagaccaagcacuuccccugggccgacggcaccuccugcggcgagggcaaguggugcaucaacggcaagugcgucaacaagaccgaccgcaagcacuucgacacccccuuccacggcuccuggggcauguggggccccuggggcgacugcucccgcaccugcggcggcggcguccaguacaccaugcgcgagugcgacaaccccguccccaagaacggcggcaaguacugcgagggcaagcgcguccgcuaccgcuccugcaaccucgaggacugccccgacaacaacggcaagaccuuccgcgaggagcagugcgaggcccacaacgaguucuccaaggccuccuucggcuccggccccgccgucgaguggauccccaaguacgccggcgucucccccaaggaccgcugcaagcucaucugccaggccaagggcaucggcuacuucuucguccuccagcccaaggucgucgacggcacccccugcucccccgacuccaccuccgucugcguccagggccagugcgucaaggccggcugcgaccgcaucaucgacuccaagaagaaguucgacaagugcggcgucugcggcggcaacggcuccaccugcaagaagaucuccggcuccgucaccuccgccaagcccggcuaccacgacaucaucaccauccccaccggcgccaccaacaucgaggucaagcagcgcaaccagcgcggcucccgcaacaacggcuccuuccucgccaucaaggccgccgacggcaccuacauccucaacggcgacuacacccucuccacccucgagcaggacaucauguacaagggcgucguccuccgcuacuccggcuccuccgccgcccucgagcgcauccgcuccuucuccccccucaaggagccccucaccauccagguccucaccgucggcaacgcccuccgccccaagaucaaguacaccuacuucgucaagaagaagaaggaguccuucaacgccauccccaccuucuccgccugggucaucgaggaguggggcgagugcuccaaguccugcgagcucggcuggcagcgccgccucgucgagugccgcgacaucaacggccagcccgccuccgagugcgccaaggaggucaagcccgccuccacccgccccugcgccgaccaccccugcccccaguggcagcucggcgagugguccuccugcuccaagaccugcggcaagggcuacaagaagcgcucccucaagugccucucccacgacggcggcguccucucccacgaguccugcgacccccucaagaagcccaagcacuucaucgacuucugcaccauggccgagugcuccuga

SEQ ID NO: 39388 - RNA, 5733 nt, Artificial Sequence
  derived and/or modified sequence opt2 from ADAMTS20__Homo_sapiens__NP_079279
augugggucgccaaguggcucaccggccuccucuaccaccucucccucuucaucacccgcuccugggaggucgacuuccacccccgccaggaggcccucguccgcacccucaccuccuacgaggucgucauccccgagcgcgucaacgaguucggcgaggucuucccccagucccaccacuucucccgccagaagcgcuccuccgaggcccucgagcccaugcccuuccgcacccacuaccgcuucaccgccuacggccagcucuuccagcucaaccucaccgccgacgccuccuuccucgccgccggcuacaccgagguccaccucggcacccccgagcgcggcgccugggaguccgacgccggccccuccgaccuccgccacugcuucuaccgcggccaggucaacucccaggaggacuacaaggccgucgucucccucugcggcggccucaccggcaccuucaagggccagaacggcgaguacuuccucgagcccaucaugaaggccgacggcaacgaguacgaggacggccacaacaagccccaccucaucuaccgccaggaccucaacaacuccuuccuccagacccucaaguacugcuccgucuccgagucccagaucaaggagaccucccuccccuuccacaccuacuccaacaugaacgaggaccucaacgucaugaaggagcgcguccucggccacaccuccaagaacgucccccucaaggacgagcgccgccacucccgcaagaagcgccucaucuccuacccccgcuacaucgagaucauggucaccgccgacgccaaggucgucuccgcccacggcuccaaccuccagaacuacauccucacccucauguccaucgucgccaccaucuacaaggaccccuccaucggcaaccucauccacaucgucgucgucaagcucgucaugauccaccgcgaggaggagggccccgucaucaacuucgacggcgccaccacccucaagaacuucugcuccuggcagcagacccagaacgaccucgacgacguccaccccucccaccacgacaccgccguccucaucacccgcgaggacaucugcuccuccaaggagaagugcaacaugcucggccucuccuaccucggcaccaucugcgacccccuccaguccugcuucaucaacgaggagaagggccucaucuccgccuucaccaucgcccacgagcucggccacacccucggcguccagcacgacgacaacccccgcugcaaggagaugaaggucaccaaguaccacgucauggcccccgcccucuccuuccacaugucccccugguccugguccaacugcucccgcaaguacgucaccgaguuccucgacaccggcuacggcgagugccuccucgacaagcccgacgaggagaucuacaaccuccccuccgagcuccccggcucccgcuacgacggcaacaagcagugcgagcucgccuucggccccggcucccagaugugcccccacaucaacaucugcaugcaccucuggugcaccuccaccgagaagcuccacaagggcugcuucacccagcacgucccccccgccgacggcaccgacugcggccccggcaugcacugccgccacggccucugcgucaacaaggagaccgagacccgccccgucaacggcgaguggggccccugggagcccuacuccuccugcucccgcaccugcggcggcggcaucgaguccgccacccgccgcugcaaccgccccgagccccgcaacggcggcaacuacugcgucggccgccgcaugaaguuccgcuccugcaacaccgacuccugccccaagggcacccaggacuuccgcgagaagcagugcuccgacuucaacggcaagcaccucgacaucuccggcauccccuccaacguccgcuggcucccccgcuacuccggcaucggcaccaaggaccgcugcaagcucuacugccaggucgccggcaccaacuacuucuaccuccucaaggacauggucgaggacggcacccccugcggcaccgagacccacgacaucugcguccagggccagugcauggccgccggcugcgaccacguccucaacuccuccgccaagaucgacaagugcggcgucugcggcggcgacaacuccuccugcaagaccaucaccggcgucuucaacuccucccacuacggcuacaacgucgucgucaagauccccgccggcgccaccaacgucgacauccgccaguacuccuacuccggccagcccgacgacuccuaccucgcccucuccgacgccgagggcaacuuccucuucaacggcaacuuccuccucuccaccuccaagaaggagaucaacguccagggcacccgcaccgucaucgaguacuccggcuccaacaacgccgucgagcgcaucaacuccaccaaccgccaggagaaggagcucauccuccagguccucugcgucggcaaccucuacaaccccgacguccacuacuccuucaacaucccccucgaggagcgcuccgacauguucaccugggaccccuacggccccugggagggcugcaccaagaugugccagggccuccagcgccgcaacaucaccugcauccacaaguccgaccacuccgucgucuccgacaaggagugcgaccaccucccccuccccuccuucgucacccaguccugcaacaccgacugcgagcuccgcuggcacgucaucggcaaguccgagugcuccucccagugcggccagggcuaccgcacccucgacauccacugcaugaaguacuccauccacgagggccagaccguccaggucgacgaccacuacugcggcgaccagcucaagccccccacccaggagcucugccacggcaacugcgucuucacccgcuggcacuacuccgaguggucccagugcucccgcuccugcggcggcggcgagcgcucccgcgaguccuacugcaugaacaacuucggccaccgccucgccgacaacgagugccaggagcucucccgcgucacccgcgagaacugcaacgaguucuccugccccuccugggccgccuccgagugguccgagugccucgucaccugcggcaagggcaccaagcagcgccaggucuggugccagcucaacgucgaccaccucuccgacggcuucugcaacuccuccaccaagcccgagucccucucccccugcgagcuccacaccugcgccuccuggcaggucggccccuggggccccugcaccaccaccugcggccacggcuaccagaugcgcgacgucaagugcgucaacgagcucgccuccgccguccucgaggacaccgagugccacgaggccucccgccccuccgaccgccaguccugcguccucacccccugcuccuucaucuccaagcucgagaccgcccuccuccccaccguccucaucaagaagauggcccaguggcgccacggcuccuggacccccugcuccgucuccugcggccgcggcacccaggcccgcuacgucuccugccgcgacgcccucgaccgcaucgccgacgaguccuacugcgcccaccucccccgccccgccgagaucugggacugcuucacccccugcggcgaguggcaggccggcgacuggucccccugcuccgccuccugcggccacggcaagaccacccgccagguccucugcaugaacuaccaccagcccaucgacgagaacuacugcgaccccgagguccgcccccucauggagcaggagugcucccucgccgccugcccccccgcccacucccacuuccccuccucccccguccagcccuccuacuaccucuccaccaaccucccccucacccagaagcucgaggacaacgagaaccaggucguccaccccuccguccgcggcaaccaguggcgcaccggccccuggggcuccugcuccuccuccugcuccggcggccuccagcaccgcgccgucgucugccaggacgagaacggccaguccgccuccuacugcgacgccgccuccaagccccccgagcuccagcagugcggccccggccccugcccccaguggaacuacggcaacuggggcgagugcucccagaccugcggcggcggcaucaagucccgccucgucaucugccaguuccccaacggccagauccucgaggaccacaacugcgagaucgucaacaagccccccuccgucauccagugccacaugcacgccugccccgccgacgucuccuggcaccaggagcccuggaccuccugcuccgccuccugcggcaagggccgcaaguaccgcgaggucuucugcaucgaccaguuccagcgcaagcucgaggacaccaacugcucccagguccagaagccccccacccacaaggccugccgcuccguccgcugccccuccuggaaggccaacuccuggaacgagugcuccgucaccugcggcuccggcguccagcagcgcgacgucuacugccgccucaagggcgucggccaggucgucgaggagaugugcgaccaguccacccgccccugcucccagcgccgcugcuggucccaggacugcguccagcacaagggcauggagcgcggccgccucaacugcuccaccuccugcgagcgcaaggacucccaccagcgcauggagugcaccgacaaccagauccgccaggucaacgagaucgucuacaacuccuccaccaucucccucaccuccaagaacugccgcaacccccccugcaacuacaucgucgucaccgccgacuccucccagugcgccaacaacugcggcuucuccuaccgccagcgcaucaccuacugcaccgagauccccuccaccaagaagcacaagcuccaccgccuccgccccaucgucuaccaggagugccccgucguccccuccucccaggucuaccagugcaucaacuccugccuccaccucgccaccuggaaggucggcaagugguccaagugcuccgucaccugcggcaucggcaucaugaagcgccaggucaagugcaucaccaagcacggccucuccuccgaccucugccucaaccaccucaagcccggcgcccagaagaagugcuacgccaacgacugcaaguccuucaccaccugcaaggagauccaggucaagaaccacauccgcaaggacggcgacuacuaccucaacaucaagggccgcaucaucaagaucuacugcgccgacauguaccucgagaaccccaaggaguaccucacccucguccagggcgaggagaacuucuccgaggucuacggcuuccgccucaagaaccccuaccagugccccuucaacggcucccgccgcgaggacugcgagugcgacaacggccaccucgccgccggcuacaccgucuucuccaagauccgcaucgaccucaccuccaugcagaucaagaccaccgaccuccucuucuccaagaccaucuucggcaacgccguccccuucgccaccgccggcgacugcuacuccgccuuccgcugcccccagggccaguucuccaucaaccucuccggcaccggcaugaagaucuccuccaccgccaaguggcucacccagggcuccuacaccuccgucuccauccgccgcuccgaggacggcacccgcuucuucggcaagugcggcggcuacugcggcaagugccucccccacaugaccaccggccuccccauccaggucaucuga

SEQ ID NO: 39389 - RNA, 3636 nt, Artificial Sequence
  derived and/or modified sequence opt2 from ADAMTS2__Homo_sapiens__NP_055059
auggacccccccgccggcgccgcccgccgccuccucugccccgcccuccuccuccuccuccuccuccucccccccccccuccucccccccccccccccccccgccaacgcccgccucgccgccgccgccgacccccccggcggcccccucggccacggcgccgagcgcauccucgccguccccguccgcaccgacgcccagggccgccucgucucccacgucgucuccgccgccaccucccgcgccggcguccgcgcccgccgcgccgcccccguccgcacccccuccuuccccggcggcaacgaggaggagcccggcucccaccucuucuacaacgucaccgucuucggccgcgaccuccaccuccgccuccgccccaacgcccgccucgucgcccccggcgccaccauggaguggcagggcgagaagggcaccacccgcgucgagccccuccucggcuccugccucuacgucggcgacgucgccggccucgccgaggccuccuccgucgcccucuccaacugcgacggccucgccggccucauccgcauggaggaggaggaguucuucaucgagccccucgagaagggccucgccgcccaggaggccgagcagggccgcguccacgucgucuaccgccgcccccccaccucccccccccucggcggcccccaggcccucgacaccggcgccucccucgacucccucgacucccucucccgcgcccucggcguccucgaggagcacgccaacuccucccgccgccgcgcccgccgccacgccgccgacgacgacuacaacaucgagguccuccucggcgucgacgacuccgucguccaguuccacggcaaggagcacguccagaaguaccuccucacccucaugaacaucgucaacgagaucuaccacgacgagucccucggcgcccacaucaacgucguccucguccgcaucauccuccucuccuacggcaaguccaugucccucaucgagaucggcaaccccucccagucccucgagaacgucugccgcugggccuaccuccagcagaagcccgacaccggccacgacgaguaccacgaccacgccaucuuccucacccgccaggacuucggccccuccggcaugcagggcuacgcccccgucaccggcaugugccaccccguccgcuccugcacccucaaccacgaggacggcuucuccuccgccuucgucgucgcccacgagaccggccacguccucggcauggagcacgacggccagggcaaccgcugcggcgacgagguccgccucggcuccaucauggccccccucguccaggccgccuuccaccgcuuccacuggucccgcugcucccagcaggagcucucccgcuaccuccacuccuacgacugccuccucgacgaccccuucgcccacgacuggcccgcccucccccagcuccccggccuccacuacuccaugaacgagcagugccgcuucgacuucggccucggcuacaugaugugcaccgccuuccgcaccuucgaccccugcaagcagcucuggugcucccaccccgacaaccccuacuucugcaagaccaagaagggccccccccucgacggcaccaugugcgcccccggcaagcacugcuucaagggccacugcaucuggcucacccccgacauccucaagcgcgacggcuccuggggcgccuggucccccuucggcuccugcucccgcaccugcggcaccggcgucaaguuccgcacccgccagugcgacaacccccaccccgccaacggcggccgcaccugcuccggccucgccuacgacuuccagcucugcucccgccaggacugccccgacucccucgccgacuuccgcgaggagcagugccgccagugggaccucuacuucgagcacggcgacgcccagcaccacuggcucccccacgagcaccgcgacgccaaggagcgcugccaccucuacugcgagucccgcgagaccggcgaggucgucuccaugaagcgcaugguccacgacggcacccgcugcuccuacaaggacgccuucucccucugcguccgcggcgacugccgcaaggucggcugcgacggcgucaucggcuccuccaagcaggaggacaagugcggcgucugcggcggcgacaacucccacugcaaggucgucaagggcaccuucacccgcucccccaagaagcacggcuacaucaagauguucgagauccccgccggcgcccgccaccuccucauccaggaggucgacgccaccucccaccaccucgccgucaagaaccucgagaccggcaaguucauccucaacgaggagaacgacgucgacgccuccuccaagaccuucaucgccaugggcgucgagugggaguaccgcgacgaggacggccgcgagacccuccagaccaugggcccccuccacggcaccaucaccguccucgucauccccgucggcgacacccgcgucucccucaccuacaaguacaugauccacgaggacucccucaacgucgacgacaacaacguccucgaggaggacuccgucgucuacgagugggcccucaagaaguggucccccugcuccaagcccugcggcggcggcucccaguucaccaaguacggcugccgccgccgccucgaccacaagaugguccaccgcggcuucugcgccgcccucuccaagcccaaggccauccgccgcgccugcaacccccaggagugcucccagcccgucugggucaccggcgagugggagcccugcucccagaccugcggccgcaccggcaugcagguccgcuccguccgcugcauccagccccuccacgacaacaccacccgcuccguccacgccaagcacugcaacgacgcccgccccgagucccgccgcgccugcucccgcgagcucugccccggccgcuggcgcgccggccccuggucccagugcuccgucaccugcggcaacggcacccaggagcgccccguccucugccgcaccgccgacgacuccuucggcaucugccaggaggagcgccccgagaccgcccgcaccugccgccucggccccugcccccgcaacaucuccgaccccuccaagaaguccuacgucguccaguggcucucccgccccgaccccgacucccccauccgcaagaucuccuccaagggccacugccagggcgacaaguccaucuucugccgcauggagguccucucccgcuacugcuccauccccggcuacaacaagcucugcugcaaguccugcaaccucuacaacaaccucaccaacgucgagggccgcaucgagcccccccccggcaagcacaacgacaucgacgucuucaugcccacccuccccguccccaccgucgccauggagguccgccccucccccuccaccccccucgaggucccccucaacgccuccuccaccaacgccaccgaggaccaccccgagaccaacgccgucgacgagcccuacaagauccacggccucgaggacgagguccagccccccaaccucaucccccgccgccccucccccuacgagaagacccgcaaccagcgcauccaggagcucaucgacgagaugcgcaagaaggagaugcucggcaaguucuga

SEQ ID NO: 39390 - RNA, 3618 nt, Artificial Sequence
  derived and/or modified sequence opt2 from ADAMTS3__Homo_sapiens__NP_055058
augguccuccucucccucuggcucaucgccgccgcccucgucgagguccgcaccuccgccgacggccaggccggcaacgaggagaugguccagaucgaccuccccaucaagcgcuaccgcgaguacgagcucgucacccccgucuccaccaaccucgagggccgcuaccucucccacacccucuccgccucccacaagaagcgcuccgcccgcgacgucuccuccaaccccgagcagcucuucuucaacaucaccgccuucggcaaggacuuccaccuccgccucaagcccaacacccagcucgucgcccccggcgccgucgucgaguggcacgagaccucccucguccccggcaacaucaccgaccccaucaacaaccaccagcccggcuccgccaccuaccgcauccgccgcaccgagccccuccagaccaacugcgccuacgucggcgacaucgucgacauccccggcaccuccgucgccaucuccaacugcgacggccucgccggcaugaucaaguccgacaacgaggaguacuucaucgagccccucgagcgcggcaagcagauggaggaggagaagggccgcauccacgucgucuacaagcgcuccgccgucgagcaggcccccaucgacauguccaaggacuuccacuaccgcgaguccgaccucgagggccucgacgaccucggcaccgucuacggcaacauccaccagcagcucaacgagaccaugcgccgccgccgccacgccggcgagaacgacuacaacaucgagguccuccucggcgucgacgacuccgucguccgcuuccacggcaaggagcacguccagaacuaccuccucacccucaugaacaucgucaacgagaucuaccacgacgagucccucggcguccacaucaacgucguccucguccgcaugaucaugcucggcuacgccaaguccaucucccucaucgagcgcggcaaccccucccgcucccucgagaacgucugccgcugggccucccagcagcagcgcuccgaccucaaccacuccgagcaccacgaccacgccaucuuccucacccgccaggacuucggccccgccggcaugcagggcuacgcccccgucaccggcaugugccaccccguccgcuccugcacccucaaccacgaggacggcuucuccuccgccuucgucgucgcccacgagaccggccacguccucggcauggagcacgacggccagggcaaccgcugcggcgacgagaccgccaugggcuccgucauggccccccucguccaggccgccuuccaccgcuaccacuggucccgcugcuccggccaggagcucaagcgcuacauccacuccuacgacugccuccucgacgaccccuucgaccacgacuggcccaagcuccccgagcuccccggcaucaacuacuccauggacgagcagugccgcuucgacuucggcgucggcuacaagaugugcaccgccuuccgcaccuucgaccccugcaagcagcucuggugcucccaccccgacaaccccuacuucugcaagaccaagaagggccccccccucgacggcaccgagugcgccgccggcaaguggugcuacaagggccacugcauguggaagaacgccaaccagcagaagcaggacggcaacuggggcuccuggaccaaguucggcuccugcucccgcaccugcggcaccggcguccgcuuccgcacccgccagugcaacaaccccaugcccaucaacggcggccaggacugccccggcgucaacuucgaguaccagcucugcaacaccgaggagugccagaagcacuucgaggacuuccgcgcccagcagugccagcagcgcaacucccacuucgaguaccagaacaccaagcaccacuggcuccccuacgagcaccccgaccccaagaagcgcugccaccucuacugccaguccaaggagaccggcgacgucgccuacaugaagcagcucguccacgacggcacccacugcuccuacaaggaccccuacuccaucugcguccgcggcgagugcgucaaggucggcugcgacaaggagaucggcuccaacaaggucgaggacaagugcggcgucugcggcggcgacaacucccacugccgcaccgucaagggcaccuucacccgcaccccccgcaagcucggcuaccucaagauguucgacaucccccccggcgcccgccacguccucauccaggaggacgaggccuccccccacauccucgccaucaagaaccaggccaccggccacuacauccucaacggcaagggcgaggaggccaagucccgcaccuucaucgaccucggcgucgagugggacuacaacaucgaggacgacaucgagucccuccacaccgacggcccccuccacgaccccgucaucguccucaucaucccccaggagaacgacacccgcuccucccucaccuacaaguacaucauccacgaggacuccguccccaccaucaacuccaacaacgucauccaggaggagcucgacaccuucgagugggcccucaaguccuggucccagugcuccaagcccugcggcggcggcuuccaguacaccaaguacggcugccgccgcaaguccgacaacaagaugguccaccgcuccuucugcgaggccaacaagaagcccaagcccauccgccgcaugugcaacauccaggagugcacccacccccucugggucgccgaggagugggagcacugcaccaagaccugcggcuccuccggcuaccagcuccgcaccguccgcugccuccagccccuccucgacggcaccaaccgcuccguccacuccaaguacugcaugggcgaccgccccgagucccgccgccccugcaaccgcguccccugccccgcccaguggaagaccggccccugguccgagugcuccgucaccugcggcgagggcaccgagguccgccagguccucugccgcgccggcgaccacugcgacggcgagaagcccgaguccguccgcgccugccagcucccccccugcaacgacgagcccugccucggcgacaaguccaucuucugccagauggagguccucgcccgcuacugcuccauccccggcuacaacaagcucugcugcgaguccugcuccaagcgcuccuccacccuccccccccccuaccuccucgaggccgccgagacccacgacgacgucaucuccaaccccuccgaccucccccgcucccucgucaugcccaccucccucguccccuaccacuccgagacccccgccaagaagaugucccucuccuccaucuccuccgucggcggccccaacgccuacgccgccuuccgccccaacuccaagcccgacggcgccaaccuccgccagcgcuccgcccagcaggccggcuccaagaccguccgccucgucaccguccccuccuccccccccaccaagcgcguccaccucuccuccgccucccagauggccgccgccuccuucuucgccgccuccgacuccaucggcgccuccucccaggcccgcaccuccaagaaggacggcaagaucaucgacaaccgccgccccacccgcuccuccacccucgagcgcuga

SEQ ID NO: 39391 - RNA, 2514 nt, Artificial Sequence
  derived and/or modified sequence opt2 from ADAMTS4__Homo_sapiens__NP_005090
augucccagaccggcucccaccccggccgcggccucgccggccgcuggcucuggggcgcccagcccugccuccuccuccccaucgucccccucuccuggcucgucuggcuccuccuccuccuccucgccucccuccuccccuccgcccgccucgccuccccccucccccgcgaggaggagaucgucuuccccgagaagcucaacggcuccguccuccccggcuccggcgcccccgcccgccuccucugccgccuccaggccuucggcgagacccuccuccucgagcucgagcaggacuccggcguccaggucgagggccucaccguccaguaccucggccaggcccccgagcuccucggcggcgccgagcccggcaccuaccucaccggcaccaucaacggcgaccccgaguccgucgccucccuccacugggacggcggcgcccuccucggcguccuccaguaccgcggcgccgagcuccaccuccagccccucgagggcggcacccccaacuccgccggcggccccggcgcccacauccuccgccgcaagucccccgccuccggccagggccccaugugcaacgucaaggccccccucggcucccccuccccccgcccccgccgcgccaagcgcuucgccucccucucccgcuucgucgagacccucgucgucgccgacgacaagauggccgccuuccacggcgccggccucaagcgcuaccuccucaccgucauggccgccgccgccaaggccuucaagcaccccuccauccgcaaccccgucucccucgucgucacccgccucgucauccucggcuccggcgaggagggcccccaggucggccccuccgccgcccagacccuccgcuccuucugcgccuggcagcgcggccucaacacccccgaggacuccgaccccgaccacuucgacaccgccauccucuucacccgccaggaccucugcggcgucuccaccugcgacacccucggcauggccgacgucggcaccgucugcgaccccgcccgcuccugcgccaucgucgaggacgacggccuccaguccgccuucaccgccgcccacgagcucggccacgucuucaacaugcuccacgacaacuccaagcccugcaucucccucaacggcccccucuccaccucccgccacgucauggcccccgucauggcccacgucgaccccgaggagcccuggucccccugcuccgcccgcuucaucaccgacuuccucgacaacggcuacggccacugccuccucgacaagcccgaggccccccuccaccuccccgucaccuuccccggcaaggacuacgacgccgaccgccagugccagcucaccuucggccccgacucccgccacugcccccagcuccccccccccugcgccgcccucuggugcuccggccaccucaacggccacgccaugugccagaccaagcacucccccugggccgacggcacccccugcggccccgcccaggccugcaugggcggccgcugccuccacauggaccagcuccaggacuucaacaucccccaggccggcggcuggggccccuggggccccuggggcgacugcucccgcaccugcggcggcggcguccaguucuccucccgcgacugcacccgccccgucccccgcaacggcggcaaguacugcgagggccgccgcacccgcuuccgcuccugcaacaccgaggacugccccaccggcuccgcccucaccuuccgcgaggagcagugcgccgccuacaaccaccgcaccgaccucuucaaguccuuccccggccccauggacugggucccccgcuacaccggcgucgccccccaggaccagugcaagcucaccugccaggcccaggcccucggcuacuacuacguccucgagccccgcgucgucgacggcacccccugcucccccgacuccuccuccgucugcguccagggccgcugcauccacgccggcugcgaccgcaucaucggcuccaagaagaaguucgacaagugcauggucugcggcggcgacggcuccggcugcuccaagcaguccggcuccuuccgcaaguuccgcuacggcuacaacaacgucgucaccauccccgccggcgccacccacauccucguccgccagcagggcaaccccggccaccgcuccaucuaccucgcccucaagcuccccgacggcuccuacgcccucaacggcgaguacacccucaugcccucccccaccgacgucguccuccccggcgccgucucccuccgcuacuccggcgccaccgccgccuccgagacccucuccggccacggcccccucgcccagccccucacccuccagguccucgucgccggcaacccccaggacacccgccuccgcuacuccuucuucgucccccgccccacccccuccaccccccgccccaccccccaggacuggcuccaccgccgcgcccagauccucgagauccuccgccgccgccccugggccggccgcaaguga

SEQ ID NO: 39392 - RNA, 2793 nt, Artificial Sequence
  derived and/or modified sequence opt2 from ADAMTS5__Homo_sapiens__NP_008969
augcuccucggcugggccucccuccuccucugcgccuuccgccucccccucgccgccgucggccccgccgccacccccgcccaggacaaggccggccagccccccaccgccgccgccgccgcccagccccgccgccgccagggcgaggagguccaggagcgcgccgagccccccggccacccccacccccucgcccagcgccgccgcuccaagggccucguccagaacaucgaccagcucuacuccggcggcggcaaggucggcuaccucgucuacgccggcggccgccgcuuccuccucgaccucgagcgcgacggcuccgucggcaucgccggcuucguccccgccggcggcggcaccuccgcccccuggcgccaccgcucccacugcuucuaccgcggcaccgucgacggcuccccccgcucccucgccgucuucgaccucugcggcggccucgacggcuucuucgccgucaagcacgcccgcuacacccucaagccccuccuccgcggccccugggccgaggaggagaagggccgcgucuacggcgacggcuccgcccgcauccuccacgucuacacccgcgagggcuucuccuucgaggcccuccccccccgcgccuccugcgagacccccgccuccacccccgaggcccacgagcacgcccccgcccacuccaaccccuccggccgcgccgcccucgccucccagcuccucgaccaguccgcccucucccccgccggcggcuccggcccccagaccugguggcgccgccgccgccgcuccaucucccgcgcccgccaggucgagcuccuccucgucgccgacgccuccauggcccgccucuacggccgcggccuccagcacuaccuccucacccucgccuccaucgccaaccgccucuacucccacgccuccaucgagaaccacauccgccucgccgucgucaaggucgucguccucggcgacaaggacaagucccucgaggucuccaagaacgccgccaccacccucaagaacuucugcaaguggcagcaccagcacaaccagcucggcgacgaccacgaggagcacuacgacgccgccauccucuucacccgcgaggaccucugcggccaccacuccugcgacacccucggcauggccgacgucggcaccaucugcucccccgagcgcuccugcgccgucaucgaggacgacggccuccacgccgccuucaccgucgcccacgagaucggccaccuccucggccucucccacgacgacuccaaguucugcgaggagaccuucggcuccaccgaggacaagcgccucauguccuccauccucaccuccaucgacgccuccaagcccugguccaagugcaccuccgccaccaucaccgaguuccucgacgacggccacggcaacugccuccucgaccucccccgcaagcagauccucggccccgaggagcuccccggccagaccuacgacgccacccagcagugcaaccucaccuucggccccgaguacuccgucugccccggcauggacgucugcgcccgccucuggugcgccgucguccgccagggccagauggucugccucaccaagaagcuccccgccgucgagggcacccccugcggcaagggccgcaucugccuccagggcaagugcgucgacaagaccaagaagaaguacuacuccaccuccucccacggcaacuggggcuccuggggcuccuggggccagugcucccgcuccugcggcggcggcguccaguucgccuaccgccacugcaacaaccccgccccccgcaacaacggccgcuacugcaccggcaagcgcgccaucuaccgcuccugcucccucaugcccugcccccccaacggcaaguccuuccgccacgagcagugcgaggccaagaacggcuaccaguccgacgccaagggcgucaagaccuucgucgaguggguccccaaguacgccggcguccuccccgccgacgucugcaagcucaccugccgcgccaagggcaccggcuacuacgucgucuucucccccaaggucaccgacggcaccgagugccgccucuacuccaacuccgucugcguccgcggcaagugcguccgcaccggcugcgacggcaucaucggcuccaagcuccaguacgacaagugcggcgucugcggcggcgacaacuccuccugcaccaagaucgucggcaccuucaacaagaaguccaagggcuacaccgacgucguccgcauccccgagggcgccacccacaucaagguccgccaguucaaggccaaggaccagacccgcuucaccgccuaccucgcccucaagaagaagaacggcgaguaccucaucaacggcaaguacaugaucuccaccuccgagaccaucaucgacaucaacggcaccgucaugaacuacuccggcuggucccaccgcgacgacuuccuccacggcaugggcuacuccgccaccaaggagauccucaucguccagauccucgccaccgaccccaccaagccccucgacguccgcuacuccuucuucguccccaagaaguccacccccaaggucaacuccgucaccucccacggcuccaacaaggucggcucccacaccucccagccccagugggucaccggccccuggcucgccugcucccgcaccugcgacaccggcuggcacacccgcaccguccagugccaggacggcaaccgcaagcucgccaagggcugcccccucucccagcgccccuccgccuucaagcagugccuccucaagaagugcuga

SEQ ID NO: 39393 - RNA, 3354 nt, Artificial Sequence
  derived and/or modified sequence opt2 from ADAMTS6__Homo_sapiens__NP_922932
auggagauccucuggaagacccucaccuggauccucucccucaucauggccuccuccgaguuccacuccgaccaccgccucuccuacuccucccaggaggaguuccucaccuaccucgagcacuaccagcucaccauccccauccgcgucgaccagaacggcgccuuccucuccuucaccgucaagaacgacaagcacucccgccgccgccgcuccauggaccccaucgacccccagcaggccgucuccaagcucuucuucaagcucuccgccuacggcaagcacuuccaccucaaccucacccucaacaccgacuucgucuccaagcacuucaccgucgaguacuggggcaaggacggcccccaguggaagcacgacuuccucgacaacugccacuacaccggcuaccuccaggaccagcgcuccaccaccaaggucgcccucuccaacugcgucggccuccacggcgucaucgccaccgaggacgaggaguacuucaucgagccccucaagaacaccaccgaggacuccaagcacuucuccuacgagaacggccacccccacgucaucuacaagaaguccgcccuccagcagcgccaccucuacgaccacucccacugcggcgucuccgacuucacccgcuccggcaagcccugguggcucaacgacaccuccaccgucuccuacucccuccccaucaacaacacccacauccaccaccgccagaagcgcuccgucuccaucgagcgcuucgucgagacccucgucgucgccgacaagaugauggucggcuaccacggccgcaaggacaucgagcacuacauccucuccgucaugaacaucgucgccaagcucuaccgcgacuccucccucggcaacgucgucaacaucaucgucgcccgccucaucguccucaccgaggaccagcccaaccucgagaucaaccaccacgccgacaagucccucgacuccuucugcaaguggcagaaguccauccucucccaccaguccgacggcaacaccauccccgagaacggcaucgcccaccacgacaacgccguccucaucacccgcuacgacaucugcaccuacaagaacaagcccugcggcacccucggccucgccuccgucgccggcaugugcgagcccgagcgcuccugcuccaucaacgaggacaucggccucggcuccgccuucaccaucgcccacgagaucggccacaacuucggcaugaaccacgacggcaucggcaacuccugcggcaccaagggccacgaggccgccaagcucauggccgcccacaucaccgccaacaccaaccccuucuccugguccgccugcucccgcgacuacaucaccuccuuccucgacuccggccgcggcaccugccucgacaacgagccccccaagcgcgacuuccucuaccccgccgucgcccccggccaggucuacgacgccgacgagcagugccgcuuccaguacggcgccaccucccgccagugcaaguacggcgaggucugccgcgagcucuggugccucuccaaguccaaccgcugcgucaccaacuccauccccgccgccgagggcacccucugccagaccggcaacaucgagaagggcuggugcuaccagggcgacugcguccccuucggcaccuggccccaguccaucgacggcggcuggggccccuggucccucuggggcgagugcucccgcaccugcggcggcggcgucuccuccucccuccgccacugcgacucccccgcccccuccggcggcggcaaguacugccucggcgagcgcaagcgcuaccgcuccugcaacaccgaccccugcccccucggcucccgcgacuuccgcgagaagcagugcgccgacuucgacaacaugcccuuccgcggcaaguacuacaacuggaagcccuacaccggcggcggcgucaagcccugcgcccucaacugccucgccgagggcuacaacuucuacaccgagcgcgcccccgccgucaucgacggcacccagugcaacgccgacucccucgacaucugcaucaacggcgagugcaagcacgucggcugcgacaacauccucggcuccgacgcccgcgaggaccgcugccgcgucugcggcggcgacggcuccaccugcgacgccaucgagggcuucuucaacgacucccucccccgcggcggcuacauggaggucguccagaucccccgcggcuccguccacaucgagguccgcgaggucgccauguccaagaacuacaucgcccucaaguccgagggcgacgacuacuacaucaacggcgccuggaccaucgacuggccccgcaaguucgacgucgccggcaccgccuuccacuacaagcgccccaccgacgagcccgagucccucgaggcccucggccccaccuccgagaaccucaucgucaugguccuccuccaggagcagaaccucggcauccgcuacaaguucaacguccccaucacccgcaccggcuccggcgacaacgaggucggcuucaccuggaaccaccagcccugguccgagugcuccgccaccugcgccggcggcguccagcgccaggaggucgucugcaagcgccucgacgacaacuccaucguccagaacaacuacugcgaccccgacuccaagccccccgagaaccagcgcgccugcaacaccgagcccugcccccccgagugguucaucggcgacuggcucgagugcuccaagaccugcgacggcggcaugcgcacccgcgccguccucugcauccgcaagaucggccccuccgaggaggagacccucgacuacuccggcugccucacccaccgccccgucgagaaggagcccugcaacaaccaguccugccccccccagugggucgcccucgacugguccgagugcacccccaagugcggccccggcuucaagcaccgcaucguccucugcaaguccuccgaccucuccaagaccuuccccgccgcccagugccccgaggaguccaagccccccguccgcauccgcugcucccucggccgcugcccccccccccgcugggucaccggcgacuggggccagugcuccgcccagugcggccucggccagcagaugcgcaccguccagugccucuccuacaccggccaggccuccuccgacugccucgagaccguccgcccccccuccaugcagcagugcgaguccaagugcgacuccacccccaucuccaacaccgaggagugcaaggacgucaacaaggucgccuacugcccccucguccucaaguucaaguucugcucccgcgccuacuuccgccagaugugcugcaagaccugccagggccacuga

SEQ ID NO: 39394 - RNA, 5061 nt, Artificial Sequence
  derived and/or modified sequence opt2 from ADAMTS7__Homo_sapiens__NP_055087
augcccggcggccccuccccccgcucccccgccccccuccuccgcccccuccuccuccuccucugcgcccucgcccccggcgcccccggccccgcccccggccgcgccaccgagggccgcgccgcccucgacaucguccaccccguccgcgucgacgccggcggcuccuuccucuccuacgagcucuggccccgcgcccuccgcaagcgcgacgucuccguccgccgcgacgcccccgccuucuacgagcuccaguaccgcggccgcgagcuccgcuucaaccucaccgccaaccagcaccuccucgcccccggcuucgucuccgagacccgccgccgcggcggccucggccgcgcccacauccgcgcccacacccccgccugccaccuccucggcgagguccaggaccccgagcucgagggcggccucgccgccaucuccgccugcgacggccucaagggcgucuuccagcucuccaacgaggacuacuucaucgagccccucgacuccgcccccgcccgccccggccacgcccagccccacgucgucuacaagcgccaggcccccgagcgccucgcccagcgcggcgacuccuccgcccccuccaccugcggcguccaggucuaccccgagcucgagucccgccgcgagcgcugggagcagcgccagcaguggcgccgcccccgccuccgccgccuccaccagcgcuccgucuccaaggagaagugggucgagacccucgucgucgccgacgccaagauggucgaguaccacggccagccccaggucgaguccuacguccucaccaucaugaacauggucgccggccucuuccacgaccccuccaucggcaaccccauccacaucaccaucguccgccucguccuccucgaggacgaggaggaggaccucaagaucacccaccacgccgacaacacccucaaguccuucugcaaguggcagaaguccaucaacaugaagggcgacgcccacccccuccaccacgacaccgccauccuccucacccgcaaggaccucugcgccgccaugaaccgccccugcgagacccucggccucucccacgucgccggcaugugccagccccaccgcuccugcuccaucaacgaggacaccggccucccccucgccuucaccgucgcccacgagcucggccacuccuucggcauccagcacgacggcuccggcaacgacugcgagcccgucggcaagcgccccuucaucauguccccccagcuccucuacgacgccgccccccucaccuggucccgcugcucccgccaguacaucacccgcuuccucgaccgcggcuggggccucugccucgacgacccccccgccaaggacaucaucgacuuccccuccgucccccccggcguccucuacgacgucucccaccagugccgccuccaguacggcgccuacuccgccuucugcgaggacauggacaacgucugccacacccucuggugcuccgucggcaccaccugccacuccaagcucgacgccgccgucgacggcacccgcugcggcgagaacaaguggugccucuccggcgagugcguccccgucggcuuccgccccgaggccgucgacggcggcugguccggcugguccgccugguccaucugcucccgcuccugcggcaugggcguccaguccgccgagcgccagugcacccagcccacccccaaguacaagggccgcuacugcgucggcgagcgcaagcgcuuccgccucugcaaccuccaggccugccccgccggccgccccuccuuccgccacguccagugcucccacuucgacgccaugcucuacaagggccagcuccacaccuggguccccgucgucaacgacgucaaccccugcgagcuccacugccgccccgccaacgaguacuucgccgagaagcuccgcgacgccgucgucgacggcacccccugcuaccagguccgcgccucccgcgaccucugcaucaacggcaucugcaagaacgucggcugcgacuucgagaucgacuccggcgccauggaggaccgcugcggcgucugccacggcaacggcuccaccugccacaccgucuccggcaccuucgaggaggccgagggccucggcuacgucgacgucggccucauccccgccggcgcccgcgagauccgcauccaggaggucgccgaggccgccaacuuccucgcccuccgcuccgaggaccccgagaaguacuuccucaacggcggcuggaccauccaguggaacggcgacuaccaggucgccggcaccaccuucaccuacgcccgccgcggcaacugggagaaccucaccucccccggccccaccaaggagcccgucuggauccagcuccucuuccaggaguccaaccccggcguccacuacgaguacaccauccaccgcgaggccggcggccacgacgagguccccccccccgucuucuccuggcacuacggccccuggaccaagugcaccgucaccugcggccgcggcguccagcgccagaacgucuacugccucgagcgccaggccggccccgucgacgaggagcacugcgacccccucggccgccccgacgaccagcagcgcaagugcuccgagcagcccugccccgcccgcuggugggccggcgaguggcagcucugcuccuccuccugcggccccggcggccucucccgccgcgccguccucugcauccgcuccgucggccucgacgagcaguccgcccucgagccccccgccugcgagcaccucccccgcccccccaccgagacccccugcaaccgccacguccccugccccgccaccugggccgucggcaacuggucccagugcuccgucaccugcggcgagggcacccagcgccgcaacguccucugcaccaacgacaccggcguccccugcgacgaggcccagcagcccgccuccgaggucaccugcucccucccccucugccgcuggccccucggcacccucggccccgagggcuccggcuccggcuccuccucccacgagcucuucaacgaggccgacuucaucccccaccaccucgccccccgccccucccccgccuccucccccaagcccggcaccaugggcaacgccaucgaggaggaggcccccgagcucgaccuccccggccccgucuucgucgacgacuucuacuacgacuacaacuucaucaacuuccacgaggaccucuccuacggccccuccgaggagcccgaccucgaccucgccggcaccggcgaccgcaccccccccccccacucccaccccgccgcccccuccaccggcucccccguccccgccaccgagccccccgccgccaaggaggagggcguccucggccccuggucccccucccccuggcccucccaggccggccgcuccccccccccccccuccgagcagacccccggcaacccccucaucaacuuccuccccgaggaggacacccccaucggcgcccccgaccucggccuccccucccucuccuggccccgcgucuccaccgacggccuccagacccccgccacccccgagucccagaacgacuuccccgucggcaaggacucccagucccagcuccccccccccuggcgcgaccgcaccaacgaggucuucaaggacgacgaggagcccaagggccgcggcgccccccaccuccccccccgccccuccuccacccuccccccccucucccccgucggcuccacccacuccucccccucccccgacgucgccgagcucuggaccggcggcaccgucgccugggagcccgcccucgagggcggccucggccccgucgacuccgagcucuggcccaccgucggcgucgccucccuccuccccccccccaucgccccccuccccgagaugaagguccgcgacuccucccucgagcccggcacccccuccuuccccacccccggccccggcuccugggaccuccagaccgucgccgucuggggcaccuuccuccccaccacccucaccggccucggccacaugcccgagcccgcccucaaccccggccccaagggccagcccgagucccucucccccgaggucccccucuccucccgccuccucuccacccccgccugggacucccccgccaacucccaccgcguccccgagacccagccccucgcccccucccucgccgaggccggcccccccgccgacccccucgucguccgcaacgccggcuggcaggccggcaacugguccgagugcuccaccaccugcggccucggcgccgucuggcgccccguccgcugcuccuccggccgcgacgaggacugcgcccccgccggccgcccccagcccgcccgccgcugccaccuccgccccugcgccaccuggcacuccggcaacugguccaagugcucccgcuccugcggcggcggcuccuccguccgcgacguccagugcgucgacacccgcgaccuccgcccccuccgccccuuccacugccagcccggccccgccaagccccccgcccaccgccccugcggcgcccagcccugccucuccugguacaccuccuccuggcgcgagugcuccgaggccugcggcggcggcgagcagcagcgccucgucaccugccccgagcccggccucugcgaggaggcccuccgccccaacaccacccgccccugcaacacccaccccugcacccagugggucgucggccccuggggccagugcuccggccccugcggcggcggcguccagcgccgccucgucaagugcgucaacacccagaccggccuccccgaggaggacuccgaccagugcggccacgaggccuggcccgaguccucccgccccugcggcaccgaggacugcgagcccgucgagcccccccgcugcgagcgcgaccgccucuccuucggcuucugcgagacccuccgccuccucggccgcugccagcuccccaccauccgcacccagugcugccgcuccugcuccccccccucccacggcgcccccucccgcggccaccagcgcgucgcccgccgcuga

SEQ ID NO: 39395 - RNA, 2670 nt, Artificial Sequence
  derived and/or modified sequence opt2 from ADAMTS8__Homo_sapiens__NP_008968
augcuccccgcccccgccgccccccgcuggcccccccuccuccuccuccuccuccuccuccucccccucgcccgcggcgcccccgcccgccccgccgccggcggccaggccuccgagcucgucguccccacccgccuccccggcuccgccggcgagcucgcccuccaccucuccgccuucggcaagggcuucguccuccgccucgcccccgacgacuccuuccucgcccccgaguucaagaucgagcgccucggcggcuccggccgcgccaccggcggcgagcgcggccuccgcggcugcuucuucuccggcaccgucaacggcgagcccgagucccucgccgccgucucccucugccgcggccucuccggcuccuuccuccucgacggcgaggaguucaccauccagccccagggcgccggcggcucccucgcccagccccaccgccuccagcgcuggggccccgccggcgcccgcccccucccccgcggccccgagugggaggucgagaccggcgagggccagcgccaggagcgcggcgaccaccaggaggacuccgaggaggagucccaggaggaggaggccgagggcgccuccgagcccccccccccccucggcgccaccucccgcaccaagcgcuucgucuccgaggcccgcuucgucgagacccuccucgucgccgacgccuccauggccgccuucuacggcgccgaccuccagaaccacauccucacccucauguccgucgccgcccgcaucuacaagcaccccuccaucaagaacuccaucaaccucauggucgucaagguccucaucgucgaggacgagaaguggggccccgaggucuccgacaacggcggccucacccuccgcaacuucugcaacuggcagcgccgcuucaaccagcccuccgaccgccaccccgagcacuacgacaccgccauccuccucacccgccagaacuucugcggccaggagggccucugcgacacccucggcgucgccgacaucggcaccaucugcgaccccaacaaguccugcuccgucaucgaggacgagggccuccaggccgcccacacccucgcccacgagcucggccacguccucuccaugccccacgacgacuccaagcccugcacccgccucuucggccccaugggcaagcaccacgucauggccccccucuucguccaccucaaccagacccuccccuggucccccugcuccgccauguaccucaccgagcuccucgacggcggccacggcgacugccuccucgacgcccccgccgccgcccucccccuccccaccggccuccccggccgcauggcccucuaccagcucgaccagcagugccgccagaucuucggccccgacuuccgccacugccccaacaccuccgcccaggacgucugcgcccagcucuggugccacaccgacggcgccgagccccucugccacaccaagaacggcucccuccccugggccgacggcacccccugcggccccggccaccucugcuccgagggcuccugccuccccgaggaggaggucgagcgccccaagcccgucgccgacggcggcugggcccccuggggccccuggggcgagugcucccgcaccugcggcggcggcguccaguucucccaccgcgagugcaaggaccccgagccccagaacggcggccgcuacugccucggccgccgcgccaaguaccaguccugccacaccgaggagugcccccccgacggcaaguccuuccgcgagcagcagugcgagaaguacaacgccuacaacuacaccgacauggacggcaaccuccuccaguggguccccaaguacgccggcgucuccccccgcgaccgcugcaagcucuucugccgcgcccgcggccgcuccgaguucaaggucuucgaggccaaggucaucgacggcacccucugcggccccgagacccucgccaucugcguccgcggccagugcgucaaggccggcugcgaccacgucgucgacuccccccgcaagcucgacaagugcggcgucugcggcggcaagggcaacuccugccgcaaggucuccggcucccucacccccaccaacuacggcuacaacgacaucgucaccauccccgccggcgccaccaacaucgacgucaagcagcgcucccaccccggcguccagaacgacggcaacuaccucgcccucaagaccgccgacggccaguaccuccucaacggcaaccucgccaucuccgccaucgagcaggacauccucgucaagggcaccauccucaaguacuccggcuccaucgccacccucgagcgccuccaguccuuccgcccccuccccgagccccucaccguccagcuccucaccguccccggcgaggucuucccccccaaggucaaguacaccuucuucguccccaacgacgucgacuucuccaugcaguccuccaaggagcgcgccaccaccaacaucauccagccccuccuccacgcccaguggguccucggcgacugguccgagugcuccuccaccugcggcgccggcuggcagcgccgcaccgucgagugccgcgaccccuccggccaggccuccgccaccugcaacaaggcccucaagcccgaggacgccaagcccugcgagucccagcucugcccccucuga

SEQ ID NO: 39396 - RNA, 5808 nt, Artificial Sequence
  derived and/or modified sequence opt2 from ADAMTS9__Homo_sapiens__NP_891550
augcaguucgucuccugggccacccuccucacccuccucguccgcgaccucgccgagaugggcucccccgacgccgccgccgccguccgcaaggaccgccuccacccccgccaggucaagcuccucgagacccucuccgaguacgagaucgucucccccauccgcgucaacgcccucggcgagcccuuccccaccaacguccacuucaagcgcacccgccgcuccaucaacuccgccaccgaccccuggcccgccuucgccuccuccuccuccuccuccaccuccucccaggcccacuaccgccucuccgccuucggccagcaguuccucuucaaccucaccgccaacgccggcuucaucgccccccucuucaccgucacccuccucggcacccccggcgucaaccagaccaaguucuacuccgaggaggaggccgagcucaagcacugcuucuacaagggcuacgucaacaccaacuccgagcacaccgccgucaucucccucugcuccggcaugcucggcaccuuccgcucccacgacggcgacuacuucaucgagccccuccaguccauggacgagcaggaggacgaggaggagcagaacaagccccacaucaucuaccgccgcuccgccccccagcgcgagcccuccaccggccgccacgccugcgacaccuccgagcacaagaaccgccacuccaaggacaagaagaagacccgcgcccgcaaguggggcgagcgcaucaaccucgccggcgacgucgccgcccucaacuccggccucgccaccgaggccuucuccgccuacggcaacaagaccgacaacacccgcgagaagcgcacccaccgccgcaccaagcgcuuccucuccuacccccgcuucgucgagguccucgucgucgccgacaaccgcauggucuccuaccacggcgagaaccuccagcacuacauccucacccucauguccaucgucgccuccaucuacaaggaccccuccaucggcaaccucaucaacaucgucaucgucaaccucaucgucauccacaacgagcaggacggccccuccaucuccuucaacgcccagaccacccucaagaacuucugccaguggcagcacuccaagaacucccccggcggcauccaccacgacaccgccguccuccucacccgccaggacaucugccgcgcccacgacaagugcgacacccucggccucgccgagcucggcaccaucugcgaccccuaccgcuccugcuccaucuccgaggacuccggccucuccaccgccuucaccaucgcccacgagcucggccacgucuucaacaugccccacgacgacaacaacaagugcaaggaggagggcgucaaguccccccagcacgucauggcccccacccucaacuucuacaccaaccccuggaugugguccaagugcucccgcaaguacaucaccgaguuccucgacaccggcuacggcgagugccuccucaacgagcccgagucccgccccuacccccuccccguccagcuccccggcauccucuacaacgucaacaagcagugcgagcucaucuucggccccggcucccaggucugccccuacaugaugcagugccgccgccucuggugcaacaacgucaacggcguccacaagggcugccgcacccagcacacccccugggccgacggcaccgagugcgagcccggcaagcacugcaaguacggcuucugcguccccaaggagauggacguccccgucaccgacggcuccuggggcuccuggucccccuucggcaccugcucccgcaccugcggcggcggcaucaagaccgccauccgcgagugcaaccgccccgagcccaagaacggcggcaaguacugcgucggccgccgcaugaaguucaaguccugcaacaccgagcccugccucaagcagaagcgcgacuuccgcgacgagcagugcgcccacuucgacggcaagcacuucaacaucaacggccuccuccccaacguccgcuggguccccaaguacuccggcauccucaugaaggaccgcugcaagcucuucugccgcgucgccggcaacaccgccuacuaccagcuccgcgaccgcgucaucgacggcacccccugcggccaggacaccaacgacaucugcguccagggccucugccgccaggccggcugcgaccacguccucaacuccaaggcccgccgcgacaagugcggcgucugcggcggcgacaacuccuccugcaagaccgucgccggcaccuucaacaccguccacuacggcuacaacaccgucguccgcauccccgccggcgccaccaacaucgacguccgccagcacuccuucuccggcgagaccgacgacgacaacuaccucgcccucuccuccuccaagggcgaguuccuccucaacggcaacuucgucgucaccauggccaagcgcgagauccgcaucggcaacgccgucgucgaguacuccggcuccgagaccgccgucgagcgcaucaacuccaccgaccgcaucgagcaggagcuccuccuccagguccucuccgucggcaagcucuacaaccccgacguccgcuacuccuucaacauccccaucgaggacaagccccagcaguucuacuggaacucccacggccccuggcaggccugcuccaagcccugccagggcgagcgcaagcgcaagcucgucugcacccgcgaguccgaccagcucaccgucuccgaccagcgcugcgaccgccucccccagcccggccacaucaccgagcccugcggcaccgacugcgaccuccgcuggcacgucgccucccgcuccgagugcuccgcccagugcggccucggcuaccgcacccucgacaucuacugcgccaaguacucccgccucgacggcaagaccgagaaggucgacgacggcuucugcuccucccaccccaagcccuccaaccgcgagaagugcuccggcgagugcaacaccggcggcuggcgcuacuccgccuggaccgagugcuccaaguccugcgacggcggcacccagcgccgccgcgccaucugcgucaacacccgcaacgacguccucgacgacuccaagugcacccaccaggagaaggucaccauccagcgcugcuccgaguuccccugcccccaguggaaguccggcgacugguccgagugccucgucaccugcggcaagggccacaagcaccgccaggucuggugccaguucggcgaggaccgccucaacgaccgcaugugcgaccccgagaccaagcccaccuccaugcagaccugccagcagcccgagugcgccuccuggcaggccggccccuggggccagugcuccgucaccugcggccagggcuaccagcuccgcgccgucaagugcaucaucggcaccuacauguccgucgucgacgacaacgacugcaacgccgccacccgccccaccgacacccaggacugcgagcuccccuccugccaccccccccccgccgcccccgagacccgccgcuccaccuacuccgccccccgcacccaguggcgcuucggcuccuggacccccugcuccgccaccugcggcaagggcacccgcaugcgcuacgucuccugccgcgacgagaacggcuccgucgccgacgaguccgccugcgccacccucccccgccccgucgccaaggaggagugcuccgucacccccugcggccaguggaaggcccucgacugguccuccugcuccgucaccugcggccagggccgcgccacccgccaggucaugugcgucaacuacuccgaccacgucaucgaccgcuccgagugcgaccaggacuacauccccgagaccgaccaggacugcuccaugucccccugcccccagcgcacccccgacuccggccucgcccagcaccccuuccagaacgaggacuaccgcccccgcuccgccucccccucccgcacccacguccucggcggcaaccaguggcgcaccggccccuggggcgccugcuccuccaccugcgccggcggcucccagcgccgcgucgucgucugccaggacgagaacggcuacaccgccaacgacugcgucgagcgcaucaagcccgacgagcagcgcgccugcgaguccggccccugcccccagugggccuacggcaacuggggcgagugcaccaagcucugcggcggcggcauccgcacccgccucgucgucugccagcgcuccaacggcgagcgcuuccccgaccucuccugcgagauccucgacaagccccccgaccgcgagcagugcaacacccacgccugcccccacgacgccgccugguccaccggccccugguccuccugcuccgucuccugcggccgcggccacaagcagcgcaacgucuacugcauggccaaggacggcucccaccucgaguccgacuacugcaagcaccucgccaagccccacggccaccgcaagugccgcggcggccgcugccccaaguggaaggccggcgccuggucccagugcuccgucuccugcggccgcggcguccagcagcgccacgucggcugccagaucggcacccacaagaucgcccgcgagaccgagugcaaccccuacacccgccccgaguccgagcgcgacugccagggcccccgcugcccccucuacaccuggcgcgccgaggaguggcaggagugcaccaagaccugcggcgagggcucccgcuaccgcaaggucgucugcgucgacgacaacaagaacgagguccacggcgcccgcugcgacgucuccaagcgccccgucgaccgcgaguccugcucccuccagcccugcgaguacgucuggaucaccggcgagugguccgagugcuccgucaccugcggcaagggcuacaagcagcgccucgucuccugcuccgagaucuacaccggcaaggagaacuacgaguacuccuaccagaccaccaucaacugccccggcacccagccccccuccguccaccccugcuaccuccgcgacugccccgucuccgccaccuggcgcgucggcaacuggggcuccugcuccgucuccugcggcgucggcgucaugcagcgcuccguccagugccucaccaacgaggaccagcccucccaccucugccacaccgaccucaagcccgaggagcgcaagaccugccgcaacgucuacaacugcgagcucccccagaacugcaaggaggucaagcgccucaagggcgccuccgaggacggcgaguacuuccucaugauccgcggcaagcuccucaagaucuucugcgccggcaugcacuccgaccaccccaaggaguacgucacccucguccacggcgacuccgagaacuucuccgaggucuacggccaccgccuccacaaccccaccgagugccccuacaacggcucccgccgcgacgacugccagugccgcaaggacuacaccgccgccggcuucuccuccuuccagaagauccgcaucgaccucaccuccaugcagaucaucaccaccgaccuccaguucgcccgcaccuccgagggccaccccguccccuucgccaccgccggcgacugcuacuccgccgccaagugcccccagggccgcuucuccaucaaccucuacggcaccggccucucccucaccgaguccgcccgcuggaucucccagggcaacuacgccgucuccgacaucaagaagucccccgacggcacccgcgucgucggcaagugcggcggcuacugcggcaagugcacccccuccuccggcaccggccucgagguccgcguccucuga

SEQ ID NO: 39397 - RNA, 5289 nt, Artificial Sequence
  derived and/or modified sequence opt2 from ADAMTSL1__Homo_sapiens__NP_001035362
auggagugcugccgccgcgccacccccggcacccuccuccucuuccucgccuuccuccuccucuccucccgcaccgcccgcuccgaggaggaccgcgacggccucugggacgccuggggccccugguccgagugcucccgcaccugcggcggcggcgccuccuacucccuccgccgcugccucuccuccaaguccugcgagggccgcaacauccgcuaccgcaccugcuccaacgucgacugcccccccgaggccggcgacuuccgcgcccagcagugcuccgcccacaacgacgucaagcaccacggccaguucuacgaguggcuccccgucuccaacgaccccgacaaccccugcucccucaagugccaggccaagggcaccacccucgucgucgagcucgcccccaagguccucgacggcacccgcugcuacaccgagucccucgacaugugcaucuccggccucugccagaucgucggcugcgaccaccagcucggcuccaccgucaaggaggacaacugcggcgucugcaacggcgacggcuccaccugccgccucguccgcggccaguacaagucccagcucuccgccaccaaguccgacgacaccgucgucgccauccccuacggcucccgccacauccgccucguccucaagggccccgaccaccucuaccucgagaccaagacccuccagggcaccaagggcgagaacucccucuccuccaccggcaccuuccucgucgacaacuccuccgucgacuuccagaaguuccccgacaaggagauccuccgcauggccggcccccucaccgccgacuucaucgucaagauccgcaacuccggcuccgccgacuccaccguccaguucaucuucuaccagcccaucauccaccgcuggcgcgagaccgacuucuuccccugcuccgccaccugcggcggcggcuaccagcucaccuccgccgagugcuacgaccuccgcuccaaccgcgucgucgccgaccaguacugccacuacuaccccgagaacaucaagcccaagcccaagcuccaggagugcaaccucgaccccugccccgccuccgacggcuacaagcagaucaugcccuacgaccucuaccacccccucccccgcugggaggccacccccuggaccgccugcuccuccuccugcggcggcggcauccagucccgcgccgucuccugcgucgaggaggacauccagggccacgucaccuccgucgaggaguggaagugcauguacacccccaagaugcccaucgcccagcccugcaacaucuucgacugccccaaguggcucgcccaggaguggucccccugcaccgucaccugcggccagggccuccgcuaccgcgucguccucugcaucgaccaccgcggcaugcacaccggcggcugcucccccaagaccaagccccacaucaaggaggagugcaucguccccacccccugcuacaagcccaaggagaagcuccccgucgaggccaagcuccccugguucaagcaggcccaggagcucgaggagggcgccgccgucuccgaggagcccuccuucauccccgaggccugguccgccugcaccgucaccugcggcgucggcacccagguccgcaucguccgcugccagguccuccucuccuucucccaguccgucgccgaccuccccaucgacgagugcgagggccccaagcccgccucccagcgcgccugcuacgccggccccugcuccggcgagauccccgaguucaaccccgacgagaccgacggccucuucggcggccuccaggacuucgacgagcucuacgacugggaguacgagggcuucaccaagugcuccgaguccugcggcggcggcguccaggaggccgucgucuccugccucaacaagcagacccgcgagcccgccgaggagaaccucugcgucaccucccgccgccccccccagcuccucaaguccugcaaccucgaccccugccccgcccgcugggagaucggcaaguggucccccugcucccucaccugcggcgucggccuccagacccgcgacgucuucugcucccaccuccucucccgcgagaugaacgagaccgucauccucgccgacgagcucugccgccagcccaagcccuccaccguccaggccugcaaccgcuucaacugcccccccgccugguaccccgcccaguggcagcccugcucccgcaccugcggcggcggcguccagaagcgcgagguccucugcaagcagcgcauggccgacggcuccuuccucgagcuccccgagaccuucugcuccgccuccaagcccgccugccagcaggccugcaagaaggacgacugccccuccgaguggcuccucuccgacuggaccgagugcuccaccuccugcggcgagggcacccagacccgcuccgccaucugccgcaagaugcucaagaccggccucuccaccgucgucaacuccacccucugccccccccuccccuucuccuccuccauccgccccugcaugcucgccaccugcgcccgccccggccgccccuccaccaagcacuccccccacaucgccgccgcccgcaaggucuacauccagacccgccgccagcgcaagcuccacuucgucgucggcggcuucgccuaccuccuccccaagaccgccgucguccuccgcugccccgcccgccgcguccgcaagccccucaucaccugggagaaggacggccagcaccucaucuccuccacccacgucaccgucgcccccuucggcuaccucaagauccaccgccucaagcccuccgacgccggcgucuacaccugcuccgccggccccgcccgcgagcacuucgucaucaagcucaucggcggcaaccgcaagcucgucgcccgcccccucuccccccgcuccgaggaggagguccucgccggccgcaagggcggccccaaggaggcccuccagacccacaagcaccagaacggcaucuucuccaacggcuccaaggccgagaagcgcggccucgccgccaaccccggcucccgcuacgacgaccucgucucccgccuccucgagcagggcggcuggcccggcgagcuccucgccuccugggaggcccaggacuccgccgagcgcaacaccaccuccgaggaggaccccggcgccgagcagguccuccuccaccuccccuucaccauggucaccgagcagcgccgccucgacgacauccucggcaaccucucccagcagcccgaggagcuccgcgaccucuacuccaagcaccucgucgcccagcucgcccaggagaucuuccgcucccaccucgagcaccaggacacccuccucaagcccuccgagcgccgcaccucccccgucacccucuccccccacaagcacgucuccggcuucuccuccucccuccgcaccuccuccaccggcgacgccggcggcggcucccgccgcccccaccgcaagcccaccauccuccgcaagaucuccgccgcccagcagcucuccgccuccgaggucgucacccaccucggccagaccgucgcccucgccuccggcacccucuccguccuccuccacugcgaggccaucggccacccccgccccaccaucuccugggcccgcaacggcgaggagguccaguucuccgaccgcauccuccuccagcccgacgacucccuccagauccucgcccccgucgaggccgacgucggcuucuacaccugcaacgccaccaacgcccucggcuacgacuccgucuccaucgccgucacccucgccggcaagccccucgucaagaccucccgcaugaccgucaucaacaccgagaagcccgccgucaccgucgacaucggcuccaccaucaagaccguccagggcgucaacgucaccaucaacugccaggucgccggcguccccgaggccgaggucaccugguuccgcaacaaguccaagcucggcuccccccaccaccuccacgagggcucccuccuccucaccaacgucuccuccuccgaccagggccucuacuccugccgcgccgccaaccuccacggcgagcucaccgaguccacccagcuccucauccucgaccccccccagguccccacccagcucgaggacauccgcgcccuccucgccgccaccggccccaaccuccccuccguccucaccuccccccucggcacccagcucguccucgaccccggcaacuccgcccuccucggcugccccaucaagggccaccccguccccaacaucaccugguuccacggcggccagcccaucgucaccgccaccggccucacccaccacauccucgccgccggccagauccuccaggucgccaaccucuccggcggcucccagggcgaguucuccugccucgcccagaacgaggccggcguccucaugcagaaggccucccucgucauccaggacuacuggugguccgucgaccgccucgccaccugcuccgccuccugcggcaaccgcggcguccagcagccccgccuccgcugccuccucaacuccaccgaggucaaccccgcccacugcgccggcaagguccgccccgccguccagcccaucgccugcaaccgccgcgacugccccucccgcuggauggucaccuccugguccgccugcacccgcuccugcggcggcggcguccagacccgccgcgucaccugccagaagcucaaggccuccggcaucuccacccccgucuccaacgacaugugcacccaggucgccaagcgccccgucgacacccaggccugcaaccagcagcucugcgucgagugggccuucuccuccuggggccagugcaacggccccugcaucggcccccaccucgccguccagcaccgccaggucuucugccagacccgcgacggcaucacccuccccuccgagcagugcuccgcccucccccgccccgucuccacccagaacugcugguccgaggccugcuccguccacuggcgcgucucccucuggacccucugcaccgccaccugcggcaacuacggcuuccagucccgccgcgucgagugcguccacgcccgcaccaacaaggccguccccgagcaccucugcuccuggggcccccgccccgccaacuggcagcgcugcaacaucacccccugcgagaacauggagugccgcgacaccacccgcuacugcgagaaggucaagcagcucaagcucugccagcucucccaguucaagucccgcugcugcggcaccugcggcaaggccuga

SEQ ID NO: 39398 - RNA, 2856 nt, Artificial Sequence
  derived and/or modified sequence opt2 from ADAMTSL2__Homo_sapiens__NP_001138792
auggacggccgcuggcagugcuccugcugggccugguuccuccucguccucgccgucgucgccggcgacaccgucuccaccggcuccaccgacaacucccccaccuccaacucccucgagggcggcaccgacgccaccgccuucugguggggcgaguggaccaaguggaccgccugcucccgcuccugcggcggcggcgucaccucccaggagcgccacugccuccagcagcgccgcaaguccguccccggccccggcaaccgcaccugcaccggcaccuccaagcgcuaccagcucugccgcguccaggagugcccccccgacggccgcuccuuccgcgaggagcagugcgucuccuucaacucccacgucuacaacggccgcacccaccaguggaagccccucuaccccgacgacuacguccacaucuccuccaagcccugcgaccuccacugcaccaccgucgacggccagcgccagcucaugguccccgcccgcgacggcaccuccugcaagcucaccgaccuccgcggcgucugcgucuccggcaagugcgagcccaucggcugcgacggcguccucuucuccacccacacccucgacaagugcggcaucugccagggcgacggcuccuccugcacccacgucaccggcaacuaccgcaagggcaacgcccaccucggcuacucccucgucacccacauccccgccggcgcccgcgacauccagaucgucgagcgcaagaaguccgccgacguccucgcccucgccgacgaggccggcuacuacuucuucaacggcaacuacaaggucgacucccccaagaacuucaacaucgccggcaccgucgucaaguaccgccgccccauggacgucuacgagaccggcaucgaguacaucgucgcccagggccccaccaaccagggccucaacgucauggucuggaaccagaacggcaagucccccuccaucaccuucgaguacacccuccuccagcccccccacgagucccgcccccagcccaucuacuacggcuucuccgaguccgccgagucccagggccucgacggcgccggccucaugggcuucgucccccacaacggcucccucuacggccaggccuccuccgagcgccucggccucgacaaccgccucuucggccaccccggccucgacauggagcucggccccucccagggccaggagaccaacgaggucugcgagcaggccggcggcggcgccugcgagggccccccccgcggcaagggcuuccgcgaccgcaacgucaccggcaccccccucaccggcgacaaggacgacgaggaggucgacacccacuucgccucccaggaguucuucuccgccaacgccaucuccgaccagcuccucggcgccggcuccgaccucaaggacuucacccucaacgagaccgucaacuccaucuucgcccagggcgccccccgcuccucccucgccgaguccuucuucgucgacuacgaggagaacgagggcgccggccccuaccuccucaacggcuccuaccucgagcucuccuccgaccgcgucgccaacuccuccuccgaggcccccuuccccaacgucuccaccucccuccucaccuccgccggcaaccgcacccacaaggcccgcacccgccccaaggcccgcaagcagggcgucucccccgccgacauguaccgcuggaagcucuccucccacgagcccugcuccgccaccugcaccaccggcgucauguccgccuacgccaugugcguccgcuacgacggcgucgaggucgacgacuccuacugcgacgcccucacccgccccgagcccguccacgaguucugcgccggccgcgagugccagccccgcugggagaccuccuccugguccgagugcucccgcaccugcggcgagggcuaccaguuccgcgucguccgcugcuggaagaugcucucccccggcuucgacuccuccgucuacuccgaccucugcgaggccgccgaggccguccgccccgaggagcgcaagaccugccgcaaccccgccugcggcccccagugggagauguccgagugguccgagugcaccgccaagugcggcgagcgcuccgucgucacccgcgacauccgcugcuccgaggacgagaagcucugcgaccccaacacccgccccgucggcgagaagaacugcaccggcccccccugcgaccgccaguggaccgucuccgacuggggccccugcuccggcuccugcggccagggccgcaccauccgccacgucuacugcaagaccuccgacggccgcgucguccccgagucccagugccagauggagaccaagccccucgccauccaccccugcggcgacaagaacugccccgcccacuggcucgcccaggacugggagcgcugcaacaccaccugcggccgcggcgucaagaagcgccucguccucugcauggagcucgccaacggcaagccccagacccgcuccggccccgagugcggccucgccaagaagccccccgaggaguccaccugcuucgagcgccccugcuucaagugguacaccucccccugguccgagugcaccaagaccugcggcgucggcguccgcaugcgcgacgucaagugcuaccagggcaccgacaucguccgcggcugcgacccccucgucaagcccgucggccgccaggccugcgaccuccagcccugccccaccgagccccccgacgacuccugccaggaccagcccggcaccaacugcgcccucgccaucaaggucaaccucugcggccacugguacuacuccaaggccugcugccgcuccugccgccccccccacuccuga

SEQ ID NO: 39399 - RNA, 5076 nt, Artificial Sequence
  derived and/or modified sequence opt2 from ADAMTSL3__Homo_sapiens__NP_997400
auggccuccuggaccucccccugguggguccucaucggcauggucuucaugcacuccccccucccccagaccaccgccgagaagucccccggcgccuacuuccuccccgaguucgcccucuccccccagggcuccuuccucgaggacaccaccggcgagcaguuccucaccuaccgcuacgacgaccagaccucccgcaacacccgcuccgacgaggacaaggacggcaacugggacgccuggggcgacugguccgacugcucccgcaccugcggcggcggcgccuccuacucccuccgccgcugccucaccggccgcaacugcgagggccagaacauccgcuacaagaccugcuccaaccacgacugcccccccgacgccgaggacuuccgcgcccagcagugcuccgccuacaacgacguccaguaccagggccacuacuacgaguggcucccccgcuacaacgaccccgccgcccccugcgcccucaagugccacgcccagggccagaaccucgucgucgagcucgcccccaagguccucgacggcacccgcugcaacaccgacucccucgacaugugcaucuccggcaucugccaggccgucggcugcgaccgccagcucggcuccaacgccaaggaggacaacugcggcgucugcgccggcgacggcuccaccugccgccucguccgcggccaguccaagucccacgucucccccgagaagcgcgaggagaacgucaucgccgucccccucggcucccgcuccguccgcaucaccgucaagggccccgcccaccucuucaucgaguccaagacccuccagggcuccaagggcgagcacuccuucaacucccccggcgucuuccucgucgagaacaccaccgucgaguuccagcgcggcuccgagcgccagaccuucaagauccccggcccccucauggccgacuucaucuucaagacccgcuacaccgccgccaaggacuccgucguccaguucuucuucuaccagcccaucucccaccaguggcgccagaccgacuucuuccccugcaccgucaccugcggcggcggcuaccagcucaacuccgccgagugcgucgacauccgccucaagcgcgucguccccgaccacuacugccacuacuaccccgagaacgucaagcccaagcccaagcucaaggagugcuccauggaccccugccccuccuccgacggcuucaaggagaucaugcccuacgaccacuuccagccccucccccgcugggagcacaaccccuggaccgccugcuccgucuccugcggcggcggcauccagcgccgcuccuucgucugcgucgaggaguccaugcacggcgagauccuccaggucgaggaguggaagugcauguacgcccccaagcccaaggucaugcagaccugcaaccucuucgacugccccaaguggaucgccauggaguggucccagugcaccgucaccugcggccgcggccuccgcuaccgcgucguccucugcaucaaccaccgcggcgagcacgucggcggcugcaacccccagcucaagcuccacaucaaggaggagugcgucauccccauccccugcuacaagcccaaggagaagucccccgucgaggccaagcuccccuggcucaagcaggcccaggagcucgaggagacccgcaucgccaccgaggagcccaccuucauccccgagcccugguccgccugcuccaccaccugcggccccggcguccagguccgcgaggucaagugccgcguccuccucaccuucacccagaccgagaccgagcuccccgaggaggagugcgagggccccaagcuccccaccgagcgccccugccuccucgaggccugcgacgagucccccgccucccgcgagcucgacaucccccuccccgaggacuccgagaccaccuacgacugggaguacgccggcuucacccccugcaccgccaccugcgucggcggccaccaggaggccaucgccgucugccuccacauccagacccagcagaccgucaacgacucccucugcgacaugguccaccgcccccccgccaugucccaggccugcaacaccgagcccugccccccccgcuggcacgucggcuccuggggccccugcuccgccaccugcggcgucggcauccagacccgcgacgucuacugccuccaccccggcgagacccccgccccccccgaggagugccgcgacgagaagccccacgcccuccaggccugcaaccaguucgacugcccccccggcuggcacaucgaggaguggcagcagugcucccgcaccugcggcggcggcacccagaaccgccgcgucaccugccgccagcuccucaccgacggcuccuuccucaaccucuccgacgagcucugccagggccccaaggccuccucccacaaguccugcgcccgcaccgacugccccccccaccucgccgucggcgacugguccaagugcuccgucuccugcggcgucggcauccagcgccgcaagcaggucugccagcgccucgccgccaagggccgccgcaucccccucuccgagaugaugugccgcgaccuccccggccucccccucguccgcuccugccagaugcccgagugcuccaagaucaaguccgagaugaagaccaagcucggcgagcagggcccccagauccucuccguccagcgcgucuacauccagacccgcgaggagaagcgcaucaaccucaccaucggcucccgcgccuaccuccuccccaacaccuccgucaucaucaagugccccguccgccgcuuccagaagucccucauccagugggagaaggacggccgcugccuccagaacuccaagcgccucggcaucaccaaguccggcucccucaagauccacggccucgccgcccccgacaucggcgucuaccgcugcaucgccggcuccgcccaggagaccgucguccucaagcucaucggcaccgacaaccgccucaucgcccgccccgcccuccgcgagcccaugcgcgaguaccccggcauggaccacuccgaggccaacucccucggcgucaccuggcacaagaugcgccagauguggaacaacaagaacgaccucuaccucgacgacgaccacaucuccaaccagcccuuccuccgcgcccuccucggccacugcuccaacuccgccggcuccaccaacuccugggagcucaagaacaagcaguucgaggccgccgucaagcagggcgccuacuccauggacaccgcccaguucgacgagcucauccgcaacaugucccagcucauggagaccggcgaggucuccgacgaccucgccucccagcucaucuaccagcucgucgccgagcucgccaaggcccagcccacccacaugcaguggcgcggcauccaggaggagaccccccccgccgcccagcuccgcggcgagaccggcuccgucucccaguccucccacgccaagaacuccggcaagcucaccuucaagcccaagggccccguccucaugcgccagucccagccccccuccaucuccuucaacaagaccaucaacucccgcaucggcaacaccgucuacaucaccaagcgcaccgaggucaucaacauccucugcgaccucaucacccccuccgaggccaccuacaccuggaccaaggacggcacccuccuccagcccuccgucaagaucauccucgacggcaccggcaagauccagauccagaaccccacccgcaaggagcagggcaucuacgagugcuccgucgccaaccaccucggcuccgacgucgaguccuccuccguccucuacgccgaggcccccgucauccucuccgucgagcgcaacaucaccaagcccgagcacaaccaccucuccgucgucgucggcggcaucgucgaggccgcccucggcgccaacgucaccauccgcugccccgucaagggcgucccccagcccaacaucaccuggcucaagcgcggcggcucccucuccggcaacgucucccuccucuucaacggcucccuccuccuccagaacgucucccucgagaacgagggcaccuacgucugcaucgccaccaacgcccucggcaaggccgucgccaccuccguccuccaccuccucgagcgccgcuggcccgagucccgcaucgucuuccuccagggccacaagaaguacauccuccaggccaccaacacccgcaccaacuccaacgaccccaccggcgagccccccccccaggagcccuucugggagcccggcaacuggucccacugcuccgccaccugcggccaccucggcgcccgcauccagcgcccccagugcgucauggccaacggccaggaggucuccgaggcccucugcgaccaccuccagaagccccucgccggcuucgagcccugcaacauccgcgacugccccgcccgcugguucaccuccgucuggucccagugcuccgucuccugcggcgagggcuaccacucccgccaggucaccugcaagcgcaccaaggccaacggcaccguccaggucgucuccccccgcgccugcgcccccaaggaccgcccccucggccgcaagcccugcuucggccaccccugcguccagugggagcccggcaaccgcugccccggccgcugcaugggccgcgccguccgcaugcagcagcgccacaccgccugccagcacaacuccuccgacuccaacugcgacgaccgcaagcgccccacccuccgccgcaacugcaccuccggcgccugcgacgucugcuggcacaccggccccuggaagcccugcaccgccgccugcggccgcggcuuccagucccgcaaggucgacugcauccacacccgcuccugcaagcccgucgccaagcgccacugcguccagaagaagaagcccaucuccuggcgccacugccucggccccuccugcgaccgcgacugcaccgacaccacccacuacugcauguucgucaagcaccucaaccucugcucccucgaccgcuacaagcagcgcugcugccaguccugccaggagggcuga

SEQ ID NO: 39400 - RNA, 3393 nt, Artificial Sequence
  derived and/or modified sequence opt2 from ADAMTSL4__Homo_sapiens__XP_011507946
augcucgccccccgccgcgcccccuccaccccccgcugccuccgcuccuucugcgaccaguccgcccccgccucccccuggggcucccgcggcggcgccauggagaacuggaccggccgccccuggcucuaccuccuccuccuccucucccucccccagcucugccucgaccaggagguccucuccggccacucccuccagacccccaccgaggagggccagggccccgagggcgucuggggccccuggguccagugggccuccugcucccagcccugcggcgucggcguccagcgccgcucccgcaccugccagcuccccaccguccagcuccaccccucccucccccuccccccccgccccccccgccaccccgaggcccuccucccccgcggccagggcccccgcccccagaccucccccgagacccucccccucuaccgcacccagucccgcggccgcggcggcccccuccgcggccccgccucccaccucggccgcgaggagacccaggagauccgcgccgcccgccgcucccgccuccgcgaccccaucaagcccggcauguucggcuacggccgcguccccuucgcccucccccuccaccgcaaccgccgccacccccgcucccccccccgcuccgagcucucccucaucuccucccgcggcgaggaggccauccccucccccaccccccgcgccgagcccuucuccgccaacggcuccccccagaccgagcucccccccaccgagcucuccguccacacccccuccccccaggccgagccccucucccccgagaccgcccagaccgaggucgccccccgcacccgccccgccccccuccgccaccacccccgcgcccaggccuccggcaccgagccccccucccccacccacucccucggcgagggcggcuucuuccgcgccuccccccagccccgccgccccuccucccagggcugggccuccccccaggucgccggccgccgccccgaccccuuccccuccgucccccgcggccgcggccagcagggccagggccccuggggcaccggcggcaccccccacggcccccgccucgagcccgacccccagcaccccggcgccuggcucccccuccucuccaacggcccccacgccuccucccucuggucccucuucgcccccuccucccccaucccccgcugcuccggcgaguccgagcagcuccgcgccugcucccaggcccccugcccccccgagcagcccgacccccgcgcccuccagugcgccgccuucaacucccaggaguucaugggccagcucuaccagugggagcccuucaccgaggccccccuccucccccuccgccacgccuucuuccuccuccccggcgccggcuccggcgacuccaccggcguccagggcucccagcgcugcgagcucaacugccgcccccgcggcuuccgcuucuacguccgccacaccgagaagguccaggacggcacccucugccagcccggcgcccccgacaucugcgucgccggccgcugccucucccccggcugcgacggcauccucggcuccggccgccgccccgacggcugcggcgucugcggcggcgacgacuccaccugccgccucgucuccggcaaccucaccgaccgcggcggcccccucggcuaccagaagauccucuggauccccgccggcgcccuccgccuccagaucgcccagcuccgccccuccuccaacuaccucgcccuccgcggccccggcggccgcuccaucaucaacggcaacugggccgucgacccccccggcuccuaccgcgccggcggcaccgucuuccgcuacaaccgccccccccgcgaggagggcaagggcgagucccucuccgccgagggccccaccacccagcccgucgacgucuacaugaucuuccaggaggagaaccccggcgucuucuaccaguacgucaucuccucccccccccccauccucgagaaccccacccccgagccccccgucccccagcuccagcccgagauccuccgcgucgagcccccccucgcccccgccccccgccccgcccgcacccccggcacccuccagcgccagguccgcaucccccagaugcccgcccccccccacccccgcaccccccucggcucccccgccgccuacuggaagcgcgucggccacuccgccugcuccgccuccugcggcaagggcgucuggcgccccaucuuccucugcaucucccgcgaguccggcgaggagcucgacgagcgcuccugcgccgccggcgcccgcccccccgccucccccgagcccugccacggcacccccugcccccccuacugggaggccggcgaguggaccuccugcucccgcuccugcggccccggcacccagcaccgccagcuccagugccgccaggaguucggcggcggcggcuccuccgucccccccgagcgcugcggccaccucccccgccccaacaucacccaguccugccagcuccgccucugcggccacugggaggucggcucccccuggucccagugcuccguccgcugcggccgcggccagcgcucccgccagguccgcugcgucggcaacaacggcgacgaggucuccgagcaggagugcgccuccggccccccccagccccccucccgcgaggccugcgacaugggccccugcaccaccgccugguuccacuccgacugguccuccaagugcuccgccgagugcggcaccggcauccagcgccgcuccgucgucugccucggcuccggcgccgcccucggccccggccagggcgaggccggcgccggcaccggccaguccugccccaccggcucccgcccccccgacaugcgcgccugcucccucggccccugcgagcgcaccuggcgcugguacaccggccccuggggcgagugcuccuccgagugcggcuccggcacccagcgccgcgacaucaucugcgucuccaagcucggcaccgaguucaacgucaccucccccuccaacugcucccaccucccccgcccccccgcccuccagcccugccagggccaggccugccaggaccgcugguucuccacccccuggucccccugcucccgcuccugccagggcggcacccagacccgcgagguccagugccucuccaccaaccagacccucuccacccgcugccccccccagcuccgccccucccgcaagcgccccugcaacucccagcccugcucccagcgccccgacgaccagugcaaggacuccuccccccacugcccccucgucguccaggcccgccucugcgucuaccccuacuacaccgccaccugcugccgcuccugcgcccacguccucgagcgcuccccccaggaccccuccuga

SEQ ID NO: 39401 - RNA, 1416 nt, Artificial Sequence
  derived and/or modified sequence opt2 from ADAMTSL5__Homo_sapiens__NP_998769
auggacuccgccccccucuucccccgcccccaccucuuccagaaccuccuccucuuccucugggcccuccucaacugcggccucggcgucuccgcccagggccccggcgaguggacccccugggucuccuggacccgcugcuccuccuccugcggccgcggcgucuccguccgcucccgccgcugccuccgccuccccggcgaggagcccugcuggggcgacucccacgaguaccgccucugccagcuccccgacugcccccccggcgccguccccuuccgcgaccuccagugcgcccucuacaacggccgccccguccucggcacccagaagaccuaccaguggguccccuuccacggcgcccccaaccagugcgaccucaacugccucgccgagggccacgccuucuaccacuccuucggccgcguccucgacggcaccgccugcucccccggcgcccagggcgucugcgucgccggccgcugccucuccgccggcugcgacggccuccucggcuccggcgcccucgaggaccgcugcggccgcugcggcggcgccaacgacuccugccucuucguccagcgcgucuuccgcgacgccggcgccuucgccggcuacuggaacgucacccucauccccgagggcgcccgccacauccgcgucgagcaccgcucccgcaaccaccucgcccucaugggcggcgacggccgcuacguccucaacggccacugggucgucuccccccccggcaccuacgaggccgccggcacccacgucgucuacacccgcgacaccggcccccaggagacccuccaggccgccggccccaccucccacgaccuccuccuccagguccuccuccaggagcccaaccccggcaucgaguucgaguucuggcucccccgcgagcgcuacucccccuuccaggcccgcguccaggcccucggcuggccccuccgccagccccagccccgcggcgucgagccccagccccccgccgcccccgccgucacccccgcccagacccccacccucgcccccgaccccugcccccccugccccgacacccgcggccgcgcccaccgccuccuccacuacugcggcuccgacuucgucuuccaggcccgcguccucggccaccaccaccaggcccaggagacccgcuacgagguccgcauccagcucgucuacaagaaccgcuccccccuccgcgcccgcgaguacgucugggcccccggccacugccccugccccaugcucgccccccaccgcgacuaccucauggccguccagcgccucgucucccccgacggcacccaggaccagcuccuccucccccacgccggcuacgcccgccccuggucccccgccgaggacucccgcauccgccucaccgcccgccgcugccccggcuga

SEQ ID NO: 39402 - RNA, 1158 nt, Artificial Sequence
  derived and/or modified sequence opt2 from ADAP1__Homo_sapiens__NP_001271237
auguuccaguucgucuucucccgcgucuacugcaucaaccccgcccgccgcaaguggaaggaguucgagaagaugcucggcugcgccgaggagggccacgccucccucggccgcgaccccgacugggccuccuacacccucggcgucuucaucugccucuccugcuccggcauccaccgcaacaucccccaggucuccaaggucaaguccguccgccucgacgccugggaggaggcccaggucgaguucauggccucccacggcaacgacgccgcccgcgcccgcuucgaguccaagguccccuccuucuacuaccgccccacccccuccgacugccagcuccuccgcgagcaguggauccgcgccaaguacgagcgccaggaguucaucuaccccgagaagcaggagcccuacuccgccggcuaccgcgagggcuuccucuggaagcgcggccgcgacaacggccaguuccucucccgcaaguucguccucaccgagcgcgagggcgcccucaaguacuucaaccgcaacgacgccaaggagcccaaggccgucaugaagaucgagcaccucaacgccaccuuccagcccgccaagaucggccacccccacggccuccaggucaccuaccucaaggacaacuccacccgcaacaucuucaucuaccacgaggacggcaaggagaucgucgacugguucaacgcccuccgcgccgcccgcuuccacuaccuccaggucgccuuccccggcgccuccgacgccgaccucguccccaagcucucccgcaacuaccucaaggagggcuacauggagaagaccggccccaagcagaccgagggcuuccgcaagcgcugguucaccauggacgaccgccgccucauguacuucaaggacccccucgacgccuucgcccgcggcgaggucuucaucggcuccaaggaguccggcuacaccguccuccacggcuucccccccuccacccagggccaccacuggccccacggcaucaccaucgucacccccgaccgcaaguuccucuucgccugcgagaccgaguccgaccagcgcgagugggucgccgccuuccagaaggccgucgaccgccccaugcucccccaggaguacgccgucgaggcccacuucaagcacaagcccuga

SEQ ID NO: 39403 - RNA, 1146 nt, Artificial Sequence
  derived and/or modified sequence opt2 from ADAP2__Homo_sapiens__NP_060874
augggcgaccgcgagcgcaacaagaagcgccuccucgagcuccuccgcgcccccgacaccggcaacgcccacugcgccgacugcggcgccgccgaccccgacugggccuccuacaagcucggcaucuucaucugccucaacugcugcggcguccaccgcaacuuccccgacaucucccgcgucaaguccguccgccucgacuucugggacgacuccaucgucgaguucaugauccacaacggcaaccuccgcgucaaggccaaguucgaggcccgcguccccgccuucuacuacaucccccaggccaacgacugccucguccucaaggagcaguggauccgcgccaaguacgagcgccgcgaguucauggccgacggcgagaccaucucccuccccggcaaccgcgagggcuuccucuggaagcgcggccgcgacaacucccaguuccuccgccgcaaguucguccuccucgcccgcgagggccuccucaaguacuucaccaaggagcagggcaagucccccaaggccgucaucuccaucaaggaccucaacgccaccuuccagaccgagaagaucggccacccccacggccuccagaucaccuaccgccgcgacggccacacccgcaaccucuucgucuaccacgaguccggcaaggagaucgucgacugguucaacgcccuccgcgccgcccgccuccaguaccucaagauggccuuccccgagcuccccgaguccgagcucguccccuuccucacccgcaacuaccucaagcagggcuucauggagaagaccggccccaagcagaaggagcccuucaagaagcgcugguucgcccucgacugccacgagcgccgccuccucuacuacaagaacccccucgacgccuucgagcagggccaggucuuccucggcaacaaggagcagggcuacgaggccuacgaggaccuccccaagggcauccgcggcaaccgcuggaaggccggccucaccaucgucacccccgagcgccgcuucguccucaccugccccuccgagaaggagcagcaggaguggcucgagucccuccgcggcguccucuccuccccccucaccccccucaaccgccucaccgccuccaccgaguccggccgcuccucccgcuga

SEQ ID NO: 39404 - RNA, 2145 nt, Artificial Sequence
  derived and/or modified sequence opt2 from ADARB1__Homo_sapiens__NP_056649
auggacaucgaggacgaggagaacauguccuccuccuccaccgacgucaaggagaaccgcaaccucgacaacgucucccccaaggacggcuccacccccggccccggcgagggcucccagcucuccaacggcggcggcggcggccccggccgcaagcgcccccucgaggagggcuccaacggccacuccaaguaccgccucaagaagcgccgcaagacccccggccccguccuccccaagaacgcccucaugcagcucaacgagaucaagcccggccuccaguacacccuccucucccagaccggccccguccacgccccccucuucgucauguccgucgaggucaacggccaggucuucgagggcuccggccccaccaagaagaaggccaagcuccacgccgccgagaaggcccuccgcuccuucguccaguuccccaacgccuccgaggcccaccucgccaugggccgcacccucuccgucaacaccgacuucaccuccgaccaggccgacuuccccgacacccucuucaacggcuucgagacccccgacaaggccgagccccccuucuacgucggcuccaacggcgacgacuccuucuccuccuccggcgaccucucccucuccgccucccccguccccgccucccucgcccagcccccccuccccguccucccccccuuccccccccccuccggcaagaaccccgucaugauccucaacgagcuccgccccggccucaaguacgacuuccucuccgaguccggcgagucccacgccaaguccuucgucauguccgucgucgucgacggccaguucuucgagggcuccggccgcaacaagaagcucgccaaggcccgcgccgcccaguccgcccucgccgccaucuucaaccuccaccucgaccagacccccucccgccagcccauccccuccgagggccuccagcuccaccucccccagguccucgccgacgccgucucccgccucguccucggcaaguucggcgaccucaccgacaacuucuccuccccccacgcccgccgcaagguccucgccggcgucgucaugaccaccggcaccgacgucaaggacgccaaggucaucuccgucuccaccggcaccaagugcaucaacggcgaguacauguccgaccgcggccucgcccucaacgacugccacgccgagaucaucucccgccgcucccuccuccgcuuccucuacacccagcucgagcucuaccucaacaacaaggacgaccagaagcgcuccaucuuccagaaguccgagcgcggcggcuuccgccucaaggagaacguccaguuccaccucuacaucuccaccucccccugcggcgacgcccgcaucuucuccccccacgagcccauccucgagggcucccgcuccuacacccaggccggcguccaguggugcaaccacggcucccuccagccccgcccccccggccuccucuccgaccccuccaccuccaccuuccagggcgccggcaccaccgagcccgccgaccgccaccccaaccgcaaggcccgcggccagcuccgcaccaagaucgaguccggcgagggcaccauccccguccgcuccaacgccuccauccagaccugggacggcguccuccagggcgagcgccuccucaccauguccugcuccgacaagaucgcccgcuggaacgucgucggcauccagggcucccuccucuccaucuucgucgagcccaucuacuucuccuccaucauccucggcucccucuaccacggcgaccaccucucccgcgccauguaccagcgcaucuccaacaucgaggaccuccccccccucuacacccucaacaagccccuccucuccggcaucuccaacgccgaggcccgccagcccggcaaggcccccaacuucuccgucaacuggaccgucggcgacuccgccaucgaggucaucaacgccaccaccggcaaggacgagcucggccgcgccucccgccucugcaagcacgcccucuacugccgcuggaugcgcguccacggcaagguccccucccaccuccuccgcuccaagaucaccaagcccaacgucuaccacgaguccaagcucgccgccaaggaguaccaggccgccaagguccacuga

SEQ ID NO: 39405 - RNA, 2220 nt, Artificial Sequence
  derived and/or modified sequence opt2 from ADARB2__Homo_sapiens__NP_061172
auggccuccguccucggcuccggccgcggcuccggcggccucuccucccagcucaagugcaaguccaagcgccgccgccgccgccgcuccaagcgcaaggacaaggucuccauccucuccaccuuccucgcccccuucaagcaccucucccccggcaucaccaacaccgaggacgacgacacccucuccaccuccuccgccgaggucaaggagaaccgcaacgucggcaaccucgccgcccgccccccccccuccggcgaccgcgcccgcggcggcgcccccggcgccaagcgcaagcgcccccucgaggagggcaacggcggccaccucugcaagcuccagcucgucuggaagaagcucuccugguccgucgcccccaagaacgcccucguccagcuccacgagcuccgccccggccuccaguaccgcaccgucucccagaccggccccguccacgcccccgucuucgccgucgccgucgaggucaacggccucaccuucgagggcaccggccccaccaagaagaaggccaagaugcgcgccgccgagcucgcccuccgcuccuucguccaguuccccaacgccugccaggcccaccucgccaugggcggcggccccggccccggcaccgacuucaccuccgaccaggccgacuuccccgacacccucuuccaggaguucgagccccccgccccccgccccggccucgccggcggccgccccggcgacgccgcccuccucuccgccgccuacggccgccgccgccuccucugccgcgcccucgaccucgucggccccacccccgccacccccgccgcccccggcgagcgcaaccccgucguccuccucaaccgccuccgcgccggccuccgcuacgucugccucgccgagcccgccgagcgccgcgcccgcuccuucgucauggccgucuccgucgacggccgcaccuucgagggcuccggccgcuccaagaagcucgcccgcggccaggccgcccaggccgcccuccaggagcucuucgacauccagaugcccggccacgcccccggccgcgcccgccgcacccccaugccccaggaguucgccgacuccaucucccagcucgucacccagaaguuccgcgaggucaccaccgaccucacccccaugcacgcccgccacaaggcccucgccggcaucgucaugaccaagggccucgacgcccgccaggcccaggucgucgcccucuccuccggcaccaagugcaucuccggcgagcaccucuccgaccagggccucgucgucaacgacugccacgccgaggucgucgcccgccgcgccuuccuccacuuccucuacacccagcucgagcuccaccucuccaagcgccgcgaggacuccgagcgcuccaucuucguccgccucaaggagggcggcuaccgccuccgcgagaacauccucuuccaccucuacgucuccaccucccccugcggcgacgcccgccuccacucccccuacgagaucaccaccgaccuccacuccuccaagcaccucguccgcaaguuccgcggccaccuccgcaccaagaucgaguccggcgagggcaccguccccguccgcggccccuccgccguccagaccugggacggcguccuccucggcgagcagcucaucaccauguccugcaccgacaagaucgcccgcuggaacguccucggccuccagggcgcccuccucucccacuucgucgagcccgucuaccuccaguccaucgucgucggcucccuccaccacaccggccaccucgcccgcgucaugucccaccgcauggagggcgucggccagcuccccgccuccuaccgccacaaccgcccccuccucuccggcgucuccgacgccgaggcccgccagcccggcaaguccccccccuucuccaugaacugggucgucggcuccgccgaccucgagaucaucaacgccaccaccggccgccgcuccugcggcggccccucccgccucugcaagcacguccucuccgcccgcugggcccgccucuacggccgccucuccacccgcacccccucccccggcgacacccccuccauguacugcgaggccaagcucggcgcccacaccuaccaguccgucaagcagcagcucuucaaggccuuccagaaggccggccucggcaccuggguccgcaagccccccgagcagcagcaguuccuccucacccucuga

SEQ ID NO: 39406 - RNA, 2796 nt, Artificial Sequence
  derived and/or modified sequence opt2 from ADAR__Homo_sapiens__NP_001020278
auggccgagaucaaggagaagaucugcgacuaccucuucaacgucuccgacuccuccgcccucaaccucgccaagaacaucggccucaccaaggcccgcgacaucaacgccguccucaucgacauggagcgccagggcgacgucuaccgccagggcaccaccccccccaucuggcaccucaccgacaagaagcgcgagcgcaugcagaucaagcgcaacaccaacuccguccccgagaccgcccccgccgccauccccgagaccaagcgcaacgccgaguuccucaccugcaacauccccaccuccaacgccuccaacaacauggucaccaccgagaaggucgagaacggccaggagcccgucaucaagcucgagaaccgccaggaggcccgccccgagcccgcccgccucaagccccccguccacuacaacggccccuccaaggccggcuacgucgacuucgagaacggccagugggccaccgacgacauccccgacgaccucaacuccauccgcgccgcccccggcgaguuccgcgccaucauggagaugcccuccuucuacucccacggccucccccgcugcucccccuacaagaagcucaccgagugccagcucaagaaccccaucuccggccuccucgaguacgcccaguucgccucccagaccugcgaguucaacaugaucgagcaguccggccccccccacgagccccgcuucaaguuccaggucgucaucaacggccgcgaguucccccccgccgaggccggcuccaagaaggucgccaagcaggacgccgccaugaaggccaugaccauccuccucgaggaggccaaggccaaggacuccggcaaguccgaggaguccucccacuacuccaccgagaaggaguccgagaagaccgccgagucccagacccccacccccuccgccaccuccuucuucuccggcaagucccccgucaccacccuccucgagugcaugcacaagcucggcaacuccugcgaguuccgccuccucuccaaggagggccccgcccacgagcccaaguuccaguacugcgucgccgucggcgcccagaccuuccccuccgucuccgcccccuccaagaaggucgccaagcagauggccgccgaggaggccaugaaggcccuccacggcgaggccaccaacuccauggccuccgacaaccagcccgagggcaugaucuccgagucccucgacaaccucgaguccaugaugcccaacaagguccgcaagaucggcgagcucguccgcuaccucaacaccaaccccgucggcggccuccucgaguacgcccgcucccacggcuucgccgccgaguucaagcucgucgaccaguccggccccccccacgagcccaaguucgucuaccaggccaaggucggcggccgcugguuccccgccgucugcgcccacuccaagaagcagggcaagcaggaggccgccgacgccgcccuccgcguccucaucggcgagaacgagaaggccgagcgcaugggcuucaccgaggucacccccgucaccggcgccucccuccgccgcaccaugcuccuccucucccgcucccccgaggcccagcccaagacccucccccucaccggcuccaccuuccacgaccagaucgccaugcucucccaccgcugcuucaacacccucaccaacuccuuccagcccucccuccucggccgcaagauccucgccgccaucaucaugaagaaggacuccgaggacaugggcgucgucgucucccucggcaccggcaaccgcugcgucaagggcgacucccucucccucaagggcgagaccgucaacgacugccacgccgagaucaucucccgccgcggcuucauccgcuuccucuacuccgagcucaugaaguacaacucccagaccgccaaggacuccaucuucgagcccgccaagggcggcgagaagcuccagaucaagaagaccgucuccuuccaccucuacaucuccaccgcccccugcggcgacggcgcccucuucgacaaguccugcuccgaccgcgccauggaguccaccgagucccgccacuaccccgucuucgagaaccccaagcagggcaagcuccgcaccaaggucgagaacggcgagggcaccauccccgucgaguccuccgacaucguccccaccugggacggcauccgccucggcgagcgccuccgcaccauguccugcuccgacaagauccuccgcuggaacguccucggccuccagggcgcccuccucacccacuuccuccagcccaucuaccucaaguccgucacccucggcuaccucuucucccagggccaccucacccgcgccaucugcugccgcgucacccgcgacggcuccgccuucgaggacggccuccgccaccccuucaucgucaaccaccccaaggucggccgcgucuccaucuacgacuccaagcgccaguccggcaagaccaaggagaccuccgucaacuggugccucgccgacggcuacgaccucgagauccucgacggcacccgcggcaccgucgacggcccccgcaacgagcucucccgcgucuccaagaagaacaucuuccuccucuucaagaagcucugcuccuuccgcuaccgccgcgaccuccuccgccucuccuacggcgaggccaagaaggccgcccgcgacuacgagaccgccaagaacuacuucaagaagggccucaaggacaugggcuacggcaacuggaucuccaagccccaggaggagaagaacuucuaccucugccccgucuga

SEQ ID NO: 39407 - RNA, 435 nt, Artificial Sequence
  derived and/or modified sequence opt2 from ADAT2__Homo_sapiens__NP_001273188
auggucuacaacaacgaggucgucggcaagggccgcaacgaggucaaccagaccaagaacgccacccgccacgccgagauggucgccaucgaccagguccucgacuggugccgccaguccggcaagucccccuccgaggucuucgagcacaccguccucuacgucaccgucgagcccugcaucaugugcgccgccgcccuccgccucaugaagaucccccucgucgucuacggcugccagaacgagcgcuucggcggcugcggcuccguccucaacaucgccuccgccgaccuccccaacaccggccgccccuuccagugcauccccggcuaccgcgccgaggaggccgucgagaugcucaagaccuucuacaagcaggagaaccccaacgcccccaaguccaagguccgcaagaaggagugccagaaguccuga

SEQ ID NO: 39408 - RNA, 1104 nt, Artificial Sequence
  derived and/or modified sequence opt2 from ADAT3__Homo_sapiens__NP_612431
augauccucugcucccgccucugccucccccaguccgccucccuccgcauggagcccgcccccggccucgucgagcagcccaagugccucgaggccggcucccccgagcccgagcccgcccccuggcaggcccuccccguccucuccgagaagcaguccggcgacgucgagcucguccucgccuacgccgcccccguccucgacaagcgccagaccucccgccuccucaaggaggucuccgcccuccacccccuccccgcccagccccaccucaagcgcguccgccccucccgcgacgccggcuccccccacgcccucgagaugcuccucugccucgccggccccgccuccggcccccgcucccucgccgagcuccucccccgccccgccgucgacccccgcggccucggccagcccuuccucguccccguccccgcccgccccccccucacccgcggccaguucgaggaggcccgcgcccacuggcccaccuccuuccacgaggacaagcaggucaccuccgcccucgccggccgccucuucuccacccaggagcgcgccgccaugcagucccacauggagcgcgccgucugggccgcccgccgcgccgccgcccgcggccuccgcgccgucggcgccgucgucgucgaccccgccuccgaccgcguccucgccaccggccacgacugcuccugcgccgacaacccccuccuccacgccgucauggucugcgucgaccucgucgcccgcggccagggccgcggcaccuacgacuuccgccccuuccccgccugcuccuucgcccccgccgccgccccccaggccguccgcgccggcgccguccgcaagcucgacgccgacgaggacggccuccccuaccucugcaccggcuacgaccucuacgucacccgcgagcccugcgccaugugcgccauggcccucguccacgcccgcauccuccgcgucuucuacggcgcccccucccccgacggcgcccucggcacccgcuuccgcauccacgcccgccccgaccucaaccaccgcuuccaggucuuccgcggcguccucgaggagcagugccgcuggcucgaccccgacaccuga

SEQ ID NO: 39409 - RNA, 1944 nt, Artificial Sequence
  derived and/or modified sequence opt2 from ADCK3__Homo_sapiens__NP_064632
auggccgccauccucggcgacaccaucauggucgccaagggccucgucaagcucacccaggccgccgucgagacccaccuccagcaccucggcaucggcggcgagcucaucauggccgcccgcgcccuccaguccaccgccgucgagcagaucggcauguuccucggcaagguccagggccaggacaagcacgaggaguacuucgccgagaacuucggcggccccgagggcgaguuccacuucuccgucccccacgccgccggcgccuccaccgacuucuccuccgccuccgcccccgaccaguccgccccccccucccucggccacgcccacuccgagggccccgcccccgccuacgucgccuccggccccuuccgcgaggccggcuuccccggccaggccuccuccccccucggccgcgccaacggccgccucuucgccaacccccgcgacuccuucuccgccaugggcuuccagcgccgcuucuuccaccaggaccagucccccgucggcggccucaccgccgaggacaucgagaaggcccgccaggccaaggcccgccccgagaacaagcagcacaagcagacccucuccgagcacgcccgcgagcgcaagguccccgucacccgcaucggccgccucgccaacuucggcggccucgccgucggccucggcuucggcgcccucgccgaggucgccaagaagucccuccgcuccgaggaccccuccggcaagaaggccguccucggcuccucccccuuccucuccgaggccaacgccgagcgcaucguccgcacccucugcaagguccgcggcgccgcccucaagcucggccagaugcucuccauccaggacgacgccuucaucaacccccaccucgccaagaucuucgagcgcguccgccaguccgccgacuucaugccccucaagcagaugaugaagacccucaacaacgaccucggccccaacuggcgcgacaagcucgaguacuucgaggagcgccccuucgccgccgccuccaucggccagguccaccucgcccgcaugaagggcggccgcgaggucgccaugaagauccaguaccccggcgucgcccaguccaucaacuccgacgucaacaaccucauggccguccucaacauguccaacaugcuccccgagggccucuuccccgagcaccucaucgacguccuccgccgcgagcucgcccucgagugcgacuaccagcgcgaggccgccugcgcccgcaaguuccgcgaccuccucaagggccaccccuucuucuacguccccgagaucgucgacgagcucugcuccccccacguccucaccaccgagcucgucuccggcuucccccucgaccaggccgagggccucucccaggagauccgcaacgagaucugcuacaacauccucguccucugccuccgcgagcucuucgaguuccacuucaugcagaccgaccccaacugguccaacuucuucuacgacccccagcagcacaaggucgcccuccucgacuucggcgccacccgcgaguacgaccgcuccuucaccgaccucuacauccagaucauccgcgccgccgccgaccgcgaccgcgagaccguccgcgccaaguccaucgagaugaaguuccucaccggcuacgaggucaaggucauggaggacgcccaccucgacgccauccucauccucggcgaggccuucgccuccgacgagcccuucgacuucggcacccaguccaccaccgagaagauccacaaccucauccccgucaugcuccgccaccgccucguccccccccccgaggagaccuacucccuccaccgcaagaugggcggcuccuuccucaucugcuccaagcucaaggcccgcuuccccugcaaggccauguucgaggaggccuacuccaacuacugcaagcgccaggcccagcaguga

SEQ ID NO: 39410 - RNA, 1512 nt, Artificial Sequence
  derived and/or modified sequence opt2 from ADCK4__Homo_sapiens__NP_001136027
auguggcucaaggucggcggccuccuccgcggcaccggcggccagcucggccagaccgucggcuggcccugcggcgcccucggccccggcccccaccgcuggggccccugcggcggcuccugggcccagaaguucuaccaggacggccccggccgcggccucggcgaggaggacauccgccgcgcccgcgaggcccgcccccgcaagaccccccgcccccagcucuccgaccgcucccgcgagcgcaagguccccgccucccgcaucucccgccucgccaacuucggcggccucgccgucggccucggccucggcguccucgccgagauggccaagaaguccaugcccggcggccgccuccaguccgacaacuccuucaucuccccccagcuccagcacaucuucgagcgcguccgccaguccgccgacuucaugccccgcuggcagaugcuccgcguccucgaggaggagcucggccgcgacuggcaggccaaggucgccucccucgaggagguccccuucgccgccgccuccaucggccagguccaccagggccuccuccgcgacggcaccgaggucgccgucaagauccaguaccccggcaucgcccaguccauccaguccgacguccagaaccuccucgccguccucaagauguccgccgcccuccccgccggccucuucgccgagcagucccuccaggcccuccagcaggagcucgccugggagugcgacuaccgccgcgaggccgccugcgcccagaacuuccgccagcuccucgccaacgaccccuucuuccgcguccccgccgucgucaaggagcucugcaccacccgcguccucggcauggagcucgccggcggcgucccccucgaccagugccagggccucucccaggaccuccgcaaccagaucugcuuccagcuccucacccucugccuccgcgagcucuucgaguuccgcuucaugcagaccgaccccaacugggccaacuuccucuacgacgccuccucccaccaggucacccuccucgacuucggcgccucccgcgaguucggcaccgaguucaccgaccacuacaucgaggucgucaaggccgccgccgacggcgaccgcgacugcguccuccagaagucccgcgaccucaaguuccucaccggcuucgagaccaaggccuucuccgacgcccacgucgaggccgucaugauccucggcgagcccuucgccacccagggccccuacgacuucggcuccggcgagaccgcccgccgcauccaggaccucauccccguccuccuccgccaccgccucugccccccccccgaggagaccuacgcccuccaccgcaagcucgccggcgccuuccucgccugcgcccaccuccgcgcccacaucgccugccgcgaccucuuccaggacaccuaccaccgcuacugggccucccgccagcccgacgccgccaccgccggcucccuccccaccaagggcgacuccugggucgaccccuccuga

SEQ ID NO: 39411 - RNA, 4374 nt, Artificial Sequence
  derived and/or modified sequence opt2 from ADCY10__Homo_sapiens__NP_001161221
augcucgucuucggcgacgagacccacucccacuuccucgucaucggccaggccgucgacgacguccgccucgcccagaacauggcccagaugaacgacgucauccucucccccaacugcuggcagcucugcgaccgcuccaugaucgagaucgaguccguccccgaccagcgcgccgucaaggucaacuuccucaagcccccccccaacuucaacuucgacgaguucuucaccaagugcaccaccuucaugcacuacuaccccuccggcgagcacaagaaccuccuccgccucgccugcacccucaagcccgaccccgagcucgagaugucccuccagaaguacgucauggaguccauccucaagcagaucgacaacaagcagcuccagggcuaccucuccgagcuccgccccgucaccaucgucuucgucaaccucauguucgaggaccaggacaaggccgaggagaucggccccgccauccaggacgccuacaugcacaucaccuccguccucaagaucuuccagggccagaucaacaaggucuucauguucgacaagggcugcuccuuccucugcgucuucggcuuccccggcgagaagguccccgacgagcucacccacgcccucgagugcgccauggacaucuucgacuucugcucccagguccacaagauccagaccgucuccaucggcgucgccuccggcaucgucuucugcggcaucgucggccacaccguccgccacgaguacaccgucaucggccagaaggucaaccucgccgcccgcaugaugauguacuaccccggcaucgucaccugcgacuccgucaccuacaacggcuccaaccuccccgccuacuucuucaaggagcuccccaagaaggucaugaagggcgucgccgacuccggcccccucuaccaguacuggggccgcaccgagaaggucauguucggcauggccugccucaucugcaaccgcaaggaggacuacccccuccucggccgcaacaaggagaucaacuacuucauguacaccaugaagaaguuccucaucuccaacuccucccagguccucauguacgagggccuccccggcuacggcaagucccagauccucaugaagaucgaguaccucgcccagggcaagaaccaccgcaucaucgccaucucccucaacaagaucuccuuccaccagaccuucuacaccauccagauguucauggccaacguccucggccucgacaccugcaagcacuacaaggagcgccagaccaaccuccgcaacaaggucaugacccuccucgacgagaaguucuacugccuccucaacgacaucuuccacguccaguuccccaucucccgcgagaucucccgcauguccacccucaagaagcagaagcagcucgagauccucuucaugaagauccucaagcucaucgucaaggaggagcgcaucaucuucaucaucgacgaggcccaguucgucgacuccaccuccuggcgcuucauggagaagcucauccgcacccuccccaucuucaucaucaugucccucugccccuucgucaacauccccugcgccgccgcccgcgccgucaucaagaaccgcaacaccaccuacaucgucaucggcgccguccagcccaacgacaucuccaacaagaucugccucgaccucaacgucuccugcaucuccaaggagcucgacuccuaccucggcgagggcuccugcggcauccccuucuacugcgaggagcuccucaagaaccucgagcaccacgagguccucgucuuccagcagaccgaguccgaggagaagaccaaccgcaccuggaacaaccucuucaaguacuccaucaagcucaccgagaagcucaacauggucacccuccacuccgacaaggaguccgaggaggucugccaccucaccuccggcguccgccucaagaaccucuccccccccaccucccucaaggagaucucccucauccagcucgacuccaugcgccucucccaccagaugcucguccgcugcgccgccaucaucggccucaccuucaccaccgagcuccucuucgagauccuccccugcuggaacaugaagaugaugaucaagacccucgccacccucgucgaguccaacaucuucuacugcuuccgcaacggcaaggagcuccagaaggcccucaagcagaacgaccccuccuucgagguccacuaccgcucccucucccucaagcccuccgagggcauggaccacggcgaggaggagcagcuccgcgagcucgagaacgaggucaucgagugccaccgcauccgcuucugcaaccccaugaugcagaagaccgccuacgagcucuggcucaaggaccagcgcaaggccaugcaccucaagugcgcccgcuuccucgaggaggacgcccaccgcugcgaccacugccgcggccgcgacuucauccccuaccaccacuucaccgucaacauccgccucaacgcccucgacauggacgccaucaagaagauggccaugucccacggcuucaagaccgaggagaagcucauccucuccaacuccgagauccccgagaccuccgccuucuuccccgagaaccgcucccccgaggagauccgcgagaagauccucaacuucuucgaccacguccucaccaagaugaagaccuccgacgaggacaucaucccccucgaguccugccagugcgaggagauccucgagaucgucauccucccccucgcccaccacuuccucgcccucggcgagaacgacaaggcccucuacuacuuccucgagaucgccuccgccuaccucaucuucugcgacaacuacauggccuacauguaccucaacgagggccagaagcuccucaagacccucaagaaggacaaguccuggucccagaccuucgaguccgccaccuucuacucccucaagggcgaggucugcuucaacaugggccagaucguccucgccaagaagaugcuccgcaaggcccucaagcuccucaaccgcaucuuccccuacaaccucaucucccucuuccuccacauccacgucgagaagaaccgccacuuccacuacgucaaccgccaggcccaggagucccccccccccggcaagaagcgccucgcccagcucuaccgccagaccgucugccucucccuccucuggcgcaucuacuccuacuccuaccucuuccacugcaaguacuacgcccaccucgccgucaugaugcagaugaacaccgcccucgagacccagaacugcuuccagaucaucaaggccuaccucgacuacucccucuaccaccaccucgccggcuacaagggcgucugguucaaguacgaggucauggccauggagcacaucuucaaccucccccucaagggcgagggcaucgagaucgucgccuacgucgccgagacccucgucuucaacaagcucaucaugggccaccucgaccucgccaucgagcucggcucccgcgcccuccagaugugggcccuccuccagaaccccaaccgccacuaccagucccucugccgccucucccgcugccuccuccucaacucccgcuacccccagcucauccagguccucggccgccucugggagcucuccgucacccaggagcacaucuucuccaaggccuucuucuacuucgucugccucgacauccuccucuacuccggcuucgucuaccgcaccuucgaggagugccucgaguucauccaccaguacgagaacaaccgcauccucaaguuccacuccggccuccuccucggccucuacuccuccgucgccaucugguacgcccgccuccaggagugggacaacuucuacaaguucuccaaccgcgccaagaaccuccucccccgccgcaccaugacccucaccuacuacgacggcaucucccgcuacauggagggccagguccuccaccuccagaagcagaucaaggagcaguccgagaacgcccaggccuccggcgaggagcuccucaagaaccucgagaaccucgucgcccagaacaccaccggccccgucuucugcccccgccucuaccaccucauggccuacgucugcauccucaugggcgacggccagaagugcggccucuuccucaacaccgcccuccgccucuccgagacccagggcaacauccucgagaagugcuggcucaacaugaacaaggaguccugguacuccaccuccgagcucaaggaggaccaguggcuccagaccauccucucccuccccuccugggagaagaucgucgccggccgcgucaacauccaggaccuccagaagaacaaguuccucaugcgcgccaacaccgucgacaaccacuucuga

SEQ ID NO: 39412 - RNA, 3360 nt, Artificial Sequence
  derived and/or modified sequence opt2 from ADCY1__Homo_sapiens__NP_066939
auggccggcgccccccgcggcggcggcggcggcggcggcggcgccggcgagcccggcggcgccgagcgcgccgccggcaccucccgccgccgcggccuccgcgccugcgacgaggaguucgccugccccgagcucgaggcccucuuccgcggcuacacccuccgccucgagcaggccgccacccucaaggcccucgccguccucucccuccucgccggcgcccucgcccucgccgagcuccucggcgcccccggccccgcccccggccucgccaagggcucccaccccguccacugcguccucuuccucgcccuccucgucgucaccaacguccgcucccuccaggucccccagcuccagcaggucggccagcucgcccuccucuucucccucaccuucgcccuccucugcugccccuucgcccucggcggccccgcccgcggcuccgccggcgccgccggcggccccgccaccgccgagcagggcgucuggcagcuccuccucgucaccuucgucuccuacgcccuccuccccguccgcucccuccucgccaucggcuucggccucgucgucgccgccucccaccuccucgucaccgccacccucguccccgccaagcgcccccgccucuggcgcacccucggcgccaacgcccuccucuucgucggcgucaacauguacggcgucuucguccgcauccucaccgagcgcucccagcgcaaggccuuccuccaggcccgcuccugcaucgaggaccgccuccgccucgaggacgagaacgagaagcaggagcgccuccucaugucccuccucccccgcaacgucgccauggagaugaaggaggacuuccucaagccccccgagcgcaucuuccacaagaucuacauccagcgccacgacaacgucuccauccucuucgccgacaucgucggcuucaccggccucgccucccagugcaccgcccaggagcucgucaagcuccucaacgagcucuucggcaaguucgacgagcucgccaccgagaaccacugccgccgcaucaagauccucggcgacugcuacuacugcgucuccggccucacccagcccaagaccgaccacgcccacugcugcgucgagaugggccucgacaugaucgacaccaucaccuccgucgccgaggccaccgaggucgaccucaacaugcgcgucggccuccacaccggccgcguccucugcggcguccucggccuccgcaaguggcaguacgacgucugguccaacgacgucacccucgccaacgucauggaggccgccggccuccccggcaagguccacaucaccaagaccacccucgccugccucaacggcgacuacgaggucgagcccggcuacggccacgagcgcaacuccuuccucaagacccacaacaucgagaccuucuucaucguccccucccaccgccgcaagaucuuccccggccucauccucuccgacaucaagcccgccaagcgcaugaaguucaagaccgucugcuaccuccucguccagcucaugcacugccgcaagauguucaaggccgagauccccuucuccaacgucaugaccugcgaggacgacgacaagcgccgcgcccuccgcaccgccuccgagaagcuccgcaaccgcuccuccuucuccaccaacgucgucuacaccacccccggcacccgcgucaaccgcuacaucucccgccuccucgaggcccgccagaccgagcucgagauggccgaccucaacuucuucacccucaaguacaagcacgucgagcgcgagcagaaguaccaccagcuccaggacgaguacuucaccuccgccgucguccucacccucauccucgccgcccucuucggccucgucuaccuccucaucuucccccaguccgucgucguccuccuccuccucgucuucugcaucugcuuccucgucgccugcguccucuaccuccacaucacccgcguccagugcuuccccggcugccucaccauccagauccgcaccguccucugcaucuucaucgucguccucaucuacuccgucgcccagggcugcgucgucggcugccuccccugggccugguccuccaagcccaacuccucccucgucguccucuccuccggcggccagcgcaccgcccuccccacccuccccugcgaguccacccaccacgcccuccucugcugccucgucggcacccucccccucgccaucuucuuccgcgucuccucccuccccaagaugauccuccucuccggccucaccaccuccuacauccucguccucgagcucuccggcuacacccgcaccggcggcggcgccgucuccggccgcuccuacgagcccaucgucgccauccuccucuucuccugcgcccucgcccuccacgcccgccaggucgacauccgccuccgccucgacuaccucugggccgcccaggccgaggaggagcgcgaggacauggagaaggucaagcucgacaaccgccgcauccucuucaaccuccuccccgcccacgucgcccagcacuuccucauguccaacccccgcaacauggaccucuacuaccaguccuacucccaggucggcgucauguucgccuccauccccaacuucaacgacuucuacaucgagcucgacggcaacaacaugggcgucgagugccuccgccuccucaacgagaucaucgccgacuucgacgagcucauggagaaggacuucuacaaggacaucgagaagaucaagaccaucggcuccaccuacauggccgccgucggccucgcccccaccuccggcaccaaggccaagaaguccaucuccucccaccucuccacccucgccgacuucgccaucgagauguucgacguccucgacgagaucaacuaccaguccuacaacgacuucguccuccgcgucggcaucaacgucggccccgucgucgccggcgucaucggcgcccgccgcccccaguacgacaucuggggcaacaccgucaacgucgccucccgcauggacuccaccggcguccagggccgcauccaggucaccgaggagguccaccgccuccuccgccgcugccccuaccacuucgucugccgcggcaaggucuccgucaagggcaagggcgagaugcucaccuacuuccucgagggccgcaccgacggcaacggcucccagauccgcucccucggccucgaccgcaagaugugccccuucggccgcgccggccuccagggccgccgcccccccgucugccccaugcccggcgucuccguccgcgccggccuccccccccacucccccggccaguaccuccccuccgccgccgccggcaaggaggccuga

SEQ ID NO: 39413 - RNA, 3276 nt, Artificial Sequence
  derived and/or modified sequence opt2 from ADCY2__Homo_sapiens__NP_065433
auguggcaggaggccaugcgccgccgccgcuaccuccgcgaccgcuccgaggaggccgccggcggcggcgacggccucccccgcucccgcgacuggcucuacgaguccuacuacugcaugucccagcagcacccccucaucgucuuccuccuccucaucgucaugggcuccugccucgcccuccucgccgucuucuucgcccucggccucgaggucgaggaccacgucgccuuccucaucaccguccccaccgcccucgccaucuucuucgccaucuucauccucgucugcaucgaguccgucuucaagaagcuccuccgccucuucucccucgucaucuggaucugccucgucgccaugggcuaccucuucaugugcuucggcggcaccgucucccccugggaccaggucuccuucuuccucuucaucaucuucgucgucuacaccaugcuccccuucaacaugcgcgacgccaucaucgccuccguccucaccuccuccucccacaccaucguccucuccgucugccucuccgccacccccggcggcaaggagcaccucgucuggcagauccucgccaacgucaucaucuucaucugcggcaaccucgccggcgccuaccacaagcaccucauggagcucgcccuccagcagaccuaccaggacaccugcaacugcaucaagucccgcaucaagcucgaguucgagaagcgccagcaggagcgccuccuccucucccuccuccccgcccacaucgccauggagaugaaggccgagaucauccagcgccuccagggccccaaggccggccagauggagaacaccaacaacuuccacaaccucuacgucaagcgccacaccaacgucuccauccucuacgccgacaucgucggcuucacccgccucgccuccgacugcucccccggcgagcucguccacaugcucaacgagcucuucggcaaguucgaccagaucgccaaggagaacgagugcaugcgcaucaagauccucggcgacugcuacuacugcgucuccggccuccccaucucccuccccaaccacgccaagaacugcgucaagaugggccucgacaugugcgaggccaucaagaagguccgcgacgccaccggcgucgacaucaacaugcgcgucggcguccacuccggcaacguccucugcggcgucaucggccuccagaaguggcaguacgacgucuggucccacgacgucacccucgccaaccacauggaggccggcggcguccccggccgcguccacaucuccuccgucacccucgagcaccucaacggcgccuacaaggucgaggagggcgacggcgacauccgcgaccccuaccucaagcagcaccucgucaagaccuacuucgucaucaaccccaagggcgagcgccgcuccccccagcaccucuuccgcccccgccacacccucgacggcgccaagaugcgcgccuccguccgcaugacccgcuaccucgaguccuggggcgccgccaagcccuucgcccaccuccaccaccgcgacuccaugaccaccgagaacggcaagaucuccaccaccgacguccccaugggccagcacaacuuccagaaccgcacccuccgcaccaagucccagaagaagcgcuucgaggaggagcucaacgagcgcaugauccaggccaucgacggcaucaacgcccagaagcaguggcucaaguccgaggacauccagcgcaucucccuccucuucuacaacaagguccucgagaaggaguaccgcgccaccgcccuccccgccuucaaguacuacgucaccugcgccugccucaucuucuucugcaucuucaucguccagauccucguccuccccaagaccuccguccucggcaucuccuucggcgccgccuuccuccuccucgccuucauccucuucgucugcuucgccggccagcuccuccagugcuccaagaaggccuccccccuccucauguggcuccucaaguccuccggcaucaucgccaaccgccccuggccccgcaucucccucaccaucaucaccaccgccaucauccucaugauggccgucuucaacauguucuuccucuccgacuccgaggagaccaucccccccaccgccaacaccaccaacaccuccuucuccgccuccaacaaccaggucgccauccuccgcgcccagaaccucuucuuccuccccuacuucaucuacuccugcauccucggccucaucuccugcuccgucuuccuccgcgucaacuacgagcucaagaugcucaucaugauggucgcccucgucggcuacaacaccauccuccuccacacccacgcccacguccucggcgacuacucccagguccucuucgagcgccccggcaucuggaaggaccucaagaccaugggcuccgucucccucuccaucuucuucaucacccuccucguccucggccgccagaacgaguacuacugccgccucgacuuccucuggaagaacaaguucaagaaggagcgcgaggagaucgagaccauggagaaccucaaccgcguccuccucgagaacguccuccccgcccacgucgccgagcacuuccucgcccgcucccucaagaacgaggagcucuaccaccaguccuacgacugcgucugcgucauguucgccuccauccccgacuucaaggaguucuacaccgaguccgacgucaacaaggagggccucgagugccuccgccuccucaacgagaucaucgccgacuucgacgaccuccucuccaagcccaaguucuccggcgucgagaagaucaagaccaucggcuccaccuacauggccgccaccggccucuccgccguccccucccaggagcacucccaggagcccgagcgccaguacaugcacaucggcaccauggucgaguucgccuucgcccucgucggcaagcucgacgccaucaacaagcacuccuucaacgacuucaagcuccgcgucggcaucaaccacggccccgucaucgccggcgucaucggcgcccagaagccccaguacgacaucuggggcaacaccgucaacgucgccucccgcauggacuccaccggcguccucgacaagauccaggucaccgaggagaccucccucguccuccagacccucggcuacaccugcaccugccgcggcaucaucaacgucaagggcaagggcgaccucaagaccuacuucgucaacaccgagaugucccgcucccucucccaguccaacgucgccuccuga

SEQ ID NO: 39414 - RNA, 3435 nt, Artificial Sequence
  derived and/or modified sequence opt2 from ADCY3__Homo_sapiens__NP_004027
augccccgcaaccagggcuucuccgagcccgaguacuccgccgaguacuccgccgaguacuccgucucccuccccuccgaccccgaccgcggcgucggccgcacccacgagaucuccguccgcaacuccggcuccugccucugccucccccgcuucaugcgccucaccuucguccccgagucccucgagaaccucuaccagaccuacuucaagcgccagcgccacgagacccuccucguccucgucgucuucgccgcccucuucgacugcuacgucgucgucaugugcgccgucgucuucuccuccgacaagcucgccucccucgccgucgccggcaucggccucguccucgacaucauccucuucguccucugcaagaagggccuccuccccgaccgcgucacccgccgcguccuccccuacguccucuggcuccucaucaccgcccagaucuucuccuaccucggccucaacuucgcccgcgcccacgccgccuccgacaccgucggcuggcaggucuucuucgucuucuccuucuucaucacccucccccucucccucucccccaucgucaucaucuccgucgucuccugcgucguccacacccucguccucggcgucaccgucgcccagcagcagcaggaggagcucaagggcaugcagcuccuccgcgagauccucgccaacgucuuccucuaccucugcgccaucgccgucggcaucauguccuacuacauggccgaccgcaagcaccgcaaggccuuccucgaggcccgccagucccucgaggucaagaugaaccucgaggagcagucccagcagcaggagaaccucaugcucuccauccuccccaagcacgucgccgacgagaugcucaaggacaugaagaaggacgagucccagaaggaccagcagcaguucaacaccauguacauguaccgccacgagaacgucuccauccucuucgccgacaucgucggcuucacccagcucuccuccgccugcuccgcccaggagcucgucaagcuccucaacgagcucuucgcccgcuucgacaagcucgccgccaaguaccaccagcuccgcaucaagauccucggcgacugcuacuacugcaucugcggccuccccgacuaccgcgaggaccacgccgucugcuccauccucaugggccucgccauggucgaggccaucuccuacguccgcgagaagaccaagaccggcgucgacaugcgcgucggcguccacaccggcaccguccucggcggcguccucggccagaagcgcuggcaguacgacgucugguccaccgacgucaccgucgccaacaagauggaggccggcggcauccccggccgcguccacaucucccaguccaccauggacugccucaagggcgaguucgacgucgagcccggcgacggcggcucccgcugcgacuaccucgaggagaagggcaucgagaccuaccucaucaucgccuccaagcccgaggucaagaagaccgccacccagaacggccucaacggcuccgcccuccccaacggcgcccccgccuccuccaaguccuccucccccgcccucaucgagaccaaggagcccaacggcuccgcccacuccuccggcuccaccuccgagaagcccgaggagcaggacgcccaggccgacaaccccuccuuccccaacccccgccgccgccuccgccuccaggaccucgccgaccgcgucgucgacgccuccgaggacgagcacgagcucaaccagcuccucaacgaggcccuccucgagcgcgaguccgcccaggucgucaagaagcgcaacaccuuccuccucuccaugcgcuucauggaccccgagauggagacccgcuacuccgucgagaaggagaagcaguccggcgccgccuucuccugcuccugcgucguccuccucugcaccgcccucgucgagauccucaucgaccccuggcucaugaccaacuacgucaccuucauggucggcgagauccuccuccucauccucaccaucugcucccucgccgccaucuucccccgcgccuuccccaagaagcucgucgccuucuccaccuggaucgaccgcacccgcugggcccgcaacaccugggccaugcucgccaucuucauccucgucauggccaacgucgucgacaugcucuccugccuccaguacuacaccggccccuccaacgccaccgccggcauggagaccgagggcuccugccucgagaaccccaaguacuacaacuacgucgccguccucucccucaucgccaccaucaugcucguccaggucucccacauggucaagcucacccucaugcuccucgucgccggcgccgucgccaccaucaaccucuacgccuggcgccccgucuucgacgaguacgaccacaagcgcuuccgcgagcacgaccuccccauggucgcccucgagcagaugcagggcuucaaccccggccucaacggcaccgaccgccucccccucguccccuccaaguacuccaugaccgucauggucuuccucaugaugcucuccuucuacuacuucucccgccacgucgagaagcucgcccgcacccucuuccucuggaagaucgagguccacgaccagaaggagcgcgucuacgagaugcgccgcuggaacgaggcccucgucaccaacaugcuccccgagcacgucgcccgccacuuccucggcuccaagaagcgcgacgaggagcucuacucccagaccuacgacgagaucggcgucauguucgccucccuccccaacuucgccgacuucuacaccgaggaguccaucaacaacggcggcaucgagugccuccgcuuccucaacgagaucaucuccgacuucgacucccuccucgacaaccccaaguuccgcgucaucaccaagaucaagaccaucggcuccaccuacauggccgccuccggcgucacccccgacgucaacaccaacggcuucgccuccuccaacaaggaggacaaguccgagcgcgagcgcuggcagcaccucgccgaccucgccgacuucgcccucgccaugaaggacacccucaccaacaucaacaaccaguccuucaacaacuucaugcuccgcaucggcaugaacaagggcggcguccucgccggcgucaucggcgcccgcaagccccacuacgacaucuggggcaacaccgucaacgucgccucccgcauggaguccaccggcgucaugggcaacauccaggucgucgaggagacccaggucauccuccgcgaguacggcuuccgcuucguccgccgcggccccaucuucgucaagggcaagggcgagcuccucaccuucuuccucaagggccgcgacaagcucgccaccuuccccaacggccccuccgucacccucccccaccaggucgucgacaacuccuga

SEQ ID NO: 39415 - RNA, 2736 nt, Artificial Sequence
  derived and/or modified sequence opt2 from ADCY5__Homo_sapiens__NP_001186571
augaagucccagaaggagggcugcugcucccgcggcgaccucuccauccagaccggccccggcggcgagugggccccccgccgccucgucuccaacguccucaucuucuccugcaccaacaucgucggcgucugcacccacuaccccgccgaggucucccagcgccaggccuuccaggagacccgcgagugcauccaggcccgccuccacucccagcgcgagaaccagcagcaggagcgccuccuccucuccguccucccccgccacgucgccauggagaugaaggccgacaucaacgccaagcaggaggacaugauguuccacaagaucuacauccagaagcacgacaacgucuccauccucuucgccgacaucgagggcuucaccucccucgccucccagugcaccgcccaggagcucgucaugacccucaacgagcucuucgcccgcuucgacaagcucgccgccgagaaccacugccuccgcaucaagauccucggcgacugcuacuacugcgucuccggccuccccgaggcccgcgccgaccacgcccacugcugcgucgagaugggcauggacaugaucgaggccaucucccucguccgcgaggucaccggcgucaacgucaacaugcgcgucggcauccacuccggccgcguccacugcggcguccucggccuccgcaaguggcaguucgacgucugguccaacgacgucacccucgccaaccacauggaggccggcggcaaggccggccgcauccacaucaccaaggccacccucaacuaccucaacggcgacuacgaggucgagcccggcugcggcggcgagcgcaacgccuaccucaaggagcacuccaucgagaccuuccucauccuccgcugcacccagaagcgcaaggaggagaaggccaugaucgccaagaugaaccgccagcgcaccaacuccaucggccacaaccccccccacuggggcgccgagcgccccuucuacaaccaccucggcggcaaccaggucuccaaggagaugaagcgcaugggcuucgaggaccccaaggacaagaacgcccaggaguccgccaaccccgaggacgaggucgacgaguuccucggccgcgccaucgacgcccgcuccaucgaccgccuccgcuccgagcacguccgcaaguuccuccucaccuuccgcgagcccgaccucgagaagaaguacuccaagcaggucgacgaccgcuucggcgccuacgucgccugcgccucccucgucuuccucuucaucugcuucguccagaucaccaucgucccccacuccaucuucaugcucuccuucuaccucaccugcucccuccuccucacccucgucgucuucgucuccgucaucuacuccugcgucaagcucuuccccuccccccuccagacccucucccgcaagaucguccgcuccaagaugaacuccacccucgucggcgucuucaccaucacccucgucuuccucgccgccuucgucaacauguucaccugcaacucccgcgaccuccucggcugccucgcccaggagcacaacaucuccgccucccaggucaacgccugccacgucgccgaguccgccgucaacuacucccucggcgacgagcagggcuucugcggcucccccuggcccaacugcaacuuccccgaguacuucaccuacuccguccuccucucccuccucgccugcuccgucuuccuccagaucuccugcaucggcaagcucguccucaugcucgccaucgagcucaucuacguccucaucgucgagguccccggcgucacccucuucgacaacgccgaccuccucgucaccgccaacgccaucgacuucuucaacaacggcaccucccagugccccgagcacgccaccaaggucgcccucaaggucgucacccccaucaucaucuccgucuucguccucgcccucuaccuccacgcccagcaggucgaguccaccgcccgccucgacuuccucuggaagcuccaggccaccgaggagaaggaggagauggaggagcuccaggccuacaaccgccgccuccuccacaacauccuccccaaggacgucgccgcccacuuccucgcccgcgagcgccgcaacgacgagcucuacuaccaguccugcgagugcgucgccgucauguucgccuccaucgccaacuucuccgaguucuacgucgagcucgaggccaacaacgagggcgucgagugccuccgccuccucaacgagaucaucgccgacuucgacgagaucaucuccgaggaccgcuuccgccagcucgagaagaucaagaccaucggcuccaccuacauggccgccuccggccucaacgacuccaccuacgacaaggucggcaagacccacaucaaggcccucgccgacuucgccaugaagcucauggaccagaugaaguacaucaacgagcacuccuucaacaacuuccagaugaagaucggccucaacaucggccccgucgucgccggcgucaucggcgcccgcaagccccaguacgacaucuggggcaacaccgucaacgucgccucccgcauggacuccaccggcguccccgaccgcauccaggucaccaccgacauguaccagguccucgccgccaacaccuaccagcucgagugccgcggcgucgucaaggucaagggcaagggcgagaugaugaccuacuuccucaacggcggccccccccucuccuga

SEQ ID NO: 39416 - RNA, 3507 nt, Artificial Sequence
  derived and/or modified sequence opt2 from ADCY6__Homo_sapiens__NP_056085
auguccugguucuccggccuccucguccccaaggucgacgagcgcaagaccgccuggggcgagcgcaacggccagaagcgcucccgccgccgcggcacccgcgccggcggcuucugcaccccccgcuacauguccugccuccgcgacgccgagccccccucccccacccccgccggccccccccgcugccccuggcaggacgacgccuucauccgccgcggcggccccggcaagggcaaggagcucggccuccgcgccgucgcccucggcuucgaggacaccgaggucaccaccaccgccggcggcaccgccgaggucgcccccgacgccgucccccgcuccggccgcuccugcuggcgccgccucguccaggucuuccaguccaagcaguuccgcuccgccaagcucgagcgccucuaccagcgcuacuucuuccagaugaaccaguccucccucacccuccucauggccguccucguccuccucaccgccguccuccucgccuuccacgccgcccccgcccgcccccagcccgccuacgucgcccuccucgccugcgccgccgcccucuucgucggccucauggucgucugcaaccgccacuccuuccgccaggacuccaugugggucgucuccuacgucguccucggcauccucgccgccguccaggucggcggcgcccucgccgccgacccccgcucccccuccgccggccucuggugccccgucuucuucgucuacaucgccuacacccuccuccccauccgcaugcgcgccgccguccucuccggccucggccucuccacccuccaccucauccucgccuggcagcucaaccgcggcgacgccuuccucuggaagcagcucggcgccaacguccuccucuuccucugcaccaacgucaucggcaucugcacccacuaccccgccgaggucucccagcgccaggccuuccaggagacccgcggcuacauccaggcccgccuccaccuccagcacgagaaccgccagcaggagcgccuccuccucuccguccucccccagcacgucgccauggagaugaaggaggacaucaacaccaagaaggaggacaugauguuccacaagaucuacauccagaagcacgacaacgucuccauccucuucgccgacaucgagggcuucaccucccucgccucccagugcaccgcccaggagcucgucaugacccucaacgagcucuucgcccgcuucgacaagcucgccgccgagaaccacugccuccgcaucaagauccucggcgacugcuacuacugcgucuccggccuccccgaggcccgcgccgaccacgcccacugcugcgucgagaugggcgucgacaugaucgaggccaucucccucguccgcgaggucaccggcgucaacgucaacaugcgcgucggcauccacuccggccgcguccacugcggcguccucggccuccgcaaguggcaguucgacgucugguccaacgacgucacccucgccaaccacauggaggccggcggccgcgccggccgcauccacaucacccgcgccacccuccaguaccucaacggcgacuacgaggucgagcccggccgcggcggcgagcgcaacgccuaccucaaggagcagcacaucgagaccuuccucauccucggcgccucccagaagcgcaaggaggagaaggccaugcucgccaagcuccagcgcacccgcgccaacuccauggagggccucaugccccgcuggguccccgaccgcgccuucucccgcaccaaggacuccaaggccuuccgccagaugggcaucgacgacuccuccaaggacaaccgcggcacccaggacgcccucaaccccgaggacgaggucgacgaguuccucucccgcgccaucgacgcccgcuccaucgaccagcuccgcaaggaccacguccgccgcuuccuccucaccuuccagcgcgaggaccucgagaagaaguacucccgcaaggucgacccccgcuucggcgccuacgucgccugcgcccuccucgucuucugcuucaucugcuucauccagcuccucaucuucccccacuccacccucaugcucggcaucuacgccuccaucuuccuccuccuccucaucaccguccucaucugcgccgucuacuccugcggcucccucuuccccaaggcccuccagcgccucucccgcuccaucguccgcucccgcgcccacuccaccgccgucggcaucuucuccguccuccucgucuucaccuccgccaucgccaacauguucaccugcaaccacacccccauccgcuccugcgccgcccgcaugcucaaccucacccccgccgacaucaccgccugccaccuccagcagcucaacuacucccucggccucgacgccccccucugcgagggcaccaugcccaccugcuccuuccccgaguacuucaucggcaacaugcuccucucccuccucgccuccuccgucuuccuccacaucuccuccaucggcaagcucgccaugaucuucguccucggccucaucuaccucguccuccuccuccucggcccccccgccaccaucuucgacaacuacgaccuccuccucggcguccacggccucgccuccuccaacgagaccuucgacggccucgacugccccgccgccggccgcgucgcccucaaguacaugacccccgucauccuccucgucuucgcccucgcccucuaccuccacgcccagcaggucgaguccaccgcccgccucgacuuccucuggaagcuccaggccaccggcgagaaggaggagauggaggagcuccaggccuacaaccgccgccuccuccacaacauccuccccaaggacgucgccgcccacuuccucgcccgcgagcgccgcaacgacgagcucuacuaccaguccugcgagugcgucgccgucauguucgccuccaucgccaacuucuccgaguucuacgucgagcucgaggccaacaacgagggcgucgagugccuccgccuccucaacgagaucaucgccgacuucgacgagaucaucuccgaggagcgcuuccgccagcucgagaagaucaagaccaucggcuccaccuacauggccgccuccggccucaacgccuccaccuacgaccaggucggccgcucccacaucaccgcccucgccgacuacgccaugcgccucauggagcagaugaagcacaucaacgagcacuccuucaacaacuuccagaugaagaucggccucaacaugggccccgucgucgccggcgucaucggcgcccgcaagccccaguacgacaucuggggcaacaccgucaacgucuccucccgcauggacuccaccggcguccccgaccgcauccaggucaccaccgaccucuaccagguccucgccgccaagggcuaccagcucgagugccgcggcgucgucaaggucaagggcaagggcgagaugaccaccuacuuccucaacggcggccccuccuccuga

SEQ ID NO: 39417 - RNA, 3243 nt, Artificial Sequence
  derived and/or modified sequence opt2 from ADCY7__Homo_sapiens__NP_001105
augcccgccaagggccgcuacuuccucaacgagggcgaggagggccccgaccaggacgcccucuacgagaaguaccagcucaccucccagcacggcccccuccuccucacccuccuccucgucgccgccaccgccugcgucgcccucaucaucaucgccuucucccagggcgaccccucccgccaccaggccauccucggcauggccuuccucguccucgccgucuucgccgcccucuccguccucauguacgucgagugccuccuccgccgcuggcuccgcgcccucgcccuccucaccugggccugccucgucgcccucggcuacguccucgucuucgacgccuggaccaaggccgccugcgccugggagcagguccccuucuuccucuucaucgucuucgucgucuacacccuccuccccuucuccaugcgcggcgccgucgccgucggcgccgucuccaccgccucccaccuccucguccucggcucccucaugggcggcuucaccacccccuccguccgcgucggccuccagcuccucgccaacgccgucaucuuccucugcggcaaccucaccggcgccuuccacaagcaccagaugcaggacgccucccgcgaccucuucaccuacaccgucaagugcauccagauccgccgcaagcuccgcaucgagaagcgccagcaggagaaccuccuccucuccguccuccccgcccacaucuccaugggcaugaagcucgccaucaucgagcgccucaaggagcacggcgaccgccgcugcaugcccgacaacaacuuccacucccucuacgucaagcgccaccagaacgucuccauccucuacgccgacaucgucggcuucacccagcucgccuccgacugcucccccaaggagcucgucgucguccucaacgagcucuucggcaaguucgaccagaucgccaaggccaacgagugcaugcgcaucaagauccucggcgacugcuacuacugcgucuccggccuccccgucucccuccccacccacgcccgcaacugcgucaagaugggccucgacaugugccaggccaucaagcagguccgcgaggccaccggcgucgacaucaacaugcgcgucggcauccacuccggcaacguccucugcggcgucaucggccuccgcaaguggcaguacgacgucuggucccacgacgucucccucgccaaccgcauggaggccgccggcguccccggccgcguccacaucaccgaggccacccucaagcaccucgacaaggccuacgaggucgaggacggccacggccagcagcgcgaccccuaccucaaggagaugaacauccgcaccuaccucgucaucgacccccgcucccagcagccccccccccccucccagcaccucccccgccccaagggcgacgccgcccucaagaugcgcgccuccguccgcaugacccgcuaccucgaguccuggggcgccgcccgccccuucgcccaccucaaccaccgcgaguccgucuccuccggcgagacccacguccccaacggccgccgccccaaguccgucccccagcgccaccgccgcacccccgaccgcuccaugucccccaagggccgcuccgaggacgacuccuacgacgacgagaugcucuccgccaucgagggccucuccuccacccgccccugcugcuccaaguccgacgacuucuacaccuucggcuccaucuuccucgagaagggcuucgagcgcgaguaccgccucgcccccaucccccgcgcccgccacgacuucgccugcgccucccucaucuucgucugcauccuccucguccacguccuccucaugccccgcaccgccgcccucggcgucuccuucggccucgucgccugcguccucggccucguccucggccucugcuucgccaccaaguucucccgcugcugccccgcccgcggcacccucugcaccaucuccgagcgcgucgagacccagccccuccuccgccucacccucgccguccucaccaucggcucccuccucaccgucgccaucaucaaccucccccucaugcccuuccagguccccgagcuccccgucggcaacgagaccggccuccucgccgccuccuccaagacccgcgcccucugcgagccccuccccuacuacaccugcuccugcguccucggcuucaucgccugcuccgucuuccuccgcaugucccucgagcccaaggucguccuccucaccgucgcccucgucgccuaccucguccucuucaaccucucccccugcuggcagugggacugcugcggccagggccucggcaaccucaccaagcccaacggcaccaccuccggcacccccuccugcuccuggaaggaccucaagaccaugaccaacuucuaccucguccucuucuacaucacccuccucacccucucccgccagaucgacuacuacugccgccucgacugccucuggaagaagaaguucaagaaggagcacgaggaguucgagaccauggagaacgucaaccgccuccuccucgagaacguccuccccgcccacgucgccgcccacuucaucggcgacaagcucaacgaggacugguaccaccaguccuacgacugcgucugcgucauguucgccuccguccccgacuucaaggucuucuacaccgagugcgacgucaacaaggagggccucgagugccuccgccuccucaacgagaucaucgccgacuucgacgagcuccuccucaagcccaaguucuccggcgucgagaagaucaagaccaucggcuccaccuacauggccgccgccggccucuccgucgccuccggccacgagaaccaggagcucgagcgccagcacgcccacaucggcgucauggucgaguucuccaucgcccucauguccaagcucgacggcaucaaccgccacuccuucaacuccuuccgccuccgcgucggcaucaaccacggccccgucaucgccggcgucaucggcgcccgcaagccccaguacgacaucuggggcaacaccgucaacgucgccucccgcauggaguccaccggcgagcucggcaagauccaggucaccgaggagaccugcaccauccuccagggccucggcuacuccugcgagugccgcggccucaucaacgucaagggcaagggcgagcuccgcaccuacuucgucugcaccgacaccgccaaguuccagggccucggccucaacuga

SEQ ID NO: 39418 - RNA, 3756 nt, Artificial Sequence
  derived and/or modified sequence opt2 from ADCY8__Homo_sapiens__NP_001106
auggagcucuccgacguccgcugccucaccggcuccgaggagcucuacaccauccaccccaccccccccgccggcgacggccgcuccgccucccgcccccagcgccuccucuggcagaccgccguccgccacaucaccgagcagcgcuucauccacggccaccgcggcggcuccggcuccggcuccggcggcuccggcaaggccuccgaccccgccggcggcggccccaaccaccacgccccccagcucuccggcgacuccgcccucccccucuacucccucggccccggcgagcgcgcccacuccaccugcggcaccaaggucuuccccgagcgcuccggcuccggcuccgccuccggcuccggcggcggcggcgaccucggcuuccuccaccucgacugcgcccccuccaacuccgacuucuuccucaacggcggcuacuccuaccgcggcgucaucuuccccacccuccgcaacuccuucaagucccgcgaccucgagcgccucuaccagcgcuacuuccucggccagcgccgcaaguccgaggucgucaugaacguccucgacguccucaccaagcucacccuccucguccuccaccucucccucgccuccgcccccauggacccccucaagggcauccuccucggcuucuucaccggcaucgaggucgucaucugcgcccucgucgucguccgcaaggacaccaccucccacaccuaccuccaguacuccggcgucgucaccugggucgccaugaccacccagauccucgccgccggccucggcuacggccuccucggcgacggcaucggcuacguccucuucacccucuucgccaccuacuccaugcucccccucccccucaccugggccauccucgccggccucggcaccucccuccuccaggucauccuccaggucgucaucccccgccucgccgucaucuccaucaaccaggucgucgcccaggccguccucuucaugugcaugaacaccgccggcaucuucaucuccuaccucuccgaccgcgcccagcgccaggccuuccucgagacccgccgcugcgucgaggcccgccuccgccucgagaccgagaaccagcgccaggagcgccucguccucuccguccucccccgcuucgucguccucgagaugaucaacgacaugaccaacgucgaggacgagcaccuccagcaccaguuccaccgcaucuacauccaccgcuacgagaacgucuccauccucuucgccgacgucaagggcuucaccaaccucuccaccacccucuccgcccaggagcucguccgcaugcucaacgagcucuucgcccgcuucgaccgccucgcccacgagcaccacugccuccgcaucaagauccucggcgacugcuacuacugcgucuccggccuccccgagccccgccaggaccacgcccacugcugcgucgagaugggccucuccaugaucaagaccauccgcuacguccgcucccgcaccaagcacgacgucgacaugcgcaucggcauccacuccggcuccguccucugcggcguccucggccuccgcaaguggcaguucgacgucugguccugggacgucgacaucgccaacaagcucgaguccggcggcauccccggccgcauccacaucuccaaggccacccucgacugccucaacggcgacuacaacgucgaggagggccacggcaaggagcgcaacgaguuccuccgcaagcacaacaucgagaccuaccucaucaagcagcccgaggacucccuccucucccuccccgaggacaucgucaaggaguccgucuccuccuccgaccgccgcaacuccggcgccaccuucaccgagggcuccuggucccccgagcuccccuucgacaacaucgucggcaagcagaacacccucgccgcccucacccgcaacuccaucaaccuccuccccaaccaccucgcccaggcccuccacguccaguccggccccgaggagaucaacaagcgcaucgagcacaccaucgaccuccgcuccggcgacaagcuccgccgcgagcacaucaagcccuucucccucauguucaaggacuccucccucgagcacaaguacucccagaugcgcgacgaggucuucaaguccaaccucgucugcgccuucaucguccuccucuucaucaccgccauccagucccuccuccccuccucccgcgucaugcccaugaccauccaguucuccauccucaucaugcuccacuccgcccucguccucaucaccaccgccgaggacuacaagugccucccccucauccuccgcaagaccugcugcuggaucaacgagaccuaccucgcccgcaacgucaucaucuucgccuccauccucaucaacuuccucggcgccauccucaacauccucuggugcgacuucgacaaguccaucccccucaagaaccucaccuucaacuccuccgccgucuucaccgacaucugcuccuaccccgaguacuucgucuucaccggcguccucgccauggucaccugcgccgucuuccuccgccucaacuccguccucaagcucgccguccuccucaucaugaucgccaucuacgcccuccucaccgagaccgucuacgccggccucuuccuccgcuacgacaaccucaaccacuccggcgaggacuuccucggcaccaaggaggucucccuccuccucauggccauguuccuccucgccgucuucuaccacggccagcagcucgaguacaccgcccgccucgacuuccucuggcgcguccaggccaaggaggagaucaacgagaugaaggagcuccgcgagcacaacgagaacaugcuccgcaacauccuccccucccacgucgcccgccacuuccucgagaaggaccgcgacaacgaggagcucuacucccaguccuacgacgccgucggcgucauguucgccuccauccccggcuucgccgacuucuacucccagaccgagaugaacaaccagggcgucgagugccuccgccuccucaacgagaucaucgccgacuucgacgagcuccucggcgaggaccgcuuccaggacaucgagaagaucaagaccaucggcuccaccuacauggccgucuccggccucucccccgagaagcagcagugcgaggacaaguggggccaccucugcgcccucgccgacuucucccucgcccucaccgaguccauccaggagaucaacaagcacuccuucaacaacuucgagcuccgcaucggcaucucccacggcuccgucgucgccggcgucaucggcgccaagaagccccaguacgacaucuggggcaagaccgucaaccucgccucccgcauggacuccaccggcgucuccggccgcauccagguccccgaggagaccuaccucauccucaaggaccagggcuucgccuucgacuaccgcggcgagaucuacgucaagggcaucuccgagcaggagggcaagaucaagaccuacuuccuccucggccgcguccagcccaaccccuucauccuccccccccgccgccuccccggccaguacucccucgccgccgucguccucggccucguccagucccucaaccgccagcgccagaagcagcuccucaacgagaacaacaacaccggcaucaucaagggccacuacaaccgccgcacccuccucucccccuccggcaccgagcccggcgcccaggccgagggcaccgacaaguccgaccuccccuga

SEQ ID NO: 39419 - RNA, 4062 nt, Artificial Sequence
  derived and/or modified sequence opt2 from ADCY9__Homo_sapiens__NP_001107
auggccucccccccccaccagcagcuccuccaccaccacuccaccgaggucuccugcgacuccuccggcgacuccaacuccguccgcgucaagaucaaccccaagcagcucuccuccaacucccaccccaagcacugcaaguacuccaucuccuccuccugcuccuccuccggcgacuccggcggcgucccccgccgcgucggcggcggcggccgccuccgccgccagaagaagcucccccagcucuucgagcgcgccuccucccgcuggugggaccccaaguucgacuccgucaaccucgaggaggccugccucgagcgcugcuucccccagacccagcgccgcuuccgcuacgcccucuucuacaucggcuucgccugccuccucugguccaucuacuucgccguccacaugcgcucccgccucaucgucauggucgcccccgcccucugcuuccuccucgucugcgucggcuucuuccucuucaccuucaccaagcucuacgcccgccacuacgccuggaccucccucgcccucacccuccucgucuucgcccucacccucgccgcccaguuccagguccucacccccgucuccggccgcggcgacuccuccaaccucaccgccaccgcccgccccaccgacaccugccucucccaggucggcuccuucuccaugugcaucgagguccucuuccuccucuacaccgucaugcaccucccccucuaccucucccucugccucggcgucgccuacuccguccucuucgagaccuucggcuaccacuuccgcgacgaggccugcuuccccucccccggcgccggcgcccuccacugggagcuccucucccgcggccuccuccacggcugcauccacgccaucggcguccaccucuucgucaugucccagguccgcucccgcuccaccuuccucaaggucggccaguccaucaugcacggcaaggaccucgaggucgagaaggcccucaaggagcgcaugauccacuccgucaugccccgcaucaucgccgacgaccucaugaagcagggcgacgaggaguccgagaacuccgucaagcgccacgccaccuccucccccaagaaccgcaagaagaaguccuccauccagaaggcccccaucgccuuccgccccuucaagaugcagcagaucgaggaggucuccauccucuucgccgacaucgucggcuucaccaagauguccgccaacaaguccgcccacgcccucgucggccuccucaacgaccucuucggccgcuucgaccgccucugcgaggagaccaagugcgagaagaucuccacccucggcgacugcuacuacugcgucgccggcugccccgagccccgcgccgaccacgccuacugcugcaucgagaugggccucggcaugaucaaggccaucgagcaguucugccaggagaagaaggagauggucaacaugcgcgucggcguccacaccggcaccguccucugcggcauccucggcaugcgccgcuucaaguucgacgucugguccaacgacgucaaccucgccaaccucauggagcagcucggcgucgccggcaagguccacaucuccgaggccaccgccaaguaccucgacgaccgcuacgagauggaggacggcaaggucaucgagcgccucggccaguccgucgucgccgaccagcucaagggccucaagaccuaccucaucuccggccagcgcgccaaggagucccgcugcuccugcgccgaggcccuccucuccggcuucgaggucaucgacggcucccaggucuccuccggcccccgcggccagggcaccgccuccuccggcaacgucuccgaccucgcccagaccgucaagaccuucgacaaccucaagaccugccccuccugcggcaucaccuucgcccccaaguccgaggccggcgccgagggcggcgccccccagaacggcugccaggacgagcacaagaacuccaccaaggccuccggcggccccaaccccaagacccagaacggccuccucucccccccccaggaggagaagcucaccaacucccagaccucccucugcgagauccuccaggagaagggccgcugggccggcgucucccucgaccaguccgcccuccucccccuccgcuucaagaacauccgcgagaagaccgacgcccacuucgucgacgucaucaaggaggacucccucaugaaggacuacuucuucaagccccccaucaaccaguucucccucaacuuccucgaccaggagcucgagcgcuccuaccgcaccuccuaccaggaggaggucaucaagaacucccccgucaagaccuucgccucccccaccuucuccucccuccucgacgucuuccucuccaccaccgucuuccucacccucuccaccaccugcuuccucaaguacgaggccgccaccgucccccccccccccgccgcccucgccgucuucuccgccgcccuccuccucgagguccucucccucgccgucuccauccgcauggucuucuuccucgaggacgucauggccugcaccaagcgccuccucgaguggaucgccggcuggcucccccgccacugcaucggcgccauccucgucucccuccccgcccucgccgucuacucccacgucaccuccgaguacgagaccaacauccacuuccccgucuucaccggcuccgccgcccucaucgccgucguccacuacugcaacuucugccagcucuccuccuggaugcgcuccucccucgccaccgucgucggcgccggcccccuccuccuccucuacgucucccucugccccgacuccuccguccucaccuccccccucgacgccguccagaacuucuccuccgagcgcaaccccugcaacuccuccgucccccgcgaccuccgccgccccgccucccucaucggccaggaggucguccucgucuucuuccuccuccuccuccucgucugguuccucaaccgcgaguucgaggucuccuaccgccuccacuaccacggcgacgucgaggccgaccuccaccgcaccaagauccaguccaugcgcgaccaggccgacuggcuccuccgcaacaucauccccuaccacgucgccgagcagcucaaggucucccagaccuacuccaagaaccacgacuccggcggcgucaucuucgccuccaucgucaacuucuccgaguucuacgaggagaacuacgagggcggcaaggagugcuaccgcguccucaacgagcucaucggcgacuucgacgagcuccucuccaagcccgacuacuccuccaucgagaagaucaagaccaucggcgccaccuacauggccgccuccggccucaacaccgcccaggcccaggacggcucccacccccaggagcaccuccagauccucuucgaguucgccaaggagaugaugcgcgucgucgacgacuucaacaacaacaugcucugguucaacuucaagcuccgcgucggcuucaaccacggcccccucaccgccggcgucaucggcaccaccaagcuccucuacgacaucuggggcgacaccgucaacaucgccucccgcauggacaccaccggcgucgagugccgcauccaggucuccgaggaguccuaccgcguccucuccaagaugggcuacgacuucgacuaccgcggcaccgucaacgucaagggcaagggccagaugaagaccuaccucuaccccaagugcaccgaccaccgcgucaucccccagcaccagcucuccaucucccccgacauccgcguccaggucgacggcuccaucggccgcucccccaccgacgagaucgccaaccucguccccuccguccaguacgucgacaagaccucccucggcuccgacuccuccacccaggccaaggacgcccaccucucccccaagcgccccuggaaggagcccgucaaggccgaggagcgcggccgcuucggcaaggccaucgagaaggacgacugcgacgagaccggcaucgaggaggccaacgagcucaccaagcucaacgucuccaaguccgucuga

SEQ ID NO: 39420 - RNA, 531 nt, Artificial Sequence
  derived and/or modified sequence opt2 from ADCYAP1__Homo_sapiens__NP_001093203
augaccaugugcuccggcgcccgccucgcccuccucgucuacggcaucaucaugcacuccuccgucuacuccucccccgccgccgccggccuccgcuuccccggcauccgccccgaggaggaggccuacggcgaggacggcaacccccuccccgacuucgacggcuccgagccccccggcgccggcucccccgccuccgccccccgcgccgccgccgccugguaccgccccgccggccgccgcgacgucgcccacggcauccucaacgaggccuaccgcaagguccucgaccagcucuccgccggcaagcaccuccagucccucgucgcccgcggcgucggcggcucccucggcggcggcgccggcgacgacgccgagccccucuccaagcgccacuccgacggcaucuucaccgacuccuacucccgcuaccgcaagcagauggccgucaagaaguaccucgccgccguccucggcaagcgcuacaagcagcgcgucaagaacaagggccgccgcaucgccuaccucuga

SEQ ID NO: 39421 - RNA, 1407 nt, Artificial Sequence
  derived and/or modified sequence opt2 from ADCYAP1R1__Homo_sapiens__NP_001109
auggccggcgucguccacgucucccucgccgcccuccuccuccuccccauggcccccgccaugcacuccgacugcaucuucaagaaggagcaggccaugugccucgagaagauccagcgcgccaacgagcucaugggcuucaacgacuccucccccggcugccccggcaugugggacaacaucaccugcuggaagcccgcccacgucggcgagaugguccucgucuccugccccgagcucuuccgcaucuucaaccccgaccaggucugggagaccgagaccaucggcgaguccgacuucggcgacuccaacucccucgaccucuccgacaugggcgucgucucccgcaacugcaccgaggacggcugguccgagcccuucccccacuacuucgacgccugcggcuucgacgaguacgaguccgagaccggcgaccaggacuacuacuaccucuccgucaaggcccucuacaccgucggcuacuccaccucccucgucacccucaccaccgccauggucauccucugccgcuuccgcaagcuccacugcacccgcaacuucauccacaugaaccucuucgucuccuucaugcuccgcgccaucuccgucuucaucaaggacuggauccucuacgccgagcaggacuccaaccacugcuucaucuccaccgucgagugcaaggccgucauggucuucuuccacuacugcgucgucuccaacuacuucuggcucuucaucgagggccucuaccucuucacccuccucgucgagaccuucuuccccgagcgccgcuacuucuacugguacaccaucaucggcuggggcacccccaccgucugcgucaccgucugggccacccuccgccucuacuucgacgacaccggcugcugggacaugaacgacuccaccgcccucuggugggucaucaagggccccgucgucggcuccaucauggucaacuucguccucuucaucggcaucaucgucauccucguccagaagcuccagucccccgacaugggcggcaacgaguccuccaucuaccuccgccucgcccgcuccacccuccuccucaucccccucuucggcauccacuacaccgucuucgccuucucccccgagaacgucuccaagcgcgagcgccucgucuucgagcucggccucggcuccuuccagggcuucgucgucgccguccucuacugcuuccucaacggcgagguccaggccgagaucaagcgcaaguggcgcuccuggaaggucaaccgcuacuucgccgucgacuucaagcaccgccaccccucccucgccuccuccggcgucaacggcggcacccagcucuccauccucuccaaguccuccucccagauccgcauguccggccuccccgccgacaaccucgccaccuga

SEQ ID NO: 39422 - RNA, 2214 nt, Artificial Sequence
  derived and/or modified sequence opt2 from ADD1__Homo_sapiens__NP_001110
augaacggcgacucccgcgccgccgucgucaccucccccccccccaccaccgccccccacaaggagcgcuacuucgaccgcgucgacgagaacaaccccgaguaccuccgcgagcgcaacauggcccccgaccuccgccaggacuucaacaugauggagcagaagaagcgcgucuccaugauccuccagucccccgccuucugcgaggagcucgaguccaugauccaggagcaguucaagaagggcaagaaccccaccggccuccucgcccuccagcagaucgccgacuucaugaccaccaacguccccaacgucuaccccgccgccccccagggcggcauggccgcccucaacaugucccucggcauggucacccccgucaacgaccuccgcggcuccgacuccaucgccuacgacaagggcgagaagcuccuccgcugcaagcucgccgccuucuaccgccucgccgaccucuucggcuggucccagcucaucuacaaccacaucaccacccgcgucaacuccgagcaggagcacuuccucaucguccccuucggccuccucuacuccgaggucaccgccuccucccucgucaagaucaaccuccagggcgacaucgucgaccgcggcuccaccaaccucggcgucaaccaggccggcuucacccuccacuccgccaucuacgccgcccgccccgacgucaagugcgucguccacauccacacccccgccggcgccgccgucuccgccaugaagugcggccuccuccccaucucccccgaggcccucucccucggcgaggucgccuaccacgacuaccacggcauccucgucgacgaggaggagaagguccucauccagaagaaccucggccccaaguccaagguccucauccuccgcaaccacggccucgucuccgucggcgaguccgucgaggaggccuucuacuacauccacaaccucgucgucgccugcgagauccagguccgcacccucgccuccgccggcggccccgacaaccucguccuccucaaccccgagaaguacaaggccaagucccgcucccccggcucccccgucggcgagggcaccggcuccccccccaaguggcagaucggcgagcaggaguucgaggcccucaugcgcaugcucgacaaccucggcuaccgcaccggcuaccccuaccgcuaccccgcccuccgcgagaaguccaagaaguacuccgacgucgagguccccgccuccgucaccggcuacuccuucgccuccgacggcgacuccggcaccugcuccccccuccgccacuccuuccagaagcagcagcgcgagaagacccgcuggcucaacuccggccgcggcgacgaggccuccgaggagggccagaacggcuccucccccaaguccaagaccaaguggaccaaggaggacggccaccgcaccuccaccuccgccguccccaaccucuucgucccccucaacaccaaccccaaggagguccaggagaugcgcaacaagauccgcgagcagaaccuccaggacaucaagaccgccggcccccagucccagguccucugcggcgucgucauggaccgcucccucguccagggcgagcucgucaccgccuccaaggccaucaucgagaaggaguaccagccccacgucaucgucuccaccaccggccccaaccccuucaccacccucaccgaccgcgagcucgaggaguaccgccgcgaggucgagcgcaagcagaagggcuccgaggagaaccucgacgaggcccgcgagcagaaggagaaguccccccccgaccagcccgccgucccccaccccccccccuccacccccaucaagcucgaggaggaccucguccccgagcccaccaccggcgacgacuccgacgccgccaccuucaagcccacccuccccgaccucucccccgacgagcccuccgaggcccucggcuuccccaugcucgagaaggaggaggaggcccaccgcccccccucccccaccgaggcccccaccgaggccucccccgagcccgcccccgaccccgcccccgucgccgaggaggccgcccccuccgccgucgaggagggcgccgccgccgaccccggcuccgacggcucccccggcaagucccccuccaagaagaagaagaaguuccgcacccccuccuuccucaagaaguccaagaagaaguccgacuccuga

SEQ ID NO: 39423 - RNA, 1728 nt, Artificial Sequence
  derived and/or modified sequence opt2 from ADD2__Homo_sapiens__NP_001171984
augccccgccgccgcguccccggcgccaacugcaagcccaccggcaagauguccgaggagaccguccccgaggccgccucccccccccccccccagggccagcccuacuucgaccgcuucuccgaggacgaccccgaguacaugcgccuccgcaaccgcgccgccgaccuccgccaggacuucaaccucauggagcagaagaagcgcgucaccaugauccuccagucccccuccuuccgcgaggagcucgagggccucauccaggagcagaugaagaagggcaacaacuccuccaacaucugggcccuccgccagaucgccgacuucauggccuccaccucccacgccgucuuccccaccuccuccaugaacgucuccaugaugacccccaucaacgaccuccacaccgccgacucccucaaccucgccaagggcgagcgccucaugcgcugcaagaucuccuccgucuaccgccuccucgaccucuacggcugggcccagcucuccgacaccuacgucacccuccgcgucuccaaggagcaggaccacuuccucaucucccccaagggcgucuccugcuccgaggucaccgccuccucccucaucaaggucaacauccucggcgaggucgucgagaagggcuccuccugcuuccccgucgacaccaccggcuucugccuccacuccgccaucuacgccgcccgccccgacguccgcugcaucauccaccuccacacccccgccaccgccgccgucuccgccaugaaguggggccuccuccccgucucccacaacgcccuccucgucggcgacauggccuacuacgacuucaacggcgagauggagcaggaggccgaccgcaucaaccuccagaagugccucggccccaccugcaagauccucguccuccgcaaccacggcgucgucgcccucggcgacaccgucgaggaggccuucuacaagaucuuccaccuccaggccgccugcgagauccaggucuccgcccucuccuccgccggcggcgucgagaaccucauccuccucgagcaggagaagcaccgcccccacgaggucggcuccguccagugggccggcuccaccuucggccccaugcagaagucccgccucggcgagcacgaguucgaggcccucaugcgcaugcucgacaaccucggcuaccgcaccggcuacaccuaccgccaccccuucguccaggagaagaccaagcacaaguccgaggucgagauccccgccaccgucaccgccuucgucuucgaggaggacggcgcccccguccccgcccuccgccagcacgcccagaagcagcagaaggagaagacccgcuggcucaacacccccaacaccuaccuccgcgucaacgucgccgacgagguccagcgcuccaugggcuccccccgccccaagaccaccuggaugaaggccgacgaggucgagaaguccuccuccggcaugcccauccgcaucgagaaccccaaccaguucgucccccucuacaccgacccccaggagguccucgagaugcgcaacaagauccgcgagcagaaccgccaggacgucaaguccgccggcccccagucccagcuccucgccuccgucaucgccgagaagucccgcucccccgucgagcagcgccucccccucaccggcggcgagaccugccuccccuccggcuccuccguccccggcgccggccuccaggaccccuga

SEQ ID NO: 39424 - RNA, 2121 nt, Artificial Sequence
  derived and/or modified sequence opt2 from ADD3__Homo_sapiens__NP_058432
auguccuccgacgccucccagggcgucaucaccaccccccccccccccuccaugccccacaaggagcgcuacuucgaccgcaucaacgagaacgaccccgaguacauccgcgagcgcaacaugucccccgaccuccgccaggacuucaacaugauggagcagcgcaagcgcgucacccagauccuccagucccccgccuuccgcgaggaccucgagugccucauccaggagcagaugaagaagggccacaaccccaccggccuccucgcccuccagcagaucgccgacuacaucauggccaacuccuucuccggcuucuccucccccccccucucccucggcauggucacccccaucaacgaccuccccggcgccgacaccuccuccuacgucaagggcgagaagcucacccgcugcaagcucgccucccucuaccgccucgucgaccucuucggcugggcccaccucgccaacaccuacaucuccguccgcaucuccaaggagcaggaccacaucaucaucaucccccgcggccucuccuucuccgaggccaccgccuccaaccucgucaaggucaacaucaucggcgaggucgucgaccagggcuccaccaaccucaagaucgaccacaccggcuucuccccccacgccgccaucuacuccacccgccccgacgucaagugcgucauccacauccacacccucgccaccgccgccgucuccuccaugaagugcggcauccuccccaucucccaggagucccuccuccucggcgacgucgccuacuacgacuaccagggcucccucgaggagcaggaggagcgcauccagcuccagaagguccucggccccuccugcaagguccucguccuccgcaaccacggcgucgucgcccucggcgagacccucgaggaggccuuccacuacaucuucaacguccagcucgccugcgagauccagguccaggcccucgccggcgccggcggcgucgacaaccuccacguccucgacuuccagaaguacaaggccuucaccuacaccgucgccgccuccggcggcggcggcgucaacaugggcucccaccagaaguggaaggucggcgagaucgaguucgagggccucaugcgcacccucgacaaccucggcuaccgcaccggcuacgccuaccgccacccccucauccgcgagaagccccgccacaaguccgacgucgagauccccgccaccgucaccgccuucuccuucgaggacgacaccgucccccucuccccccucaaguacauggcccagcgccagcagcgcgagaagacccgcuggcucaacucccccaacaccuacaugaaggucaacguccccgaggagucccgcaacggcgagaccuccccccgcaccaagaucaccuggaugaaggccgaggacuccuccaaggucuccggcggcacccccaucaagaucgaggaccccaaccaguucgucccccucaacaccaaccccaacgagguccucgagaagcgcaacaagauccgcgagcagaaccgcuacgaccucaagaccgccggcccccagucccagcuccucgccggcaucgucgucgacaagccccccuccaccaugcaguucgaggacgacgaccacggcccccccgccccccccaaccccuucucccaccucaccgagggcgagcucgaggaguacaagcgcaccaucgagcgcaagcagcagggccucgaggacgccgagcaggagcuccucuccgacgacgccuccuccgucucccagauccagucccagacccaguccccccagaacguccccgagaagcucgaggagaaccacgagcucuucuccaaguccuucaucuccauggagguccccgucauggucgucaacggcaaggacgacaugcacgacgucgaggacgagcucgccaagcgcgucucccgccucuccaccuccaccaccaucgagaacaucgagaucaccaucaagucccccgagaagaucgaggagguccucucccccgagggcucccccuccaagucccccuccaagaagaagaagaaguuccgcacccccuccuuccucaagaagaacaagaagaaggagaaggucgaggccuga

SEQ ID NO: 39425 - RNA, 5004 nt, Artificial Sequence
  derived and/or modified sequence opt2 from ADGB__Homo_sapiens__NP_078970
auggccuccaagcagaccaagaagaaggagguccaccgcaucaacuccgcccacggcuccgacaaguccaaggacuucuaccccuucggcuccaacguccaguccggcuccaccgagcagaagaagggcaaguucccccucuggcccgagugguccgaggccgacaucaacuccgagaagugggacgccggcaagggcgccaaggagaaggacaagaccggcaagucccccgucuuccacuucuucgaggaccccgagggcaagaucgagcucccccccucccucaagaucuacuccuggaagcgcccccaggacauccucuucucccagacccccgucgucgucaagaacgagaucaccuucgaccucuucuccgccaacgagcaccuccucugcuccgagcucaugcgcuggaucaucuccgagaucuacgccgucuggaagaucuucaacggcggcauccucuccaacuacuucaagggcaccuccggcgagcccccccuccuccccuggaagcccugggagcacaucuacucccucugcaaggccgucaagggccacaugccccucuucaacuccuacggcaaguacgucgucaagcucuacuggaugggcugcuggcgcaagaucaccaucgacgacuuccuccccuucgacgaggacaacaaccuccuccuccccgccaccaccuacgaguucgagcucuggcccaugcuccucuccaaggccaucaucaagcucgccaacaucgacauccacgucgccgaccgccgcgagcucggcgaguucaccgucauccacgcccucaccggcuggcuccccgaggucaucucccuccaccccggcuacauggacaaggucugggagcuccucaaggagauccuccccgaguucaagcucuccgacgaggccuccuccgaguccaagaucgccguccucgacuccaagcucaaggagcccggcaaggagggcaaggagggcaaggagaucaaggacggcaaggaggucaaggacgucaaggaguucaagcccgaguccucccucaccacccucaaggcccccgagaaguccgacaagguccccaaggagaaggccgacgcccgcgacaucggcaagaagcgcuccaaggacggcgagaaggagaaguucaaguucucccuccacggcucccgccccuccuccgagguccaguacuccguccagucccucuccgacugcuccuccgccauccagaccucccacauggucgucuacgccaccuucaccccccucuaccucuucgagaacaagaucuucucccucgagaagauggccgacuccgccgagaagcuccgcgaguacggccucucccacaucugcucccaccccguccucgucacccgcucccgcuccugcccccucgucgccccccccaagccccccccccucccccccuggaagcucauccgccagaagaaggagaccgucaucaccgacgaggcccaggagcucaucgucaagaagcccgagcgcuuccucgagaucuccucccccuuccucaacuaccgcaugacccccuucaccauccccaccgagaugcacuucguccgcucccucaucaagaagggcaucccccccggcuccgaccuccccuccgucuccgagaccgacgagaccgccacccacucccagaccgaccucucccagaucaccaaggccaccucccagggcaacaccgccucccaggucauccucggcaagggcaccgacgagcagaccgacuucggccucggcgacgcccaccaguccgacggccucaaccucgagcgcgagaucgucucccagaccaccgccacccaggagaagucccaggaggagcuccccaccaccaacaacuccgucuccaaggagaucuggcucgacuucgaggacuucugcgucugcuuccagaacaucuacaucuuccacaagcccuccuccuacugccucaacuuccagaaguccgaguucaaguucuccgaggagcgcgucuccuacuaccucuucgucgacucccucaagcccaucgagcuccucgucugcuucuccgcccucguccgcuggggcgaguacggcgcccucaccaaggacuccccccccaucgagcccggccuccucaccgccgagaccuucuccuggaagucccucaagcccggcucccucguccucaagauccacaccuacgccaccaaggccaccgucguccgccuccccgucggccgccacaugcuccucuucaacgccuacucccccgucggccacuccauccacaucugcuccauggucuccuucgucaucggcgacgagcacgucguccuccccaacuucgagcccgaguccugccgcuucaccgagcagucccuccucaucaugaaggccaucggcaacgucaucgccaacuucaaggacaagggcaagcucuccgccgcccucaaggaccuccagaccgcccacuaccccguccccuuccacgacaaggagcucaccgcccagcacuuccgcgucuuccaccucucccucuggcgccucaugaagaagguccagaucaccaagcccccccccaacuucaaguucgccuuccgcgccaugguccucgaccucgagcuccucaacuccucccucgaggaggucucccucgucgaguggcucgacgucaaguacugcaugcccaccuccgacaaggaguacuccgccgaggaggucgccgccgccaucaagauccaggccauguggcgcggcaccuacguccgccuccucaugaaggcccgcauccccgacaccaaggagaacaucuccgucgccgacacccuccagaaggucugggccguccucgagaugaaccucgagcaguacgccgucucccuccuccgccucauguucaaguccaagugcaagucccucgaguccuaccccugcuaccaggacgaggagaccaagaucgccuucgccgacuacaccgucaccuaccaggagcagccccccaacuccugguucaucgucuuccgcgagaccuuccucguccaccaggacaugauccucguccccaaggucuacaccacccuccccaucugcauccuccacaucgucaacaacgacaccauggagcagguccccaaggucuuccagaaggucguccccuaccucuacaccaagaacaagaagggcuacaccuucgucgccgaggccuucaccggcgacaccuacgucgccgccucccgcuggaagcuccgccucaucggcuccuccgccccccuccccugccucucccgcgacucccccugcaacuccuucgccaucaaggagauccgcgacuacuacauccccaacgacaagaagauccucuuccgcuacuccgucaagguccucaccccccagcccgccaccauccagguccgcaccuccaagcccgacgccuucaucaagcuccagguccucgagaacgaggagaccauggucuccuccaccggcaagggccaggccaucauccccgccuuccacuuccucaaguccgagaagggccucuccucccaguccuccaagcacauccucuccuuccacuccgccuccaagaaggagcaggaggucuacgucaagaagaaggccgcccagggcauccagaagucccccaagggccgcgccgucuccgccauccaggacaucggccucccccucgucgaggaggagaccaccuccacccccacccgcgaggacuccuccuccaccccccuccagaacuacaaguacaucauccagugcuccguccucuacaacuccuggccccucaccgagucccagcucaccuucguccaggcccucaaggaccucaagaaguccaacaccaaggccuacggcgagcgccacgaggagcucaucaaccucggcucccccgacucccacaccaucuccgagggccagaaguccuccgucaccuccaagaccacccgcaagggcaaggagaaguccuccgagaaggagaagaccgccaaggagaagcaggccccccgcuucgagccccagaucuccaccguccacccccagcaggaggaccccaacaagcccuacuggauccuccgccucgucaccgagcacaacgaguccgagcucuucgaggucaagaaggacaccgagcgcgccgacgagauccgcgccaugaagcaggccugggagaccaccgagcccggccgcgccaucaaggccucccaggcccgccuccacuaccucuccggcuucaucaagaagaccuccgacgccgaguccccccccaucuccgagucccagaccaagcccaaggaggaggucgagaccgccgcccgcggcgucaaggagcccaacuccaagaacuccgccggcuccgaguccaaggagaugacccagaccggcuccggcuccgccgucuggaagaaguggcagcucaccaagggccuccgcgacgucgccaaguccaccuccuccgaguccggcggcgucuccucccccggcaaggaggagcgcgagcaguccacccgcaaggagaacauccagaccggcccccgcacccgcucccccaccauccucgagaccuccccccgccucauccgcaaggcccucgaguucauggaccucucccaguacguccgcaagaccgacaccgacccccuccuccagaccgacgagcucaaccagcagcaggccaugcagaaggccgaggagauccaccaguuccgccagcaccgcacccgcguccucuccauccgcaacaucgaccaggaggagcgccucaagcucaaggacgagguccucgacauguacaaggagaugcaggacucccucgacgaggcccgccagaagaucuucgacauccgcgaggaguaccgcaacaagcuccucgaggccgagcaccucaagcucgagacccucgccgcccaggaggccgccaugaagcucgagaccgagaagaugacccccgcccccgacacccagaagaagaagaagggcaagaagaaguga

SEQ ID NO: 39426 - RNA, 1683 nt, Artificial Sequence
  derived and/or modified sequence opt2 from ADGRA1__Homo_sapiens__NP_001077378
auggaccucaagaccguccucucccucccccgcuaccccggcgaguuccuccaccccgucgucuacgccugcaccgccgucaugcuccucugccuccucgccuccuucgucaccuacaucguccaccaguccgccauccgcaucucccgcaagggccgccacacccuccucaacuucugcuuccacgccgcccucaccuucaccgucuucgccggcggcaucaaccgcaccaaguaccccauccucugccaggccgucggcaucguccuccacuacuccacccucuccaccaugcucuggaucggcgucaccgcccgcaacaucuacaagcaggucaccaagaaggccccccucugccucgacaccgaccagccccccuacccccgccagccccuccuccgcuucuaccucgucuccggcggcguccccuucaucaucugcggcgucaccgccgccaccaacauccgcaacuacggcaccgaggacgaggacaccgccuacugcuggauggccugggagcccucccucggcgccuucuacggccccgccgccaucaucacccucgucaccugcgucuacuuccucggcaccuacguccagcuccgccgccaccccggccgccgcuacgagcuccgcacccagcccgaggagcagcgccgccucgccacccccgagggcggccgcggcauccgccccggcaccccccccgcccacgacgcccccggcgccuccguccuccagaacgagcacuccuuccaggcccagcuccgcgccgccgccuucacccucuuccucuucaccgccaccugggccuucggcgcccucgccgucucccagggccacuuccucgacauggucuucuccugccucuacggcgccuucugcgucacccucggccucuucguccucauccaccacugcgccaagcgcgaggacgucuggcagugcuggugggccugcugccccccccgcaaggacgcccaccccgcccucgacgccaacggcgccgcccucggccgcgccgccugccuccacucccccggccucggccagccccgcggcuucgcccacccccccggccccugcaagaugaccaaccuccaggccgcccagggccacgccuccugccucucccccgccacccccugcugcgccaagaugcacugcgagccccucaccgccgacgaggcccacguccaccuccaggaggagggcgccuucggccacgacccccaccuccacggcugccuccagggccgcaccaagccccccuacuucucccgccaccccgccgaggagcccgaguacgccuaccacauccccuccucccucgacggcuccccccgcuccucccgcaccgacuccccccccuccucccucgacggccccgccggcacccacacccucgccugcugcacccagggcgaccccuuccccauggucacccagcccgagggcuccgacggcucccccgcccucuacuccugccccacccagcccggccgcgaggccgcccucggccccggccaccucgagaugcuccgccgcacccagucccuccccuucggcggccccucccagaacggccuccccaagggcaagcuccucgagggccuccccuucggcaccgacggcaccggcaacauccgcaccggccccuggaagaacgagaccaccgucuga

SEQ ID NO: 39427 - RNA, 4017 nt, Artificial Sequence
  derived and/or modified sequence opt2 from ADGRA2__Homo_sapiens__NP_116166
augggcgccggcggccgccgcaugcgcggcgcccccgcccgccuccuccucccccuccuccccuggcuccuccuccuccucgcccccgaggcccgcggcgcccccggcugcccccucuccauccgcuccugcaagugcuccggcgagcgccccaagggccucuccggcggcguccccggccccgcccgccgccgcgucgucugcuccggcggcgaccuccccgagccccccgagcccggccuccuccccaacggcaccgucacccuccuccucuccaacaacaagaucaccggccuccgcaacggcuccuuccucggccucucccuccucgagaagcucgaccuccgcaacaacaucaucuccaccguccagcccggcgccuuccucggccucggcgagcucaagcgccucgaccucuccaacaaccgcaucggcugccucaccuccgagaccuuccagggccucccccgccuccuccgccucaacaucuccggcaacaucuucuccucccuccagcccggcgucuucgacgagcuccccgcccucaaggucgucgaccucggcaccgaguuccucaccugcgacugccaccuccgcuggcuccuccccugggcccagaaccgcucccuccagcucuccgagcacacccucugcgccuaccccuccgcccuccacgcccaggcccucggcucccuccaggaggcccagcucugcugcgagggcgcccucgagcuccacacccaccaccucauccccucccuccgccaggucgucuuccagggcgaccgccuccccuuccagugcuccgccuccuaccucggcaacgacacccgcauccgcugguaccacaaccgcgcccccgucgagggcgacgagcaggccggcauccuccucgccgagucccucauccacgacugcaccuucaucaccuccgagcucacccucucccacaucggcgucugggccuccggcgagugggagugcaccgucuccauggcccagggcaacgccuccaagaaggucgagaucgucguccucgagaccuccgccuccuacugccccgccgagcgcgucgccaacaaccgcggcgacuuccgcuggccccgcacccucgccggcaucaccgccuaccaguccugccuccaguaccccuucaccuccgucccccucggcggcggcgcccccggcacccgcgccucccgccgcugcgaccgcgccggccgcugggagcccggcgacuacucccacugccucuacaccaacgacaucacccgcguccucuacaccuucguccucaugcccaucaacgccuccaacgcccucacccucgcccaccagcuccgcgucuacaccgccgaggccgccuccuucuccgacaugauggacgucgucuacgucgcccagaugauccagaaguuccucggcuacgucgaccagaucaaggagcucgucgaggucauggucgacauggccuccaaccucaugcucgucgacgagcaccuccucuggcucgcccagcgcgaggacaaggccugcucccgcaucgucggcgcccucgagcgcaucggcggcgccgcccucuccccccacgcccagcacaucuccgucaacgcccgcaacgucgcccucgaggccuaccucaucaagccccacuccuacgucggccucaccugcaccgccuuccagcgccgcgagggcggcguccccggcacccgccccggcucccccggccagaaccccccccccgagcccgagccccccgccgaccagcagcuccgcuuccgcugcaccaccggccgccccaacgucucccucuccuccuuccacaucaagaacuccgucgcccucgccuccauccagcucccccccucccucuucuccucccuccccgccgcccucgccccccccgucccccccgacugcacccuccagcuccucgucuuccgcaacggccgccucuuccacucccacuccaacaccucccgccccggcgccgccggccccggcaagcgccgcggcgucgccacccccgucaucuucgccggcaccuccggcugcggcgucggcaaccucaccgagcccgucgccgucucccuccgccacugggccgagggcgccgagcccgucgccgccugguggucccaggagggccccggcgaggccggcggcuggaccuccgagggcugccagcuccgcuccucccagcccaacgucuccgcccuccacugccagcaccucggcaacgucgccguccucauggagcucuccgccuucccccgcgaggucggcggcgccggcgccggccuccaccccgucgucuaccccugcaccgcccuccuccuccucugccucuucgccaccaucaucaccuacauccucaaccacuccuccauccgcgucucccgcaagggcuggcacaugcuccucaaccucugcuuccacaucgccaugaccuccgccgucuucgccggcggcaucacccucaccaacuaccagauggucugccaggccgucggcaucacccuccacuacuccucccucuccacccuccucuggaugggcgucaaggcccgcguccuccacaaggagcucaccuggcgcgccccccccccccaggagggcgaccccgcccuccccacccccucccccaugcuccgcuucuaccucaucgccggcggcaucccccucaucaucugcggcaucaccgccgccgucaacauccacaacuaccgcgaccacucccccuacugcuggcucgucuggcgccccucccucggcgccuucuacauccccgucgcccucauccuccucaucaccuggaucuacuuccucugcgccggccuccgccuccgcggcccccucgcccagaaccccaaggccggcaacucccgcgccucccucgaggccggcgaggagcuccgcggcuccacccgccuccgcggcuccggcccccuccucuccgacuccggcucccuccucgccaccggcuccgcccgcgucggcacccccggcccccccgaggacggcgacucccucuacucccccggcguccagcucggcgcccucgucaccacccacuuccucuaccucgccaugugggccugcggcgcccucgccgucucccagcgcuggcucccccgcgucgucugcuccugccucuacggcgucgccgccuccgcccucggccucuucgucuucacccaccacugcgcccgccgccgcgacguccgcgccuccuggcgcgccugcugcccccccgccucccccgccgccccccacgcccccccccgcgcccuccccgccgccgccgaggacggcucccccgucuucggcgagggcccccccucccucaaguccucccccuccggcuccuccggccacccccucgcccucggccccugcaagcucaccaaccuccagcucgcccagucccaggucugcgaggccggcgccgccgccggcggcgagggcgagcccgagcccgccggcacccgcggcaaccucgcccaccgccaccccaacaacguccaccacggccgccgcgcccacaagucccgcgccaagggccaccgcgccggcgaggccugcggcaagaaccgccucaaggcccuccgcggcggcgccgccggcgcccucgagcuccucuccuccgaguccggcucccuccacaacucccccaccgacuccuaccucggcuccucccgcaacucccccggcgccggccuccagcucgagggcgagcccaugcucacccccuccgagggcuccgacaccuccgccgccccccucuccgaggccggccgcgccggccagcgccgcuccgccucccgcgacucccucaagggcggcggcgcccucgagaaggagucccaccgccgcuccuacccccucaacgccgccucccucaacggcgcccccaagggcggcaaguacgacgacgucacccucaugggcgccgaggucgccuccggcggcugcaugaagaccggccucuggaaguccgagaccaccgucuga

SEQ ID NO: 39428 - RNA, 3966 nt, Artificial Sequence
  derived and/or modified sequence opt2 from ADGRA3__Homo_sapiens__NP_660333
auggagccccccggccgccgccgcggccgcgcccagcccccccuccuccucccccucucccuccucgcccuccucgcccuccucggcggcggcggcggcggcggcgccgccgcccuccccgccggcugcaagcacgacggccgcccccgcggcgccggccgcgccgccggcgccgccgagggcaaggucgucugcuccucccucgagcucgcccagguccucccccccgacacccuccccaaccgcaccgucacccucauccucuccaacaacaagaucuccgagcucaagaacggcuccuucuccggccucucccuccucgagcgccucgaccuccgcaacaaccucaucuccuccaucgaccccggcgccuucuggggccucuccucccucaagcgccucgaccucaccaacaaccgcaucggcugccucaacgccgacaucuuccgcggccucaccaaccucguccgccucaaccucuccggcaaccucuucuccucccucucccagggcaccuucgacuaccucgccucccuccgcucccucgaguuccagaccgaguaccuccucugcgacugcaacauccucuggaugcaccgcugggucaaggagaagaacaucaccguccgcgacacccgcugcgucuaccccaagucccuccaggcccagcccgucaccggcgucaagcaggagcuccucaccugcgaccccccccucgagcuccccuccuucuacaugacccccucccaccgccaggucgucuucgagggcgacucccuccccuuccagugcauggccuccuacaucgaccaggacaugcagguccucugguaccaggacggccgcaucgucgagaccgacgagucccagggcaucuucgucgagaagaacaugauccacaacugcucccucaucgccuccgcccucaccaucuccaacauccaggccggcuccaccggcaacuggggcugccacguccagaccaagcgcggcaacaacacccgcaccgucgacaucgucguccucgaguccuccgcccaguacugcccccccgagcgcgucgucaacaacaagggcgacuuccgcuggccccgcacccucgccggcaucaccgccuaccuccagugcacccgcaacacccacggcuccggcaucuaccccggcaacccccaggacgagcgcaaggccuggcgccgcugcgaccgcggcggcuucugggccgacgacgacuacucccgcugccaguacgccaacgacgucacccgcguccucuacauguucaaccagaugccccucaaccucaccaacgccgucgccaccgcccgccagcuccucgccuacaccgucgaggccgccaacuucuccgacaagauggacgucaucuucgucgccgagaugaucgagaaguucggccgcuucaccaaggaggagaaguccaaggagcucggcgacgucauggucgacaucgccuccaacaucaugcucgccgacgagcgcguccucuggcucgcccagcgcgaggccaaggccugcucccgcaucguccagugccuccagcgcaucgccaccuaccgccucgccggcggcgcccacgucuacuccaccuacucccccaacaucgcccucgaggccuacgucaucaaguccaccggcuucaccggcaugaccugcaccgucuuccagaaggucgccgccuccgaccgcaccggccucuccgacuacggccgccgcgaccccgagggcaaccucgacaagcagcucuccuucaagugcaacgucuccaacaccuucuccucccucgcccucaagaacaccaucgucgaggccuccauccagcucccccccucccucuucucccccaagcagaagcgcgagcuccgccccaccgacgacucccucuacaagcuccagcucaucgccuuccgcaacggcaagcucuuccccgccaccggcaacuccaccaaccucgccgacgacggcaagcgccgcaccgucgucacccccgucauccucaccaagaucgacggcgucaacgucgacacccaccacauccccgucaacgucacccuccgccgcaucgcccacggcgccgacgccgucgccgcccgcugggacuucgaccuccucaacggccagggcggcuggaaguccgacggcugccacauccucuacuccgacgagaacaucaccaccauccagugcuacucccucuccaacuacgccguccucauggaccucaccggcuccgagcucuacacccaggccgccucccuccuccaccccgucgucuacaccaccgccaucauccuccuccucugccuccucgccgucaucgucuccuacaucuaccaccacucccucauccgcaucucccucaaguccuggcacaugcucgucaaccucugcuuccacaucuuccucaccugcgucgucuucgucggcggcaucacccagacccgcaacgccuccaucugccaggccgucggcaucauccuccacuacuccacccucgccaccguccucugggucggcgucaccgcccgcaacaucuacaagcaggucaccaagaaggccaagcgcugccaggaccccgacgagccccccccccccccccgccccaugcuccgcuucuaccucaucggcggcggcauccccaucaucgucugcggcaucaccgccgccgccaacaucaagaacuacggcucccgccccaacgcccccuacugcuggauggccugggagcccucccucggcgccuucuacggccccgccuccuucaucaccuucgucaacugcauguacuuccucuccaucuucauccagcucaagcgccaccccgagcgcaaguacgagcucaaggagcccaccgaggagcagcagcgccucgccgccaacgagaacggcgagaucaaccaccaggacuccaugucccucucccucaucuccaccuccgcccucgagaacgagcacaccuuccacucccagcuccucggcgccucccucacccuccuccucuacgucgcccucuggauguucggcgcccucgccgucucccucuacuacccccucgaccucgucuucuccuucgucuucggcgccaccucccucuccuucuccgccuucuucgucguccaccacugcgucaaccgcgaggacguccgccucgccuggaucaugaccugcugccccggccgcuccuccuacuccguccaggucaacguccagccccccaacuccaacggcaccaacggcgaggcccccaagugccccaacuccuccgccgaguccuccugcaccaacaaguccgccuccuccuucaagaacuccucccagggcugcaagcucaccaaccuccaggccgccgccgcccagugccacgccaacucccucccccucaacuccaccccccagcucgacaacucccucaccgagcacuccauggacaacgacaucaagaugcacgucgccccccucgagguccaguuccgcaccaacguccacuccucccgccaccacaagaaccgcuccaagggccaccgcgccucccgccucaccguccuccgcgaguacgccuacgacguccccaccuccgucgagggcuccguccagaacggccuccccaagucccgccucggcaacaacgagggccacucccgcucccgccgcgccuaccucgccuaccgcgagcgccaguacaaccccccccagcaggacuccuccgacgccugcuccacccuccccaaguccucccgcaacuucgagaagcccgucuccaccaccuccaagaaggacgcccuccgcaagcccgccgucgucgagcucgagaaccagcagaaguccuacggccucaaccucgccauccagaacggccccaucaaguccaacggccaggagggcccccuccucggcaccgacuccaccggcaacguccgcaccggccucuggaagcacgagaccaccgucuga

SEQ ID NO: 39429 - RNA, 4755 nt, Artificial Sequence
  derived and/or modified sequence opt2 from ADGRB1__Homo_sapiens__XP_011515501
augcgcggccaggccgccgcccccggccccgucuggauccucgccccccuccuccuccuccuccuccuccucggccgccgcgcccgcgccgccgccggcgccgacgccggccccggccccgagcccugcgccacccucguccagggcaaguucuucggcuacuucuccgccgccgccgucuuccccgccaacgccucccgcugcuccuggacccuccgcaaccccgacccccgccgcuacacccucuacaugaaggucgccaaggcccccguccccugcuccggccccggccgcguccgcaccuaccaguucgacuccuuccucgaguccacccgcaccuaccucggcgucgaguccuucgacgagguccuccgccucugcgaccccuccgccccccucgccuuccuccaggccuccaagcaguuccuccagaugcgccgccagcagcccccccagcacgacggccuccgcccccgcgccggcccccccggccccaccgacgacuucuccgucgaguaccucgucgucggcaaccgcaaccccucccgcgccgccugccagaugcucugccgcuggcucgacgccugccucgccggcucccgcuccucccaccccugcggcaucaugcagacccccugcgccugccucggcggcgaggccggcggccccgccgccggcccccucgccccccgcggcgacgucugccuccgcgacgccgucgccggcggccccgagaacugccucaccucccucacccaggaccgcggcggccacggcgccaccggcggcuggaagcucuggucccucuggggcgagugcacccgcgacugcggcggcggccuccagacccgcacccgcaccugccuccccgcccccggcgucgagggcggcggcugcgagggcguccucgaggagggccgccagugcaaccgcgaggccugcggccccgccggccgcaccuccucccgcucccagucccuccgcuccaccgacgcccgccgccgcgaggagcucggcgacgagcuccagcaguucggcuuccccgccccccagaccggcgaccccgccgccgaggaguggucccccugguccgucugcuccuccaccugcggcgagggcuggcagacccgcacccgcuucugcgucuccuccuccuacuccacccagugcuccggcccccuccgcgagcagcgccucugcaacaacuccgccgucugccccguccacggcgccugggacgaguggucccccuggucccucugcuccuccaccugcggccgcggcuuccgcgaccgcacccgcaccugccgccccccccaguucggcggcaaccccugcgagggccccgagaagcagaccaaguucugcaacaucgcccucugccccggccgcgccgucgacggcaacuggaacgagugguccuccugguccgccugcuccgccuccugcucccagggccgccagcagcgcacccgcgagugcaacggccccuccuacggcggcgccgagugccagggccacugggucgagacccgcgacugcuuccuccagcagugccccgucgacggcaaguggcaggccugggccuccuggggcuccugcuccgucaccugcggcgccggcucccagcgccgcgagcgcgucugcuccggccccuucuucggcggcgccgccugccagggcccccaggacgaguaccgccagugcggcacccagcgcugccccgagccccacgagaucugcgacgaggacaacuucggcgccgucaucuggaaggagacccccgccggcgaggucgccgccguccgcugcccccgcaacgccaccggccucauccuccgccgcugcgagcucgacgaggagggcaucgccuacugggagccccccaccuacauccgcugcgucuccaucgacuaccgcaacauccagaugaugacccgcgagcaccucgccaaggcccagcgcggccuccccggcgagggcgucuccgaggucauccagacccucgucgagaucucccaggacggcaccuccuacuccggcgaccuccucuccaccaucgacguccuccgcaacaugaccgagaucuuccgccgcgccuacuacucccccacccccggcgacguccagaacuucguccagauccucuccaaccuccucgccgaggagaaccgcgacaagugggaggaggcccagcucgccggccccaacgccaaggagcucuuccgccucgucgaggacuucgucgacgucaucggcuuccgcaugaaggaccuccgcgacgccuaccaggucaccgacaaccucguccucuccauccacaagcuccccgccuccggcgccaccgacaucuccuuccccaugaagggcuggcgcgccaccggcgacugggccaagguccccgaggaccgcgucaccgucuccaaguccgucuucuccaccggccucaccgaggccgacgaggccuccgucuucgucgucggcaccguccucuaccgcaaccucggcuccuuccucgcccuccagcgcaacaccaccguccucaacuccaaggucaucuccgucaccgucaagccccccccccgcucccuccgcaccccccucgagaucgaguucgcccacauguacaacggcaccaccaaccagaccugcauccucugggacgagaccgacguccccuccuccuccgcccccccccagcucggccccugguccuggcgcggcugccgcaccgucccccucgacgcccuccgcacccgcugccucugcgaccgccucuccaccuucgccauccucgcccagcucuccgccgacgccaacauggagaaggccacccuccccuccgucacccucaucgucggcugcggcgucuccucccucacccuccucaugcucgucaucaucuacgucuccgucuggcgcuacauccgcuccgagcgcuccgucauccucaucaacuucugccucuccaucaucuccuccaacgcccucauccucaucggccagacccagacccgcaacaaggucgucugcacccucgucgccgccuuccuccacuucuucuuccucuccuccuucugcuggguccucaccgaggccuggcaguccuacauggccgucaccggccaccuccgcaaccgccucauccgcaagcgcuuccucugccucggcuggggccuccccgcccucgucgucgccaucuccgucggcuucaccaaggccaagggcuacuccaccaugaacuacugcuggcucucccucgagggcggccuccucuacgccuucgucggccccgccgccgccgucguccucgucaacauggucaucggcauccucgucuucaacaagcucgucuccaaggacggcaucaccgacaagaagcucaaggagcgcgccggcgccucccucugguccuccugcgucguccucccccuccucgcccucaccuggauguccgccguccucgccgucaccgaccgccgcuccgcccucuuccagauccucuucgccgucuucgacucccucgagggcuucgucaucgucaugguccacugcauccuccgccgcgagguccaggacgccgucaagugccgcgucgucgaccgccaggaggagggcaacggcgacuccggcggcuccuuccagaacggccacgcccagcucaugaccgacuucgagaaggacgucgaccucgccugccgcuccguccucaacaaggacaucgccgccugccgcaccgccaccaucaccggcacccucaagcgccccucccuccccgaggaggagaagcucaagcucgcccacgccaagggcccccccaccaacuucaacucccuccccgccaacgucuccaagcuccaccuccacggcuccccccgcuaccccggcggcccccuccccgacuuccccaaccacucccucacccucaagcgcgacaaggcccccaaguccuccuucgucggcgacggcgacaucuucaagaagcucgacuccgagcucucccgcgcccaggagaaggcccucgacaccuccuacgucauccuccccaccgccaccgccacccuccgccccaagcccaaggaggagcccaaguacuccauccacaucgaccagaugccccagacccgccucauccaccucuccaccgcccccgaggccucccuccccgcccgcuccccccccucccgccagccccccuccggcggcccccccgaggccccccccgcccagcccccccccccccccccccccccccccccccccccccagcagccccucccccccccccccaaccucgagcccgccccccccucccucggcgaccccggcgagcccgccgcccaccccggccccuccaccggccccuccaccaagaacgagaacgucgccacccucuccgucuccucccucgagcgccgcaagucccgcuacgccgagcucgacuucgagaagaucaugcacacccgcaagcgccaccaggacauguuccaggaccucaaccgcaagcuccagcacgccgccgagaaggacaaggagguccucggccccgacuccaagcccgagaagcagcagacccccaacaagcgccccugggagucccuccgcaaggcccacggcacccccaccugggucaagaaggagcucgagccccuccagcccuccccccucgagcuccgcuccgucgagugggagcgcuccggcgccaccaucccccucgucggccaggacaucaucgaccuccagaccgaggucuga

SEQ ID NO: 39430 - RNA, 4755 nt, Artificial Sequence
  derived and/or modified sequence opt2 from ADGRB2__Homo_sapiens__NP_001281264
auggagaacaccggcuggaugggcaagggccaccgcaugacccccgccugcccccuccuccucuccgucauccucucccuccgccucgccaccgccuucgaccccgcccccuccgccugcuccgcccucgccuccggcguccucuacggcgccuucucccuccaggaccucuuccccaccaucgccuccggcugcuccuggacccucgagaaccccgaccccaccaaguacucccucuaccuccgcuucaaccgccaggagcaggucugcgcccacuucgccccccgccuccucccccucgaccacuaccucgucaacuucaccugccuccgccccucccccgaggaggccgucgcccaggccgaguccgaggucggccgccccgaggaggaggaggccgaggccgccgccggccucgagcucugcuccggcuccggccccuucaccuuccuccacuucgacaagaacuucguccagcucugccucuccgccgagcccuccgaggccccccgccuccucgcccccgccgcccucgccuuccgcuucgucgagguccuccucaucaacaacaacaacuccucccaguucaccugcggcguccucugccgcugguccgaggagugcggccgcgccgccggccgcgccugcggcuucgcccagcccggcugcuccugccccggcgaggccggcgccggcuccaccaccaccaccucccccggcccccccgccgcccacacccucuccaacgcccucguccccggcggccccgccccccccgccgaggccgaccuccacuccggcuccuccaacgaccucuucaccaccgagaugcgcuacggcgaggagcccgaggaggagcccaaggucaagacccaguggccccgcuccgccgacgagcccggccucuacauggcccagaccggcgaccccgccgccgaggaguggucccccugguccgucugcucccucaccugcggccagggccuccagguccgcacccgcuccugcgucuccucccccuacggcacccucugcuccggcccccuccgcgagacccgccccugcaacaacuccgccaccugccccguccacggcgucugggaggaguggggcuccuggucccucugcucccgcuccugcggccgcggcucccgcucccgcaugcgcaccugcguccccccccagcacggcggcaaggccugcgagggccccgagcuccagaccaagcucugcuccauggccgccugccccgucgagggccaguggcucgaguggggccccuggggccccugcuccaccuccugcgccaacggcacccagcagcgcucccgcaagugcuccgucgccggccccgccugggccaccugcaccggcgcccucaccgacacccgcgagugcuccaaccucgagugccccgccaccgacuccaaguggggccccuggaacgccuggucccucugcuccaagaccugcgacaccggcuggcagcgccgcuuccgcaugugccaggccaccggcacccagggcuaccccugcgagggcaccggcgaggaggucaagcccugcuccgagaagcgcugccccgccuuccacgagaugugccgcgacgaguacgucaugcucaugaccuggaagaaggccgccgccggcgagaucaucuacaacaagugcccccccaacgccuccggcuccgccucccgccgcugccuccucuccgcccagggcgucgccuacuggggccuccccuccuucgcccgcugcaucucccacgaguaccgcuaccucuaccucucccuccgcgagcaccucgccaagggccagcgcaugcucgccggcgagggcaugucccaggucguccgcucccuccaggagcuccucgcccgccgcaccuacuacuccggcgaccuccucuucuccgucgacauccuccgcaacgucaccgacaccuucaagcgcgccaccuacguccccuccgccgacgacguccagcgcuucuuccaggucgucuccuucauggucgacgccgagaacaaggagaagugggacgacgcccagcaggucucccccggcuccguccaccuccuccgcgucgucgaggacuucauccaccucgucggcgacgcccucaaggccuuccaguccucccucaucgucaccgacaaccucgucaucuccauccagcgcgagcccgucuccgccgucuccuccgacaucaccuuccccaugcgcggccgccgcggcaugaaggacuggguccgccacuccgaggaccgccucuuccuccccaaggagguccucucccucuccucccccggcaagcccgccaccuccggcgccgccggcucccccggccgcggccgcggccccggcaccgucccccccggccccggccacucccaccagcgccuccuccccgccgaccccgacgaguccuccuacuucgucaucggcgccguccucuaccgcacccucggccucauccucccccccccccgccccccccucgccgucaccucccgcgucaugaccgucaccguccgcccccccacccagccccccgccgagccccucaucaccgucgagcucuccuacaucaucaacggcaccaccgacccccacugcgccuccugggacuacucccgcgccgacgccuccuccggcgacugggacaccgagaacugccagacccucgagacccaggccgcccacacccgcugccagugccagcaccucuccaccuucgccguccucgcccagccccccaaggaccucacccucgagcucgccggcucccccuccgucccccucgucaucggcugcgccgucuccugcauggcccuccucacccuccucgccaucuacgccgccuucuggcgcuucaucaaguccgagcgcuccaucauccuccucaacuucugccucuccauccucgccuccaacauccucauccucgucggccagucccgcguccucuccaagggcgucugcaccaugaccgccgccuuccuccacuucuucuuccucuccuccuucugcuggguccucaccgaggccuggcaguccuaccucgccgucaucggccgcaugcgcacccgccucguccgcaagcgcuuccucugccucggcuggggccuccccgcccucgucgucgccgucuccgucggcuucacccgcaccaagggcuacggcaccuccuccuacugcuggcucucccucgagggcggccuccucuacgccuucgucggccccgccgccgucaucguccucgucaacaugcucaucggcaucaucgucuucaacaagcucauggcccgcgacggcaucuccgacaaguccaagaagcagcgcgccggcuccgagcgcugccccugggccucccuccuccuccccugcuccgccugcggcgccguccccuccccccuccucuccuccgccuccgcccgcaacgccauggccucccucugguccuccugcgucguccucccccuccucgcccucaccuggauguccgccguccucgccaugaccgaccgccgcuccguccucuuccaggcccucuucgccgucuucaacuccgcccagggcuucgucaucaccgccguccacugcuuccuccgccgcgagguccaggacgucgucaagugccagaugggcgucugccgcgccgacgaguccgaggacucccccgacuccugcaagaacggccagcuccagauccucuccgacuucgagaaggacgucgaccucgccugccagaccguccucuucaaggaggucaacaccugcaaccccuccaccaucaccggcacccucucccgccucucccucgacgaggacgaggagcccaaguccugccucgucggccccgagggcucccucuccuucuccccccuccccggcaacauccucguccccauggccgccucccccggccucggcgagcccccccccccccaggaggccaaccccgucuacaugugcggcgagggcggccuccgccagcucgaccucaccuggcuccgccccaccgagcccggcuccgagggcgacuacaugguccucccccgccgcacccucucccuccagcccggcggcggcggcggcggcggcgaggacgccccccgcgcccgccccgagggcaccccccgccgcgccgccaagaccgucgcccacaccgagggcuaccccuccuuccucuccgucgaccacuccggccucggccucggccccgccuacggcucccuccagaaccccuacggcaugaccuuccagccccccccccccacccccuccgcccgccagguccccgagcccggcgagcgcucccgcaccaugccccgcaccguccccggcuccaccaugaagaugggcucccucgagcgcaagaagcuccgcuacuccgaccucgacuucgaggucaugcacacccgcaagcgccacuccgagcucuaccacgagcucaaccagaaguuccacaccuucgaccgcuaccgcucccaguccaccgccaagcgcgagaagcgcugguccgucuccuccggcggcgccgccgagcgcuccgucugcaccgacaagcccucccccggcgagcgccccucccucucccagcaccgccgccaccaguccugguccaccuucaaguccaugacccucggcucccucccccccaagccccgcgagcgccucacccuccaccgcgccgccgccugggagcccaccgagccccccgacggcgacuuccagaccgaggucuga

SEQ ID NO: 39431 - RNA, 4569 nt, Artificial Sequence
  derived and/or modified sequence opt2 from ADGRB3__Homo_sapiens__NP_001695
augaaggccguccgcaaccuccucaucuacaucuucuccaccuaccuccucgucauguucggcuucaacgccgcccaggacuucuggugcuccacccucgucaagggcgucaucuacggcuccuacuccgucuccgagauguuccccaagaacuucaccaacugcaccuggacccucgagaaccccgaccccaccaaguacuccaucuaccucaaguucuccaagaaggaccucuccugcuccaacuucucccuccucgccuaccaguucgaccacuucucccacgagaagaucaaggaccuccuccgcaagaaccacuccaucaugcagcucugcaacuccaagaacgccuucgucuuccuccaguacgacaagaacuucauccagauccgccgcgucuuccccaccaacuuccccggccuccagaagaagggcgaggaggaccagaaguccuucuucgaguuccucguccucaacaaggucucccccucccaguucggcugccacguccucugcaccuggcucgaguccugccucaaguccgagaacggccgcaccgaguccugcggcaucauguacaccaagugcaccugcccccagcaccucggcgaguggggcaucgacgaccagucccucauccuccucaacaacgucguccucccccucaacgagcagaccgagggcugccucacccaggagcuccagaccacccaggucugcaaccucacccgcgaggccaagcgcccccccaaggaggaguucggcaugaugggcgaccacaccaucaagucccagcgcccccgcuccguccacgagaagcgcgucccccaggagcaggccgacgccgccaaguucauggcccagaccggcgaguccggcgucgaggaguggucccagugguccaccugcuccgucaccugcggccagggcucccagguccgcacccgcaccugcgucucccccuacggcacccacugcuccggcccccuccgcgagucccgcgucugcaacaacaccgcccucugccccguccacggcgucugggaggaguggucccccuggucccucugcuccuucaccugcggccgcggccagcgcacccgcacccgcuccugcacccccccccaguacggcggccgccccugcgagggccccgagacccaccacaagcccugcaacaucgcccucugccccgucgacggccaguggcaggagugguccuccuggucccagugcuccgucaccugcuccaacggcacccagcagcgcucccgccagugcaccgccgccgcccacggcggcuccgagugccgcggccccugggccgagucccgcgagugcuacaaccccgagugcaccgccaacggccaguggaaccaguggggccacugguccggcugcuccaaguccugcgacggcggcugggagcgccgcauccgcaccugccagggcgccgucaucaccggccagcagugcgagggcaccggcgaggagguccgccgcugcuccgagcagcgcugccccgcccccuacgagaucugccccgaggacuaccucauguccauggucuggaagcgcacccccgccggcgaccucgccuucaaccagugcccccucaacgccaccggcaccaccucccgccgcugcucccucucccuccacggcgucgccuucugggagcagcccuccuucgcccgcugcaucuccaacgaguaccgccaccuccagcacuccaucaaggagcaccucgccaagggccagcgcaugcucgccggcgacggcaugucccaggucaccaagacccuccucgaccucacccagcgcaagaacuucuacgccggcgaccuccucauguccgucgagauccuccgcaacgucaccgacaccuucaagcgcgccuccuacauccccgccuccgacggcguccagaacuucuuccagaucgucuccaaccuccucgacgaggagaacaaggagaagugggaggacgcccagcagaucuaccccggcuccaucgagcucaugcaggucaucgaggacuucauccacaucgucggcaugggcaugauggacuuccagaacuccuaccucaugaccggcaacgucgucgccuccauccagaagcuccccgccgccuccguccucaccgacaucaacuuccccaugaagggccgcaagggcauggucgacugggcccgcaacuccgaggaccgcgucgucauccccaaguccaucuucacccccgucuccuccaaggagcucgacgaguccuccgucuucguccucggcgccguccucuacaagaaccucgaccucauccuccccacccuccgcaacuacaccgucaucaacuccaagaucaucgucgucaccauccgccccgagcccaagaccaccgacuccuuccucgagaucgagcucgcccaccucgccaacggcacccucaaccccuacugcguccucugggacgacuccaagaccaacgagucccucggcaccugguccacccagggcugcaagaccguccucaccgacgccucccacaccaagugccucugcgaccgccucuccaccuucgccauccucgcccagcagccccgcgagaucaucauggaguccuccggcacccccuccgucacccucaucgucggcuccggccucuccugccucgcccucaucacccucgccgucgucuacgccgcccucuggcgcuacauccgcuccgagcgcuccaucauccucaucaacuucugccucuccaucaucuccuccaacauccucauccucgucggccagacccagacccacaacaaguccaucugcaccaccaccaccgccuuccuccacuucuucuuccucgccuccuucugcuggguccucaccgaggccuggcaguccuacauggccgucaccggcaagauccgcacccgccucauccgcaagcgcuuccucugccucggcuggggccuccccgcccucgucgucgccaccuccgucggcuucacccgcaccaagggcuacggcaccgaccacuacugcuggcucucccucgagggcggccuccucuacgccuucgucggccccgccgccgccgucguccucgucaacauggucaucggcauccucgucuucaacaagcucgucucccgcgacggcauccucgacaagaagcucaagcaccgcgccggccagauguccgagccccacuccggccucacccucaagugcgccaagugcggcgucgucuccaccaccgcccucuccgccaccaccgccuccaacgccauggccucccucugguccuccugcgucguccucccccuccucgcccucaccuggauguccgccguccucgccaugaccgacaagcgcuccauccucuuccagauccucuucgccgucuucgacucccuccagggcuucgucaucgucaugguccacugcauccuccgccgcgagguccaggacgccuuccgcugccgccuccgcaacugccaggaccccaucaacgccgacuccuccuccuccuuccccaacggccacgcccagaucaugaccgacuucgagaaggacgucgacaucgccugccgcuccguccuccacaaggacaucggccccugccgcgccgccaccaucaccggcacccucucccgcaucucccucaacgacgacgaggaggagaagggcaccaaccccgagggccucuccuacuccacccuccccggcaacgucaucuccaaggucaucauccagcagcccaccggccuccacaugcccauguccaugaacgagcucuccaaccccugccucaagaaggagaacuccgagcuccgccgcaccgucuaccucugcaccgacgacaaccuccgcggcgccgacauggacaucguccacccccaggagcgcaugauggaguccgacuacaucgucaugccccgcuccuccgucaacaaccagcccuccaugaaggaggaguccaagaugaacaucggcauggagacccucccccacgagcgccuccuccacuacaaggucaaccccgaguucaacaugaacccccccgucauggaccaguucaacaugaaccucgagcagcaccucgccccccaggagcacaugcagaaccuccccuucgagccccgcaccgccgucaagaacuucauggccuccgagcucgacgacaacgccggccucucccgcuccgagaccggcuccaccaucuccauguccucccucgagcgccgcaagucccgcuacuccgaccucgacuucgagaaggucaugcacacccgcaagcgccacauggagcucuuccaggagcucaaccagaaguuccagacccucgaccgcuuccgcgacauccccaacaccuccuccauggagaaccccgcccccaacaagaaccccugggacaccuucaagaaccccuccgaguacccccacuacaccaccaucaacguccucgacaccgaggccaaggacgcccucgagcuccgccccgccgagugggagaagugccucaaccucccccucgacguccaggagggcgacuuccagaccgaggucuga

SEQ ID NO: 39432 - RNA, 2625 nt, Artificial Sequence
  derived and/or modified sequence opt2 from ADGRD1__Homo_sapiens__NP_942122
auggagaagcuccuccgccucugcugcugguacuccuggcuccuccucuucuacuacaacuuccagguccgcggcgucuacucccgcucccaggaccaccccggcuuccagguccucgccuccgccucccacuacuggccccucgagaacgucgacggcauccacgagcuccaggacaccaccggcgacaucgucgagggcaaggucaacaagggcaucuaccucaaggaggagaagggcgucacccuccucuacuacggccgcuacaacuccuccugcaucuccaagcccgagcagugcggccccgagggcgucaccuucuccuucuucuggaagacccagggcgagcagucccgccccauccccuccgccuacggcggccaggucaucuccaacggcuucaaggucugcuccuccggcggccgcggcuccgucgagcucuacacccgcgacaacuccaugaccugggaggccuccuucuccccccccggccccuacuggacccacguccucuucaccuggaaguccaaggagggccucaaggucuacgucaacggcacccucuccaccuccgaccccuccggcaaggucucccgcgacuacggcgaguccaacgucaaccucgucaucggcuccgagcaggaccaggccaagugcuacgagaacggcgccuucgacgaguucaucaucugggagcgcgcccucacccccgacgagaucgccauguacuucaccgccgccaucggcaagcacgcccuccucuccuccacccuccccucccucuucaugaccuccaccgccucccccgucaugcccaccgacgccuaccaccccaucaucaccaaccucaccgaggagcgcaagaccuuccagucccccggcgucauccucuccuaccuccagaacgucucccucucccuccccuccaagucccucuccgagcagaccgcccucaaccucaccaagaccuuccucaaggccgucggcgagauccuccuccuccccggcuggaucgcccucuccgaggacuccgccgucguccucucccucaucgacaccaucgacaccgucaugggccacgucuccuccaaccuccacggcuccaccccccaggucaccgucgagggcuccuccgccauggccgaguucuccgucgccaagauccuccccaagaccgucaacuccucccacuaccgcuuccccgcccacggccaguccuucauccagaucccccacgaggccuuccaccgccacgccugguccaccgucgucggccuccucuaccacuccaugcacuacuaccucaacaacaucuggcccgcccacaccaagaucgccgaggccaugcaccaccaggacugccuccucuucgccaccucccaccucaucucccucgaggucucccccccccccacccucucccagaaccucuccggcuccccccucaucaccguccaccucaagcaccgccucacccgcaagcagcacuccgaggccaccaacuccuccaaccgcgucuucgucuacugcgccuuccucgacuucuccuccggcgagggcgucugguccaaccacggcugcgcccucacccgcggcaaccucaccuacuccgucugccgcugcacccaccucaccaacuucgccauccucaugcaggucgucccccucgagcucgcccgcggccaccaggucgcccucuccuccaucuccuacgucggcugcucccucuccguccucugccucgucgccacccucgucaccuucgccguccucuccuccgucuccaccauccgcaaccagcgcuaccacauccacgccaaccucuccuucgccguccucgucgcccagguccuccuccucaucuccuuccgccucgagcccggcaccacccccugccaggucauggccguccuccuccacuacuucuuccucuccgccuucgccuggaugcucgucgagggccuccaccucuacuccauggucaucaaggucuucggcuccgaggacuccaagcaccgcuacuacuacggcaugggcuggggcuucccccuccucaucugcaucaucucccucuccuucgccauggacuccuacggcaccuccaacaacugcuggcucucccucgccuccggcgccaucugggccuucgucgcccccgcccucuucgucaucgucgucaacaucggcauccucaucgccgucacccgcgucaucucccagaucuccgccgacaacuacaagauccacggcgaccccuccgccuucaagcucaccgccaaggccgucgccguccuccuccccauccucggcaccuccugggucuucggcguccucgccgucaacggcugcgccgucgucuuccaguacauguucgccacccucaacucccuccagggccucuucaucuuccucuuccacugccuccucaacuccgagguccgcgccgccuucaagcacaagaccaaggucuggucccucaccuccuccuccgcccgcaccuccaacgccaagcccuuccacuccgaccucaugaacggcacccgccccggcauggccuccaccaagcucucccccugggacaaguccucccacuccgcccaccgcgucgaccucuccgccgucuga

SEQ ID NO: 39433 - RNA, 2925 nt, Artificial Sequence
  derived and/or modified sequence opt2 from ADGRD2__Homo_sapiens__XP_006717411
auggucaccggccccgaggagggcaacuccgagauggacgcccccuggggcgccggcgagcgcuggcuccacggcgccgccgucgaccgcuccggcgucucccucggccccccccccaccccccaggucaaccagggcacccucggcccccaggucgcccccgucgccgccggcgaggucgucaagaccgccggcggcgucugcaaguucuccggccagcgccucuccugguggcaggcccaggaguccugcgagcagcaguucggccaccucgcccuccagccccccgacggcguccucgccucccgccuccgcgaccccgucugggucggccagcgcgaggccccccuccgccgccccccccagcgccgcgcccgcaccaccgccguccucgucuucgacgagcgcaccgccgaccgcgccgcccgccuccgcuccccccuccccgagcucgccgcccucaccgccugcacccacguccagugggacugcgccucccccgaccccgccgcccucuucuccgucgccgcccccgcccuccccaacgcccuccagcuccgcgccuucgccgagcccggcggcgucguccgcgccgcccucgucguccgcggccagcacgcccccuuccucgccgccuuccgcgccgacggccgcuggcaccacgucugcgccaccugggagcagcgcggcggccgcugggcccucuucuccgacggccgccgccgcgccggcgcccgcggccucggcgccggccaccccguccccuccggcggcauccucguccucggccaggaccaggacucccucggcggcggcuucuccguccgccacgcccucuccggcaaccucaccgacuuccaccucugggcccgcgcccucucccccgcccagcuccaccgcgcccgcgccugcgccccccccuccgagggccuccucuuccgcugggaccccggcgcccucgacgucacccccucccuccuccccaccgucuggguccgccuccucugccccguccccuccgaggagugccccaccuggaaccccggcccccgcuccgagggcuccgagcucugccucgagccccagcccuuccucugcugcuaccgcaccgagcccuaccgccgccuccaggacgcccaguccuggcccggccaggacgucaucucccgcgucaacgcccucgccaacgacaucguccuccuccccgacccccucuccgagguccacggcgcccucucccccgccgaggccuccuccuuccucggccuccucgagcacguccucgccauggagauggccccccucggccccgccgcccuccucgccgucguccgcuuccucaagcgcgucgucgcccucggcgccggcgaccccgagcuccuccucaccggccccugggagcagcucucccagggcgucgucuccgucgccucccucguccucgaggagcaggucgccgacaccuggcucucccuccgcgaggucaucggcggccccauggcccucgucgccuccguccagcgccucgccccccuccucuccaccuccaugaccuccgagcgcccccgcaugcgcauccagcaccgccacgccggccucuccggcgucaccgucauccacuccugguucaccucccgcgucuuccagcacacccucgagggccccgaccucgagccccaggcccccgccuccuccgaggaggccaaccgcguccagcgcuuccucuccacccaggucggcuccgccaucaucuccuccgaggucugggacgucaccggcgaggucaacgucgccaugaccuuccaccuccagcaccgcgcccaguccccccucuuccccccccacccccccucccccuacaccggcggcgccugggccaccaccggcugcuccgucgccgcccucuaccucgacuccaccgccugcuucugcaaccacuccaccuccuucgccauccuccuccagaucuacgagguccagcgcggccccgaggaggagucccuccuccgcacccucuccuucgucggcugcggcgucuccuucugcgcccucaccaccaccuuccuccucuuccucgucgccggcguccccaaguccgagcgcaccaccguccacaagaaccucaccuucucccucgccuccgccgagggcuuccucaugaccuccgagugggccaaggccaacgaggucgccugcgucgccgucaccgucgccaugcacuuccucuuccucgucgccuucuccuggaugcucgucgagggccuccuccucuggcgcaaggucgucgccgucuccaugcaccccggccccggcaugcgccucuaccacgccaccggcuggggcguccccgucggcaucgucgccgucacccucgccaugcucccccacgacuacgucgcccccggccacugcuggcucaacguccacaccaacgccaucugggccuucgucggccccguccucuucguccucaccgccaacaccugcauccucgcccgcgucgucaugaucaccgucuccuccgcccgccgccgcgcccgcaugcucuccccccagcccugccuccagcagcagaucuggacccagaucugggccaccgucaagcccguccucguccuccuccccguccucggccucaccuggcucgccggcauccucguccaccucucccccgccugggccuacgccgccgucggccucaacuccauccagggccucuacaucuuccucgucuacgccgccugcaacgaggagguccgcuccgcccuccagcgcauggccgagaagaaggucgccgagguccuccgcgcccucggcgucuggggcggcgccgccaaggagcacucccuccccuucuccguccucccccucuuccucccccccaagcccuccaccccccgccacccccucaaggcccccgccuga

SEQ ID NO: 39434 - RNA, 2604 nt, Artificial Sequence
  derived and/or modified sequence opt2 from ADGRE1__Homo_sapiens__NP_001243181
augcgcggcuucaaccuccuccucuucuggggcugcugcgucaugcacuccugggagggccacauccgccccacccgcaagcccaacaccaagggcaacaacugccgcgacuccacccucugccccgccuacgccaccugcaccaacaccgucgacuccuacuacugcgccugcaagcagggcuuccucuccuccaacggccagaaccacuucaaggaccccggcguccgcugcaaggacaucaacgagugccucaccuccuccgucugccccgagcacuccgacugcgucaacuccaugggcuccuacuccugcuccugccaggucggcuucaucucccgcaacuccaccugcgaggacgucgacgagugcgccgacccccgcgccugccccgagcacgccaccugcaacaacaccgucggcaacuacuccugcuucugcaaccccggcuucgaguccuccuccggccaccucuccuuccagggccucaaggccuccugcgaggacaucgacgagugcaccgagaugugccccaucaacuccaccugcaccaacacccccggcuccuacuucugcaccugccaccccggcuucgcccccuccaacggccagcucaacuucaccgaccagggcgucgagugccgcgacaucgacgagugccgccaggaccccuccaccugcggccccaacuccaucugcaccaacgcccucggcuccuacuccugcggcugcaucgccggcuuccaccccaaccccgagggcucccagaaggacggcaacuucuccugccagcgcguccucuucaagugcaaggaggacgucauccccgacaacaagcagauccagcagugccaggagggcaccgccgucaagcccgccuacgucuccuucugcgcccagaucaacaacaucuucuccguccucgacaaggucugcgagaacaagaccaccgucgucucccucaagaacaccaccgaguccuucguccccguccucaagcagaucuccaccuggaccaaguucaccaaggaggagaccuccucccucgccaccgucuuccucgaguccgucgaguccaugacccucgccuccuucuggaagcccuccgccaacaucacccccgccguccgcaccgaguaccucgacaucgaguccaaggucaucaacaaggagugcuccgaggagaacgucacccucgaccucgucgccaagggcgacaagaugaagaucggcugcuccaccaucgaggaguccgaguccaccgagaccaccggcgucgccuucgucuccuucgucggcauggaguccguccucaacgagcgcuucuucaaggaccaccaggccccccucaccaccuccgagaucaagcucaagaugaacucccgcgucgucggcggcaucaugaccggcgagaagaaggacggcuucuccgaccccaucaucuacacccucgagaacauccagcccaagcagaaguucgagcgccccaucugcgucuccugguccaccgacgucaagggcggccgcuggaccuccuucggcugcgucauccucgaggccuccgagaccuacaccaucugcuccugcaaccagauggccaaccucgccgucaucauggccuccggcgagcucaccauggacuucucccucuacaucaucucccacgucggcaucaucaucucccucgucugccucguccucgccaucgccaccuuccuccucugccgcuccauccgcaaccacaacaccuaccuccaccuccaccucugcgucugccuccuccucgccaagacccucuuccucgccggcauccacaagaccgacaacaagaugggcugcgccaucaucgccggcuuccuccacuaccucuuccucgccugcuucuucuggaugcucgucgaggccgucauccucuuccucaugguccgcaaccucaaggucgucaacuacuucuccucccgcaacaucaagaugcuccacaucugcgccuucggcuacggccuccccaugcucgucgucgucaucuccgccuccguccagccccagggcuacggcaugcacaaccgcugcuggcucaacaccgagaccggcuucaucugguccuuccucggccccgucugcaccgucaucgucgucuccaaguacuacaacucccucgccaagugcguccucaaggaggagcagggcgaccuccgcgaccucgaguuccccggcaccugcgccgccgagcgcaucaacucccuccuccucaccuggacccucuggauccuccgccagcgccucuccuccgucaacgccgaggucuccacccucaaggacacccgccuccucaccuucaaggccuucgcccagcucuucauccucggcugcuccuggguccucggcaucuuccagaucggccccgucgccggcgucauggccuaccucuucaccaucaucaacucccuccagggcgccuucaucuuccucauccacugccuccucaacggccagguccgcgaggaguacaagcgcuggaucaccggcaagaccaagcccuccucccagucccagaccucccgcauccuccucuccuccaugcccuccgccuccaagaccggcuga

SEQ ID NO: 39435 - RNA, 2298 nt, Artificial Sequence
  derived and/or modified sequence opt2 from ADGRE2__Homo_sapiens__NP_001257981
augggcggccgcgucuuccucgucuuccucgccuucugcgucuggcucacccuccccggcgccgagacccaggacucccgcggcugcgcccgcuggugcccccaggacuccuccugcgucaacgccaccgccugccgcugcaaccccggcuucuccuccuucuccgagaucaucaccacccccauggagaccugcgacgacaucaacgagugcgccacccucuccaaggucuccugcggcaaguucuccgacugcuggaacaccgagggcuccuacgacugcgucugcucccccggcuacgagcccgucuccggcgccaagaccuucaagaacgaguccgagaacaccugccaggacgucgacgagugccagcagaacccccgccucugcaaguccuacggcaccugcgucaacacccucggcuccuacaccugccagugccuccccggcuucaagcucaagcccgaggaccccaagcucugcaccgacgucaacgagugcaccuccggccagaaccccugccacuccuccacccacugccucaacaacgucggcuccuaccagugccgcugccgccccggcuggcagcccauccccggcucccccaacggccccaacaacaccgucugcgaggacgucgacgagugcuccuccggccagcaccagugcgacuccuccaccgucugcuucaacaccgucggcuccuacuccugccgcugccgccccggcuggaagccccgccacggcauccccaacaaccagaaggacaccgucugcgaggacaugaccuucuccaccuggacccccccccccggcguccacucccagacccucucccgcuucuucgacaagguccaggaccucggccgcgacuacaagcccggccucgccaacaacaccauccaguccauccuccaggcccucgacgagcuccucgaggcccccggcgaccucgagacccucccccgccuccagcagcacugcgucgccucccaccuccucgacggccucgaggacguccuccgcggccucuccaagaaccucuccaacggccuccucaacuucuccuaccccgccggcaccgagcucucccucgagguccagaagcaggucgaccgcuccgucacccuccgccagaaccaggccgucaugcagcucgacuggaaccaggcccagaaguccggcgaccccggccccuccgucgucggccucgucuccauccccggcaugggcaagcuccucgccgaggccccccucguccucgagcccgagaagcagaugcuccuccacgagacccaccagggccuccuccaggacggcucccccauccuccucuccgacgucaucuccgccuuccucuccaacaacgacacccagaaccucuccucccccgucaccuucaccuucucccaccgcgaggaggaccccguccucaccgucaucaccuacaugggccucuccgucucccuccucugccuccuccucgccgcccucaccuuccuccucugcaaggccauccagaacaccuccaccucccuccaccuccagcucucccucugccucuuccucgcccaccuccucuuccucgucgccaucgaccagaccggccacaagguccucugcuccaucaucgccggcacccuccacuaccucuaccucgccacccucaccuggaugcuccucgaggcccucuaccucuuccucaccgcccgcaaccucaccgucgucaacuacuccuccaucaaccgcuucaugaagaagcucauguuccccgucggcuacggcguccccgccgucaccgucgccaucuccgccgccucccgcccccaccucuacggcacccccucccgcugcuggcuccagcccgagaagggcuucaucuggggcuuccucggccccgucugcgccaucuucuccgucaaccucguccucuuccucgucacccucuggauccucaagaaccgccucuccucccucaacuccgaggucuccacccuccgcaacacccgcaugcucgccuucaaggccaccgcccagcucuucauccucggcugcaccuggugccucggcauccuccaggucggccccgccgcccgcgucauggccuaccucuucaccaucaucaacucccuccagggcgucuucaucuuccucgucuacugccuccucucccagcagguccgcgagcaguacggcaagugguccaagggcauccgcaagcucaagaccgaguccgagaugcacacccucuccuccuccgccaaggccgacaccuccaagcccuccaccgucaacuga

SEQ ID NO: 39436 - RNA, 2361 nt, Artificial Sequence
  derived and/or modified sequence opt2 from ADGRE5__Homo_sapiens__NP_001020331
augggcggccgcgucuuccucgccuucugcgucuggcucacccuccccggcgccgagacccaggacucccgcggcugcgcccgcuggugcccccagaacuccuccugcgucaacgccaccgccugccgcugcaaccccggcuucuccuccuucuccgagaucaucaccacccccaccgagaccugcgacgacaucaacgagugcgccacccccuccaaggucuccugcggcaaguucuccgacugcuggaacaccgagggcuccuacgacugcgucugcucccccggcuacgagcccgucuccggcgccaagaccuucaagaacgaguccgagaacaccugccaggacgucgacgagugccagcagaacccccgccucugcaaguccuacggcaccugcgucaacacccucggcuccuacaccugccagugccuccccggcuucaaguucauccccgaggaccccaaggucugcaccgacgucgacgagugcuccuccggccagcaccagugcgacuccuccaccgucugcuucaacaccgucggcuccuacuccugccgcugccgccccggcuggaagccccgccacggcauccccaacaaccagaaggacaccgucugcgaggacaugaccuucuccaccuggacccccccccccggcguccacucccagacccucucccgcuucuucgacaagguccaggaccucggccgcgacuccaagaccuccuccgccgaggucaccauccagaacgucaucaagcucgucgacgagcucauggaggcccccggcgacgucgaggcccucgccccccccguccgccaccucaucgccacccagcuccucuccaaccucgaggacaucaugcgcauccucgccaagucccuccccaagggccccuucaccuacaucucccccuccaacaccgagcucacccucaugauccaggagcgcggcgacaagaacgucaccaugggccaguccuccgcccgcaugaagcucaacugggccgucgccgccggcgccgaggaccccggccccgccgucgccggcauccucuccauccagaacaugaccacccuccucgccaacgccucccucaaccuccacuccaagaagcaggccgagcucgaggagaucuacgaguccuccauccgcggcguccagcuccgccgccucuccgccgucaacuccaucuuccucucccacaacaacaccaaggagcucaacucccccauccucuucgccuucucccaccucgaguccuccgacggcgaggccggccgcgacccccccgccaaggacgucaugcccggcccccgccaggagcuccucugcgccuucuggaaguccgacuccgaccgcggcggccacugggccaccgagggcugccagguccucggcuccaagaacggcuccaccaccugccagugcucccaccucuccuccuucgccauccucauggcccacuacgacgucgaggacuggaagcucacccucaucacccgcgucggccucgcccucucccucuucugccuccuccucugcauccucaccuuccuccucguccgccccauccagggcucccgcaccaccauccaccuccaccucugcaucugccucuucgucggcuccaccaucuuccucgccggcaucgagaacgagggcggccaggucggccuccgcugccgccucgucgccggccuccuccacuacugcuuccucgccgccuucugcuggaugucccucgagggccucgagcucuacuuccucgucguccgcgucuuccagggccagggccucuccacccgcuggcucugccucaucggcuacggcgucccccuccucaucgucggcgucuccgccgccaucuacuccaagggcuacggccgcccccgcuacugcuggcucgacuucgagcagggcuuccucugguccuuccucggccccgucaccuucaucauccucugcaacgccgucaucuucgucaccaccgucuggaagcucacccagaaguucuccgagaucaaccccgacaugaagaagcucaagaaggcccgcgcccucaccaucaccgccaucgcccagcucuuccuccucggcugcaccugggucuucggccucuucaucuucgacgaccgcucccucguccucaccuacgucuucaccauccucaacugccuccagggcgccuuccucuaccuccuccacugccuccucaacaagaagguccgcgaggaguaccgcaagugggccugccucgucgccggcggcuccaaguacuccgaguucaccuccaccaccuccggcaccggccacaaccagacccgcgcccuccgcgccuccgaguccggcaucuga

SEQ ID NO: 39437 - RNA, 4041 nt, Artificial Sequence
  derived and/or modified sequence opt2 from ADGRF5__Homo_sapiens__NP_056049
augaaguccccccgccgcaccacccucugccucauguucaucgucaucuacuccuccaaggccgcccucaacuggaacuacgaguccaccauccacccccucucccuccacgagcacgagcccgccggcgaggaggcccuccgccagaagcgcgccgucgccaccaagucccccaccgccgaggaguacaccgucaacaucgagaucuccuucgagaacgccuccuuccucgaccccaucaaggccuaccucaacucccucuccuuccccauccacggcaacaacaccgaccagaucaccgacauccucuccaucaacgucaccaccgucugccgccccgccggcaacgagaucuggugcuccugcgagaccggcuacggcuggccccgcgagcgcugccuccacaaccucaucugccaggagcgcgacgucuuccuccccggccaccacugcuccugccucaaggagcucccccccaacggccccuucugccuccuccaggaggacgucacccucaacaugcgcguccgccucaacgucggcuuccaggaggaccucaugaacaccuccuccgcccucuaccgcuccuacaagaccgaccucgagaccgccuuccgcaagggcuacggcauccuccccggcuucaagggcgucaccgucaccggcuucaaguccggcuccgucgucgucaccuacgaggucaagaccaccccccccucccucgagcucauccacaaggccaacgagcaggucguccagucccucaaccagaccuacaagauggacuacaacuccuuccaggccgucaccaucaacgaguccaacuucuucgucacccccgagaucaucuucgagggcgacaccgucucccucgucugcgagaaggagguccucuccuccaacgucuccuggcgcuacgaggagcagcagcucgagauccagaacuccucccgcuucuccaucuacaccgcccucuucaacaacaugaccuccgucuccaagcucaccauccacaacaucacccccggcgacgccggcgaguacgucugcaagcucauccucgacaucuucgaguacgagugcaagaagaagaucgacgucaugcccauccagauccucgccaacgaggagaugaaggucaugugcgacaacaaccccgucucccucaacugcugcucccagggcaacgucaacugguccaaggucgaguggaagcaggagggcaagaucaacauccccggcacccccgagaccgacaucgacuccuccugcucccgcuacacccucaaggccgacggcacccagugccccuccggcuccuccggcaccaccgucaucuacaccugcgaguucaucuccgccuacggcgcccgcggcuccgccaacaucaaggucaccuucaucuccgucgccaaccucaccaucacccccgaccccaucuccgucuccgagggccagaacuucuccaucaagugcaucuccgacgucuccaacuacgacgaggucuacuggaacaccuccgccggcaucaagaucuaccagcgcuucuacaccacccgccgcuaccucgacggcgccgaguccguccucaccgucaagaccuccacccgcgaguggaacggcaccuaccacugcaucuuccgcuacaagaacuccuacuccaucgccaccaaggacgucaucguccacccccucccccucaagcucaacaucauggucgacccccucgaggccaccgucuccugcuccggcucccaccacaucaagugcugcaucgaggaggacggcgacuacaaggucaccuuccacaccggcuccuccucccuccccgccgccaaggaggucaacaagaagcaggucugcuacaagcacaacuucaacgccuccuccgucuccuggugcuccaagaccgucgacgucugcugccacuucaccaacgccgccaacaacuccgucuggucccccuccaugaagcucaaccucguccccggcgagaacaucaccugccaggaccccgucaucggcgucggcgagcccggcaaggucauccagaagcucugccgcuucuccaacguccccuccucccccgagucccccaucggcggcaccaucaccuacaagugcgucggcucccagugggaggagaagcgcaacgacugcaucuccgcccccaucaacucccuccuccagauggccaaggcccucaucaagucccccucccaggacgagaugcuccccaccuaccucaaggaccucuccaucuccaucgacaaggccgagcacgagaucuccuccucccccggcucccucggcgccaucaucaacauccucgaccuccucuccaccguccccacccaggucaacuccgagaugaugacccacguccucuccaccgucaacgucauccucggcaagcccguccucaacaccuggaagguccuccagcagcaguggaccaaccaguccucccagcuccuccacuccgucgagcgcuucucccaggcccuccaguccggcgacucccccccccucuccuucucccagaccaacguccagauguccuccauggucaucaaguccucccaccccgagaccuaccagcagcgcuucgucuuccccuacuucgaccucuggggcaacgucgucaucgacaaguccuaccucgagaaccuccaguccgacuccuccaucgucaccauggccuuccccacccuccaggccauccucgcccaggacauccaggagaacaacuucgccgagucccucgucaugaccaccaccgucucccacaacaccaccaugcccuuccgcaucuccaugaccuucaagaacaacucccccuccggcggcgagaccaagugcgucuucuggaacuuccgccucgccaacaacaccggcggcugggacuccuccggcugcuacgucgaggagggcgacggcgacaacgucaccugcaucugcgaccaccucaccuccuucuccauccucaugucccccgacucccccgaccccuccucccuccucggcauccuccucgacaucaucuccuacgucggcgucggcuucuccauccucucccucgccgccugccucgucgucgaggccgucgucuggaaguccgucaccaagaaccgcaccuccuacaugcgccacaccugcaucgucaacaucgccgccucccuccucgucgccaacaccugguucaucgucgucgccgccauccaggacaaccgcuacauccucugcaagaccgccugcgucgccgccaccuucuucauccacuucuucuaccucuccgucuucuucuggaugcucacccucggccucaugcucuucuaccgccucgucuucauccuccacgagaccucccgcuccacccagaaggccaucgccuucugccucggcuacggcugcccccucgccaucuccgucaucacccucggcgccacccagccccgcgaggucuacacccgcaagaacgucugcuggcucaacugggaggacaccaaggcccuccucgccuucgccauccccgcccucaucaucgucgucgucaacaucaccaucaccaucgucgucaucaccaagauccuccgccccuccaucggcgacaagcccugcaagcaggagaaguccucccucuuccagaucuccaaguccaucggcguccucaccccccuccucggccucaccuggggcuucggccucaccaccgucuuccccggcaccaaccucgucuuccacaucaucuucgccauccucaacgucuuccagggccucuucauccuccucuucggcugccucugggaccucaagguccaggaggcccuccucaacaaguucucccucucccgcugguccucccagcacuccaaguccaccucccucggcuccuccacccccgucuucuccauguccucccccaucucccgccgcuucaacaaccucuucggcaagaccggcaccuacaacgucuccacccccgaggccaccuccuccucccucgagaacuccuccuccgccuccucccuccucaacuga

SEQ ID NO: 39438 - RNA, 1572 nt, Artificial Sequence
  derived and/or modified sequence opt2 from ADGRG1__Homo_sapiens__NP_001277071
augaccccccagucccuccuccagaccacccucuuccuccucucccuccucuuccucguccagggcgcccacggccgcggccaccgcgaggacuuccgcuucugcucccagcagcuccagucccucgaguccaagcucaccuccguccgcuucaugggcgacauggucuccuucgaggaggaccgcaucaacgccaccgucuggaagcuccagcccaccgccggccuccaggaccuccacauccacucccgccaggaggaggagcaguccgagaucauggaguacuccguccuccucccccgcacccucuuccagcgcaccaagggccgcuccggcgaggccgagaagcgccuccuccucgucgacuucuccucccaggcccucuuccaggacaagaacuccucccagguccucggcgagaagguccucggcaucgucguccagaacaccaaggucgccaaccucaccgagcccgucguccucaccuuccagcaccagcuccagcccaagaacgucacccuccagugcgucuucugggucgaggaccccacccucuccucccccggccacugguccuccgccggcugcgagaccguccgccgcgagacccagaccuccugcuucugcaaccaccucaccuacuucgccguccucauggucuccuccgucgaggucgacgccguccacaagcacuaccucucccuccucuccuacgucggcugcgucgucuccgcccucgccugccucgucaccaucgccgccuaccucugcucccgcgucccccuccccugccgccgcaagccccgcgacuacaccaucaagguccacaugaaccuccuccucgccgucuuccuccucgacaccuccuuccuccucuccgagcccgucgcccucaccggcuccgaggccggcugccgcgccuccgccaucuuccuccacuucucccuccucaccugccucuccuggaugggccucgagggcuacaaccucuaccgccucgucgucgaggucuucggcaccuacguccccggcuaccuccucaagcucuccgccaugggcuggggcuuccccaucuuccucgucacccucgucgcccucgucgacgucgacaacuacggccccaucauccucgccguccaccgcacccccgagggcgucaucuaccccuccaugugcuggauccgcgacucccucgucuccuacaucaccaaccucggccucuucucccucgucuuccucuucaacauggccaugcucgccaccauggucguccagauccuccgccuccgcccccacacccagaaguggucccacguccucacccuccucggccucucccucguccucggccuccccugggcccucaucuucuucuccuucgccuccggcaccuuccagcucgucguccucuaccucuucuccaucaucaccuccuuccagggcuuccucaucuucaucugguacugguccaugcgccuccaggcccgcggcggccccuccccccucaaguccaacuccgacuccgcccgccuccccaucuccuccggcuccaccuccuccucccgcaucuga

SEQ ID NO: 39439 - RNA, 3054 nt, Artificial Sequence
  derived and/or modified sequence opt2 from ADGRG2__Homo_sapiens__NP_001073327
auggucuucuccguccgccagugcggccacgucggccgcaccgaggagguccuccucaccuucaagaucuuccucgucaucaucugccuccacgucguccucgucaccucccucgaggaggacaccgacaacuccucccucucccccccccccgccaagcucuccgucgucuccuucgcccccuccuccaacggcacccccgaggucgagaccaccucccucaacgacgucacccucucccuccuccccuccaacgagaccgagaagaccaagaucaccaucgucaagaccuucaacgccuccggcgucaagccccagcgcaacaucugcaaccucuccuccaucugcaacgacuccgccuucuuccgcggcgagaucauguuccaguacgacaaggaguccaccgucccccagaaccagcacaucaccaacggcacccucaccggcguccucucccucuccgagcucaagcgcuccgagcucaacaagacccuccagacccucuccgagaccuacuucaucaugugcgccaccgccgaggcccaguccacccucaacugcaccuucaccaucaagcucaacaacaccaugaacgccugcgccgucaucgccgcccucgagcgcgucaagauccgccccauggagcacugcugcugcuccguccgcauccccugccccuccucccccgaggagcucgagaagcuccagugcgaccuccaggaccccaucgucugccucgccgaccacccccgcggcccccccuucuccuccucccaguccauccccgucgucccccgcgccaccguccucucccagguccccaaggccaccuccuucgccgagccccccgacuacucccccgucacccacaacguccccucccccaucggcgagauccagccccucuccccccagcccuccgcccccaucgccuccucccccgccaucgacaugcccccccaguccgagaccaucuccucccccaugccccagacccacgucuccggcacccccccccccgucaaggccuccuucuccucccccaccgucuccgcccccgccaacgucaacaccaccuccgccccccccguccagaccgacaucgucaacaccuccuccaucuccgaccucgagaaccagguccuccagauggagaaggcccucucccucggcucccucgagcccaaccucgccggcgagaugaucaaccaggucucccgccuccuccacuccccccccgacaugcucgccccccucgcccagcgccuccucaaggucgucgacgacaucggccuccagcucaacuucuccaacaccaccaucucccucaccucccccucccucgcccucgccgucauccgcgucaacgccuccuccuucaacaccaccaccuucgucgcccaggaccccgccaaccuccaggucucccucgagacccaggcccccgagaacuccaucggcaccaucacccuccccuccucccucaugaacaaccuccccgcccacgacauggagcucgccucccgcguccaguucaacuucuucgagacccccgcccucuuccaggaccccucccucgagaaccucucccucaucuccuacgucaucuccuccuccgucgccaaccucaccguccgcaaccucacccgcaacgucaccgucacccucaagcacaucaaccccucccaggacgagcucaccguccgcugcgucuucugggaccucggccgcaacggcggccgcggcggcugguccgacaacggcugcuccgucaaggaccgccgccucaacgagaccaucugcaccugcucccaccucaccuccuucggcguccuccucgaccucucccgcaccuccguccuccccgcccagaugauggcccucaccuucaucaccuacaucggcugcggccucuccuccaucuuccucuccgucacccucgucaccuacaucgccuucgagaagauccgccgcgacuaccccuccaagauccucauccagcucugcgccgcccuccuccuccucaaccucgucuuccuccucgacuccuggaucgcccucuacaagaugcagggccucugcaucuccgucgccgucuuccuccacuacuuccuccucgucuccuucaccuggaugggccucgaggccuuccacauguaccucgcccucgucaaggucuucaacaccuacauccgcaaguacauccucaaguucugcaucgucggcuggggcguccccgccgucgucgucaccaucauccucaccaucucccccgacaacuacggccucggcuccuacggcaaguuccccaacggcucccccgacgacuucugcuggaucaacaacaacgccgucuucuacaucaccgucgucggcuacuucugcgucaucuuccuccucaacgucuccauguucaucgucguccucguccagcucugccgcaucaagaagaagaagcagcucggcgcccagcgcaagaccuccauccaggaccuccgcuccaucgccggccucaccuuccuccucggcaucaccuggggcuucgccuucuucgccuggggccccgucaacgucaccuucauguaccucuucgccaucuucaacacccuccagggcuucuucaucuucaucuucuacugcgucgccaaggagaacguccgcaagcaguggcgccgcuaccucugcugcggcaagcuccgccucgccgagaacuccgacugguccaagaccgccaccaacggccucaagaagcagaccgucaaccagggcgucuccuccuccuccaacucccuccaguccuccuccaacuccaccaacuccaccacccuccucgucaacaacgacugcuccguccacgccuccggcaacggcaacgccuccaccgagcgcaacggcgucuccuucuccguccagaacggcgacgucugccuccacgacuucaccggcaagcagcacauguucaacgagaaggaggacuccugcaacggcaagggccgcauggcccuccgccgcaccuccaagcgcggcucccuccacuucaucgagcagauguga

SEQ ID NO: 39440 - RNA, 1650 nt, Artificial Sequence
  derived and/or modified sequence opt2 from ADGRG3__Homo_sapiens__NP_740746
auggccaccccccgcggccucggcgcccuccuccuccuccuccuccuccccaccuccggccaggagaagcccaccgagggcccccgcaacaccugccucggcuccaacaacauguacgacaucuucaaccucaacgacaaggcccucugcuucaccaagugccgccaguccggcuccgacuccugcaacgucgagaaccuccagcgcuacuggcucaacuacgaggcccaccucaugaaggagggccucacccagaaggucaacacccccuuccucaaggcccucguccagaaccucuccaccaacaccgccgaggacuucuacuucucccucgagcccucccaggucccccgccaggucaugaaggacgaggacaagccccccgaccgcguccgccuccccaagucccucuuccgcucccuccccggcaaccgcuccgucguccgccucgccgucaccauccucgacaucggccccggcacccucuucaagggcccccgccucggccucggcgacggcuccggcguccucaacaaccgccucgucggccucuccgucggccagaugcacgucaccaagcucgccgagccccucgagaucgucuucucccaccagcgccccccccccaacaugacccucaccugcgucuucugggacgucaccaagggcaccaccggcgacugguccuccgagggcugcuccaccgagguccgccccgagggcaccgucugcugcugcgaccaccucaccuucuucgcccuccuccuccgccccacccucgaccaguccaccguccacauccucacccgcaucucccaggccggcugcggcgucuccaugaucuuccucgccuucaccaucauccucuacgccuuccuccgccucucccgcgagcgcuucaaguccgaggacgcccccaagauccacgucgcccucggcggcucccucuuccuccucaaccucgccuuccucgucaacgucggcuccggcuccaagggcuccgacgccgccugcugggcccgcggcgccgucuuccacuacuuccuccucugcgccuucaccuggaugggccucgaggccuuccaccucuaccuccucgccguccgcgucuucaacaccuacuucggccacuacuuccucaagcucucccucgucggcuggggccuccccgcccucauggucaucggcaccggcuccgccaacuccuacggccucuacaccauccgcgaccgcgagaaccgcaccucccucgagcucugcugguuccgcgagggcaccaccauguacgcccucuacaucaccguccacggcuacuuccucaucaccuuccucuucggcauggucguccucgcccucgucgucuggaagaucuucacccucucccgcgccaccgccgucaaggagcgcggcaagaaccgcaagaagguccucacccuccucggccucuccucccucgucggcgucaccuggggccucgccaucuucaccccccucggccucuccaccgucuacaucuucgcccucuucaacucccuccagggcgucuucaucugcugcugguucaccauccucuaccuccccucccaguccaccaccgucuccuccuccaccgcccgccucgaccaggcccacuccgccucccaggaguga

SEQ ID NO: 39441 - RNA, 3582 nt, Artificial Sequence
  derived and/or modified sequence opt2 from ADGRG6__Homo_sapiens__NP_001027566
augauguuccgcuccgaccgcaugugguccugccacuggaaguggaagcccuccccccuccucuuccucuucgcccucuacaucaugugcgucccccacuccgucuggggcugcgccaacugccgcgucguccucuccaaccccuccggcaccuucaccucccccugcuaccccaacgacuaccccaacucccaggccugcauguggacccuccgcgcccccaccggcuacaucauccagaucaccuucaacgacuucgacaucgaggaggcccccaacugcaucuacgacucccucucccucgacaacggcgagucccagaccaaguucugcggcgccaccgccaagggccucuccuucaacuccuccgccaacgagaugcacgucuccuucuccuccgacuucuccauccagaagaagggcuucaacgccuccuacauccgcgucgccgucucccuccgcaaccagaaggucauccucccccagaccuccgacgccuaccaggucuccgucgccaaguccaucuccauccccgagcucuccgccuucacccucugcuucgaggccaccaaggucggccacgaggacuccgacuggaccgccuucuccuacuccaacgccuccuucacccagcuccucuccuucggcaaggccaaguccggcuacuuccucuccaucuccgacuccaagugccuccucaacaacgcccuccccgucaaggagaaggaggacaucuucgccgaguccuucgagcagcucugccucgucuggaacaacucccucggcuccaucggcgucaacuucaagcgcaacuacgagaccguccccugcgacuccaccaucuccaaggucauccccggcaacggcaagcuccuccucggcuccaaccagaacgagaucgucucccucaagggcgacaucuacaacuuccgccucuggaacuucaccaugaacgccaagauccucuccaaccucuccugcaacgucaagggcaacgucgucgacuggcagaacgacuucuggaacauccccaaccucgcccucaaggccgaguccaaccucuccugcggcuccuaccucaucccccuccccgccgccgagcucgccuccugcgccgaccucggcacccucugccaggacggcaucaucuaccgcaucuccgucgucauccagaacauccuccgccaccccgaggucaagguccaguccaaggucgccgaguggcucaacuccaccuuccagaacuggaacuacaccgucuacgucgucaacaucuccuuccaccucuccgccggcgaggacaagaucaaggucaagcgcucccucgaggacgagccccgccucguccucugggcccuccucgucuacaacgccaccaacaacaccaaccucgagggcaagaucauccagcagaagcuccucaagaacaacgagucccucgacgagggccuccgccuccacaccgucaacguccgccagcucggccacugccucgccauggaggagcccaagggcuacuacuggcccuccauccagcccuccgaguacguccuccccugccccgacaagcccggcuucuccgccucccgcaucugcuucuacaacgccaccaacccccucgucaccuacuggggccccgucgacaucuccaacugccucaaggaggccaacgaggucgccaaccagauccucaaccucaccgccgacggccagaaccucaccuccgccaacaucaccaacaucgucgagcaggucaagcgcaucgucaacaaggaggagaacaucgacaucacccucggcuccacccucaugaacaucuucuccaacauccucuccuccuccgacuccgaccuccucgaguccuccuccgaggcccucaagaccaucgacgagcucgccuucaagaucgaccucaacuccaccucccacgucaacaucaccacccgcaaccucgcccucuccgucuccucccuccuccccggcaccaacgccaucuccaacuucuccaucggccuccccuccaacaacgaguccuacuuccagauggacuucgaguccggccaggucgacccccucgccuccgucauccucccccccaaccuccucgagaaccucucccccgaggacuccguccucguccgccgcgcccaguucaccuucuucaacaagaccggccucuuccaggacgucggcccccagcgcaagacccucgucuccuacgucauggccugcuccaucggcaacaucaccauccagaaccucaaggaccccguccagaucaagaucaagcacacccgcacccaggagguccaccaccccaucugcgccuucugggaccucaacaagaacaaguccuucggcggcuggaacaccuccggcugcgucgcccaccgcgacuccgacgccuccgagaccgucugccucugcaaccacuucacccacuucggcguccucauggaccucccccgcuccgccucccagcucgacgcccgcaacaccaagguccucaccuucaucuccuacaucggcugcggcaucuccgccaucuucuccgccgccacccuccucaccuacgucgccuucgagaagcuccgccgcgacuaccccuccaagauccucaugaaccucuccaccgcccuccucuuccucaaccuccucuuccuccucgacggcuggaucaccuccuucaacgucgacggccucugcaucgccgucgccguccuccuccacuucuuccuccucgccaccuucaccuggaugggccucgaggccauccacauguacaucgcccucgucaaggucuucaacaccuacauccgccgcuacauccucaaguucugcaucaucggcuggggccuccccgcccucgucgucuccgucguccucgccucccgcaacaacaacgaggucuacggcaaggaguccuacggcaaggagaagggcgacgaguucugcuggauccaggaccccgucaucuucuacgucaccugcgccggcuacuucggcgucauguucuuccucaacaucgccauguucaucgucgucaugguccagaucugcggccgcaacggcaagcgcuccaaccgcacccuccgcgaggagguccuccgcaaccuccgcuccgucgucucccucaccuuccuccucggcaugaccuggggcuucgccuucuucgccuggggcccccucaacauccccuucauguaccucuucuccaucuucaacucccuccagggccucuucaucuucaucuuccacugcgccaugaaggagaacguccagaagcaguggcgccgccaccucugcugcggccgcuuccgccucgccgacaacuccgacugguccaagaccgccaccaacaucaucaagaaguccuccgacaaccucggcaagucccucuccuccuccuccaucggcuccaacuccaccuaccucaccuccaaguccaaguccuccuccaccaccuacuucaagcgcaacucccacaccgacaacgucuccuacgagcacuccuucaacaaguccggcucccuccgccagugcuuccacggccagguccucgucaagaccggccccugcuga

SEQ ID NO: 39442 - RNA, 2394 nt, Artificial Sequence
  derived and/or modified sequence opt2 from ADGRG7__Homo_sapiens__NP_116176
auggccuccugccgcgccuggaaccuccgcguccucgucgccgucgucugcggccuccucaccggcaucauccucggccucggcaucuggcgcaucgucauccgcauccagcgcggcaaguccaccuccuccuccuccacccccaccgaguucugccgcaacggcggcaccugggagaacggccgcugcaucugcaccgaggaguggaagggccuccgcugcaccaucgccaacuucugcgagaacuccaccuacaugggcuucaccuucgcccgcauccccgucggccgcuacggccccucccuccagaccugcggcaaggacacccccaacgccggcaaccccauggccguccgccucugcucccucucccucuacggcgagaucgagcuccagaaggucaccaucggcaacugcaacgagaaccucgagacccucgagaagcaggucaaggacgucaccgccccccucaacaacaucuccuccgagguccagauccucaccuccgacgccaacaagcucaccgccgagaacaucaccuccgccacccgcgucgucggccagaucuucaacaccucccgcaacgccucccccgaggccaagaaggucgccaucgucaccgucucccagcuccucgacgccuccgaggacgccuuccagcgcgucgccgccaccgccaacgacgacgcccucaccacccucaucgagcagauggagaccuacucccucucccucggcaaccaguccgucgucgagcccaacaucgccauccaguccgccaacuucuccuccgagaacgccgucggccccuccaacguccgcuucuccguccagaagggcgccuccuccucccucgucuccuccuccaccuucauccacaccaacgucgacggccucaaccccgacgcccagaccgagcuccagguccuccucaacaugaccaagaacuacaccaagaccugcggcuucgucgucuaccagaacgacaagcucuuccaguccaagaccuucaccgccaaguccgacuucucccagaagaucaucuccuccaagaccgacgagaacgagcaggaccaguccgccuccgucgacauggucuucucccccaaguacaaccagaaggaguuccagcucuacuccuacgccugcgucuacuggaaccucuccgccaaggacugggacaccuacggcugccagaaggacaagggcaccgacggcuuccuccgcugccgcugcaaccacaccaccaacuucgccguccucaugaccuucaagaaggacuaccaguaccccaagucccucgacauccucuccaacgucggcugcgcccucuccgucaccggccucgcccucaccgucaucuuccagaucgucacccgcaagguccgcaagaccuccgucaccuggguccucgucaaccucugcaucuccaugcucaucuucaaccuccucuucgucuucggcaucgagaacuccaacaagaaccuccagaccuccgacggcgacaucaacaacaucgacuucgacaacaacgacaucccccgcaccgacaccaucaacauccccaaccccaugugcaccgccaucgccgcccuccuccacuacuuccuccucgucaccuucaccuggaacgcccucuccgccgcccagcucuacuaccuccucauccgcaccaugaagccccucccccgccacuucauccucuucaucucccucaucggcuggggcguccccgccaucgucgucgccaucaccgucggcgucaucuacucccagaacggcaacaacccccagugggagcucgacuaccgccaggagaagaucugcuggcucgccauccccgagcccaacggcgucaucaaguccccccuccucugguccuucaucguccccgucaccaucauccucaucuccaacgucgucauguucaucaccaucuccaucaagguccucuggaagaacaaccagaaccucaccuccaccaagaaggucuccuccaugaagaagaucgucuccacccucuccgucgccgucgucuucggcaucaccuggauccucgccuaccucaugcucgucaacgacgacuccauccgcaucgucuucuccuacaucuucugccucuucaacaccacccagggccuccagaucuucauccucuacaccguccgcaccaaggucuuccaguccgaggccuccaagguccucaugcuccucuccuccaucggccgccgcaagucccuccccuccgucacccgcccccgccuccgcgucaagauguacaacuuccuccgcucccuccccacccuccacgagcgcuuccgccuccucgagaccucccccuccaccgaggagaucacccucuccgaguccgacaacgccaaggaguccaucuga

SEQ ID NO: 39443 - RNA, 4425 nt, Artificial Sequence
  derived and/or modified sequence opt2 from ADGRL1__Homo_sapiens__NP_001008701
auggcccgccucgccgccguccucuggaaccucugcgucaccgccguccucgucaccuccgccacccagggccucucccgcgccggccuccccuucggccucaugcgccgcgagcucgccugcgagggcuaccccaucgagcuccgcugccccggcuccgacgucaucauggucgagaacgccaacuacggccgcaccgacgacaagaucugcgacgccgaccccuuccagauggagaacguccagugcuaccuccccgacgccuucaagaucaugucccagcgcugcaacaaccgcacccagugcgucgucgucgccggcuccgacgccuuccccgaccccugccccggcaccuacaaguaccucgagguccaguacgacugcguccccuacaaggucgagcagaaggucuucgucugccccggcacccuccagaagguccucgagcccaccuccacccacgaguccgagcaccaguccggcgccuggugcaaggacccccuccaggccggcgaccgcaucuacgucaugcccuggauccccuaccgcaccgacacccucaccgaguacgccuccugggaggacuacgucgccgcccgccacaccaccaccuaccgccuccccaaccgcgucgacggcaccggcuucgucgucuacgacggcgccgucuucuacaacaaggagcgcacccgcaacaucgucaaguacgaccuccgcacccgcaucaaguccggcgagaccgucaucaacaccgccaacuaccacgacaccucccccuaccgcuggggcggcaagaccgacaucgaccucgccgucgacgagaacggccucugggucaucuacgccaccgagggcaacaacggccgccucgucgucucccagcucaaccccuacacccuccgcuucgagggcaccugggagaccggcuacgacaagcgcuccgccuccaacgccuucauggucugcggcguccucuacguccuccgcuccgucuacgucgacgacgacuccgaggccgccggcaaccgcgucgacuacgccuucaacaccaacgccaaccgcgaggagcccgucucccucaccuuccccaaccccuaccaguucaucuccuccgucgacuacaacccccgcgacaaccagcucuacgucuggaacaacuacuucgucguccgcuacucccucgaguucggcccccccgaccccuccgccggccccgccaccucccccccccucuccaccaccaccaccgcccgccccaccccccucaccuccaccgccucccccgccgccaccaccccccuccgccgcgccccccucaccacccaccccgucggcgccaucaaccagcucggccccgaccucccccccgccaccgcccccguccccuccacccgccgcccccccgcccccaaccuccacgucucccccgagcucuucugcgagccccgcgagguccgccgcguccaguggcccgccacccagcagggcaugcucgucgagcgccccugccccaagggcacccgcggcaucgccuccuuccagugccuccccgcccucggccucuggaacccccgcggccccgaccucuccaacugcaccucccccugggucaaccaggucgcccagaagaucaaguccggcgagaacgccgccaacaucgccuccgagcucgcccgccacacccgcggcuccaucuacgccggcgacgucuccuccuccgucaagcucauggagcagcuccucgacauccucgacgcccagcuccaggcccuccgccccaucgagcgcgaguccgccggcaagaacuacaacaagaugcacaagcgcgagcgcaccugcaaggacuacaucaaggccgucgucgagaccgucgacaaccuccuccgccccgaggcccucgaguccuggaaggacaugaacgccaccgagcagguccacaccgccaccaugcuccucgacguccucgaggagggcgccuuccuccucgccgacaacguccgcgagcccgcccgcuuccucgccgccaaggagaacgucguccucgaggucaccguccucaacaccgagggccagguccaggagcucgucuucccccaggaggaguacccccgcaagaacuccauccagcucuccgccaagaccaucaagcagaacucccgcaacggcgucgucaaggucgucuucauccucuacaacaaccucggccucuuccucuccaccgagaacgccaccgucaagcucgccggcgaggccggccccggcggccccggcggcgccucccucgucgucaacucccaggucaucgccgccuccaucaacaaggaguccucccgcgucuuccucauggaccccgucaucuucaccgucgcccaccucgaggacaagaaccacuucaacgccaacugcuccuucuggaacuacuccgagcgcuccaugcucggcuacugguccacccagggcugccgccucgucgaguccaacaagacccacaccaccugcgccugcucccaccucaccaacuucgccguccucauggcccaccgcgagaucuaccagggccgcaucaacgagcuccuccucuccgucaucaccugggucggcaucgucaucucccucgucugccucgccaucugcaucuccaccuucugcuuccuccgcggccuccagaccgaccgcaacaccauccacaagaaccucugcaucaaccucuuccucgccgagcuccucuuccucgucggcaucgacaagacccaguacgagaucgccugccccaucuucgccggccuccuccacuacuucuuccucgccgccuucuccuggcucugccucgagggcguccaccucuaccuccuccucgucgaggucuucgaguccgaguacucccgcaccaaguacuacuaccucggcggcuacugcuuccccgcccucgucgucggcaucgccgccgccaucgacuaccgcuccuacggcaccgagaaggccugcuggcuccgcgucgacaacuacuucaucugguccuucaucggccccgucuccuucgucaucgucgucaaccucgucuuccucauggucacccuccacaagaugauccgcuccuccuccguccucaagcccgacuccucccgccucgacaacaucaaguccugggcccucggcgccaucgcccuccucuuccuccucggccucaccugggccuucggccuccucuucaucaacaaggaguccgucgucauggccuaccucuucaccaccuucaacgccuuccagggcgucuucaucuucgucuuccacugcgcccuccagaagaagguccacaaggaguacuccaagugccuccgccacuccuacugcugcauccgcuccccccccggcggcacccacggcucccucaagaccuccgccaugcgcuccaacacccgcuacuacaccggcacccagucccgcauccgccgcauguggaacgacaccguccgcaagcagaccgaguccuccuucauggccggcgacaucaacuccacccccacccucaaccgcggcaccaugggcaaccaccuccucaccaaccccguccuccagccccgcggcggcaccucccccuacaacacccucaucgccgaguccgucggcuucaaccccuccuccccccccgucuucaacucccccggcuccuaccgcgagcccaagcacccccucggcggccgcgaggccugcggcauggacacccucccccucaacggcaacuucaacaacuccuacucccuccgcuccggcgacuucccccccggcgacggcggccccgagcccccccgcggccgcaaccucgccgacgccgccgccuucgagaagaugaucaucuccgagcucguccacaacaaccuccgcggcuccuccuccgccgccaagggcccccccccccccgagccccccgucccccccguccccggcggcggcggcgaggaggaggccggcggccccggcggcgccgaccgcgccgagaucgagcuccucuacaaggcccucgaggagccccuccuccucccccgcgcccaguccguccucuaccaguccgaccucgacgaguccgaguccugcaccgccgaggacggcgccaccucccgcccccucuccuccccccccggccgcgacucccucuacgccuccggcgccaaccuccgcgacucccccuccuaccccgacuccucccccgagggccccuccgaggcccuccccccccccccccccgccccccccggcccccccgagaucuacuacaccucccgcccccccgcccucgucgcccgcaacccccuccagggcuacuaccagguccgccgccccucccacgagggcuaccucgccgcccccggccucgagggccccggccccgacggcgacggccagaugcagcucgucaccucccucuga

SEQ ID NO: 39444 - RNA, 4410 nt, Artificial Sequence
  derived and/or modified sequence opt2 from ADGRL3__Homo_sapiens__NP_056051
auguggcccucccagcuccucaucuucaugaugcuccucgcccccaucauccacgccuucucccgcgcccccauccccauggccgucguccgccgcgagcucuccugcgaguccuaccccaucgagcuccgcugccccggcaccgacgucaucaugaucgaguccgccaacuacggccgcaccgacgacaagaucugcgacuccgaccccgcccagauggagaacauccgcugcuaccuccccgacgccuacaagaucaugucccagcgcugcaacaaccgcacccagugcgccgucgucgccggccccgacgucuuccccgaccccugccccggcaccuacaaguaccucgagguccaguacgagugcguccccuacaaggucgagcagaaggucuuccucugccccggccuccucaagggcgucuaccaguccgagcaccucuucgaguccgaccaccaguccggcgccuggugcaaggacccccuccaggccuccgacaagaucuacuacaugcccuggacccccuaccgcaccgacacccucaccgaguacuccuccaaggacgacuucaucgccggccgccccaccaccaccuacaagcucccccaccgcgucgacggcaccggcuucgucgucuacgacggcgcccucuucuucaacaaggagcgcacccgcaacaucgucaaguucgaccuccgcacccgcaucaaguccggcgaggccaucaucgccaacgccaacuaccacgacaccucccccuaccgcuggggcggcaaguccgacaucgaccucgccgucgacgagaacggccucugggucaucuacgccaccgagcagaacaacggcaagaucgucaucucccagcucaaccccuacacccuccgcaucgagggcaccugggacaccgccuacgacaagcgcuccgccuccaacgccuucaugaucugcggcauccucuacgucgucaaguccgucuacgaggacgacgacaacgaggccaccggcaacaagaucgacuacaucuacaacaccgaccaguccaaggacucccucgucgacguccccuuccccaacuccuaccaguacaucgccgccgucgacuacaacccccgcgacaaccuccucuacgucuggaacaacuaccacgucgucaaguacucccucgacuucggcccccucgacucccgcuccggccaggcccaccacggccaggucuccuacaucuccccccccauccaccucgacuccgagcucgagcgccccuccgucaaggacaucuccaccaccggcccccucggcaugggcuccaccaccaccuccaccacccuccgcaccaccacccucucccccggccgcuccaccacccccuccgucuccggccgccgcaaccgcuccaccuccacccccucccccgccgucgagguccucgacgacaugaccacccaccuccccuccgccuccucccagauccccgcccucgaggaguccugcgaggccgucgaggcccgcgagaucaugugguucaagacccgccagggccagaucgccaagcagcccugccccgccggcaccaucggcgucuccaccuaccucugccucgcccccgacggcaucugggacccccagggccccgaccucuccaacugcuccucccccugggucaaccacaucacccagaagcucaaguccggcgagaccgccgccaacaucgcccgcgagcucgccgagcagacccgcaaccaccucaacgccggcgacaucaccuacuccguccgcgccauggaccagcucgucggccuccucgacguccagcuccgcaaccucacccccggcggcaaggacuccgccgcccgcucccucaacaagcuccagaagcgcgagcgcuccugccgcgccuacguccaggccauggucgagaccgucaacaaccuccuccagccccaggcccucaacgccuggcgcgaccucaccaccuccgaccagcuccgcgccgccaccaugcuccuccacaccgucgaggaguccgccuucguccucgccgacaaccuccucaagaccgacaucguccgcgagaacaccgacaacaucaagcucgaggucgcccgccucuccaccgagggcaaccucgaggaccucaaguuccccgagaacaugggccacggcuccaccauccagcucuccgccaacacccucaagcagaacggccgcaacggcgagauccgcgucgccuucguccucuacaacaaccucggccccuaccucuccaccgagaacgccuccaugaagcucggcaccgaggcccucuccaccaaccacuccgucaucgucaacucccccgucaucaccgccgccaucaacaaggaguucuccaacaaggucuaccucgccgaccccgucgucuucaccgucaagcacaucaagcaguccgaggagaacuucaaccccaacugcuccuucugguccuacuccaagcgcaccaugaccggcuacugguccacccagggcugccgccuccucaccaccaacaagacccacaccaccugcuccugcaaccaccucaccaacuucgccguccucauggcccacgucgaggucaagcacuccgacgccguccacgaccuccuccucgacgucaucaccugggucggcauccuccucucccucgucugccuccucaucugcaucuucaccuucugcuucuuccgcggccuccaguccgaccgcaacaccauccacaagaaccucugcaucucccucuucgucgccgagcuccucuuccucaucggcaucaaccgcaccgaccagcccaucgccugcgccgucuucgccgcccuccuccacuucuucuuccucgccgccuucaccuggauguuccucgagggcguccagcucuacaucaugcucgucgaggucuucgaguccgagcacucccgccgcaaguacuucuaccucgucggcuacggcaugcccgcccucaucgucgccgucuccgccgccgucgacuaccgcuccuacggcaccgacaaggucugcuggcuccgccucgacaccuacuucaucugguccuucaucggccccgccacccucaucaucaugcucaacgucaucuuccucggcaucgcccucuacaagauguuccaccacaccgccauccucaagcccgaguccggcugccucgacaacaucaacuacgaggacaaccgccccuucaucaaguccugggucaucggcgccaucgcccuccucugccuccucggccucaccugggccuucggccucauguacaucaacgaguccaccgucaucauggccuaccucuucaccaucuucaacucccuccagggcauguucaucuucaucuuccacugcguccuccagaagaagguccgcaaggaguacggcaagugccuccgcacccacugcugcuccggcaaguccaccgaguccuccaucggcuccggcaagaccuccggcucccgcacccccggccgcuacuccaccggcucccagucccgcauccgccgcauguggaacgacaccguccgcaagcaguccgaguccuccuucaucaccggcgacaucaacuccuccgccucccucaaccgcgagggccuccucaacaacgcccgcgacaccuccgucauggacacccucccccucaacggcaaccacggcaacuccuacuccaucgccuccggcgaguaccucuccaacugcguccagaucaucgaccgcggcuacaaccacaacgagaccgcccucgagaagaagauccucaaggagcucaccuccaacuacauccccuccuaccucaacaaccacgagcgcuccuccgagcagaaccgcaaccucaugaacaagcucgucaacaaccucggcuccggccgcgaggacgacgccaucguccucgacgacgccaccuccuucaaccacgaggagucccucggccucgagcucauccacgaggaguccgacgccccccuccuccccccccgcgucuacuccaccgagaaccaccagccccaccacuacacccgccgccgcaucccccaggaccacuccgaguccuucuucccccuccucaccaacgagcacaccgaggaccuccaguccccccaccgcgacucccucuacaccuccaugcccacccucgccggcgucgccgccaccgaguccgucaccaccuccacccagaccgagcccccccccgccaagugcggcgacgccgaggacgucuacuacaaguccaugcccaaccucggcucccgcaaccacguccaccagcuccacaccuacuaccagcucggccgcggcuccuccgacggcuucaucgucccccccaacaaggacggcaccccccccgagggcuccuccaagggccccgcccaccucgucaccucccucuga

SEQ ID NO: 39445 - RNA, 18921 nt, Artificial Sequence
  derived and/or modified sequence opt2 from ADGRV1__Homo_sapiens__NP_115495
auguccgucuuccucggccccggcaugcccuccgccucccuccucgucaaccuccucuccgcccuccucauccucuucgucuucggcgagaccgagauccgcuucaccggccagaccgaguucgucgucaacgagaccuccaccaccgucauccgccucaucaucgagcgcaucggcgagcccgccaacgucaccgccaucgucucccucuacggcgaggacgccggcgacuucuucgacaccuacgccgccgccuucauccccgccggcgagaccaaccgcaccgucuacaucgccgucugcgacgacgaccuccccgagcccgacgagaccuucaucuuccaccucacccuccagaagcccuccgccaacgucaagcucggcuggccccgcaccgucaccgucaccauccucuccaacgacaacgccuucggcaucaucuccuucaacaugcuccccuccaucgccgucuccgagcccaagggccgcaacgaguccaugccccucacccucauccgcgagaagggcaccuacggcauggucauggucaccuucgaggucgagggcggccccaacccccccgacgaggaccucucccccgucaagggcaacaucaccuucccccccggccgcgccaccgucaucuacaaccucaccguccucgacgacgagguccccgagaacgacgagaucuuccucauccagcucaaguccgucgagggcggcgccgagaucaacaccucccgcaacuccaucgagaucaucaucaagaagaacgacucccccguccgcuuccuccaguccaucuaccucguccccgaggaggaccacauccucaucauccccgucguccgcggcaaggacaacaacggcaaccucaucggcuccgacgaguacgaggucuccaucuccuacgccgucaccaccggcaacuccaccgcccacgcccagcagaaccucgacuucaucgaccuccagcccaacaccaccgucgucuucccccccuucauccacgagucccaccucaaguuccagaucgucgacgacaccauccccgagaucgccgaguccuuccacaucaugcuccucaaggacacccuccagggcgacgccguccucaucucccccuccgucguccaggucaccaucaagcccaacgacaagcccuacggcguccucuccuucaacuccguccucuucgagcgcaccgucaucaucgacgaggaccgcaucucccgcuacgaggagaucaccgucguccgcaacggcggcacccacggcaacgucuccgccaacuggguccucacccgcaacuccaccgaccccucccccgucaccgccgacauccgccccuccuccggcguccuccacuucgcccagggccagaugcucgccaccaucccccucaccgucgucgacgacgaccuccccgaggaggccgaggccuaccuccuccagauccucccccacaccauccgcggcggcgccgaggucuccgagcccgccgagcuccucuucuacauccaggacuccgacgacgucuacggccucaucaccuucuuccccauggagaaccagaagaucgaguccucccccggcgagcgcuaccucucccucuccuucacccgccucggcggcaccaagggcgacguccgccuccucuacuccguccucuacauccccgccggcgccgucgacccccuccaggccaaggagggcauccucaacaucucccgccgcaacgaccucaucuuccccgagcagaagacccaggucaccaccaagcuccccauccgcaacgacgccuuccuccagaacggcgcccacuuccucguccagcucgagaccgucgagcuccucaacaucaucccccucaucccccccaucuccccccgcuucggcgagaucugcaacaucucccuccucgucacccccgccaucgccaacggcgagaucggcuuccucuccaaccuccccaucauccuccacgagcccgaggacuucgccgccgaggucgucuacaucccccuccaccgcgacggcaccgacggccaggccaccgucuacuggucccucaagcccuccggcuucaacuccaaggccgucacccccgacgacaucggccccuucaacggcuccguccucuuccucuccggccaguccgacaccaccaucaacaucaccaucaagggcgacgacauccccgagaugaacgagaccgucacccucucccucgaccgcgucaacgucgagaaccagguccucaaguccggcuacaccucccgcgaccucaucauccucgagaacgacgaccccggcggcgucuucgaguucucccccgccucccgcggccccuacgucaucaaggagggcgaguccgucgagcuccacaucauccgcucccgcggcucccucgucaagcaguuccuccacuaccgcgucgagccccgcgacuccaacgaguucuacggcaacaccggcguccucgaguucaagcccggcgagcgcgagaucgucaucacccuccucgcccgccucgacggcauccccgagcucgacgagcacuacugggucguccucuccucccacggcgagcgcgaguccaagcucggcuccgccaccaucgucaacaucaccauccucaagaacgacgacccccacggcaucaucgaguucgucuccgacggccucaucgucaugaucaacgaguccaagggcgacgccaucuacuccgccgucuacgacgucguccgcaaccgcggcaacuucggcgacgucuccgucuccugggucgucucccccgacuucacccaggacgucuuccccguccagggcaccgucgucuucggcgaccaggaguucuccaagaacaucaccaucuacucccuccccgacgagauccccgaggagauggaggaguucaccgucauccuccucaacggcaccggcggcgccaaggucggcaaccgcaccaccgccacccuccgcauccgccgcaacgacgaccccaucuacuucgccgagccccgcgucguccgcguccaggagggcgagaccgccaacuucaccguccuccgcaacggcuccgucgacgucaccugcaugguccaguacgccaccaaggacggcaaggccaccgcccgcgagcgcgacuucauccccgucgagaagggcgagacccucaucuucgaggucggcucccgccagcaguccaucuccaucuucgucaacgaggacggcauccccgagaccgacgagcccuucuacaucauccuccucaacuccaccggcgacaccgucgucuaccaguacggcgucgccaccgucaucaucgaggccaacgacgaccccaacggcaucuucucccucgagcccaucgacaaggccgucgaggagggcaagaccaacgccuucuggauccuccgccaccgcggcuacuucggcuccgucuccgucuccuggcagcucuuccagaacgacuccgcccuccagcccggccaggaguucuacgagaccuccggcaccgucaacuucauggacggcgaggaggccaagcccaucauccuccacgccuuccccgacaagauccccgaguucaacgaguucuacuuccucaagcucgucaacaucuccggcggcucccccggccccggcggccagcucgccgagaccaaccuccaggucaccgucaugguccccuucaacgacgaccccuucggcgucuucauccucgaccccgagugccucgagcgcgaggucgccgaggacguccucuccgaggacgacauguccuacaucaccaacuucaccauccuccgccagcagggcgucuucggcgacguccagcucggcugggagauccucuccuccgaguuccccgccggccucccccccaugaucgacuuccuccucgucggcaucuuccccaccaccguccaccuccagcagcacaugcgccgccaccacuccggcaccgacgcccucuacuucaccggccucgagggcgccuucggcaccgucaaccccaaguaccaccccucccgcaacaacaccaucgccaacuucaccuucuccgccugggucaugcccaacgccaacaccaacggcuucaucaucgccaaggacgacggcaacggcuccaucuacuacggcgucaagauccagaccaacgagucccacgucacccucucccuccacuacaagacccucggcuccaacgccaccuacaucgccaagaccaccgucaugaaguaccucgaggaguccgucuggcuccaccuccucaucauccucgaggacggcaucaucgaguucuaccucgacggcaacgccaugccccgcggcaucaagucccucaagggcgaggccaucaccgacggccccggcauccuccgcaucggcgccggcaucaacggcaacgaccgcuucaccggccucaugcaggacguccgcuccuacgagcgcaagcucacccucgaggagaucuacgagcuccacgccaugcccgccaaguccgaccuccaccccaucuccggcuaccucgaguuccgccagggcgagaccaacaaguccuucaucaucuccgcccgcgacgacaacgacgaggagggcgaggagcucuucauccucaagcucgucuccgucuacggcggcgcccgcaucuccgaggagaacaccaccgcccgccucaccauccagaaguccgacaacgccaacggccucuucggcuucaccggcgccugcauccccgagaucgccgaggagggcuccaccaucuccugcgucgucgagcgcacccgcggcgcccucgacuacguccacgucuucuacaccaucucccagaucgagaccgacggcaucaacuaccucgucgacgacuucgccaacgccuccggcaccaucaccuuccuccccuggcagcgcuccgagguccucaacaucuacguccucgacgacgacauccccgagcucaacgaguacuuccgcgucacccucgucuccgccauccccggcgacggcaagcucggcuccacccccaccuccggcgccuccaucgaccccgagaaggagaccaccgacaucaccaucaaggccuccgaccaccccuacggccuccuccaguucuccaccggccuccccccccagcccaaggacgccaugacccuccccgccuccuccgucccccacaucaccgucgaggaggaggacggcgagauccgccuccucgucauccgcgcccagggccuccucggccgcgucaccgccgaguuccgcaccgucucccucaccgccuucucccccgaggacuaccagaacgucgccggcacccucgaguuccagcccggcgagcgcuacaaguacaucuucaucaacaucaccgacaacuccauccccgagcucgagaaguccuucaaggucgagcuccucaaccucgagggcggcgucgccgagcucuuccgcgucgacggcuccggcuccggcgacggcgacauggaguucuuccuccccaccauccacaagcgcgccucccucggcgucgccucccagauccucgucaccaucgccgccuccgaccacgcccacggcgucuucgaguucucccccgagucccucuucgucuccggcaccgagcccgaggacggcuacuccaccgucacccucaacgucauccgccaccacggcacccucucccccgucacccuccacuggaacaucgacuccgaccccgacggcgaccucgccuucaccuccggcaacaucaccuucgagaucggccagaccuccgccaacaucaccgucgagauccuccccgacgaggaccccgagcucgacaaggccuucuccgucuccguccucuccgucuccuccggcucccucggcgcccacaucaacgccacccucaccguccucgccuccgacgaccccuacggcaucuucaucuucuccgagaagaaccgccccgucaaggucgaggaggccacccagaacaucacccucuccaucauccgccucaagggccucaugggcaagguccucgucuccuacgccacccucgacgacauggagaagccccccuacuucccccccaaccucgcccgcgccacccagggccgcgacuacauccccgccuccggcuucgcccucuucggcgccaaccaguccgaggccaccaucgccaucuccauccucgacgacgacgagcccgagcgcuccgaguccgucuucaucgagcuccucaacuccacccucgucgccaagguccagucccgcuccauccccaacuccccccgccucggccccaaggucgagaccaucgcccagcucaucaucaucgccaacgacgacgccuucggcacccuccagcucuccgcccccaucguccgcgucgccgagaaccacgucggccccaucaucaacgucacccgcaccggcggcgccuucgccgacgucuccgucaaguucaaggccguccccaucaccgccaucgccggcgaggacuacuccaucgccuccuccgacgucguccuccucgagggcgagaccuccaaggccguccccaucuacgucaucaacgacaucuaccccgagcucgaggaguccuuccucguccagcucaugaacgagaccaccggcggcgcccgccucggcgcccucaccgaggccgucaucaucaucgaggccuccgacgaccccuacggccucuucggcuuccagaucaccaagcucaucgucgaggagcccgaguucaacuccgucaaggucaaccuccccaucauccgcaacuccggcacccucggcaacgucaccguccagugggucgccaccaucaacggccagcucgccaccggcgaccuccgcgucgucuccggcaacgucaccuucgcccccggcgagaccauccagacccuccuccucgagguccucgccgacgacguccccgagaucgaggaggucauccagguccagcucaccgacgccuccggcggcggcaccaucggccucgaccgcaucgccaacaucaucauccccgccaacgacgaccccuacggcaccgucgccuucgcccagauggucuaccgcguccaggagccccucgagcgcuccuccugcgccaacaucaccguccgccgcuccggcggccacuucggccgccuccuccucuucuacuccaccuccgacaucgacgucgucgcccucgccauggaggagggccaggaccuccucuccuacuacgagucccccauccagggcguccccgacccccucuggcgcaccuggaugaacgucuccgccgucggcgagccccucuacaccugcgccacccucugccucaaggagcaggccugcuccgccuucuccuucuucuccgccuccgagggcccccagugcuucuggaugaccuccuggaucucccccgccgucaacaacuccgacuucuggaccuaccgcaagaacaugacccgcgucgccucccucuucuccggccaggccgucgccggcuccgacuacgagcccgucacccgccagugggccaucaugcaggagggcgacgaguucgccaaccucaccgucuccauccuccccgacgacuuccccgagauggacgaguccuuccucaucucccuccucgagguccaccucaugaacaucuccgccucccucaagaaccagcccaccaucggccagcccaacaucuccaccgucgucaucgcccucaacggcgacgccuucggcgucuucgucaucuacaacaucucccccaacaccuccgaggacggccucuucgucgagguccaggagcagccccagacccucgucgagcucaugauccaccgcaccggcggcucccucggccaggucgccgucgaguggcgcgucgucggcggcaccgccaccgagggccucgacuucaucggcgccggcgagauccucaccuucgccgagggcgagaccaagaagaccgucauccucaccauccucgacgacuccgagcccgaggacgacgaguccaucaucgucucccucgucuacaccgagggcggcucccgcauccuccccuccuccgacaccguccgcgucaacauccucgccaacgacaacgucgccggcaucgucuccuuccagaccgccucccgcuccgucaucggccacgagggcgagauccuccaguuccacgucauccgcaccuuccccggccgcggcaacgucaccgucaacuggaagaucaucggccagaaccucgagcucaacuucgccaacuucuccggccagcucuucuuccccgagggcucccucaacaccacccucuucguccaccuccucgacgacaacauccccgaggagaaggaggucuaccaggucauccucuacgacguccgcacccagggcgucccccccgccggcaucgcccuccucgacgcccagggcuacgccgccguccucaccgucgaggccuccgacgagccccacggcguccucaacuucgcccucuccucccgcuucguccuccuccaggaggccaacaucaccauccagcucuucaucaaccgcgaguucggcucccucggcgccaucaacgucaccuacaccaccguccccggcaugcucucccucaagaaccagaccgucggcaaccucgccgagcccgaggucgacuucguccccaucaucggcuuccucauccucgaggagggcgagaccgccgccgccaucaacaucaccauccucgaggacgacguccccgagcucgaggaguacuuccucgucaaccucaccuacgucggccucaccauggccgccuccaccuccuuccccccccgccucgacuccgagggccucaccgcccaggucaucaucgacgccaacgacggcgcccgcggcgucaucgaguggcagcagucccgcuucgaggucaacgagacccacggcucccucacccucgucgcccagcgcucccgcgagccccucggccacgucucccucuucgucuacgcccagaaccucgaggcccaggucggccucgacuacaucuucacccccaugauccuccacuucgccgacggcgagcgcuacaagaacgucaacaucaugauccucgacgacgacauccccgagggcgacgagaaguuccagcucauccucaccaaccccucccccggccucgagcucggcaagaacaccaucgcccucaucaucguccucgccaacgacgacggccccggcguccucuccuucaacaacuccgagcacuucuuccuccgcgagcccaccgcccucuacguccaggaguccgucgccguccucuacaucguccgcgagcccgcccagggccucuucggcaccgucaccguccaguucaucgucaccgaggucaacuccuccaacgaguccaaggaccucacccccuccaagggcuacaucguccucgaggagggcguccgcuucaaggcccuccagaucuccgccauccucgacaccgagcccgagauggacgaguacuucgucugcacccucuucaaccccaccggcggcgcccgccucggcguccacguccagacccucaucaccguccuccagaaccaggccccccucggccucuucuccaucuccgccgucgagaaccgcgccaccuccaucgacaucgaggaggccaaccgcaccgucuaccucaacgucucccgcaccaacggcaucgaccucgccgucuccguccagugggagaccgucuccgagaccgccuucggcaugcgcggcauggacgucgucuucuccgucuuccaguccuuccucgacgaguccgccuccggcuggugcuucuucacccucgagaaccucaucuacggcaucaugcuccgcaaguccuccgucaccgucuaccgcuggcagggcaucuucauccccgucgaggaccucaacaucgagaaccccaagaccugcgaggccuucaacaucggcuucucccccuacuucgucaucacccacgaggagcgcaacgaggagaagcccucccucaacuccgucuucaccuucaccuccggcuucaagcucuuccucguccagaccaucaucauccucgaguccucccagguccgcuacuucaccuccgacucccaggacuaccucaucaucgccucccagcgcgacgacuccgagcucacccaggucuuccgcuggaacggcggcuccuucguccuccaccagaagcuccccguccgcggcguccucaccgucgcccucuucaacaagggcggcuccgucuuccucgccaucucccaggccaacgcccgccucaacucccuccucuuccgcugguccggcuccggcuucaucaacuuccaggagguccccgucuccggcaccaccgaggucgaggcccucuccuccgccaacgacaucuaccucaucuucgccgagaacgucuuccucggcgaccagaacuccaucgacaucuucaucugggagaugggccaguccuccuuccgcuacuuccaguccgucgacuucgccgccgucaaccgcauccacuccuucacccccgccuccggcaucgcccacauccuccucaucggccaggacauguccgcccucuacugcuggaacuccgagcgcaaccaguucuccuucguccucgagguccccuccgccuacgacgucgccuccgucaccgucaagucccucaacuccuccaagaaccucaucgcccucgucggcgcccacucccacaucuacgagcucgccuacaucuccucccacuccgacuucauccccuccuccggcgagcucaucuucgagcccggcgagcgcgaggccaccaucgccgucaacauccucgacgacaccguccccgagaaggaggaguccuucaagguccagcucaagaaccccaagggcggcgccgagaucggcaucaacgacuccgucaccaucaccauccucuccaacgacgacgccuacggcaucgucgccuucgcccagaacucccucuacaagcaggucgaggagauggagcaggacucccucgucacccucaacgucgagcgccucaagggcaccuacggccgcaucaccaucgccugggaggccgacggcuccaucuccgacaucuuccccaccuccggcgucauccucuucaccgagggccagguccucuccaccaucacccucaccauccucgccgacaacauccccgagcucuccgaggucgucaucgucacccucacccgcaucaccaccgagggcgucgaggacuccuacaagggcgccaccaucgaccaggaccgcuccaaguccgucaucaccacccuccccaacgacucccccuucggccucgucggcuggcgcgccgccuccgucuucauccgcgucgccgagcccaaggagaacaccaccacccuccagcuccagaucgcccgcgacaagggccuccucggcgacaucgccauccaccuccgcgcccagcccaacuuccuccuccacgucgacaaccaggccaccgagaacgaggacuacguccuccaggagaccaucaucaucaugaaggagaacaucaaggaggcccacgccgaggucuccauccuccccgacgaccuccccgagcucgaggagggcuucaucgucaccaucaccgaggucaaccucgucaacuccgacuucuccaccggccagcccuccguccgccgccccggcauggagaucgccgagaucaugaucgaggagaacgacgacccccgcggcaucuucauguuccacgucacccgcggcgccggcgaggucaucaccgccuacgaggucccccccccccucaacguccuccagguccccgucguccgccucgccggcuccuucggcgccgucaacgucuacuggaaggccucccccgacuccgccggccucgaggacuucaagcccucccacggcauccucgaguucgccgacaagcaggucaccgccaugaucgagaucaccaucaucgacgacgccgaguucgagcucaccgagaccuucaacaucucccucaucuccgucgccggcggcggccgccucggcgacgacgucgucgucaccgucgucaucccccagaacgacucccccuucggcgucuucggcuucgaggagaagaccgucaugaucgacgagucccucuccuccgacgaccccgacuccuacgucacccucaccgucguccgcucccccggcggcaagggcaccguccgccucgaguggaccaucgacgagaaggccaagcacaaccucuccccccucaacggcacccuccacuucgacgagaccgagucccagaagaccaucguccuccacacccuccaggacaccguccucgaggaggaccgccgcuucaccauccagcucaucuccaucgacgaggucgagaucucccccgucaagggcuccgccuccaucaucauccgcggcgacaagcgcgccuccggcgaggucggcaucgcccccuccucccgccacauccucaucggcgagcccuccgccaaguacaacggcaccgccaucaucucccucguccgcggccccggcauccucggcgaggucaccgucuucuggcgcaucuucccccccuccgucggcgaguucgccgagaccuccggcaagcucaccaugcgcgacgagcaguccgccgucaucgucgucauccaggcccucaacgacgacauccccgaggagaaguccuucuacgaguuccagcucaccgccgucuccgagggcggcguccucuccgaguccuccuccaccgccaacaucaccgucgucgccuccgacucccccuacggccgcuucgccuucucccacgagcagcuccgcgucuccgaggcccagcgcgucaacaucaccaucauccgcuccuccggcgacuucggccacguccgccucugguacaagaccauguccggcaccgccgaggccggccucgacuucguccccgccgccggcgagcuccucuucgaggccggcgagaugcgcaagucccuccacgucgagauccucgacgacgacuaccccgagggccccgaggaguucucccucaccaucaccaaggucgagcuccagggccgcggcuacgacuucaccauccaggagaacggccuccagaucgaccagccccccgagaucggcaacaucuccaucguccgcaucaucaucaugaagaacgacaacgccgagggcaucaucgaguucgaccccaaguacaccgccuucgaggucgaggaggacgucggccucaucaugauccccgucguccgccuccacggcaccuacggcuacgucaccgccgacuucaucucccaguccuccuccgccucccccggcggcgucgacuacauccuccacggcuccaccgucaccuuccagcacggccagaaccucuccuucaucaacaucuccaucaucgacgacaacgaguccgaguucgaggagcccaucgagauccuccucaccggcgccaccggcggcgccguccucggccgccaccucgucucccgcaucaucaucgccaaguccgacucccccuucggcgucauccgcuuccucaaccaguccaagaucuccaucgccaaccccaacuccaccaugauccucucccucguccucgagcgcaccggcggccuccucggcgagauccaggucaacugggagaccgucggccccaacucccaggaggcccuccucccccagaaccgcgacaucgccgaccccgucuccggccucuucuacuucggcgagggcgagggcggcguccgcaccaucauccucaccaucuacccccacgaggagaucgaggucgaggagaccuucaucaucaagcuccaccucgucaagggcgaggccaagcucgacucccgcgccaaggacgucacccucaccauccaggaguucggcgaccccaacggcgucguccaguucgcccccgagacccucuccaagaagaccuacuccgagccccucgcccucgagggcccccuccucaucaccuucuucguccgccgcgucaagggcaccuucggcgagaucauggucuacugggagcucuccuccgaguucgacaucaccgaggacuuccucuccaccuccggcuucuucaccaucgccgacggcgaguccgaggccuccuucgacguccaccuccuccccgacgagguccccgagaucgaggaggacuacgucauccagcucgucuccgucgagggcggcgccgagcucgaccucgagaaguccaucaccugguucuccgucuacgccaacgacgacccccacggcgucuucgcccucuacuccgaccgccaguccauccucaucggccagaaccucauccgcuccauccagaucaacaucacccgccucgccggcaccuucggcgacgucgccgucggccuccgcaucuccuccgaccacaaggagcagcccaucgucaccgagaacgccgagcgccagcucgucgucaaggacggcgccaccuacaaggucgacgucguccccaucaagaaccaggucuuccucucccucggcuccaacuucacccuccagcucgucaccgucaugcucgucggcggccgcuucuacggcaugcccaccauccuccaggaggccaaguccgccguccuccccgucuccgagaaggccgccaacucccaggucggcuucgaguccaccgccuuccagcucaugaacaucaccgccggcaccucccacgucaugaucucccgccgcggcaccuacggcgcccucuccgucgccuggaccaccggcuacgcccccggccucgagauccccgaguucaucgucgucggcaacaugacccccacccucggcucccucuccuucucccacggcgagcagcgcaagggcgucuuccucuggaccuuccccucccccggcuggcccgaggccuucguccuccaccucuccggcguccaguccuccgcccccggcggcgcccagcuccgcuccggcuucaucgucgccgagaucgagcccaugggcgucuuccaguucuccaccuccucccgcaacaucaucgucuccgaggacacccagaugauccgccuccacguccagcgccucuucggcuuccacuccgaccucaucaaggucuccuaccagaccaccgccggcuccgccaagccccucgaggacuucgagcccguccagaacggcgagcucuucuuccagaaguuccagaccgaggucgacuucgagaucaccaucaucaacgaccagcucuccgagaucgaggaguucuucuacaucaaccucaccuccgucgagauccgcggccuccagaaguucgacgucaacugguccccccgccucaaccucgacuucuccgucgccgucaucaccauccucgacaacgacgaccucgccggcauggacaucuccuuccccgagaccaccgucgccgucgccgucgacaccacccucauccccgucgagaccgaguccaccaccuaccucuccaccuccaagaccaccaccauccuccagcccaccaacgucgucgccaucgucaccgaggccaccggcgucuccgccauccccgagaagcucgucacccuccacggcacccccgccgucuccgagaagcccgacgucgccaccgucaccgccaacgucuccauccacggcaccuucucccucggccccuccaucgucuacaucgaggaggagaugaagaacggcaccuucaacaccgccgagguccucauccgccgcaccggcggcuucaccggcaacgucuccaucaccgucaagaccuucggcgagcgcugcgcccagauggagcccaacgcccuccccuuccgcggcaucuacggcaucuccaaccucaccugggccgucgaggaggaggacuucgaggagcagacccucacccucaucuuccucgacggcgagcgcgagcgcaaggucuccguccagauccucgacgacgacgagcccgagggccaggaguucuucuacgucuuccucaccaacccccagggcggcgcccagaucgucgaggagaaggacgacaccggcuucgccgccuucgccauggucaucaucaccggcuccgaccuccacaacggcaucaucggcuucuccgaggagucccaguccggccucgagcuccgcgagggcgccgucaugcgccgccuccaccucaucgucacccgccagcccaaccgcgccuucgaggacgucaaggucuucuggcgcgucacccucaacaagaccgucgucguccuccagaaggacggcgucaaccucgucgaggagcuccaguccgucuccggcaccaccaccugcaccaugggccagaccaagugcuucaucuccaucgagcucaagcccgagaaggucccccaggucgaggucuacuucuucgucgagcucuacgaggccaccgccggcgccgccaucaacaacuccgcccgcuucgcccagaucaagauccucgaguccgacgagucccagucccucgucuacuucuccgucggcucccgccucgccgucgcccacaagaaggccacccucaucucccuccaggucgcccgcgacuccggcaccggccucaugauguccgucaacuucuccacccaggagcuccgcuccgccgagaccaucggccgcaccaucaucucccccgccaucuccggcaaggacuucgucaucaccgagggcacccucgucuucgagcccggccagcgcuccaccguccucgacgucauccucacccccgagaccggcucccucaacuccuuccccaagcgcuuccagaucguccucuucgaccccaagggcggcgcccgcaucgacaaggucuacggcaccgccaacaucacccucgucuccgacgccgacucccaggccaucuggggccucgccgaccagcuccaccagcccgucaacgacgacauccucaaccgcguccuccacaccaucuccaugaaggucgccaccgagaacaccgacgagcagcucuccgccaugaugcaccucaucgagaagaucaccaccgagggcaagauccaggccuucuccgucgccucccgcacccucuucuacgagauccucugcucccucaucaaccccaagcgcaaggacacccgcggcuucucccacuucgccgaggucaccgagaacuucgccuucucccuccucaccaacgucaccugcggcucccccggcgagaaguccaagaccauccucgacuccugccccuaccucuccauccucgcccuccacugguacccccagcagaucaacggccacaaguucgagggcaaggagggcgacuacauccgcauccccgagcgccuccucgacguccaggacgccgagaucauggccggcaaguccaccugcaagcucguccaguucaccgaguacuccucccagcagugguucaucuccggcaacaaccuccccacccucaagaacaagguccucucccucuccgucaagggccaguccucccagcuccucaccaacgacaacgagguccucuaccgcaucuacgccgccgagccccgcaucaucccccagaccucccucugccuccucuggaaccaggccgccgccuccuggcucuccgacucccaguucugcaaggucgucgaggagaccgccgacuacgucgagugcgccugcucccacauguccgucuacgccgucuacgcccgcaccgacaaccucuccuccuacaacgaggccuucuucaccuccggcuucaucugcaucuccggccucugccucgccguccucucccacaucuucugcgcccgcuacuccauguucgccgccaagcuccucacccacaugauggccgccucccucggcacccagauccucuuccucgccuccgccuacgccuccccccagcucgccgaggaguccugcuccgccauggccgccgucacccacuaccucuaccucugccaguucuccuggaugcucauccaguccgucaacuucugguacguccucgucaugaacgacgagcacaccgagcgccgcuaccuccucuucuuccuccucuccuggggccuccccgccuucgucgucauccuccucaucgucauccucaagggcaucuaccaccaguccaugucccagaucuacggccucauccacggcgaccucugcuucauccccaacgucuacgccgcccucuucaccgccgcccucgucccccucaccugccucgucgucgucuucgucgucuucauccacgccuaccaggucaagccccaguggaaggccuacgacgacgucuuccgcggccgcaccaacgccgccgagaucccccucauccucuaccucuucgcccucaucuccgucaccuggcucuggggcggccuccacauggccuaccgccacuucuggaugcucguccucuucgucaucuucaacucccuccagggccucuacgucuucauggucuacuucauccuccacaaccagaugugcugccccaugaaggccuccuacaccgucgagaugaacggccaccccggccccuccaccgccuucuucacccccggcuccggcaugccccccgccggcggcgagaucuccaaguccacccagaaccucaucggcgccauggaggaggucccccccgacugggagcgcgccuccuuccagcagggcucccaggccucccccgaccucaagcccuccccccagaacggcgccaccuuccccuccuccggcggcuacggccagggcucccucaucgccgacgaggagucccaggaguucgacgaccucaucuucgcccucaagaccggcgccggccucuccgucuccgacaacgaguccggccagggcucccaggagggcggcacccucaccgacucccagaucgucgagcuccgccgcauccccaucgccgacacccaccucuga

SEQ ID NO: 39446 - RNA, 1128 nt, Artificial Sequence
  derived and/or modified sequence opt2 from ADH1A__Homo_sapiens__NP_000658
auguccaccgccggcaaggucaucaagugcaaggccgccguccucugggagcucaagaagcccuucuccaucgaggaggucgaggucgccccccccaaggcccacgagguccgcaucaagauggucgccgucggcaucugcggcaccgacgaccacgucgucuccggcaccauggucaccccccuccccgucauccucggccacgaggccgccggcaucgucgaguccgucggcgagggcgucaccaccgucaagcccggcgacaaggucaucccccucgccaucccccagugcggcaagugccgcaucugcaagaaccccgaguccaacuacugccucaagaacgacgucuccaacccccagggcacccuccaggacggcaccucccgcuucaccugccgccgcaagcccauccaccacuuccucggcaucuccaccuucucccaguacaccgucgucgacgagaacgccgucgccaagaucgacgccgccuccccccucgagaaggucugccucaucggcugcggcuucuccaccggcuacggcuccgccgucaacgucgccaaggucacccccggcuccaccugcgccgucuucggccucggcggcgucggccucuccgccaucaugggcugcaaggccgccggcgccgcccgcaucaucgccgucgacaucaacaaggacaaguucgccaaggccaaggagcucggcgccaccgagugcaucaacccccaggacuacaagaagcccauccaggagguccucaaggagaugaccgacggcggcgucgacuucuccuucgaggucaucggccgccucgacaccaugauggccucccuccucugcugccacgaggccugcggcaccuccgucaucgucggcgucccccccgacucccagaaccucuccaugaaccccaugcuccuccucaccggccgcaccuggaagggcgccauccucggcggcuucaaguccaaggagugcguccccaagcucgucgccgacuucauggccaagaaguucucccucgacgcccucaucacccacguccuccccuucgagaagaucaacgagggcuucgaccuccuccacuccggcaaguccauccgcaccauccucauguucuga

SEQ ID NO: 39447 - RNA, 1128 nt, Artificial Sequence
  derived and/or modified sequence opt2 from ADH1B__Homo_sapiens__NP_000659
auguccaccgccggcaaggucaucaagugcaaggccgccguccucugggaggucaagaagcccuucuccaucgaggacgucgaggucgccccccccaaggccuacgagguccgcaucaagauggucgccgucggcaucugccacaccgacgaccacgucgucuccggcaaccucgucaccccccuccccgucauccucggccacgaggccgccggcaucgucgaguccgucggcgagggcgucaccaccgucaagcccggcgacaaggucaucccccucuucaccccccagugcggcaagugccgcgucugcaagaaccccgaguccaacuacugccucaagaacgaccucggcaacccccgcggcacccuccaggacggcacccgccgcuucaccugccgcggcaagcccauccaccacuuccucggcaccuccaccuucucccaguacaccgucgucgacgagaacgccgucgccaagaucgacgccgccuccccccucgagaaggucugccucaucggcugcggcuucuccaccggcuacggcuccgccgucaacgucgccaaggucacccccggcuccaccugcgccgucuucggccucggcggcgucggccucuccgccgucaugggcugcaaggccgccggcgccgcccgcaucaucgccgucgacaucaacaaggacaaguucgccaaggccaaggagcucggcgccaccgagugcaucaacccccaggacuacaagaagcccauccaggagguccucaaggagaugaccgacggcggcgucgacuucuccuucgaggucaucggccgccucgacaccaugauggccucccuccucugcugccacgaggccugcggcaccuccgucaucgucggcgucccccccgccucccagaaccucuccaucaaccccaugcuccuccucaccggccgcaccuggaagggcgccgucuacggcggcuucaaguccaaggagggcauccccaagcucgucgccgacuucauggccaagaaguucucccucgacgcccucaucacccacguccuccccuucgagaagaucaacgagggcuucgaccuccuccacuccggcaaguccauccgcaccguccucaccuucuga

SEQ ID NO: 39448 - RNA, 1143 nt, Artificial Sequence
  derived and/or modified sequence opt2 from ADH4__Homo_sapiens__NP_000661
augggcaccaagggcaaggucaucaagugcaaggccgccaucgccugggaggccggcaagccccucugcaucgaggaggucgaggucgccccccccaaggcccacgagguccgcauccagaucaucgccaccucccucugccacaccgacgccaccgucaucgacuccaaguucgagggccucgccuuccccgucaucgucggccacgaggccgccggcaucgucgaguccaucggccccggcgucaccaacgucaagcccggcgacaaggucaucccccucuacgccccccucugccgcaagugcaaguucugccucuccccccucaccaaccucugcggcaagaucuccaaccucaagucccccgccuccgaccagcagcucauggaggacaagaccucccgcuucaccugcaagggcaagcccgucuaccacuucuucggcaccuccaccuucucccaguacaccgucgucuccgacaucaaccucgccaagaucgacgacgacgccaaccucgagcgcgucugccuccucggcugcggcuucuccaccggcuacggcgccgccaucaacaacgccaaggucacccccggcuccaccugcgccgucuucggccucggcggcgucggccucuccgccgucaugggcugcaaggccgccggcgccucccgcaucaucggcaucgacaucaacuccgagaaguucgucaaggccaaggcccucggcgccaccgacugccucaacccccgcgaccuccacaagcccauccaggaggucaucaucgagcucaccaagggcggcgucgacuucgcccucgacugcgccggcggcuccgagaccaugaaggccgcccucgacugcaccaccgccggcuggggcuccugcaccuucaucggcgucgccgccggcuccaagggccucaccaucuuccccgaggagcucaucaucggccgcaccaucaacggcaccuucuucggcggcuggaaguccgucgacuccauccccaagcucgucaccgacuacaagaacaagaaguucaaccucgacgcccucgucacccacacccuccccuucgacaagaucuccgaggccuucgaccucaugaaccagggcaaguccguccgcaccauccucaucuucuga

SEQ ID NO: 39449 - RNA, 1125 nt, Artificial Sequence
  derived and/or modified sequence opt2 from ADH5__Homo_sapiens__NP_000662
auggccaacgaggucaucaagugcaaggccgccgucgccugggaggccggcaagccccucuccaucgaggagaucgaggucgccccccccaaggcccacgagguccgcaucaagaucaucgccaccgccgucugccacaccgacgccuacacccucuccggcgccgaccccgagggcugcuuccccgucauccucggccacgagggcgccggcaucgucgaguccgucggcgagggcgucaccaagcucaaggccggcgacaccgucaucccccucuacaucccccagugcggcgagugcaaguucugccucaaccccaagaccaaccucugccagaagauccgcgucacccagggcaagggccucaugcccgacggcaccucccgcuucaccugcaagggcaagaccauccuccacuacaugggcaccuccaccuucuccgaguacaccgucgucgccgacaucuccgucgccaagaucgacccccucgccccccucgacaaggucugccuccucggcugcggcaucuccaccggcuacggcgccgccgucaacaccgccaagcucgagcccggcuccgucugcgccgucuucggccucggcggcgucggccucgccgucaucaugggcugcaaggucgccggcgccucccgcaucaucggcgucgacaucaacaaggacaaguucgcccgcgccaaggaguucggcgccaccgagugcaucaacccccaggacuucuccaagcccauccaggagguccucaucgagaugaccgacggcggcgucgacuacuccuucgagugcaucggcaacgucaaggucaugcgcgccgcccucgaggccugccacaagggcuggggcgucuccgucgucgucggcgucgccgccuccggcgaggagaucgccacccgccccuuccagcucgucaccggccgcaccuggaagggcaccgccuucggcggcuggaaguccgucgaguccguccccaagcucgucuccgaguacauguccaagaagaucaaggucgacgaguucgucacccacaaccucuccuucgacgagaucaacaaggccuucgagcucaugcacuccggcaaguccauccgcaccgucgucaagaucuga

SEQ ID NO: 39450 - RNA, 1107 nt, Artificial Sequence
  derived and/or modified sequence opt2 from ADH6__Homo_sapiens__NP_000663
auguccaccaccggccaggucauccgcugcaaggccgccauccucuggaagcccggcgcccccuucuccaucgaggaggucgaggucgccccccccaaggccaaggagguccgcaucaaggucgucgccaccggccucugcggcaccgagaugaagguccucggcuccaagcaccucgaccuccucuaccccaccauccucggccacgagggcgccggcaucgucgaguccaucggcgagggcgucuccaccgucaagcccggcgacaaggucaucacccucuuccucccccagugcggcgagugcaccuccugccucaacuccgagggcaacuucugcauccaguucaagcaguccaagacccagcucauguccgacggcaccucccgcuucaccugcaagggcaaguccaucuaccacuucggcaacaccuccaccuucugcgaguacaccgucaucaaggagaucuccgucgccaagaucgacgccgucgccccccucgagaaggucugccucaucuccugcggcuucuccaccggcuucggcgccgccaucaacaccgccaaggucacccccggcuccaccugcgccgucuucggccucggcggcgucggccucuccgucgucaugggcugcaaggccgccggcgccgcccgcaucaucggcgucgacgucaacaaggagaaguucaagaaggcccaggagcucggcgccaccgagugccucaacccccaggaccucaagaagcccauccaggagguccucuucgacaugaccgacgccggcaucgacuucugcuucgaggccaucggcaaccucgacguccucgccgccgcccucgccuccugcaacgaguccuacggcgucugcgucgucgucggcguccuccccgccuccguccagcucaagaucuccggccagcucuucuucuccggccgcucccucaagggcuccgucuucggcggcuggaagucccgccagcacauccccaagcucgucgccgacuacauggccgagaagcucaaccucgacccccucaucacccacacccucaaccucgacaagaucaacgaggccgucgagcucaugaagaccggcaagugguga

SEQ ID NO: 39451 - RNA, 1161 nt, Artificial Sequence
  derived and/or modified sequence opt2 from ADH7__Homo_sapiens__NP_000664
auguucgccgagauccagauccaggacaaggaccgcaugggcaccgccggcaaggucaucaagugcaaggccgccguccucugggagcagaagcagcccuucuccaucgaggagaucgaggucgccccccccaagaccaaggagguccgcaucaagauccucgccaccggcaucugccgcaccgacgaccacgucaucaagggcaccauggucuccaaguuccccgucaucgucggccacgaggccaccggcaucgucgaguccaucggcgagggcgucaccaccgucaagcccggcgacaaggucaucccccucuuccucccccagugccgcgagugcaacgccugccgcaaccccgacggcaaccucugcauccgcuccgacaucaccggccgcggcguccucgccgacggcaccacccgcuucaccugcaagggcaagcccguccaccacuucaugaacaccuccaccuucaccgaguacaccgucgucgacgaguccuccgucgccaagaucgacgacgccgccccccccgagaaggucugccucaucggcugcggcuucuccaccggcuacggcgccgccgucaagaccggcaaggucaagcccggcuccaccugcgucgucuucggccucggcggcgucggccucuccgucaucaugggcugcaaguccgccggcgccucccgcaucaucggcaucgaccucaacaaggacaaguucgagaaggccauggccgucggcgccaccgagugcaucucccccaaggacuccaccaagcccaucuccgagguccucuccgagaugaccggcaacaacgucggcuacaccuucgaggucaucggccaccucgagaccaugaucgacgcccucgccuccugccacaugaacuacggcaccuccgucgucgucggcgucccccccuccgccaagaugcucaccuacgaccccaugcuccucuucaccggccgcaccuggaagggcugcgucuucggcggccucaagucccgcgacgacguccccaagcucgucaccgaguuccucgccaagaaguucgaccucgaccagcucaucacccacguccuccccuucaagaagaucuccgagggcuucgagcuccucaacuccggccaguccauccgcaccguccucaccuucuga

SEQ ID NO: 39452 - RNA, 1404 nt, Artificial Sequence
  derived and/or modified sequence opt2 from ADHFE1__Homo_sapiens__NP_653251
auggccgccgccgcccgcgcccgcgucgccuaccuccuccgccagcuccagcgcgccgccugccagugccccacccacucccacaccuacucccaggcccccggccucucccccuccggcaagaccaccgacuacgccuucgagauggccgucuccaacauccgcuacggcgccgccgucaccaaggaggucggcauggaccucaagaacaugggcgccaagaacgucugccucaugaccgacaagaaccucuccaagcucccccccguccaggucgccauggacucccucgucaagaacggcauccccuucaccgucuacgacaacguccgcgucgagcccaccgacuccuccuucauggaggccaucgaguucgcccagaagggcgccuucgacgccuacgucgccgucggcggcggcuccaccauggacaccugcaaggccgccaaccucuacgccuccuccccccacuccgacuuccucgacuacgucuccgcccccaucggcaagggcaagcccgucuccgucccccucaagccccucaucgccguccccaccaccuccggcaccggcuccgagaccaccggcgucgccaucuucgacuacgagcaccucaaggucaagaucggcaucaccucccgcgccaucaagcccacccucggccucaucgacccccuccacacccuccacaugcccgcccgcgucgucgccaacuccggcuucgacguccucugccacgcccucgaguccuacaccacccuccccuaccaccuccgcucccccugccccuccaaccccaucacccgccccgccuaccagggcuccaaccccaucuccgacaucugggccauccacgcccuccgcaucgucgccaaguaccucaagcgcgccguccgcaaccccgacgaccucgaggcccgcucccacaugcaccucgccuccgccuucgccggcaucggcuucggcaacgccggcguccaccucugccacggcauguccuaccccaucuccggccucgucaagauguacaaggccaaggacuacaacgucgaccacccccucgucccccacggccucuccgucguccucaccucccccgccgucuucaccuucaccgcccagauguuccccgagcgccaccucgagauggccgagauccucggcgccgacacccgcaccgcccgcauccaggacgccggccucguccucgccgacacccuccgcaaguuccucuucgaccucgacgucgacgacggccucgccgccgucggcuacuccaaggccgacauccccgcccucgucaagggcacccucccccaggagcgcgucaccaagcucgcccccugcccccaguccgaggaggaccucgccgcccucuucgaggccuccaugaagcucuacuga

SEQ ID NO: 39453 - RNA, 540 nt, Artificial Sequence
  derived and/or modified sequence opt2 from ADI1__Homo_sapiens__NP_060739
augguccaggccugguacauggacgacgcccccggcgacccccgccagccccaccgccccgaccccggccgccccgucggccucgagcagcuccgccgccucggcguccucuacuggaagcucgacgccgacaaguacgagaacgaccccgagcucgagaagauccgccgcgagcgcaacuacuccuggauggacaucaucaccaucugcaaggacaagcuccccaacuacgaggagaagaucaagauguucuacgaggagcaccuccaccucgacgacgagauccgcuacauccucgacggcuccggcuacuucgacguccgcgacaaggaggaccaguggauccgcaucuucauggagaagggcgacauggucacccuccccgccggcaucuaccaccgcuucaccgucgacgagaagaacuacaccaaggccaugcgccucuucgucggcgagcccgucuggaccgccuacaaccgccccgccgaccacuucgaggcccgcggccaguacgucaaguuccucgcccagaccgccuga

SEQ ID NO: 39454 - RNA, 243 nt, Artificial Sequence
  derived and/or modified sequence opt2 from ADIG__Homo_sapiens__NP_001018092
augaaguacccccucaugccccucgucaacgaccucaccuucuccuuccucgucuucugguucugccuccccgucggccuccuccuccuccucaucaucuggcuccgcuuccuccucucccaggacuccgaggagaacgacuccuccgucugccucgacugggagcccugguccaagggccccgccgaguucugcuggaagggcacccuccacggccaggagaaggagcgccccugcugguga

SEQ ID NO: 39455 - RNA, 735 nt, Artificial Sequence
  derived and/or modified sequence opt2 from ADIPOQ__Homo_sapiens__NP_001171271
augcuccuccucggcgccguccuccuccuccucgcccuccccggccacgaccaggagaccaccacccagggccccggcguccuccucccccuccccaagggcgccugcaccggcuggauggccggcauccccggccaccccggccacaacggcgcccccggccgcgacggccgcgacggcacccccggcgagaagggcgagaagggcgaccccggccucaucggccccaagggcgacaucggcgagaccggcguccccggcgccgagggcccccgcggcuuccccggcauccagggccgcaagggcgagcccggcgagggcgccuacgucuaccgcuccgccuucuccgucggccucgagaccuacgucaccauccccaacaugcccauccgcuucaccaagaucuucuacaaccagcagaaccacuacgacggcuccaccggcaaguuccacugcaacauccccggccucuacuacuucgccuaccacaucaccgucuacaugaaggacgucaaggucucccucuucaagaaggacaaggccaugcucuucaccuacgaccaguaccaggagaacaacgucgaccaggccuccggcuccguccuccuccaccucgaggucggcgaccaggucuggcuccaggucuacggcgagggcgagcgcaacggccucuacgccgacaacgacaacgacuccaccuucaccggcuuccuccucuaccacgacaccaacuga

SEQ ID NO: 39456 - RNA, 1128 nt, Artificial Sequence
  derived and/or modified sequence opt2 from ADIPOR1__Homo_sapiens__NP_001277558
auguccucccacaagggcuccgucgucgcccagggcaacggcgcccccgccuccaaccgcgaggccgacaccgucgagcucgccgagcucggcccccuccucgaggagaagggcaagcgcgucaucgccaacccccccaaggccgaggaggagcagaccugccccgucccccaggaggaggaggaggagguccgcguccucacccucccccuccaggcccaccacgccauggagaagauggaggaguucgucuacaaggucugggagggccgcuggcgcgucauccccuacgacguccuccccgacuggcucaaggacaacgacuaccuccuccacggccaccgcccccccaugcccuccuuccgcgccugcuucaaguccaucuuccgcauccacaccgagaccggcaacaucuggacccaccuccucggcuucguccucuuccucuuccucggcauccucaccaugcuccgccccaacauguacuucauggccccccuccaggagaaggucgucuucggcauguucuuccucggcgccguccucugccucuccuucuccuggcucuuccacaccgucuacugccacuccgagaaggucucccgcaccuucuccaagcucgacuacuccggcaucgcccuccucaucaugggcuccuucguccccuggcucuacuacuccuucuacugcuccccccagccccgccucaucuaccucuccaucgucugcguccucggcaucuccgccaucaucgucgcccagugggaccgcuucgccacccccaagcaccgccagacccgcgccggcgucuuccucggccucggccucuccggcgucguccccaccaugcacuucaccaucgccgagggcuucgucaaggccaccaccgucggccagaugggcugguucuuccucauggccgucauguacaucaccggcgccggccucuacgccgcccgcauccccgagcgcuucuuccccggcaaguucgacaucugguuccagucccaccagaucuuccacguccucgucgucgccgccgccuucguccacuucuacggcgucuccaaccuccaggaguuccgcuacggccucgagggcggcugcaccgacgacacccuccucuga

SEQ ID NO: 39457 - RNA, 1161 nt, Artificial Sequence
  derived and/or modified sequence opt2 from ADIPOR2__Homo_sapiens__XP_006719081
augaacgagcccaccgagaaccgccucggcugcucccgcacccccgagcccgacauccgccuccgcaagggccaccagcucgacggcacccgccgcggcgacaacgacucccaccagggcgaccucgagcccauccucgaggccuccguccucuccucccaccacaagaaguccuccgaggagcacgaguacuccgacgaggccccccaggaggacgagggcuucaugggcauguccccccuccuccaggcccaccacgccauggagaagauggaggaguucgucugcaaggucugggagggccgcuggcgcgucaucccccacgacguccuccccgacuggcucaaggacaacgacuuccuccuccacggccaccgcccccccaugcccuccuuccgcgccugcuucaaguccaucuuccgcauccacaccgagaccggcaacaucuggacccaccuccucggcugcgucuucuuccucugccucggcaucuucuacauguuccgccccaacaucuccuucgucgccccccuccaggagaaggucgucuucggccucuucuuccucggcgccauccucugccucuccuucuccuggcucuuccacaccgucuacugccacuccgagggcgucucccgccucuucuccaagcucgacuacuccggcaucgcccuccucaucaugggcuccuucguccccuggcucuacuacuccuucuacugcaacccccagcccugcuucaucuaccucaucgucaucugcguccucggcaucgccgccaucaucgucucccagugggacauguucgccaccccccaguaccgcggcguccgcgccggcgucuuccucggccucggccucuccggcaucauccccacccuccacuacgucaucuccgagggcuuccucaaggccgccaccaucggccagaucggcuggcucaugcucauggccucccucuacaucaccggcgccgcccucuacgccgcccgcauccccgagcgcuucuuccccggcaagugcgacaucugguuccacucccaccagcucuuccacaucuucgucgucgccggcgccuucguccacuuccacggcgucuccaaccuccaggaguuccgcuucaugaucggcggcggcugcuccgaggaggacgcccucuga

SEQ ID NO: 39458 - RNA, 231 nt, Artificial Sequence
  derived and/or modified sequence opt2 from ADIRF__Homo_sapiens__NP_006820
auggccuccaagggccuccaggaccucaagcagcaggucgagggcaccgcccaggaggccgucuccgccgccggcgccgccgcccagcaggucgucgaccaggccaccgaggccggccagaaggccauggaccagcucgccaagaccacccaggagaccaucgacaagaccgccaaccaggccuccgacaccuucuccggcaucggcaagaaguucggccuccucaaguga

SEQ ID NO: 39459 - RNA, 1038 nt, Artificial Sequence
  derived and/or modified sequence opt2 from ADK__Homo_sapiens__NP_001114
augaccuccguccgcgagaacauccucuucggcaugggcaacccccuccucgacaucuccgccgucgucgacaaggacuuccucgacaaguacucccucaagcccaacgaccagauccucgccgaggacaagcacaaggagcucuucgacgagcucgucaagaaguucaaggucgaguaccacgccggcggcuccacccagaacuccaucaaggucgcccaguggaugauccagcagccccacaaggccgccaccuucuucggcugcaucggcaucgacaaguucggcgagauccucaagcgcaaggccgccgaggcccacgucgacgcccacuacuacgagcagaacgagcagcccaccggcaccugcgccgccugcaucaccggcgacaaccgcucccucaucgccaaccucgccgccgccaacugcuacaagaaggagaagcaccucgaccucgagaagaacuggaugcucgucgagaaggcccgcgucugcuacaucgccggcuucuuccucaccgucucccccgaguccguccucaaggucgcccaccacgccuccgagaacaaccgcaucuucacccucaaccucuccgcccccuucaucucccaguucuacaaggagucccucaugaaggucaugcccuacgucgacauccucuucggcaacgagaccgaggccgccaccuucgcccgcgagcagggcuucgagaccaaggacaucaaggagaucgccaagaagacccaggcccuccccaagaugaacuccaagcgccagcgcaucgucaucuucacccagggccgcgacgacaccaucauggccaccgaguccgaggucaccgccuucgccguccucgaccaggaccagaaggagaucaucgacaccaacggcgccggcgacgccuucgucggcggcuuccucucccagcucgucuccgacaagccccucaccgagugcauccgcgccggccacuacgccgccuccaucaucauccgccgcaccggcugcaccuuccccgagaagcccgacuuccacuga

SEQ ID NO: 39460 - RNA, 447 nt, Artificial Sequence
  derived and/or modified sequence opt2 from ADM2__Homo_sapiens__NP_001240774
auggcccgcauccccaccgccgcccucggcugcaucucccuccucugccuccagcuccccggcucccucucccgcucccucggcggcgacccccgccccgucaagccccgcgagccccccgcccgcucccccuccuccucccuccagccccgccaccccgccccccgccccgucgucuggaagcuccaccgcgcccuccaggcccagcgcggcgccggccucgcccccgucaugggccagccccuccgcgacggcggccgccagcacuccggcccccgccgccacuccggcccccgccgcacccaggcccagcuccuccgcgucggcugcguccucggcaccugccagguccagaaccucucccaccgccucuggcagcucaugggccccgccggccgccaggacuccgcccccgucgaccccuccuccccccacuccuacggcuga

SEQ ID NO: 39461 - RNA, 558 nt, Artificial Sequence
  derived and/or modified sequence opt2 from ADM__Homo_sapiens__NP_001115
augaagcucgucuccgucgcccucauguaccucggcucccucgccuuccucggcgccgacaccgcccgccucgacgucgccuccgaguuccgcaagaaguggaacaagugggcccucucccgcggcaagcgcgagcuccgcauguccuccuccuaccccaccggccucgccgacgucaaggccggccccgcccagacccucauccgcccccaggacaugaagggcgccucccgcucccccgaggacuccucccccgacgccgcccgcauccgcgucaagcgcuaccgccaguccaugaacaacuuccagggccuccgcuccuucggcugccgcuucggcaccugcaccguccagaagcucgcccaccagaucuaccaguucaccgacaaggacaaggacaacgucgccccccgcuccaagaucuccccccagggcuacggccgccgccgccgccgcucccuccccgaggccggccccggccgcacccucgucuccuccaagccccaggcccacggcgcccccgccccccccuccggcuccgccccccacuuccucuga

SEQ ID NO: 39462 - RNA, 3309 nt, Artificial Sequence
  derived and/or modified sequence opt2 from ADNP__Homo_sapiens__XP_011527049
auguuccagcuccccgucaacaaccucggcucccuccgcaaggcccgcaagaccgucaagaagauccucuccgacaucggccucgaguacugcaaggagcacaucgaggacuucaagcaguucgagcccaacgacuucuaccucaagaacaccaccugggaggacgucggccucugggaccccucccucaccaagaaccaggacuaccgcaccaagcccuucugcugcuccgccugccccuucuccuccaaguucuucuccgccuacaagucccacuuccgcaacguccacuccgaggacuucgagaaccgcauccuccucaacugccccuacugcaccuucaacgccgacaagaagacccucgagacccacaucaagaucuuccacgcccccaacgccuccgcccccuccuccucccucuccaccuucaaggacaagaacaagaacgacggccucaagcccaagcaggccgacuccgucgagcaggccgucuacuacugcaagaagugcaccuaccgcgacccccucuacgagaucguccgcaagcacaucuaccgcgagcacuuccagcacgucgccgcccccuacaucgccaaggccggcgagaagucccucaacggcgccgucccccucggcuccaacgcccgcgaggaguccuccauccacugcaagcgcugccucuucaugcccaaguccuacgaggcccucguccagcacgucaucgaggaccacgagcgcaucggcuaccaggucaccgccaugaucggccacaccaacgucgucgucccccgcuccaagccccucaugcucaucgcccccaagccccaggacaagaaguccaugggccuccccccccgcaucggcucccucgccuccggcaacguccgcucccuccccucccagcagauggucaaccgccucuccauccccaagcccaaccucaacuccaccggcgucaacaugauguccuccguccaccuccagcagaacaacuacggcgucaaguccgucggccagggcuacuccgucggccaguccaugcgccucggccucggcggcaacgcccccgucuccaucccccagcagucccaguccgucaagcagcuccuccccuccggcaacggccgcuccuacggccucggcuccgagcagcgcucccaggcccccgcccgcuacucccuccaguccgccaacgccuccucccucuccuccggccagcucaagucccccucccucucccagucccaggccucccgcguccucggccaguccuccuccaagcccgccgccgccgccaccggccccccccccggcaacaccuccuccacccagaaguggaagaucugcaccaucugcaacgagcucuuccccgagaacgucuacuccguccacuucgagaaggagcacaaggccgagaagguccccgccgucgccaacuacaucaugaagauccacaacuucaccuccaagugccucuacugcaaccgcuaccuccccaccgacacccuccucaaccacaugcucauccacggccucuccugccccuacugccgcuccaccuucaacgacgucgagaagauggccgcccacaugcgcaugguccacaucgacgaggagaugggccccaagaccgacuccacccucuccuucgaccucacccuccagcagggcucccacaccaacauccaccuccucgucaccaccuacaaccuccgcgacgcccccgccgaguccgucgccuaccacgcccagaacaacccccccgucccccccaagccccagcccaagguccaggagaaggccgacauccccgucaaguccuccccccaggccgccguccccuacaagaaggacgucggcaagacccucugcccccucugcuucuccauccucaagggccccaucuccgacgcccucgcccaccaccuccgcgagcgccaccaggucauccagaccguccaccccgucgagaagaagcucaccuacaagugcauccacugccucggcgucuacaccuccaacaugaccgccuccaccaucacccuccaccucguccacugccgcggcgucggcaagacccagaacggccaggacaagaccaacgcccccucccgccucaaccagucccccucccucgcccccgucaagcgcaccuacgagcagauggaguucccccuccucaagaagcgcaagcucgacgacgacuccgacucccccuccuucuucgaggagaagcccgaggagcccgucguccucgcccucgaccccaagggccacgaggacgacuccuacgaggcccgcaaguccuuccucaccaaguacuucaacaagcagcccuaccccacccgccgcgagaucgagaagcucgccgccucccucuggcucuggaaguccgacaucgccucccacuucuccaacaagcgcaagaagugcguccgcgacugcgagaaguacaagcccggcguccuccucggcuucaacaugaaggagcucaacaaggucaagcacgagauggacuucgacgccgaguggcucuucgagaaccacgacgagaaggacucccgcgucaacgccuccaagaccgccgacaagaagcucaaccucggcaaggaggacgacuccuccuccgacuccuucgagaaccucgaggaggaguccaacgaguccggcucccccuucgaccccgucuucgaggucgagcccaagaucuccaacgacaaccccgaggagcacguccucaaggucauccccgaggacgccuccgaguccgaggagaagcucgaccagaaggaggacggcuccaaguacgagaccauccaccucaccgaggagcccaccaagcucaugcacaacgccuccgacuccgaggucgaccaggacgacgucgucgaguggaaggacggcgccucccccuccgaguccggccccggcucccagcaggucuccgacuucgaggacaacaccugcgagaugaagcccggcaccugguccgacgaguccucccaguccgaggacgcccgcuccuccaagcccgccgccaagaagaaggccaccaugcagggcgaccgcgagcagcucaaguggaagaacuccuccuacggcaaggucgagggcuucugguccaaggaccagucccaguggaagaacgccuccgagaacgacgagcgccucuccaacccccagaucgaguggcagaacuccaccaucgacuccgaggacggcgagcaguucgacaacaugaccgacggcgucgccgagcccaugcacggcucccucgccggcgucaagcucuccucccagcaggccuga

SEQ ID NO: 39463 - RNA, 813 nt, Artificial Sequence
  derived and/or modified sequence opt2 from ADO__Homo_sapiens__NP_116193
augccccgcgacaacauggccucccucauccagcgcaucgcccgccaggccugccucaccuuccgcggcuccggcggcggccgcggcgccuccgaccgcgacgccgccuccggccccgaggcccccaugcagcccggcuuccccgagaaccucuccaagcucaagucccuccucacccagcuccgcgccgaggaccucaacaucgccccccgcaaggccacccuccagccccucccccccaaccucccccccgucaccuacaugcacaucuacgagaccgacggcuucucccucggcgucuuccuccucaaguccggcaccuccaucccccuccacgaccaccccggcaugcacggcaugcucaagguccucuacggcaccguccgcaucuccugcauggacaagcucgacgccggcggcggccagcgcccccgcgcccucccccccgagcagcaguucgagcccccccuccagccccgcgagcgcgaggccguccgccccggcguccuccgcucccgcgccgaguacaccgaggccuccggccccugcauccucaccccccaccgcgacaaccuccaccagaucgacgccgucgagggccccgccgccuuccucgacauccucgccccccccuacgaccccgacgacggccgcgacugccacuacuaccgcguccucgagcccguccgccccaaggaggccuccuccuccgccugcgaccucccccgcgaggucuggcuccucgagaccccccaggccgacgacuucuggugcgagggcgagcccuaccccggccccaaggucuuccccuga

SEQ ID NO: 39464 - RNA, 981 nt, Artificial Sequence
  derived and/or modified sequence opt2 from ADORA1__Homo_sapiens__NP_000665
augccccccuccaucuccgccuuccaggccgccuacaucggcaucgagguccucaucgcccucgucuccguccccggcaacguccucgucaucugggccgucaaggucaaccaggcccuccgcgacgccaccuucugcuucaucgucucccucgccgucgccgacgucgccgucggcgcccucgucaucccccucgccauccucaucaacaucggcccccagaccuacuuccacaccugccucauggucgccugccccguccucauccucacccaguccuccauccucgcccuccucgccaucgccgucgaccgcuaccuccgcgucaagaucccccuccgcuacaagauggucgucaccccccgccgcgccgccgucgccaucgccggcugcuggauccucuccuucgucgucggccucacccccauguucggcuggaacaaccucuccgccgucgagcgcgccugggccgccaacggcuccaugggcgagcccgucaucaagugcgaguucgagaaggucaucuccauggaguacauggucuacuucaacuucuucgucuggguccuccccccccuccuccucaugguccucaucuaccucgaggucuucuaccucauccgcaagcagcucaacaagaaggucuccgccuccuccggcgacccccagaaguacuacggcaaggagcucaagaucgccaagucccucgcccucauccucuuccucuucgcccucuccuggcucccccuccacauccucaacugcaucacccucuucugccccuccugccacaagcccuccauccucaccuacaucgccaucuuccucacccacggcaacuccgccaugaaccccaucgucuacgccuuccgcauccagaaguuccgcgucaccuuccucaagaucuggaacgaccacuuccgcugccagcccgccccccccaucgacgaggaccuccccgaggagcgccccgacgacuga

SEQ ID NO: 39465 - RNA, 1239 nt, Artificial Sequence
  derived and/or modified sequence opt2 from ADORA2A__Homo_sapiens__NP_001265429
augcccaucaugggcuccuccgucuacaucaccgucgagcucgccaucgccguccucgccauccucggcaacguccucgucugcugggccgucuggcucaacuccaaccuccagaacgucaccaacuacuucgucgucucccucgccgccgccgacaucgccgucggcguccucgccauccccuucgccaucaccaucuccaccggcuucugcgccgccugccacggcugccucuucaucgccugcuucguccucguccucacccaguccuccaucuucucccuccucgccaucgccaucgaccgcuacaucgccauccgcaucccccuccgcuacaacggccucgucaccggcacccgcgccaagggcaucaucgccaucugcuggguccucuccuucgccaucggccucacccccaugcucggcuggaacaacugcggccagcccaaggagggcaagaaccacucccagggcugcggcgagggccaggucgccugccucuucgaggacgucguccccaugaacuacauggucuacuucaacuucuucgccugcguccucgucccccuccuccucaugcucggcgucuaccuccgcaucuuccucgccgcccgccgccagcucaagcagauggagucccagccccuccccggcgagcgcgcccgcuccacccuccagaaggagguccacgccgccaagucccucgccaucaucgucggccucuucgcccucugcuggcucccccuccacaucaucaacugcuucaccuucuucugccccgacugcucccacgccccccucuggcucauguaccucgccaucguccucucccacaccaacuccgucgucaaccccuucaucuacgccuaccgcauccgcgaguuccgccagaccuuccgcaagaucauccgcucccacguccuccgccagcaggagcccuucaaggccgccggcaccuccgcccgcguccucgccgcccacggcuccgacggcgagcaggucucccuccgccucaacggccacccccccggcgucugggccaacggcuccgccccccaccccgagcgccgccccaacggcuacgcccucggccucgucuccggcggcuccgcccaggagucccagggcaacaccggccuccccgacgucgagcuccucucccacgagcucaagggcgucugccccgagccccccggccucgacgacccccucgcccaggacggcgccggcgucuccuga

SEQ ID NO: 39466 - RNA, 999 nt, Artificial Sequence
  derived and/or modified sequence opt2 from ADORA2B__Homo_sapiens__NP_000667
augcuccucgagacccaggacgcccucuacgucgcccucgagcucgucaucgccgcccucuccgucgccggcaacguccucgucugcgccgccgucggcaccgccaacacccuccagacccccaccaacuacuuccucgucucccucgccgccgccgacgucgccgucggccucuucgccauccccuucgccaucaccaucucccucggcuucugcaccgacuucuacggcugccucuuccucgccugcuucguccucguccucacccaguccuccaucuucucccuccucgccgucgccgucgaccgcuaccucgccaucugcgucccccuccgcuacaagucccucgucaccggcacccgcgcccgcggcgucaucgccguccucuggguccucgccuucggcaucggccucacccccuuccucggcuggaacuccaaggacuccgccaccaacaacugcaccgagcccugggacggcaccaccaacgaguccugcugccucgucaagugccucuucgagaacgucguccccauguccuacauggucuacuucaacuucuucggcugcguccuccccccccuccucaucaugcucgucaucuacaucaagaucuuccucgucgccugccgccagcuccagcgcaccgagcucauggaccacucccgcaccacccuccagcgcgagauccacgccgccaagucccucgccaugaucgucggcaucuucgcccucugcuggcuccccguccacgccgucaacugcgucacccucuuccagcccgcccagggcaagaacaagcccaagugggccaugaacauggccauccuccucucccacgccaacuccgucgucaaccccaucgucuacgccuaccgcaaccgcgacuuccgcuacaccuuccacaagaucaucucccgcuaccuccucugccaggccgacgucaaguccggcaacggccaggccggcguccagcccgcccucggcgucggccucuga

SEQ ID NO: 39467 - RNA, 1491 nt, Artificial Sequence
  derived and/or modified sequence opt2 from ADPGK__Homo_sapiens__NP_112574
auggcccucuggcgcggcuccgccuacgccggcuuccucgcccucgccgucggcugcgucuuccuccucgagcccgagcuccccggcuccgcccuccgcucccucugguccucccucugccucggccccgcccccgccccccccggccccgucucccccgagggccgccucgccgccgccugggacgcccucaucguccgccccguccgccgcuggcgccgcgucgccgucggcgucaacgccugcgucgacgucguccucuccggcgucaagcuccuccaggcccucggccucucccccggcaacggcaaggaccacuccauccuccacucccgcaacgaccucgaggaggccuucauccacuucaugggcaagggcgccgccgccgagcgcuucuucuccgacaaggagaccuuccacgacaucgcccaggucgccuccgaguuccccggcgcccagcacuacgucggcggcaacgccgcccucaucggccagaaguucgccgccaacuccgaccucaagguccuccucugcggccccgucggccccaagcuccacgagcuccucgacgacaacgucuucgucccccccgagucccuccaggaggucgacgaguuccaccucauccucgaguaccaggccggcgaggaguggggccagcucaaggccccccacgccaaccgcuucaucuucucccacgaccucuccaacggcgccaugaacaugcucgaggucuucgucuccucccucgaggaguuccagcccgaccucgucguccucuccggccuccacaugauggagggccaguccaaggagcuccagcgcaagcgccuccucgaggucgucaccuccaucuccgacauccccaccggcauccccguccaccucgagcucgccuccaugaccaaccgcgagcucauguccuccaucguccaccaggucuuccccgccgucaccucccucggccucaacgagcaggagcuccucuuccucacccaguccgccuccggcccccacuccucccucuccuccuggaacggcguccccgacgucggcauggucuccgacauccucuucuggauccucaaggagcacggccgcuccaagucccgcgccuccgaccucacccgcauccacuuccacacccucgucuaccacauccucgccaccgucgacggccacugggccaaccagcucgccgccgucgccgccggcgcccgcgucgccggcacccaggccugcgccaccgagaccaucgacaccucccgcgucucccuccgcgccccccaggaguucaugaccucccacuccgaggccggcucccgcaucguccucaaccccaacaagcccgucgucgaguggcaccgcgagggcaucuccuuccacuucacccccguccucgucugcaaggaccccauccgcaccgucggccucggcgacgccaucuccgccgagggccucuucuacuccgagguccacccccacuacuga

SEQ ID NO: 39468 - RNA, 1074 nt, Artificial Sequence
  derived and/or modified sequence opt2 from ADPRH__Homo_sapiens__NP_001278878
auggagaaguacgucgccgccaugguccucuccgccgccggcgacgcccucggcuacuacaacggcaagugggaguuccuccaggacggcgagaagauccaccgccagcucgcccagcucggcggccucgacgcccucgacgucggccgcuggcgcgucuccgacgacaccgucaugcaccucgccaccgccgaggcccucgucgaggccggcaaggcccccaagcucacccagcucuacuaccuccucgccaagcacuaccaggacugcauggaggacauggacggccgcgcccccggcggcgccuccguccacaacgccaugcagcucaagcccggcaagcccaacggcuggcgcauccccuucaacucccacgagggcggcugcggcgccgccaugcgcgccaugugcaucggccuccgcuucccccaccacucccagcucgacacccucauccaggucuccaucgaguccggccgcaugacccaccaccaccccaccggcuaccucggcgcccucgccuccgcccucuucaccgccuacgccgucaacucccgccccccccuccaguggggcaagggccucauggagcuccuccccgaggccaagaaguacaucguccaguccggcuacuucgucgaggagaaccuccagcacugguccuacuuccagaccaagugggagaacuaccucaagcuccgcggcauccucgacggcgaguccgcccccaccuuccccgaguccuucggcgucaaggagcgcgaccaguucuacaccucccucuccuacuccggcuggggcggcuccuccggccacgacgcccccaugaucgccuacgacgccguccucgccgccggcgacuccuggaaggagcucgcccaccgcgccuucuuccacggcggcgacuccgacuccaccgccgccaucgccggcugcugguggggcgucauguacggcuucaagggcgucucccccuccaacuacgagaagcucgaguaccgcaaccgccucgaggagaccgcccgcgcccucuacucccucggcuccaaggaggacaccgucaucucccucuga

SEQ ID NO: 39469 - RNA, 1065 nt, Artificial Sequence
  derived and/or modified sequence opt2 from ADPRHL1__Homo_sapiens__NP_612439
auggagaaguucaaggccgccaugcuccucggcuccgucggcgacgcccucggcuaccgcaacgucugcaaggagaacuccaccgucggcaugaagauccaggaggagcuccagcgcuccggcggccucgaccaccucguccucucccccggcgaguggcccgucuccgacaacaccaucaugcacaucgccaccgccgaggcccucaccaccgacuacuggugccucgacgaccucuaccgcgagaugguccgcugcuacgucgagaucgucgagaagcuccccgagcgccgccccgaccccgccaccaucgagggcugcgcccagcucaagcccaacaacuaccuccucgccuggcacacccccuucaacgagaagggcuccggcuucggcgccgccaccaaggccaugugcaucggccuccgcuacuggaagcccgagcgccucgagacccucaucgaggucuccgucgagugcggccgcaugacccacaaccaccccaccggcuuccucggcucccucugcaccgcccucuucgucuccuucgccgcccagggcaagccccucguccaguggggccgcgacaugcuccgcgccgucccccucgccgaggaguacugccgcaagaccauccgccacaccgccgaguaccaggagcacugguucuacuucgaggccaaguggcaguucuaccucgaggagcgcaagaucuccaaggacuccgagaacaaggccaucuuccccgacaacuacgacgccgaggagcgcgagaagaccuaccgcaagugguccuccgagggccgcggcggccgccgcggccacgacgcccccaugaucgccuacgacgcccuccucgccgccggcaacuccuggaccgagcucugccaccgcgccauguuccacggcggcgaguccgccgccaccggcaccaucgccggcugccucuucggccuccucuacggccucgaccucguccccaagggccucuaccaggaccucgaggacaaggagaagcucgaggaccucggcgccgcccucuaccgccucuccaccgaggagaaguga

SEQ ID NO: 39470 - RNA, 630 nt, Artificial Sequence
  derived and/or modified sequence opt2 from ADPRHL2__Homo_sapiens__XP_011539938
augcgcgucgccggcaucucccucgccuacuccuccguccaggacguccagaaguucgcccgccucuccgcccagcucacccacgccuccucccucggcuacaacggcgccauccuccaggcccucgccguccaccucgcccuccagggcgaguccuccuccgagcacuuccucaagcagcuccucggccacauggaggaccucgagggcgacgcccaguccguccucgacgcccgcgagcucggcauggaggagcgccccuacuccucccgccucaagaagaucggcgagcuccucgaccaggccuccgucacccgcgaggaggucgucuccgagcucggcaacggcaucgccgccuucgaguccguccccaccgccaucuacugcuuccuccgcugcauggagcccgaccccgagauccccuccgccuucaacucccuccagcgcacccucaucuacuccaucucccucggcggcgacaccgacaccaucgccaccauggccggcgccaucgccggcgccuacuacggcauggaccagguccccgaguccuggcagcaguccugcgagggcuacgaggagaccgacauccucgcccagucccuccaccgcgucuuccagaaguccuga

SEQ ID NO: 39471 - RNA, 1401 nt, Artificial Sequence
  derived and/or modified sequence opt2 from ADRA1A__Homo_sapiens__NP_000671
auggucuuccucuccggcaacgccuccgacuccuccaacugcacccagccccccgcccccgucaacaucuccaaggccauccuccucggcgucauccucggcggccucauccucuucggcguccucggcaacauccucgucauccucuccgucgccugccaccgccaccuccacuccgucacccacuacuacaucgucaaccucgccgucgccgaccuccuccucaccuccaccguccuccccuucuccgccaucuucgagguccucggcuacugggccuucggccgcgucuucugcaacaucugggccgccgucgacguccucugcugcaccgccuccaucaugggccucugcaucaucuccaucgaccgcuacaucggcgucuccuacccccuccgcuaccccaccaucgucacccagcgccgcggccucauggcccuccucugcgucugggcccucucccucgucaucuccaucggcccccucuucggcuggcgccagcccgcccccgaggacgagaccaucugccagaucaacgaggagcccggcuacguccucuucuccgcccucggcuccuucuaccucccccucgccaucauccucgucauguacugccgcgucuacgucgucgccaagcgcgagucccgcggccucaaguccggccucaagaccgacaaguccgacuccgagcaggucacccuccgcauccaccgcaagaacgcccccgccggcggcuccggcauggccuccgccaagaccaagacccacuucuccguccgccuccucaaguucucccgcgagaagaaggccgccaagacccucggcaucgucgucggcugcuucguccucugcuggcuccccuucuuccucgucaugcccaucggcuccuucuuccccgacuucaagcccuccgagaccgucuucaagaucgucuucuggcucggcuaccucaacuccugcaucaaccccaucaucuaccccugcuccucccaggaguucaagaaggccuuccagaacguccuccgcauccagugccucugccgcaagcaguccuccaagcacgcccucggcuacacccuccacccccccucccaggccgucgagggccagcacaaggacaugguccgcauccccgucggcucccgcgagaccuucuaccgcaucuccaagaccgacggcgucugcgaguggaaguucuucuccuccaugccccgcggcuccgcccgcaucaccgucuccaaggaccaguccuccugcaccaccgcccgcguccgcuccaaguccuuccuccaggucugcugcugcgucggccccuccacccccucccucgacaagaaccaccagguccccaccaucaagguccacaccaucucccucuccgagaacggcgaggaggucuga

SEQ ID NO: 39472 - RNA, 1563 nt, Artificial Sequence
  derived and/or modified sequence opt2 from ADRA1B__Homo_sapiens__NP_000670
augaaccccgaccucgacaccggccacaacaccuccgcccccgcccacuggggcgagcucaagaacgccaacuucaccggccccaaccagaccuccuccaacuccacccucccccagcucgacaucacccgcgccaucuccgucggccucguccucggcgccuucauccucuucgccaucgucggcaacauccucgucauccucuccgucgccugcaaccgccaccuccgcacccccaccaacuacuucaucgucaaccucgccauggccgaccuccuccucuccuucaccguccuccccuucuccgccgcccucgagguccucggcuacuggguccucggccgcaucuucugcgacaucugggccgccgucgacguccucugcugcaccgccuccauccucucccucugcgccaucuccaucgaccgcuacaucggcguccgcuacucccuccaguaccccacccucgucacccgccgcaaggccauccucgcccuccucuccgucuggguccucuccaccgucaucuccaucggcccccuccucggcuggaaggagcccgcccccaacgacgacaaggagugcggcgucaccgaggagcccuucuacgcccucuucuccucccucggcuccuucuacaucccccucgccgucauccucgucauguacugccgcgucuacaucgucgccaagcgcaccaccaagaaccucgaggccggcgucaugaaggagauguccaacuccaaggagcucacccuccgcauccacuccaagaacuuccacgaggacacccucuccuccaccaaggccaagggccacaacccccgcuccuccaucgccgucaagcucuucaaguucucccgcgagaagaaggccgccaagacccucggcaucgucgucggcauguucauccucugcuggcuccccuucuucaucgcccucccccucggcucccucuucuccacccucaagccccccgacgccgucuucaaggucgucuucuggcucggcuacuucaacuccugccucaaccccaucaucuaccccugcuccuccaaggaguucaagcgcgccuucguccgcauccucggcugccagugccgcggccgcggccgccgccgccgccgccgccgccgccgccucggcggcugcgccuacaccuaccgccccuggacccgcggcggcucccucgagcgcucccagucccgcaaggacucccucgacgacuccggcuccugccucuccggcucccagcgcacccuccccuccgccucccccucccccggcuaccucggccgcggcgcccccccccccgucgagcucugcgccuuccccgaguggaaggcccccggcgcccuccucucccuccccgcccccgagccccccggccgccgcggccgccacgacuccggcccccucuucaccuucaagcuccucaccgagcccgagucccccggcaccgacggcggcgccuccaacggcggcugcgaggccgccgccgacgucgccaacggccagcccggcuucaaguccaacaugccccucgcccccggccaguucuga

SEQ ID NO: 39473 - RNA, 1719 nt, Artificial Sequence
  derived and/or modified sequence opt2 from ADRA1D__Homo_sapiens__NP_000669
augaccuuccgcgaccuccucuccgucuccuucgagggcccccgccccgacuccuccgccggcggcuccuccgccggcggcggcggcggcuccgccggcggcgccgcccccuccgagggccccgccgucggcggcguccccggcggcgccggcggcggcggcggcgucgucggcgccggcuccggcgaggacaaccgcuccuccgccggcgagcccggcuccgccggcgccggcggcgacgucaacggcaccgccgccgucggcggccucgucgucuccgcccagggcgucggcgucggcgucuuccucgccgccuucauccucauggccgucgccggcaaccuccucgucauccucuccgucgccugcaaccgccaccuccagaccgucaccaacuacuucaucgucaaccucgccgucgccgaccuccuccucuccgccaccguccuccccuucuccgccaccauggagguccucggcuucugggccuucggccgcgccuucugcgacgucugggccgccgucgacguccucugcugcaccgccuccauccucucccucugcaccaucuccgucgaccgcuacgucggcguccgccacucccucaaguaccccgccaucaugaccgagcgcaaggccgccgccauccucgcccuccucugggucgucgcccucgucgucuccgucggcccccuccucggcuggaaggagcccgucccccccgacgagcgcuucugcggcaucaccgaggaggccggcuacgccgucuucuccuccgucugcuccuucuaccuccccauggccgucaucgucgucauguacugccgcgucuacgucgucgcccgcuccaccacccgcucccucgaggccggcgucaagcgcgagcgcggcaaggccuccgaggucguccuccgcauccacugccgcggcgccgccaccggcgccgacggcgcccacggcaugcgcuccgccaagggccacaccuuccgcuccucccucuccguccgccuccucaaguucucccgcgagaagaaggccgccaagacccucgccaucgucgucggcgucuucguccucugcugguuccccuucuucuucguccucccccucggcucccucuucccccagcucaagcccuccgagggcgucuucaaggucaucuucuggcucggcuacuucaacuccugcgucaacccccucaucuaccccugcuccucccgcgaguucaagcgcgccuuccuccgccuccuccgcugccagugccgccgccgccgccgccgccgcccccucuggcgcgucuacggccaccacuggcgcgccuccaccuccggccuccgccaggacugcgcccccuccuccggcgacgccccccccggcgccccccucgcccucaccgcccuccccgaccccgaccccgagccccccggcacccccgagaugcaggcccccgucgccucccgccgcaagccccccuccgccuuccgcgaguggcgccuccucggccccuuccgccgccccaccacccagcuccgcgccaaggucuccucccucucccacaagauccgcgccggcggcgcccagcgcgccgaggccgccugcgcccagcgcuccgaggucgaggccgucucccucggcgucccccacgaggucgccgagggcgccaccugccaggccuacgagcucgccgacuacuccaaccuccgcgagaccgacaucuga

SEQ ID NO: 39474 - RNA, 1398 nt, Artificial Sequence
  derived and/or modified sequence opt2 from ADRA2A__Homo_sapiens__NP_000672
auguuccgccaggagcagccccucgccgagggcuccuucgcccccaugggcucccuccagcccgacgccggcaacgccuccuggaacggcaccgaggcccccggcggcggcgcccgcgccacccccuacucccuccaggucacccucacccucgucugccucgccggccuccucaugcuccucaccgucuucggcaacguccucgucaucaucgccgucuucaccucccgcgcccucaaggccccccagaaccucuuccucgucucccucgccuccgccgacauccucgucgccacccucgucauccccuucucccucgccaacgaggucaugggcuacugguacuucggcaaggccuggugcgagaucuaccucgcccucgacguccucuucugcaccuccuccaucguccaccucugcgccaucucccucgaccgcuacugguccaucacccaggccaucgaguacaaccucaagcgcaccccccgccgcaucaaggccaucaucaucaccgucugggucaucuccgccgucaucuccuuccccccccucaucuccaucgagaagaagggcggcggcggcggcccccagcccgccgagccccgcugcgagaucaacgaccagaagugguacgucaucuccuccugcaucggcuccuucuucgcccccugccucaucaugauccucgucuacguccgcaucuaccagaucgccaagcgccgcacccgcgucccccccucccgccgcggccccgacgccgucgccgccccccccggcggcaccgagcgccgccccaacggccucggccccgagcgcuccgccggccccggcggcgccgaggccgagccccuccccacccagcucaacggcgcccccggcgagcccgcccccgccggcccccgcgacaccgacgcccucgaccucgaggaguccuccuccuccgaccacgccgagcgcccccccggcccccgccgccccgagcgcggcccccgcggcaagggcaaggcccgcgccucccaggucaagcccggcgacucccucccccgccgcggccccggcgccaccggcaucggcacccccgccgccggccccggcgaggagcgcgucggcgccgccaaggccucccgcuggcgcggccgccagaaccgcgagaagcgcuucaccuucguccucgccgucgucaucggcgucuucgucgucugcugguuccccuucuucuucaccuacacccucaccgccgucggcugcuccgucccccgcacccucuucaaguucuucuucugguucggcuacugcaacuccucccucaaccccgucaucuacaccaucuucaaccacgacuuccgccgcgccuucaagaagauccucugccgcggcgaccgcaagcgcaucgucuga

SEQ ID NO: 39475 - RNA, 1353 nt, Artificial Sequence
  derived and/or modified sequence opt2 from ADRA2B__Homo_sapiens__NP_000673
auggaccaccaggaccccuacuccguccaggccaccgccgccaucgccgccgccaucaccuuccucauccucuucaccaucuucggcaacgcccucgucauccucgccguccucaccucccgcucccuccgcgccccccagaaccucuuccucgucucccucgccgccgccgacauccucgucgccacccucaucauccccuucucccucgccaacgagcuccucggcuacugguacuuccgccgcaccuggugcgaggucuaccucgcccucgacguccucuucugcaccuccuccaucguccaccucugcgccaucucccucgaccgcuacugggccgucucccgcgcccucgaguacaacuccaagcgcaccccccgccgcaucaagugcaucauccucaccgucuggcucaucgccgccgucaucucccuccccccccucaucuacaagggcgaccagggcccccagccccgcggccgcccccagugcaagcucaaccaggaggccugguacauccucgccuccuccaucggcuccuucuucgcccccugccucaucaugauccucgucuaccuccgcaucuaccucaucgccaagcgcuccaaccgccgcggcccccgcgccaagggcggccccggccagggcgaguccaagcagccccgccccgaccacggcggcgcccucgccuccgccaagcuccccgcccucgccuccgucgccuccgcccgcgaggucaacggccacuccaaguccaccggcgagaaggaggagggcgagacccccgaggacaccggcacccgcgcccucccccccuccugggccgcccuccccaacuccggccagggccagaaggagggcgucugcggcgccucccccgaggacgaggccgaggaggaggaggaggaggaggaggaggaggaggagugcgagccccaggccguccccgucucccccgccuccgccugcucccccccccuccagcagccccagggcucccgcguccucgccacccuccgcggccagguccuccucggccgcggcgucggcgccaucggcggccagugguggcgccgccgcgcccagcucacccgcgagaagcgcuucaccuucguccucgccgucgucaucggcgucuucguccucugcugguuccccuucuucuucuccuacucccucggcgccaucugccccaagcacugcaaggucccccacggccucuuccaguucuucuucuggaucggcuacugcaacuccucccucaaccccgucaucuacaccaucuucaaccaggacuuccgccgcgccuuccgccgcauccucugccgccccuggacccagaccgccugguga

SEQ ID NO: 39476 - RNA, 1389 nt, Artificial Sequence
  derived and/or modified sequence opt2 from ADRA2C__Homo_sapiens__NP_000674
auggccucccccgcccucgccgccgcccucgccgucgccgccgccgccggccccaacgccuccggcgccggcgagcgcggcuccggcggcgucgccaacgccuccggcgccuccuggggccccccccgcggccaguacuccgccggcgccgucgccggccucgccgccgucgucggcuuccucaucgucuucaccgucgucggcaacguccucgucgucaucgccguccucaccucccgcgcccuccgcgccccccagaaccucuuccucgucucccucgccuccgccgacauccucgucgccacccucgucaugcccuucucccucgccaacgagcucauggccuacugguacuucggccaggucuggugcggcgucuaccucgcccucgacguccucuucugcaccuccuccaucguccaccucugcgccaucucccucgaccgcuacugguccgucacccaggccgucgaguacaaccucaagcgcaccccccgccgcgucaaggccaccaucgucgccgucuggcucaucuccgccgucaucuccuuccccccccucgucucccucuaccgccagcccgacggcgccgccuacccccagugcggccucaacgacgagaccugguacauccucuccuccugcaucggcuccuucuucgcccccugccucaucaugggccucgucuacgcccgcaucuaccgcgucgccaagcuccgcacccgcacccucuccgagaagcgcgcccccgucggccccgacggcgccucccccaccaccgagaacggccucggcgccgccgccggcgccggcgagaacggccacugcgcccccccccccgccgacgucgagcccgacgaguccuccgccgccgccgagcgccgccgccgccgcggcgcccuccgccgcggcggccgccgccgcgccggcgccgagggcggcgccggcggcgccgacggccagggcgccggccccggcgccgccgaguccggcgcccucaccgccucccgcucccccggccccggcggccgccucucccgcgccuccucccgcuccgucgaguucuuccucucccgccgccgccgcgcccgcuccuccgucugccgccgcaaggucgcccaggcccgcgagaagcgcuucaccuucguccucgccgucgucaugggcgucuucguccucugcugguuccccuucuucuucuccuacucccucuacggcaucugccgcgaggccugccagguccccggcccccucuucaaguucuucuucuggaucggcuacugcaacuccucccucaaccccgucaucuacaccgucuucaaccaggacuuccgccgcuccuucaagcacauccucuuccgccgccgccgccgcggcuuccgccaguga

SEQ ID NO: 39477 - RNA, 1434 nt, Artificial Sequence
  derived and/or modified sequence opt2 from ADRB1__Homo_sapiens__NP_000675
augggcgccggcguccucguccucggcgccuccgagcccggcaaccucuccuccgccgccccccuccccgacggcgccgccaccgccgcccgccuccucguccccgccuccccccccgccucccuccucccccccgccuccgagucccccgagccccucucccagcaguggaccgccggcaugggccuccucauggcccucaucguccuccucaucgucgccggcaacguccucgucaucgucgccaucgccaagaccccccgccuccagacccucaccaaccucuucaucaugucccucgccuccgccgaccucgucaugggccuccucgucguccccuucggcgccaccaucgucgucuggggccgcugggaguacggcuccuucuucugcgagcucuggaccuccgucgacguccucugcgucaccgccuccaucgagacccucugcgucaucgcccucgaccgcuaccucgccaucaccucccccuuccgcuaccagucccuccucacccgcgcccgcgcccgcggccucgucugcaccgucugggccaucuccgcccucgucuccuuccuccccauccucaugcacugguggcgcgccgaguccgacgaggcccgccgcugcuacaacgaccccaagugcugcgacuucgucaccaaccgcgccuacgccaucgccuccuccgucgucuccuucuacgucccccucugcaucauggccuucgucuaccuccgcgucuuccgcgaggcccagaagcaggucaagaagaucgacuccugcgagcgccgcuuccucggcggccccgcccgcccccccucccccucccccucccccguccccgcccccgcccccccccccggccccccccgccccgccgccgccgccgccaccgccccccucgccaacggccgcgccggcaagcgccgccccucccgccucgucgcccuccgcgagcagaaggcccucaagacccucggcaucaucaugggcgucuucacccucugcuggcuccccuucuuccucgccaacgucgucaaggccuuccaccgcgagcucguccccgaccgccucuucgucuucuucaacuggcucggcuacgccaacuccgccuucaaccccaucaucuacugccgcucccccgacuuccgcaaggccuuccagggccuccucugcugcgcccgccgcgccgcccgccgccgccacgccacccacggcgaccgcccccgcgccuccggcugccucgcccgccccggccccccccccucccccggcgccgccuccgacgacgacgacgacgacgucgucggcgccaccccccccgcccgccuccucgagcccugggccggcugcaacggcggcgccgccgccgacuccgacuccucccucgacgagcccugccgccccggcuucgccuccgaguccaaggucuga

SEQ ID NO: 39478 - RNA, 1242 nt, Artificial Sequence
  derived and/or modified sequence opt2 from ADRB2__Homo_sapiens__NP_000015
augggccagcccggcaacggcuccgccuuccuccucgcccccaaccgcucccacgcccccgaccacgacgucacccagcagcgcgacgaggucugggucgucggcaugggcaucgucaugucccucaucguccucgccaucgucuucggcaacguccucgucaucaccgccaucgccaaguucgagcgccuccagaccgucaccaacuacuucaucaccucccucgccugcgccgaccucgucaugggccucgccgucguccccuucggcgccgcccacauccucaugaagauguggaccuucggcaacuucuggugcgaguucuggaccuccaucgacguccucugcgucaccgccuccaucgagacccucugcgucaucgccgucgaccgcuacuucgccaucaccucccccuucaaguaccagucccuccucaccaagaacaaggcccgcgucaucauccucauggucuggaucgucuccggccucaccuccuuccuccccauccagaugcacugguaccgcgccacccaccaggaggccaucaacugcuacgccaacgagaccugcugcgacuucuucaccaaccaggccuacgccaucgccuccuccaucgucuccuucuacgucccccucgucaucauggucuucgucuacucccgcgucuuccaggaggccaagcgccagcuccagaagaucgacaaguccgagggccgcuuccacguccagaaccucucccaggucgagcaggacggccgcaccggccacggccuccgccgcuccuccaaguucugccucaaggagcacaaggcccucaagacccucggcaucaucaugggcaccuucacccucugcuggcuccccuucuucaucgucaacaucguccacgucauccaggacaaccucauccgcaaggaggucuacauccuccucaacuggaucggcuacgucaacuccggcuucaacccccucaucuacugccgcucccccgacuuccgcaucgccuuccaggagcuccucugccuccgccgcuccucccucaaggccuacggcaacggcuacuccuccaacggcaacaccggcgagcaguccggcuaccacgucgagcaggagaaggagaacaagcuccucugcgaggaccuccccggcaccgaggacuucgucggccaccagggcaccguccccuccgacaacaucgacucccagggccgcaacugcuccaccaacgacucccuccucuga

SEQ ID NO: 39479 - RNA, 1227 nt, Artificial Sequence
  derived and/or modified sequence opt2 from ADRB3__Homo_sapiens__NP_000016
auggcccccuggccccacgagaacuccucccucgcccccuggcccgaccuccccacccucgcccccaacaccgccaacaccuccggccuccccggcguccccugggaggccgcccucgccggcgcccuccucgcccucgccguccucgccaccgucggcggcaaccuccucgucaucgucgccaucgccuggaccccccgccuccagaccaugaccaacgucuucgucaccucccucgccgccgccgaccucgucaugggccuccucgucgucccccccgccgccacccucgcccucaccggccacuggccccucggcgccaccggcugcgagcucuggaccuccgucgacguccucugcgucaccgccuccaucgagacccucugcgcccucgccgucgaccgcuaccucgccgucaccaacccccuccgcuacggcgcccucgucaccaagcgcugcgcccgcaccgccgucguccucgucugggucgucuccgccgccgucuccuucgcccccaucaugucccagugguggcgcgucggcgccgacgccgaggcccagcgcugccacuccaacccccgcugcugcgccuucgccuccaacaugcccuacguccuccucuccuccuccgucuccuucuaccucccccuccucgucaugcucuucgucuacgcccgcgucuucgucgucgccacccgccagcuccgccuccuccgcggcgagcucggccgcuucccccccgaggaguccccccccgcccccucccgcucccucgcccccgcccccgucggcaccugcgccccccccgagggcguccccgccugcggccgccgccccgcccgccuccucccccuccgcgagcaccgcgcccucugcacccucggccucaucaugggcaccuucacccucugcuggcuccccuucuuccucgccaacguccuccgcgcccucggcggccccucccucguccccggccccgccuuccucgcccucaacuggcucggcuacgccaacuccgccuucaacccccucaucuacugccgcucccccgacuuccgcuccgccuuccgccgccuccucugccgcugcggccgccgccucccccccgagcccugcgccgccgcccgccccgcccucuuccccuccggcguccccgccgcccgcuccucccccgcccagccccgccucugccagcgccucgacggcgccuccuggggcgucuccuga

SEQ ID NO: 39480 - RNA, 2070 nt, Artificial Sequence
  derived and/or modified sequence opt2 from ADRBK1__Homo_sapiens__NP_001610
auggccgaccucgaggccguccucgccgacgucuccuaccucauggccauggagaaguccaaggccacccccgccgcccgcgccuccaagaagauccuccuccccgagcccuccauccgcuccgucaugcagaaguaccucgaggaccgcggcgaggucaccuucgagaagaucuucucccagaagcucggcuaccuccucuuccgcgacuucugccucaaccaccucgaggaggcccgcccccucgucgaguucuacgaggagaucaagaaguacgagaagcucgagaccgaggaggagcgcgucgcccgcucccgcgagaucuucgacuccuacaucaugaaggagcuccucgccugcucccaccccuucuccaaguccgccaccgagcacguccagggccaccucggcaagaagcaggucccccccgaccucuuccagcccuacaucgaggagaucugccagaaccuccgcggcgacgucuuccagaaguucaucgaguccgacaaguucacccgcuucugccaguggaagaacgucgagcucaacauccaccucaccaugaacgacuucuccguccaccgcaucaucggccgcggcggcuucggcgaggucuacggcugccgcaaggccgacaccggcaagauguacgccaugaagugccucgacaagaagcgcaucaagaugaagcagggcgagacccucgcccucaacgagcgcaucaugcucucccucgucuccaccggcgacugccccuucaucgucugcauguccuacgccuuccacacccccgacaagcucuccuucauccucgaccucaugaacggcggcgaccuccacuaccaccucucccagcacggcgucuucuccgaggccgacaugcgcuucuacgccgccgagaucauccucggccucgagcacaugcacaaccgcuucgucgucuaccgcgaccucaagcccgccaacauccuccucgacgagcacggccacguccgcaucuccgaccucggccucgccugcgacuucuccaagaagaagccccacgccuccgucggcacccacggcuacauggcccccgagguccuccagaagggcgucgccuacgacuccuccgccgacugguucucccucggcugcaugcucuucaagcuccuccgcggccacucccccuuccgccagcacaagaccaaggacaagcacgagaucgaccgcaugacccucaccauggccgucgagcuccccgacuccuucucccccgagcuccgcucccuccucgagggccuccuccagcgcgacgucaaccgccgccucggcugccucggccgcggcgcccaggaggucaaggagucccccuucuuccgcucccucgacuggcagauggucuuccuccagaaguacccccccccccucauccccccccgcggcgaggucaacgccgccgacgccuucgacaucggcuccuucgacgaggaggacaccaagggcaucaagcuccucgacuccgaccaggagcucuaccgcaacuucccccucaccaucuccgagcgcuggcagcaggaggucgccgagaccgucuucgacaccaucaacgccgagaccgaccgccucgaggcccgcaagaaggccaagaacaagcagcucggccacgaggaggacuacgcccucggcaaggacugcaucaugcacggcuacauguccaagaugggcaaccccuuccucacccaguggcagcgccgcuacuucuaccucuuccccaaccgccucgaguggcgcggcgagggcgaggccccccagucccuccucaccauggaggagauccaguccgucgaggagacccagaucaaggagcgcaagugccuccuccucaagauccgcggcggcaagcaguucauccuccagugcgacuccgaccccgagcucguccaguggaagaaggagcuccgcgacgccuaccgcgaggcccagcagcucguccagcgcguccccaagaugaagaacaagccccgcucccccgucgucgagcucuccaaggucccccucguccagcgcggcuccgccaacggccucuga

SEQ ID NO: 39481 - RNA, 2067 nt, Artificial Sequence
  derived and/or modified sequence opt2 from ADRBK2__Homo_sapiens__NP_005151
auggccgaccucgaggccguccucgccgacgucuccuaccucauggccauggagaaguccaaggccacccccgccgcccgcgccuccaagcgcaucguccuccccgagcccuccauccgcuccgucaugcagaaguaccucgccgagcgcaacgagaucaccuucgacaagaucuucaaccagaagaucggcuuccuccucuucaaggacuucugccucaacgagaucaacgaggccgucccccaggucaaguucuacgaggagaucaaggaguacgagaagcucgacaacgaggaggaccgccucugccgcucccgccagaucuacgacgccuacaucaugaaggagcuccucuccugcucccaccccuucuccaagcaggccgucgagcacguccagucccaccucuccaagaagcaggucaccuccacccucuuccagcccuacaucgaggagaucugcgagucccuccgcggcgacaucuuccagaaguucauggaguccgacaaguucacccgcuucugccaguggaagaacgucgagcucaacauccaccucaccaugaacgaguucuccguccaccgcaucaucggccgcggcggcuucggcgaggucuacggcugccgcaaggccgacaccggcaagauguacgccaugaagugccucgacaagaagcgcaucaagaugaagcagggcgagacccucgcccucaacgagcgcaucaugcucucccucgucuccaccggcgacugccccuucaucgucugcaugaccuacgccuuccacacccccgacaagcucugcuucauccucgaccucaugaacggcggcgaccuccacuaccaccucucccagcacggcgucuucuccgagaaggagaugcgcuucuacgccaccgagaucauccucggccucgagcacaugcacaaccgcuucgucgucuaccgcgaccucaagcccgccaacauccuccucgacgagcacggccacgcccgcaucuccgaccucggccucgccugcgacuucuccaagaagaagccccacgccuccgucggcacccacggcuacauggcccccgagguccuccagaagggcaccgccuacgacuccuccgccgacugguucucccucggcugcaugcucuucaagcuccuccgcggccacucccccuuccgccagcacaagaccaaggacaagcacgagaucgaccgcaugacccucaccgucaacgucgagcuccccgacaccuucucccccgagcucaagucccuccucgagggccuccuccagcgcgacgucuccaagcgccucggcugccacggcggcggcucccaggaggucaaggagcacuccuucuucaagggcgucgacuggcagcacgucuaccuccagaaguacccccccccccucauccccccccgcggcgaggucaacgccgccgacgccuucgacaucggcuccuucgacgaggaggacaccaagggcaucaagcuccucgacugcgaccaggagcucuacaagaacuucccccucgucaucuccgagcgcuggcagcaggaggucaccgagaccgucuacgaggccgucaacgccgacaccgacaagaucgaggcccgcaagcgcgccaagaacaagcagcucggccacgaggaggacuacgcccucggcaaggacugcaucaugcacggcuacaugcucaagcucggcaaccccuuccucacccaguggcagcgccgcuacuucuaccucuuccccaaccgccucgaguggcgcggcgagggcgagucccgccagaaccuccucaccauggagcagauccucuccgucgaggagacccagaucaaggacaagaagugcauccucuuccgcaucaagggcggcaagcaguucguccuccagugcgaguccgaccccgaguucguccaguggaagaaggagcucaacgagaccuucaaggaggcccagcgccuccuccgccgcgcccccaaguuccucaacaagccccgcuccggcaccgucgagcuccccaagcccucccucugccaccgcaacuccaacggccucuga

SEQ ID NO: 39482 - RNA, 1224 nt, Artificial Sequence
  derived and/or modified sequence opt2 from ADRM1__Homo_sapiens__XP_011526804
augaccaccuccggcgcccucuuccccucccucguccccggcucccgcggcgccuccaacaaguaccucgucgaguuccgcgccggcaagaugucccucaagggcaccaccgucacccccgacaagcgcaagggccucgucuacauccagcagaccgacgacucccucauccacuucugcuggaaggaccgcaccuccggcaacgucgaggacgaccucaucaucuuccccgacgacugcgaguucaagcgcgucccccagugccccuccggccgcgucuacguccucaaguucaaggccggcuccaagcgccucuucuucuggaugcaggagcccaagaccgaccaggacgaggagcacugccgcaaggucaacgaguaccucaacaacccccccaugcccggcgcccucggcgccuccggcuccuccggccacgagcucuccgcccucggcggcgagggcggccuccagucccuccucggcaacaugucccacucccagcucaugcagcucaucggccccgccggccucggcggccucggcggccucggcgcccucaccggccccggccucgccucccuccucggcuccuccggcccccccggcuccuccuccuccuccuccucccgcucccaguccgccgccgucacccccuccuccaccaccuccuccacccgcgccacccccgcccccuccgcccccgccgccgccuccgccaccucccccucccccgcccccuccuccggcaacggcgccuccaccgccgccucccccacccagcccauccagcucuccgaccuccaguccauccucgccaccaugaacguccccgccggccccgccggcggccagcaggucgaccucgccuccguccucacccccgagaucauggcccccauccucgccaacgccgacguccaggagcgccuccuccccuaccuccccuccggcgagucccucccccagaccgccgacgagauccagaacacccucaccuccccccaguuccagcaggcccucggcauguucuccgccgcccucgccuccggccagcucggcccccucaugugccaguucggccuccccgccgaggccgucgaggccgccaacaagggcgacgucgaggccuucgccaaggccaugcagaacaacgccaagcccgagcagaaggagggcgacaccaaggacaagaaggacgaggaggaggacaugucccucgacuga

SEQ ID NO: 39483 - RNA, 1455 nt, Artificial Sequence
  derived and/or modified sequence opt2 from ADSL__Homo_sapiens__NP_000017
auggccgccggcggcgaccacggcucccccgacuccuaccgcuccccccucgccucccgcuacgccucccccgagaugugcuucgucuucuccgaccgcuacaaguuccgcaccuggcgccagcucuggcucuggcucgccgaggccgagcagacccucggccuccccaucaccgacgagcagauccaggagaugaaguccaaccucgagaacaucgacuucaagauggccgccgaggaggagaagcgccuccgccacgacgucauggcccacguccacaccuucggccacugcugccccaaggccgccggcaucauccaccucggcgccaccuccugcuacgucggcgacaacaccgaccucaucauccuccgcaacgcccucgaccuccuccuccccaagcucgcccgcgucaucucccgccucgccgacuucgccaaggagcgcgccucccuccccacccucggcuucacccacuuccagcccgcccagcucaccaccgucggcaagcgcugcugccucuggauccaggaccucugcauggaccuccagaaccucaagcgcguccgcgacgaccuccgcuuccgcggcgucaagggcaccaccggcacccaggccuccuuccuccagcucuucgagggcgacgaccacaaggucgagcagcucgacaagauggucaccgagaaggccggcuucaagcgcgccuucaucaucaccggccagaccuacacccgcaaggucgacaucgagguccucuccguccucgccucccucggcgccuccguccacaagaucugcaccgacauccgccuccucgccaaccucaaggagauggaggagcccuucgagaagcagcagaucggcuccuccgccaugcccuacaagcgcaaccccaugcgcuccgagcgcugcugcucccucgcccgccaccucaugacccucgucauggacccccuccagaccgccuccguccagugguucgagcgcacccucgacgacuccgccaaccgccgcaucugccucgccgaggccuuccucaccgccgacaccauccucaacacccuccagaacaucuccgagggccucgucgucuaccccaaggucaucgagcgccgcauccgccaggagcuccccuucauggccaccgagaacaucaucauggccauggucaaggccggcggcucccgccaggacugccacgagaagauccgcguccucucccagcaggccgccuccgucgucaagcaggagggcggcgacaacgaccucaucgagcgcauccaggucgacgccuacuucucccccauccacucccagcucgaccaccuccucgaccccuccuccuucaccggccgcgccucccagcagguccagcgcuuccucgaggaggaggucuacccccuccucaagcccuacgaguccgucaugaaggucaaggccgagcucugccucuga

SEQ ID NO: 39484 - RNA, 1371 nt, Artificial Sequence
  derived and/or modified sequence opt2 from ADSS__Homo_sapiens__NP_001117
auggccuucgccgagaccuaccccgccgccuccucccuccccaacggcgacugcggccgcccccgcgcccgccccggcggcaaccgcgucaccgucguccucggcgcccaguggggcgacgagggcaagggcaaggucgucgaccuccucgcccaggacgccgacaucgucugccgcugccagggcggcaacaacgccggccacaccgucgucgucgacuccgucgaguacgacuuccaccuccuccccuccggcaucaucaaccccaacgucaccgccuucaucggcaacggcgucgucauccaccuccccggccucuucgaggaggccgagaagaacguccagaagggcaagggccucgagggcugggagaagcgccucaucaucuccgaccgcgcccacaucgucuucgacuuccaccaggccgccgacggcauccaggagcagcagcgccaggagcaggccggcaagaaccucggcaccaccaagaagggcaucggccccgucuacuccuccaaggccgcccgcuccggccuccgcaugugcgaccucgucuccgacuucgacggcuucuccgagcgcuucaagguccucgccaaccaguacaaguccaucuaccccacccucgagaucgacaucgagggcgagcuccagaagcucaagggcuacauggagaagaucaagcccaugguccgcgacggcgucuacuuccucuacgaggcccuccacggcccccccaagaagauccucgucgagggcgccaacgccgcccuccucgacaucgacuucggcaccuaccccuucgucaccuccuccaacugcaccgucggcggcgucugcaccggccucggcaugcccccccagaacgucggcgaggucuacggcgucgucaaggccuacaccacccgcgucggcaucggcgccuuccccaccgagcaggacaacgagaucggcgagcuccuccagacccgcggccgcgaguucggcgucaccaccggccgcaagcgccgcugcggcuggcucgaccucguccuccucaaguacgcccacaugaucaacggcuucaccgcccucgcccucaccaagcucgacauccucgacauguucaccgagaucaaggucggcgucgccuacaagcucgacggcgagaucaucccccacauccccgccaaccaggagguccucaacaaggucgagguccaguacaagacccuccccggcuggaacaccgacaucuccaacgcccgcgccuucaaggagcuccccgucaacgcccagaacuacguccgcuucaucgaggacgagcuccagauccccgucaaguggaucggcgucggcaagucccgcgaguccaugauccagcucuucuga

SEQ ID NO: 39485 - RNA, 1374 nt, Artificial Sequence
  derived and/or modified sequence opt2 from ADSSL1__Homo_sapiens__NP_689541
auguccggcacccgcgccuccaacgaccgcccccccggcgccggcggcgucaagcgcggccgccuccagcaggaggccgccgccaccggcucccgcgucaccgucguccucggcgcccaguggggcgacgagggcaagggcaaggucgucgaccuccucgccaccgacgccgacaucaucucccgcugccagggcggcaacaacgccggccacaccgucgucgucgacggcaaggaguacgacuuccaccuccuccccuccggcaucaucaacaccaaggccgucuccuucaucggcaacggcgucgucauccaccuccccggccucuucgaggaggccgagaagaacgagaagaagggccucaaggacugggagaagcgccucaucaucuccgaccgcgcccaccucgucuucgacuuccaccaggccgucgacggccuccaggagguccagcgccaggcccaggagggcaagaacaucggcaccaccaagaagggcaucggccccaccuacuccuccaaggccgcccgcaccggccuccgcaucugcgaccuccucuccgacuucgacgaguucuccucccgcuucaagaaccucgcccaccagcaccaguccauguuccccacccucgagaucgacaucgagggccagcucaagcgccucaagggcuucgccgagcgcauccgccccaugguccgcgacggcgucuacuucauguacgaggcccuccacggcccccccaagaagauccucgucgagggcgccaacgccgcccuccucgacaucgacuucggcaccuaccccuucgucaccuccuccaacugcaccgucggcggcgucugcaccggccucggcauccccccccagaacaucggcgacgucuacggcgucgucaaggccuacaccacccgcgucggcaucggcgccuuccccaccgagcagaucaacgagaucggcggccuccuccagacccgcggccacgaguggggcgucaccaccggccgcaagcgccgcugcggcuggcucgaccucaugauccuccgcuacgcccacauggucaacggcuucaccgcccucgcccucaccaagcucgacauccucgacguccucggcgaggucaaggucggcgucuccuacaagcucaacggcaagcgcauccccuacuuccccgccaaccaggagaugcuccagaaggucgaggucgaguacgagacccuccccggcuggaaggccgacaccaccggcgcccgccgcugggaggaccuccccccccaggcccagaacuacauccgcuucgucgagaaccacgucggcgucgccgucaagugggucggcgucggcaagucccgcgaguccaugauccagcucuucuga

SEQ ID NO: 39486 - RNA, 747 nt, Artificial Sequence
  derived and/or modified sequence opt2 from ADTRP__Homo_sapiens__NP_001137420
augaccaagaccuccaccugcaucuaccacuuccucguccucuccugguacaccuuccucaacuacuacaucucccaggagggcaaggacgaggucaagcccaagauccucgccaacggcgcccgcuggaaguacaugacccuccucaaccuccucaagaaccgcaccgccggcuucgacaucuaccagcccggcuccuuccgccagcuccuccagaccaucuucuacggcgucaccugccucgacgacguccucaagcgcaccaagggcggcaaggacaucaaguuccucaccgccuuccgcgaccuccucuucaccacccucgccuuccccgucuccaccuucgucuuccucgccuucuggauccucuuccucuacaaccgcgaccucaucuaccccaagguccucgacaccgucauccccgucuggcucaaccacgccaugcacaccuucaucuuccccaucacccucgccgaggucguccuccgcccccacuccuaccccuccaagaagaccggccucacccuccucgccgccgccuccaucgccuacaucucccgcauccucuggcucuacuucgagaccggcaccugggucuaccccgucuucgccaagcucucccuccucggccucgccgccuucuucucccucuccuacgucuucaucgccuccaucuaccuccucggcgagaagcucaaccacuggaaguggggcgacaugcgccagccccgcaagaagcgcaaguga

SEQ ID NO: 39487 - RNA, 1554 nt, Artificial Sequence
  derived and/or modified sequence opt2 from AEBP2__Homo_sapiens__NP_001107648
auggccgccgccaucaccgacauggccgaccucgaggagcucucccgccucuccccccucccccccggcucccccggcuccgccgcccgcggccgcgccgagccccccgaggaggaggaggaggaggaggaggaggaggaggaggccgaggccgaggccgucgccgcccuccuccucaacggcggcuccggcggcggcggcggcggcggcggcggcggcgucggcggcggcgaggccgagaccauguccgagcccucccccgaguccgccucccaggccggcgaggacgaggacgaggaggaggacgacgaggaggaggaggacgaguccuccuccuccggcggcggcgaggaggaguccuccgccgagucccucgucggcuccuccggcggcuccuccuccgacgagacccgcucccucucccccggcgccgccuccuccuccuccggcgacggcgacggcaaggagggccucgaggagcccaagggcccccgcggcucccagggcggcggcggcggcggcuccuccuccuccuccgucgucuccuccggcggcgacgagggcuacggcaccggcggcggcggcuccuccgccaccuccggcggccgccgcggcucccucgagauguccuccgacggcgagccccucucccgcauggacuccgaggacuccaucuccuccaccaucauggacgucgacuccaccaucuccuccggccgcuccacccccgccaugaugaacggccagggcuccaccaccuccuccuccaagaacaucgccuacaacugcugcugggaccagugccaggccugcuucaacuccucccccgaccucgccgaccacauccgcuccauccacgucgacggccagcgcggcggcgucuucgucugccucuggaagggcugcaaggucuacaacacccccuccaccucccaguccuggcuccagcgccacaugcucacccacuccggcgacaagcccuucaagugcgucgucggcggcugcaacgccuccuucgccucccagggcggccucgcccgccacguccccacccacuucucccagcagaacuccuccaaggucuccucccagcccaaggccaaggaggagucccccuccaaggccggcaugaacaagcgccgcaagcucaagaacaagcgccgccgcucccucccccgcccccacgacuucuucgacgcccagacccucgacgccauccgccaccgcgccaucugcuucaaccucuccgcccacaucgagucccucggcaagggccacuccgucgucuuccacuccaccgucaucgccaagcgcaaggaggacuccggcaagaucaagcuccuccuccacuggaugcccgaggacauccuccccgacgucugggucaacgaguccgagcgccaccagcucaagaccaaggucguccaccucuccaagcuccccaaggacaccgcccuccuccucgaccccaacaucuaccgcaccaugccccagaagcgccucaagcgcacccucauccgcaaggucuucaaccucuaccucuccaagcaguga

SEQ ID NO: 39488 - RNA, 978 nt, Artificial Sequence
  derived and/or modified sequence opt2 from AEN__Homo_sapiens__NP_073604
auggucccccgcgaggcccccgaguccgcccagugccucugccccucccucaccauccccaacgccaaggacguccuccgcaagcgccacaagcgccgcucccgccagcaccagcgcuucauggcccgcaaggcccuccuccaggagcagggccuccucuccaugccccccgagcccggcuccuccccccuccccacccccuucggcgccgccaccgccaccgaggccgccuccuccggcaagcagugccuccgcgccggcuccggcuccgcccccugcucccgccgccccgcccccggcaaggccuccggcccccuccccuccaagugcgucgccaucgacugcgagauggucggcaccggcccccgcggccgcgucuccgagcucgcccgcugcuccaucgucuccuaccacggcaacguccucuacgacaaguacauccgccccgagaugcccaucgccgacuaccgcacccgcugguccggcaucacccgccagcacaugcgcaaggccguccccuuccaggucgcccagaaggagauccucaagcuccucaagggcaaggucgucgucggccacgcccuccacaacgacuuccaggcccucaaguacguccacccccgcucccagacccgcgacaccaccuacguccccaacuuccucuccgagcccggccuccacacccgcgcccgcgucucccucaaggaccucgcccuccagcuccuccacaagaagauccaggucggccagcacggccacuccuccgucgaggacgccaccaccgccauggagcucuaccgccucgucgagguccagugggagcagcaggaggcccgcucccucuggaccugccccgaggaccgcgagcccgacuccuccaccgacauggagcaguacauggaggaccaguacuggcccgacgaccucgcccacggcucccgcggcggcgcccgcgaggcccaggaccgccgcaacuga

SEQ ID NO: 39489 - RNA, 795 nt, Artificial Sequence
  derived and/or modified sequence opt2 from AES__Homo_sapiens__NP_945320
augugccacaagaacggcuucccccaggagggcggcaucaccgccgccuuccuccagaagcgcaagcuccgccucuccaagaaccaccgccccgcccgcgccaaggucaccgagcacguccgcggcacccgccccggccgcgccaccgccggccccgccgccuccacccgcgccgccggcucccucuucuucgaccgcuggggcaaccgcggccccgccggcugccgcggcuccucccaccucccccagcagcucaaguucaccaccuccgacuccugcgaccgcaucaaggacgaguuccagcuccuccaggcccaguaccacucccucaagcucgagugcgacaagcucgccuccgagaaguccgagaugcagcgccacuacgucauguacuacgagauguccuacggccucaacaucgagaugcacaagcaggccgagaucgucaagcgccucaacggcaucugcgcccagguccuccccuaccucucccaggagcaccagcagcagguccucggcgccaucgagcgcgccaagcaggucaccgcccccgagcucaacuccaucauccgccagcagcuccaggcccaccagcucucccagcuccaggcccucgcccucccccucaccccccuccccgucggccuccagccccccucccuccccgccgucuccgccggcaccggccuccucucccucuccgcccucggcucccaggcccaccucuccaaggaggacaagaacggccacgacggcgacacccaccaggaggacgacggcgagaaguccgacuga

SEQ ID NO: 39490 - RNA, 2445 nt, Artificial Sequence
  derived and/or modified sequence opt2 from AFAP1__Homo_sapiens__NP_001128119
auggaggagcucaucgucgagcuccgccucuuccucgagcuccucgaccacgaguaccucaccuccaccguccgcgagaagaaggccgucaucaccaacauccuccuccgcauccaguccuccaagggcuucgacgucaaggaccacgcccagaagcaggagaccgccaacucccuccccgcccccccccagaugccccuccccgagaucccccagcccuggcucccccccgacuccggcccccccccccuccccaccuccucccuccccgagggcuacuacgaggaggccgucccccucucccccggcaaggcccccgaguacaucaccuccaacuacgacuccgacgccauguccuccuccuacgaguccuacgacgaggaggaggaggacggcaagggcaagaagacccgccaccaguggcccuccgaggaggccuccauggaccucgucaaggacgccaagaucugcgccuuccuccuccgcaagaagcgcuucggccaguggaccaagcuccucugcgucaucaaggacaccaagcuccucugcuacaaguccuccaaggaccagcagccccagauggagcucccccuccagggcugcaacaucaccuacauccccaaggacuccaagaagaagaagcacgagcucaagaucacccagcagggcaccgacccccucguccucgccguccaguccaaggagcaggccgagcaguggcucaaggucaucaaggaggccuacuccggcugcuccggccccgucgacuccgagugcccccccccccccuccucccccguccacaaggccgagcucgagaagaagcucuccuccgagcgccccuccuccgacggcgagggcgucgucgagaacggcaucaccaccugcaacggcaaggagcaggucaagcgcaagaaguccuccaaguccgaggccaagggcaccgucuccaaggucaccggcaagaagaucaccaagaucaucucccucggcaagaagaagcccuccaccgacgagcagaccuccuccgccgaggaggacguccccaccugcggcuaccucaacguccucuccaacucccgcuggcgcgagcgcuggugccgcgucaaggacaacaagcucaucuuccacaaggaccgcaccgaccucaagacccacaucgucuccaucccccuccgcggcugcgaggucauccccggccucgacuccaagcacccccucaccuuccgccuccuccgcaacggccaggaggucgccguccucgaggccuccuccuccgaggacaugggccgcuggaucggcauccuccucgccgagaccggcuccuccaccgaccccgaggcccuccacuacgacuacaucgacgucgagauguccgccuccgucauccagaccgccaagcagaccuucugcuucaugaaccgccgcgucaucuccgccaaccccuaccucggcggcaccuccaacggcuacgcccaccccuccggcaccgcccuccacuacgacgacguccccugcaucaacggcuccugggagcccgaggacggcuuccccgccuccugcucccgcggccucggcgaggagguccucuacgacaacgccggccucuacgacaaccucccccccccccacaucuucgcccgcuacucccccgccgaccgcaaggccucccgccucuccgccgacaagcucuccuccaaccacuacaaguaccccgccuccgcccaguccgucaccaacaccuccuccgucggccgcgccucccucggccucaacucccagcucaagggcaagaagccccccgucgccuccaacggcgucaccggcaagggcaagacccucuccucccagcccaagaaggccgaccccgccgccgucgucaagcgcaccggcuccaacgccgcccaguacaaguacggcaagaaccgcgucgaggccgacgccaagcgccuccagaccaaggaggaggagcuccucaagcgcaaggaggcccuccgcaaccgccucgcccagcuccgcaaggagcgcaaggaccuccgcgccgccaucgaggucaacgccggccgcaagccccaggccauccucgaggagaagcucaagcagcucgaggaggagugccgccagaaggaggccgagcgcgucucccucgagcucgagcucaccgaggucaaggagucccucaagaaggcccucgccggcggcgucacccucggccucgccaucgagcccaaguccggcaccuccuccccccagucccccgucuuccgccaccgcacccucgagaacucccccaucuccuccugcgacaccuccgacaccgagggccccguccccgucaacuccgccgccguccucaagaagucccaggccgcccccggcuccucccccugccgcggccacguccuccgcaaggccaaggagugggagcucaagaacggcaccuga

SEQ ID NO: 39491 - RNA, 2178 nt, Artificial Sequence
  derived and/or modified sequence opt2 from AFAP1L1__Homo_sapiens__NP_001139809
auggaccgcggccagguccucgagcagcuccuccccgagcucaccggccuccucucccuccucgaccacgaguaccucuccgacaccacccucgagaagaagauggccgucgccuccauccuccagucccuccagccccuccccgccaaggaggucuccuaccucuacgucaacaccgccgaccuccacuccggccccuccuucgucgagucccucuucgaggaguucgacugcgaccucuccgaccuccgcgacaugcccgaggacgacggcgagcccuccaagggcgccucccccgagcucgccaaguccccccgccuccgcaacgccgccgaccucccccccccccuccccaacaagcccccccccgaggacuacuacgaggaggcccucccccucggccccggcaagucccccgaguacaucuccucccacaacggcugcucccccucccacuccaucgucgacggcuacuacgaggacgccgacuccuccuaccccgccacccgcgucaacggcgagcucaaguccuccuacaacgacuccgacgccauguccuccuccuacgaguccuacgacgaggaggaggaggagggcaaguccccccagccccgccaccaguggcccuccgaggaggccuccaugcaccucguccgcgagugccgcaucugcgccuuccuccuccgcaagaagcgcuucggccagugggccaagcagcucaccgucauccgcgaggaccagcuccucugcuacaaguccuccaaggaccgccagccccaccuccgccucgcccucgacaccugcuccaucaucuacguccccaaggacucccgccacaagcgccacgagcuccgcuucacccagggcgccaccgagguccucguccucgcccuccagucccgcgagcaggccgaggaguggcucaaggucauccgcgaggucuccaagcccgucggcggcgccgagggcgucgaggucccccgcucccccguccuccucugcaagcucgaccucgacaagcgccucucccaggagaagcagaccuccgacuccgacuccgucggcgucggcgacaacugcuccacccucggccgccgcgagaccugcgaccacggcaagggcaagaaguccucccucgccgagcucaagggcuccaugucccgcgccgccggccgcaagaucacccgcaucaucggcuucuccaagaagaagacccucgccgacgaccuccagaccuccuccaccgaggaggagguccccugcugcggcuaccucaacguccucgucaaccagggcuggaaggagcgcuggugccgccucaagugcaacacccucuacuuccacaaggaccacauggaccuccgcacccacgucaacgccaucgcccuccagggcugcgaggucgcccccggcuucggcccccgccaccccuucgccuuccgcauccuccgcaaccgccaggaggucgccauccucgaggccuccugcuccgaggacaugggccgcuggcucggccuccuccucgucgagaugggcucccgcgucacccccgaggcccuccacuacgacuacgucgacgucgagacccucaccuccaucgucuccgccggccgcaacuccuuccucuacgcccgcuccugccagaaccaguggcccgagccccgcgucuacgacgacguccccuacgagaagaugcaggacgaggagcccgagcgccccaccggcgcccaggucaagcgccacgccuccuccugcuccgagaagucccaccgcgucgacccccaggucaaggucaagcgccacgccuccuccgccaaccaguacaaguacggcaagaaccgcgccgaggaggacgcccgccgcuaccucgucgagaaggagaagcucgagaaggagaaggagaccauccgcaccgagcucaucgcccuccgccaggagaagcgcgagcucaaggaggccauccgcuccucccccggcgccaagcucaaggcccucgaggaggccgucgccacccucgaggcccagugccgcgccaaggaggagcgccgcaucgaccucgagcucaagcucgucgccgucaaggagcgccuccagcagucccucgccggcggccccgcccucggccucuccgucuccuccaagcccaaguccggcgagugggagaugaagaagaccuga

SEQ ID NO: 39492 - RNA, 2457 nt, Artificial Sequence
  derived and/or modified sequence opt2 from AFAP1L2__Homo_sapiens__NP_001001936
auggagcgcuacaaggcccucgagcagcuccucaccgagcucgacgacuuccucaagauccucgaccaggagaaccucuccuccaccgcccucgucaagaaguccugccucgccgagcuccuccgccucuacaccaaguccuccuccuccgacgaggaguacaucuacaugaacaaggucaccaucaacaagcagcagaacgccgagucccagggcaaggcccccgaggagcagggccuccuccccaacggcgagcccucccagcacuccuccgccccccagaagucccuccccgaccuccccccccccaagaugauccccgagcgcaagcagcucgccauccccaagaccgagucccccgagggcuacuacgaggaggccgagcccuacgacaccucccucaacgaggacggcgaggccgucuccuccuccuacgaguccuacgacgaggaggacggcuccaagggcaaguccgcccccuaccaguggcccucccccgaggccggcaucgagcucaugcgcgacgcccgcaucugcgccuuccucuggcgcaagaaguggcucggccagugggccaagcagcucugcgucaucaaggacaaccgccuccucugcuacaaguccuccaaggaccacuccccccagcucgacgucaaccuccucggcuccuccgucauccacaaggagaagcagguccgcaagaaggagcacaagcucaagaucacccccaugaacgccgacgucaucguccucggccuccaguccaaggaccaggccgagcaguggcuccgcgucauccaggaggucuccggccuccccuccgagggcgccuccgagggcaaccaguacacccccgacgcccagcgcuucaacugccagaagcccgacaucgccgagaaguaccucuccgccuccgaguacggcuccuccgucgacggccaccccgagguccccgagaccaaggacgucaagaagaagugcuccgccggccucaagcucuccaaccucaugaaccucggccgcaagaaguccaccucccucgagcccgucgagcgcucccucgagaccuccuccuaccucaacguccucgucaacucccaguggaagucccgcuggugcuccguccgcgacaaccaccuccacuucuaccaggaccgcaaccgcuccaaggucgcccagcagccccucucccucgucggcugcgaggucguccccgaccccucccccgaccaccucuacuccuuccgcauccuccacaagggcgaggagcucgccaagcucgaggccaaguccuccgaggagaugggccacuggcucggccuccuccucuccgaguccggcuccaagaccgaccccgaggaguucaccuacgacuacgucgacgccgaccgcgucuccugcaucgucuccgccgccaagaacucccuccuccucaugcagcgcaaguucuccgagcccaacaccuacaucgacggccuccccucccaggaccgccaggaggagcucuacgacgacgucgaccucuccgagcucaccgccgccgucgagcccaccgaggaggccacccccgucgccgacgaccccaacgagcgcgaguccgaccgcgucuaccucgaccucacccccgucaaguccuuccuccacggccccuccuccgcccaggcccaggccuccucccccacccucuccugccucgacaacgccaccgaggcccuccccgccgacuccggccccggccccacccccgacgagcccugcaucaagugccccgagaaccucggcgagcagcagcucgagucccucgagcccgaggaccccucccuccgcaucaccaccgucaagauccagaccgagcagcagcgcaucuccuucccccccuccugccccgacgccgucgucgccaccccccccggcgccuccccccccgucaaggaccgccuccgcgucaccuccgccgagaucaagcucggcaagaaccgcaccgaggccgaggucaagcgcuacaccgaggagaaggagcgccucgagaagaagaaggaggagauccgcggccaccucgcccagcuccgcaaggagaagcgcgagcucaaggagacccuccucaagugcaccgacaaggagguccucgccucccucgagcagaagcucaaggagaucgacgaggagugccgcggcgaggagucccgccgcgucgaccucgagcucuccaucauggaggucaaggacaaccucaagaaggccgaggccggccccgucacccucggcaccaccgucgacaccacccaccucgagaacgucuccccccgccccaaggccgucacccccgccuccgcccccgacugcacccccgucaacuccgccaccacccucaagaaccgcccccucuccgucgucgucaccggcaagggcaccguccuccagaaggccaaggagugggagaagaagggcgccuccuga

SEQ ID NO: 39493 - RNA, 3657 nt, Artificial Sequence
  derived and/or modified sequence opt2 from AFF1__Homo_sapiens__NP_001160165
auggccuucaccgagcgcgucaacuccuccggcaacucccucuacaacgacgaccgcaaccuccuccgcauccgcgagaaggagcgccgcaaccaggaggcccaccaggagaaggaggccuuccccgagaagaucccccucuucggcgagcccuacaagaccgccaagggcgacgagcucuccucccgcauccagaacaugcucggcaacuacgaggaggucaaggaguuccucuccaccaagucccacacccaccgccucgacgccuccgagaaccgccucggcaagcccaaguacccccucauccccgacaagggcuccuccauccccuccuccuccuuccacaccuccguccaccaccaguccauccacacccccgccuccggcccccucuccgucggcaacaucucccacaaccccaagauggcccagccccgcaccgagcccaugcccucccuccacgccaaguccugcggcccccccgacucccagcaccucacccaggaccgccucggccaggagggcuucggcuccucccaccacaagaagggcgaccgccgcgccgacggcgaccacugcgccuccgucaccgacuccgcccccgagcgcgagcucuccccccucaucucccuccccucccccguccccccccucucccccauccacuccaaccagcagacccucccccgcacccagggcuccuccaagguccacggcuccuccaacaacuccaagggcuacugccccgccaagucccccaaggaccucgccgucaagguccacgacaaggagaccccccaggacucccucgucgcccccgcccagccccccucccagaccuuccccccccccucccuccccuccaaguccgucgccaugcagcagaagcccaccgccuacguccgccccauggacggccaggaccaggcccccuccgagucccccgagcucaagccccuccccgaggacuaccgccagcagaccuucgagaagaccgaccucaagguccccgccaaggccaagcucaccaagcucaagaugcccucccaguccgucgagcagaccuacuccaacgagguccacugcgucgaggagauccucaaggagaugacccacuccuggccccccccccucaccgccauccacacccccuccaccgccgagcccuccaaguuccccuuccccaccaaggacucccagcacgucuccuccgucacccagaaccagaagcaguacgacaccuccuccaagacccacuccaacucccagcagggcaccuccuccaugcucgaggacgaccuccagcucuccgacuccgaggacuccgacuccgagcagacccccgagaagccccccuccuccuccgccccccccuccgccccccagucccuccccgagcccgucgccuccgcccacuccuccuccgccgaguccgaguccaccuccgacuccgacuccuccuccgacuccgaguccgaguccuccuccuccgacuccgaggagaacgagccccucgagacccccgcccccgagcccgagccccccaccaccaacaaguggcagcucgacaacuggcucaccaaggucucccagcccgccgccccccccgagggcccccgcuccaccgagcccccccgccgccaccccgaguccaagggcuccuccgacuccgccaccucccaggagcacuccgaguccaaggaccccccccccaaguccuccuccaaggccccccgcgccccccccgaggccccccaccccggcaagcgcuccugccagaagucccccgcccagcaggagcccccccagcgccagaccgucggcaccaagcagcccaagaagcccgucaaggccuccgcccgcgccggcucccgcaccucccuccagggcgagcgcgagcccggccuccuccccuacggcucccgcgaccagaccuccaaggacaagcccaaggucaagaccaagggccgcccccgcgccgccgccuccaacgagcccaagcccgccgucccccccuccuccgagaagaagaagcacaaguccucccuccccgcccccuccaaggcccucuccggccccgagcccgccaaggacaacgucgaggaccgcacccccgagcacuucgcccucgucccccucaccgagucccagggccccccccacuccggcuccggcucccgcaccuccggcugccgccaggccgucgucguccaggaggacucccgcaaggaccgccucccccucccccuccgcgacaccaagcuccucuccccccuccgcgacaccccccccccccagucccucauggucaagaucacccucgaccuccucucccgcaucccccagccccccggcaagggcucccgccagcgcaaggccgaggacaagcagccccccgccggcaagaagcacuccuccgagaagcgcuccuccgacuccuccuccaagcucgccaagaagcgcaagggcgaggccgagcgcgacugcgacaacaagaagauccgccucgagaaggagaucaagucccaguccuccuccuccuccuccucccacaaggaguccuccaagaccaagcccucccgccccuccucccaguccuccaagaaggagaugcucccccccccccccgucuccuccuccucccagaagcccgccaagcccgcccucaagcgcucccgccgcgaggccgacaccugcggccaggacccccccaaguccgccuccuccaccaaguccaaccacaaggacuccuccauccccaagcagcgccgcgucgagggcaagggcucccgcuccuccuccgagcacaagggcuccuccggcgacaccgccaaccccuuccccguccccucccuccccaacggcaacuccaagcccggcaagccccaggucaaguucgacaagcagcaggccgaccuccacaugcgcgaggccaagaagaugaagcagaaggccgagcucaugaccgaccgcgucggcaaggccuucaaguaccucgaggccguccucuccuucaucgagugcggcaucgccaccgaguccgagucccaguccuccaaguccgccuacuccgucuacuccgagaccgucgaccucaucaaguucaucaugucccucaaguccuucuccgacgccaccgcccccacccaggagaagaucuucgccguccucugcaugcgcugccaguccauccucaacauggccauguuccgcugcaagaaggacaucgccaucaaguacucccgcacccucaacaagcacuucgaguccuccuccaaggucgcccaggcccccucccccugcaucgcccgcuccaccggcacccccuccccccucucccccaugcccucccccgccuccuccgucggcucccaguccuccgccggcuccgucggcuccuccggcgucgccgccaccaucuccacccccgucaccauccagaacaugaccuccuccuacgucaccaucaccucccacguccucaccgccuucgaccucugggagcaggccgaggcccucacccgcaagaacaaggaguucuucgcccgccucuccaccaacgucugcacccucgcccucaacuccucccucgucgaccucguccacuacacccgccagggcuuccagcagcuccaggagcucaccaagacccccuga

SEQ ID NO: 39494 - RNA, 3831 nt, Artificial Sequence
  derived and/or modified sequence opt2 from AFF2__Homo_sapiens__NP_001162593
auggaccucuucgacuucuuccgcgacugggaccucgagcagcagugccacuacgagcaggaccgcuccgcccucaagaagcgcgagugggagcgccgcaaccaggagguccagcaggaggacgaccucuucuccuccggcuucgaccucuucggcgagcccuacaagaccaacaagggcgacgcccucgccaaccgcguccagaacacccucggcaacuacgacgagaugaagaaccuccucaccaaccacuccaaccagaaccaccucgucggcauccccaagaacuccgucccccagaaccccaacaacaagaacgagcccuccuucuuccccgagcagaagaaccgcaucauccccccccaccaggacaacacccaccccuccgcccccaugcccccccccuccgucgucauccucaacuccacccucauccacuccaaccgcaaguccaagcccgaguggucccgcgacucccacaaccccuccaccguccucgccucccaggccuccggccagcccaacaagaugcagacccucacccaggaccagucccaggccaagcucgaggacuucuucgucuaccccgccgagcagccccagaucggcgaggucgaggaguccaaccccuccgccaaggaggacuccaaccccaacuccuccggcgaggacgccuucaaggagaucuuccaguccaacucccccgaggaguccgaguucgccguccaggcccccggcuccccccucgucgccuccucccuccucgcccccuccuccggccucuccguccagaacuucccccccggccucuacugcaagaccuccaugggccagcagaagcccaccgccuacguccgccccauggacggccaggaccaggcccccgacaucucccccacccucaagcccuccaucgaguucgagaacuccuucggcaaccucuccuucggcacccuccucgacggcaagcccuccgccgccuccuccaagaccaagcuccccaaguucaccauccuccagaccuccgaggucucccuccccuccgaccccuccugcgucgaggagauccuccgcgagucccagcaccucacccccggcuucacccuccagaaguggaacgaccccaccacccgcgccuccaccaaguccgucuccuucaaguccaugcucgaggacgaccucaagcucuccuccgacgaggacgaccucgagcccgucaagacccucaccacccagugcaccgccaccgagcucuaccaggccgucgagaaggccaagccccgcaacaaccccgucaaccccccccucgccaccccccagcccccccccgccguccaggccuccggcggcuccggcuccuccuccgaguccgaguccuccuccgaguccgacuccgacaccgaguccuccaccaccgacuccgaguccaacgaggccccccgcgucgccacccccgagcccgagccccccuccaccaacaaguggcagcucgacaaguggcucaacaaggucaccucccagaacaaguccuucaucugcggccagaacgagacccccauggagaccaucucccuccccccccccaucauccagcccauggagguccagaugaaggucaagaccaacgccucccagguccccgccgagcccaaggagcgcccccuccucucccucauccgcgagaaggcccgcccccgccccacccagaagauccccgagaccaaggcccucaagcacaagcucuccaccaccuccgagaccgucucccagcgcaccaucggcaagaagcagcccaagaaggucgagaagaacaccuccaccgacgaguucaccuggcccaagcccaacaucaccuccuccacccccaaggagaaggaguccgucgagcuccacgaccccccccgcggccgcaacaaggccaccgcccacaagcccgccccccgcaaggagccccgccccaacaucccccucgcccccgagaagaagaaguaccgcggccccggcaagaucguccccaagucccgcgaguucaucgagaccgacuccuccaccuccgacuccaacaccgaccaggaggagacccuccagaucaagguccucccccccugcaucaucuccggcggcaacaccgccaaguccaaggagaucugcggcgccucccucacccucuccacccucauguccuccuccggcuccaacaacaaccucuccaucuccaacgaggagcccaccuucucccccauccccgucaugcagaccgagauccucuccccccuccgcgaccacgagaaccucaagaaccucugggucaagaucgaccucgaccuccucucccgcguccccggccacuccucccuccacgccgcccccgccaagcccgaccacaaggagaccgccaccaagcccaagcgccagaccgccgucaccgccgucgagaagcccgcccccaagggcaagcgcaagcacaagcccaucgaggucgccgagaagauccccgagaagaagcagcgccucgaggaggccaccaccaucugccuccucccccccugcaucucccccgcccccccccacaagccccccaacacccgcgagaacaacuccucccgccgcgccaaccgccgcaaggaggagaagcucuucccccccccccucuccccccuccccgaggaccccccccgccgccgcaacgucuccggcaacaacggccccuucggccaggacaagaacaucgccaugaccggccagaucaccuccaccaagcccaagcgcaccgagggcaaguucugcgccaccuucaagggcaucuccgagggcgacacccccaagaaggccuccuccgccaccaucaccgucaccaacaccgccaucgccaccgccaccgucaccgccaccgccaucgucaccaccaccgucaccgccaccgccaccgccaccgccaccaccaccaccaccaccaccaccaucuccaccaucaccuccaccaucaccaccggccucauggacuccucccaccucgagaugaccuccugggccgcccucccccuccucuccuccuccuccaccaacguccgccgccccaagcucaccuucgacgacuccguccacaacgccgacuacuacaugcaggaggccaagaagcucaagcacaaggccgacgcccucuucgagaaguucggcaaggccgucaacuacgccgacgccgcccucuccuucaccgagugcggcaacgccauggagcgcgacccccucgaggccaagucccccuacaccauguacuccgagaccgucgagcuccuccgcuacgccaugcgccucaagaacuucgccuccccccucgccuccgacggcgacaagaagcucgccguccucugcuaccgcugccucucccuccucuaccuccgcauguucaagcucaagaaggaccacgccaugaaguacucccgcucccucauggaguacuucaagcagaacgccuccaaggucgcccagauccccucccccugggucuccaacggcaagaacacccccucccccgucucccucaacaacgucucccccaucaacgccaugggcaacugcaacaacggccccgucaccaucccccagcgcauccaccacauggccgccucccacgucaacaucaccuccaacguccuccgcggcuacgagcacugggacauggccgacaagcucacccgcgagaacaaggaguucuucggcgaccucgacacccucaugggcccccucacccagcacuccuccaugaccaaccucguccgcuacguccgccagggccucugcuggcuccgcaucgacgcccaccuccucuga

SEQ ID NO: 39495 - RNA, 3756 nt, Artificial Sequence
  derived and/or modified sequence opt2 from AFF3__Homo_sapiens__NP_001020279
auggacuccuucgaccucgcccuccuccaggagugggaccucgagucccucuggggcgaggacauccucaaccagcgcaacgacucccucgucgucgaguuccaguccuccgccucccgcugccgcuccgucuacgagcccgaccgcaacgcccuccgccgcaaggagcgcgagcgccgcaaccaggagacccagcaggacgacggcaccuucaacuccuccuacucccucuucuccgagcccuacaagaccaacaagggcgacgagcucuccaaccgcauccagaacacccucggcaacuacgacgagaugaaggacuuccucaccgaccgcuccaaccagucccaccucgucggcguccccaagcccggcgucccccagacccccgucaacaagaucgacgagcacuucgucgccgacucccgcgcccagaaccagcccuccuccaucugcuccaccaccaccuccacccccgccgccguccccguccagcaguccaagcgcggcaccaugggcuggcagaaggccggccacccccccuccgacggccagcagcgcgccacccagcagggcucccuccgcacccuccucggcgacggcgucggccgccagcagccccgcgccaagcaggucugcaacgucgaggucggccuccagacccaggagcgcccccccgccauggccgccaagcacuccuccuccggccacugcguccagaacuucccccccucccucgccuccaagcccucccucguccagcagaagcccaccgccuacguccgccccauggacggccaggaccaggcccccgacgagucccccaagcucaaguccuccuccgagaccuccguccacugcaccuccuaccgcggcguccccgccuccaagcccgagcccgcccgcgccaaggccaagcucuccaaguucuccauccccaagcagggcgaggagucccgcuccggcgagaccaacuccugcgucgaggagaucauccgcgagaugaccuggcuccccccccucuccgccauccaggcccccggcaaggucgagcccaccaaguuccccuuccccaacaaggacucccagcucgucuccuccggccacaacaaccccaagaagggcgacgccgagcccgagucccccgacaacggcaccuccaacaccuccaugcucgaggacgaccucaagcucuccuccgacgaggaggagaacgagcagcaggccgcccagcgcaccgcccuccgcgcccucuccgacuccgccgucguccagcagcccaacugccgcaccuccguccccuccuccaagggcuccuccuccuccuccuccuccggcuccuccuccuccuccuccgacuccgaguccuccuccggcuccgacuccgagaccgaguccuccuccuccgaguccgagggcuccaagcccccccacuucuccucccccgaggccgagcccgccuccuccaacaaguggcagcucgacaaguggcucaacaaggucaacccccacaagccccccauccucauccagaacgagucccacggcuccgaguccaaccaguacuacaaccccgucaaggaggacguccaggacugcggcaagguccccgacgucugccagcccucccuccgcgagaaggagaucaaguccaccugcaaggaggagcagcgcccccgcaccgccaacaaggcccccggcuccaagggcgucaagcagaaguccccccccgccgccgucgccgucgccgucuccgccgccgcccccccccccgccguccccugcgcccccgccgagaacgcccccgcccccgcccgccgcuccgccggcaagaagcccacccgccgcaccgagcgcaccuccgccggcgacggcgccaacugccaccgccccgaggagcccgccgccgccgacgcccucggcaccuccgucgucgucccccccgagcccaccaagacccgccccugcggcaacaaccgcgccucccaccgcaaggagcuccgcuccuccgucaccugcgagaagcgccgcacccgcggccucucccgcaucguccccaaguccaaggaguucaucgagaccgaguccuccuccuccuccuccuccuccgacuccgaccucgaguccgagcaggaggaguacccccucuccaaggcccagaccgucgccgccuccgccuccuccggcaacgaccagcgccucaaggaggccgccgccaacggcggcuccggcccccgcgcccccgucggcuccaucaacgcccgcaccaccuccgacaucgccaaggagcucgaggagcaguucuacacccucguccccuucggccgcaacgagcuccucuccccccucaaggacuccgacgagauccgcucccucugggucaagaucgaccucacccuccucucccgcauccccgagcaccucccccaggagcccggcguccucuccgcccccgccaccaaggacuccgaguccgccccccccucccacaccuccgacacccccgccgagaaggcccuccccaaguccaagcgcaagcgcaagugcgacaacgaggacgacuaccgcgagaucaagaagucccagggcgagaaggacuccuccucccgccucgccaccuccaccuccaacacccucuccgccaaccacugcaacaugaacaucaacuccgucgccauccccaucaacaagaacgagaagaugcuccgcucccccaucuccccccucuccgacgccuccaagcacaaguacaccuccgaggaccucaccuccuccucccgccccaacggcaacucccucuucaccuccgccuccuccuccaagaagcccaaggccgacucccagcuccagccccacggcggcgaccucaccaaggccgcccacaacaacuccgagaacaucccccuccacaagucccgcccccagaccaagcccuggucccccggcuccaacggccaccgcgacugcaagcgccagaagcucgucuucgacgacaugccccgcuccgccgacuacuucaugcaggaggccaagcgcaugaagcacaaggccgacgccauggucgagaaguucggcaaggcccucaacuacgccgaggccgcccucuccuucaucgagugcggcaacgccauggagcagggccccauggaguccaagucccccuacaccauguacuccgagaccgucgagcucauccgcuacgccaugcgccucaagacccacuccggccccaacgccacccccgaggacaagcagcucgccgcccucugcuaccgcugccucgcccuccucuacuggcgcauguuccgccucaagcgcgaccacgccgucaaguacuccaaggcccucaucgacuacuucaagaacuccuccaaggccgcccaggcccccucccccuggggcgccuccggcaaguccaccggcacccccucccccaugucccccaaccccucccccgccuccuccgucggcucccagggcucccucuccaacgccuccgcccucucccccuccaccaucgucuccaucccccagcgcauccaccagauggccgccaaccacgucuccaucaccaacuccauccuccacuccuacgacuacugggagauggccgacaaccucgccaaggagaaccgcgaguucuucaacgaccucgaccuccucaugggccccgucacccuccacuccuccauggagcaccucguccaguacucccagcagggccuccacuggcuccgcaacuccgcccaccucuccuga

SEQ ID NO: 39496 - RNA, 3492 nt, Artificial Sequence
  derived and/or modified sequence opt2 from AFF4__Homo_sapiens__NP_055238
augaaccgcgaggaccgcaacguccuccgcaugaaggagcgcgagcgccgcaaccaggagauccagcagggcgaggacgccuucccccccuccuccccccucuucgccgagcccuacaaggucaccuccaaggaggacaagcucuccucccgcauccaguccaugcucggcaacuacgacgagaugaaggacuucaucggcgaccgcuccauccccaagcucgucgccauccccaagcccaccgucccccccuccgccgacgagaaguccaaccccaacuucuucgagcagcgccacggcggcucccaccaguccuccaaguggacccccgucggccccgcccccuccaccucccagucccagaagcgcuccuccggccuccaguccggccacuccucccagcgcaccuccgccggcuccuccuccggcaccaacuccuccggccagcgccacgaccgcgaguccuacaacaacuccggcuccuccucccgcaagaagggccagcacggcuccgagcacuccaagucccgcuccuccucccccggcaagccccaggccgucuccucccucaacuccucccacucccgcucccacggcaacgaccaccacuccaaggagcaccagcgcuccaaguccccccgcgaccccgacgccaacugggacucccccucccgcguccccuucuccuccggccagcacuccacccaguccuucccccccucccucauguccaaguccaacuccaugcuccagaagcccaccgccuacguccgccccauggacggccaggaguccauggagcccaagcucuccuccgagcacuacuccucccagucccacggcaacuccaugaccgagcucaagcccuccuccaaggcccaccucaccaagcucaagauccccucccagccccucgacgccuccgccuccggcgacgucuccugcgucgacgagauccucaaggagaugacccacuccuggccccccccccucaccgccauccacacccccugcaagaccgagcccuccaaguuccccuuccccaccaaggagucccagcaguccaacuucggcaccggcgagcagaagcgcuacaaccccuccaagaccuccaacggccaccaguccaaguccaugcucaaggacgaccucaagcucuccuccuccgaggacuccgacggcgagcaggacugcgacaagaccaugccccgcuccacccccggcuccaacuccgagcccucccaccacaacuccgagggcgccgacaacucccgcgacgacuccuccucccacuccggcuccgaguccuccuccggcuccgacuccgaguccgaguccuccuccuccgacuccgaggccaacgagcccucccaguccgccucccccgagcccgagcccccccccaccaacaaguggcagcucgacaacuggcucaacaaggucaacccccacaaggucucccccgccuccuccgucgacuccaacauccccuccucccagggcuacaagaaggagggccgcgagcagggcaccggcaacuccuacaccgacaccuccggccccaaggagaccuccuccgccacccccggccgcgacuccaagaccauccagaagggcuccgaguccggccgcggccgccagaagucccccgcccaguccgacuccaccacccagcgccgcaccgucggcaagaagcagcccaagaaggccgagaaggccgccgccgaggagccccgcggcggccucaagaucgaguccgagacccccgucgaccucgccuccuccaugcccuccucccgccacaaggccgccaccaagggcucccgcaagcccaacaucaagaaggaguccaaguccuccccccgccccaccgccgagaagaagaaguacaaguccaccuccaaguccucccagaagucccgcgagaucaucgagaccgacaccuccuccuccgacuccgacgaguccgagucccucccccccuccucccagacccccaaguaccccgaguccaaccgcacccccgucaagcccuccuccgucgaggaggaggacuccuucuuccgccagcgcauguucucccccauggaggagaaggagcuccucuccccccucuccgagcccgacgaccgcuacccccucaucgucaagaucgaccucaaccuccucacccgcauccccggcaagcccuacaaggagaccgagccccccaagggcgagaagaagaacguccccgagaagcacacccgcgaggcccagaagcaggccuccgagaaggucuccaacaagggcaagcgcaagcacaagaacgaggacgacaaccgcgccuccgaguccaagaagcccaagaccgaggacaagaacuccgccggccacaagcccuccuccaaccgcgaguccuccaagcaguccgccgccaaggagaaggaccuccuccccucccccgccggccccguccccuccaaggaccccaagaccgagcacggcucccgcaagcgcaccaucucccaguccuccucccucaaguccuccuccaacuccaacaaggagaccuccggcuccuccaagaacuccuccuccaccuccaagcagaagaagaccgagggcaagaccuccuccuccuccaaggaggucaaggagaaggcccccuccuccuccuccaacugcccccccuccgcccccacccucgacuccuccaagccccgccgcaccaagcucgucuucgacgaccgcaacuacuccgccgaccacuaccuccaggaggccaagaagcucaagcacaacgccgacgcccucuccgaccgcuucgagaaggccgucuacuaccucgacgccgucgucuccuucaucgagugcggcaacgcccucgagaagaacgcccaggaguccaagucccccuuccccauguacuccgagaccgucgaccucaucaaguacaccaugaagcucaagaacuaccucgcccccgacgccaccgccgccgacaagcgccucaccguccucugccuccgcugcgagucccuccucuaccuccgccucuucaagcucaagaaggagaacgcccucaaguacuccaagacccucaccgagcaccucaagaacuccuacaacaacucccaggcccccucccccggccucggcuccaaggccgucggcaugcccucccccgucucccccaagcucucccccggcaacuccggcaacuacuccuccggcgccuccuccgccuccgccuccggcuccuccgucaccaucccccagaagauccaccagauggccgccuccuacguccaggucaccuccaacuuccucuacgccaccgagaucugggaccaggccgagcagcucuccaaggagcagaaggaguucuucgccgagcucgacaaggucaugggcccccucaucuucaacgccuccaucaugaccgaccucguccgcuacacccgccagggccuccacuggcuccgccaggacgccaagcucaucuccuga

SEQ ID NO: 39497 - RNA, 2394 nt, Artificial Sequence
  derived and/or modified sequence opt2 from AFG3L2__Homo_sapiens__NP_006787
auggcccaccgcugccuccgccucuggggccgcggcggcugcuggccccgcggccuccagcagcuccucguccccggcggcgucggccccggcgagcagcccugccuccgcacccucuaccgcuucgucaccacccaggcccgcgccucccgcaacucccuccucaccgacaucaucgccgccuaccagcgcuucugcucccgcccccccaagggcuucgagaaguacuuccccaacggcaagaacggcaagaaggccuccgagcccaaggaggucaugggcgagaagaaggaguccaagcccgccgccaccacccgcuccuccggcggcggcggcggcggcggcggcaagcgcggcggcaagaaggacgacucccacugguggucccgcuuccagaagggcgacauccccugggacgacaaggacuuccgcauguucuuccucuggaccgcccucuucuggggcggcgucauguucuaccuccuccucaagcgcuccggccgcgagaucaccuggaaggacuucgucaacaacuaccucuccaagggcgucgucgaccgccucgaggucgucaacaagcgcuucguccgcgucaccuucacccccggcaagacccccgucgacggccaguacgucugguucaacaucggcuccgucgacaccuucgagcgcaaccucgagacccuccagcaggagcucggcaucgagggcgagaaccgcguccccgucgucuacaucgccgaguccgacggcuccuuccuccucuccaugcuccccaccguccucaucaucgccuuccuccucuacaccauccgccgcggccccgccggcaucggccgcaccggccgcggcaugggcggccucuucuccgucggcgagaccaccgccaagguccucaaggacgagaucgacgucaaguucaaggacgucgccggcugcgaggaggccaagcucgagaucauggaguucgucaacuuccucaagaaccccaagcaguaccaggaccucggcgccaagauccccaagggcgccauccucaccggcccccccggcaccggcaagacccuccucgccaaggccaccgccggcgaggccaacguccccuucaucaccgucuccggcuccgaguuccucgagauguucgucggcgucggccccgcccgcguccgcgaccucuucgcccucgcccgcaagaacgcccccugcauccucuucaucgacgagaucgacgccgucggccgcaagcgcggccgcggcaacuucggcggccaguccgagcaggagaacacccucaaccagcuccucgucgagauggacggcuucaacaccaccaccaacgucgucauccucgccggcaccaaccgccccgacauccucgaccccgcccuccuccgccccggccgcuucgaccgccagaucuucaucggcccccccgacaucaagggccgcgccuccaucuucaagguccaccuccgcccccucaagcucgacuccacccucgagaaggacaagcucgcccgcaagcucgccucccucacccccggcuucuccggcgccgacgucgccaacgucugcaacgaggccgcccucaucgccgcccgccaccucuccgacuccaucaaccagaagcacuucgagcaggccaucgagcgcgucaucggcggccucgagaagaagacccagguccuccagcccgaggagaagaagaccgucgccuaccacgaggccggccacgccgucgccggcugguaccucgagcacgccgacccccuccucaaggucuccaucaucccccgcggcaagggccucggcuacgcccaguaccuccccaaggagcaguaccucuacaccaaggagcagcuccucgaccgcaugugcaugacccucggcggccgcgucuccgaggagaucuucuucggccgcaucaccaccggcgcccaggacgaccuccgcaaggucacccaguccgccuacgcccagaucguccaguucggcaugaacgagaaggucggccagaucuccuucgaccucccccgccagggcgacaugguccucgagaagcccuacuccgaggccaccgcccgccucaucgacgacgagguccgcauccucaucaacgacgccuacaagcgcaccgucgcccuccucaccgagaagaaggccgacgucgagaaggucgcccuccuccuccucgagaaggagguccucgacaagaacgacauggucgagcuccucggcccccgccccuucgccgagaaguccaccuacgaggaguucgucgagggcaccggcucccucgacgaggacaccucccuccccgagggccucaaggacuggaacaaggagcgcgagaaggagaaggaggagccccccggcgagaaggucgccaacuga

SEQ ID NO: 39498 - RNA, 1800 nt, Artificial Sequence
  derived and/or modified sequence opt2 from AFM__Homo_sapiens__NP_001124
augaagcuccucaagcucaccggcuucaucuucuuccucuucuuccucaccgagucccucacccuccccacccagccccgcgacaucgagaacuucaacuccacccagaaguucaucgaggacaacaucgaguacaucaccaucaucgccuucgcccaguacguccaggaggccaccuucgaggagauggagaagcucgucaaggacauggucgaguacaaggaccgcugcauggccgacaagacccuccccgagugcuccaagcuccccaacaacguccuccaggagaagaucugcgccauggagggccucccccagaagcacaacuucucccacugcugcuccaaggucgacgcccagcgccgccucugcuucuucuacaacaagaaguccgacgucggcuuccucccccccuuccccacccucgaccccgaggagaagugccaggccuacgaguccaaccgcgagucccuccucaaccacuuccucuacgaggucgcccgccgcaaccccuucgucuucgcccccacccuccucaccgucgccguccacuucgaggaggucgccaaguccugcugcgaggagcagaacaaggucaacugccuccagacccgcgccauccccgucacccaguaccucaaggccuucuccuccuaccagaagcacgucugcggcgcccuccucaaguucggcaccaaggucguccacuucaucuacaucgccauccucucccagaaguuccccaagaucgaguucaaggagcucaucucccucgucgaggacgucuccuccaacuacgacggcugcugcgagggcgacgucguccagugcauccgcgacaccuccaaggucaugaaccacaucugcuccaagcaggacuccaucuccuccaagaucaaggagugcugcgagaagaagauccccgagcgcggccagugcaucaucaacuccaacaaggacgaccgccccaaggaccucucccuccgcgagggcaaguucaccgacuccgagaacgucugccaggagcgcgacgccgaccccgacaccuucuucgccaaguucaccuucgaguacucccgccgccaccccgaccucuccauccccgagcuccuccgcaucguccagaucuacaaggaccuccuccgcaacugcugcaacaccgagaacccccccggcugcuaccgcuacgccgaggacaaguucaacgagaccaccgagaagucccucaagaugguccagcaggagugcaagcacuuccagaaccucggcaaggacggccucaaguaccacuaccucauccgccucaccaagaucgccccccagcucuccaccgaggagcucgucucccucggcgagaagauggucaccgccuucaccaccugcugcacccucuccgaggaguucgccugcgucgacaaccucgccgaccucgucuucggcgagcucugcggcgucaacgagaaccgcaccaucaaccccgccgucgaccacugcugcaagaccaacuucgccuuccgccgccccugcuucgagucccucaaggccgacaagaccuacguccccccccccuucucccaggaccucuucaccuuccacgccgacaugugccagucccagaacgaggagcuccagcgcaagaccgaccgcuuccucgucaaccucgucaagcucaagcacgagcucaccgacgaggagcuccagucccucuucaccaacuucgccaacgucgucgacaagugcugcaaggccgagucccccgaggucugcuucaacgaggagucccccaagaucggcaacuga

SEQ ID NO: 39499 - RNA, 1830 nt, Artificial Sequence
  derived and/or modified sequence opt2 from AFP__Homo_sapiens__NP_001125
augaagugggucgaguccaucuuccucaucuuccuccucaacuucaccgagucccgcacccuccaccgcaacgaguacggcaucgccuccauccucgacuccuaccagugcaccgccgagaucucccucgccgaccucgccaccaucuucuucgcccaguucguccaggaggccaccuacaaggaggucuccaagauggucaaggacgcccucaccgccaucgagaagcccaccggcgacgagcaguccuccggcugccucgagaaccagcuccccgccuuccucgaggagcucugccacgagaaggagauccucgagaaguacggccacuccgacugcugcucccaguccgaggagggccgccacaacugcuuccucgcccacaagaagcccacccccgccuccaucccccucuuccagguccccgagcccgucaccuccugcgaggccuacgaggaggaccgcgagaccuucaugaacaaguucaucuacgagaucgcccgccgccaccccuuccucuacgcccccaccauccuccucugggccgcccgcuacgacaagaucauccccuccugcugcaaggccgagaacgccgucgagugcuuccagaccaaggccgccaccgucaccaaggagcuccgcgaguccucccuccucaaccagcacgccugcgccgucaugaagaacuucggcacccgcaccuuccaggccaucaccgucaccaagcucucccagaaguucaccaaggucaacuucaccgagauccagaagcucguccucgacgucgcccacguccacgagcacugcugccgcggcgacguccucgacugccuccaggacggcgagaagaucauguccuacaucugcucccagcaggacacccucuccaacaagaucaccgagugcugcaagcucaccacccucgagcgcggccagugcaucauccacgccgagaacgacgagaagcccgagggccucucccccaaccucaaccgcuuccucggcgaccgcgacuucaaccaguucuccuccggcgagaagaacaucuuccucgccuccuucguccacgaguacucccgccgccacccccagcucgccgucuccgucauccuccgcgucgccaagggcuaccaggagcuccucgagaagugcuuccagaccgagaacccccucgagugccaggacaagggcgaggaggagcuccagaaguacauccaggagucccaggcccucgccaagcgcuccugcggccucuuccagaagcucggcgaguacuaccuccagaacgccuuccucgucgccuacaccaagaaggccccccagcucaccuccuccgagcucauggccaucacccgcaagauggccgccaccgccgccaccugcugccagcucuccgaggacaagcuccucgccugcggcgagggcgccgccgacaucaucaucggccaccucugcauccgccacgagaugacccccgucaaccccggcgucggccagugcugcaccuccuccuacgccaaccgccgccccugcuucuccucccucgucgucgacgagaccuacgucccccccgccuucuccgacgacaaguucaucuuccacaaggaccucugccaggcccagggcgucgcccuccagaccaugaagcaggaguuccucaucaaccucgucaagcagaagccccagaucaccgaggagcagcucgaggccgucaucgccgacuucuccggccuccucgagaagugcugccagggccaggagcaggaggucugcuucgccgaggagggccagaagcucaucuccaagacccgcgccgcccucggcgucuga

SEQ ID NO: 39500 - RNA, 1041 nt, Artificial Sequence
  derived and/or modified sequence opt2 from AGA__Homo_sapiens__NP_000018
auggcccgcaaguccaaccuccccguccuccucguccccuuccuccucugccaggcccucguccgcugcuccuccccccucccccucgucgucaacaccuggcccuucaagaacgccaccgaggccgccuggcgcgcccucgccuccggcggcuccgcccucgacgccgucgaguccggcugcgccaugugcgagcgcgagcagugcgacggcuccgucggcuucggcggcucccccgacgagcucggcgagaccacccucgacgccaugaucauggacggcaccaccauggacgucggcgccgucggcgaccuccgccgcaucaagaacgccaucggcgucgcccgcaagguccucgagcacaccacccacacccuccucgucggcgaguccgccaccaccuucgcccaguccaugggcuucaucaacgaggaccucuccaccaccgccucccaggcccuccacuccgacuggcucgcccgcaacugccagcccaacuacuggcgcaacgucauccccgaccccuccaaguacugcggccccuacaagccccccggcauccucaagcaggacauccccauccacaaggagaccgaggacgaccgcggccacgacaccaucggcauggucgucauccacaagaccggccacaucgccgccggcaccuccaccaacggcaucaaguucaagauccacggccgcgucggcgacucccccauccccggcgccggcgccuacgccgacgacaccgccggcgccgccgccgccaccggcaacggcgacauccucaugcgcuuccuccccuccuaccaggccgucgaguacaugcgccgcggcgaggaccccaccaucgccugccagaaggucaucucccgcauccagaagcacuuccccgaguucuucggcgccgucaucugcgccaacgucaccggcuccuacggcgccgccugcaacaagcucuccaccuucacccaguucuccuucauggucuacaacuccgagaagaaccagcccaccgaggagaaggucgacugcaucuga

SEQ ID NO: 39501 - RNA, 2574 nt, Artificial Sequence
  derived and/or modified sequence opt2 from AGAP1__Homo_sapiens__NP_001032208
augaacuaccagcagcagcucgccaacuccgccgccauccgcgccgagauccagcgcuucgaguccguccaccccaacaucuacuccaucuacgagcuccucgagcgcgucgaggagcccguccuccagaaccagauccgcgagcacgucaucgccaucgaggacgccuucgucaacucccaggaguggacccucucccgcuccguccccgagcucaaggucggcaucgucggcaaccucgccuccggcaaguccgcccucguccaccgcuaccucaccggcaccuacguccaggaggagucccccgagggcggccgcuucaagaaggagaucgucgucgacggccaguccuaccuccuccucauccgcgacgagggcggcccccccgaggcccaguucgccaugugggucgacgccgucaucuucgucuucucccucgaggacgagaucuccuuccagaccgucuaccacuacuacucccgcauggccaacuaccgcaacaccuccgagaucccccucguccucgucggcacccaggacgccaucuccuccgccaacccccgcgucaucgacgacgcccgcgcccgcaagcucuccaacgaccucaagcgcugcaccuacuacgagaccugcgccaccuacggccucaacgucgagcgcgucuuccaggacgucgcccagaagaucgucgccacccgcaagaagcagcagcucuccaucggccccugcaagucccuccccaacucccccucccacuccuccgucugcuccgcccaggucuccgccguccacaucucccagaccuccaacggcggcggcucccucuccgacuacuccuccuccguccccuccacccccuccaccucccagaaggagcuccgcaucgacgucccccccaccgccaacacccccacccccguccgcaagcaguccaagcgccgcuccaaccucuucaccucccgcaagggcuccgaccccgacaaggagaagaagggccucgagucccgcgccgacuccaucggcuccggccgcgccauccccaucaagcagggcaugcuccucaagcgcuccggcaagucccucaacaaggaguggaagaagaaguacgucacccucugcgacaacggcguccucaccuaccaccccucccuccacgacuacaugcagaacguccacggcaaggagaucgaccuccuccgcaccaccgucaagguccccggcaagcgccccccccgcgccaccuccgccugcgcccccaucuccucccccaagaccaacggccucuccaaggacauguccucccuccacaucucccccaacuccggcaacgucaccuccgccuccggcucccagauggccuccggcaucucccucgucuccuucaacucccgccccgacggcaugcaccagcgcuccuacuccgucuccuccgccgaccagugguccgaggccaccgucaucgccaacuccgccaucuccuccgacaccggccucggcgacuccgucugcuccucccccuccaucuccuccaccaccucccccaagcucgaccccccccccuccccccacgccaaccgcaagaagcaccgccgcaagaaguccaccuccaacuucaaggccgacggccucuccggcaccgccgaggagcaggaggagaacuucgaguucaucaucgucucccucaccggccagaccuggcacuucgaggccaccaccuacgaggagcgcgacgccuggguccaggccaucgagucccagauccucgccucccuccaguccugcgaguccuccaagaacaagucccgccucaccucccaguccgaggccauggcccuccaguccauccgcaacaugcgcggcaacucccacugcgucgacugcgagacccagaaccccaacugggccucccucaaccucggcgcccucaugugcaucgagugcuccggcauccaccgcaaccucggcacccaccucucccgcguccgcucccucgaccucgacgacuggcccgucgagcucaucaaggucauguccuccaucggcaacgagcucgccaacuccgucugggaggaguccucccagggccgcaccaagcccuccgucgacuccacccgcgaggagaaggagcgcuggauccgcgccaaguacgagcagaagcucuuccucgccccccuccccugcaccgagcucucccucggccagcaccuccuccgcgccaccgccgacgaggaccuccgcaccgccauccuccuccucgcccacggcucccgcgacgaggucaacgagaccugcggcgagggcgacggccgcaccgcccuccaccucgccugccgcaagggcaacgucguccucgcccagcuccucaucugguacggcgucgacgucaccgcccgcgacgcccacggcaacaccgcccucgccuacgcccgccaggccuccucccaggagugcaucgacguccuccuccaguacggcugccccgacgagcgcuucguccucauggccacccccaaccucucccgccgcaacaacaaccgcaacaacuccuccggccgcguccccaccaucaucuga

SEQ ID NO: 39502 - RNA, 3579 nt, Artificial Sequence
  derived and/or modified sequence opt2 from AGAP2__Homo_sapiens__NP_001116244
augucccgcggcgccggcgcccuccagcgccgcaccaccaccuaccucaucucccucacccucgucaagcucgaguccguccccccccccccccccucccccuccgccgccgccgccggcgccgccggcgcccgcggcuccgagaccggcgaccccggcuccccccgcggcgccgaggagcccggcaagaagcgccacgagcgccucuuccaccgccaggacgcccucuggaucuccaccuccuccgccggcaccggcggcgccgagccccccgcccucucccccgcccccgccucccccgcccgccccgucucccccgcccccggccgccgccucucccucugggccgucccccccggccccccccucuccggcggccucucccccgaccccaagcccggcggcgcccccaccuccucccgccgcccccuccucuccucccccuccuggggcggccccgagcccgagggccgcgccggcggcggcauccccggcuccuccuccccccaccccggcaccggcucccgccgccucaaggucgccccccccccccccgcccccaagcccugcaagaccgucaccaccuccggcgccaaggccggcggcggcaagggcgccggcucccgccucuccuggcccgaguccgagggcaagccccgcgucaagggcuccaaguccuccgccggcaccggcgccuccgucuccgccgccgccaccgccgccgccgccggcggcggcggcuccaccgccuccaccuccggcggcgucggcgccggcgccggcgcccgcggcaagcucuccccccgcaagggcaaguccaagacccucgacaacuccgaccuccaccccggcccccccgccggcuccccccccccccucacccucccccccacccccucccccgccaccgccgucaccgccgccuccgcccagccccccggccccgccccccccaucacccucgagccccccgcccccggccucaagcgcggccgcgagggcggccgcgccuccacccgcgaccgcaagaugcucaaguucaucuccggcaucuucaccaaguccaccggcggcccccccggcuccggcccccuccccggcccccccucccucuccuccggcuccggcucccgcgagcuccucggcgccgagcuccgcgccucccccaaggccgucaucaacucccaggaguggacccucucccgcuccauccccgagcuccgccucggcguccucggcgacgcccgcuccggcaaguccucccucauccaccgcuuccucaccggcuccuaccagguccucgagaagaccgaguccgagcaguacaagaaggagaugcucgucgacggccagacccaccucguccucauccgcgaggaggccggcgcccccgacgccaaguucuccggcugggccgacgccgucaucuucgucuucucccucgaggacgagaacuccuuccaggccgucucccgccuccacggccagcucuccucccuccgcggcgagggccgcggcggccucgcccucgcccucgucggcacccaggaccgcaucuccgccuccuccccccgcgucgucggcgacgcccgcgcccgcgcccucugcgccgacaugaagcgcugcuccuacuacgagaccugcgccaccuacggccucaacgucgaccgcgucuuccaggaggucgcccagaaggucgucacccuccgcaagcagcagcagcuccucgccgccugcaagucccuccccuccucccccucccacuccgccgccuccacccccgucgccggccaggccuccaacggcggccacaccuccgacuacuccuccucccuccccuccucccccaacgucggccaccgcgagcuccgcgccgaggccgccgccgucgccggccucuccacccccggcucccuccaccgcgccgccaagcgccgcaccucccucuucgccaaccgccgcggcuccgacuccgagaagcgcucccucgacucccgcggcgagaccaccggcuccggccgcgccauccccaucaagcaguccuuccuccucaagcgcuccggcaacucccucaacaaggaguggaagaagaaguacgucacccucuccuccaacggcuuccuccucuaccaccccuccaucaacgacuacauccacuccacccacggcaaggagauggaccuccuccgcaccaccgucaagguccccggcaagcgccccccccgcgccaucuccgccuucggccccuccgccuccaucaacggccucgucaaggacauguccaccguccagaugggcgagggccucgaggccaccacccccaugcccucccccucccccucccccuccucccuccagcccccccccgaccagaccuccaagcaccuccucaagcccgaccgcaaccucgcccgcgcccucuccaccgacugcacccccuccggcgaccucuccccccucucccgcgagcccccccccucccccauggucaagaagcagcgccgcaagaagcucaccacccccuccaagaccgagggcuccgccggccaggccgaggccaagcgcaagauguggaagcucaaguccuucggcucccuccgcaacaucuacaaggccgaggagaacuucgaguuccucaucgucuccuccaccggccagaccuggcacuucgaggccgccuccuucgaggagcgcgacgccuggguccaggccaucgagucccagauccucgccucccuccagugcugcgaguccuccaaggucaagcuccgcaccgacucccaguccgaggccgucgccauccaggccauccgcaacgccaagggcaacuccaucugcgucgacugcggcgcccccaaccccaccugggccucccucaaccucggcgcccucaucugcaucgagugcuccggcauccaccgcaaccucggcacccaccucucccgcguccgcucccucgaccucgacgacuggccccgcgagcucacccucguccucaccgccaucggcaacgacaccgccaaccgcgucugggaguccgacacccgcggccgcgccaagcccucccgcgacuccucccgcgaggagcgcgaguccuggauccgcgccaaguacgagcagcuccucuuccucgccccccucuccaccuccgaggagccccucggccgccagcucugggccgccguccaggcccaggacgucgccaccguccuccuccuccucgcccacgcccgccacggcccccucgacaccuccgucgaggacccccagcuccgcuccccccuccaccucgccgccgagcucgcccacgucgucaucacccagcuccuccucugguacggcgccgacgucgccgcccgcgacgcccagggccgcaccgcccucuucuacgcccgccaggccggcucccagcucugcgccgacauccuccuccagcacggcugccccggcgagggcggcuccgccgccaccacccccuccgccgccaccacccccuccaucaccgccacccccuccccccgccgccgcuccuccgccgccuccgucggccgcgccgacgcccccgucgcccucgucuga

SEQ ID NO: 39503 - RNA, 1191 nt, Artificial Sequence
  derived and/or modified sequence opt2 from AGAP3__Homo_sapiens__NP_001036000
augaacuuccaggccggcggcggccaguccccccagcagcagcagucccucgccgcccccggcggcggcggcgccgccgcccagcagcucgucugcggcggccaguucggcggcgccggccccggcgccggcggcggcggcggccccucccagcagcucgccggcggccccccccagcaguucgcccucuccaacuccgccgccauccgcgccgagauccagcgcuucgaguccguccaccccaacaucuacgccaucuacgaccucaucgagcgcaucgaggaccucgcccuccagaaccagauccgcgagcacgucaucuccaucgaggacuccuucgucaacucccaggaguggacccucucccgcuccguccccgagcucaaggucggcaucgucggcaaccucuccuccggcaaguccgcccucguccaccgcuaccucaccggcaccuacguccaggaggagucccccgagggcggccgcuucaagaaggagaucgucgucgacggccaguccuaccuccuccucauccgcgacgagggcggcccccccgagcuccaguucgccgccugggucgacgccgucgucuucgucuucucccucgaggacgagaucuccuuccagaccgucuacaacuacuuccuccgccucugcuccuuccgcaacgccuccgagguccccaugguccucgucggcacccaggacgccaucuccgccgccaacccccgcgucaucgacgacucccgcgcccgcaagcucuccaccgaccucaagcgcugcaccuacuacgagaccugcgccaccuacggccucaacgucgagcgcgucuuccaggacgucgcccagaaggucgucgcccuccgcaagaagcagcagcucgccaucggccccugcaagucccuccccaacucccccucccacuccgccgucuccgccgccuccauccccgccguccacaucaaccaggccaccaacggcggcggcuccgccuucuccgacuacuccuccuccguccccuccacccccuccaucucccagcgcgagcuccgcaucgagaccaucgccgccuccuccacccccacccccauccgcaagcaguccaagcgccgcuccaacaucuucaccaucugcgccaccgucuccaacuucuccuccaccaagcgccccuuccagcuccuccccaacuga

SEQ ID NO: 39504 - RNA, 1992 nt, Artificial Sequence
  derived and/or modified sequence opt2 from AGAP4__Homo_sapiens__NP_597703
augggcaacauccucaccugccgcguccaccccuccgucucccucgaguucgaccagcagcagggcuccgucugccccuccgaguccgagaucuacgaggccggcgccggcgaccgcauggccggcgcccccauggccgccgccguccagcccgccgaggucaccgucgaggucggcgaggaccuccacaugcaccacguccgcgaccgcgagaugcccgaggcccucgaguucaaccccuccgccaaccccgaggccuccaccaucuuccagcgcaacucccagaccgacgucgucgagauccgccgcuccaacugcaccaaccacgucuccaccguccgcuucucccagcaguacucccucugcuccaccaucuuccucgacgacuccaccgccauccagcacuaccucaccaugaccaucaucuccgucacccucgagaucccccaccacaucacccagcgcgacgccgaccgcucccucuccauccccgacgagcagcuccacuccuucgccgucuccaccguccacaucaugaagaagcgcaacggcggcggcucccucaacaacuacuccuccuccauccccuccacccccuccaccucccaggaggacccccaguucuccgucccccccaccgccaacacccccacccccgucugcaagcgcuccaugcgcugguccaaccucuucaccuccgagaagggcuccgaccccgacaaggagcgcaaggcccccgagaaccacgccgacaccaucggcuccggccgcgccauccccaucaagcagggcaugcuccucaagcgcuccggcaaguggcucaagaccuggaagaagaaguacgucacccucugcuccaacggcguccucaccuacuacuccucccucggcgacuacaugaagaacauccacaagaaggagaucgaccuccagaccuccaccaucaagguccccggcaaguggcccucccucgccaccuccgccugcacccccaucuccaccuccaaguccaacggccucuccaaggacauggacaccggccucggcgacuccaucugcuucucccccuccaucuccuccaccaccucccccaagcucaaccccccccccuccccccacgccaacaagaagaagcaccucaagaagaaguccaccaacaacuucaugaucgucuccgccaccggccagaccuggcacuucgaggccaccaccuacgaggagcgcgacgccuggguccaggccauccagucccagauccucgccucccuccaguccugcgaguccuccaaguccaagucccagcucaccucccaguccaaggccauggcccuccaguccauccagaacaugcgcggcaacgcccacugcgucgacugcgagacccagaaccccaagugggccucccucaaccucggcguccucaugugcaucgagugcuccggcauccaccgcucccucggcacccgccucucccgcguccgcucccucgagcucgacgacuggcccgucgagcuccgcaaggucauguccuccaucggcaacgaccucgccaacuccaucugggagggcuccucccagggccagaccaagcccuccgagaaguccacccgcgaggagaaggagcgcuggauccgcuccaaguacgaggagaagcucuuccucgccccccuccccugcaccgagcucucccucggccagcagcuccuccgcgccaccgccgacgaggaccuccagaccgccauccuccuccucgcccacggcucccgcgaggaggucaacgagaccugcggcgagggcgacggcugcaccgcccuccaccucgccugccgcaagggcaacgucguccucgcccagcuccucaucugguacggcgucgacgucauggcccgcgacgcccacggcaacaccgcccucaccuacgcccgccaggccuccucccaggagugcaucaacguccuccuccaguacggcugccccgacaagugcgucuga

SEQ ID NO: 39505 - RNA, 3201 nt, Artificial Sequence
  derived and/or modified sequence opt2 from AGBL1__Homo_sapiens__NP_689549
augaucuccaagggcggcuccgaggcccuccuccagacccucgucgacaccgcccgcaccgccccccccgacuacgacauccuccucccccucuuccgccuccucgccaaggucggccuccgcgacaagaagaucggccgcaaggcccucgagcucgaggcccucgacgucacccucauccucgcccgcaagaaccucucccacggccagaaccuccuccacugccucugggcccuccgcgucuucgccuccuccgucuccaugggcgccaugcucggcaucaacggcgccauggagcuccucuucaaggucaucacccccuacacccgcaagcgcacccaggccauccgcgccgccaccgagguccucgccgcccuccucaaguccaaguccaacggccgccgcgccgucaaccgcggcuacgucaccucccuccucggccuccaccaggacuggcacucccacgacaccgccaacgccuacguccagauccgccgcggccuccuccucugccuccgccacaucgccgcccuccgcuccggccgcgaggccuuccucgccgcccagggcauggagauccucuucuccaccacccagaacugccucgacgacaaguccauggagcccgucaucuccgucguccuccagauccuccgccagugcuaccccaccuccccccucccccucgucaccgccuccuccgccuacgccuuccccguccccggcugcaucaccaccgagcccccccacgaccuccccgaggaggacuucgaggacgacggcgacgacgaggucgacaaggacuccgacaccgaggacggcaaggucgaggacgacgaccucgagaccgacgucaacaagcucuccuccaagcccggccucgaccgccccgaggaggagcucaugcaguacgaggucaugugccucgagcucuccuacuccuucgaggagcuccaguccaagcucggcgacgaccucaacuccgagaagacccaguacgccaaccaccaccacauccccgccgccgccuccuccaagcagcacugcuacuccaaggaccaguccuccugcggccaggagcgcgaguacgccguccagaccucccuccucugccgcgucaagaccggccgcuccaccguccaccucggcuccaagaagaaccccggcgucaaccucuaccagaacguccaguccaacucccuccgccgcgacuccuccgaguccgagauccccgacauccaggccucccccaaggccgacgccugggacgucgacgccaucuucugcccccgcauguccgccuccuucuccaacuccacccgcacccgcgaggucgucaaggucaucgacaagcuccuccagacccaccucaagcgcguccccuuccacgaccccuaccucuacauggccaaggcccgccgcaccuccuccgucgucgacuucaagaugauggccuuccccgacgucuggggccacugccccccccccaccacccagcccaugcucgagcgcaagugcggcguccagcgcauccgcaucuucgaggacauccgccgccucauccagcccuccgacgucaucaacaaggucgucuucucccucgacgagcccuggccccuccaggacaacgccuccaacugccuccgcuucuucuccaaguucgaguccggcaaccuccgcaaggccauccagguccgcgaguucgaguacgaccuccucgucaacgccgacgucaacuccacccagcaccagcagugguucuacuucaaggucuccggcaugcaggccgccauccccuaccacuucaacaucaucaacugcgagaagcccaacucccaguucaacuacggcaugcagcccacccucuacuccgucaaggaggcccuccucggcaagcccaccuggauccgcaccggccacgagaucugcuacuacaagaaccacuaccgccaguccaccgccgucgccggcggcgccuccggcaagugcuacuacacccucaccuucgccgucaccuucccccacuccgaggacgucugcuaccucgccuaccacuaccccuacaccuacaccgcccucaugacccaccucgacauccucgagaaguccgucaaccucaaggaggucuacuuccgccaggacguccucugccagacccucggcggcaaccccugcccccucgucaccaucaccgccaugcccgaguccaacuccgacgagcaccucgagcaguuccgccaccgccccuaccaggucaucaccgcccgcguccaccccggcgaguccaacgccuccugggucaugaagggcacccucgaguuccucgucuccuccgaccccgucgcccgccuccuccgcgagaacuucaucuucaagaucauccccaugcucaaccccgacggcgucaucaacggcaaccaccgcugcucccucuccggcgaggaccucaaccgccaguggcucucccccuccgcccaccuccagcccaccaucuaccacgccaagggccuccucuaccaccucuccuccaucggccgcucccccgucgucuucugcgacuuccacggccacucccagaagaagaacgucuuccucuacggcugcuccaucaaggagacccucuggcaggccgccugcaccgucggcaccuccaccauccucgaggaggucaacuaccgcacccuccccaagauccucgacaagcucgcccccgccuucaccauguccuccugcuccuuccucgucgagaagucccgcgccuccaccgcccgcgucgucgucuggcgcgagaugggcgucucccgcuccuacaccauggaguccuccuacugcggcugcaaccagggccccuaccagugcacccagcgccuccucgagcgcaccaagaacgagcgcgcccaccccgucgacggccuccagggccuccaguucggcacccgcgagcucgaggagaugggcgccauguucugccucggccuccucauccucgagcucaaguccgccuccugcucccaccagcuccucgcccaggccgccacccuccucuccgccgaggaggacgcccucgaccagcaccuccagcgccucaaguccuccaacuuccuccccaagcacaucugguucgccuaccacuucuucgccaucaccaacuucuucaagaugaaccuccuccuccacgucucccccgucugcgacaccuga

SEQ ID NO: 39506 - RNA, 2709 nt, Artificial Sequence
  derived and/or modified sequence opt2 from AGBL2__Homo_sapiens__NP_079059
auguuccccgcccucgagacccaccucaagcagaccauccccgaccccuacgaggacuucauguaccgccaccuccaguacuacggcuacuucaaggcccagcgcggcucccuccccaacuccgccacccaccagcacguccgcaagaacaacccccagugccuccucaacggcucccucggcgagaaggacgaccucauccccgacacccuccagaaggagaagcuccucuggcccaucucccucuccuccgccguccaccgccagaucgaggccaucaaccgcgacuuccacuccugccucggcuggaugcaguggcgcggccucuccucccuccagcccccccccccccgcuucaaggacucccccgccuccgccuuccgcgucgccggcaucaccgacucccacaugcucucccucccccaccuccgcucccgccagcuccucuacgacgagcucgacgaggucaacccccgccuccgcgagccccaggagcucuucuccauccucuccaccaagcgcccccuccaggccccccgcuggcccaucgagugcgaggucaucaaggagaacauccaccacaucgagugggcccccccccagcccgaguacuucuaccagcccaagggcaacgagaagguccccgagaucgucggcgagaagaagggcaccgucgucuaccagcucgacuccguccccaucgagggcuccuacuucaccuccucccgcgucggcggcaagcgcggcaucgucaaggagcucgccgucacccuccagggccccgaggacaacacccuccucuucgagucccgcuucgaguccggcaaccuccagaaggccguccgcgucgacaccuacgaguacgagcucacccuccgcaccgaccucuacaccaacaagcacacccagugguucuacuuccgcguccagaacacccgcaaggacgccaccuaccgcuucaccaucgucaaccuccucaagcccaagucccucuacaccgucggcaugaagccccuccucuacucccagcucgacgccaacacccgcaacaucggcuggcgccgcgagggcaacgagaucaaguacuacaagaacaacaccgacgacggccagcagcccuucuacugccucaccuggaccauccaguuccccuacgaccaggacaccugcuucuucgcccacuucuaccccuacaccuacaccgaccuccagugcuaccuccucuccgucgccaacaaccccauccagucccaguucugcaagcuccagacccucugccgcucccucgccggcaacaccgucuaccuccucaccaucaccaaccccucccagaccccccaggaggccgccgccaagaaggccgucguccucuccgcccgcguccaccccggcgaguccaacggcuccugggucaugaagggcuuccucgacuucauccucuccaacucccccgacgcccagcuccuccgcgacaucuucgucuucaagguccuccccaugcucaaccccgacggcgucaucgucggcaacuaccgcugcucccucgccggccgcgaccucaaccgccacuacaagaccauccucaaggaguccuuccccugcaucugguacacccgcaacaugaucaagcgccuccucgaggagcgcgagguccuccucuacugcgacuuccacggccacucccgcaagaacaacaucuuccucuacggcugcaacaacaacaaccgcaaguacuggcuccacgagcgcgucuucccccucaugcucugcaagaacgcccccgacaaguucuccuuccacuccugcaacuucaagguccagaagugcaaggagggcaccggccgcgucgucauguggcgcaugggcauccucaacuccuacaccauggaguccaccuucggcggcuccacccucggcaacaagcgcgacacccacuucaccaucgaggaccucaagucccucggcuaccacgucugcgacacccuccucgacuucugcgaccccgaccagaugaaguucacccagugccucgccgagcucaaggagcuccuccgccaggagauccacaagaaguuccacgagcucggccaggacgucgaccucgagggcuccugguccgacaucucccucuccgacaucgaguccuccaccuccggcuccgacuccucccucuccgacggccuccccguccaccucgccaacaucgccgacgagcucacccagaagaagaagauguucaagaagaagaagaagaagucccuccagacccgcaagcagcgcaacgagcaguaccagaagaagaaccucaugcagaagcucaagcucaccgaggacaccuccgagaaggccggcuucgccuccacccuccagaagcagcccaccuucuucaagaacuccgagaacuccuccuuccuccccaugaagaacgagaacccccgccucaacgagaccaaccucaaccgccgcgacaaggacaccccccucgaccccuccauggccacccucauccuccccaagaacaagggccgcaugcagaacaagaagcccggcuucaccgucuccugcucccccaagcgcaccaucaacuccucccaggagcccgcccccggcaugaagcccaacuggccccgcucccgcuaccccgccaccaagcgcggcugcgccgccauggccgccuaccccucccuccacaucuacaccuaccccuga

SEQ ID NO: 39507 - RNA, 2763 nt, Artificial Sequence
  derived and/or modified sequence opt2 from AGBL3__Homo_sapiens__NP_848658
auguccgaggacuccgagaaggaggacuacuccgaccgcaccaucuccgacgaggacgaguccgacgaggacauguucaugaaguucgucuccgaggaccuccaccgcugcgcccuccucaccgccgacuccuucggcgaccccuucuucccccgcaccacccagauccuccucgaguaccagcucggccgcugggucccccgccuccgcgagccccgcgaccucuacggcgucuccuccuccggcccccucucccccacccgcuggcccuaccacugcgaggucaucgacgagaagguccagcacaucgacuggacccccuccugccccgagcccgucuacauccccaccggccucgagaccgagccccucuaccccgacuccaaggaggccaccgucgucuaccucgccgaggacgccuacaaggagcccugcuucgucuacucccgcgucggcggcaaccgcaccccccucaagcagcccgucgacuaccgcgacaacacccucauguucgaggcccgcuucgaguccggcaaccuccagaaggucgucaaggucgccgaguacgaguaccagcucaccguccgccccgaccucuucaccaacaagcacacccagugguacuacuuccaggucaccaacaugcgcgccggcaucgucuaccgcuucaccaucgucaacuucaccaagcccgccucccucuacucccgcggcaugcgcccccucuucuacuccgagaaggaggccaaggcccaccacaucggcuggcagcgcaucggcgaccagaucaaguacuaccgcaacaaccccggccaggacggccgccacuacuucucccucaccuggaccuuccaguucccccacaacaaggacaccugcuacuucgcccacugcuaccccuacaccuacaccaaccuccaggaguaccucuccggcaucaacaacgaccccguccgcuccaaguucugcaagauccgcguccucugccacacccucgcccgcaacauggucuacauccucaccaucaccaccccccucaagaacuccgacucccgcaagcgcaaggccgucauccucaccgcccgcguccaccccggcgagaccaacuccuccuggaucaugaagggcuuccucgacuacauccucggcaacuccuccgacgcccagcuccuccgcgacaccuucgucuucaaggucguccccaugcucaaccccgacggcgucaucgucggcaacuaccgcugcucccucgccggccgcgaccucaaccgcaacuacaccucccuccucaaggaguccuuccccuccgucugguacacccgcaacaugguccaccgccucauggagaagcgcgaggucauccucuacugcgaccuccacggccacucccgcaaggagaacaucuucauguacggcugcgacggcuccgaccgcuccaagacccucuaccuccagcagcgcaucuucccccucaugcucuccaagaacugccccgacaaguucuccuucuccgccugcaaguucaacguccagaaguccaaggagggcaccggccgcgucgucauguggaagaugggcauccgcaacuccuucaccauggaggccaccuucugcggcuccacccucggcaacaagcgcggcacccacuucuccaccaaggaccucgaguccaugggcuaccacuucugcgacucccuccucgacuacugcgaccccgaccgcaccaaguacuaccgcugccucaaggagcucgaggagauggagcgccacaucacccucgagaaggucuucgaggacuccgacacccccgucaucgacaucacccucgacgucgaguccuccucccgcggcuccgacuccuccgaguccaucgacucccucaccuaccuccucaagcucaccucccagaagaagcaccucaagaccaagaaggagcgcaacuccaccaucgccucccaccagaacgcccgcggccaggaggucuacgaccgcggccaccuccuccagcgccacacccaguccaacuccgacgucaaggacacccgccccaacgagcccgacgacuacauggucgacuacuuccgccgccagcuccccaaccagggccucgaccuccaccacaaccucaaguccaagaucaaggagugcaucuccuuccaguccaagaagaccggcaucaacuggaccgacgacgagaagcgcuccuacaaggacaagggcaucguccagacccaggagauccuccaguaccuccuccccaucguccacuccaccaagaacaugcagaccacccagaucaagcagcucuucaacccccgcaccaacuuccagauccagcaccagcucaaccccgccaccugccgcaacaucaagaaguacuccaccuccuggaccgccccccgcaaccaccccuucgucauccagggcgacgucauggccaacuccuccgaguggguccaguccaagccccaccgcucccucgagucccucuccccccucaagggccccaagaagaacaagcacucccagaucugggccaucaagaacgaggacaucaagccccucuccuccaagugggagaccgccuccuccuccuucggcauggacgccaacguccucaaguacaagucccuccaggccgaggagaccaaccagcaguccuccaagcacaccgcccuccaccucaccaagaacaaggacgagcaggccaacaagaacgacggccagcccacccucuaccucaaguuccagcgcgaguccuga

SEQ ID NO: 39508 - RNA, 1521 nt, Artificial Sequence
  derived and/or modified sequence opt2 from AGBL4__Homo_sapiens__XP_011540611
auggccgagggcucccaguccgcccccgaggccggcaacgacaugggcaacgacgacgccaucggcggcaacgucuccaaguacaucguccuccccaccggcuacugcggccagcccaagaagggccaccucaucuucgacgccugcuucgaguccggcaaccucggccgcgucgaccaggucuccgaguucgaguacgaccucuucauccgccccgacaccugcaacccccgcuuccgcgucugguucaacuucaccgucgagaacgucaaggagucccagguccgcgagaucgucgacaccuuccgcgucguccuccgcgucaucuucaacaucgucaacuucuccaagaccaagucccucuaccgcgacggcauggcccccauggucaaguccaccucccgccccaaguggcagcgccucccccccaagaacgucuacuacuaccgcugccccgaccaccgcaagaacuacgucauguccuucgccuucugcuucgaccgcgaggaggacaucuaccaguucgccuacugcuaccccuacaccuacacccgcuuccagcacuaccucgacucccuccagaagcgcaacauggacuacuucuuccgcgagcagcucggccaguccguccagcagcgcaagcucgaccuccucaccaucaccucccccgacaaccuccgcgagggcgccgagcagaaggucgucuucaucaccggccgcguccaccccggcgagacccccuccuccuucgucugccagggcaucaucgacuuccucgucucccagcaccccaucgccugcguccuccgcgaguaccucgucuucaagaucgcccccaugcucaaccccgacggcgucuaccucggcaacuaccgcugcucccucaugggcuucgaccucaaccgccacuggcucgaccccucccccuggguccaccccacccuccacggcgucaagcagcucaucguccagauguacaacgaccccaagaccucccucgaguucuacaucgacauccacgcccacuccaccaugaugaacggcuucauguacggcaacaucuucgaggacgaggagcgcuuccagcgccaggccaucuuccccaagcuccucugccagaacgccgaggacuucuccuacuccuccaccuccuucaaccgcgacgccgucaaggccggcaccggccgccgcuuccucggcggccuccucgaccacaccuccuacugcuacacccucgaggucuccuucuacuccuacaucaucuccggcaccaccgccgccguccccuacaccgaggaggccuacaugaagcucggccgcaacgucgcccgcaccuuccucgacuacuaccgccucaaccccgucgucgagaaggucgccauccccaugccccgccuccgcaaggagaaguccccccccuacaagcacccccuccuccgcggccccgccuccaacuaccccaacuccaagggcgacaagaaguccuccgucaaccacaaggaccccuccacccccuucuga

SEQ ID NO: 39509 - RNA, 1215 nt, Artificial Sequence
  derived and/or modified sequence opt2 from AGER__Homo_sapiens__NP_001127
auggccgccggcaccgccgucggcgccuggguccucguccucucccucuggggcgccgucgucggcgcccagaacaucaccgcccgcaucggcgagccccucguccucaagugcaagggcgcccccaagaagcccccccagcgccucgaguggaagcucaacaccggccgcaccgaggccuggaagguccucuccccccagggcggcggccccugggacuccgucgcccgcguccuccccaacggcucccucuuccuccccgccgucggcauccaggacgagggcaucuuccgcugccaggccaugaaccgcaacggcaaggagaccaaguccaacuaccgcguccgcgucuaccagauccccggcaagcccgagaucgucgacuccgccuccgagcucaccgccggcguccccaacaaggucggcaccugcgucuccgagggcuccuaccccgccggcacccucuccuggcaccucgacggcaagccccucguccccaacgagaagggcgucuccgucaaggagcagacccgccgccaccccgagaccggccucuucacccuccaguccgagcucauggucacccccgcccgcggcggcgacccccgccccaccuucuccugcuccuucucccccggccucccccgccaccgcgcccuccgcaccgcccccauccagccccgcgucugggagcccgucccccucgaggagguccagcucgucgucgagcccgagggcggcgccgucgcccccggcggcaccgucacccucaccugcgagguccccgcccagcccuccccccagauccacuggaugaaggacggcgucccccucccccucccccccucccccguccucauccuccccgagaucggcccccaggaccagggcaccuacuccugcgucgccacccacuccucccacggcccccaggagucccgcgccgucuccaucuccaucaucgagcccggcgaggagggccccaccgccggcuccgucggcggcuccggccucggcacccucgcccucgcccucggcauccucggcggccucggcaccgccgcccuccucaucggcgucauccucuggcagcgccgccagcgccgcggcgaggagcgcaaggcccccgagaaccaggaggaggaggaggagcgcgccgagcucaaccaguccgaggagcccgaggccggcgaguccuccaccggcggccccuga

SEQ ID NO: 39510 - RNA, 1755 nt, Artificial Sequence
  derived and/or modified sequence opt2 from AGFG1__Homo_sapiens__NP_001128659
auggccgccuccgccaagcgcaagcaggaggagaagcaccucaagaugcuccgcgacaugaccggccucccccacaaccgcaagugcuucgacugcgaccagcgcggccccaccuacgucaacaugaccgucggcuccuucgucugcaccuccugcuccggcucccuccgcggccucaaccccccccaccgcgucaaguccaucuccaugaccaccuucacccagcaggagaucgaguuccuccagaagcacggcaacgaggucugcaagcagaucuggcucggccucuucgacgaccgcuccuccgccauccccgacuuccgcgacccccagaaggucaaggaguuccuccaggagaaguacgagaagaagcgcugguacgucccccccgagcaggccaaggucgucgccuccguccacgccuccaucuccggcuccuccgccuccuccaccuccuccacccccgaggucaagccccucaagucccuccucggcgacuccgcccccacccuccaccucaacaagggcacccccucccagucccccgucgucggccgcucccagggccagcagcaggagaagaagcaguucgaccuccucuccgaccucggcuccgacaucuucgccgcccccgccccccaguccaccgccaccgccaacuucgccaacuucgcccacuucaacucccacgccgcccagaacuccgccaacgccgacuucgccaacuucgacgccuucggccaguccuccggcuccuccaacuucggcggcuuccccaccgccucccacucccccuuccagccccagaccaccgccuuccgcaugcucuccuccuccugcuccuucggcgaguucaccuccgccuucccccuccaggccacccacuccggcuccgccgccuccgucaacgccaacuucgcccacuucgacaacuuccccaaguccuccuccgccgacuucggcaccuucaacaccucccagucccaccagaccgccuccgccgucuccaaggucuccaccaacaaggccggccuccagaccgccgacaaguacgccgcccucgccaaccucgacaacaucuucuccgccggccagggcggcgaccagggcuccggcuucggcaccaccggcaaggcccccgucggcuccgucgucuccguccccucccaguccuccgccuccuccgacaaguacgccgcccucgccgagcucgacuccgucuucuccuccgccgccaccuccuccaacgccuacaccuccaccuccaacgccuccuccaacgucuucggcaccguccccgucgucgccuccgcccagacccagcccgccuccuccuccguccccgcccccuucggcgccacccccuccaccaaccccuucgucgccgccgccggccccuccgucgccuccuccaccaaccccuuccagaccaacgcccgcggcgccaccgccgccaccuucggcaccgccuccauguccaugcccaccggcuucggcacccccgcccccuacucccuccccaccuccuucuccggcuccuuccagcagcccgccuuccccgcccaggccgccuucccccagcagaccgccuucucccagcagcccaacggcuucgccgccuucggccagaccaagcccgucgucacccccuucggccaggucgccgccgccggcgucuccuccaaccccuucaugaccggcgcccccaccggccaguuccccaccggcuccuccuccaccaaccccuuccucuga

SEQ ID NO: 39511 - RNA, 1446 nt, Artificial Sequence
  derived and/or modified sequence opt2 from AGFG2__Homo_sapiens__NP_006067
auggucauggccgccaagaagggccccggccccggcggcggcgucuccggcggcaaggccgaggccgaggccgccuccgaggucuggugccgccgcguccgcgagcucggcggcugcucccaggccggcaaccgccacugcuucgagugcgcccagcgcggcgucaccuacgucgacaucaccgucggcuccuucgucugcaccaccugcuccggccuccuccgcggccucaaccccccccaccgcgucaaguccaucuccaugaccaccuucaccgagcccgaggucgucuuccuccagucccgcggcaacgaggucugccgcaagaucuggcucggccucuucgacgcccgcaccucccucguccccgacucccgcgacccccagaaggucaaggaguuccuccaggagaaguacgagaagaagcgcugguacgucccccccgaccaggucaagggccccaccuacaccaagggcuccgccuccacccccguccagggcuccauccccgagggcaagccccuccgcacccuccucggcgaccccgcccccucccucuccgucgccgccuccaccuccucccagcccgucucccagucccacgcccgcaccucccaggcccgcuccacccagccccccccccacuccuccgucaagaaggccuccaccgaccuccucgccgacaucggcggcgaccccuucgccgccccccagauggcccccgccuucgccgccuuccccgccuucggcggccagacccccucccagggcggcuucgccaacuucgacgccuucuccuccggccccuccuccuccgucuucggcucccucccccccgccggccaggccuccuuccaggcccagcccacccccgccggcuccucccagggcacccccuucggcgccaccccccucgcccccgccucccagcccaacucccucgccgacgucggcuccuuccucggccccggcguccccgccgccggcguccccuccucccucuucggcauggccggccagguccccccccuccaguccgucaccaugggcggcggcggcggcuccuccaccggccucgccuucggcgccuucaccaaccccuucaccgcccccgccgcccaguccccccuccccuccaccaaccccuuccagcccaacggccucgcccccggccccggcuucggcauguccuccgccggccccggcuucccccaggccgucccccccaccggcgccuucgccuccuccuuccccgccccccucuuccccccccagaccccccucguccagcagcagaacggcuccuccuucggcgaccucggcuccgccaagcucggccagcgcccccucucccagcccgccggcaucuccaccaaccccuucaugaccggccccuccuccucccccuucgccuccaagccccccaccaccaaccccuuccucuga

SEQ ID NO: 39512 - RNA, 2145 nt, Artificial Sequence
  derived and/or modified sequence opt2 from AGGF1__Homo_sapiens__NP_060516
auggccuccgaggcccccucccccccccgcuccccccccccccccaccucccccgagcccgagcucgcccagcuccgccgcaaggucgagaagcucgagcgcgagcuccgcuccugcaagcgccagguccgcgagaucgagaagcuccuccaccacaccgagcgccucuaccagaacgccgaguccaacaaccaggagcuccgcacccaggucgaggagcucuccaagauccuccagcgcggccgcaacgaggacaacaagaaguccgacgucgagguccagaccgagaaccacgcccccugguccaucuccgacuacuucuaccagaccuacuacaacgacgucucccuccccaacaaggucaccgagcucuccgaccagcaggaccaggccaucgagaccuccauccucaacuccaaggaccaccuccaggucgagaacgacgccuaccccggcaccgaccgcaccgagaacgucaaguaccgccaggucgaccacuucgccuccaacucccaggagcccgccuccgcccucgccaccgaggacaccucccucgagggcuccucccucgccgagucccuccgcgccgccgccgaggccgccgucucccagaccggcuucuccuacgacgagaacaccggccucuacuucgaccacuccaccggcuucuacuacgacuccgagaaccagcucuacuacgaccccuccaccggcaucuacuacuacugcgacgucgaguccggccgcuaccaguuccacucccgcgucgaccuccagcccuaccccaccuccuccaccaagcaguccaaggacaagaagcucaagaagaagcgcaaggaccccgacuccuccgccaccaacgaggagaaggaccucaacuccgaggaccagaaggccuucuccgucgagcacaccuccugcaacgaggaggagaacuucgccaacaugaagaagaaggccaagaucggcauccaccacaagaacuccccccccaaggucaccguccccaccuccggcaacaccaucgaguccccccuccacgagaacaucuccaacuccaccuccuucaaggacgagaagaucauggagaccgacuccgagcccgaggagggcgagaucaccgacucccagaccgaggacuccuacgacgaggccaucaccuccgagggcaacgucaccgccgaggacuccgaggacgaggacgaggacaagaucuggccccccugcauccgcgucaucgucauccgcucccccguccuccagaucggcucccucuucaucaucaccgccgucaaccccgccaccaucggccgcgagaaggacauggagcacacccuccgcauccccgaggucggcgucuccaaguuccacgccgagaucuacuucgaccacgaccuccaguccuacguccucgucgaccagggcucccagaacggcaccaucgucaacggcaagcagauccuccagcccaagaccaagugcgaccccuacguccucgagcacggcgacgaggucaagaucggcgagaccguccucuccuuccacauccaccccggcuccgacaccugcgacggcugcgagcccggccagguccgcgcccaccuccgccucgacaagaaggacgaguccuucgucggccccacccucuccaaggaggagaaggagcucgagcgccgcaaggagcucaagaagauccgcgucaaguacggccuccagaacaccgaguacgaggacgagaagacccucaagaaccccaaguacaaggaccgcgccggcaagcgccgcgagcaggucggcuccgagggcaccuuccagcgcgacgacgcccccgccuccguccacuccgagaucaccgacuccaacaagggccgcaagaugcucgagaagaugggcuggaagaagggcgagggccucggcaaggacggcggcggcaugaagacccccauccagcuccagcuccgccgcacccacgccggccucggcaccggcaagcccuccuccuucgaggacguccaccuccuccagaacaagaacaagaagaacugggacaaggcccgcgagcgcuucaccgagaacuuccccgagaccaagccccagaaggacgaccccggcaccaugcccugggucaagggcacccucgaguga

SEQ ID NO: 39513 - RNA, 1053 nt, Artificial Sequence
  derived and/or modified sequence opt2 from AGK__Homo_sapiens__XP_005250080
augaccgucuucuucaagacccuccgcaaccacuggaagaagaccaccgccggccucugccuccucaccuggggcggccacuggcucuacggcaagcacugcgacaaccuccuccgccgcgccgccugccaggaggcccaggucuucggcaaccagcucaucccccccaacgcccaggucaagaaggccaccgucuuccucaaccccgccgccugcaagggcaaggcccgcacccucuucgagaagaacgccgcccccauccuccaccucuccggcauggacgucaccaucgucaagaccgacuacgagggccaggccaagaagcuccucgagcucauggagaacaccgacgucaucaucgucgccggcggcgacggcacccuccaggaggucgucaccggcguccuccgccgcaccgacgaggccaccuucuccaagauccccaucggcuucaucccccucggcgagaccuccucccucucccacacccucuucgccgaguccggcaacaagguccagcacaucaccgacgccacccucgccaucgucaagggcgagaccgucccccucgacguccuccagaucaagggcgagaaggagcagcccgucuucgccaugaccggccuccgcuggggcuccuuccgcgacgccggcgucaaggucuccaaguacugguaccucggcccccucaagaucaaggccgcccacuucuucuccacccucaaggaguggccccagacccaccaggccuccaucuccuacaccggccccaccgagcgcccccccaacgagcccgaggagacccccguccagcgccccucccucuaccgccgcauccuccgccgccucgccuccuacugggcccagccccaggacgcccucucccaggaggucucccccgaggucuggaaggacguccagcucuccaccaucgagcucuccaucaccacccgcaacaaccagcucgaccccaccuccaaggaggacuuccucaacaucugcaucgagcccgacaccaucuccaagggcgacuucaucaccaucggcaaguga

SEQ ID NO: 39514 - RNA, 1338 nt, Artificial Sequence
  derived and/or modified sequence opt2 from AGMO__Homo_sapiens__NP_001004320
augaagaaccccgaggcccagcaggacgucuccgucucccagggcuuccgcaugcucuucuacaccaugaagcccuccgagaccuccuuccagacccucgaggagguccccgacuacgucaagaaggccacccccuucuucaucucccucaugcuccucgagcucgucgucuccuggauccucaagggcaagccccccggccgccucgacgacgcccucaccuccaucuccgccggcguccucucccgccuccccucccucuucuuccgcuccaucgagcucaccuccuacaucuacaucugggagaacuaccgccucuucaaccuccccugggacucccccuggaccugguacuccgccuuccucggcgucgacuucggcuacuacugguuccaccgcauggcccacgaggucaacaucaugugggccggccaccagacccaccacuccuccgaggacuacaaccucuccaccgcccuccgccaguccguccuccagaucuacaccuccuggaucuucuacuccccccucgcccucuucaucccccccuccgucuacgccguccaccuccaguucaaccuccucuaccaguucuggauccacaccgaggucaucaacaaccucggcccccucgagcucauccucaacacccccucccaccaccgcguccaccacggccgcaaccgcuacugcaucgacaagaacuacgccggcguccucaucaucugggacaagaucuucggcaccuucgaggccgagaacgagaaggucgucuacggccucacccaccccaucaacaccuucgagcccaucaagguccaguuccaccaccucuucuccaucuggaccaccuucugggccacccccggcuucuucaacaaguucuccgucaucuucaagggccccggcuggggccccggcaagccccgccucggccucuccgaggagauccccgaggucaccggcaaggagguccccuucuccuccuccuccucccagcuccucaagaucuacaccgucguccaguucgcccucaugcucgccuucuacgaggagaccuucgccgacaccgccgcccucucccaggucacccuccuccuccgcgucugcuucaucauccucacccucaccuccaucggcuuccuccucgaccagcgccccaaggccgccaucauggagacccuccgcugccucauguuccucaugcucuaccgcuucggccaccucaagccccucguccccucccucuccuccgccuucgagaucgucuucuccaucugcaucgccuucuggggcguccgcuccaugaagcagcucaccucccaccccuggaaguga

SEQ ID NO: 39515 - RNA, 2478 nt, Artificial Sequence
  derived and/or modified sequence opt2 from AGO2__Homo_sapiens__NP_001158095
auguacuccggcgccggccccgcccucgccccccccgccccccccccccccauccagggcuacgccuucaagccccccccccgccccgacuucggcaccuccggccgcaccaucaagcuccaggccaacuucuucgagauggacauccccaagaucgacaucuaccacuacgagcucgacaucaagcccgagaagugcccccgccgcgucaaccgcgagaucgucgagcacaugguccagcacuucaagacccagaucuucggcgaccgcaagcccgucuucgacggccgcaagaaccucuacaccgccaugccccuccccaucggccgcgacaaggucgagcucgaggucacccuccccggcgagggcaaggaccgcaucuucaaggucuccaucaagugggucuccugcgucucccuccaggcccuccacgacgcccucuccggccgccuccccuccguccccuucgagaccauccaggcccucgacgucgucaugcgccaccuccccuccaugcgcuacacccccgucggccgcuccuucuucaccgccuccgagggcugcuccaacccccucggcggcggccgcgaggucugguucggcuuccaccaguccguccgccccucccucuggaagaugaugcucaacaucgacgucuccgccaccgccuucuacaaggcccagcccgucaucgaguucgucugcgagguccucgacuucaaguccaucgaggagcagcagaagccccucaccgacucccagcgcgucaaguucaccaaggagaucaagggccucaaggucgagaucacccacugcggccagaugaagcgcaaguaccgcgucugcaacgucacccgccgccccgccucccaccagaccuucccccuccagcaggaguccggccagaccgucgagugcaccgucgcccaguacuucaaggaccgccacaagcucguccuccgcuacccccaccuccccugccuccaggucggccaggagcagaagcacaccuaccucccccucgaggucugcaacaucgucgccggccagcgcugcaucaagaagcucaccgacaaccagaccuccaccaugauccgcgccaccgcccgcuccgcccccgaccgccaggaggagaucuccaagcucaugcgcuccgccuccuucaacaccgaccccuacguccgcgaguucggcaucauggucaaggacgagaugaccgacgucaccggccgcguccuccagccccccuccauccucuacggcggccgcaacaaggccaucgccacccccguccagggcgucugggacaugcgcaacaagcaguuccacaccggcaucgagaucaaggucugggccaucgccugcuucgccccccagcgccagugcaccgagguccaccucaaguccuucaccgagcagcuccgcaagaucucccgcgacgccggcaugcccauccagggccagcccugcuucugcaaguacgcccagggcgccgacuccgucgagcccauguuccgccaccucaagaacaccuacgccggccuccagcucgucgucgucauccuccccggcaagacccccgucuacgccgaggucaagcgcgucggcgacaccguccucggcauggccacccagugcguccagaugaagaacguccagcgcaccaccccccagacccucuccaaccucugccucaagaucaacgucaagcucggcggcgucaacaacauccuccucccccagggccgcccccccgucuuccagcagcccgucaucuuccucggcgccgacgucacccacccccccgccggcgacggcaagaagcccuccaucgccgccgucgucggcuccauggacgcccaccccaaccgcuacugcgccaccguccgcguccagcagcaccgccaggagaucauccaggaccucgccgccaugguccgcgagcuccucauccaguucuacaaguccacccgcuucaagcccacccgcaucaucuucuaccgcgacggcgucuccgagggccaguuccagcagguccuccaccacgagcuccucgccauccgcgaggccugcaucaagcucgagaaggacuaccagcccggcaucaccuucaucgucguccagaagcgccaccacacccgccucuucugcaccgacaagaacgagcgcggcaccucccgccccucccacuaccacguccucugggacgacaaccgcuucuccuccgacgagcuccagauccucaccuaccagcucugccacaccuacguccgcugcacccgcuccgucuccauccccgcccccgccuacuacgcccaccucgucgccuuccgcgcccgcuaccaccucgucgacaaggagcacgacuccgccgagggcucccacaccuccggccaguccaacggccgcgaccaccaggcccucgccaaggccguccagguccaccaggacacccuccgcaccauguacuucgccuga

SEQ ID NO: 39516 - RNA, 864 nt, Artificial Sequence
  derived and/or modified sequence opt2 from AGPAT1__Homo_sapiens__XP_005248862
auggucgcccgcauggaccucuggcccggcgccuggaugcuccuccuccuccucuuccuccuccuccucuuccuccuccccacccucugguucugcucccccuccgccaaguacuucuucaagauggccuucuacaacggcuggauccucuuccucgccguccucgccauccccgucugcgccguccgcggccgcaacgucgagaacaugaagauccuccgccucaugcuccuccacaucaaguaccucuacggcauccgcgucgagguccgcggcgcccaccacuucccccccucccagcccuacgucgucgucuccaaccaccaguccucccucgaccuccucggcaugauggagguccuccccggccgcugcguccccaucgccaagcgcgagcuccucugggccggcuccgccggccucgccugcuggcucgccggcgucaucuucaucgaccgcaagcgcaccggcgacgccaucuccgucauguccgaggucgcccagacccuccucacccaggacguccgcgucugggucuuccccgagggcacccgcaaccacaacggcuccaugcuccccuucaagcgcggcgccuuccaccucgccguccaggcccagguccccaucguccccaucgucauguccuccuaccaggacuucuacugcaagaaggagcgccgcuucaccuccggccagugccagguccgcguccucccccccguccccaccgagggccucacccccgacgacguccccgcccucgccgaccgcguccgccacuccaugcucaccgucuuccgcgagaucuccaccgacggccgcggcggcggcgacuaccucaagaagcccggcggcggcggcuga

SEQ ID NO: 39517 - RNA, 741 nt, Artificial Sequence
  derived and/or modified sequence opt2 from AGPAT2__Homo_sapiens__NP_001012745
auggagcucuggcccugccucgccgccgcccuccuccuccuccuccuccucguccagcucucccgcgccgccgaguucuacgccaaggucgcccucuacugcgcccucugcuucaccgucuccgccgucgccucccucgucugccuccuccgccacggcggccgcaccgucgagaacauguccaucaucggcugguucguccgcuccuucaaguacuucuacggccuccgcuucgagguccgcgacccccgccgccuccaggaggcccgccccugcgucaucgucuccaaccaccaguccauccucgacaugaugggccucauggagguccuccccgagcgcugcguccagaucgccaagcgcgagcuccucuuccucggccccgucggccucaucauguaccucggcggcgucuucuucaucaaccgccagcgcuccuccaccgccaugaccgucauggccgaccucggcgagcgcaugguccgcgagaacguccccaucguccccgucgucuacuccuccuucuccuccuucuacaacaccaagaagaaguucuucaccuccggcaccgucaccguccagguccucgaggccauccccaccuccggccucaccgccgccgacguccccgcccucgucgacaccugccaccgcgccaugcgcaccaccuuccuccacaucuccaagaccccccaggagaacggcgccaccgccggcuccggcguccagcccgcccaguga

SEQ ID NO: 39518 - RNA, 1131 nt, Artificial Sequence
  derived and/or modified sequence opt2 from AGPAT3__Homo_sapiens__XP_006724093
augggccuccucgccuuccucaagacccaguucguccuccaccuccucgucggcuucgucuucgucgucuccggccucgucaucaacuucguccagcucugcacccucgcccucuggcccgucuccaagcagcucuaccgccgccucaacugccgccucgccuacucccucuggucccagcucgucaugcuccucgaguggugguccugcaccgagugcacccucuucaccgaccaggccaccgucgagcgcuucggcaaggagcacgccgucaucauccucaaccacaacuucgagaucgacuuccucugcggcuggaccaugugcgagcgcuucggcguccucggcuccuccaagguccucgccaagaaggagcuccucuacgucccccucaucggcuggaccugguacuuccucgagaucgucuucugcaagcgcaagugggaggaggaccgcgacaccgucgucgagggccuccgccgccucuccgacuaccccgaguacaugugguuccuccucuacugcgagggcacccgcuucaccgagaccaagcaccgcgucuccauggaggucgccgccgccaagggccuccccguccucaaguaccaccuccucccccgcaccaagggcuucaccaccgccgucaagugccuccgcggcaccgucgccgccgucuacgacgucacccucaacuuccgcggcaacaagaaccccucccuccucggcauccucuacggcaagaaguacgaggccgacaugugcguccgccgcuucccccucgaggacaucccccucgacgagaaggaggccgcccaguggcuccacaagcucuaccaggagaaggacgcccuccaggagaucuacaaccagaagggcauguuccccggcgagcaguucaagcccgcccgccgccccuggacccuccucaacuuccucuccugggccaccauccuccucuccccccucuucuccuucguccucggcgucuucgccuccggcuccccccuccucauccucaccuuccucggcuucgucggcgccgccuccuucggcguccgccgccucaucggcgucaccgagaucgagaagggcuccuccuacggcaaccaggaguucaagaagaaggaguga

SEQ ID NO: 39519 - RNA, 1137 nt, Artificial Sequence
  derived and/or modified sequence opt2 from AGPAT4__Homo_sapiens__NP_064518
auggaccucgccggccuccucaagucccaguuccucugccaccucgucuucugcuacgucuucaucgccuccggccucaucaucaacaccauccagcucuucacccuccuccucuggcccaucaacaagcagcucuuccgcaagaucaacugccgccucuccuacugcaucuccucccagcucgucaugcuccucgaguggugguccggcaccgagugcaccaucuucaccgacccccgcgccuaccucaaguacggcaaggagaacgccaucgucguccucaaccacaaguucgagaucgacuuccucugcggcuggucccucuccgagcgcuucggccuccucggcggcuccaagguccucgccaagaaggagcucgccuacguccccaucaucggcuggaugugguacuucaccgagauggucuucugcucccgcaagugggagcaggaccgcaagaccgucgccaccucccuccagcaccuccgcgacuaccccgagaaguacuucuuccucauccacugcgagggcacccgcuucaccgagaagaagcacgagaucuccaugcaggucgcccgcgccaagggccucccccgccucaagcaccaccuccucccccgcaccaagggcuucgccaucaccguccgcucccuccgcaacgucgucuccgccgucuacgacugcacccucaacuuccgcaacaacgagaaccccacccuccucggcguccucaacggcaagaaguaccacgccgaccucuacguccgccgcaucccccucgaggacauccccgaggacgacgacgagugcuccgccuggcuccacaagcucuaccaggagaaggacgccuuccaggaggaguacuaccgcaccggcaccuuccccgagacccccaugguccccccccgccgccccuggacccucgucaacuggcucuucugggccucccucguccucuaccccuucuuccaguuccucgucuccaugauccgcuccggcuccucccucacccucgccuccuucauccucgucuucuucgucgccuccgucggcguccgcuggaugaucggcgucaccgagaucgacaagggcuccgccuacggcaacuccgacuccaagcagaagcucaacgacuga

SEQ ID NO: 39520 - RNA, 1305 nt, Artificial Sequence
  derived and/or modified sequence opt2 from AGPAT9__Homo_sapiens__NP_001243350
auggagggcgccgagcucgccggcaagauccucuccaccuggcucacccucguccucggcuucauccuccuccccuccgucuucggcgucucccucggcaucuccgagaucuacaugaagauccucgucaagacccucgagugggccaccauccgcaucgagaagggcacccccaaggaguccauccucaagaacuccgccuccgucggcaucauccagcgcgacgagucccccauggagaagggccucuccggccuccgcggccgcgacuucgagcucuccgacgucuucuacuucuccaagaagggccucgaggccaucgucgaggacgaggucacccagcgcuucuccuccgaggagcucgucuccuggaaccuccucacccgcaccaacgucaacuuccaguacaucucccuccgccucaccauggucuggguccucggcgucaucguccgcuacugcguccuccucccccuccgcgucacccucgccuucaucggcaucucccuccucgucaucggcaccacccucgucggccagcuccccgacuccucccucaagaacuggcucuccgagcucguccaccucaccugcugccgcaucugcguccgcgcccucuccggcaccauccacuaccacaacaagcaguaccgcccccagaagggcggcaucugcgucgccaaccacaccucccccaucgacguccucauccucaccaccgacggcugcuacgccauggucggccagguccacggcggccucaugggcaucauccagcgcgccauggucaaggccugcccccacgucugguucgagcgcuccgagaugaaggaccgccaccucgucaccaagcgccucaaggagcacaucgccgacaagaagaagcuccccauccucaucuuccccgagggcaccugcaucaacaacaccuccgucaugauguucaagaagggcuccuucgagaucggcggcaccauccaccccgucgccaucaaguacaacccccaguucggcgacgccuucuggaacuccuccaaguacaacauggucuccuaccuccuccgcaugaugaccuccugggccaucgucugcgacgucugguacaugccccccaugacccgcgaggagggcgaggacgccguccaguucgccaaccgcgucaaguccgccaucgccauccagggcggccucaccgagcuccccugggacggcggccucaagcgcgccaaggucaaggacaucuucaaggaggagcagcagaagaacuacuccaagaugaucgucggcaacggcucccucuccuga

SEQ ID NO: 39521 - RNA, 1977 nt, Artificial Sequence
  derived and/or modified sequence opt2 from AGPS__Homo_sapiens__NP_003650
auggccgaggccgccgccgccgccggcggcaccggccucggcgccggcgccuccuacggcuccgccgccgaccgcgaccgcgaccccgaccccgaccgcgccggccgccgccuccgcguccucuccggccaccuccucggccgcccccgcgaggcccucuccaccaacgagugcaaggcccgccgcgccgccuccgccgccaccgccgcccccaccgccacccccgccgcccaggaguccggcaccauccccaagaagcgccaggaggucaugaaguggaacggcuggggcuacaacgacuccaaguucaucuucaacaagaagggccagaucgagcucaccggcaagcgcuacccccucuccggcaugggccuccccaccuucaaggaguggauccagaacacccucggcgucaacgucgagcacaagaccaccuccaaggccucccucaaccccuccgacaccccccccuccgucgucaacgaggacuuccuccacgaccucaaggagaccaacaucuccuacucccaggaggccgacgaccgcgucuuccgcgcccacggccacugccuccacgagaucuuccuccuccgcgagggcauguucgagcgcauccccgacaucguccucuggcccaccugccacgacgacgucgucaagaucgucaaccucgccugcaaguacaaccucugcaucauccccaucggcggcggcaccuccgucuccuacggccucaugugccccgccgacgagacccgcaccaucaucucccucgacaccucccagaugaaccgcauccucugggucgacgagaacaaccucaccgcccacgucgaggccggcaucaccggccaggagcucgagcgccagcucaaggaguccggcuacugcaccggccacgagcccgacucccucgaguucuccaccgucggcggcugggucuccacccgcgccuccggcaugaagaagaacaucuacggcaacaucgaggaccucgucguccacaucaagauggucaccccccgcggcaucaucgagaaguccugccagggcccccgcauguccaccggccccgacauccaccacuucaucaugggcuccgagggcacccucggcgucaucaccgaggccaccaucaagauccgccccguccccgaguaccagaaguacggcuccgucgccuuccccaacuucgagcagggcgucgccugccuccgcgagaucgccaagcagcgcugcgcccccgccuccauccgccucauggacaacaagcaguuccaguucggccacgcccucaagccccaggucuccuccaucuucaccuccuuccucgacggccucaagaaguucuacaucaccaaguucaagggcuucgaccccaaccagcucuccgucgccacccuccucuucgagggcgaccgcgagaagguccuccagcacgagaagcaggucuacgacaucgccgccaaguucggcggccucgccgccggcgaggacaacggccagcgcggcuaccuccucaccuacgucaucgccuacauccgcgaccucgcccucgaguacuacguccucggcgaguccuucgagaccuccgcccccugggaccgcgucgucgaccucugccgcaacgucaaggagcgcaucacccgcgagugcaaggagaagggcguccaguucgcccccuucuccaccugccgcgucacccagaccuacgacgccggcgccugcaucuacuucuacuucgccuucaacuaccgcggcaucuccgacccccucaccgucuucgagcagaccgaggccgccgcccgcgaggagauccucgccaacggcggcucccucucccaccaccacggcgucggcaagcuccgcaagcaguggcucaaggaguccaucuccgacgucggcuucggcaugcucaaguccgucaaggaguacgucgaccccaacaacaucuucggcaaccgcaaccuccucuga

SEQ ID NO: 39522 - RNA, 528 nt, Artificial Sequence
  derived and/or modified sequence opt2 from AGR2__Homo_sapiens__NP_006399
auggagaagauccccgucuccgccuuccuccuccucgucgcccucuccuacacccucgcccgcgacaccaccgucaagcccggcgccaagaaggacaccaaggacucccgccccaagcucccccagacccucucccgcggcuggggcgaccagcucaucuggacccagaccuacgaggaggcccucuacaaguccaagaccuccaacaagccccucaugaucauccaccaccucgacgagugcccccacucccaggcccucaagaaggucuucgccgagaacaaggagauccagaagcucgccgagcaguucguccuccucaaccucgucuacgagaccaccgacaagcaccucucccccgacggccaguacgucccccgcaucauguucgucgaccccucccucaccguccgcgccgacaucaccggccgcuacuccaaccgccucuacgccuacgagcccgccgacaccgcccuccuccucgacaacaugaagaaggcccucaagcuccucaagaccgagcucuga

SEQ ID NO: 39523 - RNA, 501 nt, Artificial Sequence
  derived and/or modified sequence opt2 from AGR3__Homo_sapiens__NP_789783
augaugcuccacuccgcccucggccucugccuccuccucgucaccgucuccuccaaccucgccaucgccaucaagaaggagaagcgccccccccagacccucucccgcggcuggggcgacgacaucaccuggguccagaccuacgaggagggccucuucuacgcccagaaguccaagaagccccucauggucauccaccaccucgaggacugccaguacucccaggcccucaagaaggucuucgcccagaacgaggagauccaggagauggcccagaacaaguucaucaugcucaaccucaugcacgagaccaccgacaagaaccucucccccgacggccaguacgucccccgcaucauguucgucgaccccucccucaccguccgcgccgacaucgccggccgcuacuccaaccgccucuacaccuacgagccccgcgaccucccccuccucaucgagaacaugaagaaggcccuccgccucauccaguccgagcucuga

SEQ ID NO: 39524 - RNA, 4416 nt, Artificial Sequence
  derived and/or modified sequence opt2 from AGRN__Homo_sapiens__XP_011539733
augcuccacguccacgccugcacccaccagaucucccuccacgucgccuccgccggccccugcgagaccugcggcgacgccgucugcgccuucggcgccgucugcuccgccggccagugcgucugcccccgcugcgagcaccccccccccggccccgucugcggcuccgacggcgucaccuacggcuccgccugcgagcuccgcgaggccgccugccuccagcagacccagaucgaggaggcccgcgccggccccugcgagcaggccgagugcggcuccggcggcuccggcuccggcgaggacggcgacugcgagcaggagcucugccgccagcgcggcggcaucugggacgaggacuccgaggacggccccugcgucugcgacuucuccugccaguccguccccggcucccccgucugcggcuccgacggcgucaccuacuccaccgagugcgagcucaagaaggcccgcugcgagucccagcgcggccucuacgucgccgcccagggcgccugccgcggccccaccuucgccccccucccccccgucgccccccuccacugcgcccagacccccuacggcugcugccaggacaacaucaccgccgcccgcggcgucggccucgccggcugccccuccgccugccagugcaacccccacggcuccuacggcggcaccugcgaccccgccaccggccagugcuccugccgccccggcgucggcggccuccgcugcgaccgcugcgagcccggcuucuggaacuuccgcggcaucgucaccgacggccgcuccggcugcacccccugcuccugcgacccccagggcgccguccgcgacgacugcgagcagaugaccggccucugcuccugcaagcccggcgucgccggccccaagugcggccagugccccgacggccgcgcccucggccccgccggcugcgaggccgacgccuccgcccccgccaccugcgccgagaugcgcugcgaguucggcgcccgcugcgucgaggaguccggcuccgcccacugcgucugccccaugcucaccugccccgaggccaacgccaccaaggucugcggcuccgacggcgucaccuacggcaacgagugccagcucaagaccaucgccugccgccagggccuccagaucuccauccagucccucggccccugccaggaggccgucgcccccuccacccaccccaccuccgccuccgucaccgucaccacccccggccuccuccucucccaggcccuccccgccccccccggcgcccucccccucgcccccuccuccaccgcccacucccagaccacccccccccccuccucccgcccccgcaccaccgccuccgucccccgcaccaccgucuggcccguccucaccgucccccccaccgcccccucccccgcccccucccucgucgccuccgccuucggcgaguccggcuccaccgacggcuccuccgacgaggagcucuccggcgaccaggaggccuccggcggcggcuccggcggccucgagccccucgagggcuccuccgucgccacccccggcccccccgucgagcgcgccuccugcuacaacuccgcccucggcugcugcuccgacggcaagacccccucccucgacgccgagggcuccaacugccccgccaccaaggucuuccagggcguccucgagcucgagggcgucgagggccaggagcucuucuacacccccgagauggccgaccccaaguccgagcucuucggcgagaccgcccgcuccaucgaguccacccucgacgaccucuuccgcaacuccgacgucaagaaggacuuccgcuccguccgccuccgcgaccucggccccggcaaguccguccgcgccaucgucgacguccacuucgaccccaccaccgccuuccgcgcccccgacgucgcccgcgcccuccuccgccagauccaggucucccgccgccgcucccucggcguccgccgcccccuccaggagcacguccgcuucauggacuucgacugguuccccgccuucaucaccggcgccaccuccggcgccaucgccgccggcgccaccgcccgcgccaccaccgccucccgccuccccuccuccgccgucaccccccgcgccccccaccccucccacaccucccagcccgucgccaagaccaccgccgcccccaccacccgccgcccccccaccaccgcccccucccgcguccccggccgccgcccccccgccccccagcagccccccaagcccugcgacucccagcccugcuuccacggcggcaccugccaggacugggcccucggcggcggcuucaccugcuccugccccgccggccgcggcggcgccgucugcgagaagguccucggcgcccccguccccgccuucgagggccgcuccuuccucgccuuccccacccuccgcgccuaccacacccuccgccucgcccucgaguuccgcgcccucgagccccagggccuccuccucuacaacggcaacgcccgcggcaaggacuuccucgcccucgcccuccucgacggccgcguccagcuccgcuucgacaccggcuccggccccgccguccucaccuccgccguccccgucgagcccggccaguggcaccgccucgagcucucccgccacuggcgccgcggcacccucuccgucgacggcgagacccccguccucggcgagucccccuccggcaccgacggccucaaccucgacaccgaccucuucgucggcggcguccccgaggaccaggccgccgucgcccucgagcgcaccuucgucggcgccggccuccgcggcugcauccgccuccucgacgucaacaaccagcgccucgagcucggcaucggccccggcgccgccacccgcggcuccggcgucggcgagugcggcgaccaccccugccuccccaaccccugccacggcggcgcccccugccagaaccucgaggccggccgcuuccacugccagugcccccccggccgcgucggccccaccugcgccgacgagaagucccccugccagcccaaccccugccacggcgccgcccccugccgcguccuccccgagggcggcgcccagugcgagugcccccucggccgcgagggcaccuucugccagaccgccuccggccaggacggcuccggccccuuccucgccgacuucaacggcuucucccaccucgagcuccgcggccuccacaccuucgcccgcgaccucggcgagaagauggcccucgaggucgucuuccucgcccgcggccccuccggccuccuccucuacaacggccagaagaccgacggcaagggcgacuucgucucccucgcccuccgcgaccgccgccucgaguuccgcuacgaccucggcaagggcgccgccgucauccgcucccgcgagcccgucacccucggcgccuggacccgcgucucccucgagcgcaacggccgcaagggcgcccuccgcgucggcgacggcccccgcguccucggcgagucccccaagucccgcaaggucccccacaccguccucaaccucaaggagccccucuacgucggcggcgcccccgacuucuccaagcucgcccgcgccgccgccgucuccuccggcuucgacggcgccauccagcucgucucccucggcggccgccagcuccucacccccgagcacguccuccgccaggucgacgucaccuccuucgccggccaccccugcacccgcgccuccggccaccccugccucaacggcgccuccugcgucccccgcgaggccgccuacgucugccucugccccggcggcuucuccggcccccacugcgagaagggccucgucgagaaguccgccggcgacgucgacacccucgccuucgacggccgcaccuucgucgaguaccucaacgccgucaccgaguccgagaaggcccuccaguccaaccacuucgagcucucccuccgcaccgaggccacccagggccucguccucugguccggcaaggccaccgagcgcgccgacuacgucgcccucgccaucgucgacggccaccuccagcucuccuacaaccucggcucccagcccgucguccuccgcuccaccguccccgucaacaccaaccgcuggcuccgcgucgucgcccaccgcgagcagcgcgagggcucccuccaggucggcaacgaggcccccgucaccggcuccuccccccucggcgccacccagcucgacaccgacggcgcccucuggcucggcggccuccccgagcuccccgucggccccgcccuccccaaggccuacggcaccggcuucgucggcugccuccgcgacgucgucgucggccgccacccccuccaccuccucgaggacgccgucaccaagcccgagcuccgccccugccccacccccuga

SEQ ID NO: 39525 - RNA, 399 nt, Artificial Sequence
  derived and/or modified sequence opt2 from AGRP__Homo_sapiens__XP_011521229
augcucaccgccgccguccucuccugcgcccuccuccucgcccuccccgccacccgcggcgcccagaugggccucgcccccauggagggcauccgccgccccgaccaggcccuccuccccgagcuccccggccucggccuccgcgccccccucaagaagaccaccgccgagcaggccgaggaggaccuccuccaggaggcccaggcccucgccgagguccucgaccuccaggaccgcgagccccgcuccucccgccgcugcguccgccuccacgaguccugccucggccagcagguccccugcugcgaccccugcgccaccugcuacugccgcuucuucaacgccuucugcuacugccgcaagcucggcaccgccaugaaccccugcucccgcaccuga

SEQ ID NO: 39526 - RNA, 1458 nt, Artificial Sequence
  derived and/or modified sequence opt2 from AGT__Homo_sapiens__NP_000020
augcgcaagcgcgccccccaguccgagauggcccccgccggcgucucccuccgcgccaccauccucugccuccucgccugggccggccucgccgccggcgaccgcgucuacauccaccccuuccaccucgucauccacaacgaguccaccugcgagcagcucgccaaggccaacgccggcaagcccaaggaccccaccuucauccccgcccccauccaggccaagaccucccccgucgacgagaaggcccuccaggaccagcucguccucgucgccgccaagcucgacaccgaggacaagcuccgcgccgccauggucggcaugcucgccaacuuccucggcuuccgcaucuacggcaugcacuccgagcucuggggcgucguccacggcgccaccguccucucccccaccgccgucuucggcacccucgccucccucuaccucggcgcccucgaccacaccgccgaccgccuccaggccauccucggcguccccuggaaggacaagaacugcaccucccgccucgacgcccacaagguccucuccgcccuccaggccguccagggccuccucgucgcccagggccgcgccgacucccaggcccagcuccuccucuccaccgucgucggcgucuucaccgcccccggccuccaccucaagcagcccuucguccagggccucgcccucuacacccccgucguccucccccgcucccucgacuucaccgagcucgacgucgccgccgagaagaucgaccgcuucaugcaggccgucaccggcuggaagaccggcugcucccucaugggcgccuccgucgacuccacccucgccuucaacaccuacguccacuuccagggcaagaugaagggcuucucccuccucgccgagccccaggaguucugggucgacaacuccaccuccgucuccguccccaugcucuccggcaugggcaccuuccagcacugguccgacauccaggacaacuucuccgucacccagguccccuucaccgaguccgccugccuccuccucauccagccccacuacgccuccgaccucgacaaggucgagggccucaccuuccagcagaacucccucaacuggaugaagaagcucuccccccgcaccauccaccucaccaugccccagcucguccuccagggcuccuacgaccuccaggaccuccucgcccaggccgagcuccccgccauccuccacaccgagcucaaccuccagaagcucuccaacgaccgcauccgcgucggcgagguccucaacuccaucuucuucgagcucgaggccgacgagcgcgagcccaccgaguccacccagcagcucaacaagcccgagguccucgaggucacccucaaccgccccuuccucuucgccgucuacgaccaguccgccaccgcccuccacuuccucggccgcgucgccaacccccucuccaccgccuga

SEQ ID NO: 39527 - RNA, 3837 nt, Artificial Sequence
  derived and/or modified sequence opt2 from AGTPBP1__Homo_sapiens__NP_001273644
augcgcaccggcuccgccgccuccuccgccgccgccgccgccgccgccgccgccgccuccgccucccccgccaccggcgucugcaugaagacccccggcggcggccgccgcggcauccgccgcgaccccggcgccgagcccggcgccgccgcccuccgcggcccccgccagcgccccauccucucccgccucaccaacaacucccgcaucgucggccuccucgcccagcucgagaagaucaacgccgagcccuccgaguccgacaccgcccgcuacgucaccuccaagauccuccaccucgcccagucccaggagaagacccgccgcgagaugaccgccaagggcuccaccggcauggagauccuccucuccacccucgagaacaccaaggaccuccagaccacccucaacauccucuccauccucgucgagcucgucuccgccggcggcggccgccgcgucuccuuccucgucaccaagggcggcucccagauccuccuccagcuccucaugaacgccuccaaggagucccccccccacgaggaccucaugguccagauccacuccauccucgccaagaucggccccaaggacaagaaguucggcgucaaggcccgcaucaacggcgcccucaacaucacccucaaccucgucaagcagaaccuccagaaccaccgccucguccuccccugccuccagcuccuccgcgucuacuccgccaacuccgucaacuccgucucccucggcaagaacggcgucgucgagcucauguucaagaucaucggccccuucuccaagaagaacuccucccucaucaaggucgcccucgacacccucgccgcccuccucaaguccaagaccaacgcccgccgcgccgucgaccgcggcuacguccagguccuccucaccaucuacgucgacuggcaccgccacgacaaccgccaccgcaacaugcucauccgcaagggcauccuccagucccucaaguccgucaccaacaucaagcucggccgcaaggccuucaucgacgccaacggcaugaagauccucuacaacaccucccaggagugccucgccguccgcacccucgacccccucgucaacaccuccucccucaucaugcgcaagugcuuccccaagaaccgccucccccuccccaccaucaaguccuccuuccacuuccagcuccccgucauccccgucaccggccccgucgcccagcucuacucccucccccccgaggucgacgacgucgucgacgaguccgacgacaacgacgacaucgacgucgaggccgagaacgagaccgagaacgaggacgaccucgaccagaacuucaagaacgacgacaucgagaccgacaucaacaagcucaagccccagcaggagcccggccgcaccaucgaggaccucaagauguacgagcaccucuuccccgagcucgucgacgacuuccaggacuacgaccucaucuccaaggagcccaagcccuucgucuucgagggcaagguccgcggccccaucgucguccccaccgccggcgaggagaccuccggcaacuccggcaaccuccgcaaggucgucaugaaggagaacaucuccuccaagggcgacgagggcgagaagaaguccaccuucauggaccucgccaaggaggacaucaaggacaacgaccgcacccuccagcagcagcccggcgaccagaaccgcaccaucuccuccguccacggccucaacaacgacaucgucaaggcccucgaccgcaucacccuccagaacauccccucccagaccgcccccggcuucaccgccgagaugaagaaggacugcucccucccccucaccguccucaccugcgccaaggccugcccccacauggccaccugcggcaacguccucuucgagggccgcaccguccagcucggcaagcucugcugcaccggcgucgagaccgaggacgacgaggacaccgaguccaacuccuccgucgagcaggccuccgucgagguccccgacggccccacccuccacgaccccgaccucuacaucgagaucgucaagaacaccaaguccguccccgaguacuccgaggucgccuaccccgacuacuucggccacauccccccccccuucaaggagcccauccucgagcgccccuacggcguccagcgcaccaagaucgcccaggacaucgagcgccucauccaccaguccgacaucaucgaccgcgucgucuacgaccucgacaaccccaacuacaccauccccgaggagggcgacauccucaaguucaacuccaaguucgaguccggcaaccuccgcaaggucauccagauccgcaagaacgaguacgaccucauccucaacuccgacaucaacuccaaccacuaccaccagugguucuacuucgaggucuccggcaugcgccccggcgucgccuaccgcuucaacaucaucaacugcgagaaguccaacucccaguucaacuacggcaugcagccccucauguacuccguccaggaggcccucaacgcccgccccugguggauccgcaugggcaccgacaucugcuacuacaagaaccacuucucccgcuccuccgucgccgccggcggccagaagggcaaguccuacuacaccaucaccuucaccgucaacuucccccacaaggacgacgucugcuacuucgccuaccacuaccccuacaccuacuccacccuccagaugcaccuccagaagcucgaguccgcccacaacccccagcagaucuacuuccgcaaggacguccucugcgagacccucuccggcaacuccugcccccucgucaccaucaccgccaugcccgaguccaacuacuacgagcacaucugccacuuccgcaaccgccccuacgucuuccucuccgcccgcguccaccccggcgagaccaacgccuccugggucaugaagggcacccucgaguaccucauguccaacaaccccaccgcccagucccuccgcgaguccuacaucuucaagaucguccccaugcucaaccccgacggcgucaucaacggcaaccaccgcugcucccucuccggcgaggaccucaaccgccaguggcagucccccucccccgaccuccaccccaccaucuaccacgccaagggccuccuccaguaccucgccgccgucaagcgccucccccucgucuacugcgacuaccacggccacucccgcaagaagaacgucuucauguacggcugcuccaucaaggagaccgucuggcacaccaacgacaacgccaccuccugcgacgucgucgaggacaccggcuaccgcacccuccccaagauccucucccacaucgcccccgccuucugcauguccuccugcuccuucgucgucgagaaguccaaggaguccaccgcccgcgucgucgucuggcgcgagaucggcguccagcgcuccuacaccauggaguccacccucugcggcugcgaccagggcaaguacaagggccuccagaucggcacccgcgagcucgaggagaugggcgccaaguucugcgucggccuccuccgccucaagcgccucaccuccccccucgaguacaaccuccccuccucccuccucgacuucgagaacgaccucaucgaguccuccugcaaggucaccucccccaccaccuacguccucgacgaggacgagccccgcuuccucgaggaggucgacuacuccgccgaguccaacgacgagcucgacaucgagcucgccgagaacgucggcgacuacgagcccuccgcccaggaggagguccucuccgacuccgagcucucccgcaccuaccuccccuga

SEQ ID NO: 39528 - RNA, 1185 nt, Artificial Sequence
  derived and/or modified sequence opt2 from AGTR1__Homo_sapiens__NP_004826
augaagaagaugaaccacaaguccaccgacucccccaaggccccccagcuccgcggcggcgucuucgacaucgucuucgccaccaacuccacccaggucaucaagaugauccucaacuccuccaccgaggacggcaucaagcgcauccaggacgacugccccaaggccggccgccacaacuacaucuucgucaugauccccacccucuacuccaucaucuucgucgucggcaucuucggcaacucccucgucgucaucgucaucuacuucuacaugaagcucaagaccgucgccuccgucuuccuccucaaccucgcccucgccgaccucugcuuccuccucacccucccccucugggccgucuacaccgccauggaguaccgcuggcccuucggcaacuaccucugcaagaucgccuccgccuccgucuccuucaaccucuacgccuccgucuuccuccucaccugccucuccaucgaccgcuaccucgccaucguccaccccaugaagucccgccuccgccgcaccaugcucgucgccaaggucaccugcaucaucaucuggcuccucgccggccucgccucccuccccgccaucauccaccgcaacgucuucuucaucgagaacaccaacaucaccgucugcgccuuccacuacgagucccagaacuccacccuccccaucggccucggccucaccaagaacauccucggcuuccucuuccccuuccucaucauccucaccuccuacacccucaucuggaaggcccucaagaaggccuacgagauccagaagaacaagccccgcaacgacgacaucuucaagaucaucauggccaucguccucuucuucuucuucuccuggaucccccaccagaucuucaccuuccucgacguccucauccagcucggcaucauccgcgacugccgcaucgccgacaucgucgacaccgccaugcccaucaccaucugcaucgccuacuucaacaacugccucaacccccucuucuacggcuuccucggcaagaaguucaagcgcuacuuccuccagcuccucaaguacaucccccccaaggccaagucccacuccaaccucuccaccaagauguccacccucuccuaccgccccuccgacaacgucuccuccuccaccaagaagcccgcccccugcuucgaggucgaguga

SEQ ID NO: 39529 - RNA, 1092 nt, Artificial Sequence
  derived and/or modified sequence opt2 from AGTR2__Homo_sapiens__XP_011535835
augaagggcaacuccacccucgccaccaccuccaagaacaucaccuccggccuccacuucggccucgucaacaucuccggcaacaacgaguccacccucaacugcucccagaagcccuccgacaagcaccucgacgccauccccauccucuacuacaucaucuucgucaucggcuuccucgucaacaucgucgucgucacccucuucugcugccagaagggccccaagaaggucuccuccaucuacaucuucaaccucgccgucgccgaccuccuccuccucgccacccucccccucugggccaccuacuacuccuaccgcuacgacuggcucuucggccccgucaugugcaaggucuucggcuccuuccucacccucaacauguucgccuccaucuucuucaucaccugcauguccgucgaccgcuaccaguccgucaucuaccccuuccucucccagcgccgcaaccccuggcaggccuccuacaucgucccccucgucuggugcauggccugccucuccucccuccccaccuucuacuuccgcgacguccgcaccaucgaguaccucggcgucaacgccugcaucauggccuucccccccgagaaguacgcccagugguccgccggcaucgcccucaugaagaacauccucggcuucaucaucccccucaucuucaucgccaccugcuacuucggcauccgcaagcaccuccucaagaccaacuccuacggcaagaaccgcaucacccgcgaccagguccucaagauggccgccgccgucguccucgccuucaucaucugcuggcuccccuuccacguccucaccuuccucgacgcccucgccuggaugggcgucaucaacuccugcgaggucaucgccgucaucgaccucgcccuccccuucgccauccuccucggcuucaccaacuccugcgucaaccccuuccucuacugcuucgucggcaaccgcuuccagcagaagcuccgcuccgucuuccgcguccccaucaccuggcuccagggcaagcgcgaguccauguccugccgcaaguccuccucccuccgcgagauggagaccuucgucuccuga

SEQ ID NO: 39530 - RNA, 1545 nt, Artificial Sequence
  derived and/or modified sequence opt2 from AGXT2__Homo_sapiens__NP_114106
augacccucaucuggcgccaccuccuccgcccccucugccucgucaccuccgccccccgcauccucgagaugcaccccuuccucucccucggcaccucccgcaccuccgucaccaagcucucccuccacaccaagccccgcaugccccccugcgacuucaugcccgagcgcuaccagucccucggcuacaaccgcguccucgagauccacaaggagcaccucucccccgucgucaccgccuacuuccagaagccccuccuccuccaccagggccacauggaguggcucuucgacgccgagggcucccgcuaccucgacuucuucuccggcaucgucaccgucuccgucggccacugccaccccaaggucaacgccgucgcccagaagcagcucggccgccucuggcacaccuccaccgucuucuuccacccccccaugcacgaguacgccgagaagcucgccgcccuccuccccgagccccucaaggucaucuuccucgucaacuccggcuccgaggccaacgagcucgccaugcucauggcccgcgcccacuccaacaacaucgacaucaucuccuuccgcggcgccuaccacggcugcucccccuacacccucggccucaccaacgucggcaccuacaagauggagcuccccggcggcaccggcugccagcccaccaugugccccgacgucuuccgcggccccuggggcggcucccacugccgcgacucccccguccagaccauccgcaagugcuccugcgcccccgacugcugccaggccaaggaccaguacaucgagcaguucaaggacacccucuccaccuccgucgccaaguccaucgccggcuucuucgccgagcccauccagggcgucaacggcgucguccaguaccccaagggcuuccucaaggaggccuucgagcucguccgcgcccgcggcggcgucugcaucgccgacgagguccagaccggcuucggccgccucggcucccacuucuggggcuuccagacccacgacguccuccccgacaucgucaccauggccaagggcaucggcaacggcuuccccauggccgccgucaucaccacccccgagaucgccaagucccucgccaagugccuccagcacuucaacaccuucggcggcaaccccauggccugcgccaucggcuccgccguccucgaggucaucaaggaggagaaccuccaggagaacucccaggaggucggcaccuacaugcuccucaaguucgccaagcuccgcgacgaguucgagaucgucggcgacguccgcggcaagggccucaugaucggcaucgagaugguccaggacaagaucuccugccgcccccucccccgcgaggaggucaaccagauccacgaggacugcaagcacaugggccuccucgucggccgcggcuccaucuucucccagaccuuccgcaucgcccccuccaugugcaucaccaagcccgaggucgacuucgccgucgaggucuuccgcuccgcccucacccagcacauggagcgccgcgccaaguga

SEQ ID NO: 39531 - RNA, 1179 nt, Artificial Sequence
  derived and/or modified sequence opt2 from AGXT__Homo_sapiens__NP_000021
auggccucccacaagcuccucgucaccccccccaaggcccuccucaagccccucuccauccccaaccagcuccuccucggccccggccccuccaaccuccccccccgcaucauggccgccggcggccuccagaugaucggcuccauguccaaggacauguaccagaucauggacgagaucaaggagggcauccaguacgucuuccagacccgcaacccccucacccucgucaucuccggcuccggccacugcgcccucgaggccgcccucgucaacguccucgagcccggcgacuccuuccucgucggcgccaacggcaucuggggccagcgcgccgucgacaucggcgagcgcaucggcgcccgcguccaccccaugaccaaggaccccggcggccacuacacccuccaggaggucgaggagggccucgcccagcacaagcccguccuccucuuccucacccacggcgaguccuccaccggcguccuccagccccucgacggcuucggcgagcucugccaccgcuacaagugccuccuccucgucgacuccgucgccucccucggcggcaccccccucuacauggaccgccagggcaucgacauccucuacuccggcucccagaaggcccucaacgccccccccggcaccucccucaucuccuucuccgacaaggccaagaagaagauguacucccgcaagaccaagcccuucuccuucuaccucgacaucaaguggcucgccaacuucuggggcugcgacgaccagccccgcauguaccaccacaccauccccgucaucucccucuacucccuccgcgagucccucgcccucaucgccgagcagggccucgagaacuccuggcgccagcaccgcgaggccgccgccuaccuccacggccgccuccaggcccucggccuccagcucuucgucaaggaccccgcccuccgccuccccaccgucaccaccgucgccguccccgccggcuacgacuggcgcgacaucgucuccuacgucaucgaccacuucgacaucgagaucaugggcggccucggccccuccaccggcaagguccuccgcaucggccuccucggcugcaacgccacccgcgagaacgucgaccgcgucaccgaggcccuccgcgccgcccuccagcacugccccaagaagaagcucuga

SEQ ID NO: 39532 - RNA, 1299 nt, Artificial Sequence
  derived and/or modified sequence opt2 from AHCY__Homo_sapiens__NP_000678
auguccgacaagcuccccuacaaggucgccgacaucggccucgccgccuggggccgcaaggcccucgacaucgccgagaacgagaugcccggccucaugcgcaugcgcgagcgcuacuccgccuccaagccccucaagggcgcccgcaucgccggcugccuccacaugaccgucgagaccgccguccucaucgagacccucgucacccucggcgccgagguccagugguccuccugcaacaucuucuccacccaggaccacgccgccgccgccaucgccaaggccggcauccccgucuacgccuggaagggcgagaccgacgaggaguaccucuggugcaucgagcagacccucuacuucaaggacggcccccucaacaugauccucgacgacggcggcgaccucaccaaccucauccacaccaaguacccccagcuccuccccggcauccgcggcaucuccgaggagaccaccaccggcguccacaaccucuacaagaugauggccaacggcauccucaagguccccgccaucaacgucaacgacuccgucaccaaguccaaguucgacaaccucuacggcugccgcgagucccucaucgacggcaucaagcgcgccaccgacgucaugaucgccggcaaggucgccgucgucgccggcuacggcgacgucggcaagggcugcgcccaggcccuccgcggcuucggcgcccgcgucaucaucaccgagaucgaccccaucaacgcccuccaggccgccauggagggcuacgaggucaccaccauggacgaggccugccaggagggcaacaucuucgucaccaccaccggcugcaucgacaucauccucggccgccacuucgagcagaugaaggacgacgccaucgucugcaacaucggccacuucgacgucgagaucgacgucaaguggcucaacgagaacgccgucgagaaggucaacaucaagccccaggucgaccgcuaccgccucaagaacggccgccgcaucauccuccucgccgagggccgccucgucaaccucggcugcgccaugggccaccccuccuucgucauguccaacuccuucaccaaccaggucauggcccagaucgagcucuggacccaccccgacaaguaccccgucggcguccacuuccuccccaagaagcucgacgaggccgucgccgaggcccaccucggcaagcucaacgucaagcucaccaagcucaccgagaagcaggcccaguaccucggcauguccugcgacggccccuucaagcccgaccacuaccgcuacuga

SEQ ID NO: 39533 - RNA, 1833 nt, Artificial Sequence
  derived and/or modified sequence opt2 from AHCYL2__Homo_sapiens__NP_001124192
auguccguccaggucgucuccgccgccgccgccgccaagguccccgaggucgagcucaaggaccucucccccuccgaggccgagucccagcucggccucuccaccgccgccgucggcgccauggccccccccgccggcggcggcgaccccgaggcccccgcccccgccgccgagcgcccccccguccccggccccggcuccggccccgccgccgcccucucccccgccgccggcaaggucccccaggccuccgccaugaagcgcuccgacccccaccaccagcaccagcgccaccgcgacggcggcgaggcccucgucucccccgacggcaccgucaccgaggccccccgcaccgucaagaagauccaguucgccgaccagaagcaggaguucaacaagcgccccaccaagaucggccgccgcucccucucccgcuccaucucccaguccuccaccgacuccuacuccuccgccgccuccuacaccgacuccuccgacgacgagaccuccccccgcgacaagcagcagaagaacuccaagggcuccuccgacuucugcgucaagaacaucaagcaggccgaguucggccgccgcgagaucgagaucgccgagcaggagaugcccgcccucauggcccuccgcaagcgcgcccagggcgagaagccccucgccggcgccaagaucgucggcugcacccacaucaccgcccagaccgccguccucauggagacccucggcgcccucggcgcccagugccgcugggccgccugcaacaucuacuccacccucaacgaggucgccgccgcccucgccgaguccggcuuccccgucuucgccuggaagggcgaguccgaggacgacuucugguggugcaucgaccgcugcgucaacgucgagggcuggcagcccaacaugauccucgacgacggcggcgaccucacccacuggaucuacaagaaguaccccaacauguucaagaagaucaagggcaucgucgaggaguccgucaccggcguccaccgccucuaccagcucuccaaggccggcaagcucugcguccccgccaugaacgucaacgacuccgucaccaagcagaaguucgacaaccucuacugcugccgcgaguccauccucgacggccucaagcgcaccaccgacaugauguucggcggcaagcaggucgucgucugcggcuacggcgaggucggcaagggcugcugcgccgcccucaaggccaugggcuccaucgucuacgucaccgagaucgaccccaucugcgcccuccaggccugcauggacggcuuccgccucgucaagcucaacgaggucauccgccaggucgacaucgucaucaccugcaccggcaacaagaacgucgucacccgcgagcaccucgaccgcaugaagaacuccugcaucgucugcaacaugggccacuccaacaccgagaucgacgucgccucccuccgcacccccgagcucaccugggagcgcguccgcucccaggucgaccacgucaucuggcccgacggcaagcgcaucguccuccucgccgagggccgccuccucaaccucuccugcuccaccguccccaccuucguccucuccaucaccgccaccacccaggcccucgcccucaucgagcucuacaacgcccccgagggccgcuacaagcaggacgucuaccuccuccccaagaagauggacgaguacgucgccucccuccaccuccccaccuucgacgcccaccucaccgagcucaccgacgagcaggccaaguaccucggccucaacaagaacggccccuucaagcccaacuacuaccgcuacuga

SEQ ID NO: 39534 - RNA, 3162 nt, Artificial Sequence
  derived and/or modified sequence opt2 from AHI1__Homo_sapiens__NP_001128304
augcccaccgccgaguccgaggccaaggucaagaccaagguccgcuucgaggagcuccucaagacccacuccgaccucaugcgcgagaagaagaagcucaagaagaagcucguccgcuccgaggagaacaucucccccgacaccauccgcuccaaccuccacuacaugaaggagaccaccuccgacgaccccgacaccauccgcuccaaccucccccacaucaaggagaccaccuccgacgacgucuccgccgccaacaccaacaaccucaagaaguccacccgcgucaccaagaacaagcuccgcaacacccagcucgccaccgagaaccccaacggcgacgccuccgucgaggaggacaagcagggcaagcccaacaagaaggucaucaagaccgucccccagcucaccacccaggaccucaagcccgagacccccgagaacaaggucgacuccacccaccagaagacccacaccaagccccagcccggcgucgaccaccagaaguccgagaaggccaacgagggccgcgaggagaccgaccucgaggaggacgaggagcucaugcaggccuaccagugccacgucaccgaggagauggccaaggagaucaagcgcaagauccgcaagaagcucaaggagcagcucaccuacuuccccuccgacacccucuuccacgacgacaagcucuccuccgagaagcgcaagaagaagaaggagguccccgucuucuccaaggccgagaccuccacccucaccaucuccggcgacaccgucgagggcgagcagaagaaggaguccuccguccgcuccgucuccuccgacucccaccaggacgacgagaucuccuccauggagcaguccaccgaggacuccaugcaggacgacaccaagcccaagcccaagaagaccaagaagaagaccaaggccgucgccgacaacaacgaggacgucgacggcgacggcguccacgagaucaccucccgcgacucccccgucuaccccaagugccuccucgacgacgaccucguccucggcgucuacauccaccgcaccgaccgccucaaguccgacuucaugaucucccaccccauggucaagauccacgucgucgacgagcacaccggccaguacgucaagaaggacgacuccggccgccccgucuccuccuacuacgagaaggagaacgucgacuacauccuccccaucaugacccagcccuacgacuucaagcagcucaagucccgccuccccgagugggaggagcagaucgucuucaacgagaacuuccccuaccuccuccgcggcuccgacgagucccccaaggucauccucuucuucgagauccucgacuuccucuccgucgacgagaucaagaacaacuccgagguccagaaccaggagugcggcuuccgcaagaucgccugggccuuccucaagcuccucggcgccaacggcaacgccaacaucaacuccaagcuccgccuccagcucuacuacccccccaccaagccccgcuccccccucuccgucgucgaggccuucgaguggugguccaagugcccccgcaaccacuaccccuccacccucuacgucaccguccgcggccucaagguccccgacugcaucaagcccuccuaccgcuccaugauggcccuccaggaggagaagggcaagcccguccacugcgagcgccaccacgaguccuccuccgucgacaccgagcccggccucgaggaguccaaggaggucaucaaguggaagcgccuccccggccaggccugccgcauccccaacaagcaccucuucucccucaacgccggcgagcgcggcugcuucugccucgacuucucccacaacggccgcauccucgccgccgccugcgccucccgcgacggcuaccccaucauccucuacgagauccccuccggccgcuucaugcgcgagcucugcggccaccucaacaucaucuacgaccucuccugguccaaggacgaccacuacauccucaccuccuccuccgacggcaccgcccgcaucuggaagaacgagaucaacaacaccaacaccuuccgcguccucccccaccccuccuucgucuacaccgccaaguuccaccccgccguccgcgagcucgucgucaccggcugcuacgacuccaugauccgcaucuggaaggucgagaugcgcgaggacuccgccauccucguccgccaguucgacguccacaaguccuucaucaacucccucugcuucgacaccgagggccaccacauguacuccggcgacugcaccggcgucaucgucgucuggaacaccuacgucaagaucaacgaccucgagcacuccguccaccacuggaccaucaacaaggagaucaaggagaccgaguucaagggcauccccaucuccuaccucgagauccaccccaacggcaagcgccuccucauccacaccaaggacuccacccuccgcaucauggaccuccgcauccucgucgcccgcaaguucgucggcgccgccaacuaccgcgagaagauccacuccacccucacccccugcggcaccuuccucuucgccggcuccgaggacggcaucgucuacgucuggaaccccgagaccggcgagcaggucgccauguacuccgaccuccccuucaagucccccauccgcgacaucuccuaccaccccuucgagaacauggucgccuucugcgccuucggccagaacgagcccauccuccucuacaucuacgacuuccacgucgcccagcaggaggccgagauguucaagcgcuacaacggcaccuucccccuccccggcauccaccagucccaggacgcccucugcaccugccccaagcucccccaccagggcuccuuccagaucgacgaguucguccacaccgaguccuccuccaccaagaugcagcucgucaagcagcgccucgagaccgucaccgaggucauccgcuccugcgccgccaaggucaacaagaaccucuccuucaccuccccccccgccgucuccucccagcaguccaagcucaagcaguccaacaugcucaccgcccaggagauccuccaccaguucggcuucacccagaccgacucccacuucgccgaguucaacaccugcauccucugguggaagaagcacuga

SEQ ID NO: 39535 - RNA, 450 nt, Artificial Sequence
  derived and/or modified sequence opt2 from AHNAK__Homo_sapiens__NP_076965
auggagaaggaggagaccacccgcgagcuccuccuccccaacuggcagggcuccggcucccacggccucaccaucgcccagcgcgacgacggcgucuucguccaggaggucacccagaacucccccgccgcccgcaccggcgucgucaaggagggcgaccagaucgucggcgccaccaucuacuucgacaaccuccaguccggcgaggucacccagcuccucaacaccaugggccaccacaccgucggccucaagcuccaccgcaagggcgaccgcucccccgagcccggccagaccuggacccgcgaggucuucuccuccugcuccuccgaggucguccucaacaccccccagcccuccgcccucgagugcaaggaccagaacaagcagaaggaggccuccucccaggccggcgccgucuccgucuccacccccaacgccggccucuga

SEQ ID NO: 39536 - RNA, 2547 nt, Artificial Sequence
  derived and/or modified sequence opt2 from AHR__Homo_sapiens__NP_001612
augaacuccuccuccgccaacaucaccuacgccucccgcaagcgccgcaagcccguccagaagaccgucaagcccauccccgccgagggcaucaaguccaaccccuccaagcgccaccgcgaccgccucaacaccgagcucgaccgccucgccucccuccuccccuucccccaggacgucaucaacaagcucgacaagcucuccguccuccgccucuccgucuccuaccuccgcgccaaguccuucuucgacgucgcccucaaguccucccccaccgagcgcaacggcggccaggacaacugccgcgccgccaacuuccgcgagggccucaaccuccaggagggcgaguuccuccuccaggcccucaacggcuucguccucgucgucaccaccgacgcccucgucuucuacgccuccuccaccauccaggacuaccucggcuuccagcaguccgacgucauccaccaguccgucuacgagcucauccacaccgaggaccgcgccgaguuccagcgccagcuccacugggcccucaaccccucccagugcaccgaguccggccagggcaucgaggaggccaccggccucccccagaccgucgucugcuacaaccccgaccagaucccccccgagaacuccccccucauggagcgcugcuucaucugccgccuccgcugccuccucgacaacuccuccggcuuccucgccaugaacuuccagggcaagcucaaguaccuccacggccagaagaagaagggcaaggacggcuccauccuccccccccagcucgcccucuucgccaucgccaccccccuccagccccccuccauccucgagauccgcaccaagaacuucaucuuccgcaccaagcacaagcucgacuucacccccaucggcugcgacgccaagggccgcaucguccucggcuacaccgaggccgagcucugcacccgcggcuccggcuaccaguucauccacgccgccgacaugcucuacugcgccgagucccacauccgcaugaucaagaccggcgaguccggcaugaucgucuuccgccuccucaccaagaacaaccgcuggaccuggguccaguccaacgcccgccuccucuacaagaacggccgccccgacuacaucaucgucacccagcgcccccucaccgacgaggagggcaccgagcaccuccgcaagcgcaacaccaagcuccccuucauguucaccaccggcgaggccguccucuacgaggccaccaaccccuuccccgccaucauggacccccucccccuccgcaccaagaacggcaccuccggcaaggacuccgccaccaccuccacccucuccaaggacucccucaaccccuccucccuccucgccgccaugaugcagcaggacgaguccaucuaccucuaccccgccuccuccaccuccuccaccgcccccuucgagaacaacuucuucaacgaguccaugaacgagugccgcaacuggcaggacaacaccgcccccaugggcaacgacaccauccucaagcacgagcagaucgaccagccccaggacgucaacuccuucgccggcggccaccccggccucuuccaggacuccaagaacuccgaccucuacuccaucaugaagaaccucggcaucgacuucgaggacauccgccacaugcagaacgagaaguucuuccgcaacgacuucuccggcgaggucgacuuccgcgacaucgaccucaccgacgagauccucaccuacguccaggacucccucuccaagucccccuucauccccuccgacuaccagcagcagcagucccucgcccucaacuccuccugcaugguccaggagcaccuccaccucgagcagcagcagcagcaccaccagaagcaggucgucgucgagccccagcagcagcucugccagaagaugaagcacaugcaggucaacggcauguucgagaacuggaacuccaaccaguucguccccuucaacugcccccagcaggacccccagcaguacaacgucuucaccgaccuccacggcaucucccaggaguuccccuacaaguccgagauggacuccaugcccuacacccagaacuucaucuccugcaaccagcccguccucccccagcacuccaagugcaccgagcucgacuaccccaugggcuccuucgagcccucccccuaccccaccaccuccucccucgaggacuucgucaccugccuccagcuccccgagaaccagaagcacggccucaacccccaguccgccaucaucaccccccagaccugcuacgccggcgccgucuccauguaccagugccagcccgagccccagcacacccacgucggccagaugcaguacaaccccguccuccccggccagcaggccuuccucaacaaguuccagaacggcguccucaacgagaccuaccccgccgagcucaacaacaucaacaacacccagaccaccacccaccuccagccccuccaccaccccuccgaggcccgccccuuccccgaccucaccuccuccggcuuccucuga

SEQ ID NO: 39537 - RNA, 2106 nt, Artificial Sequence
  derived and/or modified sequence opt2 from AHRR__Homo_sapiens__NP_001229341
augccccgcaccaugaucccccccggcgagugcaccuacgccggccgcaagcgccgccgcccccuccagaagcagcgccccgccgucggcgccgagaaguccaaccccuccaagcgccaccgcgaccgccucaacgccgagcucgaccaccucgccucccuccuccccuucccccccgacaucaucuccaagcucgacaagcucuccguccuccgccucuccgucuccuaccuccgcgucaaguccuucuuccaggucguccaggagcaguccucccgccagcccgccgccggcgcccccucccccggcgacuccugcccccucgccggcuccgccguccucgagggccgccuccuccucgagucccucaacggcuucgcccucgucgucuccgccgagggcaccaucuucuacgccuccgccaccaucgucgacuaccucggcuuccaccagaccgacgucaugcaccagaacaucuacgacuacauccacgucgacgaccgccaggacuucugccgccagcuccacugggccauggaccccccccaggucgucuucggccagccccccccccucgagaccggcgacgacgccauccucggccgccuccuccgcgcccaggaguggggcaccggcacccccaccgaguacuccgccuuccucacccgcugcuucaucugccgcguccgcugccuccucgacuccaccuccggcuuccucaccaugcaguuccagggcaagcucaaguuccucuucggccagaagaagaaggcccccuccggcgccaugcuccccccccgccucucccucuucugcaucgccgcccccguccuccuccccuccgccgccgagaugaagaugcgcuccgcccuccuccgcgccaagccccgcgccgacaccgccgccaccgccgacgccaaggucaaggccaccaccucccucugcgaguccgagcuccacggcaagcccaacuacuccgccggccgcuccucccgcgaguccggcguccucguccuccgcgagcagaccgacgccggccgcugggcccagguccccgcccgcgcccccugccucugccuccgcggcggccccgaccucguccucgaccccaagggcggcuccggcgaccgcgaggaggagcagcaccgcaugcucucccgcgccuccggcgucaccggccgccgcgagacccccggccccaccaagccccuccccuggaccgccggcaagcacuccgaggacggcgcccgcccccgccuccagcccuccaagaacgacccccccucccuccgccccaugccccgcggcuccugccuccccugccccugcguccagggcaccuuccgcaacucccccaucucccacccccccucccccucccccuccgccuacuccucccgcaccucccgccccaugcgcgacgucggcgaggaccagguccaccccccccucugccacuucccccagcgcucccuccagcaccagcucccccagcccggcgcccagcgcuucgccacccgcggcuaccccauggaggacaugaagcuccagggcguccccaugccccccggcgaccucugcggccccacccuccuccucgacgucuccaucaagauggagaaggacuccggcugcgagggcgccgccgacggcugcguccccucccaggucuggcucggcgccuccgaccgcucccaccccgccaccuuccccacccgcaugcaccucaagaccgagcccgacucccgccagcaggucuacaucucccaccucggccacggcguccgcggcgcccagccccacggccgcgccaccgccggccgcucccgcgagcucacccccuuccaccccgcccacugcgccugccucgagcccaccgacggccucccccaguccgagcccccccaccagcucugcgcccgcggccgcggcgagcaguccugcaccugccgcgccgccgaggccgcccccgucgucaagcgcgagccccucgacuccccccagugggccacccacucccagggcaugguccccggcaugcuccccaaguccgcccucgccacccucguccccccccaggccuccggcugcaccuuccuccccuga

SEQ ID NO: 39538 - RNA, 1017 nt, Artificial Sequence
  derived and/or modified sequence opt2 from AHSA1__Homo_sapiens__NP_036243
auggccaaguggggcgagggcgacccccgcuggaucgucgaggagcgcgccgacgccaccaacgucaacaacuggcacuggaccgagcgcgacgccuccaacugguccaccgacaagcucaagacccucuuccucgccguccagguccagaacgaggagggcaagugcgaggucaccgaggucuccaagcucgacggcgaggccuccaucaacaaccgcaagggcaagcucaucuucuucuacgagugguccgucaagcucaacuggaccggcaccuccaaguccggcguccaguacaagggccacgucgagauccccaaccucuccgacgagaacuccgucgacgaggucgagaucuccgucucccucgccaaggacgagcccgacaccaaccucgucgcccucaugaaggaggagggcgucaagcuccuccgcgaggccaugggcaucuacaucuccacccucaagaccgaguucacccagggcaugauccuccccaccaugaacggcgaguccgucgaccccgucggccagcccgcccucaagaccgaggagcgcaaggccaagcccgcccccuccaagacccaggcccgccccgucggcgucaagauccccaccugcaagaucacccucaaggagaccuuccucaccucccccgaggagcucuaccgcgucuucaccacccaggagcucguccaggccuucacccacgcccccgccacccucgaggccgaccgcggcggcaaguuccacauggucgacggcaacgucuccggcgaguucaccgaccucguccccgagaagcacaucgucaugaaguggcgcuucaaguccuggcccgagggccacuucgccaccaucacccucaccuucaucgacaagaacggcgagaccgagcucugcauggagggccgcggcauccccgcccccgaggaggagcgcacccgccagggcuggcagcgcuacuacuucgagggcaucaagcagaccuucggcuacggcgcccgccucuucuga

SEQ ID NO: 39539 - RNA, 414 nt, Artificial Sequence
  derived and/or modified sequence opt2 from AHSA2__Homo_sapiens__NP_689605
augauccuccccaccaaggccauggccacccaggagcucaccgucaagcgcaagcucuccggcaacacccuccagguccaggccuccucccccgucgcccucggcguccgcauccccaccgucgcccuccacaugauggagcucuucgacaccaccgucgagcagcucuacuccaucuucaccgucaaggagcucaccaacaagaagaucaucaugaaguggcgcugcggcaacuggcccgaggagcacuacgccauggucgcccucaacuucguccccacccucggccagaccgagcuccagcucaaggaguuccucuccaucugcaaggaggagaacaugaaguucugcuggcagaagcagcacuucgaggagaucaagggcucccuccagcucaccccccucaacggcuga

SEQ ID NO: 39540 - RNA, 1104 nt, Artificial Sequence
  derived and/or modified sequence opt2 from AHSG__Homo_sapiens__NP_001613
augaagucccucguccuccuccucugccucgcccagcucuggggcugccacuccgccccccacggccccggccucaucuaccgccagcccaacugcgacgaccccgagaccgaggaggccgcccucgucgccaucgacuacaucaaccagaaccuccccuggggcuacaagcacacccucaaccagaucgacgaggucaaggucuggccccagcagcccuccggcgagcucuucgagaucgagaucgacacccucgagaccaccugccacguccucgaccccacccccgucgcccgcugcuccguccgccagcucaaggagcacgccgucgagggcgacugcgacuuccagcuccucaagcucgacggcaaguucuccgucgucuacgccaagugcgacuccucccccgacuccgccgaggacguccgcaaggucugccaggacugcccccuccucgccccccucaacgacacccgcgucguccacgccgccaaggccgcccucgccgccuucaacgcccagaacaacggcuccaacuuccagcucgaggagaucucccgcgcccagcucgucccccucccccccuccaccuacgucgaguucaccgucuccggcaccgacugcgucgccaaggaggccaccgaggccgccaagugcaaccuccucgccgagaagcaguacggcuucugcaaggccacccucuccgagaagcucggcggcgccgaggucgccgucaccugcauggucuuccagacccagcccgucuccucccagccccagcccgagggcgccaacgaggccguccccacccccgucgucgaccccgacgccccccccucccccccccucggcgcccccggccucccccccgccggcuccccccccgacucccacguccuccucgccgccccccccggccaccagcuccaccgcgcccacuacgaccuccgccacaccuucaugggcgucgucucccucggcucccccuccggcgaggucucccacccccgcaagacccgcaccgucguccagcccuccgucggcgccgccgccggccccgucgucccccccugccccggccgcauccgccacuucaaggucuga

SEQ ID NO: 39541 - RNA, 597 nt, Artificial Sequence
  derived and/or modified sequence opt2 from AICDA__Homo_sapiens__NP_065712
auggacucccuccucaugaaccgccgcaaguuccucuaccaguucaagaacguccgcugggccaagggccgccgcgagaccuaccucugcuacgucgucaagcgccgcgacuccgccaccuccuucucccucgacuucggcuaccuccgcaacaagaacggcugccacgucgagcuccucuuccuccgcuacaucuccgacugggaccucgaccccggccgcugcuaccgcgucaccugguucaccuccuggucccccugcuacgacugcgcccgccacgucgccgacuuccuccgcggcaaccccaaccucucccuccgcaucuucaccgcccgccucuacuucugcgaggaccgcaaggccgagcccgagggccuccgccgccuccaccgcgccggcguccagaucgccaucaugaccuucaaggacuacuucuacugcuggaacaccuucgucgagaaccacgagcgcaccuucaaggccugggagggccuccacgagaacuccguccgccucucccgccagcuccgccgcauccuccucccccucuacgaggucgacgaccuccgcgacgccuuccgcacccucggccucuga

SEQ ID NO: 39542 - RNA, 921 nt, Artificial Sequence
  derived and/or modified sequence opt2 from AIDA__Homo_sapiens__NP_073742
auguccgaggucacccgcucccuccuccagcgcuggggcgccuccuuccgccgcggcgccgacuucgacuccuggggccagcucgucgaggccaucgacgaguaccagauccucgcccgccaccuccagaaggaggcccaggcccagcacaacaacuccgaguucaccgaggagcagaagaagaccaucggcaagaucgccaccugccucgagcuccgcuccgccgcccuccaguccacccagucccaggaggaguucaagcucgaggaccucaagaagcucgagcccauccucaagaacauccucaccuacaacaaggaguuccccuucgacguccagcccgucccccuccgccgcauccucgcccccggcgaggaggagaaccucgaguucgaggaggacgaggaggagggcggcgccggcgccggcucccccgacuccuuccccgcccgcguccccggcacccuccucccccgccuccccuccgagcccggcaugacccuccucaccauccgcaucgagaagaucggccucaaggacgccggccagugcaucgaccccuacaucaccgucuccgucaaggaccucaacggcaucgaccucacccccguccaggacacccccgucgccucccgcaaggaggacaccuacguccacuucaacgucgacaucgagcuccagaagcacgucgagaagcucaccaagggcgccgccaucuucuucgaguucaagcacuacaagcccaagaagcgcuucaccuccaccaagugcuucgccuucauggagauggacgagaucaagcccggccccaucgucaucgagcucuacaagaagcccaccgacuucaagcgcaagaagcuccagcuccucaccaagaagccccucuaccuccaccuccaccagacccuccacaaggaguga

SEQ ID NO: 39543 - RNA, 444 nt, Artificial Sequence
  derived and/or modified sequence opt2 from AIF1__Homo_sapiens__NP_001614
augucccagacccgcgaccuccagggcggcaaggccuucggccuccucaaggcccagcaggaggagcgccucgacgagaucaacaagcaguuccucgacgaccccaaguacuccuccgacgaggaccuccccuccaagcucgagggcuucaaggagaaguacauggaguucgaccucaacggcaacggcgacaucgacaucaugucccucaagcgcaugcucgagaagcucggcguccccaagacccaccucgagcucaagaagcucaucggcgaggucuccuccggcuccggcgagaccuucuccuaccccgacuuccuccgcaugaugcucggcaagcgcuccgccauccucaagaugauccucauguacgaggagaaggcccgcgagaaggagaagcccaccggcccccccgccaagaaggccaucuccgagcuccccuga

SEQ ID NO: 39544 - RNA, 825 nt, Artificial Sequence
  derived and/or modified sequence opt2 from AIFM1__Homo_sapiens__NP_001124318
augggcaagauccuccccgaguaccucuccaacuggaccauggagaagguccgccgcgagggcgucaaggucaugcccaacgccaucguccaguccgucggcgucuccuccggcaagcuccucaucaagcucaaggacggccgcaaggucgagaccgaccacaucgucgccgccgucggccucgagcccaacgucgagcucgccaagaccggcggccucgagaucgacuccgacuucggcggcuuccgcgucaacgccgagcuccaggcccgcuccaacaucugggucgccggcgacgccgccugcuucuacgacaucaagcucggccgccgccgcgucgagcaccacgaccacgccgucgucuccggccgccucgccggcgagaacaugaccggcgccgccaagcccuacuggcaccaguccauguucugguccgaccucggccccgacgucggcuacgaggccaucggccucgucgacuccucccuccccaccgucggcgucuucgccaaggccaccgcccaggacaaccccaaguccgccaccgagcaguccggcaccggcauccgcuccgaguccgagaccgaguccgaggccuccgagaucaccaucccccccuccacccccgccgucccccaggcccccguccagggcgaggacuacggcaagggcgucaucuucuaccuccgcgacaaggucgucgucggcaucguccucuggaacaucuucaaccgcaugcccaucgcccgcaagaucaucaaggacggcgagcagcacgaggaccucaacgaggucgccaagcucuucaacauccacgaggacuga

SEQ ID NO: 39545 - RNA, 1122 nt, Artificial Sequence
  derived and/or modified sequence opt2 from AIFM2__Homo_sapiens__NP_001185625
augggcucccaggucuccgucgaguccggcgcccuccacgucgucaucgucggcggcggcuucggcggcaucgccgccgccucccagcuccaggcccucaacguccccuucaugcucgucgacaugaaggacuccuuccaccacaacgucgccgcccuccgcgccuccgucgagaccggcuucgccaagaagaccuucaucuccuacuccgucaccuucaaggacaacuuccgccagggccucgucgucggcaucgaccucaagaaccagaugguccuccuccagggcggcgaggcccuccccuucucccaccucauccucgccaccggcuccaccggccccuuccccggcaaguucaacgaggucuccucccagcaggccgccauccaggccuacgaggacaugguccgccagguccagcgcucccgcuucaucgucgucgucggcggcggcuccgccggcgucgagauggccgccgagaucaagaccgaguaccccgagaaggaggucacccucauccacucccaggucgcccucgccgacaaggagcuccuccccuccguccgccaggaggucaaggagauccuccuccgcaagggcguccagcuccuccucuccgagcgcgucuccaaccucgaggagcucccccucaacgaguaccgcgaguacaucaagguccagaccgacaagggcaccgaggucgccaccaaccucgucauccucugcaccggcaucaagaucaacuccuccgccuaccgcaaggccuucgagucccgccucgccuccuccggcgcccuccgcgucaacgagcaccuccaggucgagggccacuccaacgucuacgccaucggcgacugcgccgacguccgcacccccaagauggccuaccucgccggccuccacgccaacaucgccgucgccaacaucgucaacuccgucaagcagcgcccccuccaggccuacaagcccggcgcccucaccuuccuccucuccaugggccgcaacgacggcgucggccagaucuccggcuucuacgucggccgccucaugguccgccucaccaagucccgcgaccucuucgucuccaccuccuggaagaccaugcgccaguccccccccuga

SEQ ID NO: 39546 - RNA, 1797 nt, Artificial Sequence
  derived and/or modified sequence opt2 from AIFM3__Homo_sapiens__NP_001018070
augggcggcugcuucuccaagcccaagcccgucgagcucaagaucgaggucguccuccccgagaaggagcgcggcaaggaggagcucuccgccuccggcaagggcuccccccgcgccuaccagggcaacggcaccgcccgccacuuccacaccgaggagcgccucuccaccccccaccccuaccccuccccccaggacugcgucgaggccgccgucugccacgucaaggaccucgagaacggccagaugcgcgaggucgagcucggcuggggcaagguccuccucgucaaggacaacggcgaguuccacgcccucggccacaagugcccccacuacggcgccccccucgucaagggcguccucucccgcggccgcguccgcugccccuggcacggcgccugcuucaacaucuccaccggcgaccucgaggacuuccccggccucgacucccuccacaaguuccaggucaagaucgagaaggagaaggucuacguccgcgccuccaagcaggcccuccagcuccagcgccgcaccaaggucauggccaagugcaucucccccuccgccggcuacuccuccuccaccaacguccucaucgucggcgccggcgccgccggccucgucugcgccgagacccuccgccaggagggcuucuccgaccgcaucguccucugcacccucgaccgccaccuccccuacgaccgccccaagcucuccaagucccucgacacccagcccgagcagcucgcccuccgccccaaggaguucuuccgcgccuacggcaucgagguccucaccgaggcccaggucgucaccgucgacguccgcaccaagaaggucgucuucaaggacggcuucaagcucgaguacuccaagcuccuccucgcccccggcuccucccccaagacccucuccugcaagggcaaggaggucgagaacgucuucaccauccgcacccccgaggacgccaaccgcgucguccgccucgcccgcggccgcaacgucgucgucgucggcgccggcuuccucggcauggaggucgccgccuaccucaccgagaaggcccacuccgucuccgucgucgagcucgaggagacccccuuccgccgcuuccucggcgagcgcgucggccgcgcccucaugaagauguucgagaacaaccgcgucaaguucuacaugcagaccgaggucuccgagcuccgcggccaggagggcaagcucaaggaggucguccucaaguccuccaaggucguccgcgccgacgucugcgucgucggcaucggcgccguccccgccaccggcuuccuccgccaguccggcaucggccucgacucccgcggcuucauccccgucaacaagaugaugcagaccaacguccccggcgucuucgccgccggcgacgccgucaccuucccccucgccuggcgcaacaaccgcaaggucaacaucccccacuggcagauggcccacgcccagggccgcgucgccgcccagaacaugcucgcccaggaggccgagauguccaccguccccuaccucuggaccgccauguucggcaagucccuccgcuacgccggcuacggcgagggcuucgacgacgucaucauccagggcgaccucgaggagcucaaguucgucgccuucuacaccaagggcgacgaggucaucgccgucgccuccaugaacuacgaccccaucgucuccaaggucgccgagguccucgccuccggccgcgccauccgcaagcgcgaggucgagaccggcgacauguccuggcucaccggcaagggcuccuga

SEQ ID NO: 39547 - RNA, 687 nt, Artificial Sequence
  derived and/or modified sequence opt2 from AIG1__Homo_sapiens__NP_001273516
auggccauccuccucuccuacugcuccauccucugcaacuacaaggccaucgagaugcccucccaccagaccuacggcggcuccuggaaguuccucaccuucaucgaccucgucauccaggccgucuucuucggcaucugcguccucaccgaccucuccucccuccucacccgcggcuccggcaaccaggagcaggagcgccagcucaagaagcucaucucccuccgcgacuggaugcucgccguccucgccuuccccgucggcgucuucgucgucgccgucuucuggaucaucuacgccuacgaccgcgagaugaucuaccccaagcuccucgacaacuucauccccggcuggcucaaccacggcaugcacaccaccguccuccccuucauccucaucgagaugcgcaccucccaccaccaguaccccucccgcuccuccggccucaccgccaucugcaccuucuccgucggcuacauccucugggucugcuggguccaccacgucaccggcaugugggucuaccccuuccucgagcacaucggccccggcgcccgcaucaucuucuucggcuccaccaccauccucaugaacuuccucuaccuccucggcgagguccucaacaacuacaucugggacacccagaaguccauggaggaggagaaggagaagcccaagcucgaguga

SEQ ID NO: 39548 - RNA, 5172 nt, Artificial Sequence
  derived and/or modified sequence opt2 from AIM1__Homo_sapiens__NP_001615
auggagaagcgcuccuccggccgccgcuccggccgccgccgcggcucccagaaguccaccgacucccccggcgccgacgccgagcuccccgaguccgccgcccgcgacgacgccgucuucgacgacgaggucgcccccaacgccgccuccgacaacgccuccgccgagaagaaggucaaguccccccgcgccgcccucgacggcggcgucgccuccgccgccucccccgaguccaagcccucccccggcaccaagggccagcuccgcggcgaguccgaccgcuccaagcagcccccccccgccuccucccccaccaagcgcaagggccgcucccgcgcccucgaggccguccccgccccccccgccuccggcccccgcgcccccgccaaggaguccccccccaagcgcguccccgaccccucccccgucaccaagggcaccgccgccgaguccggcgaggaggccgcccgcgccaucccccgcgagcuccccgucaaguccuccucccuccuccccgagaucaagcccgagcacaagcgcggcccccuccccaaccacuucaacggccgcgccgagggcggccgcucccgcgagcucggccgcgccgccggcgcccccggcgccuccgacgccgacggccucaagccccgcaaccacuucggcgucggccgcuccaccgucaccaccaaggucacccuccccgccaagcccaagcacgucgagcucaaccucaagacccccaagaaccucgacucccucggcaacgagcacaaccccuucucccagcccguccacaagggcaacaccgccaccaagaucucccucuucgagaacaagcgcaccaacuccuccccccgccacaccgacauccgcggccagcgcaacacccccgccuccuccaagaccuucgucggccgcgccaagcucaaccucgccaagaaggccaaggagauggagcagcccgagaagaaggucaugcccaacuccccccagaacggcguccucgucaaggagaccgccaucgagaccaaggucaccgucuccgaggaggagauccuccccgccacccgcggcaugaacggcgacuccuccgagaaccaggcccucggcccccagcccaaccaggacgacaaggccgacguccagaccgacgccggcugccucuccgagcccgucgccuccgcccucauccccgucaaggaccacaagcuccucgagaaggaggacuccgaggccgccgacuccaagucccucguccucgagaacgucaccgacaccgcccaggacauccccaccaccgucgacaccaaggaccucccccccaccgccaugcccaagccccagcacaccuucuccgacucccagucccccgccgaguccucccccggccccucccucucccucuccgcccccgcccccggcgacguccccaaggacaccugcguccagucccccaucuccuccuuccccugcaccgaccucaaggucuccgagaaccacaagggcugcguccuccccgucucccgccagaacaacgagaagaugccccuccucgagcucggcggcgagaccacccccccccucuccaccgagcgcucccccgaggccgucggcuccgagugccccucccgcguccucguccagguccgcuccuucguccuccccgucgaguccacccaggacgucuccucccaggucauccccgaguccuccgagguccgcgagguccagcuccccaccugccacuccaacgagcccgaggucgucuccgucgccuccugcgcccccccccaggaggagguccucggcaacgagcacucccacugcaccgccgagcucgccgccaaguccggcccccaggucaucccccccgccuccgagaagacccuccccauccaggcccagucccagggcucccgcaccccccucauggccgaguccucccccaccaacucccccuccuccggcaaccaccucgccaccccccagcgccccgaccagaccgucaccaacggccaggacucccccgccucccuccucaacaucuccgccggcuccgacgacuccgucuucgacuccuccuccgacauggagaaguucaccgagaucaucaagcagauggacuccgccgucugcaugcccaugaagcgcaagaaggcccgcaugcccaacucccccgccccccacuucgccaugccccccauccacgaggaccaccucgagaaggucuucgaccccaaggucuucaccuucggccucggcaagaagaaggagucccagcccgagaugucccccgcccuccaccucaugcagaaccucgacaccaaguccaagcuccgccccaagcgcgccuccgccgagcaguccguccucuucaagucccuccacaccaacaccaacggcaacuccgagccccucgucaugcccgagaucaacgacaaggagaaccgcgacgucaccaacggcggcaucaagcgcucccgccucgagaaguccgcccucuucuccucccuccucuccucccucccccaggacaagaucuucucccccuccgucaccuccgucaacaccaugaccaccgccuucuccaccucccagaacggcucccucucccaguccuccgucucccagcccaccaccgagggcgccccccccugcggccucaacaaggagcaguccaaccuccuccccgacaacucccucaaggucuucaacuucaacuccuccuccaccucccacuccucccucaagucccccucccacauggagaaguacccccagaaggagaagaccaaggaggaccucgacucccgcuccaaccuccaccuccccgagaccaaguucuccgagcucuccaagcucaagaacgacgacauggagaaggccaaccacaucgaguccgucaucaaguccaaccuccccaacugcgccaacuccgacaccgacuucaugggccucuucaaguccucccgcuacgaccccuccaucuccuucuccggcaugucccucuccgacaccaugacccuccgcggcuccguccagaacaagcucaacccccgccccggcaaggucgucaucuacuccgagcccgacgucuccgagaagugcaucgaggucuucuccgacauccaggacugcuccuccuggucccucucccccgucauccucaucaaggucguccgcggcugcuggauccucuacgagcagcccaacuucgagggccacuccaucccccucgaggagggcgagcucgagcucuccggccucuggggcaucgaggacauccucgagcgccacgaggaggccgaguccgacaagcccgucgucaucggcuccauccgccacgucguccaggacuaccgcgucucccacaucgaccucuucaccgagcccgagggccucggcauccucuccuccuacuucgacgacaccgaggagaugcagggcuucggcgucaugcagaagaccugcuccaugaagguccacuggggcaccuggcucaucuacgaggagcccggcuuccagggcguccccuucauccucgagcccggcgaguaccccgaccucuccuucugggacaccgaggaggccuacaucggcuccaugcgcccccucaagaugggcggccgcaaggucgaguuccccaccgaccccaaggucgucgucuacgagaagcccuucuucgagggcaagugcgucgagcucgagaccggcaugugcuccuucgucauggagggcggcgagaccgaggaggccaccggcgacgaccaccuccccuucaccuccgucggcuccaugaagguccuccgcggcaucugggucgccuacgagaagcccggcuucaccggccaccaguaccuccucgaggagggcgaguaccgcgacuggaaggccuggggcggcuacaacggcgagcuccagucccuccgccccauccucggcgacuucuccaacgcccacaugaucauguacuccgagaagaacuucggcuccaagggcuccuccaucgacguccucggcaucgucgccaaccucaaggagaccggcuacggcgucaagacccaguccaucaacguccucuccggcgucugggucgccuacgagaaccccgacuucaccggcgagcaguacauccucgacaagggcuucuacaccuccuucgaggacuggggcggcaagaacugcaagaucuccuccguccagcccaucugccucgacuccuucaccggcccccgccgccgcaaccagauccaccucuucuccgagccccaguuccagggccacucccaguccuucgaggagaccaccucccagaucgacgacuccuucuccaccaaguccugccgcgucuccggcggcuccugggucgucuacgacggcgagaacuucaccggcaaccaguacguccucgaggagggccacuaccccugccucuccgccaugggcugcccccccggcgccaccuucaagucccuccgcuucaucgacgucgaguucuccgagcccaccaucauccucuucgagcgcgaggacuucaagggcaagaagaucgagcucaacgccgagaccgucaaccuccgcucccucggcuucaacacccagauccgcuccguccaggucaucggcggcaucugggucaccuacgaguacggcuccuaccgcggccgccaguuccuccucucccccgccgagguccccaacugguacgaguucuccggcugccgccagaucggcucccuccgccccuucguccagaagcgcaucuacuuccgccuccgcaacaaggccaccggccucuucauguccaccaacggcaaccucgaggaccucaagcuccuccgcauccaggucauggaggacgucggcgccgacgaccagaucuggaucuaccaggagggcugcaucaagugccgcaucgccgaggacugcugccucaccaucgucggcucccucgucaccuccggcuccaagcucggccucgcccucgaccagaacgccgacucccaguucuggucccucaaguccgacggccgcaucuacuccaagcucaagcccaaccucguccucgacaucaagggcggcacccaguacgaccagaaccacaucauccucaacaccgucuccaaggagaaguucacccaggucugggaggccaugguccucuacaccuga

SEQ ID NO: 39549 - RNA, 1032 nt, Artificial Sequence
  derived and/or modified sequence opt2 from AIM2__Homo_sapiens__NP_004824
auggaguccaaguacaaggagauccuccuccucaccggccucgacaacaucaccgacgaggagcucgaccgcuucaaguucuuccucuccgacgaguucaacaucgccaccggcaagcuccacaccgccaaccgcauccaggucgccacccucaugauccagaacgccggcgccgucuccgccgucaugaagaccauccgcaucuuccagaagcucaacuacaugcuccucgccaagcgccuccaggaggagaaggagaaggucgacaagcaguacaaguccgucaccaagcccaagccccucucccaggccgagaugucccccgccgccuccgccgccauccgcaacgacgucgccaagcagcgcgccgcccccaaggucuccccccacgucaagcccgagcagaagcagauggucgcccagcaggaguccauccgcgagggcuuccagaagcgcugccuccccgucaugguccucaaggccaagaagcccuucaccuucgagacccaggagggcaagcaggagauguuccacgccaccgucgccaccgagaaggaguucuucuucgucaaggucuucaacacccuccucaaggacaaguucauccccaagcgcaucaucaucaucgcccgcuacuaccgccacuccggcuuccucgaggucaacuccgccucccgcguccucgacgccgaguccgaccagaaggucaacgucccccucaacaucauccgcaaggccggcgagacccccaagaucaacacccuccagacccagccccucggcaccaucgucaacggccucuucgucguccagaaggucaccgagaagaagaagaacauccucuucgaccucuccgacaacaccggcaagauggagguccucggcguccgcaacgaggacaccaugaagugcaaggagggcgacaagguccgccucaccuucuucacccucuccaagaacggcgagaagcuccagcucaccuccggcguccacuccaccaucaaggucaucaaggccaagaagaagaccuga

SEQ ID NO: 39550 - RNA, 939 nt, Artificial Sequence
  derived and/or modified sequence opt2 from AIMP1__Homo_sapiens__NP_001135887
auggccaacaacgacgccguccucaagcgccucgagcagaagggcgccgaggccgaccagaucaucgaguaccucaagcagcaggucucccuccucaaggagaaggccauccuccaggccacccuccgcgaggagaagaagcuccgcgucgagaacgccaagcucaagaaggagaucgaggagcucaagcaggagcucauccaggccgagauccagaacggcgucaagcagauccccuuccccuccggcaccccccuccacgccaacuccauggucuccgagaacgucauccaguccaccgccgucaccaccgucuccuccggcaccaaggagcagaucaagggcggcaccggcgacgagaagaaggccaaggagaagaucgagaagaagggcgagaagaaggagaagaagcagcaguccaucgccggcuccgccgacuccaagcccaucgacgucucccgccucgaccuccgcaucggcugcaucaucaccgcccgcaagcaccccgacgccgacucccucuacgucgaggaggucgacgucggcgagaucgccccccgcaccgucgucuccggccucgucaaccacgucccccucgagcagaugcagaaccgcauggucauccuccucugcaaccucaagcccgccaagaugcgcggcguccucucccaggccauggucaugugcgccuccucccccgagaagaucgagauccucgccccccccaacggcuccguccccggcgaccgcaucaccuucgacgccuuccccggcgagcccgacaaggagcucaaccccaagaagaagaucugggagcagauccagcccgaccuccacaccaacgacgagugcgucgccaccuacaagggcguccccuucgaggucaagggcaagggcgucugccgcgcccagaccauguccaacuccggcaucaaguga

SEQ ID NO: 39551 - RNA, 963 nt, Artificial Sequence
  derived and/or modified sequence opt2 from AIMP2__Homo_sapiens__NP_006294
augcccauguaccaggucaagcccuaccacggcggcggcgccccccuccgcgucgagcuccccaccugcauguaccgccuccccaacguccacggccgcuccuacggccccgcccccggcgccggccacguccaggaggaguccaaccucucccuccaggcccucgagucccgccaggacgacauccucaagcgccucuacgagcucaaggccgccgucgacggccucuccaagaugauccagacccccgacgccgaccucgacgucaccaacaucauccaggccgacgagcccaccacccucaccaccaacgcccucgaccucaacuccguccucggcaaggacuacggcgcccucaaggacaucgucaucaacgccaaccccgccucccccccccucucccuccucguccuccaccgccuccucugcgagcacuuccgcguccucuccaccguccacacccacuccuccgucaaguccguccccgagaaccuccucaagugcuucggcgagcagaacaagaagcagccccgccaggacuaccagcucggcuucacccucaucuggaagaacguccccaagacccagaugaaguucuccauccagaccaugugccccaucgagggcgagggcaacaucgcccgcuuccucuucucccucuucggccagaagcacaacgccgucaacgccacccucaucgacuccugggucgacaucgccaucuuccagcucaaggagggcuccuccaaggagaaggccgccgucuuccgcuccaugaacuccgcccucggcaagucccccuggcucgccggcaacgagcucaccgucgccgacgucguccucugguccguccuccagcagaucggcggcugcuccgucaccguccccgccaacguccagcgcuggaugcgcuccugcgagaaccucgcccccuucaacaccgcccucaagcuccucaaguga

SEQ ID NO: 39552 - RNA, 993 nt, Artificial Sequence
  derived and/or modified sequence opt2 from AIP__Homo_sapiens__NP_003968
auggccgacaucaucgcccgccuccgcgaggacggcauccagaagcgcgucauccaggagggccgcggcgagcuccccgacuuccaggacggcaccaaggccaccuuccacuaccgcacccuccacuccgacgacgagggcaccguccucgacgacucccgcgcccgcggcaagcccauggagcucaucaucggcaagaaguucaagcuccccgucugggagaccaucgucugcaccaugcgcgagggcgagaucgcccaguuccucugcgacaucaagcacgucguccucuacccccucgucgccaagucccuccgcaacaucgccgucggcaaggacccccucgagggccagcgccacugcugcggcgucgcccagaugcgcgagcacuccucccucggccacgccgaccucgacgcccuccagcagaacccccagccccucaucuuccacauggagaugcucaaggucgagucccccggcaccuaccagcaggaccccugggccaugaccgacgaggagaaggccaaggccgucccccucauccaccaggagggcaaccgccucuaccgcgagggccacgucaaggaggccgccgccaaguacuacgacgccaucgccugccucaagaaccuccagaugaaggagcagcccggcucccccgaguggauccagcucgaccagcagaucaccccccuccuccucaacuacugccagugcaagcucgucgucgaggaguacuacgagguccucgaccacugcuccuccauccucaacaaguacgacgacaacgucaaggccuacuucaagcgcggcaaggcccacgccgccgucuggaacgcccaggaggcccaggccgacuucgccaagguccucgagcucgaccccgcccucgcccccgucgucucccgcgagcuccgcgcccucgaggcccgcauccgccagaaggacgaggaggacaaggcccgcuuccgcggcaucuucucccacuga

SEQ ID NO: 39553 - RNA, 966 nt, Artificial Sequence
  derived and/or modified sequence opt2 from AIPL1__Homo_sapiens__NP_001028226
auggacgccgcccuccuccucaacgucgagggcgucaagaagaccauccuccacggcggcaccggcgagcuccccaacuucaucaccggcucccgcgucaucuuccacuuccgcaccaugaagugcgacgaggagcgcaccgucaucgacgacucccgccaggucggccagcccaugcacaucaucaucggcaacauguucaagcucgaggucugggagauccuccucaccuccaugcgcguccacgaggucgccgaguucuggugcgacaccaucgucgacgcccccuccgacuaccagcgcgagaccuggaaccucuccaaccacgagaagaugaaggccguccccguccuccacggcgagggcaaccgccucuucaagcucggccgcuacgaggaggccuccuccaaguaccaggaggccaucaucugccuccgcaaccuccagaccaaggagaagcccugggagguccaguggcucaagcucgagaagaugaucaacacccucauccucaacuacugccagugccuccucaagaaggaggaguacuacgagguccucgagcacaccuccgacauccuccgccaccaccccggcaucgucaaggccuacuacguccgcgcccgcgcccacgccgaggucuggaacgaggccgaggccaaggccgaccuccagaagguccucgagcucgagcccuccaugcagaaggccguccgccgcgagcuccgccuccucgagaaccgcauggccgagaagcaggaggaggagcgccuccgcugccgcaacaugcucucccagggcgccacccagccccccgccgagccccccaccgagccccccgcccaguccuccaccgagccccccgccgagccccccaccgcccccuccgccgagcucuccgccggcccccccgccgagcccgccaccgagcccccccccucccccggccacucccuccagcacuga

SEQ ID NO: 39554 - RNA, 1638 nt, Artificial Sequence
  derived and/or modified sequence opt2 from AIRE__Homo_sapiens__NP_000374
auggccaccgacgccgcccuccgccgccuccuccgccuccaccgcaccgagaucgccgucgccgucgacuccgccuucccccuccuccacgcccucgccgaccacgacgucguccccgaggacaaguuccaggagacccuccaccucaaggagaaggagggcugcccccaggccuuccacgcccuccucuccuggcuccucacccaggacuccaccgccauccucgacuucuggcgcguccucuucaaggacuacaaccucgagcgcuacggccgccuccagcccauccucgacuccuuccccaaggacgucgaccucucccagccccgcaagggccgcaagccccccgccguccccaaggcccucgucccccccccccgccuccccaccaagcgcaaggccuccgaggaggcccgcgccgccgcccccgccgcccucaccccccgcggcaccgccucccccggcucccagcucaaggccaagccccccaagaagcccgaguccuccgccgagcagcagcgccucccccucggcaacggcauccagaccauguccgccuccguccagcgcgccgucgccauguccuccggcgacguccccggcgcccgcggcgccgucgagggcauccucauccagcaggucuucgaguccggcggcuccaagaagugcauccaggucggcggcgaguucuacacccccuccaaguucgaggacuccggcuccggcaagaacaaggcccgcuccuccuccggccccaagccccucguccgcgccaagggcgcccagggcgccgcccccggcggcggcgaggcccgccucggccagcagggcuccguccccgccccccucgcccuccccuccgacccccagcuccaccagaagaacgaggacgagugcgccgucugccgcgacggcggcgagcucaucugcugcgacggcugcccccgcgccuuccaccucgccugccucucccccccccuccgcgagauccccuccggcaccuggcgcugcuccuccugccuccaggccaccguccaggagguccagccccgcgccgaggagccccgcccccaggagccccccgucgagaccccccucccccccggccuccgcuccgccggcgaggagguccgcggcccccccggcgagccccucgccggcauggacaccacccucgucuacaagcaccuccccgccccccccuccgccgccccccuccccggccucgacuccuccgcccuccacccccuccucugcgucggccccgagggccagcagaaccucgcccccggcgcccgcugcggcgucugcggcgacggcaccgacguccuccgcugcacccacugcgccgccgccuuccacuggcgcugccacuuccccgccggcaccucccgccccggcaccggccuccgcugccgcuccugcuccggcgacgucacccccgcccccgucgagggcguccucgcccccucccccgcccgccucgcccccggccccgccaaggacgacaccgccucccacgagcccgcccuccaccgcgacgaccucgagucccuccucuccgagcacaccuucgacggcauccuccagugggccauccaguccauggcccgccccgccgcccccuuccccuccuga

SEQ ID NO: 39555 - RNA, 1236 nt, Artificial Sequence
  derived and/or modified sequence opt2 from AJAP1__Homo_sapiens__XP_011540088
auguggauccagcagcuccucggccucuccuccauguccauccgcuggcccggccgcccccucggcucccacgccuggauccucaucgccauguuccagcucgccgucgaccuccccgccugcgaggcccucggccccggccccgaguucuggcuccucccccgcucccccccccgccccccccgccucugguccuuccgcuccggccagcccgcccgcguccccgcccccgucugguccccccgccccccccgcgucgagcgcauccacggccagaugcagaugccccgcgcccgccgcgcccaccgcccccgcgaccaggccgccgcccucguccccaaggccggccucgccaagccccccgccgccgccaaguccucccccucccucgccuccuccuccuccuccuccuccuccgccgucgccggcggcgcccccgagcagcaggcccuccuccgccgcggcaagcgccaccuccagggcgacggccucuccuccuucgacucccgcggcucccgccccaccaccgagaccgaguucaucgccuggggccccaccggcgacgaggaggcccucgaguccaacaccuuccccggcgucuacggccccaccaccgucuccauccuccagacccgcaagaccaccgucgccgccaccaccaccaccaccaccaccgccacccccaugacccuccagaccaagggcuucaccgagucccucgacccccgccgccgcauccccggcggcgucuccaccaccgagcccuccaccucccccuccaacaacggcgaggucacccagcccccccgcauccucggcgaggccuccggccucgccguccaccagaucaucaccaucaccgucucccucaucauggucaucgccgcccucaucaccacccucguccucaagaacugcugcgcccaguccggcaacacccgccgcaacucccaccagcgcaagaccaaccagcaggaggaguccugccagaaccucaccgacuuccccuccgcccgcguccccuccucccucgacaucuucaccgccuacaacgagacccuccagugcucccacgagugcguccgcgccuccguccccgucuacaccgacgagacccuccacuccaccaccggcgaguacaaguccaccuucaacggcaaccgccccuccuccuccgaccgccaccucauccccgucgccuucgucuccgagaagugguucgagaucuccugcuga

SEQ ID NO: 39556 - RNA, 1617 nt, Artificial Sequence
  derived and/or modified sequence opt2 from AJUBA__Homo_sapiens__NP_116265
auggagcgccucggcgagaaggccucccgccuccucgagaaguucggccgccgcaagggcgaguccucccgcuccggcuccgacggcacccccggccccggcaagggccgccucuccggccucggcggcccccgcaaguccggcccccgcggcgccaccggcggccccggcgacgagccccucgagcccgcccgcgagcagggcucccucgacgccgagcgcaaccagcgcggcuccuucgaggccccccgcuacgagggcuccuuccccgccggccccccccccacccgcgcccucccccucccccagucccucccccccgacuuccgccucgagcccaccgcccccgcccucuccccccgcuccuccuucgccuccuccuccgccuccgacgccuccaagcccuccuccccccgcggcucccuccuccucgacggcgccggcgccggcggcgccggcggcucccgccccugcuccaaccgcaccuccggcaucuccaugggcuacgaccagcgccacggcuccccccuccccgccggccccugccucuucggccccccccucgccggcgcccccgccggcuacucccccggcggcguccccuccgccuaccccgagcuccacgccgcccucgaccgccucuacgcccagcgccccgccggcuucggcugccaggagucccgccacuccuacccccccgcccucggcucccccggcgcccucgccggcgccggcgucggcgccgccggcccccucgagcgccgcggcgcccagcccggccgccacuccgucaccggcuacggcgacugcgccgucggcgcccgcuaccaggacgagcucaccgcccuccuccgccucaccgucggcaccggcggccgcgaggccggcgcccgcggcgagcccuccggcaucgagcccuccggccucgaggagccccccggccccuucguccccgaggccgcccgcgcccgcaugcgcgagcccgaggcccgcgaggacuacuucggcaccugcaucaagugcaacaagggcaucuacggccaguccaacgccugccaggcccucgacucccucuaccacacccagugcuucgucugcugcuccugcggccgcacccuccgcugcaaggccuucuacuccgucaacggcuccgucuacugcgaggaggacuaccucuucuccggcuuccaggaggccgccgagaagugcugcgucugcggccaccucauccucgagaagauccuccaggccaugggcaaguccuaccaccccggcugcuuccgcugcaucgucugcaacaagugccucgacggcauccccuucaccgucgacuucuccaaccaggucuacugcgucaccgacuaccacaagaacuacgcccccaagugcgccgccugcggccagcccauccuccccuccgagggcugcgaggacaucguccgcgucaucuccauggaccgcgacuaccacuucgagugcuaccacugcgaggacugccgcaugcagcucuccgacgaggagggcugcugcugcuucccccucgacggccaccuccucugccacggcugccacaugcagcgccucaacgcccgccagccccccgccaacuacaucuga

SEQ ID NO: 39557 - RNA, 585 nt, Artificial Sequence
  derived and/or modified sequence opt2 from AK1__Homo_sapiens__NP_000467
auggaggagaagcucaagaagaccaagaucaucuucgucgucggcggccccggcuccggcaagggcacccagugcgagaagaucguccagaaguacggcuacacccaccucuccaccggcgaccuccuccgcuccgaggucuccuccggcuccgcccgcggcaagaagcucuccgagaucauggagaagggccagcucgucccccucgagaccguccucgacaugcuccgcgacgccauggucgccaaggucaacaccuccaagggcuuccucaucgacggcuacccccgcgagguccagcagggcgaggaguucgagcgccgcaucggccagcccacccuccuccucuacgucgacgccggccccgagaccaugacccagcgccuccucaagcgcggcgagaccuccggccgcgucgacgacaacgaggagaccaucaagaagcgccucgagaccuacuacaaggccaccgagcccgucaucgccuucuacgagaagcgcggcaucguccgcaaggucaacgccgagggcuccgucgacuccgucuucucccaggucugcacccaccucgacgcccucaaguga

SEQ ID NO: 39558 - RNA, 564 nt, Artificial Sequence
  derived and/or modified sequence opt2 from AK3__Homo_sapiens__NP_001186781
augggcgccuccgcccgccuccuccgcgccgucaucaugggcgcccccggcuccggcaagggcaccgucuccucccgcaucaccacccacuucgagcucaagcaccucuccuccggcgaccuccuccgcgacaacaugcuccgcggcaccggcuucccccgcacccucccccaggccgaggcccucgaccgcgccuaccagaucgacaccgucaucaaccucaacguccccuucgaggucaucaagcagcgccucaccgcccgcuggauccaccccgccuccggccgcgucuacaacaucgaguucaacccccccaagaccgucggcaucgacgaccucaccggcgagccccucauccagcgcgaggacgacaagcccgagaccgucaucaagcgccucaaggccuacgaggaccagaccaagcccguccucgaguacuaccagaagaagggcguccucgagaccuucuccggcaccgagaccaacaagaucuggcccuacgucuacgccuuccuccagaccaaggucccccagcgcucccagaaggccuccgucacccccuga

SEQ ID NO: 39559 - RNA, 510 nt, Artificial Sequence
  derived and/or modified sequence opt2 from AK6__Homo_sapiens__NP_001015891
augugccaccgcaagcccggcacccccggcgucggcaagaccacccucggcaaggagcucgccuccaaguccggccucaaguacaucaacgucggcgaccucgcccgcgaggagcagcucuacgacggcuacgacgaggaguacgacugccccauccucgacgaggaccgcgucgucgacgagcucgacaaccagaugcgcgagggcggcgucaucgucgacuaccacggcugcgacuucuuccccgagcgcugguuccacaucgucuucguccuccgcaccgacaccaacguccucuacgagcgccucgagacccgcggcuacaacgagaagaagcucaccgacaacauccagugcgagaucuuccagguccucuacgaggaggccaccgccuccuacaaggaggagaucguccaccagcuccccuccaacaagcccgaggagcucgagaacaacgucgaccagauccucaaguggaucgagcaguggaucaaggaccacaacuccuga

SEQ ID NO: 39560 - RNA, 2172 nt, Artificial Sequence
  derived and/or modified sequence opt2 from AK7__Homo_sapiens__NP_689540
auggccgaggaggaggagaccgccgcccucaccgagaaggucauccgcacccagcgcgucuucaucaaccuccucgacuccuacuccuccggcaacaucggcaaguuccucuccaacugcgucgucggcgccucccucgaggagaucaccgaggaggaggaggaggaggacgagaacaaguccgccaugcucgaggccuccuccaccaaggucaaggagggcaccuuccagaucgucggcacccucuccaagcccgacuccccccgccccgacuucgccgucgagaccuacuccgccaucucccgcgaggaccuccucaugcgccuccucgagugcgacgucaucaucuacaacaucaccgaguccucccagcagauggaggaggccaucugggccgucuccgcccucuccgaggaggucucccacuucgagaagcgcaagcucuucauccuccucuccaccgucaugaccugggcccgcuccaaggcccucgaccccgaggacuccgagguccccuucaccgaggaggacuaccgccgccgcaagucccaccccaacuuccucgaccacaucaacgccgagaagaugguccucaaguucggcaagaaggcccgcaaguucgccgccuacgucgucgccgccggccuccaguacggcgccgagggcggcaugcuccacaccuucuucaagauggccuggcucggcgagauccccgcccuccccgucuucggcgacggcaccaacgucauccccaccauccacguccucgaccucgccggcgucauccagaacgucaucgaccacguccccaagccccacuaccucgucgccgucgacgaguccguccacacccucgaggacaucgucaagugcaucuccaagaacaccggccccggcaagauccagaagaucccccgcgagaacgccuaccucaccaaggaccucacccaggacugccucgaccaccuccucgucaaccuccgcauggaggcccucuucgucaaggagaacuucaacauccgcugggccgcccagaccggcuucgucgagaacaucaacaccauccucaaggaguacaagcagucccgcggccucaugcccaucaagaucugcauccucggcccccccgccgucggcaaguccuccaucgccaaggagcucgccaacuacuacaagcuccaccacauccagcucaaggacgucaucuccgaggccaucgccaagcucgaggccaucgucgcccccaacgacgucggcgagggcgaggaggaggucgaggaggaggaggaggaggagaacgucgaggacgcccaggagcuccucgacggcaucaaggaguccauggagcagaacgccggccagcucgacgaccaguacaucauccgcuucaugaaggagaagcucaaguccaugcccugccgcaaccagggcuacauccucgacggcuuccccaagaccuacgaccaggccaaggaccucuucaaccaggaggacgaggaggaggaggacgacguccgcggccgcauguuccccuucgacaagcucaucauccccgaguucgucugcgcccucgacgccuccgacgaguuccucaaggagcgcgucaucaaccuccccgaguccaucgucgccggcacccacuacucccaggaccgcuuccuccgcgcccucuccaacuaccgcgacaucaacaucgacgacgagaccgucuucaacuacuucgacgagcucgagauccaccccauccacaucgacgucggcaagcucgaggacgcccagaaccgccucgccaucaagcagcucaucaaggagaucggcgagccccgcaacuacggccucaccgacgaggagaaggccgaggaggagcgcaaggccgccgaggagcgccucgcccgcgaggccgccgaggaggccgagcgcgagcaccaggaggccgucgagauggccgagaagaucgcccgcugggaggaguggaacaagcgccucgaggaggucaagcgcgaggagcgcgagcuccucgaggcccaguccaucccccuccgcaacuaccucaugaccuacgucaugcccacccucauccagggccucaacgagugcugcaacguccgccccgaggaccccgucgacuuccucgccgaguaccucuucaagaacaaccccgaggcccaguga

SEQ ID NO: 39561 - RNA, 1440 nt, Artificial Sequence
  derived and/or modified sequence opt2 from AK8__Homo_sapiens__NP_689785
auggacgccaccaucgccccccaccgcaucccccccgagaugccccaguacggcgaggagaaccacaucuucgagcucaugcagaacaugcucgagcagcuccucauccaccagcccgaggaccccauccccuucaugauccagcaccuccaccgcgacaacgacaacgucccccgcaucgucauccucggcccccccgccuccggcaagaccaccaucgccauguggcucugcaagcaccucaacuccucccuccucacccucgagaaccucauccucaacgaguucuccuacaccgccaccgaggcccgccgccucuaccuccagcgcaagaccguccccuccgcccuccucguccagcucauccaggagcgccucgccgaggaggacugcaucaagcagggcuggauccucgacggcauccccgagacccgcgagcaggcccuccgcauccagacccucggcaucaccccccgccacgucaucguccucuccgcccccgacaccguccucaucgagcgcaaccucggcaagcgcaucgacccccagaccggcgagaucuaccacaccaccuucgacuggccccccgaguccgagauccagaaccgccucaugguccccgaggacaucuccgagcucgagaccgcccagaagcuccucgaguaccaccgcaacaucguccgcgucauccccuccuaccccaagauccucaaggucaucuccgccgaccagcccugcgucgacgucuucuaccaggcccucaccuacguccaguccaaccaccgcaccaacgcccccuucaccccccgcguccuccuccucggccccgucggcuccggcaagucccuccaggccgcccuccucgcccagaaguaccgccucgucaacgucugcugcggccagcuccucaaggaggccgucgccgaccgcaccaccuucggcgagcucauccagcccuucuucgagaaggagauggccguccccgacucccuccucaugaagguccucucccagcgccucgaccagcaggacugcauccagaagggcuggguccuccacggcgucccccgcgaccucgaccaggcccaccuccucaaccgccucggcuacaaccccaaccgcgucuucuuccucaacguccccuucgacuccaucauggagcgccucacccuccgccgcaucgaccccgucaccggcgagcgcuaccaccucauguacaagcccccccccaccauggagauccaggcccgccuccuccagaaccccaaggacgccgaggagcaggucaagcucaagauggaccucuucuaccgcaacuccgccgaccucgagcagcucuacggcuccgccaucacccucaacggcgaccaggaccccuacaccgucuucgaguacaucgaguccggcaucaucaacccccuccccaagaagauccccuga

SEQ ID NO: 39562 - RNA, 1266 nt, Artificial Sequence
  derived and/or modified sequence opt2 from AK9__Homo_sapiens__NP_659462
augaccucccaggagaagaccgaggaguaccccuucgccgacaucuucgacgaggacgagaccgagcgcaacuuccuccucuccaagcccgucugcuucgucgucuucggcaagcccggcgucggcaagaccacccucgcccgcuacaucacccaggccuggaagugcauccgcgucgaggcccuccccauccucgaggagcagaucgccgccgagaccgaguccggcgucaugcuccaguccaugcucaucuccggccaguccauccccgacgagcucgucaucaagcucaugcucgagaagcucaacucccccgaggucugccacuucggcuacaucaucaccgagauccccucccucucccaggacgccaugaccacccuccagcagaucgagcucaucaagaaccucaaccucaagcccgacgucaucaucaacaucaagugccccgacuacgaccucugccagcgcaucuccggccagcgccagcacaacaacaccggcuacaucuacucccgcgaccagugggaccccgaggucaucgagaaccaccgcaagaagaagaaggaggcccagaaggacggcaagggcgaggaggaggaggaggaggaggagcaggaggaggaggaggccuucaucgccgagaugcagauggucgccgagauccuccaccaccucguccagcgccccgaggacuaccucgagaacgucgagaacaucgucaagcucuacaaggagaccauccuccagacccucgaggaggucauggccgagcacaacccccaguaccucaucgagcucaacggcaacaagcccgccgaggagcucuucaugaucgucauggaccgccucaaguaccucaaccucaagcgcgccgccauccucaccaagcuccagggcgccgaggaggagaucaacgacaccauggagaacgacgagcucuuccgcacccucgccuccuacaagcucaucgccccccgcuaccgcuggcagcgcuccaaguggggccgcaccugccccgucaaccucaaggacggcaacaucuacuccggccuccccgacuacuccgucuccuuccucggcaagaucuacugccucuccuccgaggaggcccucaagcccuuccuccucaacccccgccccuaccuccucccccccaugcccggcccccccugcaaggucuucauccucggcccccaguacuccggcaagaccacccucugcaacaugcucgccgagaacuacaagggcaaggucaccaacuga

SEQ ID NO: 39563 - RNA, 1989 nt, Artificial Sequence
  derived and/or modified sequence opt2 from AKAP10__Homo_sapiens__NP_009133
augcgcggcgccggccccuccccccgccaguccccccgcacccuccgccccgaccccggccccgccauguccuucuuccgccgcaaggucaagggcaaggagcaggagaagaccuccgacgucaaguccaucaaggccuccaucuccguccacuccccccagaaguccaccaagaaccacgcccuccucgaggccgccggccccucccacgucgccaucaacgccaucuccgccaacauggacuccuucuccuccucccgcaccgccacccucaagaagcagcccucccacauggaggccgcccacuucggcgaccucggccgcuccugccucgacuaccagacccaggagaccaaguccucccucuccaagacccucgagcagguccuccacgacaccaucguccuccccuacuucauccaguucauggagcuccgccgcauggagcaccucgucaaguucuggcucgaggccgaguccuuccacuccaccaccuggucccgcauccgcgcccacucccucaacaccgucaagcaguccucccucgccgagcccgucucccccuccaagaagcacgagaccaccgccuccuuccucaccgacucccucgacaagcgccucgaggacuccggcuccgcccagcucuucaugacccacuccgagggcaucgaccucaacaaccgcaccaacuccacccagaaccaccuccuccucucccaggagugcgacuccgcccacucccuccgccucgagauggcccgcgccggcacccaccaggucuccauggagacccaggaguccuccuccacccucaccgucgccucccgcaacucccccgccuccccccucaaggagcucuccggcaagcucaugaaguccaucgagcaggacgccgucaacaccuucaccaaguacaucucccccgacgccgccaagcccauccccaucaccgaggccaugcgcaacgacaucaucgcccgcaucugcggcgaggacggccaggucgaccccaacugcuucguccucgcccaguccaucgucuucuccgccauggagcaggagcacuucuccgaguuccuccgcucccaccacuucugcaaguaccagaucgagguccucaccuccggcaccgucuaccucgccgacauccucuucugcgaguccgcccucuucuacuucuccgaguacauggagaaggaggacgccgucaacauccuccaguucuggcucgccgccgacaacuuccagucccagcucgccgccaagaagggccaguacgacggccaggaggcccagaacgacgccaugauccucuacgacaaguacuucucccuccaggccacccacccccucggcuucgacgacgucguccgccucgagaucgaguccaacaucugccgcgagggcggcccccuccccaacugcuucaccaccccccuccgccaggccuggaccaccauggagaaggucuuccuccccggcuuccucuccuccaaccucuacuacaaguaccucaacgaccucauccacuccguccgcggcgacgaguuccucggcggcaacgucucccucaccgcccccggcuccgucggcccccccgacgagucccaccccggcuccuccgacuccuccgccucccaguccuccgucaagaaggccuccaucaagauccucaagaacuucgacgaggccaucaucgucgacgccgccucccucgaccccgagucccucuaccagcgcaccuacgccggcaagaugaccuucggccgcgucuccgaccucggccaguucauccgcgaguccgagcccgagcccgacguccgcaaguccaagggcuccauguucucccaggccaugaagaaguggguccagggcaacaccgacgaggcccaggaggagcucgccuggaagaucgccaagaugaucgucuccgacaucaugcagcaggcccaguacgaccagccccucgagaaguccaccaagcucuga

SEQ ID NO: 39564 - RNA, 5349 nt, Artificial Sequence
  derived and/or modified sequence opt2 from AKAP12__Homo_sapiens__NP_005091
augggcgccggcuccuccaccgagcagcgcucccccgagcagccccccgagggcuccuccacccccgccgagcccgagcccuccggcggcggccccuccgccgaggccgcccccgacaccaccgccgaccccgccaucgccgccuccgaccccgccaccaagcuccuccagaagaacggccagcucuccaccaucaacggcgucgccgagcaggacgagcucucccuccaggagggcgaccucaacggccagaagggcgcccucaacggccagggcgcccucaacucccaggaggaggaggaggucaucgucaccgaggucggccagcgcgacuccgaggacgucuccaagcgcgacuccgacaaggagauggccaccaaguccgccgucguccacgacaucaccgacgacggccaggaggagacccccgagaucaucgagcagauccccuccuccgaguccaaccucgaggagcucacccagcccaccgagucccaggccaacgacaucggcuucaagaaggucuucaaguucgucggcuucaaguucaccgucaagaaggacaagaccgagaagcccgacaccguccagcuccucaccgucaagaaggacgagggcgagggcgccgccggcgccggcgaccacaaggaccccucccucggcgccggcgaggccgccuccaaggaguccgagcccaagcaguccaccgagaagcccgaggagacccucaagcgcgagcagucccacgccgagaucuccccccccgccgaguccggccaggccgucgaggagugcaaggaggagggcgaggagaagcaggagaaggagcccuccaaguccgccgagucccccaccucccccgucaccuccgagaccggcuccaccuucaagaaguucuucacccagggcugggccggcuggcgcaagaagaccuccuuccgcaagcccaaggaggacgaggucgaggccuccgagaagaagaaggagcaggagcccgagaaggucgacaccgaggaggacggcaaggccgaggucgccuccgagaagcucaccgccuccgagcaggcccacccccaggagcccgccgaguccgcccacgagccccgccucuccgccgaguacgagaaggucgagcuccccuccgaggagcaggucuccggcucccagggccccuccgaggagaagcccgccccccucgccaccgaggucuucgacgagaagaucgagguccaccaggaggaggucgucgccgagguccacgucuccaccgucgaggagcgcaccgaggagcagaagaccgaggucgaggagaccgccggcuccguccccgccgaggagcucgucgagauggacgccgagccccaggaggccgagcccgccaaggagcucgucaagcucaaggagaccugcgucuccggcgaggaccccacccagggcgccgaccucucccccgacgagaagguccucuccaagccccccgagggcgucgucuccgaggucgagaugcucuccucccaggagcgcaugaagguccagggcuccccccucaagaagcucuucaccuccaccggccucaagaagcucuccggcaagaagcagaagggcaagcgcggcggcggcgacgaggaguccggcgagcacacccagguccccgccgacucccccgacucccaggaggagcagaagggcgaguccuccgccuccucccccgaggagcccgaggagaucaccugccucgagaagggccucgccgagguccagcaggacggcgaggccgaggagggcgccaccuccgacggcgagaagaagcgcgagggcgucacccccugggccuccuucaagaagauggucacccccaagaagcgcguccgccgccccuccgaguccgacaaggaggacgagcucgacaaggucaaguccgccacccucuccuccaccgaguccaccgccuccgagaugcaggaggagaugaagggcuccgucgaggagcccaagcccgaggagcccaagcgcaaggucgacaccuccgucuccugggaggcccucaucugcgucggcuccuccaagaagcgcgcccgccgcggcuccuccuccgacgaggagggcggccccaaggccaugggcggcgaccaccagaaggccgacgaggccggcaaggacaaggagaccggcaccgacggcauccucgccggcucccaggagcacgaccccggccagggcuccuccucccccgagcaggccggcucccccaccgagggcgagggcgucuccaccugggaguccuucaagcgccucgucaccccccgcaagaaguccaaguccaagcucgaggagaaguccgaggacuccaucgccggcuccggcgucgagcacuccacccccgacaccgagcccggcaaggaggaguccugggucuccaucaagaaguucauccccggccgccgcaagaagcgccccgacggcaagcaggagcaggcccccgucgaggacgccggccccaccggcgccaacgaggacgacuccgacguccccgccgucgucccccucuccgaguacgacgccgucgagcgcgagaagauggaggcccagcaggcccagaaguccgccgagcagcccgagcagaaggccgccaccgaggucuccaaggagcucuccgagucccagguccacaugauggccgccgccgucgccgacggcacccgcgccgccaccaucaucgaggagcgcucccccuccuggaucuccgccuccgucaccgagccccucgagcaggucgaggccgaggccgcccuccucaccgaggagguccucgagcgcgaggucaucgccgaggaggagccccccaccgucaccgagccccuccccgagaaccgcgaggcccgcggcgacaccgucgucuccgaggccgagcucacccccgaggccgucaccgccgccgagaccgccggcccccucggcgccgaggagggcaccgaggccuccgccgccgaggagaccaccgagauggucuccgccgucucccagcucaccgacucccccgacaccaccgaggaggccacccccguccaggaggucgagggcggcguccccgacaucgaggagcaggagcgccgcacccaggagguccuccaggccgucgccgagaaggucaaggaggagucccagcuccccggcaccggcggccccgaggacguccuccagcccguccagcgcgccgaggccgagcgccccgaggagcaggccgaggccuccggccucaagaaggagaccgacgucguccucaaggucgacgcccaggaggccaagaccgagcccuucacccagggcaaggucgucggccagaccacccccgaguccuucgagaaggccccccaggucaccgaguccaucgaguccuccgagcucgucaccaccugccaggccgagacccucgccggcgucaagucccaggagauggucauggagcaggccaucccccccgacuccgucgagacccccaccgacuccgagaccgacggcuccacccccgucgccgacuucgacgcccccggcaccacccagaaggacgagaucgucgagauccacgaggagaacgaggucgccuccggcacccaguccggcggcaccgaggccgaggccguccccgcccagaaggagcgcccccccgcccccuccuccuucgucuuccaggaggagaccaaggagcaguccaagauggaggacacccucgagcacaccgacaaggaggucuccgucgagaccgucuccauccucuccaagaccgagggcacccaggaggccgaccaguacgccgacgagaagaccaaggacguccccuucuucgagggccucgagggcuccaucgacaccggcaucaccgucucccgcgagaaggucaccgaggucgcccucaagggcgagggcaccgaggaggccgagugcaagaaggacgacgcccucgagcuccagucccacgccaaguccccccccucccccgucgagcgcgagauggucguccaggucgagcgcgagaagaccgaggccgagcccacccacgucaacgaggagaagcucgagcacgagaccgccgucaccgucuccgaggaggucuccaagcagcuccuccagaccgucaacguccccaucaucgacggcgccaaggaggucuccucccucgagggcucccccccccccugccucggccaggaggaggccgucugcaccaagauccagguccaguccuccgaggccuccuucacccucaccgccgccgccgaggaggagaagguccucggcgagaccgccaacauccucgagaccggcgagacccucgagcccgccggcgcccaccucguccucgaggagaaguccuccgagaagaacgaggacuucgccgcccaccccggcgaggacgccguccccaccggccccgacugccaggccaaguccacccccgucaucgucuccgccaccaccaagaagggccucuccuccgaccucgagggcgagaagaccaccucccucaaguggaaguccgacgaggucgacgagcaggucgccugccaggaggucaaggucuccgucgccaucgaggaccucgagcccgagaacggcauccucgagcucgagaccaaguccuccaagcucguccagaacaucauccagaccgccgucgaccaguucguccgcaccgaggagaccgccaccgagaugcucaccuccgagcuccagacccaggcccacgucaucaaggccgacucccaggacgccggccaggagaccgagaaggagggcgaggagccccaggccuccgcccaggacgagacccccaucaccuccgccaaggaggaguccgaguccaccgccgucggccaggcccacuccgacaucuccaaggacauguccgaggccuccgagaagaccaugaccgucgaggucgagggcuccaccgucaacgaccagcagcucgaggaggucguccuccccuccgaggaggagggcggcggcgccggcaccaaguccguccccgaggacgacggccacgcccuccucgccgagcgcaucgagaagucccucgucgagcccaaggaggacgagaagggcgacgacgucgacgaccccgagaaccagaacuccgcccucgccgacaccgacgccuccggcggccucaccaaggagucccccgacaccaacggccccaagcagaaggagaaggaggacgcccaggaggucgagcuccaggagggcaagguccacuccgaguccgacaaggccaucaccccccaggcccaggaggagcuccagaagcaggagcgcgaguccgccaaguccgagcucaccgaguccuga

SEQ ID NO: 39565 - RNA, 4305 nt, Artificial Sequence
  derived and/or modified sequence opt2 from AKAP13__Homo_sapiens__NP_001257475
auguacgagcgccacaagcgccgcuacucccucugcgacaucuccaaggucgaccgcaccgucgacgucguccuccucaagaucaaccgcgagaacuggugcaccaucgagcccugccccgacgccgccucccuccucgccuccaagcagucccccgagugcgagaacuuccucgacgucggccucggccgcgagugcaccuccaagcagggcguccucaagcgcgaguccggcuccgacuccgaccucuuccacucccccuccgacgacauggacuccaucaucuuccccaagcccgaggaggagcaccucgccugcgacaucaccggcuccuccuccuccaccgacgacaccgccucccucgaccgccacuccucccacggcuccgacgucucccucucccagauccucaagcccaaccgcucccgcgaccgccagucccucgacggcuucuacucccacggcaugggcgccgagggccgcgaguccgaguccgagcccgccgaccccggcgacgucgaggaggaggagauggacuccaucaccgagguccccgccaacugcuccguccuccgcuccuccaugcgcucccucucccccuuccgccgccacuccuggggccccggcaagaacgccgccuccgacgccgagaugaaccaccgcuccuucucccucgagggccucaccggcggcgccggcgucggcaacaagcccuccuccucccucgaggucuccuccgccaacgccgaggagcuccgccaccccuucuccggcgaggagcgcgucgacucccucgucucccucuccgaggaggaccucgaguccgaccagcgcgagcaccgcauguucgaccagcagaucugccaccgcuccaagcagcagggcuucaacuacugcaccuccgccaucuccuccccccucaccaaguccaucucccucaugaccaucucccaccccggccucgacaacucccgccccuuccacuccaccuuccacaacaccuccgccaaccucaccgaguccaucaccgaggagaacuacaacuuccucccccacucccccuccaagaaggacuccgaguggaaguccggcaccaaggucucccgcaccuucuccuacaucaagaacaagauguccuccuccaagaaguccaaggagaaggagaaggagaaggacaagaucaaggagaaggagaaggacuccaaggacaaggagaaggacaagaagaccgucaacggccacaccuucuccuccauccccgucgucggccccaucuccugcucccagugcaugaagcccuucaccaacaaggacgccuacaccugcgccaacugcuccgccuucguccacaagggcugccgcgagucccucgccuccugcgccaaggucaagaugaagcccaagggcucccuccaggcccacgacaccuccucccuccccaccgucaucaugcgcaacaagcccucccagcccaaggagcgcccccgcuccgccguccuccucgucgacgagaccgccaccacccccaucuucgccaaccgccgcucccagcaguccgucucccucuccaaguccgucuccauccagaacaucaccggcgucggcaacgacgagaacauguccaacaccuggaaguuccucucccacuccaccgacucccucaacaagaucuccaaggucaacgaguccaccgagucccucaccgacgagggcgucggcaccgacaugaacgagggccagcuccucggcgacuucgagaucgaguccaagcagcucgaggccgaguccuggucccgcaucaucgacuccaaguuccucaagcagcagaagaaggacgucgucaagcgccaggaggucaucuacgagcucaugcagaccgaguuccaccacguccgcacccucaagaucauguccggcgucuacucccagggcaugauggccgaccuccucuucgagcagcagauggucgagaagcucuuccccugccucgacgagcucaucuccauccacucccaguucuuccagcgcauccucgagcgcaagaaggagucccucgucgacaaguccgagaagaacuuccucaucaagcgcaucggcgacguccucgucaaccaguucuccggcgagaacgccgagcgccucaagaagaccuacggcaaguucugcggccagcacaaccaguccgucaacuacuucaaggaccucuacgccaaggacaagcgcuuccaggccuucgucaagaagaagauguccuccuccgucguccgccgccucggcauccccgagugcauccuccucgucacccagcgcaucaccaaguaccccguccucuuccagcgcauccuccagugcaccaaggacaacgaggucgagcaggaggaccucgcccagucccucucccucgucaaggacgucaucggcgccgucgacuccaaggucgccuccuacgagaagaagguccgccucaacgagaucuacaccaagaccgacuccaaguccaucaugcgcaugaaguccggccagauguucgccaaggaggaccucaagcgcaagaagcucguccgcgacggcuccgucuuccucaagaacgccgccggccgccucaaggagguccaggccguccuccucaccgacauccucgucuuccuccaggagaaggaccagaaguacaucuucgccucccucgaccagaaguccaccgucaucucccucaagaagcucaucguccgcgaggucgcccacgaggagaagggccucuuccucaucuccaugggcaugaccgaccccgagauggucgagguccacgccuccuccaaggaggagcgcaacuccuggauccagaucauccaggacaccaucaacacccucaaccgcgacgaggacgagggcauccccuccgagaacgaggaggagaagaagaugcucgacacccgcgcccgcgagcucaaggagcagcuccaccagaaggaccagaagauccuccuccuccucgaggagaaggagaugaucuuccgcgacauggccgagugcuccaccccccuccccgaggacugcucccccacccacuccccccgcguccucuuccgcuccaacaccgaggaggcccucaagggcggcccccucaugaaguccgccaucaacgaggucgagauccuccagggccucgucuccggcaaccucggcggcacccucggccccaccgucuccucccccaucgagcaggacgucgucggccccgucucccucccccgccgcgccgagaccuucggcggcuucgacucccaccagaugaacgccuccaagggcggcgagaaggaggagggcgacgacggccaggaccuccgccgcaccgaguccgacuccggccucaagaagggcggcaacgccaaccucgucuucaugcucaagcgcaacuccgagcaggucguccaguccgucguccaccucuacgagcuccucuccgcccuccagggcgucguccuccagcaggacuccuacaucgaggaccagaagcucguccucuccgagcgcgcccucacccgcucccucucccgccccuccucccucaucgagcaggagaagcagcgcucccucgagaagcagcgccaggaccucgccaaccuccagaagcagcaggcccaguaccucgaggagaagcgccgccgcgagcgcgagugggaggcccgcgagcgcgagcuccgcgagcgcgaggcccuccucgcccagcgcgaggaggagguccagcagggccagcaggaccucgagaaggagcgcgaggagcuccagcagaagaagggcaccuaccaguacgaccucgagcgccuccgcgccgcccagaagcagcucgagcgcgagcaggagcagcuccgccgcgaggccgagcgccucucccagcgccagaccgagcgcgaccucugccaggucucccacccccacaccaagcucaugcgcauccccuccuucuuccccucccccgaggagccccccucccccuccgcccccuccaucgccaaguccggcucccucgacuccgagcucuccgucucccccaagcgcaacuccaucucccgcacccacaaggacaagggccccuuccacauccucuccuccaccucccagaccaacaagggccccgagggccagucccaggcccccgccuccaccuccgccuccacccgccucuucggccucaccaagcccaaggagaagaaggagaagaagaagaagaacaagaccucccgcucccagcccggcgacggccccgccuccgaggucuccgccgagggcgaggagaucuucugcuga

SEQ ID NO: 39566 - RNA, 2088 nt, Artificial Sequence
  derived and/or modified sequence opt2 from AKAP17A__Homo_sapiens__NP_005079
auggccgccgccaccaucguccacgacaccuccgaggccgucgagcucugccccgccuacggccucuaccucaagcccaucaccaagaugaccaucuccgucgcccucccccagcucaagcagcccggcaaguccaucuccaacugggaggucauggagcgccucaagggcaugguccagaaccaccaguucuccacccuccgcaucuccaaguccaccauggacuucauccgcuucgagggcgaggucgagaacaagucccucgucaaguccuuccucgccugccucgacggcaagaccaucaagcucuccggcuucuccgacauccucaagguccgcgccgccgaguucaagaucgacuuccccacccgccacgacugggacuccuucuuccgcgacgccaaggacaugaacgagacccuccccggcgagcgccccgacaccauccaccucgagggccuccccugcaagugguucgcccucaaggaguccggcuccgagaagcccuccgaggacguccucgucaaggucuucgagaaguucggcgagauccgcaacgucgacauccccaugcucgaccccuaccgcgaggagaugaccggccgcaacuuccacaccuucuccuucggcggccaccucaacuucgaggccuacguccaguaccgcgaguacaugggcuucauccaggccauguccgcccuccgcggcaugaagcucauguacaagggcgaggacggcaaggccgucgccugcaacaucaaggucuccuucgacuccaccaagcaccucuccgacgccuccaucaagaagcgccagcucgagcgccagaagcuccaggagcucgagcagcagcgcgaggagcagaagcgccgcgagaaggaggccgaggagcgccagcgcgccgaggagcgcaagcagaaggagcucgaggagcucgagcgcgagcgcaagcgcgaggagaagcuccgcaagcgcgagcagaagcagcgcgaccgcgagcuccgccgcaaccagaagaagcucgagaagcuccaggccgaggagcagaagcagcuccaggagaagaucaagcucgaggagcgcaagcuccuccucgcccagcgcaaccuccaguccauccgccucaucgccgagcuccucucccgcgccaaggccgucaagcuccgcgagcaggagcagaaggaggagaagcuccgccuccagcagcaggaggagcgccgccgccuccaggaggccgagcuccgccgcgucgaggaggagaaggagcgcgcccucggccuccagcgcaaggagcgcgagcuccgcgagcgccuccucuccauccuccucuccaagaagcccgacgacucccacacccacgacgagcucggcgucgcccacgccgaccuccuccagcccguccucgacauccuccagaccgucuccuccggcugcgucuccgccaccacccuccacccccucggcggccagccccccgccggcgcccccaaggagucccccgcccaccccgaggccgacggcgcccccaaguccgucaacggcuccgucgccgaggaggcccccugcaaggagguccaguccuccugccgcgucguccccgaggacggcucccccgagaagcgcugccccggcggcguccucuccugcauccccgacaacaaccagcagcccaagggcauccccgccugcgagcagaacgucucccgcaaggacacccgcuccgagcaggacaagugcaaccgcgagcccuccaagggccgcggccgcgccaccggcgacggccucgccgaccgccacaagcgcgagcgcucccgcgcccgccgcgccuccucccgcgaggacggccgcccccgcaaggagcgccgcccccacaagaagcacgccuacaaggacgacuccccccgccgccgcuccaccucccccgaccacacccgcucccgccgcucccacuccaaggaccgccaccgccgcgagcgcucccgcgagcgccgcggcuccgccucccgcaagcacucccgccaccgccgccgcuccgagcgcucccgcucccgcucccccucccgccaccgcuccaccuggaaccgcuga

SEQ ID NO: 39567 - RNA, 2712 nt, Artificial Sequence
  derived and/or modified sequence opt2 from AKAP1__Homo_sapiens__NP_003479
auggccauccaguuccgcucccucuucccccucgcccuccccggcaugcucgcccuccucggcugguggugguucuucucccgcaagaagggccacgucuccucccacgacgagcagcaggucgaggccggcgccguccagcuccgcgccgaccccgccaucaaggagccccuccccgucgaggacgucugccccaaggucgucuccaccccccccuccgucaccgagccccccgagaaggagcucuccaccgucuccaagcuccccgccgagccccccgcccuccuccagacccacccccccugccgccgcuccgaguccuccggcauccuccccaacaccaccgacaugcgccuccgccccggcacccgccgcgacgacuccaccaagcucgagcucgcccucaccggcggcgaggccaaguccaucccccucgagugcccccucuccucccccaagggcguccucuucuccuccaaguccgccgaggucugcaagcaggacucccccuucucccgcgucccccgcaagguccagcccggcuaccccgucguccccgccgagaagcgcuccuccggcgagcgcgcccgcgagaccggcggcgccgagggcaccggcgacgccguccucggcgagaagguccucgaggaggcccuccucucccgcgagcacguccucgagcucgagaacuccaagggccccucccucgccucccucgagggcgaggaggacaagggcaaguccuccuccucccaggucgucggccccguccaggaggaggaguacgucgccgagaagcuccccucccgcuucaucgaguccgcccacaccgagcucgccaaggacgacgccgcccccgccccccccgucgccgacgccaaggcccaggaccgcggcgucgagggcgagcucggcaacgaggagucccucgaccgcaacgaggagggccucgaccgcaacgaggagggccucgaccgcaacgaggagucccucgaccgcaacgaggagggccucgaccgcaacgaggagaucaagcgcgccgccuuccagaucaucucccaggucaucuccgaggccaccgagcagguccucgccaccaccgucggcaaggucgccggccgcgucugccaggccucccagcuccagggccagaaggaggaguccugcguccccguccaccagaagaccguccucggccccgacaccgccgagcccgccaccgccgaggccgccgucgccccccccgacgccggccucccccuccccggccuccccgccgagggcucccccccccccaagaccuacgucuccugccucaagucccuccucuccucccccaccaaggacuccaagcccaacaucuccgcccaccacaucucccucgccuccugccucgcccucaccacccccuccgaggagcuccccgaccgcgccggcauccucgucgaggacgccaccugcgucaccugcauguccgacuccucccaguccgucccccucgucgccucccccggccacugcuccgacuccuucuccaccuccggccucgaggacuccugcaccgagaccuccuccuccccccgcgacaaggccaucacccccccccuccccgaguccaccguccccuucuccaacggcguccucaagggcgagcucuccgaccucggcgccgaggacggcuggaccauggacgccgaggccgaccacuccggcggcuccgaccgcaacuccauggacuccgucgacuccugcugcucccucaagaagaccgaguccuuccagaacgcccaggccggcuccaaccccaagaaggucgaccucaucaucugggagaucgagguccccaagcaccucgucggccgccucaucggcaagcagggccgcuacgucuccuuccucaagcagaccuccggcgccaagaucuacaucuccacccuccccuacacccaguccguccagaucugccacaucgagggcucccagcaccacgucgacaaggcccucaaccucaucggcaagaaguucaaggagcucaaccucaccaacaucuacgcccccccccuccccucccucgcccuccccucccuccccaugaccuccuggcucaugcuccccgacggcaucaccgucgaggucaucgucgucaaccaggucaacgccggccaccucuucguccagcagcacacccaccccaccuuccacgcccuccgcucccucgaccagcagauguaccucugcuacucccagcccggcauccccacccuccccacccccgucgagaucaccgucaucugcgccgcccccggcgccgacggcgccugguggcgcgcccaggucgucgccuccuacgaggagaccaacgaggucgagauccgcuacgucgacuacggcggcuacaagcgcgucaaggucgacguccuccgccagauccgcuccgacuucgucacccuccccuuccagggcgccgagguccuccucgacuccgucaugccccucuccgacgacgaccaguucucccccgaggccgacgccgccauguccgagaugaccggcaacaccgcccuccucgcccaggucaccuccuacucccccaccggccucccccucauccagcucugguccgucgucggcgacgaggucguccucaucaaccgcucccucgucgagcgcggccucgcccagugggucgacuccuacuacaccucccucuga

SEQ ID NO: 39568 - RNA, 2847 nt, Artificial Sequence
  derived and/or modified sequence opt2 from AKAP2__Homo_sapiens__NP_001004065
augcgcuggccccagcccggcgccgccgcccgccucccccccgagucccccggcccccccgagucccccggcccccccgagcgcgaggccgccgccgcccgccgcuggaccggcgccgagccccaggacugcgcccccggcuccggccgccccgagaagcccccccagcucuccgaggacgacaucuggcucaaguccgagggcgacaacuacuccgccacccuccucgagcccgccgccuccucccucucccccgaccacaagaacauggagaucgaggucuccgucgccgagugcaaguccguccccggcaucaccuccaccccccaccccauggaccaccccuccgccuucuacucccccccccacaacggccuccucaccgaccaccacgagucccucgacaacgacgucgcccgcgagauccgcuaccucgacgagguccucgaggccaacugcugcgacuccgccgucgacggcaccuacaacggcaccuccucccccgagcccggcgccgucguccucgucggcggccucuccccccccguccacgaggccacccagcccgagcccaccgagcgcaccgccucccgccaggcccccccccacaucgagcucuccaacuccucccccgaccccauggccgaggccgagcgcaccaacggccacucccccucccagccccgcgacgcccucggcgacucccuccagguccccgucucccccuccuccaccaccuccucccgcugcuccucccgcgacggcgaguucacccucaccacccucaagaaggaggccaaguucgagcuccgcgccuuccacgaggacaagaagcccuccaagcucuucgaggacgacgagcacgagaaggagcaguacugcauccgcaagguccgccccuccgaggagaugcucgagcucgagaaggagcgccgcgagcucauccgcucccaggccgucaagaagaaccccggcaucgccgccaagugguggaaccccccccaggagaagaccaucgaggagcagcucgacgaggagcaccucgagucccacaagaaguacaaggagcgcaaggagcgccgcgcccagcaggagcagcuccuccuccagaagcagcuccagcagcagcagcagcagccccccucccagcucugcaccgcccccgccuccucccacgagcgcgccuccaugaucgacaaggccaaggaggacaucgucaccgagcagaucgacuucuccgccgcccgcaagcaguuccagcucauggagaacucccgccaggccgucgccaagggccaguccaccccccgccucuucuccaucaagcccuucuaccgcccccucggcuccgucaacuccgacaagccccucaccaacccccgcccccccuccgucggcggcccccccgaggacuccggcgccuccgccgccaagggccagaagucccccggcgcccucgagacccccuccgccgccggcucccagggcaacaccgccucccagggcaaggagggccccuacuccgagcccuccaagcgcggcccccucuccaagcucugggccgaggacggcgaguucaccuccgcccgcgccguccucaccgucgucaaggacgacgaccacggcauccucgaccaguucucccgcuccgucaacgucucccucacccaggaggagcucgacuccggccucgacgagcucuccguccgcucccaggacaccaccguccucgagacccucuccaacgacuucuccauggacaacaucuccgacuccggcgccuccaacgagaccaccaacgcccuccaggagaacucccucgccgacuucucccucccccagaccccccagaccgacaaccccuccgagggccgcggcgagggcgucuccaaguccuucuccgaccacggcuucuacucccccuccuccacccucggcgacuccccccucgucgacgacccccucgaguaccaggccggccuccucguccagaacgccauccagcaggccaucgccgagcaggucgacaaggccgucuccaagaccucccgcgacggcgccgagcagcagggccccgaggccaccgucgaggaggccgaggccgccgccuucggcuccgagaagccccaguccauguucgagcccccccaggucuccucccccguccaggagaagcgcgacguccuccccaagauccuccccgccgaggaccgcgcccuccgcgagcgcggccccccccagccccuccccgccguccagcccuccggccccaucaacauggaggagacccgccccgagggcuccuacuucuccaaguacuccgaggccgccgagcuccgcuccaccgccucccuccucgccacccaggaguccgacgucauggucggccccuucaagcuccgcucccgcaagcagcgcacccucuccaugaucgaggaggagauccgcgccgcccaggagcgcgaggaggagcucaagcgccagcgccagguccuccaguccacccaguccccccgcaccaagaacgcccccucccuccccucccgcaccugcuacaagaccgcccccggcaagaucgagaaggucaagcccccccccucccccaccaccgagggccccucccuccagcccgaccucgcccccgaggaggccgccggcacccagcgccccaagaaccucaugcagacccucauggaggacuacgagacccacaaguccaagcgccgcgagcgcauggacgacuccuccguccucgaggccacccgcgucaaccgccgcaaguccgcccucgcccuccgcugggaggccggcaucuacgccaaccaggaggaggaggacaacgaguga

SEQ ID NO: 39569 - RNA, 2562 nt, Artificial Sequence
  derived and/or modified sequence opt2 from AKAP3__Homo_sapiens__NP_001265238
auguccgagaaggucgacuggcuccagucccagaacggcgucugcaaggucgacgucuacucccccggcgacaaccaggcccaggacuggaagauggacaccuccaccgaccccguccgcguccucuccuggcuccgccgcgaccucgagaaguccaccgccgaguuccaggacguccgcuucaagcccggcgaguccuucggcggcgagaccuccaacuccggcgacccccacaagggcuucuccgucgacuacuacaacaccaccaccaagggcacccccgagcgccuccacuucgagaugacccacaaggagauccccugccagggcccccgcgcccagcucggcaacggcuccuccgucgacgaggucuccuucuacgccaaccgccucaccaaccucgucaucgccauggcccgcaaggagaucaacgagaagaucgacggcuccgagaacaagugcgucuaccagucccucuacaugggcaacgagcccacccccaccaagucccucuccaagaucgccuccgagcucgucaacgagaccgucuccgccugcucccgcaacgccgcccccgacaaggcccccggcuccggcgaccgcgucuccggcuccucccaguccccccccaaccucaaguacaaguccacccucaagaucaaggaguccaccaaggagcgccagggccccgacgacaagccccccuccaagaaguccuucuucuacaaggaggucuucgagucccgcaacggcgacuacgcccgcgagggcggccgcuucuucccccgcgagcgcaagcgcuuccgcggccaggagcgccccgacgacuucaccgccuccgucuccgagggcaucaugaccuacgccaacuccgucgucuccgacaugauggucuccaucaugaagacccucaagauccaggucaaggacaccaccaucgccaccauccuccucaagaagguccuccucaagcacgccaaggaggucgucuccgaccucaucgacuccuuccuccgcaaccuccacuccgucaccggcacccucaugaccgacacccaguucgucuccgccgucaagcgcaccgucuucucccacggcucccagaaggccaccgacaucauggacgccaugcuccgcaagcucuacaacgucauguucgccaagaagguccccgagcacguccgcaaggcccaggacaaggccgaguccuacucccucaucuccaugaagggcaugggcgaccccaagaaccgcaacgucaacuucgccaugaaguccgagaccaagcuccgcgagaagauguacuccgagcccaaguccgaggaggagaccugcgccaagacccucggcgagcacaucaucaaggagggccucacccucuggcacaagucccagcagaaggagugcaagucccucggcuuccagcacgccgccuucgaggcccccaacacccagcgcaagcccgccuccgacaucuccuucgaguaccccgaggacaucggcaaccucucccucccccccuacccccccgagaagcccgagaacuucauguacgacuccgacuccugggccaaggaccucaucgucuccgcccuccuccucauccaguaccaccucgcccagggcggccgccgcgacgcccgcuccuucgucgaggccgccggcaccaccaacuuccccgccaacgagccccccgucgcccccgacgaguccugccucaaguccgcccccaucgucggcgaccaggagcaggccgagaagaaggaccuccgcuccgucuucuucaacuucauccgcaaccuccucuccgagaccaucuucaagcgcgaccagucccccgagcccaagguccccgagcagcccgucaaggaggaccgcaagcucugcgagcgcccccucgccuccucccccccccgccucuacgaggacgacgagacccccggcgcccucuccggccucaccaagauggccgucucccagaucgacggccacauguccggccagauggucgagcaccucaugaacuccgucaugaagcucugcgucaucaucgccaaguccugcgacgccucccucgccgagcucggcgacgacaaguccggcgacgccucccgccucaccuccgccuuccccgacucccucuacgagugccuccccgccaagggcaccggcuccgccgaggccguccuccagaacgccuaccaggccauccacaacgagaugcgcggcaccuccggccagccccccgagggcugcgccgcccccaccgucaucgucuccaaccacaaccucaccgacaccguccagaacaagcagcuccaggccguccuccagugggucgccgccuccgagcucaacguccccauccucuacuucgccggcgacgacgagggcauccaggagaagcuccuccagcucuccgccgccgccgucgacaagggcugcuccgucggcgagguccuccaguccguccuccgcuacgagaaggagcgccagcucaacgaggccgucggcaacgucaccccccuccagcuccucgacuggcucauggucaaccucuga

SEQ ID NO: 39570 - RNA, 2565 nt, Artificial Sequence
  derived and/or modified sequence opt2 from AKAP4__Homo_sapiens__NP_003877
augauggccuacuccgacaccaccaugauguccgacgacaucgacuggcuccgcucccaccgcggcgucugcaaggucgaccucuacaaccccgagggccagcaggaccaggaccgcaaggucaucugcuucgucgacgucuccacccucaacgucgaggacaaggacuacaaggacgccgccuccuccuccuccgagggcaaccucaaccucggcucccucgaggagaaggagaucaucgucaucaaggacaccgagaagaaggaccaguccaagaccgagggcuccgucugccucuucaagcaggcccccuccgaccccgucuccguccucaacuggcuccucuccgaccuccagaaguacgcccucggcuuccagcacgcccucucccccuccaccuccaccugcaagcacaaggucggcgacaccgagggcgaguaccaccgcgccuccuccgagaacugcuacuccgucuacgccgaccaggucaacaucgacuaccucaugaaccgcccccagaaccuccgccucgagaugaccgccgccaagaacaccaacaacaaccagucccccuccgccccccccgccaagccccccuccacccagcgcgccgucaucucccccgacggcgagugcuccaucgacgaccucuccuucuacgucaaccgccucuccucccucgucauccagauggcccacaaggagaucaaggagaagcucgagggcaaguccaagugccuccaccacuccaucugccccucccccggcaacaaggagcgcaucuccccccgcacccccgccuccaagaucgccuccgagauggccuacgaggccgucgagcucaccgccgccgagaugcgcggcaccggcgaggagucccgcgagggcggccagaaguccuuccucuacuccgagcucuccaacaaguccaaguccggcgacaagcagaugucccagcgcgaguccaaggaguucgccgacuccaucuccaagggccucauggucuacgccaaccaggucgccuccgacaugauggucucccucaugaagacccucaagguccacuccuccggcaagcccauccccgccuccgucguccucaagcgcguccuccuccgccacaccaaggagaucgucuccgaccucaucgacuccugcaugaagaaccuccacaacaucaccggcguccucaugaccgacuccgacuucgucuccgccgucaagcgcaaccucuucaaccaguggaagcagaacgccaccgacaucauggaggccaugcucaagcgccucgucuccgcccucaucggcgaggagaaggagaccaagucccagucccucuccuacgccucccucaaggccggcucccacgaccccaagugccgcaaccagucccucgaguucuccaccaugaaggccgagaugaaggagcgcgacaagggcaagaugaaguccgaccccugcaagucccucaccuccgccgagaaggucggcgagcacauccucaaggagggccucaccaucuggaaccagaagcagggcaacuccugcaaggucgccaccaaggccugcuccaacaaggacgagaagggcgagaagaucaacgccuccaccgacucccucgccaaggaccucaucgucuccgcccucaagcucauccaguaccaccucacccagcagaccaagggcaaggacaccugcgaggaggacugccccggcuccaccaugggcuacauggcccaguccacccaguacgagaagugcggcggcggccaguccgccaaggcccucuccgucaagcagcucgagucccaccgcgcccccggccccuccaccugccagaaggagaaccagcaccucgacucccagaagauggacauguccaacaucguccucaugcucauccagaagcuccucaacgagaaccccuucaagugcgaggaccccugcgagggcgagaacaagugcuccgagccccgcgccuccaaggccgccuccauguccaaccgcuccgacaaggccgaggagcagugccaggagcaccaggagcucgacugcaccuccggcaugaagcaggccaacggccaguucaucgacaagcucgucgaguccgucaugaagcucugccucaucauggccaaguacuccaacgacggcgccgcccucgccgagcucgaggagcaggccgccuccgccaacaagcccaacuuccgcggcacccgcugcauccacuccggcgccaugccccagaacuaccaggacucccucggccacgaggucaucgucaacaaccagugcuccaccaacucccuccagaagcagcuccaggccguccuccaguggaucgccgccucccaguucaacguccccaugcucuacuucaugggcgacaaggacggccagcucgagaagcucccccaggucuccgccaaggccgccgagaagggcuacuccgucggcggccuccuccaggaggucaugaaguucgccaaggagcgccagcccgacgaggccgucggcaaggucgcccgcaagcagcuccucgacuggcuccucgccaaccucuga

SEQ ID NO: 39571 - RNA, 1284 nt, Artificial Sequence
  derived and/or modified sequence opt2 from AKAP5__Homo_sapiens__NP_004848
auggagaccaccaucuccgagauccacgucgagaacaaggacgagaagcgcuccgccgagggcucccccggcgccgagcgccagaaggagaaggccuccaugcucugcuucaagcgccgcaagaaggccgccaaggcccucaagcccaaggccggcuccgaggccgccgacgucgcccgcaagugcccccaggaggccggcgccuccgaccagcccgagcccacccgcggcgccugggccucccucaagcgccucgucacccgccgcaagcgcuccgaguccuccaagcagcagaagccccucgagggcgagaugcagcccgccaucaacgccgaggacgccgaccucuccaagaagaaggccaagucccgccucaagauccccugcaucaaguucccccgcggccccaagcgcuccaaccacuccaagaucaucgaggacuccgacugcuccaucaagguccaggaggaggccgagauccucgacauccagacccagaccccccucaacgaccaggccaccaaggccaaguccacccaggaccucuccgagggcaucucccgcaaggacggcgacgaggucugcgaguccaacgucuccaacuccaccaccuccggcgagaaggucaucuccgucgagcucggccucgacaacggccacuccgccauccagaccggcacccucauccucgaggagaucgagaccaucaaggagaagcaggacguccagccccagcaggccuccccccucgagaccuccgagaccgaccaccagcagcccguccucuccgacguccccccccuccccgccauccccgaccagcagaucgucgaggaggccuccaacuccacccucgaguccgcccccaacggcaaggacuacgaguccaccgagaucgucgccgaggagaccaagcccaaggacaccgagcucucccaggaguccgacuucaaggagaacggcaucaccgaggagaaguccaaguccgaggaguccaagcgcauggagcccaucgccaucaucaucaccgacaccgagaucuccgaguucgacgucaccaaguccaagaacguccccaagcaguuccucaucuccgccgagaacgagcaggucggcgucuucgccaacgacaacggcuucgaggaccgcaccuccgagcaguacgagacccuccucaucgagaccgccuccucccucgucaagaacgccauccagcucuccaucgagcagcucgucaacgagauggccuccgacgacaacaagaucaacaaccuccuccaguga

SEQ ID NO: 39572 - RNA, 6960 nt, Artificial Sequence
  derived and/or modified sequence opt2 from AKAP6__Homo_sapiens__NP_004265
augcucaccauguccgucacccucuccccccuccgcucccaggaccucgaccccauggccaccgacgccucccccauggccaucaacaugacccccaccgucgagcagggcgagggcgaggaggccaugaaggacauggacuccgaccagcaguacgagaagccccccccccuccacaccggcgccgacuggaagaucguccuccaccuccccgagaucgagaccuggcuccgcaugaccuccgagcgcguccgcgaccucaccuacuccguccagcaggacuccgacuccaagcacgucgacguccaccucguccagcucaaggacaucugcgaggacaucuccgaccacgucgagcagauccacgcccuccucgagaccgaguucucccucaagcuccucuccuacuccgucaacgucaucgucgacauccacgccguccagcuccucuggcaccagcuccgcgucuccguccucguccuccgcgagcgcauccuccagggccuccaggacgccaacggcaacuacacccgccagaccgacauccuccaggccuucuccgaggagaccaaggagggccgccucgacucccucaccgaggucgacgacuccggccagcucaccaucaagugcucccagaacuaccucucccucgacugcggcaucaccgccuucgagcucuccgacuacucccccuccgaggaccuccucuccggccucggcgacaugaccuccucccaggucaagaccaagcccuucgacuccugguccuacuccgagauggagaaggaguuccccgagcucauccgcuccgucggccuccucaccgucgccgccgacuccaucuccaccaacggcuccgaggccgucaccgaggaggucucccaggucucccucuccgucgacgacaagggcggcugcgaggaggacaacgccuccgccgucgaggagcagcccggccucacccucggcgucuccuccuccuccggcgaggcccucaccaacgccgcccagcccuccuccgagaccguccagcaggaguccuccuccuccucccaccacgacgccaagaaccagcagcccguccccugcgagaacgccacccccaagcgcaccauccgcgacugcuucaacuacaacgaggacucccccacccagcccacccuccccaagcgcggccucuuccucaaggaggagaccuucaagaacgaccucaagggcaacggcggcaagcgccagauggucgaccucaagcccgagaugucccgcuccacccccucccucgucgacccccccgaccgcuccaagcucugccucguccuccaguccuccuaccccaacucccccuccgccgccucccaguccuacgagugccuccacaaggucggcaacggcaaccucgagaacaccgucaaguuccacaucaaggagaucuccuccucccucggccgccucaacgacugcuacaaggagaagucccgccucaagaagccccacaagaccuccgaggaggucccccccugccgcacccccaagcgcggcaccggcuccggcaagcaggccaagaacaccaaguccuccgccguccccaacggcgagcucuccuacaccuccaaggccaucgagggcccccagaccaacuccgccuccaccuccucccucgagcccugcaaccagcgcuccuggaacgccaagcuccagcuccaguccgagaccuccuccucccccgccuucacccaguccuccgaguccuccgucggcuccgacaacaucaugucccccgucccccuccucuccaagcacaaguccaagaagggccaggccuccucccccucccacgucacccgcaacggcgaggucgucgaggccugguacggcuccgacgaguaccucgcccuccccucccaccucaagcagaccgagguccucgcccucaagcucgagaaccucaccaagcuccucccccagaagccccgcggcgagaccauccagaacaucgacgacugggagcucuccgagaugaacuccgacuccgagaucuaccccaccuaccacgucaagaagaagcacacccgccucggccgcgucucccccuccuccuccuccgacaucgccuccucccucggcgaguccaucgaguccggcccccucuccgacauccucuccgacgaggaguccuccaugccccucgccggcaugaagaaguacgccgacgagaaguccgagcgcgccuccuccuccgagaagaacgagucccacuccgccaccaaguccgcccucauccagaagcucaugcaggacauccagcaccaggacaacuacgaggccaucugggagaagaucgagggcuucgucaacaagcucgacgaguucauccaguggcucaacgaggccauggagaccaccgagaacuggaccccccccaaggccgagauggacgaccucaagcucuaccucgagacccaccucuccuucaagcucaacgucgacucccacugcgcccucaaggaggccgucgaggaggagggccaccagcuccucgagcucaucgccucccacaaggccggccucaaggacaugcuccgcaugaucgccucccaguggaaggagcuccagcgccagaucaagcgccagcacuccuggauccuccgcgcccucgacaccaucaaggccgagauccucgccaccgacgucuccgucgaggacgaggagggcaccggcucccccaaggccgagguccagcucugcuaccucgaggcccagcgcgacgccgucgagcagaugucccucaagcucuacuccgagcaguacaccuccuccuccaagcgcaaggaggaguucgccgacauguccaagguccacuccgucggcuccaacggccuccucgacuucgacuccgaguaccaggagcucugggacuggcucaucgacauggagucccucgucauggacucccacgaccucaugauguccgaggagcagcagcagcaccucuacaagcgcuacuccgucgagauguccauccgccaccucaagaagaccgagcuccucuccaaggucgaggcccucaagaagggcggcguccuccuccccaacgaccuccucgagaaggucgacuccaucaacgagaagugggagcuccucggcaagacccucggcgagaagauccaggacaccauggccggccacuccggcuccuccccccgcgaccuccucucccccgaguccggcucccucguccgccagcucgagguccgcaucaaggagcucaagggcuggcuccgcgacaccgagcucuucaucuucaacuccugccuccgccaggagaaggagggcaccaugaacaccgagaagcagcuccaguacuucaagucccucugccgcgagaucaagcagcgccgccgcggcgucgccuccauccuccgccucugccagcaccuccucgacgaccgcgagaccugcaaccucaacgccgaccaccagcccaugcagcucaucaucgucaaccucgagcgccgcugggaggccaucgucaugcaggccguccaguggcagacccgccuccagaagaagaugggcaaggaguccgagacccucaacgucaucgaccccggccucauggaccucaacggcauguccgaggacgcccucgagugggacgagauggacaucuccaacaagcucaucucccucaacgaggaguccaacgaccucgaccaggagcuccagcccgucauccccucccucaagcucggcgagaccuccaacgaggaccccggcuacgacgaggaggccgacaaccacggcggcucccaguacgccuccaacaucaccgcccccuccuccccccacaucuaccaggucuacucccuccacaacgucgagcucuacgaggacaaccacaugcccuuccucaagaacaaccccaaggucaccggcaugacccagcccaacguccucaccaagucccucuccaaggacuccuccuucuccuccaccaagucccuccccgaccuccucggcggcuccaaccucgucaagcccugcgccugccacggcggcgacaugucccagaacuccggcuccgaguccggcaucgucuccgagggcgacaccgagaccaccaccaacuccgagaugugccuccucaacgccgucgacggcucccccuccaaccucgagaccgagcaccucgacccccagaugggcgacgccgucaacguccucaagcagaaguucaccgacgagggcgaguccaucaagcuccccaacuccucccaguccuccaucucccccgucggcugcgucaacggcaaggucggcgaccucaacuccaucaccaagcacacccccgacugccucggcgaggagcuccagggcaagcacgacgucuucaccuucuacgacuacuccuaccuccagggcuccaagcucaagcuccccaugaucaugaagcagucccaguccgagaaggcccacgucgaggacccccuccuccgcggcuucuacuucgacaagaaguccugcaaguccaagcaccagaccaccgagcuccagcccgacguccccccccacgagcgcauccucgccuccgccucccacgagauggaccgcaucuccuacaaguccggcaacaucgagaagaccuucaccggcaugcagaacgccaagcagcucucccuccucucccacuccuccuccaucgagucccucucccccggcggcgaccucuucggccucggcaucuucaagaacggcuccgacucccuccagcgcuccaccucccucgaguccuggcucaccuccuacaaguccaacgaggaccucuucuccugccacuccuccggcgacaucuccgucuccuccggcuccgucggcgagcucuccaagcgcacccucgaccuccucaaccgccucgagaacauccagucccccuccgagcagaagaucaagcgcuccgucuccgacaucacccuccaguccuccucccagaagauguccuucaccggccagaugucccucgacaucgccuccuccaucaacgaggacuccgccgccucccucaccgagcucuccuccuccgacgagcucucccucugcuccgaggacaucguccuccacaagaacaagauccccgaguccaacgccuccuuccgcaagcgccucacccgcuccgucgccgacgaguccgacgucaacgucuccaugaucgucaacgucuccugcaccuccgccugcaccgacgacgaggacgacuccgaccuccucuccuccuccacccucacccucaccgaggaggagcucugcaucaaggacgaggacgacgacuccuccaucgccaccgacgacgagaucuacgaggacugcacccucauguccggccucgacuacaucaagaacgagcuccagaccuggauccgccccaagcucucccucacccgcgacaagaagcgcugcaacgucuccgacgagaugaagggcuccaaggacaucuccuccuccgagaugaccaaccccuccgacacccucaacaucgagacccuccucaacggcuccgucaagcgcgucuccgagaacaacggcaacggcaagaacuccucccacacccacgagcucggcaccaagcgcgagaacaagaagaccaucuucaaggucaacaaggaccccuacgucgccgacauggagaacggcaacaucgagggcauccccgagcgccagaagggcaagcccaacgucaccuccaaggucuccgagaaccucggcucccacggcaaggagaucuccgaguccgagcacugcaagugcaaggcccucauggacucccucgacgacuccaacaccgccggcaaggaguucgucucccaggacguccgccaccuccccaagaagugccccaaccaccaccacuucgagaaccaguccaccgccuccacccccaccgagaaguccuucuccgagcucgcccucgagacccgcuucaacaaccgccaggacuccgacgcccucaaguccuccgacgacgcccccuccauggccggcaaguccgccggcugcugccucgcccucgagcagaacggcaccgaggagaacgccuccaucuccaacaucuccugcugcaacugcgagcccgacgucuuccaccagaaggacgccgaggacugcuccguccacaacuucgucaaggagaucaucgacauggccuccaccgcccucaaguccaagucccagcccgagaacgaggucgccgcccccaccucccucacccagaucaaggagaagguccucgagcacucccaccgccccauccagcuccgcaagggcgacuucuacuccuaccucucccucuccucccacgacuccgacugcggcgaggucaccaacuacaucgaggagaaguccuccaccccccucccccucgacaccaccgacuccggccucgacgacaaggaggacaucgagugcuucuucgaggccugcgucgagggcgacuccgacggcgaggagcccugcuucuccuccgccccccccaacgaguccgccguccccuccgaggccgccaugccccuccaggccaccgccugcuccuccgaguucuccgacuccucccucuccgccgacgacgccgacaccgucgcccucuccucccccuccucccaggagcgcgccgaggucggcaaggaggucaacggccucccccagaccuccuccggcugcgccgagaaccucgaguucacccccuccaagcucgacuccgagaaggaguccuccggcaagcccggcgaguccggcaugcccgaggagcacaacgccgccuccgccaaguccaagguccaggaccucucccucaaggccaaccagcccaccgacaaggccgcccuccaccccucccccaagacccucaccugcgaggagaaccuccucaaccuccacgagaagcgccaccgcaacaugcaccgcuga

SEQ ID NO: 39573 - RNA, 246 nt, Artificial Sequence
  derived and/or modified sequence opt2 from AKAP7__Homo_sapiens__NP_004833
augggccagcucugcugcuuccccuucucccgcgacgagggcaagaucuccgagaagaacggcggcgagcccgacgacgccgagcucguccgccucuccaagcgccucgucgagaacgccguccucaaggccguccagcaguaccucgaggagacccagaacaagaacaagcccggcgagggcuccuccgucaagaccgaggccgccgaccagaacggcaacgacaacgagaacaaccgcaaguga

SEQ ID NO: 39574 - RNA, 11724 nt, Artificial Sequence
  derived and/or modified sequence opt2 from AKAP9__Homo_sapiens__NP_005742
auggaggacgaggagcgccagaagaagcucgaggccggcaaggccaagcucgcccaguuccgccagcgcaaggcccaguccgacggccagucccccuccaagaagcagaagaagaagcgcaagaccuccuccuccaagcacgacgucuccgcccaccacgaccucaacaucgaccagucccagugcaacgagauguacaucaacuccucccagcgcgucgaguccaccgucauccccgaguccaccaucaugcgcacccuccacuccggcgagaucaccucccacgagcagggcuucuccgucgagcucgaguccgagaucuccaccaccgccgacgacugcuccuccgaggucaacggcugcuccuucgucaugcgcaccggcaagcccaccaaccuccuccgcgaggaggaguucggcgucgacgacuccuacuccgagcagggcgcccaggacucccccacccaccucgagaugauggaguccgagcucgccggcaagcagcacgagaucgaggagcucaaccgcgagcucgaggagaugcgcgucaccuacggcaccgagggccuccagcagcuccaggaguucgaggccgccaucaagcagcgcgacggcaucaucacccagcucaccgccaaccuccagcaggcccgccgcgagaaggacgagaccaugcgcgaguuccucgagcucaccgagcagucccagaagcuccagauccaguuccagcagcuccaggccuccgagacccuccgcaacuccacccacuccuccaccgccgccgaccuccuccaggccaagcagcagauccucacccaccagcagcagcucgaggagcaggaccaccuccucgaggacuaccagaagaagaaggaggacuucaccaugcagaucuccuuccuccaggagaagaucaaggucuacgagauggagcaggacaagaaggucgagaacuccaacaaggaggagauccaggagaaggagaccaucaucgaggagcucaacaccaagaucaucgaggaggagaagaagacccucgagcucaaggacaagcucaccaccgccgacaagcuccucggcgagcuccaggagcagaucguccagaagaaccaggagaucaagaacaugaagcucgagcucaccaacuccaagcagaaggagcgccaguccuccgaggagaucaagcagcucaugggcaccgucgaggagcuccagaagcgcaaccacaaggacucccaguucgagaccgacaucguccagcgcauggagcaggagacccagcgcaagcucgagcagcuccgcgccgagcucgacgagauguacggccagcagaucguccagaugaagcaggagcucauccgccagcacauggcccagauggaggagaugaagacccgccacaagggcgagauggagaacgcccuccgcuccuacuccaacaucaccgucaacgaggaccagaucaagcucaugaacgucgccaucaacgagcucaacaucaagcuccaggacaccaacucccagaaggagaagcucaaggaggagcucggccucauccucgaggagaagugcgcccuccagcgccagcucgaggaccucgucgaggagcucuccuucucccgcgagcagauccagcgcgcccgccagaccaucgccgagcaggaguccaagcucaacgaggcccacaagucccucuccaccgucgaggaccucaaggccgagaucgucuccgccuccgagucccgcaaggagcucgagcucaagcacgaggccgaggucaccaacuacaagaucaagcucgagaugcucgagaaggagaagaacgccguccucgaccgcauggccgagucccaggaggccgagcucgagcgccuccgcacccagcuccucuucucccacgaggaggagcucuccaagcucaaggaggaccucgagaucgagcaccgcaucaacaucgagaagcucaaggacaaccucggcauccacuacaagcagcagaucgacggccuccagaacgagaugucccagaagaucgagaccaugcaguucgagaaggacaaccucaucaccaagcagaaccagcucauccucgagaucuccaagcucaaggaccuccagcagucccucgucaacuccaaguccgaggagaugacccuccagaucaacgagcuccagaaggagaucgagauccuccgccaggaggagaaggagaagggcacccucgagcaggagguccaggagcuccagcucaagaccgagcuccucgagaagcagaugaaggagaaggagaacgaccuccaggagaaguucgcccagcucgaggccgagaacuccauccucaaggacgagaagaagacccucgaggacaugcucaagauccacacccccgucucccaggaggagcgccucaucuuccucgacuccaucaaguccaaguccaaggacuccgucugggagaaggagaucgagauccucaucgaggagaacgaggaccucaagcagcagugcauccagcucaacgaggagaucgagaagcagcgcaacaccuucuccuucgccgagaagaacuucgaggucaacuaccaggagcuccaggaggaguacgccugccuccucaaggucaaggacgaccucgaggacuccaagaacaagcaggagcucgaguacaaguccaagcucaaggcccucaacgaggagcuccaccuccagcgcaucaaccccaccaccgucaagaugaaguccuccgucuucgacgaggacaagaccuucgucgccgagacccucgagaugggcgaggucgucgagaaggacaccaccgagcucauggagaagcucgaggucaccaagcgcgagaagcucgagcucucccagcgccucuccgaccucuccgagcagcucaagcagaagcacggcgagaucuccuuccucaacgaggaggucaagucccucaagcaggagaaggagcaggucucccuccgcugccgcgagcucgagaucaucaucaaccacaaccgcgccgagaacguccaguccugcgacacccaggucuccucccuccucgacggcgucgucaccaugaccucccgcggcgccgagggcuccgucuccaaggucaacaaguccuucggcgaggaguccaagaucauggucgaggacaaggucuccuucgagaacaugaccgucggcgaggaguccaagcaggagcagcucauccucgaccaccuccccuccgucaccaaggaguccucccuccgcgccacccagcccuccgagaacgacaagcuccagaaggagcucaacguccucaaguccgagcagaacgaccuccgccuccagauggaggcccagcgcaucugccucucccucgucuacuccacccacgucgaccagguccgcgaguacauggagaacgagaaggacaaggcccucugcucccucaaggaggagcucaucuucgcccaggaggagaagaucaaggagcuccagaagauccaccagcucgagcuccagaccaugaagacccaggagaccggcgacgagggcaagccccuccaccuccucaucggcaagcuccagaaggccgucuccgaggagugcuccuacuuccuccagacccucugcuccguccucggcgaguacuacacccccgcccucaagugcgaggucaacgccgaggacaaggagaacuccggcgacuacaucuccgagaacgaggaccccgagcuccaggacuaccgcuacgagguccaggacuuccaggagaacaugcacacccuccucaacaaggucaccgaggaguacaacaagcuccucguccuccagacccgccucuccaagaucuggggccagcagaccgacggcaugaagcucgaguucggcgaggagaaccuccccaaggaggagaccgaguuccucuccauccacucccagaugaccaaccucgaggacaucgacgucaaccacaaguccaagcucuccucccuccaggaccucgagaagaccaagcucgaggagcagguccaggagcucgagucccucaucuccucccuccagcagcagcucaaggagaccgagcagaacuacgaggccgagauccacugccuccagaagcgccuccaggccgucuccgaguccaccgucccccccucccuccccgucgacuccgucgucaucaccgaguccgacgcccagcgcaccauguaccccggcuccugcgucaagaagaacaucgacggcaccaucgaguucuccggcgaguucggcgucaaggaggagaccaacaucgucaagcuccucgagaagcaguaccaggagcagcucgaggaggaggucgccaaggucaucgucuccauguccaucgccuucgcccagcagaccgagcucucccgcaucuccggcggcaaggagaacaccgccuccuccaagcaggcccacgccgucugccagcaggagcagcacuacuucaacgagaugaagcucucccaggaccagaucggcuuccagaccuucgagaccgucgacgucaaguucaaggaggaguucaagccccucuccaaggagcucggcgagcacggcaaggagauccuccucuccaacuccgacccccacgacauccccgaguccaaggacugcguccucaccaucuccgaggagauguucuccaaggacaagaccuucaucguccgccaguccauccacgacgagaucuccgucuccuccauggacgccucccgccagcucaugcucaacgaggagcagcucgaggacaugcgccaggagcucguccgccaguaccaggagcaccagcaggccaccgagcuccuccgccaggcccacaugcgccagauggagcgccagcgcgaggaccaggagcagcuccaggaggagaucaagcgccucaaccgccagcucgcccagcgcuccuccaucgacaacgagaaccucgucuccgagcgcgagcgcguccuccucgaggagcucgaggcccucaagcagcucucccucgccggccgcgagaagcucugcugcgagcuccgcaacuccuccacccagacccagaacggcaacgagaaccagggcgaggucgaggagcagaccuucaaggagaaggagcucgaccgcaagcccgaggacgucccccccgagauccucuccaacgagcgcuacgcccuccagaaggccaacaaccgccuccucaagauccuccucgaggucgucaagaccaccgccgccgucgaggagaccaucggccgccacguccucggcauccucgaccgcuccuccaagucccaguccuccgccucccucaucuggcgcuccgaggccgaggccuccgucaaguccugcguccacgaggagcacacccgcgucaccgacgaguccauccccuccuacuccggcuccgacaugccccgcaacgacaucaacaugugguccaaggucaccgaggagggcaccgagcucucccagcgccucguccgcuccggcuucgccggcaccgagaucgaccccgagaacgaggagcucaugcucaacaucuccucccgccuccaggccgccgucgagaagcuccucgaggccaucuccgagaccuccucccagcucgagcacgccaaggucacccagaccgagcucaugcgcgaguccuuccgccagaagcaggaggccaccgagucccucaagugccaggaggagcuccgcgagcgccuccacgaggagucccgcgcccgcgagcagcucgccgucgagcucuccaaggccgagggcgucaucgacggcuacgccgacgagaagacccucuucgagcgccagauccaggagaagaccgacaucaucgaccgccucgagcaggagcuccucugcgccuccaaccgccuccaggagcucgaggccgagcagcagcagauccaggaggagcgcgagcuccucucccgccagaaggaggccaugaaggccgaggccggccccgucgagcagcagcuccuccaggagaccgagaagcucaugaaggagaagcucgagguccagugccaggccgagaagguccgcgacgaccuccagaagcaggucaaggcccucgagaucgacgucgaggagcaggucucccgcuucaucgagcucgagcaggagaagaacaccgagcucauggaccuccgccagcagaaccaggcccucgagaagcagcucgagaagaugcgcaaguuccucgacgagcaggccaucgaccgcgagcacgagcgcgacgucuuccagcaggagauccagaagcucgagcagcagcucaaggucgucccccgcuuccagcccaucuccgagcaccagacccgcgaggucgagcagcucgccaaccaccucaaggagaagaccgacaagugcuccgagcuccuccucuccaaggagcagcuccagcgcgacauccaggagcgcaacgaggagaucgagaagcucgaguuccgcguccgcgagcucgagcaggcccuccucgucuccgccgacaccuuccagaaggucgaggaccgcaagcacuucggcgccgucgaggccaagcccgagcucucccucgagguccagcuccaggccgagcgcgacgccaucgaccgcaaggagaaggagaucaccaaccucgaggagcagcucgagcaguuccgcgaggagcucgagaacaagaacgaggagguccagcagcuccacaugcagcucgagauccagaagaaggaguccaccacccgccuccaggagcucgagcaggagaacaagcucuucaaggacgacauggagaagcucggccucgccaucaaggaguccgacgccauguccacccaggaccagcacguccucuucggcaaguucgcccagaucauccaggagaaggaggucgagaucgaccagcucaacgagcaggucaccaagcuccagcagcagcucaagaucaccaccgacaacaaggucaucgaggagaagaacgagcucauccgcgaccucgagacccagaucgagugccucauguccgaccaggagugcgucaagcgcaaccgcgaggaggagaucgagcagcucaacgaggucaucgagaagcuccagcaggagcucgccaacaucggccagaagaccuccaugaacgcccacucccucuccgaggaggccgacucccucaagcaccagcucgacgucgucaucgccgagaagcucgcccucgagcagcaggucgagaccgccaacgaggagaugaccuucaugaagaacguccucaaggagaccaacuucaagaugaaccagcucacccaggagcucuucucccucaagcgcgagcgcgaguccgucgagaagauccaguccauccccgagaacuccgucaacgucgccaucgaccaccucuccaaggacaagcccgagcucgaggucguccucaccgaggacgcccucaagucccucgagaaccagaccuacuucaaguccuucgaggagaacggcaagggcuccaucaucaaccucgagacccgccuccuccagcucgaguccaccgucuccgccaaggaccucgagcucacccagugcuacaagcagaucaaggacaugcaggagcagggccaguucgagaccgagaugcuccagaagaagaucgucaaccuccagaagaucgucgaggagaaggucgccgccgcccucgucucccagauccagcucgaggccguccaggaguacgccaaguucugccaggacaaccagaccaucuccuccgagcccgagcgcaccaacauccagaaccucaaccagcuccgcgaggacgagcucggcuccgacaucuccgcccucacccuccgcaucuccgagcucgagucccaggucgucgagaugcacaccucccucauccucgagaaggagcaggucgagaucgccgagaagaacguccucgagaaggagaagaagcuccucgagcuccagaagcuccucgagggcaacgagaagaagcagcgcgagaaggagaagaagcgcuccccccaggacgucgagguccucaagaccaccaccgagcucuuccacuccaacgaggaguccggcuucuucaacgagcucgaggcccuccgcgccgaguccgucgccaccaaggccgagcucgccuccuacaaggagaaggccgagaagcuccaggaggagcuccucgucaaggagaccaacaugaccucccuccagaaggaccucucccagguccgcgaccaccucgccgaggccaaggagaagcucuccauccucgagaaggaggacgagaccgagguccaggaguccaagaaggccugcauguucgagccccuccccaucaagcucuccaaguccaucgccucccagaccgacggcacccucaagaucuccuccuccaaccagaccccccagauccucgucaagaacgccggcauccagaucaaccuccaguccgagugcuccuccgaggaggucaccgagaucaucucccaguucaccgagaagaucgagaagaugcaggagcuccacgccgccgagauccucgacauggagucccgccacaucuccgagaccgagacccucaagcgcgagcacuacgucgccguccagcuccucaaggaggagugcggcacccucaaggccgucauccagugccuccgcuccaaggagggcuccuccauccccgagcucgcccacuccgacgccuaccagacccgcgagaucugcuccuccgacuccggcuccgacuggggccagggcaucuaccucacccacucccagggcuucgacaucgccuccgagggccgcggcgaggaguccgaguccgccaccgacuccuuccccaagaagaucaagggccuccuccgcgccguccacaacgagggcaugcagguccucucccucaccgagucccccuacuccgacggcgaggaccacuccauccagcaggucuccgagcccuggcucgaggagcgcaaggccuacaucaacaccaucuccucccucaaggaccucaucaccaagaugcagcuccagcgcgaggccgaggucuacgacuccucccagucccacgaguccuucuccgacuggcgcggcgagcuccuccucgcccuccagcaggucuuccucgaggagcgcuccguccuccucgccgccuuccgcaccgagcucaccgcccucggcaccaccgacgccgucggccuccucaacugccucgagcagcgcauccaggagcagggcgucgaguaccaggccgccauggagugccuccagaaggccgaccgccgcucccuccucuccgagauccaggcccuccacgcccagaugaacggccgcaagaucacccucaagcgcgagcaggaguccgagaagcccucccaggagcuccucgaguacaacauccagcagaagcagucccagaugcucgagaugcaggucgagcucuccuccaugaaggaccgcgccaccgagcuccaggagcagcucuccuccgagaagauggucgucgccgagcucaaguccgagcucgcccagaccaagcucgagcucgagaccacccucaaggcccagcacaagcaccucaaggagcucgaggccuuccgccucgaggucaaggacaagaccgacgagguccaccuccucaacgacacccucgccuccgagcagaagaagucccgcgagcuccagugggcccucgagaaggagaaggccaagcucggccgcuccgaggagcgcgacaaggaggagcucgaggaccucaaguucucccucgagucccagaagcagcgcaaccuccagcucaaccuccuccucgagcagcagaagcagcuccucaacgagucccagcagaagaucgagucccagcgcaugcucuacgacgcccagcucuccgaggagcagggccgcaaccucgagcuccagguccuccucgaguccgagaagguccgcauccgcgagauguccuccacccucgaccgcgagcgcgagcuccacgcccagcuccaguccuccgacggcaccggccagucccgccccccccuccccuccgaggaccuccucaaggagcuccagaagcagcucgaggagaagcacucccgcaucgucgagcuccucaacgagaccgagaaguacaagcucgacucccuccagacccgccagcagauggagaaggaccgccagguccaccgcaagacccuccagaccgagcaggaggccaacaccgagggccagaagaagaugcacgagcuccaguccaaggucgaggaccuccagcgccagcucgaggagaagcgccagcaggucuacaagcucgaccucgagggccagcgccuccagggcaucaugcaggaguuccagaagcaggagcucgagcgcgaggagaagcgcgagucccgccgcauccucuaccagaaccucaacgagcccaccaccuggucccucaccuccgaccgcacccgcaacuggguccuccagcagaagaucgagggcgagaccaaggaguccaacuacgccaagcucaucgagaugaacggcggcggcaccggcugcaaccacgagcucgagaugauccgccagaagcuccagugcgucgccuccaagcuccagguccucccccagaaggccuccgagcgccuccaguucgagaccgccgacgacgaggacuucaucuggguccaggagaacaucgacgagaucauccuccagcuccagaagcucaccggccagcagggcgaggagcccucccucgucucccccuccaccuccugcggcucccucaccgagcgccuccuccgccagaacgccgagcucaccggccacaucucccagcucaccgaggagaagaacgaccuccgcaacauggucaugaagcucgaggagcagauccgcugguaccgccagaccggcgccggccgcgacaacuccucccgcuucucccucaacggcggcgccaacaucgaggccaucaucgccuccgagaaggaggucuggaaccgcgagaagcucacccuccagaagucccucaagcgcgccgaggccgaggucuacaagcucaaggccgagcuccgcaacgacucccuccuccagacccucucccccgacuccgagcacgucacccucaagcgcaucuacggcaaguaccuccgcgccgaguccuuccgcaaggcccucaucuaccagaagaaguaccuccuccuccuccucggcggcuuccaggagugcgaggacgccacccucgcccuccucgcccgcaugggcggccagcccgccuucaccgaccucgaggucaucaccaaccgccccaagggcuucacccgcuuccgcuccgccguccgcgucuccaucgccaucucccgcaugaaguuccucguccgccgcuggcaccgcgucaccggcuccgucuccaucaacaucaaccgcgacggcuucggccucaaccagggcgccgagaagaccgacuccuucuaccacuccuccggcggccucgagcucuacggcgagccccgccacaccaccuaccgcucccgcuccgaccucgacuacauccgcuccccccuccccuuccagaaccgcuaccccggcacccccgccgacuucaaccccggcucccucgccugcucccagcuccagaacuacgaccccgaccgcgcccucaccgacuacaucacccgccucgaggcccuccagcgccgccucggcaccauccaguccggcuccaccacccaguuccacgccggcaugcgccgcuga

SEQ ID NO: 39575 - RNA, 552 nt, Artificial Sequence
  derived and/or modified sequence opt2 from AKIP1__Homo_sapiens__NP_001193575
auggacaacugccucgccgccgccgcccucaacggcgucgaccgccgcucccuccagcgcuccgcccgccucgcccucgagguccucgagcgcgccaagcgccgcgccgucgacuggcacgcccucgagcgccccaagggcugcaugggcguccucgcccgcgaggccccccaccucgagaagcagcccgccgccggcccccagcgcguccuccccggcgagaaguacuacuccuccguccccgaggagggcggcgccacccacgucuaccgcuaccaccgcggcgaguccaagcuccacaugugccucgacaucggcaacggccagcgcaaggaccgcaagaagaccucccucggccccggcggcuccuaccagaucuccgagcacgcccccgaggccucccagcccgccgagaacaucuccaaggaccucuacaucgaggucuaccccggcaccuacuccgucaccgucggcuccaacgaccucaccaagaagacccacgucgucgccgucgacuccggccaguccgucgaccucgucuuccccgucuga

SEQ ID NO: 39576 - RNA, 612 nt, Artificial Sequence
  derived and/or modified sequence opt2 from AKIRIN2__Homo_sapiens__NP_060534
auggccugcggcgccacccucaagcgcacccucgacuucgacccccuccucucccccgccucccccaagcgccgccgcugcgccccccucuccgcccccaccuccgccgccgccuccccccucuccgccgccgccgccaccgccgccuccuucuccgccgccgccgccuccccccagaaguaccuccgcauggagcccucccccuucggcgacgucuccucccgccucaccaccgagcagauccucuacaacaucaagcaggaguacaagcgcaugcagaagcgccgccaccucgagaccuccuuccagcagaccgaccccugcugcaccuccgacgcccagccccacgccuuccuccucuccggccccgccucccccggcaccuccuccgccgccuccuccccccucaagaaggagcagccccucuucacccuccgccaggucggcaugaucugcgagcgccuccucaaggagcgcgaggagaagguccgcgaggaguacgaggagauccucaacaccaagcucgccgagcaguacgacgccuucgucaaguucacccacgaccagaucaugcgccgcuacggcgagcagcccgccuccuacgucuccuga

SEQ ID NO: 39577 - RNA, 4320 nt, Artificial Sequence
  derived and/or modified sequence opt2 from AKNA__Homo_sapiens__NP_110394
auggccuccuccgagaccgagauccgcugggccgagcccggccucggcaagggcccccagcgccgccgcugggccugggccgaggacaagcgcgacgucgaccgcuccuccucccaguccugggaggaggagcgccucuuccccaacgccaccucccccgagcuccucgaggacuuccgccucgcccagcagcaccuccccccccucgagugggacccccacccccagcccgacggccaccaggacuccgaguccggcgagaccuccggcgaggaggccgaggccgaggacgucgacucccccgccuccucccacgagccccucgccuggcucccccagcagggccgccagcucgacaugaccgaggaggagcccgacggcacccucggcucccucgaggucgaggaggccggcgaguccuccucccgccucggcuacgaggccggccucucccucgagggccacggcaacaccucccccauggcccucggccacggccaggcccgcggcugggucgccuccggcgagcaggccuccggcgacaagcucuccgagcacuccgaggucaaccccuccgucgagcucucccccgcccgcuccugguccuccggcaccgucucccucgaccaccccuccgacucccucgacuccaccugggagggcgagaccgacggcccccagcccaccgcccucgccgagacccuccccgagggccccucccaccaccuccucucccccgacggccgcaccggcggcuccgucgcccgcgccacccccauggaguuccaggacuccuccgccccccccgcccaguccccccagcacgccaccgaccgcuggcgccgcgagaccacccgcuucuucugcccccagcccaaggagcacaucuggaagcagaccaagaccucccccaagccccuccccucccgcuucaucggcuccaucuccccccucaacccccagccccgccccacccgccagggccgcccccucccccgccagggcgccacccucgccggccgcuccuccuccaacgcccccaaguacggccgcggccagcucaacuacccccuccccgacuucuccaaggucggcccccgcguccgcuuccccaaggacgaguccuaccgcccccccaagucccgcucccacaaccgcaagccccaggcccccgcccgcccccucaucuucaagucccccgccgagaucguccaggagguccuccucuccuccggcgaggccgcccucgccaaggacaccccccccgcccaccccaucacccgcgucccccaggaguuccagacccccgagcaggccaccgagcucguccaccagcuccaggaggacuaccaccgccuccucaccaaguacgccgaggccgagaacaccaucgaccagcuccgccucggcgccaaggucaaccucuucuccgaccccccccagcccaaccacuccauccacaccggcauggucccccagggcaccaagguccucuccuucaccaucccccagccccgcuccgccgagugguggcccggccccgccgaggacccccaggccuccgccgccuccggcuggcccuccgcccgcggcgaccucucccccuccucccucaccuccaugcccacccucggcuggcuccccgagaaccgcgacaucuccgaggaccaguccuccgccgagcagacccaggcccucgccucccaggccucccaguuccucgccaaggucgaguccuucgagcgccucauccaggccggccgccucaugccccaggaccaggucaagggcuuccagcgccucaaggccgcccacgccgcccucgaggaggaguaccucaaggccugccgcgagcagcaccccgcccagccccucgccggcuccaagggcacccccggccgcuucgacccccgccgcgagcucgaggccgagaucuaccgccucggcuccugccucgaggagcucaaggagcacaucgaccagacccagcaggagcccgagccccccggcuccgacuccgcccucgacuccacccccgcccuccccugccuccaccagcccacccaccuccccgcccccuccggccaggcccccaugcccgccaucaagaccuccugccccgagcccgccaccaccaccgccgccgccuccaccggccccugcccccuccacgucaacgucgaggucuccuccggcaacuccgaggucgaggaccgcccccaggacccccucgcccgccuccgccacaaggagcuccagauggagcaggucuaccacggccucauggagcgcuaccucuccgucaagucccuccccgaggccaugcgcauggaggaggaggaggagggcgaggaggaggaggaggaggagggcggcggcgacucccucgaggucgacggcgucgccgccacccccggcaaggccgaggccacccgcguccucccccgccagugccccguccaggccgagaagucccacggcgccccccucgaggaggccaccgagaagauggucuccaugaagccccccggcuuccaggccucccucgcccgcgacggccacauguccggccucggcaaggccgaggccgccccccccggccccggcguccccccccacccccccggcaccaaguccgccgccucccaccaguccuccaugaccucccucgagggcuccggcaucuccgagcgccucccccagaagccccuccaccgcggcggcggcccccaccucgaggagaccuggauggccucccccgagaccgacuccggcuucgucggcuccgagaccucccgcgucuccccccucacccagacccccgagcaccgccucucccacaucuccaccgccggcacccucgcccagcccuucgccgccuccgucccccgcgacggcgccuccuaccccaaggcccgcggcucccucaucccccgccgcgccaccgagcccuccaccccccgcucccaggcccagcgcuaccucuccucccccuccggcccccuccgccagcgcgcccccaacuucucccucgagcgcacccucgccgccgagauggccguccccggcuccgaguucgagggccacaagcgcaucuccgagcagccccuccccaacaagaccaucucccccccccccgcccccgcccccgccgccgccccccuccccugcggccccaccgagaccauccccuccuuccuccucacccgcgccggccgcgaccaggccaucugcgagcuccaggaggaggucucccgccuccgccuccgccucgaggacucccuccaccagccccuccagggcucccccacccgccccgccuccgccuucgaccgccccgcccgcacccgcggccgccccgccgacucccccgccaccuggggcucccacuacggcuccaaguccaccgagcgccuccccggcgagccccgcggcgaggagcagaucgucccccccggccgccagcgcgcccgcuccuccuccgucccccgcgagguccuccgccucucccucuccuccgaguccgagcuccccucccucccccucuucuccgagaaguccaagaccaccaaggacuccccccaggccgcccgcgacggcaagcgcggcgucggcuccgccggcuggcccgaccgcgucaccuuccgcggccaguacaccggccacgaguaccacguccucucccccaaggccguccccaagggcaacggcaccgucuccugcccccacugccgccccauccgcacccaggacgccggcggcgccgucaccggcgacccccucggccccccccccgccgacacccuccagugcccccucugcggccaggucggcuccccccccgaggccgacggccccggcuccgccaccuccggcgccgagaaggccaccacccgccgcaaggccuccuccacccccucccccaagcagcgcuccaagcaggccggcuccuccccccgccccccccccggccucugguaccucgccaccgccccccccgcccccgccccccccgccuucgccuacaucuccuccguccccaucaugcccuacccccccgccgccgucuacuacgcccccgccggccccaccuccgcccagcccgccgccaaguggccccccaccgccucccccccccccgcccgccgccaccgccacuccauccagcucgaccucggcgaccucgaggagcucaacaaggcccucucccgcgccguccaggccgccgaguccguccgcuccaccacccgccagaugcgcuccucccucuccgccgaccuccgccaggcccacucccuccgcggcuccugccucuucuga

SEQ ID NO: 39578 - RNA, 951 nt, Artificial Sequence
  derived and/or modified sequence opt2 from AKR1B10__Homo_sapiens__NP_064695
auggccaccuucgucgagcucuccaccaaggccaagaugcccaucgucggccucggcaccuggaaguccccccucggcaaggucaaggaggccgucaaggucgccaucgacgccggcuaccgccacaucgacugcgccuacgucuaccagaacgagcacgaggucggcgaggccauccaggagaagauccaggagaaggccgucaagcgcgaggaccucuucaucgucuccaagcucuggcccaccuucuucgagcgcccccucguccgcaaggccuucgagaagacccucaaggaccucaagcucuccuaccucgacgucuaccucauccacuggccccagggcuucaaguccggcgacgaccucuuccccaaggacgacaagggcaacgccaucggcggcaaggccaccuuccucgacgccugggaggccauggaggagcucgucgacgagggccucgucaaggcccucggcgucuccaacuucucccacuuccagaucgagaagcuccucaacaagcccggccucaaguacaagcccgucaccaaccaggucgagugccaccccuaccucacccaggagaagcucauccaguacugccacuccaagggcaucaccgucaccgccuacuccccccucggcucccccgaccgccccugggccaagcccgaggaccccucccuccucgaggaccccaagaucaaggagaucgccgccaagcacaagaagaccgccgcccagguccucauccgcuuccacauccagcgcaacgucaucgucauccccaaguccgucacccccgcccgcaucgucgagaacauccaggucuucgacuucaagcucuccgacgaggagauggccaccauccucuccuucaaccgcaacuggcgcgccugcaacguccuccaguccucccaccucgaggacuaccccuucaacgccgaguacuga

SEQ ID NO: 39579 - RNA, 951 nt, Artificial Sequence
  derived and/or modified sequence opt2 from AKR1B1__Homo_sapiens__NP_001619
auggccucccgccuccuccucaacaacggcgccaagaugcccauccucggccucggcaccuggaaguccccccccggccaggucaccgaggccgucaaggucgccaucgacgucggcuaccgccacaucgacugcgcccacgucuaccagaacgagaacgaggucggcgucgccauccaggagaagcuccgcgagcaggucgucaagcgcgaggagcucuucaucgucuccaagcucuggugcaccuaccacgagaagggccucgucaagggcgccugccagaagacccucuccgaccucaagcucgacuaccucgaccucuaccucauccacuggcccaccggcuucaagcccggcaaggaguucuucccccucgacgaguccggcaacgucguccccuccgacaccaacauccucgacaccugggccgccauggaggagcucgucgacgagggccucgucaaggccaucggcaucuccaacuucaaccaccuccaggucgagaugauccucaacaagcccggccucaaguacaagcccgccgucaaccagaucgagugccaccccuaccucacccaggagaagcucauccaguacugccaguccaagggcaucgucgucaccgccuacuccccccucggcucccccgaccgccccugggccaagcccgaggaccccucccuccucgaggacccccgcaucaaggccaucgccgccaagcacaacaagaccaccgcccagguccucauccgcuuccccaugcagcgcaaccucgucgucauccccaaguccgucacccccgagcgcaucgccgagaacuucaaggucuucgacuucgagcucuccucccaggacaugaccacccuccucuccuacaaccgcaacuggcgcgucugcgcccuccucuccugcaccucccacaaggacuaccccuuccacgaggaguucuga

SEQ ID NO: 39580 - RNA, 972 nt, Artificial Sequence
  derived and/or modified sequence opt2 from AKR1C1__Homo_sapiens__NP_001344
auggacuccaaguaccagugcgucaagcucaacgacggccacuucaugcccguccucggcuucggcaccuacgcccccgccgagguccccaaguccaaggcccucgaggccaccaagcucgccaucgaggccggcuuccgccacaucgacuccgcccaccucuacaacaacgaggagcaggucggccucgccauccgcuccaagaucgccgacggcuccgucaagcgcgaggacaucuucuacaccuccaagcucuggugcaacucccaccgccccgagcucguccgccccgcccucgagcgcucccucaagaaccuccagcucgacuacgucgaccucuaccucauccacuuccccgucuccgucaagcccggcgaggaggucauccccaaggacgagaacggcaagauccucuucgacaccgucgaccucugcgccaccugggaggccgucgagaagugcaaggacgccggccucgccaaguccaucggcgucuccaacuucaaccgccgccagcucgagaugauccucaacaagcccggccucaaguacaagcccgucugcaaccaggucgagugccaccccuacuucaaccagcgcaagcuccucgacuucugcaaguccaaggacaucguccucgucgccuacuccgcccucggcucccaccgcgaggagcccugggucgaccccaacucccccguccuccucgaggaccccguccucugcgcccucgccaagaagcacaagcgcacccccgcccucaucgcccuccgcuaccagcuccagcgcggcgucgucguccucgccaaguccuacaacgagcagcgcauccgccagaacguccaggucuucgaguuccagcucaccuccgaggagaugaaggccaucgacggccucaaccgcaacguccgcuaccucacccucgacaucuucgccggcccccccaacuaccccuucuccgacgaguacuga

SEQ ID NO: 39581 - RNA, 420 nt, Artificial Sequence
  derived and/or modified sequence opt2 from AKR1C2__Homo_sapiens__NP_001128713
auggacuccaaguaccagugcgucaagcucaacgacggccacuucaugcccguccucggcuucggcaccuacgcccccgccgagguccccaaguccaaggcccucgaggccgucaagcucgccaucgaggccggcuuccaccacaucgacuccgcccacgucuacaacaacgaggagcaggucggccucgccauccgcuccaagaucgccgacggcuccgucaagcgcgaggacaucuucuacaccuccaagcucugguccaacucccaccgccccgagcucguccgccccgcccucgagcgcucccucaagaaccuccagcucgacuacgucgaccucuaccucauccacuuccccgucuccgucaaggaggacaucggcauccucaccuggaagaagucccccaagcacaacuccuga

SEQ ID NO: 39582 - RNA, 972 nt, Artificial Sequence
  derived and/or modified sequence opt2 from AKR1C3__Homo_sapiens__NP_001240837
auggacuccaagcaccagugccucaagcucaacgacggccacuucaugcccguccucggcuucggcaccuacgccccccccgaggucccccgcuccaaggcccucgaggucaccaagcucgccaucgaggccggcuuccgccacaucgacuccgcccaccucuacaacaacgaggagcaggucggccucgccauccgcuccaagaucgccgacggcuccgucaagcgcgaggacaucuucuacaccuccaagcucugguccaccuuccaccgccccgagcucguccgccccgcccucgagaacucccucaagaaggcccagcucgacuacgucgaccucuaccucauccacucccccaugucccucaagcccggcgaggagcucucccccaccgacgagaacggcaaggucaucuucgacaucgucgaccucugcaccaccugggaggccauggagaagugcaaggacgccggccucgccaaguccaucggcgucuccaacuucaaccgccgccagcucgagaugauccucaacaagcccggccucaaguacaagcccgucugcaaccaggucgagugccaccccuacuucaaccgcuccaagcuccucgacuucugcaaguccaaggacaucguccucgucgccuacuccgcccucggcucccagcgcgacaagcgcugggucgaccccaacucccccguccuccucgaggaccccguccucugcgcccucgccaagaagcacaagcgcacccccgcccucaucgcccuccgcuaccagcuccagcgcggcgucgucguccucgccaaguccuacaacgagcagcgcauccgccagaacguccaggucuucgaguuccagcucaccgccgaggacaugaaggccaucgacggccucgaccgcaaccuccacuacuucaacuccgacuccuucgccucccaccccaacuaccccuacuccgacgaguacuga

SEQ ID NO: 39583 - RNA, 972 nt, Artificial Sequence
  derived and/or modified sequence opt2 from AKR1C4__Homo_sapiens__NP_001809
auggaccccaaguaccagcgcgucgagcucaacgacggccacuucaugcccguccucggcuucggcaccuacgccccccccgaggucccccgcaaccgcgccgucgaggucaccaagcucgccaucgaggccggcuuccgccacaucgacuccgccuaccucuacaacaacgaggagcaggucggccucgccauccgcuccaagaucgccgacggcuccgucaagcgcgaggacaucuucuacaccuccaagcucuggugcaccuucuuccagccccagaugguccagcccgcccucgaguccucccucaagaagcuccagcucgacuacgucgaccucuaccuccuccacuuccccauggcccucaagcccggcgagaccccccuccccaaggacgagaacggcaaggucaucuucgacaccgucgaccucuccgccaccugggaggucauggagaagugcaaggacgccggccucgccaaguccaucggcgucuccaacuucaacugccgccagcucgagaugauccucaacaagcccggccucaaguacaagcccgucugcaaccaggucgagugccaccccuaccucaaccaguccaagcuccucgacuucugcaaguccaaggacaucguccucgucgcccacuccgcccucggcacccagcgccacaagcucugggucgaccccaacucccccguccuccucgaggaccccguccucugcgcccucgccaagaagcacaagcgcacccccgcccucaucgcccuccgcuaccagcuccagcgcggcgucgucguccucgccaaguccuacaacgagcagcgcauccgcgagaacauccaggucuucgaguuccagcucaccuccgaggacaugaagguccucgacggccucaaccgcaacuaccgcuacgucgucauggacuuccucauggaccaccccgacuaccccuucuccgacgaguacuga

SEQ ID NO: 39584 - RNA, 858 nt, Artificial Sequence
  derived and/or modified sequence opt2 from AKR1D1__Homo_sapiens__NP_001177835
auggaccucuccgccgccucccaccgcaucccccucuccgacggcaacuccauccccaucaucggccucggcaccuacuccgagcccaaguccacccccaagggcgccugcgccaccuccgucaaggucgccaucgacaccggcuaccgccacaucgacggcgccuacaucuaccagaacgagcacgaggucggcgaggccauccgcgagaagaucgccgagggcaagguccgccgcgaggacaucuucuacugcggcaagcucugggccaccaaccacguccccgagaugguccgccccacccucgagcgcacccuccgcguccuccagcucgacuacgucgaccucuacaucaucgagguccccauggccuucaagcccggcgacgagaucuacccccgcgacgagaacggcaaguggcucuaccacaaguccaaccucugcgccaccugggaggucgagugccaccccuacuucacccagcccaagcuccucaaguucugccagcagcacgacaucgucaucaccgccuacuccccccucggcaccucccgcaaccccaucugggucaacgucuccucccccccccuccucaaggacgcccuccucaacucccucggcaagcgcuacaacaagaccgccgcccagaucguccuccgcuucaacauccagcgcggcgucgucgucauccccaaguccuucaaccucgagcgcaucaaggagaacuuccagaucuucgacuucucccucaccgaggaggagaugaaggacaucgaggcccucaacaagaacguccgcuucgucgagcuccucauguggcgcgaccaccccgaguaccccuuccacgacgaguacuga

SEQ ID NO: 39585 - RNA, 963 nt, Artificial Sequence
  derived and/or modified sequence opt2 from AKR1E2__Homo_sapiens__NP_001035267
augggcgacauccccgccgucggccucuccuccuggaaggccucccccggcaaggucaccgaggccgucaaggaggccaucgacgccggcuaccgccacuucgacugcgccuacuucuaccacaacgagcgcgaggucggcgccggcauccgcugcaagaucaaggagggcgccguccgccgcgaggaccucuucaucgccaccaagcucuggugcaccugccacaagaagucccucgucgagaccgccugccgcaagucccucaaggcccucaagcucaacuaccucgaccucuaccucauccacuggcccaugggcuucaagcccccccaccccgaguggaucauguccugcuccgagcucuccuucugccucucccacccccgcguccaggaccucccccucgacgaguccaacauggucauccccuccgacaccgacuuccucgacaccugggaggccauggaggaccucgucaucaccggccucgucaagaacaucggcgucuccaacuucaaccacgagcagcucgagcgccuccucaacaagcccggccuccgcuucaagccccucaccaaccagaucgagugccaccccuaccucacccagaagaaccucaucuccuucugccagucccgcgacgucuccgucaccgccuaccgcccccucggcggcuccugcgagggcgucgaccucaucgacaaccccgucaucaagcgcaucgccaaggagcacggcaagucccccgcccagauccucauccgcuuccagauccagcgcaacgucaucgucauccccggcuccaucacccccucccacaucaaggagaacauccaggucuucgacuucgagcucacccagcacgacauggacaacauccucucccucaaccgcaaccuccgccucgccauguuccccaucaccaagaaccacaaggacuaccccuuccacaucgaguacuga

SEQ ID NO: 39586 - RNA, 519 nt, Artificial Sequence
  derived and/or modified sequence opt2 from AKR7A3__Homo_sapiens__XP_011539349
augucccgccagcucucccgcgcccgccccgccaccguccucggcgccauggagaugggccgccgcauggacgcccccaccuccgccgccgucacccgcgccuuccucgagcgcggccacaccgagaucgacaccgccuucgucuacuccgagggccaguccgagaccauccucggcggccucggccuccgccucggcggcuccgacugccgcgucaagaucgacaccaaggccaucccccucuucggcaacucccucaagcccgacucccuccgcuuccagcucgagaccucccucaagcgccuccagugcccccgcgucgaccucuucuaccuccacaugcccgaccacuccacccccgucgaggagacccuccgcgccugccaccagcuccaccaggagggcaaguucgucgagcucggccucuccaacuacgccgccugggaggucgccgagaucugcacccucugcaaguccaacggcuggauccuccccaccgucuaccagggcgccugcuga

SEQ ID NO: 39587 - RNA, 1443 nt, Artificial Sequence
  derived and/or modified sequence opt2 from AKT1__Homo_sapiens__NP_001014431
auguccgacgucgccaucgucaaggagggcuggcuccacaagcgcggcgaguacaucaagaccuggcgcccccgcuacuuccuccucaagaacgacggcaccuucaucggcuacaaggagcgcccccaggacgucgaccagcgcgaggccccccucaacaacuucuccgucgcccagugccagcucaugaagaccgagcgcccccgccccaacaccuucaucauccgcugccuccaguggaccaccgucaucgagcgcaccuuccacgucgagacccccgaggagcgcgaggaguggaccaccgccauccagaccgucgccgacggccucaagaagcaggaggaggaggagauggacuuccgcuccggcucccccuccgacaacuccggcgccgaggagauggaggucucccucgccaagcccaagcaccgcgucaccaugaacgaguucgaguaccucaagcuccucggcaagggcaccuucggcaaggucauccucgucaaggagaaggccaccggccgcuacuacgccaugaagauccucaagaaggaggucaucgucgccaaggacgaggucgcccacacccucaccgagaaccgcguccuccagaacucccgccaccccuuccucaccgcccucaaguacuccuuccagacccacgaccgccucugcuucgucauggaguacgccaacggcggcgagcucuucuuccaccucucccgcgagcgcgucuucuccgaggaccgcgcccgcuucuacggcgccgagaucgucuccgcccucgacuaccuccacuccgagaagaacgucgucuaccgcgaccucaagcucgagaaccucaugcucgacaaggacggccacaucaagaucaccgacuucggccucugcaaggagggcaucaaggacggcgccaccaugaagaccuucugcggcacccccgaguaccucgcccccgagguccucgaggacaacgacuacggccgcgccgucgacugguggggccucggcgucgucauguacgagaugaugugcggccgccuccccuucuacaaccaggaccacgagaagcucuucgagcucauccucauggaggagauccgcuucccccgcacccucggccccgaggccaagucccuccucuccggccuccucaagaaggaccccaagcagcgccucggcggcggcuccgaggacgccaaggagaucaugcagcaccgcuucuucgccggcaucgucuggcagcacgucuacgagaagaagcucuccccccccuucaagccccaggucaccuccgagaccgacacccgcuacuucgacgaggaguucaccgcccagaugaucaccaucaccccccccgaccaggacgacuccauggagugcgucgacuccgagcgccgcccccacuucccccaguucuccuacuccgccuccggcaccgccuga

SEQ ID NO: 39588 - RNA, 771 nt, Artificial Sequence
  derived and/or modified sequence opt2 from AKT1S1__Homo_sapiens__NP_001092103
auggccuccggccgccccgaggagcucugggaggccgucgucggcgccgccgagcgcuuccgcgcccgcaccggcaccgagcucguccuccucaccgccgccccccccccccccccccgccccggccccugcgccuacgccgcccacggccgcggcgcccucgccgaggccgcccgccgcugccuccacgacaucgcccucgcccaccgcgccgccaccgccgcccgcccccccgcccccccccccgccccccagccccccucccccacccccucccccccccgccccacccucgcccgcgaggacaacgaggaggacgaggacgagcccaccgagaccgagaccuccggcgagcagcucggcaucuccgacaacggcggccucuucgucauggacgaggacgccacccuccaggaccucccccccuucugcgaguccgaccccgaguccaccgacgacggcucccucuccgaggagacccccgccggcccccccaccugcuccgucccccccgccuccgcccuccccacccagcaguacgccaagucccuccccgucuccguccccgucuggggcuucaaggagaagcgcaccgaggcccgcuccuccgacgaggagaacggcccccccuccucccccgaccucgaccgcaucgccgccuccaugcgcgcccucguccuccgcgaggccgaggacacccaggucuucggcgaccucccccgcccccgccucaacaccuccgacuuccagaagcucaagcgcaaguacuga

SEQ ID NO: 39589 - RNA, 1260 nt, Artificial Sequence
  derived and/or modified sequence opt2 from AKT2__Homo_sapiens__NP_001229957
augaagaccgagcgcccccgccccaacaccuucgucauccgcugccuccaguggaccaccgucaucgagcgcaccuuccacgucgacucccccgacgagcgcgaggaguggaugcgcgccauccagauggucgccaacucccucaagcagcgcgcccccggcgaggaccccauggacuacaagugcggcucccccuccgacuccuccaccaccgaggagauggaggucgccgucuccaaggcccgcgccaaggucaccaugaacgacuucgacuaccucaagcuccucggcaagggcaccuucggcaaggucauccucguccgcgagaaggccaccggccgcuacuacgccaugaagauccuccgcaaggaggucaucaucgccaaggacgaggucgcccacaccgucaccgagucccgcguccuccagaacacccgccaccccuuccucaccgcccucaaguacgccuuccagacccacgaccgccucugcuucgucauggaguacgccaacggcggcgagcucuucuuccaccucucccgcgagcgcgucuucaccgaggagcgcgcccgcuucuacggcgccgagaucgucuccgcccucgaguaccuccacucccgcgacgucgucuaccgcgacaucaagcucgagaaccucaugcucgacaaggacggccacaucaagaucaccgacuucggccucugcaaggagggcaucuccgacggcgccaccaugaagaccuucugcggcacccccgaguaccucgcccccgagguccucgaggacaacgacuacggccgcgccgucgacugguggggccucggcgucgucauguacgagaugaugugcggccgccuccccuucuacaaccaggaccacgagcgccucuucgagcucauccucauggaggagauccgcuucccccgcacccucucccccgaggccaagucccuccucgccggccuccucaagaaggaccccaagcagcgccucggcggcggccccuccgacgccaaggaggucauggagcaccgcuucuuccucuccaucaacuggcaggacgucguccagaagaagcuccucccccccuucaagccccaggucaccuccgaggucgacacccgcuacuucgacgacgaguucaccgcccaguccaucaccaucaccccccccgaccgcuacgacucccucggccuccucgagcucgaccagcgcacccacuucccccaguucuccuacuccgccuccauccgcgaguga

SEQ ID NO: 39590 - RNA, 1398 nt, Artificial Sequence
  derived and/or modified sequence opt2 from AKT3__Homo_sapiens__NP_001193658
auguccgacgucaccaucgucaaggagggcuggguccagaagcgcggcgaguacaucaagaacuggcgcccccgcuacuuccuccucaagaccgacggcuccuucaucggcuacaaggagaagccccaggacgucgaccuccccuacccccucaacaacuucuccgucgccaagugccagcucaugaagaccgagcgccccaagcccaacaccuucaucauccgcugccuccaguggaccaccgucaucgagcgcaccuuccacgucgacacccccgaggagcgcgaggaguggaccgaggccauccaggccgucgccgaccgccuccagcgccaggaggaggagcgcaugaacugcucccccaccucccagaucgacaacaucggcgaggaggagauggacgccuccaccacccaccacaagcgcaagaccaugaacgacuucgacuaccucaagcuccucggcaagggcaccuucggcaaggucauccucguccgcgagaaggccuccggcaaguacuacgccaugaagauccucaagaaggaggucaucaucgccaaggacgaggucgcccacacccucaccgagucccgcguccucaagaacacccgccaccccuuccucaccucccucaaguacuccuuccagaccaaggaccgccucugcuucgucauggaguacgucaacggcggcgagcucuucuuccaccucucccgcgagcgcgucuucuccgaggaccgcacccgcuucuacggcgccgagaucgucuccgcccucgacuaccuccacuccggcaagaucgucuaccgcgaccucaagcucgagaaccucaugcucgacaaggacggccacaucaagaucaccgacuucggccucugcaaggagggcaucaccgacgccgccaccaugaagaccuucugcggcacccccgaguaccucgcccccgagguccucgaggacaacgacuacggccgcgccgucgacugguggggccucggcgucgucauguacgagaugaugugcggccgccuccccuucuacaaccaggaccacgagaagcucuucgagcucauccucauggaggacaucaaguucccccgcacccucuccuccgacgccaagucccuccucuccggccuccucaucaaggaccccaacaagcgccucggcggcggccccgacgacgccaaggagaucaugcgccacuccuucuucuccggcgucaacuggcaggacgucuacgacaagaagcucgucccccccuucaagccccaggucaccuccgagaccgacacccgcuacuucgacgaggaguucaccgcccagaccaucaccaucaccccccccgagaagugccagcaguccgacugcggcaugcucggcaacuggaagaaguga

SEQ ID NO: 39591 - RNA, 879 nt, Artificial Sequence
  derived and/or modified sequence opt2 from AKTIP__Homo_sapiens__NP_071921
augaaccccuucugguccauguccaccuccuccguccgcaagcgcuccgagggcgaggagaagacccucaccggcgacgucaagaccucccccccccgcaccgcccccaagaagcagcuccccuccauccccaagaacgcccuccccaucaccaagcccaccucccccgcccccgccgcccaguccaccaacggcacccacgccuccuacggccccuucuaccucgaguacucccuccucgccgaguucacccucgucgucaagcagaagcuccccggcgucuacguccagcccuccuaccgcuccgcccucaugugguucggcgucaucuucauccgccacggccucuaccaggacggcgucuucaaguucaccgucuacauccccgacaacuaccccgacggcgacugcccccgccucgucuucgacauccccgucuuccacccccucgucgaccccaccuccggcgagcucgacgucaagcgcgccuucgccaaguggcgccgcaaccacaaccacaucuggcagguccucauguacgcccgccgcgucuucuacaagaucgacaccgccuccccccucaaccccgaggccgccguccucuacgagaaggacauccagcucuucaaguccaaggucgucgacuccgucaaggucugcaccgcccgccucuucgaccagcccaagaucgaggaccccuacgccaucuccuucucccccuggaaccccuccguccacgacgaggcccgcgagaagaugcucacccagaagaagcccgaggagcagcacaacaaguccguccacgucgccggccucuccugggucaagcccggcuccguccagcccuucuccaaggaggagaagaccgucgccaccuga

SEQ ID NO: 39592 - RNA, 993 nt, Artificial Sequence
  derived and/or modified sequence opt2 from ALAD__Homo_sapiens__NP_000022
augcagccccaguccguccuccacuccggcuacuuccacccccuccuccgcgccuggcagaccgccaccaccacccucaacgccuccaaccucaucuaccccaucuucgucaccgacguccccgacgacauccagcccaucaccucccuccccggcgucgcccgcuacggcgucaagcgccucgaggagaugcuccgcccccucgucgaggagggccuccgcugcguccucaucuucggcguccccucccgcguccccaaggacgagcgcggcuccgccgccgacuccgaggagucccccgccaucgaggccauccaccuccuccgcaagaccuuccccaaccuccucgucgccugcgacgucugccucugccccuacaccucccacggccacugcggccuccucuccgagaacggcgccuuccgcgccgaggagucccgccagcgccucgccgaggucgcccucgccuacgccaaggccggcugccaggucgucgcccccuccgacaugauggacggccgcgucgaggccaucaaggaggcccucauggcccacggccucggcaaccgcgucuccgucauguccuacuccgccaaguucgccuccugcuucuacggccccuuccgcgacgccgccaaguccucccccgccuucggcgaccgccgcugcuaccagcucccccccggcgcccgcggccucgcccuccgcgccgucgaccgcgacguccgcgagggcgccgacaugcucauggucaagcccggcaugcccuaccucgacaucguccgcgaggucaaggacaagcaccccgaccucccccucgccgucuaccacgucuccggcgaguucgccaugcucuggcacggcgcccaggccggcgccuucgaccucaaggccgccguccucgaggccaugaccgccuuccgccgcgccggcgccgacaucaucaucaccuacuacaccccccagcuccuccaguggcucaaggaggaguga

SEQ ID NO: 39593 - RNA, 1923 nt, Artificial Sequence
  derived and/or modified sequence opt2 from ALAS1__Homo_sapiens__NP_001291372
auggaguccgucguccgccgcugccccuuccucucccgcgucccccaggccuuccuccagaaggccggcaagucccuccucuucuacgcccagaacugccccaagaugauggaggucggcgccaagcccgccccccgcgcccucuccaccgccgccguccacuaccagcagaucaaggagaccccccccgccuccgagaaggacaagaccgccaaggccaagguccagcagacccccgacggcucccagcagucccccgacggcacccagcuccccuccggccacccccuccccgccaccucccagggcaccgccuccaagugccccuuccucgccgcccagaugaaccagcgcggcuccuccgucuucugcaaggccucccucgagcuccaggaggacguccaggagaugaacgccguccgcaaggaggucgccgagaccuccgccggccccuccgucgucuccgucaagaccgacggcggcgaccccuccggccuccucaagaacuuccaggacaucaugcagaagcagcgccccgagcgcgucucccaccuccuccaggacaaccuccccaaguccgucuccaccuuccaguacgaccgcuucuucgagaagaagaucgacgagaagaagaacgaccacaccuaccgcgucuucaagaccgucaaccgccgcgcccacaucuuccccauggccgacgacuacuccgacucccucaucaccaagaagcaggucuccgucuggugcuccaacgacuaccucggcaugucccgccacccccgcgucugcggcgccgucauggacacccucaagcagcacggcgccggcgccggcggcacccgcaacaucuccggcaccuccaaguuccacgucgaccucgagcgcgagcucgccgaccuccacggcaaggacgccgcccuccucuucuccuccugcuucgucgccaacgacuccacccucuucacccucgccaagaugaugcccggcugcgagaucuacuccgacuccggcaaccacgccuccaugauccagggcauccgcaacucccgcguccccaaguacaucuuccgccacaacgacgucucccaccuccgcgagcuccuccagcgcuccgaccccuccguccccaagaucgucgccuucgagaccguccacuccauggacggcgccgucugcccccucgaggagcucugcgacgucgcccacgaguucggcgccaucaccuucgucgacgagguccacgccgucggccucuacggcgcccgcggcggcggcaucggcgaccgcgacggcgucaugcccaagauggacaucaucuccggcacccucggcaaggccuucggcugcgucggcggcuacaucgccuccaccuccucccucaucgacaccguccgcuccuacgccgccggcuucaucuucaccaccucccucccccccaugcuccucgccggcgcccucgaguccguccgcauccucaaguccgccgagggccgcguccuccgccgccagcaccagcgcaacgucaagcucaugcgccagaugcucauggacgccggccuccccgucguccacugccccucccacaucauccccguccgcgucgccgacgccgccaagaacaccgaggucugcgacgagcucaugucccgccacaacaucuacguccaggccaucaacuaccccaccgucccccgcggcgaggagcuccuccgcaucgcccccaccccccaccacaccccccagaugaugaacuacuuccucgagaaccuccucgucaccuggaagcaggucggccucgagcucaagccccacuccuccgccgagugcaacuucugccgccgcccccuccacuucgaggucauguccgagcgcgagaaguccuacuucuccggccucuccaagcucgucuccgcccaggccuga

SEQ ID NO: 39594 - RNA, 1764 nt, Artificial Sequence
  derived and/or modified sequence opt2 from ALAS2__Homo_sapiens__NP_000023
auggucaccgccgccaugcuccuccagugcugccccguccucgcccgcggccccaccucccuccucggcaaggucgucaagacccaccaguuccucuucggcaucggccgcugccccauccucgccacccagggccccaacugcucccagauccaccucaaggccaccaaggccggcggcgacucccccuccugggccaagggccacugccccuucaugcucuccgagcuccaggacggcaaguccaagaucguccagaaggccgcccccgagguccaggaggacgucaaggccuucaagaccgaccuccccuccucccucgucuccgucucccuccgcaagcccuucuccggcccccaggagcaggagcagaucuccggcaaggucacccaccucauccagaacaacaugcccggcaacuacgucuucuccuacgaccaguucuuccgcgacaagaucauggagaagaagcaggaccacaccuaccgcgucuucaagaccgucaaccgcugggccgacgccuaccccuucgcccagcacuucuccgaggccuccgucgccuccaaggacgucuccgucuggugcuccaacgacuaccucggcaugucccgccacccccagguccuccaggccacccaggagacccuccagcgccacggcgccggcgccggcggcacccgcaacaucuccggcaccuccaaguuccacgucgagcucgagcaggagcucgccgagcuccaccagaaggacuccgcccuccucuucuccuccugcuucgucgccaacgacuccacccucuucacccucgccaagauccuccccggcugcgagaucuacuccgacgccggcaaccacgccuccaugauccagggcauccgcaacuccggcgccgccaaguucgucuuccgccacaacgaccccgaccaccucaagaagcuccucgagaaguccaaccccaagauccccaagaucgucgccuucgagaccguccacuccauggacggcgccaucugcccccucgaggagcucugcgacgucucccaccaguacggcgcccucaccuucgucgacgagguccacgccgucggccucuacggcucccgcggcgccggcaucggcgagcgcgacggcaucaugcacaagaucgacaucaucuccggcacccucggcaaggccuucggcugcgucggcggcuacaucgccuccacccgcgaccucgucgacaugguccgcuccuacgccgccggcuucaucuucaccaccucccucccccccaugguccucuccggcgcccucgaguccguccgccuccucaagggcgaggagggccaggcccuccgccgcgcccaccagcgcaacgucaagcacaugcgccagcuccucauggaccgcggccuccccgucauccccugccccucccacaucauccccauccgcgucggcaacgccgcccucaacuccaagcucugcgaccuccuccucuccaagcacggcaucuacguccaggccaucaacuaccccaccgucccccgcggcgaggagcuccuccgccucgcccccuccccccaccacuccccccagaugauggaggacuucgucgagaagcuccuccucgccuggaccgccgucggccucccccuccaggacgucuccgucgccgccugcaacuucugccgccgccccguccacuucgagcucauguccgagugggagcgcuccuacuucggcaacaugggcccccaguacgucaccaccuacgccuga

SEQ ID NO: 39595 - RNA, 1830 nt, Artificial Sequence
  derived and/or modified sequence opt2 from ALB__Homo_sapiens__NP_000468
augaagugggucaccuucaucucccuccucuuccucuucuccuccgccuacucccgcggcgucuuccgccgcgacgcccacaaguccgaggucgcccaccgcuucaaggaccucggcgaggagaacuucaaggcccucguccucaucgccuucgcccaguaccuccagcagugccccuucgaggaccacgucaagcucgucaacgaggucaccgaguucgccaagaccugcgucgccgacgaguccgccgagaacugcgacaagucccuccacacccucuucggcgacaagcucugcaccgucgccacccuccgcgagaccuacggcgagauggccgacugcugcgccaagcaggagcccgagcgcaacgagugcuuccuccagcacaaggacgacaaccccaaccucccccgccucguccgccccgaggucgacgucaugugcaccgccuuccacgacaacgaggagaccuuccucaagaaguaccucuacgagaucgcccgccgccaccccuacuucuacgcccccgagcuccucuucuucgccaagcgcuacaaggccgccuucaccgagugcugccaggccgccgacaaggccgccugccuccuccccaagcucgacgagcuccgcgacgagggcaaggccuccuccgccaagcagcgccucaagugcgccucccuccagaaguucggcgagcgcgccuucaaggccugggccgucgcccgccucucccagcgcuuccccaaggccgaguucgccgaggucuccaagcucgucaccgaccucaccaagguccacaccgagugcugccacggcgaccuccucgagugcgccgacgaccgcgccgaccucgccaaguacaucugcgagaaccaggacuccaucuccuccaagcucaaggagugcugcgagaagccccuccucgagaagucccacugcaucgccgaggucgagaacgacgagaugcccgccgaccuccccucccucgccgccgacuucgucgaguccaaggacgucugcaagaacuacgccgaggccaaggacgucuuccucggcauguuccucuacgaguacgcccgccgccaccccgacuacuccgucguccuccuccuccgccucgccaagaccuacgagaccacccucgagaagugcugcgccgccgccgacccccacgagugcuacgccaaggucuucgacgaguucaagccccucgucgaggagccccagaaccucaucaagcagaacugcgagcucuucgagcagcucggcgaguacaaguuccagaacgcccuccucguccgcuacaccaagaaggucccccaggucuccacccccacccucgucgaggucucccgcaaccucggcaaggucggcuccaagugcugcaagcaccccgaggccaagcgcaugcccugcgccgaggacuaccucuccgucguccucaaccagcucugcguccuccacgagaagacccccgucuccgaccgcgucaccaagugcugcaccgagucccucgucaaccgccgccccugcuucuccgcccucgaggucgacgagaccuacguccccaaggaguucaacgccgagaccuucaccuuccacgccgacaucugcacccucuccgagaaggagcgccagaucaagaagcagaccgcccucgucgagcucgucaagcacaagcccaaggccaccaaggagcagcucaaggccgucauggacgacuucgccgccuucgucgagaagugcugcaaggccgacgacaaggagaccugcuucgccgaggagggcaagaagcucgucgccgccucccaggccgcccucggccucuga

SEQ ID NO: 39596 - RNA, 1713 nt, Artificial Sequence
  derived and/or modified sequence opt2 from ALCAM__Homo_sapiens__NP_001230209
auggaguccaagggcgccuccuccugccgccuccucuucugccuccucaucuccgccaccgucuuccgccccggccucggcugguacaccgucaacuccgccuacggcgacaccaucaucauccccugccgccucgacgucccccagaaccucauguucggcaaguggaaguacgagaagcccgacggcucccccgucuucaucgccuuccgcuccuccaccaagaaguccguccaguacgacgacguccccgaguacaaggaccgccucaaccucuccgagaacuacacccucuccaucuccaacgcccgcaucuccgacgagaagcgcuucgucugcaugcucgucaccgaggacaacgucuucgaggcccccaccaucgucaaggucuucaagcagcccuccaagcccgagaucgucuccaaggcccucuuccucgagaccgagcagcucaagaagcucggcgacugcaucuccgaggacuccuaccccgacggcaacaucaccugguaccgcaacggcaagguccuccacccccucgagggcgccgucgucaucaucuucaagaaggagauggaccccgucacccagcucuacaccaugaccuccacccucgaguacaagaccaccaaggccgacauccagaugcccuucaccugcuccgucaccuacuacggccccuccggccagaagaccauccacuccgagcaggccgucuucgacaucuacuaccccaccgagcaggucaccauccagguccucccccccaagaacgccaucaaggagggcgacaacaucacccucaagugccucggcaacggcaaccccccccccgaggaguuccucuucuaccuccccggccagcccgagggcauccgcuccuccaacaccuacacccucaccgacguccgccgcaacgccaccggcgacuacaagugcucccucaucgacaagaaguccaugaucgccuccaccgccaucaccguccacuaccucgaccucucccucaaccccuccggcgaggucacccgccagaucggcgacgcccuccccgucuccugcaccaucuccgccucccgcaacgccaccgucgucuggaugaaggacaacauccgccuccgcuccucccccuccuucuccucccuccacuaccaggacgccggcaacuacgucugcgagaccgcccuccaggaggucgagggccucaagaagcgcgagucccucacccucaucgucgagggcaagccccagaucaagaugaccaagaagaccgaccccuccggccucuccaagaccaucaucugccacgucgagggcuuccccaagcccgccauccaguggaccaucaccggcuccggcuccgucaucaaccagaccgaggagucccccuacaucaacggccgcuacuacuccaagaucaucaucucccccgaggagaacgucacccucaccugcaccgccgagaaccagcucgagcgcaccgucaacucccucaacgucuccgccaacgagaaccgcgagaaggucaacgaccaggccaagcucaucgucggcaucgucgucggccuccuccucgccgcccucgucgccggcgucgucuacuggcucuacaugaagaaguccaagaccgccuccaagcacgucaacaaggaccucggcaacauggaggagaacaagaagcucgaggagaacaaccacaagaccgaggccuga

SEQ ID NO: 39597 - RNA, 2256 nt, Artificial Sequence
  derived and/or modified sequence opt2 from ALDH16A1__Homo_sapiens__NP_001138868
auggccgccacccgcgccggcccccgcgcccgcgagaucuucaccucccucgaguacggccccguccccgagucccacgccugcgcccucgccuggcucgacacccaggaccgcugccucggccacuacgucaacggcaaguggcucaagcccgagcaccgcaacuccguccccugccaggaccccaucaccggcgagaaccucgccuccugccuccaggcccaggccgaggacgucgccgccgccgucgaggccgcccgcauggccuucaagggcugguccgcccaccccggcgucguccgcgcccagcaccucacccgccucgccgaggucauccagaagcaccagcgccuccucuggacccucgagucccucgucaccggccgcgccguccgcgagguccgcgacggcgacguccagcucgcccagcagcuccuccacuaccacgccauccaggccuccacccaggaggaggcccucgccggcugggagcccaugggcgucaucggccucauccucccccccaccuucuccuuccucgagaugauguggcgcaucugccccgcccucgccgucggcugcaccgucgucgcccucgucccccccgccucccccgccccccuccuccucgcccagcucgccggcgagcucggccccuuccccggcauccucaacguccucuccggccccgccucccucguccccauccucgccucccagcccggcauccgcaaggucgccuucugcggcgcccccgagggcggccuccgccuccucauccaggaguccgucugggacgaggccaugcgccgccuccaggagcgcaugggccgccuccgcuccggccgcggccucgacggcgccgucgacaugggcgcccgcggcgccgccgccugcgaccucguccagcgcuucguccgcgaggcccagucccagggcgcccaggucuuccaggccggcgacguccccuccgagcgccccuucuacccccccacccucgucuccaaccucccccccgccucccccugcgcccaggucgagguccccuggcccgucgucgucgccucccccuuccgcaccgccaaggaggcccuccucgucgccaacggcaccccccgcggcggcuccgccuccgucugguccgagcgccucggccaggcccucgagcucggcuacggccuccaggucggcaccgucuggaucaacgcccacggccuccgcgaccccuccguccccaccggcggcugcaaggaguccggcugcuccuggcacggcggccccgacggccucuacgaguaccuccgccccuccggcacccccgcccgccucuccugccucuccaagaaccucaacuacgacaccuucggccucgccguccccuccacccuccccgccggccccgagaucggccccucccccgccccccccuacggccucuucgucggcggccgcuuccaggcccccggcgcccgcuccucccgccccauccgcgacuccuccggcaaccuccacggcuacgucgccgagggcggcgccaaggacauccgcggcgccgucgaggccgcccaccaggccuuccccggcugggccggccagucccccggcgcccgcgccgcccuccucugggcccucgccgccgcccucgagcgccgcaaguccacccucgccucccgccucgagcgccagggcgccgagcucaaggccgccgaggccgaggucgagcucuccgcccgccgccuccgcgccuggggcgcccgcguccaggcccagggccacacccuccaggucgccggccuccgcggccccguccuccgccuccgcgagccccucggcguccucgccgucgucugccccgacgaguggccccuccucgccuucgucucccuccucgcccccgcccucgccuacggcaacaccgucgucaugguccccuccgccgccugcccccuccucgcccucgaggucugccaggacauggccaccgucuuccccgccggccucgccaacgucgucaccggcgaccgcgaccaccucacccgcugccucgcccuccaccaggacguccaggccaugugguacuucggcuccgcccagggcucccaguucgucgagugggccuccgccggcaaccucaagcccgucugggccucccgcggcugcccccgcgccugggaccaggaggccgagggcgccggccccgagcucggccuccgcgucgcccgcaccaaggcccucuggcuccccaugggcgacuga

SEQ ID NO: 39598 - RNA, 2382 nt, Artificial Sequence
  derived and/or modified sequence opt2 from ALDH18A1__Homo_sapiens__NP_001017423
augcucucccaggucuaccgcugcggcuuccagcccuucaaccagcaccuccuccccugggucaagugcaccaccgucuuccgcucccacugcauccagcccuccgucauccgccacguccgcuccugguccaacauccccuucaucaccgucccccucucccgcacccacggcaaguccuucgcccaccgcuccgagcucaagcacgccaagcgcaucgucgucaagcucggcuccgccgucgucacccgcggcgacgagugcggccucgcccucggccgccucgccuccaucgucgagcaggucuccguccuccagaaccagggccgcgagaugaugcucgucaccuccggcgccgucgccuucggcaagcagcgccuccgccacgagauccuccucucccaguccguccgccaggcccuccacuccggccagaaccagcucaaggagauggccauccccguccucgaggcccgcgccugcgccgccgccggccaguccggccucauggcccucuacgaggccauguucacccaguacuccaucugcgccgcccagauccucgucaccaaccucgacuuccacgacgagcagaagcgccgcaaccucaacggcacccuccacgagcuccuccgcaugaacaucguccccaucgucaacaccaacgacgccgucgucccccccgccgagcccaacuccgaccuccagggcgucaucuccgucaaggacaacgacucccucgccgcccgccucgccgucgagaugaagaccgaccuccucaucguccucuccgacgucgagggccucuucgacuccccccccggcuccgacgacgccaagcucaucgacaucuucuaccccggcgaccagcaguccgucaccuucggcaccaagucccgcgucggcaugggcggcauggaggccaaggucaaggccgcccucugggcccuccagggcggcaccuccgucgucaucgccaacggcacccaccccaaggucuccggccacgucaucaccgacaucgucgagggcaagaaggucggcaccuucuucuccgaggucaagcccgccggccccaccgucgagcagcagggcgagauggcccgcuccggcggccgcaugcucgccacccucgagcccgagcagcgcgccgagaucauccaccaccucgccgaccuccucaccgaccagcgcgacgagauccuccucgccaacaagaaggaccucgaggaggccgagggccgccucgccgccccccuccucaagcgccucucccucuccaccuccaagcucaacucccucgccaucggccuccgccagaucgccgccuccucccaggacuccgucggccgcguccuccgccgcacccgcaucgccaagaaccucgagcucgagcaggucaccguccccaucggcguccuccucgucaucuucgagucccgccccgacugccucccccaggucgccgcccucgccaucgccuccggcaacggccuccuccucaagggcggcaaggaggccgcccacuccaaccgcauccuccaccuccucacccaggaggcccucuccauccacggcgucaaggaggccguccagcucgucaacacccgcgaggaggucgaggaccucugccgccucgacaagaugaucgaccucaucaucccccgcggcuccucccagcucguccgcgacauccagaaggccgccaagggcauccccgucaugggccacuccgagggcaucugccacauguacgucgacuccgaggccuccgucgacaaggucacccgccucguccgcgacuccaagugcgaguaccccgccgccugcaacgcccucgagacccuccucauccaccgcgaccuccuccgcaccccccucuucgaccagaucaucgacaugcuccgcgucgagcaggucaagauccacgccggccccaaguucgccuccuaccucaccuucucccccuccgaggucaagucccuccgcaccgaguacggcgaccucgagcucugcaucgaggucgucgacaacguccaggacgccaucgaccacauccacaaguacggcuccucccacaccgacgucaucgucaccgaggacgagaacaccgccgaguucuuccuccagcacgucgacuccgccugcgucuucuggaacgccuccacccgcuucuccgacggcuaccgcuucggccucggcgccgaggucggcaucuccaccucccgcauccacgcccgcggccccgucggccucgagggccuccucaccaccaaguggcuccuccgcggcaaggaccacgucgucuccgacuucuccgagcacggcucccucaaguaccuccacgagaaccuccccaucccccagcgcaacaccaacuga

SEQ ID NO: 39599 - RNA, 1506 nt, Artificial Sequence
  derived and/or modified sequence opt2 from ALDH1A1__Homo_sapiens__NP_000680
auguccuccuccggcacccccgaccuccccguccuccucaccgaccucaagauccaguacaccaagaucuucaucaacaacgaguggcacgacuccgucuccggcaagaaguuccccgucuucaaccccgccaccgaggaggagcucugccaggucgaggagggcgacaaggaggacgucgacaaggccgucaaggccgcccgccaggccuuccagaucggcucccccuggcgcaccauggacgccuccgagcgcggccgccuccucuacaagcucgccgaccucaucgagcgcgaccgccuccuccucgccaccauggaguccaugaacggcggcaagcucuacuccaacgccuaccucaacgaccucgccggcugcaucaagacccuccgcuacugcgccggcugggccgacaagauccagggccgcaccauccccaucgacggcaacuucuucaccuacacccgccacgagcccaucggcgucugcggccagaucauccccuggaacuucccccucgucaugcucaucuggaagaucggccccgcccucuccugcggcaacaccgucgucgucaagcccgccgagcagaccccccucaccgcccuccacgucgccucccucaucaaggaggccggcuucccccccggcgucgucaacaucguccccggcuacggccccaccgccggcgccgccaucuccucccacauggacaucgacaaggucgccuucaccggcuccaccgaggucggcaagcucaucaaggaggccgccggcaaguccaaccucaagcgcgucacccucgagcucggcggcaagucccccugcaucguccucgccgacgccgaccucgacaacgccgucgaguucgcccaccacggcgucuucuaccaccagggccagugcugcaucgccgccucccgcaucuucgucgaggaguccaucuacgacgaguucguccgccgcuccgucgagcgcgccaagaaguacauccucggcaacccccucacccccggcgucacccagggcccccagaucgacaaggagcaguacgacaagauccucgaccucaucgaguccggcaagaaggagggcgccaagcucgagugcggcggcggccccuggggcaacaagggcuacuucguccagcccaccgucuucuccaacgucaccgacgagaugcgcaucgccaaggaggagaucuucggccccguccagcagaucaugaaguucaagucccucgacgacgucaucaagcgcgccaacaacaccuucuacggccucuccgccggcgucuucaccaaggacaucgacaaggccaucaccaucuccuccgcccuccaggccggcaccgucugggucaacugcuacggcgucgucuccgcccagugccccuucggcggcuucaagauguccggcaacggccgcgagcucggcgaguacggcuuccacgaguacaccgaggucaagaccgucaccgucaagaucucccagaagaacuccuga

SEQ ID NO: 39600 - RNA, 1494 nt, Artificial Sequence
  derived and/or modified sequence opt2 from ALDH1A2__Homo_sapiens__NP_001193826
augaagaaccagugcgagaccgucuggcucaagucccccaucaagcucaagcucaucuucaucaacaacgaguggcagaacuccgaguccggccgcgucuuccccgucuacaaccccgccaccggcgagcaggucugcgagguccaggaggccgacaaggccgacaucgacaaggccguccaggccgcccgccucgccuucucccucggcuccgucuggcgccgcauggacgccuccgagcgcggccgccuccucgacaagcucgccgaccucgucgagcgcgaccgcgccguccucgccaccauggagucccucaacggcggcaagcccuuccuccaggccuucuacgucgaccuccagggcgucaucaagaccuuccgcuacuacgccggcugggccgacaagauccacggcaugaccauccccgucgacggcgacuacuucaccuucacccgccacgagcccaucggcgucugcggccagaucauccccuggaacuucccccuccucauguucgccuggaagaucgcccccgcccucugcugcggcaacaccgucgucaucaagcccgccgagcagaccccccucuccgcccucuacaugggcgcccucaucaaggaggccggcuucccccccggcgucaucaacauccuccccggcuacggccccaccgccggcgccgccaucgccucccacaucggcaucgacaagaucgccuucaccggcuccaccgaggucggcaagcucauccaggaggccgccggccgcuccaaccucaagcgcgucacccucgagcucggcggcaagucccccaacaucaucuucgccgacgccgaccucgacuacgccgucgagcaggcccaccagggcgucuucuucaaccagggccagugcugcaccgccggcucccgcaucuucgucgaggaguccaucuacgaggaguucguccgccgcuccgucgagcgcgccaagcgccgcgucgucggcucccccuucgaccccaccaccgagcagggcccccagaucgacaagaagcaguacaacaagauccucgagcucauccaguccggcgucgccgagggcgccaagcucgagugcggcggcaagggccucggccgcaagggcuucuucaucgagcccaccgucuucuccaacgucaccgacgacaugcgcaucgccaaggaggagaucuucggccccguccaggagauccuccgcuucaagaccauggacgaggucaucgagcgcgccaacaacuccgacuucggccucgucgccgccgucuucaccaacgacaucaacaaggcccucaccgucuccuccgccaugcaggccggcaccgucuggaucaacugcuacaacgcccucaacgcccagucccccuucggcggcuucaagauguccggcaacggccgcgagaugggcgaguucggccuccgcgaguacuccgaggucaagaccgucaccgucaagaucccccagaagaacuccuga

SEQ ID NO: 39601 - RNA, 1539 nt, Artificial Sequence
  derived and/or modified sequence opt2 from ALDH1A3__Homo_sapiens__NP_000684
auggccaccgccaacggcgccgucgagaacggccagcccgaccgcaagccccccgcccucccccgccccauccgcaaccucgaggucaaguucaccaagaucuucaucaacaacgaguggcacgaguccaaguccggcaagaaguucgccaccugcaaccccuccacccgcgagcagaucugcgaggucgaggagggcgacaagcccgacgucgacaaggccgucgaggccgcccaggucgccuuccagcgcggcucccccuggcgccgccucgacgcccucucccgcggccgccuccuccaccagcucgccgaccucgucgagcgcgaccgcgccacccucgccgcccucgagaccauggacaccggcaagcccuuccuccacgccuucuucaucgaccucgagggcugcauccgcacccuccgcuacuucgccggcugggccgacaagauccagggcaagaccauccccaccgacgacaacgucgucugcuucacccgccacgagcccaucggcgucugcggcgccaucacccccuggaacuucccccuccucaugcucgucuggaagcucgcccccgcccucugcugcggcaacaccaugguccucaagcccgccgagcagaccccccucaccgcccucuaccucggcucccucaucaaggaggccggcuucccccccggcgucgucaacaucguccccggcuucggccccaccgucggcgccgccaucuccucccacccccagaucaacaagaucgccuucaccggcuccaccgaggucggcaagcucgucaaggaggccgccucccgcuccaaccucaagcgcgucacccucgagcucggcggcaagaaccccugcaucgucugcgccgacgccgaccucgaccucgccgucgagugcgcccaccagggcgucuucuucaaccagggccagugcugcaccgccgccucccgcgucuucgucgaggagcaggucuacuccgaguucguccgccgcuccgucgaguacgccaagaagcgccccgucggcgaccccuucgacgucaagaccgagcagggcccccagaucgaccagaagcaguucgacaagauccucgagcucaucgaguccggcaagaaggagggcgccaagcucgagugcggcggcuccgccauggaggacaagggccucuucaucaagcccaccgucuucuccgaggucaccgacaacaugcgcaucgccaaggaggagaucuucggccccguccagcccauccucaaguucaaguccaucgaggaggucaucaagcgcgccaacuccaccgacuacggccucaccgccgccgucuucaccaagaaccucgacaaggcccucaagcucgccuccgcccucgaguccggcaccgucuggaucaacugcuacaacgcccucuacgcccaggcccccuucggcggcuucaagauguccggcaacggccgcgagcucggcgaguacgcccucgccgaguacaccgaggucaagaccgucaccaucaagcucggcgacaagaaccccuga

SEQ ID NO: 39602 - RNA, 1554 nt, Artificial Sequence
  derived and/or modified sequence opt2 from ALDH1B1__Homo_sapiens__NP_000683
augcuccgcuuccucgccccccgccuccucucccuccagggccgcaccgcccgcuacuccuccgccgccgcccuccccucccccauccucaaccccgacauccccuacaaccagcucuucaucaacaacgaguggcaggacgccgucuccaagaagaccuuccccaccgucaaccccaccaccggcgaggucaucggccacgucgccgagggcgaccgcgccgacgucgaccgcgccgucaaggccgcccgcgaggccuuccgccucggcucccccuggcgccgcauggacgccuccgagcgcggccgccuccucaaccgccucgccgaccucgucgagcgcgaccgcgucuaccucgccucccucgagacccucgacaacggcaagcccuuccaggaguccuacgcccucgaccucgacgaggucaucaaggucuaccgcuacuucgccggcugggccgacaaguggcacggcaagaccauccccauggacggccagcacuucugcuucacccgccacgagcccgucggcgucugcggccagaucauccccuggaacuucccccucgucaugcagggcuggaagcucgcccccgcccucgccaccggcaacaccgucgucaugaaggucgccgagcagaccccccucuccgcccucuaccucgccucccucaucaaggaggccggcuucccccccggcgucgucaacaucaucaccggcuacggccccaccgccggcgccgccaucgcccagcacgucgacgucgacaaggucgccuucaccggcuccaccgaggucggccaccucauccagaaggccgccggcgacuccaaccucaagcgcgucacccucgagcucggcggcaagucccccuccaucguccucgccgacgccgacauggagcacgccgucgagcagugccacgaggcccucuucuucaacaugggccagugcugcugcgccggcucccgcaccuucgucgaggaguccaucuacaacgaguuccucgagcgcaccgucgagaaggccaagcagcgcaaggucggcaaccccuucgagcucgacacccagcagggcccccaggucgacaaggagcaguucgagcgcguccucggcuacauccagcucggccagaaggagggcgccaagcuccucugcggcggcgagcgcuucggcgagcgcggcuucuucaucaagcccaccgucuucggcggcguccaggacgacaugcgcaucgccaaggaggagaucuucggccccguccagccccucuucaaguucaagaagaucgaggaggucgucgagcgcgccaacaacacccgcuacggccucgccgccgccgucuucacccgcgaccucgacaaggccauguacuucacccaggcccuccaggccggcaccgucugggucaacaccuacaacaucgucaccugccacacccccuucggcggcuucaaggaguccggcaacggccgcgagcucggcgaggacggccucaaggccuacaccgaggucaagaccgucaccaucaaggucccccagaagaacuccuga

SEQ ID NO: 39603 - RNA, 2739 nt, Artificial Sequence
  derived and/or modified sequence opt2 from ALDH1L1__Homo_sapiens__NP_001257293
auggccggccccuccaacccccccgccaccaugaagaucgccgucaucggccagucccucuucggccaggaggucuacugccaccuccgcaaggagggccacgaggucgucggcgucuucaccguccccgacaaggacggcaaggccgacccccucggccucgaggccgagaaggacggcguccccgucuucaaguacucccgcuggcgcgccaagggccaggcccuccccgacgucgucgccaaguaccaggcccucggcgccgagcucaacguccuccccuucugcucccaguucauccccauggagaucaucuccgccccccgccacggcuccaucaucuaccaccccucccuccucccccgccaccgcggcgccuccgccaucaacuggacccucauccacggcgacaagaagggcggcuucuccaucuucugggccgacgacggccucgacaccggcgaccuccuccuccagaaggagugcgagguccuccccgacgacaccgucuccacccucuacaaccgcuuccucuuccccgagggcaucaagggcaugguccaggccguccgccucaucgccgagggcaaggccccccgccucccccagcccgaggagggcgccaccuacgagggcauccagaagaaggagaccgccaagaucaacugggaccagcccgccgaggccauccacaacuggauccgcggcaacgacaagguccccggcgccuggaccgaggccugcgagcagaagcucaccuucuucaacuccacccucaacaccuccggccucguccccgagggcgacgcccuccccauccccggcgcccaccgccccggcgucgucaccaaggccggccucauccucuucggcaacgacgacaagaugcuccucgucaagaacauccagcucgaggacggcaagaugauccucgccuccaacuucuucaagggcgccgccuccuccguccucgagcucaccgaggccgagcucgucaccgccgaggccguccgcuccgucuggcagcgcauccuccccaagguccucgaggucgaggacuccaccgacuucuucaaguccggcgccgccuccgucgacgucguccgccucgucgaggaggucaaggagcucugcgacggccucgagcucgagaacgaggacgucuacauggccuccaccuucggcgacuucauccagcuccucguccgcaagcuccgcggcgacgacgaggagggcgagugcuccaucgacuacgucgagauggccgucaacaagcgcaccguccgcaugccccaccagcucuucaucggcggcgaguucgucgacgccgagggcgccaagaccuccgagaccaucaaccccaccgacggcuccgucaucugccaggucucccucgcccaggucaccgacgucgacaaggccgucgccgccgccaaggacgccuucgagaacggccgcuggggcaagaucuccgcccgcgaccgcggccgccucauguaccgccucgccgaccucauggagcagcaccaggaggagcucgccaccaucgaggcccucgacgccggcgccgucuacacccucgcccucaagacccacgucggcauguccauccagaccuuccgcuacuucgccggcuggugcgacaagauccagggcuccaccauccccaucaaccaggcccgccccaaccgcaaccucacccucacccgcaaggagcccgucggcgucugcggcaucaucauccccuggaacuacccccucaugaugcucuccuggaagaccgccgccugccucgccgccggcaacaccgucgucaucaagcccgcccaggucaccccccucaccgcccucaaguucgccgagcucacccucaaggccggcauccccaagggcgucgucaacguccuccccggcuccggcucccucgucggccagcgccucuccgaccaccccgacguccgcaagaucggcuucaccggcuccaccgaggucggcaagcacaucaugaaguccugcgccaucuccaacgucaagaaggucucccucgagcucggcggcaaguccccccucaucaucuucgccgacugcgaccucaacaaggccguccagaugggcauguccuccgucuucuucaacaagggcgagaacugcaucgccgccggccgccucuucgucgaggacuccauccacgacgaguucguccgccgcgucgucgaggagguccgcaagaugaaggucggcaacccccucgaccgcgacaccgaccacggcccccagaaccaccacgcccaccucgucaagcucauggaguacugccagcacggcgucaaggagggcgccacccucgucugcggcggcaaccaggucccccgccccggcuucuucuucgagcccaccgucuucaccgacgucgaggaccacauguucaucgccaaggaggaguccuucggccccgucaugaucaucucccgcuucgccgacggcgaccucgacgccguccucucccgcgccaacgccaccgaguucggccucgccuccggcgucuucacccgcgacaucaacaaggcccucuacgucuccgacaagcuccaggccggcaccgucuucgucaacaccuacaacaagaccgacgucgccgcccccuucggcggcuucaagcaguccggcuucggcaaggaccucggcgaggccgcccucaacgaguaccuccgcgucaagaccgucaccuucgaguacuga

SEQ ID NO: 39604 - RNA, 1554 nt, Artificial Sequence
  derived and/or modified sequence opt2 from ALDH2__Homo_sapiens__NP_000681
augcuccgcgccgccgcccgcuucggcccccgccucggccgccgccuccucuccgccgccgccacccaggccguccccgcccccaaccagcagcccgaggucuucugcaaccagaucuucaucaacaacgaguggcacgacgccgucucccgcaagaccuuccccaccgucaaccccuccaccggcgaggucaucugccaggucgccgagggcgacaaggaggacgucgacaaggccgucaaggccgcccgcgccgccuuccagcucggcucccccuggcgccgcauggacgccucccaccgcggccgccuccucaaccgccucgccgaccucaucgagcgcgaccgcaccuaccucgccgcccucgagacccucgacaacggcaagcccuacgucaucuccuaccucgucgaccucgacaugguccucaagugccuccgcuacuacgccggcugggccgacaaguaccacggcaagaccauccccaucgacggcgacuucuucuccuacacccgccacgagcccgucggcgucugcggccagaucauccccuggaacuucccccuccucaugcaggccuggaagcucggccccgcccucgccaccggcaacgucgucgucaugaaggucgccgagcagaccccccucaccgcccucuacgucgccaaccucaucaaggaggccggcuucccccccggcgucgucaacaucguccccggcuucggccccaccgccggcgccgccaucgccucccacgaggacgucgacaaggucgccuucaccggcuccaccgagaucggccgcgucauccaggucgccgccggcuccuccaaccucaagcgcgucacccucgagcucggcggcaagucccccaacaucaucauguccgacgccgacauggacugggccgucgagcaggcccacuucgcccucuucuucaaccagggccagugcugcugcgccggcucccgcaccuucguccaggaggacaucuacgacgaguucgucgagcgcuccgucgcccgcgccaagucccgcgucgucggcaaccccuucgacuccaagaccgagcagggcccccaggucgacgagacccaguucaagaagauccucggcuacaucaacaccggcaagcaggagggcgccaagcuccucugcggcggcggcaucgccgccgaccgcggcuacuucauccagcccaccgucuucggcgacguccaggacggcaugaccaucgccaaggaggagaucuucggccccgucaugcagauccucaaguucaagaccaucgaggaggucgucggccgcgccaacaacuccaccuacggccucgccgccgccgucuucaccaaggaccucgacaaggccaacuaccucucccaggcccuccaggccggcaccgucugggucaacugcuacgacgucuucggcgcccagucccccuucggcggcuacaagauguccggcuccggccgcgagcucggcgaguacggccuccaggccuacaccgaggucaagaccgucaccgucaaggucccccagaagaacuccuga

SEQ ID NO: 39605 - RNA, 1362 nt, Artificial Sequence
  derived and/or modified sequence opt2 from ALDH3A1__Homo_sapiens__NP_000682
auguccaagaucuccgaggccgucaagcgcgcccgcgccgccuucuccuccggccgcacccgcccccuccaguuccgcauccagcagcucgaggcccuccagcgccucauccaggagcaggagcaggagcucgucggcgcccucgccgccgaccuccacaagaacgaguggaacgccuacuacgaggaggucgucuacguccucgaggagaucgaguacaugauccagaagcuccccgagugggccgccgacgagcccgucgagaagaccccccagacccagcaggacgagcucuacauccacuccgagccccucggcgucguccucgucaucggcaccuggaacuaccccuucaaccucaccauccagcccauggucggcgccaucgccgccggcaacuccgucguccucaagcccuccgagcucuccgagaacauggccucccuccucgccaccaucaucccccaguaccucgacaaggaccucuaccccgucaucaacggcggcguccccgagaccaccgagcuccucaaggagcgcuucgaccacauccucuacaccggcuccaccggcgucggcaagaucaucaugaccgccgccgccaagcaccucacccccgucacccucgagcucggcggcaagucccccugcuacgucgacaagaacugcgaccucgacgucgccugccgccgcaucgccuggggcaaguucaugaacuccggccagaccugcgucgcccccgacuacauccucugcgaccccuccauccagaaccagaucgucgagaagcucaagaagucccucaaggaguucuacggcgaggacgccaagaagucccgcgacuacggccgcaucaucuccgcccgccacuuccagcgcgucaugggccucaucgagggccagaaggucgccuacggcggcaccggcgacgccgccacccgcuacaucgcccccaccauccucaccgacgucgacccccagucccccgucaugcaggaggagaucuucggccccguccuccccaucgucugcguccgcucccucgaggaggccauccaguucaucaaccagcgcgagaagccccucgcccucuacauguucuccuccaacgacaaggucaucaagaagaugaucgccgagaccuccuccggcggcgucgccgccaacgacgucaucguccacaucacccuccacucccuccccuucggcggcgucggcaacuccggcaugggcuccuaccacggcaagaaguccuucgagaccuucucccaccgccgcuccugccucguccgcccccucaugaacgacgagggccucaagguccgcuacccccccucccccgccaagaugacccagcacuga

SEQ ID NO: 39606 - RNA, 1458 nt, Artificial Sequence
  derived and/or modified sequence opt2 from ALDH3A2__Homo_sapiens__NP_000373
auggagcucgagguccgccgcguccgccaggccuuccucuccggccgcucccgcccccuccgcuuccgccuccagcagcucgaggcccuccgccgcaugguccaggagcgcgagaaggacauccucaccgccaucgccgccgaccucugcaaguccgaguucaacgucuacucccaggaggucaucaccguccucggcgagaucgacuucaugcucgagaaccuccccgagugggucaccgccaagcccgucaagaagaacguccucaccaugcucgacgaggccuacauccagccccagccccucggcgucguccucaucaucggcgccuggaacuaccccuucguccucaccauccagccccucaucggcgccaucgccgccggcaacgccgucaucaucaagcccuccgagcucuccgagaacaccgccaagauccucgccaagcuccucccccaguaccucgaccaggaccucuacaucgucaucaacggcggcgucgaggagaccaccgagcuccucaagcagcgcuucgaccacaucuucuacaccggcaacaccgccgucggcaagaucgucauggaggccgccgccaagcaccucacccccgucacccucgagcucggcggcaagucccccugcuacaucgacaaggacugcgaccucgacaucgucugccgccgcaucaccuggggcaaguacaugaacugcggccagaccugcaucgcccccgacuacauccucugcgaggccucccuccagaaccagaucgucuggaagaucaaggagaccgucaaggaguucuacggcgagaacaucaaggagucccccgacuacgagcgcaucaucaaccuccgccacuucaagcgcauccucucccuccucgagggccagaagaucgccuucggcggcgagaccgacgaggccacccgcuacaucgcccccaccguccucaccgacgucgaccccaagaccaaggucaugcaggaggagaucuucggccccauccuccccaucguccccgucaagaacgucgacgaggccaucaacuucaucaacgagcgcgagaagccccucgcccucuacgucuucucccacaaccacaagcucaucaagcgcaugaucgacgagaccuccuccggcggcgucaccggcaacgacgucaucaugcacuucacccucaacuccuuccccuucggcggcgucggcuccuccggcaugggcgccuaccacggcaagcacuccuucgacaccuucucccaccagcgccccugccuccucaagucccucaagcgcgagggcgccaacaagcuccgcuacccccccaacucccaguccaaggucgacuggggcaaguucuuccuccucaagcgcuucaacaaggagaagcucggccuccuccuccucaccuuccucggcaucgucgccgccguccucgucaaggccgaguacuacuga

SEQ ID NO: 39607 - RNA, 1407 nt, Artificial Sequence
  derived and/or modified sequence opt2 from ALDH3B1__Homo_sapiens__NP_000685
auggacccccucggcgacacccuccgccgccuccgcgaggccuuccacgccggccgcacccgccccgccgaguuccgcgccgcccagcuccagggccucggccgcuuccuccaggagaacaagcagcuccuccacgacgcccucgcccaggaccuccacaaguccgccuucgaguccgaggucuccgaggucgccaucucccagggcgaggucacccucgcccuccgcaaccuccgcgccuggaugaaggacgagcgcguccccaagaaccucgccacccagcucgacuccgccuucauccgcaaggagcccuucggccucguccucaucaucgcccccuggaacuacccccucaaccucacccucgucccccucgucggcgcccucgccgccggcaacugcgucguccucaagcccuccgagaucuccaagaacgucgagaagauccucgccgagguccucccccaguacgucgaccaguccugcuucgccgucguccucggcggcccccaggagaccggccagcuccucgagcaccgcuucgacuacaucuucuucaccggcuccccccgcgucggcaagaucgucaugaccgccgccgccaagcaccucacccccgucacccucgagcucggcggcaagaaccccugcuacgucgacgacaacugcgacccccagaccgucgccaaccgcgucgccugguuccgcuacuucaacgccggccagaccugcgucgcccccgacuacguccucugcucccccgagaugcaggagcgccuccuccccgcccuccaguccaccaucacccgcuucuacggcgacgacccccaguccucccccaaccucggccgcaucaucaaccagaagcaguuccagcgccuccgcgcccuccucggcugcggccgcgucgccaucggcggccaguccgacgaguccgaccgcuacaucgcccccaccguccucgucgacguccaggagauggagcccgucaugcaggaggagaucuucggccccauccuccccaucgucaacguccagucccucgacgaggccaucgaguucaucaaccgccgcgagaagccccucgcccucuacgccuucuccaacuccucccaggucgucaagcgcguccucacccagaccuccuccggcggcuucugcggcaacgacggcuucaugcacaugacccucgccucccuccccuucggcggcgucggcgccuccggcaugggccgcuaccacggcaaguucuccuucgacaccuucucccaccaccgcgccugccuccuccgcucccccggcauggagaagcucaacgcccuccgcuaccccccccaguccccccgccgccuccgcaugcuccucgucgccauggaggcccagggcugcuccugcacccuccucuga

SEQ ID NO: 39608 - RNA, 1539 nt, Artificial Sequence
  derived and/or modified sequence opt2 from ALDH4A1__Homo_sapiens__NP_001306147
augcuccuccccgcccccgcccuccgccgcgcccuccucucccgccccuggaccggcgccggccuccgcuggaagcacaccuccucccucaaggucgccaacgagcccguccucgccuucacccagggcucccccgagcgcgacgcccuccagaaggcccucaaggaccucaagggccgcauggaggccauccccugcgucgucggcgacgaggaggucuggaccuccgacguccaguaccaggucucccccuucaaccacggccacaaggucgccaaguucugcuacgccgacaagucccuccucaacaaggccaucgaggccgcccucgccgcccgcaaggagugggaccucaagcccaucgccgaccgcgcccagaucuuccucaaggccgccgacaugcucuccggcccccgccgcgccgagauccucgccaagaccauggucggccagggcaagaccgucauccaggccgagaucgacgccgccgccgagcucaucgacuucuuccgcuucaacgccaaguacgccgucgagcucgagggccagcagcccaucuccgucccccccuccaccaacuccaccgucuaccgcggccucgagggcuucgucgccgccaucucccccuucaacuucaccgccaucggcggcaaccucgccggcgcccccgcccucaugggcaacgucguccucuggaagcccuccgacaccgccaugcucgccuccuacgccgucuaccgcauccuccgcgaggccggccucccccccaacaucauccaguucguccccgccgacggcccccucuucggcgacaccgucaccuccuccgagcaccucugcggcaucaacuucaccggcuccguccccaccuucaagcaccucuggaagcaggucgcccagaaccucgaccgcuuccacaccuucccccgccucgccggcgagugcggcggcaagaacuuccacuucguccaccgcuccgccgacgucgaguccgucgucuccggcacccuccgcuccgccuucgaguacggcggccagaagugcuccgccugcucccgccucuacgucccccacucccucuggccccagaucaagggccgccuccucgaggagcacucccgcaucaaggucggcgaccccgccgaggacuucggcaccuucuucuccgccgucaucgacgccaaggagaucuucggccccguccucuccgucuacgucuaccccgacgacaaguacaaggagacccuccagcucgucgacuccaccaccuccuacggccucaccggcgccgucuucucccaggacaaggacgucguccaggaggccaccaagguccuccgcaacgccgccggcaacuucuacaucaacgacaaguccaccggcuccaucgucggccagcagcccuucggcggcgcccgcgccuccggcaccaacgacaagcccggcggcccccacuacauccuccgcuggaccuccccccaggucaucaaggagacccacaagccccucggcgacugguccuacgccuacaugcaguga

SEQ ID NO: 39609 - RNA, 1647 nt, Artificial Sequence
  derived and/or modified sequence opt2 from ALDH5A1__Homo_sapiens__NP_733936
auggccaccugcaucuggcuccgcuccugcggcgcccgccgccucggcuccaccuuccccggcugccgccuccgcccccgcgccggcggccucguccccgccuccggccccgcccccggccccgcccagcuccgcugcuacgccggccgccucgccggccucuccgccgcccuccuccgcaccgacuccuucgucggcggccgcuggcuccccgccgccgccaccuuccccguccaggaccccgccuccggcgccgcccucggcauggucgccgacugcggcguccgcgaggcccgcgccgccguccgcgccgccuacgaggccuucugccgcuggcgcgaggucuccgccaaggagcgcuccucccuccuccgcaagugguacaaccucaugauccagaacaaggacgaccucgcccgcaucaucaccgccgaguccggcaagccccucaaggaggcccacggcgagauccucuacuccgccuucuuccucgagugguucuccgaggaggcccgccgcgucuacggcgacaucauccacacccccgccaaggaccgccgcgcccucguccucaagcagcccaucggcgucgccgccgucaucacccccuggaacuuccccuccgccaugaucacccgcaaggucggcgccgcccucgccgccggcugcaccgucgucgucaagcccgccgaggacacccccuucuccgcccucgcccucgccgaggucaaccagggcuuccuccucgaccucgacccccuccuccucgccucccaggccggcauccccuccggcgucuacaacgucauccccugcucccgcaagaacgccaaggaggucggcgaggccaucugcaccgacccccucgucuccaagaucuccuucaccggcuccaccaccaccggcaagauccuccuccaccacgccgccaacuccgucaagcgcgucuccauggagcucggcggccucgcccccuucaucgucuucgacuccgccaacgucgaccaggccgucgccggcgccauggccuccaaguuccgcaacaccggccagaccugcgucugcuccaaccaguuccucguccagcgcggcauccacgacgccuucgucaaggccuucgccgaggccaugaagaagaaccuccgcgucggcaacggcuucgaggagggcaccacccagggcccccucaucaacgagaaggccgucgagaaggucgagaagcaggucaacgacgccgucuccaagggcgccaccgucgucaccggcggcaagcgccaccagcucggcaagaacuucuucgagcccacccuccucugcaacgucacccaggacaugcucugcacccacgaggagaccuucggcccccucgcccccgucaucaaguucgacaccgaggaggaggccaucgccaucgccaacgccgccgacgucggccucgccggcuacuucuacucccaggaccccgcccagaucuggcgcgucgccgagcagcucgaggucggcauggucggcgucaacgagggccucaucuccuccgucgagugccccuucggcggcgucaagcaguccggccucggccgcgagggcuccaaguacggcaucgacgaguaccucgagcucaaguacgucugcuacggcggccucuga

SEQ ID NO: 39610 - RNA, 1608 nt, Artificial Sequence
  derived and/or modified sequence opt2 from ALDH6A1__Homo_sapiens__NP_005580
auggccgcccuccucgccgccgccgccguccgcgcccgcauccuccaggucuccuccaaggucaaguccucccccaccugguacuccgccuccuccuucuccuccuccguccccaccgucaagcucuucaucggcggcaaguucgucgaguccaaguccgacaaguggaucgacauccacaaccccgccaccaacgaggucaucggccgcgucccccaggccaccaaggccgagauggacgccgccaucgccuccugcaagcgcgccuuccccgccugggccgacaccuccguccucucccgccagcagguccuccuccgcuaccagcagcucaucaaggagaaccucaaggagaucgccaagcucaucacccucgagcagggcaagacccucgccgacgccgagggcgacgucuuccgcggccuccaggucgucgagcacgccugcuccgucaccucccucaugaugggcgagaccaugcccuccaucaccaaggacauggaccucuacuccuaccgccucccccucggcgucugcgccggcaucgcccccuucaacuuccccgccaugaucccccucuggauguuccccauggccauggucugcggcaacaccuuccucaugaagcccuccgagcgcguccccggcgccaccaugcuccucgccaagcuccuccaggacuccggcgcccccgacggcacccucaacaucauccacggccagcacgaggccgucaacuucaucugcgaccaccccgacaucaaggccaucuccuucgucggcuccaacaaggccggcgaguacaucuucgagcgcggcucccgccacggcaagcgcguccaggccaacaugggcgccaagaaccacggcgucgucaugcccgacgccaacaaggagaacacccucaaccagcucgucggcgccgccuucggcgccgccggccagcgcugcauggcccucuccaccgccguccucgucggcgaggccaagaaguggcuccccgagcucgucgagcacgccaagaaccuccgcgucaacgccggcgaccagcccggcgccgaccucggcccccucaucaccccccaggccaaggagcgcgucugcaaccucaucgacuccggcaccaaggagggcgccuccauccuccucgacggccgcaagaucaaggucaagggcuacgagaacggcaacuucgucggccccaccaucaucuccaacgucaagcccaacaugaccugcuacaaggaggagaucuucggccccguccucgucguccucgagaccgagacccucgacgaggccauccagaucgucaacaacaaccccuacggcaacggcaccgccaucuucaccaccaacggcgccaccgcccgcaaguacgcccaccucgucgacgucggccaggucggcgucaacguccccauccccgucccccuccccauguucuccuucaccggcucccgcuccuccuuccgcggcgacaccaacuucuacggcaagcagggcauccaguucuacacccagcucaagaccaucaccucccaguggaaggaggaggacgccacccucuccucccccgccgucgucaugcccaccaugggccgcuga

SEQ ID NO: 39611 - RNA, 1620 nt, Artificial Sequence
  derived and/or modified sequence opt2 from ALDH7A1__Homo_sapiens__NP_001173
auguggcgccucccccgcgcccucugcguccacgccgccaagaccuccaagcucuccggccccuggucccgccccgccgccuucauguccacccuccucaucaaccagccccaguacgccuggcucaaggagcucggccuccgcgaggagaacgagggcgucuacaacggcuccuggggcggccgcggcgaggucaucaccaccuacugccccgccaacaacgagcccaucgcccgcguccgccaggccuccgucgccgacuacgaggagaccgucaagaaggcccgcgaggccuggaagaucugggccgacauccccgcccccaagcgcggcgagaucguccgccagaucggcgacgcccuccgcgagaagauccagguccucggcucccucgucucccucgagaugggcaagauccucgucgagggcgucggcgagguccaggaguacgucgacaucugcgacuacgccgucggccucucccgcaugaucggcggccccauccuccccuccgagcgcuccggccacgcccucaucgagcaguggaaccccgucggccucgucggcaucaucaccgccuucaacuuccccgucgccgucuacggcuggaacaacgccaucgccaugaucugcggcaacgucugccucuggaagggcgcccccaccaccucccucaucuccgucgccgucaccaagaucaucgccaagguccucgaggacaacaagcuccccggcgccaucugcucccucaccugcggcggcgccgacaucggcaccgccauggccaaggacgagcgcgucaaccuccucuccuucaccggcuccacccaggucggcaagcaggucggccucaugguccaggagcgcuucggccgcucccuccucgagcucggcggcaacaacgccaucaucgccuucgaggacgccgaccucucccucgucguccccuccgcccucuucgccgccgucggcaccgccggccagcgcugcaccaccgcccgccgccucuucauccacgaguccauccacgacgaggucgucaaccgccucaagaaggccuacgcccagauccgcgucggcaaccccugggaccccaacguccucuacggcccccuccacaccaagcaggccgucuccauguuccucggcgccgucgaggaggccaagaaggagggcggcaccgucgucuacggcggcaaggucauggaccgccccggcaacuacgucgagcccaccaucgucaccggccucggccacgacgccuccaucgcccacaccgagaccuucgcccccauccucuacgucuucaaguucaagaacgaggaggaggucuucgccuggaacaacgaggucaagcagggccucuccuccuccaucuucaccaaggaccucggccgcaucuuccgcuggcucggccccaagggcuccgacugcggcaucgucaacgucaacauccccaccuccggcgccgagaucggcggcgccuucggcggcgagaagcacaccggcggcggccgcgaguccggcuccgacgccuggaagcaguacaugcgccgcuccaccugcaccaucaacuacuccaaggaccucccccucgcccagggcaucaaguuccaguga

SEQ ID NO: 39612 - RNA, 1557 nt, Artificial Sequence
  derived and/or modified sequence opt2 from ALDH9A1__Homo_sapiens__NP_000687
auguuccuccgcgccggccucgccgcccucuccccccuccuccgcucccuccgccccucccccgucgccgccauguccaccggcaccuucgucgucucccagccccucaacuaccgcggcggcgcccgcgucgagcccgccgacgccuccggcaccgagaaggccuucgagcccgccaccggccgcgucaucgccaccuucaccugcuccggcgagaaggaggucaaccucgccguccagaacgccaaggccgccuucaagaucuggucccagaaguccggcauggagcgcugccgcauccuccucgaggccgcccgcaucauccgcgagcgcgaggacgagaucgccaccauggagugcaucaacaacggcaaguccaucuucgaggcccgccucgacaucgacaucuccuggcagugccucgaguacuacgccggccucgccgccuccauggccggcgagcacauccagcuccccggcggcuccuucggcuacacccgccgcgagccccucggcgucugcgucggcaucggcgccuggaacuaccccuuccagaucgccuccuggaaguccgcccccgcccucgccugcggcaacgccauggucuucaagcccucccccuucacccccgucuccgcccuccuccucgccgagaucuacuccgaggccggcgucccccccggccucuucaacgucguccagggcggcgccgccaccggccaguuccucugccagcaccccgacgucgccaaggucuccuucaccggcuccguccccaccggcaugaagaucauggagauguccgccaagggcaucaagcccgucacccucgagcucggcggcaaguccccccucaucaucuucuccgacugcgacaugaacaacgccgucaagggcgcccucauggccaacuuccucacccagggccaggucugcugcaacggcacccgcgucuucguccagaaggagauccucgacaaguucaccgaggaggucgucaagcagacccagcgcaucaagaucggcgacccccuccucgaggacacccgcaugggcccccucaucaaccgcccccaccucgagcgcguccucggcuucgucaaggucgccaaggagcagggcgccaagguccucugcggcggcgacaucuacguccccgaggaccccaagcucaaggacggcuacuacaugcgccccugcguccucaccaacugccgcgacgacaugaccugcgucaaggaggagaucuucggccccgucauguccauccucuccuucgacaccgaggccgagguccucgagcgcgccaacgacaccaccuucggccucgccgccggcgucuucacccgcgacauccagcgcgcccaccgcgucgucgccgagcuccaggccggcaccugcuucaucaacaacuacaacgucucccccgucgagcuccccuucggcggcuacaagaaguccggcuucggccgcgagaacggccgcgucaccaucgaguacuacucccagcucaagaccgucugcgucgagaugggcgacgucgaguccgccuucuga

SEQ ID NO: 39613 - RNA, 1257 nt, Artificial Sequence
  derived and/or modified sequence opt2 from ALDOA__Homo_sapiens__NP_001230106
auggcccgccgcaagcccgagggcuccuccuucaacaugacccaccucuccauggccauggccuucuccuucccccccgucgccuccggccagcuccacccccagcucggcaacacccagcaccagaccgagcucggcaaggagcucgccaccaccuccaccaugcccuaccaguaccccgcccucacccccgagcagaagaaggagcucuccgacaucgcccaccgcaucgucgcccccggcaagggcauccucgccgccgacgaguccaccggcuccaucgccaagcgccuccaguccaucggcaccgagaacaccgaggagaaccgccgcuucuaccgccagcuccuccucaccgccgacgaccgcgucaaccccugcaucggcggcgucauccucuuccacgagacccucuaccagaaggccgacgacggccgccccuucccccaggucaucaaguccaagggcggcgucgucggcaucaaggucgacaagggcgucgucccccucgccggcaccaacggcgagaccaccacccagggccucgacggccucuccgagcgcugcgcccaguacaagaaggacggcgccgacuucgccaaguggcgcugcguccucaagaucggcgagcacacccccuccgcccucgccaucauggagaacgccaacguccucgcccgcuacgccuccaucugccagcagaacggcaucguccccaucgucgagcccgagauccuccccgacggcgaccacgaccucaagcgcugccaguacgucaccgagaagguccucgccgccgucuacaaggcccucuccgaccaccacaucuaccucgagggcacccuccucaagcccaacauggucacccccggccacgccugcacccagaaguucucccacgaggagaucgccauggccaccgucaccgcccuccgccgcaccgucccccccgccgucaccggcaucaccuuccucuccggcggccaguccgaggaggaggccuccaucaaccucaacgccaucaacaagugcccccuccucaagcccugggcccucaccuucuccuacggccgcgcccuccaggccuccgcccucaaggccuggggcggcaagaaggagaaccucaaggccgcccaggaggaguacgucaagcgcgcccucgccaacucccucgccugccagggcaaguacacccccuccggccaggccggcgccgccgccuccgagucccucuucgucuccaaccacgccuacuga

SEQ ID NO: 39614 - RNA, 1095 nt, Artificial Sequence
  derived and/or modified sequence opt2 from ALDOB__Homo_sapiens__NP_000026
auggcccaccgcuuccccgcccucacccaggagcagaagaaggagcucuccgagaucgcccaguccaucgucgccaacggcaagggcauccucgccgccgacgaguccgucggcaccaugggcaaccgccuccagcgcaucaaggucgagaacaccgaggagaaccgccgccaguuccgcgagauccucuucuccgucgacuccuccaucaaccaguccaucggcggcgucauccucuuccacgagacccucuaccagaaggacucccagggcaagcucuuccgcaacauccucaaggagaagggcaucgucgucggcaucaagcucgaccagggcggcgccccccucgccggcaccaacaaggagaccaccauccagggccucgacggccucuccgagcgcugcgcccaguacaagaaggacggcgucgacuucggcaaguggcgcgccguccuccgcaucgccgaccagugccccuccucccucgccauccaggagaacgccaacgcccucgcccgcuacgccuccaucugccagcagaacggccucguccccaucgucgagcccgaggucauccccgacggcgaccacgaccucgagcacugccaguacgucaccgagaagguccucgccgccgucuacaaggcccucaacgaccaccacgucuaccucgagggcacccuccucaagcccaacauggucaccgccggccacgccugcaccaagaaguacacccccgagcaggucgccauggccaccgucaccgcccuccaccgcaccguccccgccgccguccccggcaucugcuuccucuccggcggcauguccgaggaggacgccacccucaaccucaacgccaucaaccucugcccccuccccaagcccuggaagcucuccuucuccuacggccgcgcccuccaggccuccgcccucgccgccuggggcggcaaggccgccaacaaggaggccacccaggaggccuucaugaagcgcgccauggccaacugccaggccgccaagggccaguacguccacaccggcuccuccggcgccgccuccacccagucccucuucaccgccugcuacaccuacuga

SEQ ID NO: 39615 - RNA, 1095 nt, Artificial Sequence
  derived and/or modified sequence opt2 from ALDOC__Homo_sapiens__NP_005156
augccccacuccuaccccgcccucuccgccgagcagaagaaggagcucuccgacaucgcccuccgcaucgucgcccccggcaagggcauccucgccgccgacgaguccgucggcuccauggccaagcgccucucccagaucggcgucgagaacaccgaggagaaccgccgccucuaccgccagguccucuucuccgccgacgaccgcgucaagaagugcaucggcggcgucaucuucuuccacgagacccucuaccagaaggacgacaacggcguccccuucguccgcaccauccaggacaagggcaucgucgucggcaucaaggucgacaagggcgucgucccccucgccggcaccgacggcgagaccaccacccagggccucgacggccucuccgagcgcugcgcccaguacaagaaggacggcgccgacuucgccaaguggcgcugcguccucaagaucuccgagcgcacccccuccgcccucgccauccucgagaacgccaacguccucgcccgcuacgccuccaucugccagcagaacggcaucguccccaucgucgagcccgagauccuccccgacggcgaccacgaccucaagcgcugccaguacgucaccgagaagguccucgccgccgucuacaaggcccucuccgaccaccacgucuaccucgagggcacccuccucaagcccaacauggucacccccggccacgccugccccaucaaguacacccccgaggagaucgccauggccaccgucaccgcccuccgccgcaccgucccccccgccguccccggcgucaccuuccucuccggcggccaguccgaggaggaggccuccuucaaccucaacgccaucaaccgcugcccccucccccgccccugggcccucaccuucuccuacggccgcgcccuccaggccuccgcccucaacgccuggcgcggccagcgcgacaacgccggcgccgccaccgaggaguucaucaagcgcgccgaggucaacggccucgccgcccagggcaaguacgagggcuccggcgaggacggcggcgccgccgcccagucccucuacaucgccaaccacgccuacuga

SEQ ID NO: 39616 - RNA, 1422 nt, Artificial Sequence
  derived and/or modified sequence opt2 from ALG10B__Homo_sapiens__NP_001013642
auggcccagcucgagggcuacugcuucuccgccgcccucuccugcaccuuccucgucuccugccuccucuucuccgccuucucccgcgcccuccgcgagcccuacauggacgagaucuuccaccucccccaggcccagcgcuacugcgagggccacuucucccucucccagugggaccccaugaucaccacccuccccggccucuaccucgucuccgucggcgucgucaagcccgccaucuggaucuucggcugguccgagcacgucgucugcuccaucggcaugcuccgcuucgucaaccuccucuucuccgucggcaacuucuaccuccucuaccuccucuuccacaagguccagccccgcaacaaggccgccuccuccauccagcgcguccucuccacccucacccucgccgucuuccccacccucuacuucuucaacuuccucuacuacaccgaggccggcuccauguucuucacccucuucgccuaccucaugugccucuacggcaaccacaagaccuccgccuuccucggcuucugcggcuucauguuccgccagaccaacaucaucugggccgucuucugcgccggcaacgucaucgcccagaagcucaccgaggccuggaagaccgagcuccagaagaaggaggaccgccucccccccaucaagggccccuucgccgaguuccgcaagauccuccaguuccuccucgccuacuccauguccuucaagaaccucuccaugcucuucugccucaccuggcccuacauccuccucggcuuccucuucugcgccuucgucgucgucaacggcggcaucgucaucggcgaccgcuccucccacgaggccugccuccacuucccccagcucuucuacuucuucuccuucacccucuucuucuccuucccccaccuccucucccccuccaagaucaagaccuuccucucccucgucuggaagcacggcauccucuuccucgucgucacccucgucuccgucuuccucgucuggaaguucaccuacgcccacaaguaccuccucgccgacaaccgccacuacaccuucuacgucuggaagcgcgucuuccagcgcuacgccauccucaaguaccuccucguccccgccuacaucuucgccggcugguccaucgccgacucccucaaguccaagcccaucuucuggaaccucauguucuucaucugccucuucaucgucaucgucccccagaagcuccucgaguuccgcuacuucauccuccccuacgucaucuaccgccucaacaucacccucccccccaccucccgccucgucugcgagcucuccugcuacgccaucgucaacuucaucaccuucuacaucuuccucaacaagaccuuccaguggcccaacucccaggacauccagcgcuucaugugguga

SEQ ID NO: 39617 - RNA, 1422 nt, Artificial Sequence
  derived and/or modified sequence opt2 from ALG10__Homo_sapiens__NP_116223
auggcccagcucgagggcuacuacuucuccgccgcccucuccugcaccuuccucgucuccugccuccucuucuccgccuucucccgcgcccuccgcgagcccuacauggacgagaucuuccaccucccccaggcccagcgcuacugcgagggccacuucucccucucccagugggaccccaugaucaccacccuccccggccucuaccucgucuccaucggcgucaucaagcccgccaucuggaucuucggcugguccgagcacgucgucugcuccaucggcaugcuccgcuucgucaaccuccucuucuccgucggcaacuucuaccuccucuaccuccucuucugcaagguccagccccgcaacaaggccgccuccuccauccagcgcguccucuccacccucacccucgccgucuuccccacccucuacuucuucaacuuccucuacuacaccgaggccggcuccauguucuucacccucuucgccuaccucaugugccucuacggcaaccacaagaccuccgccuuccucggcuucugcggcuucauguuccgccagaccaacaucaucugggccgucuucugcgccggcaacgucaucgcccagaagcucaccgaggccuggaagaccgagcuccagaagaaggaggaccgccucccccccaucaagggccccuucgccgaguuccgcaagauccuccaguuccuccucgccuacuccauguccuucaagaaccucuccaugcuccuccuccucaccuggcccuacauccuccucggcuuccucuucugcgccuucgucgucgucaacggcggcaucgucaucggcgaccgcuccucccacgaggccugccuccacuucccccagcucuucuacuucuucuccuucacccucuucuucuccuucccccaccuccucucccccuccaagaucaagaccuuccucucccucgucuggaagcgccgcauccucuucuucgucgucacccucgucuccgucuuccucgucuggaaguucaccuacgcccacaaguaccuccucgccgacaaccgccacuacaccuucuacgucuggaagcgcgucuuccagcgcuacgagaccgucaaguaccuccucguccccgccuacaucuucgccggcugguccaucgccgacucccucaaguccaaguccaucuucuggaaccucauguucuucaucugccucuucaccgucaucgucccccagaagcuccucgaguuccgcuacuucauccuccccuacgucaucuaccgccucaacaucccccucccccccaccucccgccucaucugcgagcucuccugcuacgccgucgucaacuucaucaccuucuucaucuuccucaacaagaccuuccaguggcccaacucccaggacauccagcgcuucaugugguga

SEQ ID NO: 39618 - RNA, 1479 nt, Artificial Sequence
  derived and/or modified sequence opt2 from ALG11__Homo_sapiens__NP_001004127
auggccgccggcgagcgcuccuggugccucugcaagcuccuccgcuucuucuacucccucuucuuccccggccucaucgucugcggcacccucugcgucugccucgucaucguccucuggggcauccgccuccuccuccagcgcaagaagaagcucgucuccaccuccaagaacggcaagaaccagauggucaucgccuucuuccaccccuacugcaacgccggcggcggcggcgagcgcguccucuggugcgcccuccgcgcccuccagaagaaguaccccgaggccgucuacgucgucuacaccggcgacgucaacgucaacggccagcagauccucgagggcgccuuccgccgcuucaacauccgccucauccaccccguccaguucgucuuccuccgcaagcgcuaccucgucgaggacucccucuacccccacuucacccuccucggccagucccucggcuccaucuuccucggcugggaggcccucaugcagugcguccccgacgucuacaucgacuccaugggcuacgccuucacccucccccucuucaaguacaucggcggcugccaggucggcuccuacguccacuaccccaccaucuccaccgacaugcucuccgucgucaagaaccagaacaucggcuucaacaacgccgccuucaucacccgcaaccccuuccucuccaaggucaagcucaucuacuacuaccucuucgccuucaucuacggccucgucggcuccugcuccgacgucgucauggucaacuccuccuggacccucaaccacauccucucccucuggaaggucggcaacugcaccaacaucgucuacccccccugcgacguccagaccuuccucgacaucccccuccacgagaagaagaugacccccggccaccuccucgucuccgucggccaguuccgccccgagaagaaccacccccuccagauccgcgccuucgccaagcuccucaacaagaagauggucgaguccccccccucccucaagcucguccucaucggcggcugccgcaacaaggacgacgagcuccgcgucaaccagcuccgccgccucuccgaggaccucggcguccaggaguacgucgaguucaagaucaacauccccuucgacgagcucaagaacuaccucuccgaggccaccaucggccuccacaccauguggaacgagcacuucggcaucggcgucgucgagugcauggccgccggcaccaucauccucgcccacaacuccggcggccccaagcucgacaucgucgucccccacgagggcgacaucaccggcuuccucgccgaguccgaggaggacuacgccgagaccaucgcccacauccucuccauguccgccgagaagcgccuccagauccgcaaguccgcccgcgccuccgucucccgcuucuccgaccaggaguucgaggucaccuuccucuccuccgucgagaagcucuucaaguga

SEQ ID NO: 39619 - RNA, 1467 nt, Artificial Sequence
  derived and/or modified sequence opt2 from ALG12__Homo_sapiens__NP_077010
auggccggcaagggcuccuccggccgccgcccccuccuccucggccuccucgucgccgucgccaccguccaccucgucaucugccccuacaccaaggucgaggaguccuucaaccuccaggccacccacgaccuccucuaccacuggcaggaccucgagcaguacgaccaccucgaguuccccggcgucgucccccgcaccuuccucggccccgucgucaucgccgucuucuccucccccgccgucuacguccucucccuccucgagauguccaaguucuacucccagcucaucguccgcggcguccucggccucggcgucaucuucggccucuggacccuccagaaggagguccgccgccacuucggcgccauggucgccaccauguucugcugggucaccgccaugcaguuccaccucauguucuacugcacccgcacccuccccaacguccucgcccuccccgucguccuccucgcccucgccgccuggcuccgccacgagugggcccgcuucaucuggcucuccgccuucgccaucaucgucuuccgcgucgagcucugccucuuccucggccuccuccuccuccucgcccucggcaaccgcaaggucuccgucguccgcgcccuccgccacgccguccccgccggcauccucugccucggccucaccgucgccgucgacuccuacuucuggcgccagcucaccuggcccgagggcaagguccucugguacaacaccguccucaacaaguccuccaacuggggcaccuccccccuccucugguacuucuacuccgcccucccccgcggccucggcugcucccuccucuucaucccccucggccucgucgaccgccgcacccacgcccccaccguccucgcccucggcuucauggcccucuacucccuccucccccacaaggagcuccgcuucaucaucuacgccuuccccaugcucaacaucaccgccgcccgcggcugcuccuaccuccucaacaacuacaagaaguccuggcucuacaaggccggcucccuccucgucaucggccaccucgucgucaacgccgccuacuccgccaccgcccucuacgucucccacuucaacuaccccggcggcgucgccaugcagcgccuccaccagcucguccccccccagaccgacguccuccuccacaucgacgucgccgccgcccagaccggcgucucccgcuuccuccaggucaacuccgccuggcgcuacgacaagcgcgaggacguccagcccggcaccggcaugcucgccuacacccacauccucauggaggccgcccccggccuccucgcccucuaccgcgacacccaccgcguccucgccuccgucgucggcaccaccggcgucucccucaaccucacccagcucccccccuucaacguccaccuccagaccaagcucguccuccucgagcgccucccccgccccuccuga

SEQ ID NO: 39620 - RNA, 3414 nt, Artificial Sequence
  derived and/or modified sequence opt2 from ALG13__Homo_sapiens__NP_001093392
augaagugcgucuucgucaccgucggcaccaccuccuucgacgaccucaucgccugcgucuccgcccccgacucccuccagaagaucgagucccucggcuacaaccgccucauccuccagaucggccgcggcaccgucguccccgagcccuucuccaccgaguccuucacccucgacgucuaccgcuacaaggacucccucaaggaggacauccagaaggccgaccucgucaucucccacgccggcgccggcuccugccucgagacccucgagaagggcaagccccucgucgucgucaucaacgagaagcucaugaacaaccaccagcucgagcucgccaagcagcuccacaaggagggccaccucuucuacugcaccugccgcguccucaccugccccggccaggccaaguccaucgccuccgcccccggcaagugccaggacuccgccgcccucaccuccaccgccuucuccggccucgacuucggccuccucuccggcuaccuccacaagcaggcccucgucaccgccacccaccccaccugcacccuccucuuccccuccugccacgccuucuucccccucccccucacccccacccucuacaagaugcacaagggcuggaagaacuacugcucccagaagucccucaacgaggccuccauggacgaguaccucggcucccucggccucuuccgcaagcucaccgccaaggacgccuccugccucuuccgcgccaucuccgagcagcucuucugcucccagguccaccaccucgagauccgcaaggccugcgucuccuacaugcgcgagaaccagcagaccuucgaguccuacgucgagggcuccuucgagaaguaccucgagcgccucggcgaccccaaggaguccgccggccagcucgagauccgcgcccucucccucaucuacaaccgcgacuucauccucuaccgcuuccccggcaagccccccaccuacgucaccgacaacggcuacgaggacaagauccuccucugcuacuccuccuccggccacuacgacuccgucuacuccaagcaguuccaguccuccgccgccgucugccaggccguccucuacgagauccucuacaaggacgucuucgucgucgacgaggaggagcucaagaccgccaucaagcucuuccgcuccggcuccaagaagaaccgcaacaacgccgucaccggcuccgaggacgcccacaccgacuacaaguccuccaaccagaaccgcauggaggaguggggcgccugcuacaacgccgagaacauccccgagggcuacaacaagggcaccgaggagaccaagucccccgagaaccccuccaagaugcccuuccccuacaagguccucaaggcccucgaccccgagaucuaccgcaacgucgaguucgacgucuggcucgacucccgcaaggagcuccagaaguccgacuacauggaguacgccggccgccaguacuaccucggcgacaagugccaggucugccucgaguccgagggccgcuacuacaacgcccacauccaggaggucggcaacgagaacaacuccgucaccgucuucaucgaggagcucgccgagaagcacgucgucccccucgccaaccucaagcccgucacccaggucauguccguccccgccuggaacgccaugcccucccgcaagggccgcggcuaccagaagaugcccggcggcuacguccccgagaucgucaucuccgagauggacaucaagcagcagaagaagauguucaagaagauccgcggcaaggaggucuacaugaccauggccuacggcaagggcgacccccuccuccccccccgccuccagcacuccaugcacuacggccacgacccccccaugcacuacucccagaccgccggcaacgucauguccaacgagcacuuccacccccagcaccccuccccccgccagggccgcggcuacggcaugccccgcaacuccucccgcuucaucaaccgccacaacaugcccggccccaaggucgacuucuaccccggccccggcaagcgcugcugccaguccuacgacaacuucuccuaccgcucccgcuccuuccgccgcucccaccgccagauguccugcgucaacaaggagucccaguacggcuucacccccggcaacggccagaugccccgcggccucgaggagaccaucaccuucuacgaggucgaggagggcgacgagaccgccuaccccacccuccccaaccacggcggccccuccaccaugguccccgccaccuccggcuacugcgucggccgccgcggccacuccuccggcaagcagacccucaaccucgaggagggcaacggccaguccgagaacggccgcuaccacgaggaguaccucuaccgcgccgagcccgacuacgagaccuccggcgucuacuccaccaccgccuccaccgccaaccucucccuccaggaccgcaaguccugcuccauguccccccaggacaccgucaccuccuacaacuacccccagaagaugaugggcaacaucgccgccgucgccgccuccugcgccaacaacguccccgcccccguccucuccaacggcgccgccgccaaccaggccaucuccaccaccuccgucuccucccagaacgccauccagccccucuucgucuccccccccacccacggccgccccgucaucgccucccccuccuaccccugccacuccgccaucccccacgccggcgccucccuccccccccccccccccccccccccccccccccccccccccccccccccccccccccccccccccccccccccccccccccccgcccucgacgucggcgagaccuccaaccuccagcccccccccccccucccccccccccccuacuccugcgaccccuccggcuccgaccucccccaggacaccaagguccuccaguacuacuucaaccucggccuccagugcuacuaccacuccuacuggcacuccauggucuacgucccccagaugcagcagcagcuccacgucgagaacuaccccgucuacaccgagcccccccucgucgaccagaccgucccccagugcuacuccgagguccgccgcgaggacggcauccaggccgaggccuccgccaacgacaccuuccccaacgccgacuccuccuccgucccccacggcgccgucuacuaccccgucauguccgaccccuacggccagcccccccuccccggcuucgacuccugccuccccgucguccccgacuacuccugcgucccccccuggcaccccgucggcaccgccuacggcggcuccucccagauccacggcgccaucaaccccggccccaucggcugcaucgcccccuccccccccgccucccacuacgucccccagggcauguga

SEQ ID NO: 39621 - RNA, 1395 nt, Artificial Sequence
  derived and/or modified sequence opt2 from ALG1__Homo_sapiens__NP_061982
auggccgccuccugccucguccuccucgcccucugccuccuccucccccuccuccuccucggcggcuggaagcgcuggcgccgcggccgcgccgcccgccacgucgucgccgucguccucggcgacgucggccgcuccccccgcaugcaguaccacgcccucucccucgccaugcacggcuucuccgucacccuccucggcuucugcaacuccaagccccacgacgagcuccuccagaacaaccgcauccagaucgucggccucaccgagcuccagucccucgccgucggcccccgcgucuuccaguacggcgucaaggucguccuccaggccauguaccuccucuggaagcucauguggcgcgagcccggcgccuacaucuuccuccagaacccccccggccuccccuccaucgccgucugcugguucgucggcugccucugcggcuccaagcucgucaucgacuggcacaacuacggcuacuccaucaugggccucguccacggccccaaccacccccucguccuccucgccaagugguacgagaaguucuucggccgccucucccaccucaaccucugcgucaccaacgccaugcgcgaggaccucgccgacaacuggcacauccgcgccgucaccgucuacgacaagcccgccuccuucuucaaggagaccccccucgaccuccagcaccgccucuucaugaagcucggcuccaugcacucccccuuccgcgcccgcuccgagcccgaggaccccgucaccgagcgcuccgccuucaccgagcgcgacgccggcuccggccucgucacccgccuccgcgagcgccccgcccuccucgucuccuccaccuccuggaccgaggacgaggacuucuccauccuccucgccgcccucgagaaguucgagcagcucacccucgacggccacaaccuccccucccucgucugcgucaucaccggcaagggcccccuccgcgaguacuacucccgccucauccaccagaagcacuuccagcacauccaggucugcacccccuggcucgaggccgaggacuacccccuccuccucggcuccgccgaccucggcgucugccuccacaccuccuccuccggccucgaccuccccaugaaggucgucgacauguucggcugcugccuccccgucugcgccgucaacuucaagugccuccacgagcucgucaagcacgaggagaacggccucgucuucgaggacuccgaggagcucgccgcccagcuccagaugcucuucuccaacuuccccgaccccgccggcaagcucaaccaguuccgcaagaaccuccgcgagucccagcagcuccgcugggacgaguccuggguccagaccguccucccccucgucauggacaccuga

SEQ ID NO: 39622 - RNA, 564 nt, Artificial Sequence
  derived and/or modified sequence opt2 from ALG1L__Homo_sapiens__NP_001015050
auggagcgcuccgccuucauggagcucgacgccggcucccgccucgucaugcaccuccgcgaguggcccgcccuccucgucuccuccaccggcuggaccgaguucgagcagcucacccucgacggccacaaccuccccucccucgucugcgucaucaccggcuccgucgaccucggcgucugccuccacauguccuccuccggccucgaccuccccaugaaggucgucgacauguucggcugcugccuccccgucugcgccgucaacuucaagugccuccacgagcucgucaagcacgaggagaacggccucgucuucgaggacuccgaggagcucgccgcccuccagaugcucuucuccaacuuccccgaccccgccggcaagcucaaccaguucuggaagaaccuccgcgagucccagcagcuccgcugggacgaguccuggguccagaccguccucccccucgucauggacauccagcuccucggccagcgccucaagccccgcgaccccugcugccccucccgcuccuucuucuccgagucccagggcaagcccuucuga

SEQ ID NO: 39623 - RNA, 1251 nt, Artificial Sequence
  derived and/or modified sequence opt2 from ALG2__Homo_sapiens__NP_149078
auggccgaggagcagggccgcgagcgcgacuccguccccaagcccuccguccucuuccuccaccccgaccucggcgucggcggcgccgagcgccucguccucgacgccgcccucgcccuccaggcccgcggcugcuccgucaagaucuggaccgcccacuacgaccccggccacugcuucgccgagucccgcgagcuccccguccgcugcgccggcgacuggcucccccgcggccucggcuggggcggccgcggcgccgccgucugcgccuacguccgcauggucuuccucgcccucuacguccucuuccucgccgacgaggaguucgacgucgucgucugcgaccaggucuccgccugcauccccgucuuccgccucgcccgccgccgcaagaagauccucuucuacugccacuuccccgaccuccuccucaccaagcgcgacuccuuccucaagcgccucuaccgcgcccccaucgacuggaucgaggaguacaccaccggcauggccgacugcauccucgucaacucccaguucaccgccgccgucuucaaggagaccuucaagucccucucccacaucgaccccgacguccucuaccccucccucaacgucaccuccuucgacuccgucguccccgagaagcucgacgaccucguccccaagggcaagaaguuccuccuccucuccaucaaccgcuacgagcgcaagaagaaccucacccucgcccucgaggcccucguccagcuccgcggccgccucaccucccaggacugggagcgcguccaccucaucgucgccggcggcuacgacgagcgcguccucgagaacgucgagcacuaccaggagcucaagaagaugguccagcaguccgaccucggccaguacgucaccuuccuccgcuccuucuccgacaagcagaagaucucccuccuccacuccugcaccugcguccucuacacccccuccaacgagcacuucggcaucgucccccucgaggccauguacaugcagugccccgucaucgccgucaacuccggcggcccccucgaguccaucgaccacuccgucaccggcuuccucugcgagcccgaccccguccacuucuccgaggccaucgagaaguucauccgcgagcccucccucaaggccaccaugggccucgccggccgcgcccgcgucaaggagaaguucucccccgaggccuucaccgagcagcucuaccgcuacgucaccaagcuccucgucuga

SEQ ID NO: 39624 - RNA, 1173 nt, Artificial Sequence
  derived and/or modified sequence opt2 from ALG3__Homo_sapiens__NP_001006942
auguuccccgcccaggccaaggagaacgccggcuucuccggcugcggcggcgacaccgagaucgacuggaaggccuacauggccgaggucgagggcgucaucaacggcaccuacgacuacacccagcuccagggcgacaccggcccccucgucuaccccgccggcuucgucuacaucuucaugggccucuacuacgccaccucccgcggcaccgacauccgcauggcccagaacaucuucgccguccucuaccucgccacccuccuccucgucuuccucaucuaccaccagaccugcaaggucccccccuucgucuucuucuucaugugcugcgccuccuaccgcguccacuccaucuucguccuccgccucuucaacgaccccgucgccaugguccuccucuuccucuccaucaaccuccuccucgcccagcgcuggggcuggggcugcugcuucuucucccucgccgucuccgucaagaugaacguccuccucuucgcccccggccuccucuuccuccuccucacccaguucggcuuccgcggcgcccuccccaagcucggcaucugcgccggccuccaggucguccucggccuccccuuccuccucgagaaccccuccggcuaccucucccgcuccuucgaccucggccgccaguuccucuuccacuggaccgucaacuggcgcuuccuccccgaggcccucuuccuccaccgcgccuuccaccucgcccuccucaccgcccaccucacccuccuccuccucuucgcccucugccgcuggcaccgcaccggcgaguccauccucucccuccuccgcgaccccuccaagcgcaagguccccccccagccccucacccccaaccagaucgucuccacccucuucaccuccaacuucaucggcaucugcuucucccgcucccuccacuaccaguucuacgucugguacuuccacacccuccccuaccuccucugggccaugcccgcccgcuggcucacccaccuccuccgccuccucguccucggccucaucgagcucuccuggaacaccuaccccuccaccuccugcuccuccgccgcccuccacaucugccacgccgucauccuccuccagcucuggcucggcccccagcccuuccccaaguccacccagcacuccaagaaggcccacuga

SEQ ID NO: 39625 - RNA, 1404 nt, Artificial Sequence
  derived and/or modified sequence opt2 from ALG8__Homo_sapiens__NP_001007028
auggccgcccucaccaucgccaccggcaccggcaacugguucuccgcccucgcccucggcgucacccuccucaagugccuccucauccccaccuaccacuccaccgacuucgagguccaccgcaacuggcucgccaucacccacucccuccccaucucccagugguacuacgaggccaccuccgaguggacccucgacuacccccccuucuucgccugguucgaguacauccucucccacgucgccaaguacuucgaccaggagaugcucaacguccacaaccucaacuacuccuccucccgcacccuccucuuccagcgcuucuccgucaucuucauggacguccucuucgucuacgccguccgcgagugcugcaagugcaucgacggcaagaaggucggcaaggagcucaccgagaagcccaaguucauccucuccguccuccuccucuggaacuucggccuccucaucgucgaccacauccacuuccaguacaacggcuuccucuucggccucaugcuccucuccaucgcccgccucuuccagaagcgccacauggagggcgccuuccucuucgccguccuccuccacuucaagcacaucuaccucuacgucgcccccgccuacggcgucuaccuccuccgcuccuacugcuucaccgccaacaagcccgacggcuccauccgcuggaaguccuucuccuucguccgcgucaucucccucggccucgucgucuuccucgucuccgcccucucccucggccccuuccucgcccucaaccagcucccccaggucuucucccgccucuuccccuucaagcgcggccucugccacgccuacugggcccccaacuucugggcccucuacaacgcccucgacaagguccucuccgucaucggccucaagcucaaguuccucgaccccaacaacauccccaaggccuccaugaccuccggccucguccagcaguuccagcacaccguccuccccuccgucaccccccucgccacccucaucugcacccucaucgccauccuccccuccaucuucugccucugguucaagccccagggcccccgcggcuuccuccgcugccucacccucugcgcccucuccuccuucauguucggcuggcacguccacgagaaggccauccuccucgccauccuccccaugucccuccucuccgucggcaaggccggcgacgccuccaucuuccucauccucaccaccaccggccacuacucccucuucccccuccucuucaccgcccccgagcuccccaucaagauccuccucaugcuccucuucaccaucuacuccaucuccucccucaagacccucuuccgccgcuccuucacccucgucgcccaggccggcguccaguggcacgaccucuccuga

SEQ ID NO: 39626 - RNA, 1836 nt, Artificial Sequence
  derived and/or modified sequence opt2 from ALG9__Homo_sapiens__NP_001071158
auggccucccgcggcgcccgccagcgccucaagggcuccggcgccuccuccggcgacaccgcccccgccgccgacaagcuccgcgagcuccucggcucccgcgaggccggcggcgccgagcaccgcaccgagcucuccggcaacaaggccggccaggucugggcccccgagggcuccaccgccuucaagugccuccucuccgcccgccucugcgccgcccuccucuccaacaucuccgacugcgacgagaccuucaacuacugggagcccacccacuaccucaucuacggcgagggcuuccagaccugggaguacucccccgccuacgccauccgcuccuacgccuaccuccuccuccacgccuggcccgccgccuuccacgcccgcauccuccagaccaacaagauccucgucuucuacuuccuccgcugccuccucgccuucgucuccugcaucugcgagcucuacuucuacaaggccgucugcaagaaguucggccuccacgucucccgcaugaugcucgccuuccucguccucuccaccggcauguucugcuccuccuccgccuuccuccccuccuccuucugcauguacaccacccucaucgccaugaccggcugguacauggacaagaccuccaucgccguccucggcgucgccgccggcgccauccucggcuggcccuucuccgccgcccucggccuccccaucgccuucgaccuccucgucaugaagcaccgcuggaaguccuucuuccacuggucccucauggcccucauccucuuccucguccccgucgucgucaucgacuccuacuacuacggcaagcucgucaucgccccccucaacaucguccucuacaacgucuucaccccccacggccccgaccucuacggcaccgagcccugguacuucuaccucaucaacggcuuccucaacuucaacgucgccuucgcccucgcccuccucguccucccccucaccucccucauggaguaccuccuccagcgcuuccacguccagaaccucggccaccccuacuggcucacccucgcccccauguacaucugguucaucaucuucuucauccagccccacaaggaggagcgcuuccucuuccccgucuacccccucaucugccucugcggcgccgucgcccucuccgcccuccagaagugcuaccacuucgucuuccagcgcuaccgccucgagcacuacaccgucaccuccaacuggcucgcccucggcaccgucuuccucuucggccuccucuccuucucccgcuccgucgcccucuuccgcggcuaccacggcccccucgaccucuaccccgaguucuaccgcaucgccaccgaccccaccauccacaccguccccgagggccgccccgucaacgucugcgucggcaaggagugguaccgcuuccccuccuccuuccuccuccccgacaacuggcagcuccaguucauccccuccgaguuccgcggccagcuccccaagcccuucgccgagggcccccucgccacccgcaucguccccaccgacaugaacgaccagaaccucgaggagcccucccgcuacaucgacaucuccaagugccacuaccucgucgaccucgacaccaugcgcgagaccccccgcgagcccaaguacuccuccaacaaggaggaguggaucucccucgccuaccgccccuuccucgacgccucccgcuccuccaagcuccuccgcgccuucuacguccccuuccucuccgaccaguacaccgucuacgucaacuacaccauccucaagccccgcaaggccaagcagauccgcaagaaguccggcggcuga

SEQ ID NO: 39627 - RNA, 1170 nt, Artificial Sequence
  derived and/or modified sequence opt2 from ALKBH1__Homo_sapiens__NP_006011
augggcaagauggccgccgccgucggcuccgucgccacccucgccaccgagcccggcgaggacgccuuccgcaagcucuuccgcuucuaccgccagucccgccccggcaccgccgaccucgagggcgucaucgacuucuccgccgcccacgccgcccgcggcaagggccccggcgcccagaaggucaucaagucccagcucaacgucuccuccgucuccgagcagaacgccuaccgcgccggccuccagcccgucuccaaguggcaggccuacggccucaagggcuaccccggcuucaucuucauccccaaccccuuccuccccggcuaccaguggcacugggucaagcagugccucaagcucuacucccagaagcccaacgucugcaaccucgacaagcacauguccaaggaggagacccaggaccucugggagcaguccaaggaguuccuccgcuacaaggaggccaccaagcgccgcccccgcucccuccucgagaagcuccgcugggucaccgucggcuaccacuacaacugggacuccaagaaguacuccgccgaccacuacacccccuuccccuccgaccucggcuuccucuccgagcaggucgccgccgccugcggcuucgaggacuuccgcgccgaggccggcauccucaacuacuaccgccucgacuccacccucggcauccacgucgaccgcuccgagcucgaccacuccaagccccuccucuccuucuccuucggccaguccgccaucuuccuccucggcggccuccagcgcgacgaggcccccaccgccauguucaugcacuccggcgacaucaugaucauguccggcuucucccgccuccucaaccacgccgucccccgcguccuccccaaccccgagggcgagggccucccccacugccucgaggccccccuccccgccguccucccccgcgacuccauggucgagcccugcuccauggaggacuggcaggucugcgccuccuaccucaagaccgcccgcgucaacaugaccguccgccagguccucgccaccgaccagaacuucccccucgagcccaucgaggacgagaagcgcgacaucuccaccgagggcuucugccaccucgacgaccagaacuccgaggucaagcgcgcccgcaucaaccccgacuccuga

SEQ ID NO: 39628 - RNA, 786 nt, Artificial Sequence
  derived and/or modified sequence opt2 from ALKBH2__Homo_sapiens__NP_001001655
auggaccgcuuccucgucaagggcgcccagggcggccuccuccgcaagcaggaggagcaggagcccaccggcgaggagcccgccguccucggcggcgacaaggaguccacccgcaagcgcccccgccgcgaggcccccggcaacggcggccacuccgccggccccuccuggcgccacauccgcgccgagggccucgacugcuccuacaccguccucuucggcaaggccgaggccgacgagaucuuccaggagcucgagaaggaggucgaguacuucaccggcgcccucgcccgcguccaggucuucggcaaguggcacuccgucccccgcaagcaggccaccuacggcgacgccggccucaccuacaccuucuccggccucacccucucccccaagcccuggauccccguccucgagcgcauccgcgaccacgucuccggcgucaccggccagaccuucaacuucguccucaucaaccgcuacaaggacggcugcgaccacaucggcgagcaccgcgacgacgagcgcgagcucgcccccggcucccccaucgccuccgucuccuucggcgccugccgcgacuucgucuuccgccacaaggacucccgcggcaagucccccucccgccgcgucgccgucguccgccucccccucgcccacggcucccuccucaugaugaaccaccccaccaacacccacugguaccacucccuccccguccgcaagaagguccucgccccccgcgucaaccucaccuuccgcaagauccuccucaccaagaaguga

SEQ ID NO: 39629 - RNA, 861 nt, Artificial Sequence
  derived and/or modified sequence opt2 from ALKBH3__Homo_sapiens__NP_631917
auggaggagaagcgccgccgcgcccgcguccagggcgccugggccgcccccgucaagucccaggccaucgcccagcccgccaccaccgccaagucccaccuccaccagaagcccggccagaccuggaagaacaaggagcaccaccucuccgaccgcgaguucgucuucaaggagccccagcaggucguccgccgcgcccccgagccccgcgucaucgaccgcgagggcgucuacgagaucucccucucccccaccggcgucucccgcgucugccucuaccccggcuucgucgacgucaaggaggccgacuggauccucgagcagcucugccaggacguccccuggaagcagcgcaccggcauccgcgaggacaucaccuaccagcagccccgccucaccgccugguacggcgagcuccccuacaccuacucccgcaucaccauggagcccaacccccacuggcaccccguccuccgcacccucaagaaccgcaucgaggagaacaccggccacaccuucaacucccuccucugcaaccucuaccgcaacgagaaggacuccgucgacuggcacuccgacgacgagcccucccucggccgcugccccaucaucgccucccucuccuucggcgccacccgcaccuucgagaugcgcaagaagcccccccccgaggagaacggcgacuacaccuacgucgagcgcgucaagaucccccucgaccacggcacccuccucaucauggagggcgccacccaggccgacuggcagcaccgcguccccaaggaguaccacucccgcgagccccgcgucaaccucaccuuccgcaccgucuaccccgacccccgcggcgcccccugguga

SEQ ID NO: 39630 - RNA, 666 nt, Artificial Sequence
  derived and/or modified sequence opt2 from ALKBH7__Homo_sapiens__NP_115682
auggccggcaccggccuccucgcccuccgcacccuccccggccccuccuggguccgcggcuccggccccuccguccucucccgccuccaggacgccgccgucguccgccccggcuuccucuccaccgccgaggaggagacccucucccgcgagcucgagcccgagcuccgccgccgccgcuacgaguacgaccacugggacgccgccauccacggcuuccgcgagaccgagaagucccgcugguccgaggccucccgcgccauccuccagcgcguccaggccgccgccuucggccccggccagacccuccucuccuccguccacguccucgaccucgaggcccgcggcuacaucaagccccacgucgacuccaucaaguucugcggcgccaccaucgccggccucucccuccucucccccuccgucaugcgccucguccacacccaggagcccggcgaguggcucgagcuccuccucgagcccggcucccucuacauccuccgcggcuccgcccgcuacgacuucucccacgagauccuccgcgacgaggaguccuucuucggcgagcgccgcaucccccgcggccgccgcaucuccgucaucugccgcucccuccccgagggcaugggccccggcgaguccggccagcccccccccgccugcuga

SEQ ID NO: 39631 - RNA, 2004 nt, Artificial Sequence
  derived and/or modified sequence opt2 from ALKBH8__Homo_sapiens__NP_001287939
auguucgccauggacuccaaccaccaguccaacuacaagcucuccaagaccgagaagaaguuccuccgcaagcagaucaaggccaagcacacccuccuccgccacgagggcaucgagaccgucuccuacgccacccagucccucgucgucgccaacggcggccucggcaacggcgucucccgcaaccagcuccuccccguccucgagaagugcggccucgucgacgcccuccucaugccccccaacaagcccuacuccuucgcccgcuaccgcaccaccgaggaguccaagcgcgccuacgucacccucaacggcaaggaggucgucgacgaccucggccagaagaucacccucuaccucaacuucgucgagaagguccaguggaaggagcuccgcccccaggcccucccccccggccucauggucgucgaggagaucaucuccuccgaggaggagaagaugcuccucgaguccgucgacuggaccgaggacaccgacaaccagaacucccagaagucccucaagcaccgccgcgucaagcacuucggcuacgaguuccacuacgagaacaacaacgucgacaaggacaagccccucuccggcggccuccccgacaucugcgaguccuuccucgagaaguggcuccgcaagggcuacaucaagcacaagcccgaccagaugaccaucaaccaguacgagcccggccagggcauccccgcccacaucgacacccacuccgccuucgaggacgagaucgucucccucucccucggcuccgagaucgucauggacuucaagcaccccgacggcaucgccguccccgucaugcucccccgccgcucccuccucgucaugaccggcgagucccgcuaccucuggacccacggcaucaccugccgcaaguucgacaccguccaggccuccgagucccucaaguccggcaucaucaccuccgacgucggcgaccucacccucuccaagcgcggccuccgcaccuccuucaccuuccgcaagguccgccagacccccugcaacugcuccuacccccucgucugcgacucccagcgcaaggagaccccccccuccuuccccgaguccgacaaggaggccucccgccucgagcaggaguacguccaccaggucuacgaggagaucgccggccacuucuccuccacccgccacacccccuggccccacaucgucgaguuccucaaggcccuccccuccggcuccaucgucgccgacaucggcugcggcaacggcaaguaccucggcaucaacaaggagcucuacaugaucggcugcgaccgcucccagaaccucgucgacaucugccgcgagcgccaguuccaggccuucgucugcgacgcccucgccguccccguccgcuccggcuccugcgacgccugcaucuccaucgccgucauccaccacuucgccaccgccgagcgccgcgucgccgcccuccaggagaucguccgccuccuccgccccggcggcaaggcccucaucuacgucugggccauggagcaggaguacaacaagcagaaguccaaguaccuccgcggcaaccgcaacucccagggcaagaaggaggagaugaacuccgacaccuccguccagcgcucccucgucgagcagaugcgcgacaugggcucccgcgacuccgccuccuccgucccccgcaucaacgacucccaggagggcggcugcaacucccgccaggucuccaacuccaagcuccccguccacgucaaccgcaccuccuucuacucccaggacguccucguccccuggcaccucaagggcaaccccgacaagggcaagcccgucgagcccuucggccccaucggcucccaggaccccucccccgucuuccaccgcuacuaccacgucuuccgcgagggcgagcucgagggcgccugccgcaccgucuccgacguccgcauccuccaguccuacuacgaccagggcaacuggugcgucauccuccagaaggccuga

SEQ ID NO: 39632 - RNA, 4863 nt, Artificial Sequence
  derived and/or modified sequence opt2 from ALK__Homo_sapiens__NP_004295
augggcgccaucggccuccucuggcuccucccccuccuccucuccaccgccgccgucggcuccggcaugggcaccggccagcgcgccggcucccccgccgccggccccccccuccagccccgcgagccccucuccuacucccgccuccagcgcaagucccucgccgucgacuucgucguccccucccucuuccgcgucuacgcccgcgaccuccuccucccccccuccuccuccgagcucaaggccggccgccccgaggcccgcggcucccucgcccucgacugcgccccccuccuccgccuccucggccccgcccccggcgucuccuggaccgccggcucccccgcccccgccgaggcccgcacccucucccgcguccucaagggcggcuccguccgcaagcuccgccgcgccaagcagcucguccucgagcucggcgaggaggccauccucgagggcugcgucggcccccccggcgaggccgccgucggccuccuccaguucaaccucuccgagcucuucuccugguggauccgccagggcgagggccgccuccgcauccgccucaugcccgagaagaaggccuccgaggucggccgcgagggccgccucuccgccgccauccgcgccucccagccccgccuccucuuccagaucuucggcaccggccacuccucccucgagucccccaccaacaugcccucccccucccccgacuacuucaccuggaaccucaccuggaucaugaaggacuccuuccccuuccucucccaccgcucccgcuacggccucgagugcuccuucgacuuccccugcgagcucgaguacucccccccccuccacgaccuccgcaaccaguccugguccuggcgccgcauccccuccgaggaggccucccagauggaccuccucgacggccccggcgccgagcgcuccaaggagaugccccgcggcuccuuccuccuccucaacaccuccgccgacuccaagcacaccauccucucccccuggaugcgcuccuccuccgagcacugcacccucgccgucuccguccaccgccaccuccagcccuccggccgcuacaucgcccagcuccucccccacaacgaggccgcccgcgagauccuccucaugcccacccccggcaagcacggcuggaccguccuccagggccgcaucggccgccccgacaaccccuuccgcgucgcccucgaguacaucuccuccggcaaccgcucccucuccgccgucgacuucuucgcccucaagaacugcuccgagggcaccucccccggcuccaagauggcccuccaguccuccuucaccugcuggaacggcaccguccuccagcucggccaggccugcgacuuccaccaggacugcgcccagggcgaggacgagucccagaugugccgcaagcuccccgucggcuucuacugcaacuucgaggacggcuucugcggcuggacccagggcacccucuccccccacaccccccaguggcagguccgcacccucaaggacgcccgcuuccaggaccaccaggaccacgcccuccuccucuccaccaccgacguccccgccuccgaguccgccaccgucaccuccgccaccuuccccgcccccaucaaguccucccccugcgagcuccgcauguccuggcucauccgcggcguccuccgcggcaacgucucccucguccucgucgagaacaagaccggcaaggagcagggccgcauggucuggcacgucgccgccuacgagggccucucccucuggcaguggaugguccucccccuccucgacgucuccgaccgcuucuggcuccagauggucgccugguggggccagggcucccgcgccaucgucgccuucgacaacaucuccaucucccucgacugcuaccucaccaucuccggcgaggacaagauccuccagaacaccgcccccaagucccgcaaccucuucgagcgcaaccccaacaaggagcucaagcccggcgagaacuccccccgccagacccccaucuucgaccccaccguccacuggcucuucaccaccugcggcgccuccggcccccacggccccacccaggcccagugcaacaacgccuaccagaacuccaaccucuccgucgaggucggcuccgagggcccccucaagggcauccagaucuggaagguccccgccaccgacaccuacuccaucuccggcuacggcgccgccggcggcaagggcggcaagaacaccaugaugcgcucccacggcgucuccguccucggcaucuucaaccucgagaaggacgacaugcucuacauccucgucggccagcagggcgaggacgccugccccuccaccaaccagcucauccagaaggucugcaucggcgagaacaacgucaucgaggaggagauccgcgucaaccgcuccguccacgagugggccggcggcggcggcggcggcggcggcgccaccuacgucuucaagaugaaggacggcguccccgucccccucaucaucgccgccggcggcggcggccgcgccuacggcgccaagaccgacaccuuccaccccgagcgccucgagaacaacuccuccguccucggccucaacggcaacuccggcgccgccggcggcggcggcggcuggaacgacaacaccucccuccucugggccggcaagucccuccaggagggcgccaccggcggccacuccugcccccaggccaugaagaaguggggcugggagacccgcggcggcuucggcggcggcggcggcggcugcuccuccggcggcggcggcggcggcuacaucggcggcaacgccgccuccaacaacgaccccgagauggacggcgaggacggcgucuccuucaucuccccccucggcauccucuacacccccgcccucaaggucauggagggccacggcgaggucaacaucaagcacuaccucaacugcucccacugcgaggucgacgagugccacauggaccccgagucccacaaggucaucugcuucugcgaccacggcaccguccucgccgaggacggcgucuccugcaucgucucccccacccccgagccccaccucccccucucccucauccucuccgucgucaccuccgcccucgucgccgcccucguccucgccuucuccggcaucaugaucgucuaccgccgcaagcaccaggagcuccaggccaugcagauggagcuccagucccccgaguacaagcucuccaagcuccgcaccuccaccaucaugaccgacuacaaccccaacuacugcuucgccggcaagaccuccuccaucuccgaccucaaggaggucccccgcaagaacaucacccucauccgcggccucggccacggcgccuucggcgaggucuacgagggccaggucuccggcaugcccaacgaccccuccccccuccaggucgccgucaagacccuccccgaggucugcuccgagcaggacgagcucgacuuccucauggaggcccucaucaucuccaaguucaaccaccagaacaucguccgcugcaucggcgucucccuccagucccucccccgcuucauccuccucgagcucauggccggcggcgaccucaaguccuuccuccgcgagacccgcccccgccccucccagcccuccucccucgccaugcucgaccuccuccacgucgcccgcgacaucgccugcggcugccaguaccucgaggagaaccacuucauccaccgcgacaucgccgcccgcaacugccuccucaccugccccggccccggccgcgucgccaagaucggcgacuucggcauggcccgcgacaucuaccgcgccuccuacuaccgcaagggcggcugcgccaugcuccccgucaaguggaugccccccgaggccuucauggagggcaucuucaccuccaagaccgacaccugguccuucggcguccuccucugggagaucuucucccucggcuacaugcccuaccccuccaaguccaaccaggagguccucgaguucgucaccuccggcggccgcauggacccccccaagaacugccccggccccgucuaccgcaucaugacccagugcuggcagcaccagcccgaggaccgccccaacuucgccaucauccucgagcgcaucgaguacugcacccaggaccccgacgucaucaacaccgcccuccccaucgaguacggcccccucgucgaggaggaggagaagguccccguccgccccaaggaccccgagggcguccccccccuccucgucucccagcaggccaagcgcgaggaggagcgcucccccgccgccccccccccccuccccaccaccuccuccggcaaggccgccaagaagcccaccgccgccgagaucuccguccgcgucccccgcggccccgccgucgagggcggccacgucaacauggccuucucccaguccaacccccccuccgagcuccacaagguccacggcucccgcaacaagcccaccucccucuggaaccccaccuacggcuccugguucaccgagaagcccaccaagaagaacaaccccaucgccaagaaggagccccacgaccgcggcaaccucggccucgagggcuccugcaccgucccccccaacgucgccaccggccgccuccccggcgccucccuccuccucgagcccuccucccucaccgccaacaugaaggaggucccccucuuccgccuccgccacuuccccugcggcaacgucaacuacggcuaccagcagcagggccucccccucgaggccgccaccgcccccggcgccggccacuacgaggacaccauccucaaguccaagaacuccaugaaccagcccggccccuga

SEQ ID NO: 39633 - RNA, 1176 nt, Artificial Sequence
  derived and/or modified sequence opt2 from ALLC__Homo_sapiens__NP_060906
auggacauggccuccgaguccgucggcggcaagauccucuucgccaccgacgacuucuucgcccccgccgagaaccucaucaaguccgacucccccugcuucaaggagcacgaguacaccgaguucggcaaguggauggacggcugggagacccgccgcaagcgcauccccggccacgacuggugcguccuccgccucggcauccagggcgucauccgcggcuucgacgucgacgucuccuacuucaccggcgacuacgccccccgcgucuccauccaggccgccaaccucgaggaggacaagcuccccgagauccccgagcgcggcacccgcaccggcgccgccgccacccccgaggaguucgaggccaucgccgagcucaaguccgacgacugguccuaccucguccccaugaccgagcucaagcccggcaaccccgccuccggccacaacuacuuccucgucaacucccagcagcgcuggacccacauccgccucaacaucuuccccgacggcggcaucgcccgccuccgcgucuucggcaccggccagaaggacuggaccgccaccgaccccaaggagcccgccgaccucgucgccaucgccuucggcggcgucugcgucggcuucuccaacgccaaguucggccaccccaacaacaucaucggcgucggcggcgccaaguccauggccgacggcugggagaccgcccgccgccucgaccgcccccccauccucgagaacgacgagaacggcauccuccucguccccggcugcgagugggccgucuuccgccucgcccaccccggcgucaucacccgcaucgagaucgacaccaaguacuucgagggcaacgcccccgacuccugcaaggucgacggcugcauccucaccacccaggaggaggaggccgucauccgccagaaguggauccuccccgcccacaaguggaagccccuccuccccgucaccaagcucucccccaaccagucccaccucuucgacucccucacccucgagcuccaggacgucaucacccacgcccgccucaccaucguccccgacggcggcgucucccgccuccgccuccgcggcuuccccuccuccaucugccuccuccgcccccgcgagaagcccaugcucaaguucuccgucuccuucaaggccaaccccuga

SEQ ID NO: 39634 - RNA, 12510 nt, Artificial Sequence
  derived and/or modified sequence opt2 from ALMS1__Homo_sapiens__NP_055935
auggagcccgaggaccuccccuggcccggcgagcucgaggaggaggaggaggaggaggaggaggaggaggaggaggaggaggaggaggccgccgccgccgccgccgccaacgucgacgacgucgucgucgucgaggaggucgaggaggaggccggccgcgagcucgacuccgacucccacuacggcccccagcaccucgaguccaucgacgacgaggaggacgaggaggccaaggccuggcuccaggcccaccccggccgcauccuccccccccucucccccccccagcaccgcuacuccgagggcgagcgcaccucccucgagaagaucgucccccucaccugccacgucuggcagcagaucgucuaccagggcaacucccgcacccagaucuccgacaccaacgucgucugccucgagaccaccgcccagcgcggcuccggcgacgaccagaagaccgaguccuggcacugccucccccaggagauggacuccucccagacccucgacaccucccagacccgcuucaacguccgcaccgaggacaccgaggucaccgacuuccccucccucgaggagggcauccucacccaguccgagaaccaggucaaggagcccaaccgcgaccucuucugcuccccccuccucgucauccaggacuccuucgccucccccgaccucccccuccucaccugccucacccaggaccaggaguucgcccccgacucccucuuccaccaguccgagcucuccuucgccccccuccgcggcauccccgacaaguccgaggacaccgagugguccucccgccccuccgaggucuccgaggcccucuuccaggccaccgccgaggucgccuccgaccucgccuccucccgcuucuccgucucccagcacccccucaucggcuccaccgccgucggcucccagugccccuuccuccccuccgagcagggcaacaacgaggagaccaucuccuccgucgacgagcucaagauccccaaggacugcgaccgcuacgacgaccucugcuccuacauguccuggaagacccgcaaggacacccaguggcccgagaacaaccucgccgacaaggaccaggucuccgucgccaccuccuucgacaucaccgacgagaacaucgccaccaagcgcuccgaccacuucgacgccgcccgcuccuacggccaguacuggacccaggaggacuccuccaagcaggccgagaccuaccucaccaagggccuccagggcaaggucgaguccgacgucaucacccucgacggccucaacgagaacgccgucgucugcuccgagcgcgucgccgagcuccagcgcaagcccacccgcgaguccgaguaccacuccuccgaccuccgcaugcuccgcaugucccccgacaccguccccaaggcccccaagcaccucaaggccggcgacaccuccaagggcggcaucgccaaggucacccaguccaaccucaaguccggcaucaccaccacccccgucgacuccgacaucggcucccaccucucccucucccucgaggaccucucccagcucgccgucuccuccccccucgagaccaccaccggccagcacaccgacacccucaaccagaagacccucgccgacacccaccucaccgaggagacccucaaggucaccgccauccccgagcccgccgaccagaagaccgccacccccaccguccucuccuccucccacucccaccgcggcaagcccuccaucuucuaccagcagggccuccccgacucccaccucaccgaggaggcccucaaggucuccgccgcccccggccucgccgaccagaccaccggcauguccacccucaccuccaccuccuacucccaccgcgagaagcccggcaccuucuaccagcaggagcuccccgaguccaaccucaccgaggagccccucgaggucuccgccgcccccggccccgucgagcagaagaccggcauccccaccgucuccuccaccucccacucccacgucgaggaccuccucuucuucuaccgccagacccuccccgacggccaccucaccgaccaggcccucaaggucuccgccgucuccggccccgccgaccagaagaccggcaccgccaccguccucuccaccccccacucccaccgcgagaagcccggcaucuucuaccagcaggaguucgccgacucccaccagaccgaggagacccucaccaaggucuccgccacccccggccccgccgaccagaagaccgagauccccgccguccaguccuccuccuacucccagcgcgagaagcccuccauccucuacccccaggaccucgccgacucccaccuccccgaggagggccucaaggucuccgccgucgccggccccgccgaccagaagaccggccuccccaccguccccuccuccgccuacucccaccgcgagaagcuccucgucuucuaccagcaggcccuccucgacucccaccuccccgaggaggcccucaaggucuccgccgucuccggccccgccgacggcaagaccggcacccccgccgucaccuccaccuccuccgccuccuccucccucggcgagaagcccuccgccuucuaccagcagacccuccccaacucccaccucaccgaggaggcccucaaggucuccaucguccccggccccggcgaccagaagaccggcauccccuccgcccccuccuccuucuacucccaccgcgagaagcccaucaucuucucccagcagacccuccccgacuuccucuuccccgaggaggcccucaaggucuccgccgucuccguccucgccgcccagaagaccggcacccccaccgucuccuccaacucccacucccacuccgagaaguccuccgucuucuaccagcaggagcuccccgacuccgaccucccccgcgagucccucaagauguccgccauccccggccucaccgaccagaagaccguccccacccccaccguccccuccggcuccuucucccaccgcgagaagcccuccaucuucuaccagcaggaguggcccgacuccuacgccaccgagaaggcccucaaggucuccaccggccccggccccgccgaccagaagaccgagauccccgccguccaguccuccuccuacccccagcgcgagaagcccuccguccucuacccccagguccucuccgacucccaccuccccgaggagucccucaaggucuccgccuuccccggccccgccgaccagaugaccgacacccccgccguccccuccaccuucuacucccagcgcgagaagcccggcaucuucuaccagcagacccuccccgagucccaccuccccaaggaggcccucaagaucuccgucgcccccggccucgccgaccagaagaccggcacccccaccgucaccuccaccuccuacucccagcaccgcgagaagcccuccaucuuccaccagcaggcccuccccggcacccacauccccgaggaggcccagaaggucuccgccgucaccggccccggcaaccagaagaccuggaucccccgcguccucuccaccuucuacucccagcgcgagaagcccggcaucuucuaccagcagacccuccccggcucccacauccccgaggaggcccagaaggucucccccguccucggccccgccgaccagaagaccggcacccccacccccaccuccgccuccuacucccacaccgagaagcccggcaucuucuaccagcagguccuccccgacaaccaccccaccgaggaggcccucaagaucuccgucgccuccgagcccgucgaccagaccaccggcacccccgccgucaccuccaccuccuacucccaguaccgcgagaagcccuccaucuucuaccagcagucccuccccuccucccaccucaccgaggaggccaagaacgucuccgccguccccggccccgccgaccagaagaccgucauccccauccuccccuccaccuucuacucccacaccgagaagcccggcgucuucuaccagcagguccucccccacucccaccccaccgaggaggcccucaagaucuccgucgccuccgagcccgucgaccagaccaccggcacccccaccgucaccuccaccuccuacucccagcacaccgagaagcccuccaucuucuaccagcagucccuccccggcucccaccucaccgaggaggccaagaacgucuccgccguccccggccccggcgaccgcaagaccggcauccccacccuccccuccaccuucuacucccacaccgagaagcccggcuccuucuaccagcagguccucccccacucccaccuccccgaggaggcccucgaggucuccgucgcccccggccccgucgaccagaccaucggcacccccaccgucaccucccccuccuccuccuucggcgagaagcccaucgucaucuacaagcaggccuuccccgagggccaccuccccgaggagucccucaaggucuccgucgcccccggccccgucggccagaccaccggcgcccccaccaucaccucccccuccuacucccagcaccgcgccaaguccggcuccuucuaccagcucgcccuccucggcucccagauccccgaggaggcccuccgcgucuccuccgcccccggccccgccgaccagaccaccggcauccccaccaucaccuccaccuccuacuccuucggcgagaagcccaucgucaacuacaagcaggccuuccccgacggccaccuccccgaggaggcccucaaggucuccaucgucuccggccccaccgagaagaagaccgacauccccgccggcccccucggcuccuccgcccucggcgagaagcccaucaccuucuaccgccaggcccuccucgacuccccccucaacaaggaggucgucaaggucuccgccgcccccggccccgccgaccagaagaccgagacccuccccguccacuccaccuccuacuccaaccgcggcaagcccgucaucuucuaccagcagacccucuccgacucccaccuccccgaggaggcccucaaggucccccccguccccggccccgacgcccagaagaccgagacccccuccgucuccuccucccucuacuccuaccgcgagaagcccaucgucuucuaccagcaggcccuccccgacuccgagcucacccaggaggcccucaaggucuccgccgucccccagcccgccgaccagaagaccggccucuccaccgucaccuccuccuucuacucccacaccgagaagcccaacaucuccuaccagcaggagcuccccgacucccaccucaccgaggaggcccucaaggucuccaacguccccggccccgccgaccagaagaccggcgucuccaccgucaccuccaccuccuacucccaccgcgagaagcccaucgucuccuaccagcgcgagcucccccacuucaccgaggccggccucaagauccuccgcguccccggccccgccgaccagaagaccggcaucaacauccuccccuccaacuccuacccccagcgcgagcacuccgucaucuccuacgagcaggagcuccccgaccucaccgaggucacccucaaggccaucggcguccccggccccgccgaccagaagaccggcauccagaucgccuccuccuccuccuacuccaaccgcgagaaggccuccaucuuccaccagcaggagcuccccgacgucaccgaggaggcccucaacgucuucgucguccccggccagggcgaccgcaagaccgagauccccaccgucccccucuccuacuacucccgccgcgagaagcccuccgucaucucccagcaggagcuccccgacucccaccucaccgaggaggcccucaaggucucccccgucuccauccccgccgagcagaagaccggcauccccaucggccucuccuccuccuacucccacucccacaaggagaagcucaagaucuccaccguccacauccccgacgaccagaagaccgaguuccccgccgccacccucuccuccuacucccagaucgagaagcccaagaucuccaccgucaucggccccaacgaccagaagacccccucccagaccgccuuccacuccuccuacucccagaccgucaagcccaacauccucuuccagcagcagcuccccgaccgcgaccaguccaagggcauccucaagaucuccgccguccccgagcucaccgacgucaacaccggcaagcccgucucccucuccuccuccuacuuccaccgcgagaaguccaacaucuucuccccccaggagcuccccggcucccacgucaccgaggacguccucaaggucuccaccauccccggccccgccggccagaagaccguccuccccaccgcccuccccuccuccuucucccaccgcgagaagcccgacaucuucuaccagaaggaccuccccgaccgccaccucaccgaggacgcccucaagaucuccuccgcccucggccaggccgaccagaucaccggccuccagaccguccccuccggcaccuacucccacggcgagaaccacaagcucgucuccgagcacguccagcgccucaucgacaaccucaacuccuccgacuccuccgucuccuccaacaacguccuccucaacucccaggccgacgaccgcgucgucaucaacaagcccgaguccgccggcuuccgcgacgucggcuccgaggagauccaggacgccgagaacuccgccaagacccucaaggagauccgcacccuccucauggaggccgagaacauggcccucaagcgcugcaacuuccccgccccccucgcccgcuuccgcgacaucuccgacaucuccuucauccaguccaagaaggucgucugcuucaaggagcccuccuccaccggcgucuccaacggcgaccuccuccaccgccagcccuucaccgaggagucccccuccucccgcugcauccagaaggacaucggcacccagaccaaccucaagugccgccgcggcaucgagaacugggaguucaucuccuccaccaccguccgcuccccccuccaggaggccgaguccaaggucuccauggcccucgaggagacccuccgccaguaccaggccgccaaguccgucaugcgcuccgagcccgagggcugcuccggcaccaucggcaacaagaucaucauccccaugaugaccgucaucaaguccgacuccuccuccgacgccuccgacggcaacggcuccugcuccugggacuccaaccuccccgagucccucgaguccgucuccgacguccuccucaacuucuuccccuacgucucccccaagaccuccaucaccgacucccgcgaggaggagggcgucuccgaguccgaggacggcggcggcuccuccgucgacucccucgccgcccacgucaagaaccuccuccagugcgaguccucccucaaccacgccaaggagauccuccgcaacgccgaggaggaggagucccgcguccgcgcccacgccuggaacaugaaguucaaccucgcccacgacugcggcuacuccaucuccgagcucaacgaggacgaccgccgcaaggucgaggagaucaaggccgagcucuucggccacggccgcaccaccgaccucuccaagggccuccaguccccccgcggcaugggcugcaagcccgaggccgucugcucccacaucaucaucgagucccacgagaagggcugcuuccgcacccucaccuccgagcacccccagcucgaccgccaccccugcgccuuccgcuccgccggccccuccgagaugacccgcggccgccagaaccccuccuccugccgcgccaagcacgucaaccucuccgccucccucgaccagaacaacucccacuucaaggucuggaacucccuccagcucaagucccacucccccuuccagaacuucauccccgacgaguucaagaucuccaagggccuccgcaugcccuucgacgagaagauggaccccuggcucuccgagcucgucgagcccgccuucgucccccccaaggaggucgacuuccacuccuccucccagaugcccucccccgagcccaugaagaaguucaccaccuccaucaccuucuccucccaccgccacuccaagugcaucuccaacuccuccgucgucaaggucggcgucaccgagggcucccagugcaccggcgccuccgucggcgucuucaacucccacuucaccgaggagcagaaccccccccgcgaccucaagcagaagaccuccucccccuccuccuucaagaugcacuccaacucccaggacaaggaggucaccauccucgccgagggccgccgccagucccagaagcuccccgucgacuucgagcgcuccuuccaggaggagaagccccucgagcgcuccgacuucaccggcucccacuccgagcccuccacccgcgccaacugcuccaacuucaaggagauccagaucuccgacaaccacacccucaucuccaugggccgccccuccuccacccucggcgucaaccgcuccuccucccgccucggcgucaaggagaagaacgucaccaucacccccgaccuccccuccugcaucuuccucgagcagcgcgagcucuucgagcaguccaaggccccccgcgccgacgaccacguccgcaagcaccacucccccuccccccagcaccaggacuacgucgcccccgaccuccccuccugcaucuuccucgagcagcgcgagcucuucgagcagugcaaggcccccuacgucgaccaccagaugcgcgagaaccacuccccccucccccagggccaggacuccaucgccuccgaccuccccucccccaucucccucgagcagugccaguccaaggcccccggcgucgacgaccagaugaacaagcaccacuucccccucccccagggccaggacugcgucgucgagaagaacaaccagcacaagcccaagucccacaucuccaacaucaacgucgaggccaaguucaacaccgucgucucccaguccgcccccaaccacugcacccucgccgccuccgccuccaccccccccuccaaccgcaaggcccucuccugcguccacaucacccucugccccaagaccuccuccaagcucgacuccggcacccucgacgagcgcuuccacucccucgacgccgccuccaaggcccgcaugaacuccgaguucaacuucgaccuccacaccgucuccucccgcucccucgagcccaccuccaagcuccucaccuccaagcccgucgcccaggaccaggagucccucggcuuccucggccccaaguccucccucgacuuccaggucguccagcccucccuccccgacuccaacaccaucacccaggaccucaagaccauccccucccagaacucccagaucgucaccucccgccagauccaggucaacaucuccgacuucgagggccacuccaaccccgagggcacccccgucuucgccgaccgccuccccgagaagaugaagaccccccucuccgccuucuccgagaagcucuccuccgacgccgucacccagaucaccaccgagucccccgagaagacccucuucuccuccgagaucuucaucaacgccgaggaccgcggccacgagaucaucgagcccggcaaccagaagcuccgcaaggcccccgucaaguucgccuccuccuccuccguccagcaggucaccuucucccgcggcaccgacggccagccccuccuccuccccuacaagcccuccggcuccaccaagauguacuacgucccccagcuccgccagaucccccccucccccgacuccaaguccgacaccaccgucgaguccucccacuccggcuccaacgacgccaucgcccccgacuuccccgcccagguccucggcacccgcgacgacgaccucuccgccaccgucaacaucaagcacaaggagggcaucuacuccaagcgcgucgucaccaaggccucccuccccgucggcgagaagccccuccagaacgagaacgccgacgccuccguccagguccucaucaccggcgacgagaaccucuccgacaagaagcagcaggagauccacuccacccgcgccgucaccgaggccgcccaggccaaggagaaggagucccuccagaaggacaccgccgacuccuccgccgccgccgccgccgagcacuccgcccaggucggcgaccccgagaugaagaaccuccccgacaccaaggccaucacccagaaggaggagauccaccgcaagaagaccguccccgaggaggccuggcccaacaacaaggagucccuccagaucaacaucgaggaguccgagugccacuccgaguucgagaacaccacccgcuccgucuuccgcuccgccaaguucuacauccaccaccccguccaccuccccuccgaccaggacaucugccacgagucccucggcaaguccgucuucaugcgccacuccuggaaggacuucuuccagcaccaccccgacaagcaccgcgagcacaugugccucccccuccccuaccagaacauggacaagaccaagaccgacuacacccgcaucaagucccucuccaucaacgucaaccucggcaacaaggaggucauggacaccaccaagucccagguccgcgacuaccccaagcacaacggccagaucuccgacccccagcgcgaccagaaggucacccccgagcagaccacccagcacaccgucucccucaacgagcucuggaacaaguaccgcgagcgccagcgccagcagcgccagcccgagcucggcgaccgcaaggagcucucccucgucgaccgccucgaccgccucgccaagauccuccagaaccccaucacccacucccuccaggucuccgaguccacccacgacgacucccgcggcgagcgcuccgucaaggagugguccggccgccagcagcagcgcaacaagcuccagaagaagaagcgcuucaagucccucgagaagucccacaagaacaccggcgagcucaagaaguccaagguccucucccaccaccgcgccggccgcuccaaccagaucaagaucgagcagaucaaguucgacaaguacauccucuccaagcagcccggcuucaacuacaucuccaacaccuccuccgacugccgccccuccgaggaguccgagcuccucaccgacaccaccaccaacauccucuccggcaccaccuccaccgucgaguccgacauccucacccagaccgaccgcgaggucgcccuccacgagcgcuccuccuccgucuccaccaucgacaccgcccgccucauccaggccuucggccacgagcgcgucugccucuccccccgccgcaucaagcucuacuccuccaucaccaaccagcagcgccgcuaccucgagaagcgcuccaagcacuccaagaagguccucaacaccggccacccccucgucaccuccgagcacacccgccgccgccacauccaggucgccaaccacgucaucuccuccgacuccaucuccuccuccgccuccuccuuccucuccuccaacuccaccuucugcaacaagcagaacguccacaugcucaacaagggcauccaggccggcaaccucgagaucgucaacggcgccaagaagcacacccgcgacgucggcaucaccuuccccacccccuccuccuccgaggccaagcucgaggagaacuccgacgucaccuccugguccgaggagaagcgcgaggagaagaugcucuucaccggcuaccccgaggaccgcaagcucaagaagaacaagaagaacucccacgagggcgucuccugguucguccccgucgagaacgucgagucccgcuccaagaaggagaacguccccaacaccugcggccccggcaucuccugguucgagcccaucaccaagacccgccccuggcgcgagccccuccgcgagcagaacugccagggccagcaccucgacggccgcggcuaccucgccggccccggccgcgaggccggccgcgaccuccuccgccccuucguccgcgccacccuccaggagucccuccaguuccaccgccccgacuucaucucccgcuccggcgagcgcaucaagcgccucaagcucaucguccaggagcgcaagcuccaguccaugcuccagaccgagcgcgacgcccucuucaacaucgaccgcgagcgccagggccaccagaaccgcaugugcccccuccccaagcgcgucuuccucgccauccagaagaacaagcccaucuccaagaaggagaugauccagcgcuccaagcgcaucuacgagcagcuccccgagguccagaagaagcgcgaggaggagaagcgcaaguccgaguacaaguccuaccgccuccgcgcccagcucuacaagaagcgcgucaccaaccagcuccucggccgcaagguccccugggacuga

SEQ ID NO: 39635 - RNA, 2106 nt, Artificial Sequence
  derived and/or modified sequence opt2 from ALOX12B__Homo_sapiens__NP_001130
auggccaccuacaagguccgcgucgccaccggcaccgaccuccucuccggcacccgcgacuccaucucccucaccaucgucggcacccagggcgagucccacaagcagcuccucaaccacuucggccgcgacuucgccaccggcgccgucggccaguacaccguccagugcccccaggaccucggcgagcucaucaucauccgccuccacaaggagcgcuacgccuucuuccccaaggaccccugguacugcaacuacguccagaucugcgcccccaacggccgcaucuaccacuuccccgccuaccaguggauggacggcuacgagacccucgcccuccgcgaggccaccggcaagaccaccgccgacgacucccuccccguccuccucgagcaccgcaaggaggagauccgcgccaagcaggacuucuaccacuggcgcgucuuccuccccggccuccccuccuacguccacauccccuccuaccgcccccccguccgccgccaccgcaaccccaaccgccccgaguggaacggcuacauccccggcuuccccauccucaucaacuucaaggccaccaaguuccucaaccucaaccuccgcuacuccuuccucaagaccgccuccuucuucguccgccucggccccauggcccucgccuucaagguccgcggccuccucgacugcaagcacuccuggaagcgccucaaggacauccgcaagaucuuccccggcaagaaguccgucgucuccgaguacgucgccgagcacugggccgaggacaccuucuucggcuaccaguaccucaacggcgucaaccccggccucauccgccgcugcacccgcauccccgacaaguuccccgucaccgacgacauggucgcccccuuccucggcgagggcaccugccuccaggccgagcucgagaagggcaacaucuaccucgccgacuaccgcaucauggagggcauccccaccgucgagcucuccggccgcaagcagcaccacugcgccccccucugccuccuccacuucggccccgagggcaagaugaugcccaucgccauccagcucucccagacccccggccccgacugccccaucuuccuccccuccgacuccgagugggacuggcuccucgccaagaccuggguccgcuacgccgaguucuacucccacgaggccaucgcccaccuccucgagacccaccucaucgccgaggccuucugccucgcccuccuccgcaaccuccccaugugccacccccucuacaagcuccucaucccccacacccgcuacaccguccagaucaacuccaucggccgcgccguccuccucaacgagggcggccucuccgccaagggcaugucccucggcgucgagggcuucgccggcgucaugguccgcgcccucuccgagcucaccuacgacucccucuaccuccccaacgacuucgucgagcgcggcguccaggaccuccccggcuacuacuaccgcgacgacucccucgccgucuggaacgcccucgagaaguacgucaccgagaucaucaccuacuacuaccccuccgacgccgccgucgagggcgaccccgagcuccaguccuggguccaggagaucuucaaggagugccuccucggccgcgaguccuccggcuucccccgcugccuccgcaccguccccgagcucauccgcuacgucaccaucgucaucuacaccugcuccgccaagcacgccgccgucaacaccggccagauggaguucaccgccuggaugcccaacuuccccgccuccaugcgcaacccccccauccagaccaagggccucaccacccucgagaccuucauggacacccuccccgacgucaagaccaccugcaucacccuccucguccucuggacccucucccgcgagcccgacgaccgccgcccccucggccacuuccccgacauccacuucgucgaggaggccccccgccgcuccaucgaggccuuccgccagcgccucaaccagaucucccacgacauccgccagcgcaacaagugccuccccauccccuacuacuaccucgaccccguccucaucgagaacuccaucuccaucuga

SEQ ID NO: 39636 - RNA, 1992 nt, Artificial Sequence
  derived and/or modified sequence opt2 from ALOX12__Homo_sapiens__NP_000688
augggccgcuaccgcauccgcgucgccaccggcgccuggcucuucuccggcuccuacaaccgcguccagcucuggcucgucggcacccgcggcgaggccgagcucgagcuccagcuccgccccgcccgcggcgaggaggaggaguucgaccacgacgucgccgaggaccucggccuccuccaguucguccgccuccgcaagcaccacuggcucgucgacgacgccugguucugcgaccgcaucaccguccagggccccggcgccugcgccgaggucgccuuccccugcuaccgcuggguccagggcgaggacauccucucccuccccgagggcaccgcccgccuccccggcgacaacgcccucgacauguuccagaagcaccgcgagaaggagcucaaggaccgccagcagaucuacugcugggccaccuggaaggagggccucccccucaccaucgccgccgaccgcaaggacgaccucccccccaacaugcgcuuccacgaggagaagcgccucgacuucgaguggacccucaaggccggcgcccucgagauggcccucaagcgcgucuacacccuccucuccuccuggaacugccucgaggacuucgaccagaucuucuggggccagaaguccgcccucgccgagaagguccgccagugcuggcaggacgacgagcucuucuccuaccaguuccucaacggcgccaaccccaugcuccuccgccgcuccaccucccuccccucccgccucguccuccccuccggcauggaggagcuccaggcccagcucgagaaggagcuccagaacggcucccucuucgaggccgacuucauccuccucgacggcauccccgccaacgucauccgcggcgagaagcaguaccucgccgccccccucgucaugcucaagauggagcccaacggcaagcuccagcccauggucauccagauccagccccccaaccccuccucccccacccccacccucuuccuccccuccgaccccccccucgccuggcuccucgccaaguccuggguccgcaacuccgacuuccagcuccacgagauccaguaccaccuccucaacacccaccucgucgccgaggucaucgccgucgccaccaugcgcugccuccccggccuccaccccaucuucaaguuccucaucccccacauccgcuacaccauggagaucaacacccgcgcccgcacccagcucaucuccgacggcggcaucuucgacaaggccgucuccaccggcggcggcggccacguccagcuccuccgccgcgccgccgcccagcucaccuacugcucccucugcccccccgacgaccucgccgaccgcggccuccucggccuccccggcgcccucuacgcccacgacgcccuccgccucugggagaucaucgcccgcuacgucgagggcaucguccaccucuucuaccagcgcgacgacaucgucaagggcgaccccgagcuccaggccuggugccgcgagaucaccgaggucggccucugccaggcccaggaccgcggcuuccccgucuccuuccagucccagucccagcucugccacuuccucaccaugugcgucuucaccugcaccgcccagcacgccgccaucaaccagggccagcucgacugguacgccuggguccccaacgcccccugcaccaugcgcaugcccccccccaccaccaaggaggacgucaccauggccaccgucaugggcucccuccccgacguccgccaggccugccuccagauggccaucuccuggcaccucucccgccgccagcccgacauggucccccucggccaccacaaggagaaguacuucuccggccccaagcccaaggccguccucaaccaguuccgcaccgaccucgagaagcucgagaaggagaucaccgcccgcaacgagcagcucgacuggcccuacgaguaccucaagcccuccugcaucgagaacuccgucaccaucuga

SEQ ID NO: 39637 - RNA, 1944 nt, Artificial Sequence
  derived and/or modified sequence opt2 from ALOX15B__Homo_sapiens__NP_001034219
auggccgaguuccgcguccgcgucuccaccggcgaggccuucggcgccggcaccugggacaaggucuccgucuccaucgucggcacccgcggcgagucccccccccucccccucgacaaccucggcaaggaguucaccgccggcgccgaggaggacuuccaggucacccuccccgaggacgucggccgcguccuccuccuccgcguccacaaggccccccccguccucccccuccucggcccccucgcccccgacgccugguucugccgcugguuccagcucacccccccccgcggcggccaccuccucuuccccugcuaccaguggcucgagggcgccggcacccucguccuccaggagggcaccgccaaggucuccugggccgaccaccaccccguccuccagcagcagcgccaggaggagcuccaggcccgccaggagauguaccaguggaaggccuacaaccccggcuggccccacugccucgacgagaagaccgucgaggaccucgagcucaacaucaaguacuccaccgccaagaacgccaacuucuaccuccaggccggcuccgccuucgccgagaugaagaucaagggccuccucgaccgcaagggccucuggcgcucccucaacgagaugaagcgcaucuucaacuuccgccgcacccccgccgccgagcacgccuucgagcacuggcaggaggacgccuucuucgccucccaguuccucaacggccucaaccccguccucauccgccgcugccacuaccuccccaagaacuuccccgucaccgacgccauggucgccuccguccucggccccggcaccucccuccaggccgagcucgagaagggcucccucuuccucgucgaccacggcauccucuccggcauccagaccaacgucaucaacggcaagccccaguucuccgccgcccccaugacccuccucuaccagucccccggcugcggcccccuccucccccucgccauccagcucucccagacccccggccccaacucccccaucuuccuccccaccgacgacaagugggacuggcuccucgccaagaccuggguccgcaacgccgaguucuccuuccacgaggcccucacccaccuccuccacucccaccuccuccccgaggucuucacccucgccacccuccgccagcucccccacugccacccccucuucaaguccaccggcaucggcaucgagggcuucuccgagcucauccagcgcaacaugaagcagcucaacuacucccuccucugccuccccgaggacauccgcacccgcggcgucgaggacauccccggcuacuacuaccgcgacgacggcaugcagaucuggggcgccgucgagcgcuucgucuccgagaucaucggcaucuacuaccccuccgacgaguccguccaggacgaccgcgagcuccaggccuggguccgcgagaucuucuccaagggcuuccucaaccaggaguccuccggcauccccuccucccucgagacccgcgaggcccucguccaguacgucaccauggucaucuucaccugcuccgccaagcacgccgccgucuccgccggccaguucgacuccugcgccuggaugcccaaccucccccccuccaugcagcuccccccccccaccuccaagggccucgccaccugcgagggcuucaucgccacccucccccccgucaacgccaccugcgacgucauccucgcccucuggcuccucuccaaggagcccggcgaccagcgcccccucggcaccuaccccgacgagcacuucaccgaggaggccccccgccgcuccaucgccaccuuccagucccgccucgcccagaucucccgcggcauccaggagcgcaaccagggccucguccuccccuacaccuaccucgaccccccccucaucgagaacuccgucuccaucuga

SEQ ID NO: 39638 - RNA, 1989 nt, Artificial Sequence
  derived and/or modified sequence opt2 from ALOX15__Homo_sapiens__NP_001131
augggccucuaccgcauccgcgucuccaccggcgccucccucuacgccggcuccaacaaccagguccagcucuggcucgucggccagcacggcgaggccgcccucggcaagcgccucuggcccgcccgcggcaaggagaccgagcucaaggucgagguccccgaguaccucggcccccuccucuucgucaagcuccgcaagcgccaccuccucaaggacgacgccugguucugcaacuggaucuccguccagggccccggcgccggcgacgagguccgcuuccccugcuaccgcugggucgagggcaacggcguccucucccuccccgagggcaccggccgcaccgucggcgaggacccccagggccucuuccagaagcaccgcgaggaggagcucgaggagcgccgcaagcucuaccgcuggggcaacuggaaggacggccucauccucaacauggccggcgccaagcucuacgaccuccccgucgacgagcgcuuccucgaggacaagcgcgucgacuucgaggucucccucgccaagggccucgccgaccucgccaucaaggacucccucaacguccucaccugcuggaaggaccucgacgacuucaaccgcaucuucuggugcggccaguccaagcucgccgagcgcguccgcgacuccuggaaggaggacgcccucuucggcuaccaguuccucaacggcgccaaccccgucguccuccgccgcuccgcccaccuccccgcccgccucgucuucccccccggcauggaggagcuccaggcccagcucgagaaggagcucgagggcggcacccucuucgaggccgacuucucccuccucgacggcaucaaggccaacgucauccucugcucccagcagcaccucgccgccccccucgucaugcucaagcuccagcccgacggcaagcuccuccccauggucauccagcuccagcucccccgcaccggcucccccccccccccccucuuccuccccaccgacccccccauggccuggcuccucgccaagugcuggguccgcuccuccgacuuccagcuccacgagcuccagucccaccuccuccgcggccaccucauggccgaggucaucgucgucgccaccaugcgcugccuccccuccauccaccccaucuucaagcucaucaucccccaccuccgcuacacccucgagaucaacguccgcgcccgcaccggccucgucuccgacaugggcaucuucgaccagaucauguccaccggcggcggcggccacguccagcuccucaagcaggccggcgccuuccucaccuacuccuccuucugcccccccgacgaccucgccgaccgcggccuccucggcgucaaguccuccuucuacgcccaggacgcccuccgccucugggagaucaucuaccgcuacgucgagggcaucgucucccuccacuacaagaccgacgucgccgucaaggacgaccccgagcuccagaccuggugccgcgagaucaccgagaucggccuccagggcgcccaggaccgcggcuuccccgucucccuccaggcccgcgaccaggucugccacuucgucaccaugugcaucuucaccugcaccggccagcacgccuccguccaccucggccagcucgacugguacuccuggguccccaacgcccccugcaccaugcgccuccccccccccaccaccaaggacgccacccucgagaccgucauggccacccuccccaacuuccaccaggccucccuccagauguccaucaccuggcagcucggccgccgccagcccgucauggucgccgucggccagcacgaggaggaguacuucuccggccccgagcccaaggccguccucaagaaguuccgcgaggagcucgccgcccucgacaaggagaucgagauccgcaacgccaagcucgacaugcccuacgaguaccuccgccccuccgucgucgagaacuccgucgccaucuga

SEQ ID NO: 39639 - RNA, 657 nt, Artificial Sequence
  derived and/or modified sequence opt2 from ALOX5AP__Homo_sapiens__NP_001191335
augcucaccuucaaccacgacgcccccuggcacacccagaagacccucaagaccuccgaguucggcaaguccuucggcacccucggccacaucggcaacaucucccaccagugcugggccggcugcgccgccggcggccgcgccguccucuccggcgagcccgaggccaacauggaccaggagaccgucggcaacgucguccuccucgccaucgucacccucaucuccgucguccagaacggcuucuucgcccacaaggucgagcacgagucccgcacccagaacggccgcuccuuccagcgcaccggcacccucgccuucgagcgcgucuacaccgccaaccagaacugcgucgacgccuaccccaccuuccucgccguccucugguccgccggccuccucugcucccagguccccgccgccuucgccggccucauguaccucuucguccgccagaaguacuucgucggcuaccucggcgagcgcacccaguccacccccggcuacaucuucggcaagcgcaucauccucuuccucuuccucauguccgucgccggcaucuucaacuacuaccucaucuucuucuucggcuccgacuucgagaacuacaucaagaccaucuccaccaccaucuccccccuccuccucauccccuga

SEQ ID NO: 39640 - RNA, 2025 nt, Artificial Sequence
  derived and/or modified sequence opt2 from ALOX5__Homo_sapiens__NP_000689
augcccuccuacaccgucaccgucgccaccggcucccagugguucgccggcaccgacgacuacaucuaccucucccucgucggcuccgccggcugcuccgagaagcaccuccucgacaagcccuucuacaacgacuucgagcgcggcgccgucgacuccuacgacgucaccgucgacgaggagcucggcgagauccagcucguccgcaucgagaagcgcaaguacuggcucaacgacgacugguaccucaaguacaucacccucaagaccccccacggcgacuacaucgaguuccccugcuaccgcuggaucaccggcgacgucgaggucguccuccgcgacggccgcgccaagcucgcccgcgacgaccagauccacauccucaagcagcaccgccgcaaggagcucgagacccgccagaagcaguaccgcuggauggaguggaaccccggcuucccccucuccaucgacgccaagugccacaaggaccucccccgcgacauccaguucgacuccgagaagggcgucgacuucguccucaacuacuccaaggccauggagaaccucuucaucaaccgcuucaugcacauguuccaguccuccuggaacgacuucgccgacuucgagaagaucuucgucaagaucuccaacaccaucuccgagcgcgucaugaaccacuggcaggaggaccucauguucggcuaccaguuccucaacggcugcaaccccguccucauccgccgcugcaccgagcuccccgagaagcuccccgucaccaccgagauggucgagugcucccucgagcgccagcucucccucgagcaggagguccagcagggcaacaucuucaucgucgacuucgagcuccucgacggcaucgacgccaacaagaccgaccccugcacccuccaguuccucgccgcccccaucugccuccucuacaagaaccucgccaacaagaucguccccaucgccauccagcucaaccagauccccggcgacgagaaccccaucuuccuccccuccgacgccaaguacgacuggcuccucgccaagaucuggguccgcuccuccgacuuccacguccaccagaccaucacccaccuccuccgcacccaccucgucuccgaggucuucggcaucgccauguaccgccagcuccccgccguccaccccaucuucaagcuccucgucgcccacguccgcuucaccaucgccaucaacaccaaggcccgcgagcagcucaucugcgagugcggccucuucgacaaggccaacgccaccggcggcggcggccacguccagaugguccagcgcgccaugaaggaccucaccuacgccucccucugcuuccccgaggccaucaaggcccgcggcauggaguccaaggaggacauccccuacuacuucuaccgcgacgacggccuccucgucugggaggccauccgcaccuucaccgccgaggucgucgacaucuacuacgagggcgaccaggucgucgaggaggaccccgagcuccaggacuucgucaacgacgucuacgucuacggcaugcgcggccgcaaguccuccggcuuccccaaguccgucaagucccgcgagcagcucuccgaguaccucaccgucgucaucuucaccgccuccgcccagcacgccgccgucaacuucggccaguacgacuggugcuccuggauccccaacgccccccccaccaugcgcgcccccccccccaccgccaagggcgucgucaccaucgagcagaucgucgacacccuccccgaccgcggccgcuccugcuggcaccucggcgccgucugggcccucucccaguuccaggagaacgagcucuuccucggcauguaccccgaggagcacuucaucgagaagcccgucaaggaggccauggcccgcuuccgcaagaaccucgaggccaucgucuccgucaucgccgagcgcaacaagaagaagcagcuccccuacuacuaccucucccccgaccgcauccccaacuccgucgccaucuga

SEQ ID NO: 39641 - RNA, 2532 nt, Artificial Sequence
  derived and/or modified sequence opt2 from ALOXE3__Homo_sapiens__NP_001159432
augccccgcggcgccuuccgccccugccuccccgcccucuacuucgccuuccucaccugccccacccccgagcagcgcauguccggcacccaggcccccgacauccaccucggcgagcccgcccgcggcaccggcugcguccgcggcaagcagaccuccauccgcguccaggacugcggccgccgcgaggaggcccgcgccgccucccgcgagcuccgccgcgagaaggcccaggagcacccccgcgaguccugggcccacccccagcccuaccccgccccccagccccucgcccuccgccccgagacccagcccugccccgccugccgcuccuccccccccggccgccuccuccuccgccccgcccuccccggccaccccuuccuccuccccaucauggccgucuaccgccucugcgucaccaccggccccuaccuccgcgccggcacccucgacaacaucuccgucacccucgucggcaccugcggcgagucccccaagcagcgccucgaccgcaugggccgcgacuucgcccccggcuccguccagaaguacaagguccgcugcaccgccgagcucggcgagcuccuccuccuccgcguccacaaggagcgcuacgccuucuuccgcaaggacuccugguacugcucccgcaucugcgucaccgagcccgacggcuccgucucccacuuccccugcuaccaguggaucgagggcuacugcaccgucgagcuccgccccggcaccgcccgcaccaucugccaggacucccucccccuccuccucgaccaccgcacccgcgagcuccgcgcccgccaggagugcuaccgcuggaagaucuacgcccccggcuuccccugcauggucgacgucaacuccuuccaggagauggaguccgacaagaaguucgcccucaccaagaccaccaccugcgucgaccagggcgacuccuccggcaaccgcuaccuccccggcuuccccaugaagaucgacauccccucccucauguacauggagcccaacguccgcuacuccgccaccaagaccaucucccuccucuucaacgccauccccgccucccucggcaugaagcuccgcggccuccucgaccgcaagggcuccuggaagaagcucgacgacaugcagaacaucuucuggugccacaagaccuucaccaccaaguacgucaccgagcacuggugcgaggaccacuucuucggcuaccaguaccucaacggcgucaaccccgucaugcuccacugcaucuccucccuccccuccaagcuccccgucaccaacgacauggucgccccccuccucggccaggacaccugccuccagaccgagcucgagcgcggcaacaucuuccucgccgacuacuggauccucgccgaggcccccacccacugccucaacggccgccagcaguacgucgccgccccccucugccuccucuggcucuccccccagggcgcccucgucccccucgccauccagcucucccagacccccggccccgacucccccaucuuccuccccaccgacuccgagugggacuggcuccucgccaagaccuggguccgcaacuccgaguuccucguccacgagaacaacacccacuuccucugcacccaccuccucugcgaggccuucgccauggccacccuccgccagcucccccucugccaccccaucuacaagcuccuccucccccacacccgcuacacccuccaggucaacaccaucgcccgcgccacccuccucaaccccgagggccucgucgaccaggucaccuccaucggccgccagggccucaucuaccucauguccaccggccucgcccacuucaccuacaccaacuucugccuccccgacucccuccgcgcccgcggcguccucgccauccccaacuaccacuaccgcgacgacggccucaagaucugggccgccaucgaguccuucgucuccgagaucgucggcuacuacuaccccuccgacgccuccguccagcaggacuccgagcuccaggccuggaccggcgagaucuucgcccaggccuuccucggccgcgaguccuccggcuuccccucccgccucugcacccccggcgagauggucaaguuccucaccgccaucaucuucaacugcuccgcccagcacgccgccgucaacuccggccagcacgacuucggcgccuggaugcccaacgcccccuccuccaugcgccagccccccccccagaccaagggcaccaccacccucaagaccuaccucgacacccuccccgaggucaacaucuccugcaacaaccuccuccucuucuggcucgucucccaggagcccaaggaccagcgcccccucggcaccuaccccgacgagcacuucaccgaggaggccccccgccgcuccaucgccgccuuccagucccgccucgcccagaucucccgcgacauccaggagcgcaaccagggccucgcccuccccuacaccuaccucgaccccccccucaucgagaacuccgucuccaucuga

SEQ ID NO: 39642 - RNA, 1587 nt, Artificial Sequence
  derived and/or modified sequence opt2 from ALPI__Homo_sapiens__NP_001622
augcagggccccuggguccuccuccuccucggccuccgccuccagcucucccucggcgucauccccgccgaggaggagaaccccgccuucuggaaccgccaggccgccgaggcccucgacgccgccaagaagcuccagcccauccagaaggucgccaagaaccucauccucuuccucggcgacggccucggcguccccaccgucaccgccacccgcauccucaagggccagaagaacggcaagcucggccccgagaccccccucgccauggaccgcuuccccuaccucgcccucuccaagaccuacaacgucgaccgccagguccccgacuccgccgccaccgccaccgccuaccucugcggcgucaaggccaacuuccagaccaucggccucuccgccgccgcccgcuucaaccagugcaacaccacccgcggcaacgaggucaucuccgucaugaaccgcgccaagcaggccggcaaguccgucggcgucgucaccaccacccgcguccagcacgccucccccgccggcaccuacgcccacaccgucaaccgcaacugguacuccgacgccgacaugcccgccuccgcccgccaggagggcugccaggacaucgccacccagcucaucuccaacauggacaucgacgucauccucggcggcggccgcaaguacauguuccccaugggcacccccgaccccgaguaccccgccgacgccucccagaacggcauccgccucgacggcaagaaccucguccaggaguggcucgccaagcaccagggcgccugguacgucuggaaccgcaccgagcucaugcaggccucccucgaccaguccgucacccaccucaugggccucuucgagcccggcgacaccaaguacgagauccaccgcgaccccacccucgaccccucccucauggagaugaccgaggccgcccuccgccuccucucccgcaacccccgcggcuucuaccucuucgucgagggcggccgcaucgaccacggccaccacgagggcgucgccuaccaggcccucaccgaggccgucauguucgacgacgccaucgagcgcgccggccagcucaccuccgaggaggacacccucacccucgucaccgccgaccacucccacgucuucuccuucggcggcuacacccuccgcggcuccuccaucuucggccucgcccccuccaaggcccaggacuccaaggccuacaccuccauccucuacggcaacggccccggcuacgucuucaacuccggcguccgccccgacgucaacgaguccgaguccggcucccccgacuaccagcagcaggccgccgucccccucuccuccgagacccacggcggcgaggacgucgccgucuucgcccgcggcccccaggcccaccucguccacggcguccaggagcaguccuucgucgcccacgucauggccuucgccgccugccucgagcccuacaccgccugcgaccucgccccccccgccugcaccaccgacgccgcccaccccgucgccgccucccucccccuccucgccggcacccuccuccuccucggcgccuccgccgcccccuga

SEQ ID NO: 39643 - RNA, 3735 nt, Artificial Sequence
  derived and/or modified sequence opt2 from ALPK1__Homo_sapiens__NP_001095876
augaacaaccagaaggucgucgccguccuccuccaggagugcaagcagguccucgaccagcuccuccucgaggcccccgacgucuccgaggaggacaaguccgaggaccagcgcugccgcgcccuccuccccuccgagcuccgcacccucauccaggaggccaaggagaugaaguggcccuucguccccgagaaguggcaguacaagcaggccgucggccccgaggacaagaccaaccucaaggacgucaucggcgccggccuccagcagcuccucgccucccuccgcgccuccauccucgcccgcgacugcgccgccgccgccgccaucgucuuccucgucgaccgcuuccucuacggccucgacgucuccggcaagcuccuccaggucgccaagggccuccacaagcuccagcccgccacccccaucgccccccaggucgucauccgccaggcccgcaucuccgucaacuccggcaagcuccucaaggccgaguacauccucuccucccucaucuccaacaacggcgccaccggcaccuggcucuaccgcaacgaguccgacaagguccucguccaguccgucugcauccagauccgcggccagauccuccagaagcucggcaugugguacgaggccgccgagcucaucugggccuccaucgucggcuaccucgcccucccccagcccgacaagaagggccucuccaccucccucggcauccucgccgacaucuucgucuccauguccaagaacgacuacgagaaguucaagaacaacccccagaucaaccucucccuccucaaggaguucgaccaccaccuccucuccgccgccgaggccugcaagcucgccgccgccuucuccgccuacaccccccucuucguccucaccgccgucaacauccgcggcaccugccuccucuccuacuccuccuccaacgacugcccccccgagcucaagaaccuccaccucugcgaggccaaggaggccuucgagaucggccuccucaccaagcgcgacgacgagcccgucaccggcaagcaggagcuccacuccuucgucaaggccgccuucggccucaccaccguccaccgccgccuccacggcgagaccggcaccguccacgccgccucccagcucugcaaggaggccaugggcaagcucuacaacuucuccaccuccucccgcucccaggaccgcgaggcccucucccaggaggucauguccgucaucgcccaggucaaggagcaccuccagguccaguccuucuccaacgucgacgaccgcuccuacguccccgaguccuucgagugccgccucgacaagcucauccuccacggccagggcgacuuccagaagauccucgacaccuacucccagcaccacaccuccgucugcgaggucuucgaguccgacugcggcaacaacaagaacgagcagaaggacgccaagaccggcgucugcaucaccgcccucaagaccgagaucaagaacaucgacaccgucuccaccacccaggagaagccccacugccagcgcgacaccggcaucuccuccucccucaugggcaagaacguccagcgcgagcuccgccgcggcggccgccgcaacuggacccacuccgacgccuuccgcgucucccucgaccaggacgucgagaccgagaccgagcccuccgacuacuccaacggcgagggcgccgucuucaacaagucccucuccggcucccagaccuccuccgccugguccaaccucuccggcuucuccuccuccgccuccugggaggaggucaacuaccacgucgacgaccgcuccgcccgcaaggagcccggcaaggagcaccucgucgacacccagugcuccaccgcccucuccgaggagcucgagaacgaccgcgagggccgcgccaugcacucccuccacucccagcuccacgaccucucccuccaggagcccaacaacgacaaccucgagcccucccagaaccagccccagcagcagaugccccucacccccuucuccccccacaacacccccggcaucuuccucgcccccggcgccggccuccucgagggcgcccccgagggcauccaggagguccgcaacaugggcccccgcaacaccuccgcccacucccgccccuccuaccgcuccgccuccugguccuccgacuccggccgccccaagaacaugggcacccaccccuccguccagaaggaggaggccuucgagaucaucgucgaguuccccgagaccaacugcgacgucaaggaccgccagggcaaggagcagggcgaggagaucuccgagcgcggcgccggccccaccuucaaggccucccccuccugggucgaccccgagggcgagaccgccgaguccaccgaggacgccccccucgacuuccaccgcguccuccacaacucccucggcaacaucuccaugcuccccugcuccuccuucacccccaacuggcccguccagaaccccgacucccgcaaguccggcggccccgucgccgagcagggcaucgaccccgacgccuccaccgucgacgaggagggccagcuccucgacuccauggacguccccugcaccaacggccacggcucccaccgccucugcauccuccgccagccccccggccagcgcgccgagacccccaacuccuccgucuccggcaacauccucuuccccguccucuccgaggacugcaccaccaccgaggagggcaaccagcccggcaacaugcucaacugcucccagaacuccuccuccuccuccgucugguggcucaagucccccgccuucuccuccggcuccuccgagggcgacucccccugguccuaccucaacuccuccggcuccuccugggucucccuccccggcaagaugcgcaaggagauccucgaggcccgcacccuccagcccgacgacuucgagaagcuccucgccggcguccgccacgacuggcucuuccagcgccucgagaacaccggcgucuucaagcccucccagcuccaccgcgcccacuccgcccuccuccucaaguacuccaagaaguccgagcucuggaccgcccaggagaccaucgucuaccucggcgacuaccucaccgucaagaagaagggccgccagcgcaacgccuucuggguccaccaccuccaccaggaggagauccucggccgcuacgucggcaaggacuacaaggagcagaagggccucuggcaccacuucaccgacgucgagcgccagaugaccgcccagcacuacgucaccgaguucaacaagcgccucuacgagcagaacauccccacccagaucuucuacauccccuccaccauccuccucauccucgaggacaagaccaucaagggcugcaucuccgucgagcccuacauccucggcgaguucgucaagcucuccaacaacaccaaggucgucaagaccgaguacaaggccaccgaguacggccucgccuacggccacuucuccuacgaguucuccaaccaccgcgacgucgucgucgaccuccagggcugggucaccggcaacggcaagggccucaucuaccucaccgacccccagauccacuccgucgaccagaaggucuucaccaccaacuucggcaagcgcggcaucuucuacuucuucaacaaccagcacgucgagugcaacgagaucugccaccgccucucccucacccgccccuccauggagaagcccugcaccuga

SEQ ID NO: 39644 - RNA, 6513 nt, Artificial Sequence
  derived and/or modified sequence opt2 from ALPK2__Homo_sapiens__NP_443179
augaaggacuccgagggcccccagcgccccccccucugcuuccucuccacccuccucucccagaagguccccgagaaguccgacgccguccuccgcugcaucaucuccggccagcccaagcccgaggucaccugguacaagaacggccaggccaucgacggcuccggcaucaucuccaacuacgaguucuucgagaaccaguacauccacguccuccaccucuccugcugcaccaagaacgacgccgccgucuaccagaucuccgccaagaacuccuucggcaugaucugcugcuccgccuccgucgaggucgagugcuccuccgagaacccccagcucucccccaaccucgaggacgaccgcgaccgcggcuggaagcacgagaccggcacccacgaggaggagcgcgccaaccagaucgacgagaaggagcaccccuacaaggaggaggaguccaucucccccggcaccccccgcuccgccgacuccucccccuccaaguccaaccacucccucucccuccagucccucggcaaccucgacaucuccgucuccuccuccgagaacccccucggcgucaagggcacccgccacaccggcgaggccuacgaccccuccaacaccgaggagaucgccaacggccuccucuuccucaacuccucccacaucuacgagaagcaggaccgcugcugccacaagaccguccacuccauggccuccaaguucaccgacggcgaccucaacaacgacggcccccacgacgagggccuccgcuccucccagcagaaccccaagguccagaaguacaucuccuucucccucccccucuccgaggccaccgcccacaucuaccccggcgacuccgccgucgccaacaagcagcccuccccccagcucuccuccgaggacuccgacuccgacuacgagcucugccccgagaucacccucaccuacaccgaggaguucuccgacgacgaccucgaguaccucgagugcuccgacgucaugaccgacuacuccaacgccgucuggcagcgcaaccuccucggcaccgagcacgucuuccuccucgaguccgacgacgaggagauggaguucggcgagcacugccucggcggcugcgagcacuuccucuccggcaugggcugcggcucccgcgucuccggcgacgccggccccauggucgccaccgccggcuucugcggccaccacucccagccccaggaggucggcguccgcuccucccgcgucuccaagcacggccccuccuccccccagaccggcaugacccucauccucggcccccaccaggacggcaccuccuccgucaccgagcagggccgcuacaagcuccccaccgcccccgaggccgccgagaacgacuaccccggcauccagggcgagacccgcgacucccaccaggcccgcgaggaguucgccuccgacaaccuccucaacauggacgaguccguccgcgagaccgagaugaagcuccucuccggcgaguccgagaacuccggcaugucccagugcugggagaccgccgccgacaagcgcgucggcggcaaggaccucugguccaagcgcggcucccgcaaguccgcccgcguccgccagcccggcaugaagggcaaccccaagaagcccaacgccaaccuccgcgaguccaccaccgagggcacccuccaccucugcuccgccaaggaguccgccgagcccccccucacccaguccgacaagcgcgagaccucccacaccaccgccgccgccaccggccgcuccucccacgccgacgcccgcgagugcgccaucuccacccaggccgagcaggaggccaagacccuccagaccuccaccgacuccgucuccaaggagggcaacaccaacugcaagggcgagggcaugcaggucaacacccucuucgagaccucccagguccccgacugguccgaccccccccagguccagguccaggagaccguccgcgagaccaucuccugcucccagaugcccgccuucuccgagcccgccggcgaggagucccccuucaccggcaccaccaccaucuccuucuccaaccucggcggcguccacaaggagaacgccucccucgcccagcacuccgaggucaagcccugcaccugcggcccccagcacgaggagaagcaggaccgcgacggcaacauccccgacaacuuccgcgaggaccucaaguacgagcaguccaucuccgaggccaacgacgagaccaugucccccggcgucuucucccgccaccuccccaaggacgcccgcgccgacuuccgcgagcccgucgccgucuccgucgccucccccgagcccaccgacaccgcccucacccucgagaacgucugcgacgagccccgcgaccgcgaggccgucugcgccauggagugcuucgaggccggcgaccagggcaccugcuucgacaccaucgacucccucgucggccgccccgucgacaaguacuccccccaggagaucugcuccgucgacaccgagcucgccgagggccagaacaaggucuccgaccucugcuccuccaacgacaagacccucgaggucuucuuccagacccaggucuccgagaccuccgucuccaccugcaaguccuccaaggacggcaacuccgucauguccccccucuucaccuccaccuucacccucaacaucucccacaccgccuccgagggcgccaccggcgagaaccucgccaaggucgagaacuccaccuacccccucgccuccaccguccacgccggccaggagcagcccucccccuccaacuccggcggccucgacgagacccagcuccucuccuccgagaacaacccccucguccaguucaaggagggcggcgacaagucccccucccccuccgccgccgacaccaccgccacccccgccuccuacuccuccaucgucuccuuccccugggagaagcccaccacccucaccgccaacaacgagugcuuccaggccacccgcgagaccgaggacaccuccaccgucaccaucgccaccgagguccaccccgccaaguaccucgccgucuccauccccgaggacaagcacgccggcggcaccgaggagcgcuucccccgcgccucccacgagaaggucucccaguuccccucccagguccagcucgaccacauccucuccggcgccaccaucaaguccaccaaggagcuccucugccgcgcccccuccguccccggcgucccccaccacguccuccagcuccccgagggcgagggcuucugcuccaacuccccccuccaggucgacaaccucuccggcgacaagucccagaccgucgaccgcgccgacuuccgcuccuacgaggagaacuuccaggagcgcggcuccgagaccaagcagggcguccagcagcagucccucucccagcagggcucccucuccgcccccgacuuccagcagucccuccccaccaccuccgccgcccaggaggagcgcaaccucguccccaccgcccacucccccgccuccucccgcgagggcgccggccagcgcuccggcuggggcacccgcgucuccgucgucgccgagaccgccggcgaggaggacucccaggcccucuccaacguccccucccucuccgacauccuccucgaggaguccaaggaguaccgccccggcaacugggaggccggcaacaagcucaagaucaucacccucgaggccuccgccuccgagaucuggcccccccgccagcucaccaacuccgaguccaaggccuccgacggcggccucaucauccccgacaaggucugggccguccccgacucccucaaggccgacgccgucguccccgagcucgcccccuccgagaucgccgcccucgcccacucccccgaggacgccgaguccgcccucgccgacucccgcgagucccacaagggcgaggagcccaccaucuccguccacuggcgcucccucuccucccgcggcuucucccagccccgccuccucgaguccuccgucgaccccgucgacgagaaggagcucuccgucaccgacucccucuccgccgccuccgagaccggcggcaaggagaacgucaacaacgucucccaggaccaggaggagaagcagcucaagauggaccacaccgccuucuucaagaaguuccucaccugccccaagauccucgaguccuccgucgaccccaucgacgagaucuccgucaucgaguacacccgcgccggcaagcccgagcccuccgagaccaccccccagggcgcccgcgagggcggccaguccaacgacggcaacaugggccacgaggccgagauccagcccgccauccuccagguccccugccuccagggcaccauccucuccgagaaccgcaucucccgcucccaggagggcuccaugaagcaggaggccgagcagauccagcccgaggaggccaagaccgccaucuggcagguccuccagcccuccgagggcggcgagcgcauccccuccggcugcuccaucggccagauccaggaguccuccgacggcucccucggcgaggccgagcaguccaagaaggacaaggccgagcucaucucccccaccuccccccucuccuccugccuccccaucaugacccacgccucccucggcgucgacacccacaacuccaccggccagauccacgacguccccgagaacgacaucgucgagccccgcaagcgccaguacgucuuccccgucucccagaagcgcggcaccaucgagaacgagcgcggcaagccccuccccuccucccccgaccucacccgcuuccccugcaccuccucccccgagggcaacgucaccgacuuccucaucucccacaagauggaggagcccaagaucgagguccuccagaucggcgagaccaagccccccuccuccuccuccuccuccgccaagacccucgccuucaucuccggcgagcgcgagcucgagaaggcccccaagcuccuccaggaccccugccagaagggcacccucggcugcgccaagaagucccgcgagcgcgagaagucccucgaggcccgcgccggcaagucccccggcacccucaccgccgucaccggcuccgaggaggucaagcgcaagcccgaggcccccggcuccggccaccucgccgagggcgucaagaagaagauccucucccgcgucgccgcccuccgccucaagcucgaggagaaggagaacauccgcaagaacuccgccuuccucaagaagaugcccaagcucgagaccucccucucccacaccgaggagaagcaggaccccaagaagcccuccugcaagcgcgagggccgcgcccccguccuccucaagaagauccaggccgagauguuccccgagcacuccggcaacgucaagcucuccugccaguucgccgagauccacgaggacuccaccaucugcuggaccaaggacuccaaguccaucgcccagguccagcgcuccgccggcgacaacuccaccgucuccuucgccaucguccaggccucccccaaggaccagggccucuacuacugcugcaucaagaacuccuacggcaaggucaccgccgaguucaaccucaccgccgagguccucaagcagcucuccucccgccaggacaccaagggcugcgaggagaucgaguucucccagcucaucuucaaggaggacuuccuccacgacuccuacuucggcggccgccuccgcggccagaucgccaccgaggagcuccacuucggcgagggcguccaccgcaaggccuuccgcuccaccgucaugcacggccucaugcccgucuucaagcccggccacgccugcguccucaagguccacaacgccaucgccuacggcacccgcaacaacgacgagcucauccagcgcaacuacaagcucgccgcccaggagugcuacguccagaacaccgcccgcuacuacgccaagaucuacgccgccgaggcccagccccucgagggcuucggcgagguccccgagaucauccccaucuuccucauccaccgccccgagaacaacauccccuacgccaccgucgaggaggagcucaucggcgaguucgucaaguacuccauccgcgacggcaaggagaucaacuuccuccgccgcgaguccgaggccggccagaagugcugcaccuuccagcacugggucuaccagaagaccuccggcugccuccucgucaccgacaugcagggcgucggcaugaagcucaccgacgucggcaucgccacccucgccaagggcuacaagggcuucaagggcaacugcuccaugaccuucaucgaccaguucaaggcccuccaccagugcaacaaguacugcaagaugcucggccucaagucccuccagaacaacaaccagaagcagaagcagcccuccaucggcaaguccaagguccagaccaacuccaugaccaucaagaaggccggccccgagacccccggcgagaagaagaccuga

SEQ ID NO: 39645 - RNA, 5724 nt, Artificial Sequence
  derived and/or modified sequence opt2 from ALPK3__Homo_sapiens__NP_065829
auggaggucgccuggcucgucuacguccucggccagcagccccucgcccgccagggcgagggccagucccgccucguccccggccgcggccucguccucuggcuccccggccucccccgcuccucccccuccuggcccgccgucgaccucgccccccucgcccccgcccgcccccgcggcccccucaucugccacaccggccacgagcaggccggccgcgagcccggccccggcuccuccaccaagggccccguccuccacgaccaggacacccgcugcgccuuccucccccgcccccccggcccccuccagacccgccgcuacugccgccaccagggccgccagggcuccggccucggcgccggccccggcgccggcaccugggcccccgccccccccggcgucuccaagccccgcugccccggccgcgcccgccccggcgagggccagcagcaggucaccaccgcccgcccccccgccaucaaccgcggcgcccgccagccccgcgccggcgccgccgccgccggccgcggccccggcgccggcgccuggcgcaccggcgaggccgccgccuccgccggccccgccgucggcgagggcggcgccaugggcucccgccgcgcccccucccgcggcuggggcgccggcggccgcuccggcgccggcggcgacggcgaggacgacggccccgucuggauccccucccccgccucccgcuccuaccuccucuccguccgccccgagaccucccucuccuccaaccgccucucccaccccuccuccggccgcuccaccuucugcuccaucaucgcccagcucaccgaggagacccagccccucuucgagaccacccucaagucccgcuccgucuccgaggacuccgacguccgcuucaccugcaucgucaccggcuaccccgagcccgaggucaccugguacaaggacgacaccgagcucgaccgcuacugcggccuccccaaguacgagaucacccaccagggcaaccgccacacccuccagcucuaccgcugccgcgaggaggacgccgccaucuaccaggccuccgcccagaacuccaagggcaucgucuccugcuccggcguccucgaggucggcaccaugaccgaguacaagauccaccagcgcugguucgccaagcucaagcgcaaggccgccgccaagcuccgcgagaucgagcaguccuggaagcacgagaaggccguccccggcgaggucgacacccuccgcaagcucucccccgaccgcuuccagcgcaagcgccgccucuccggcgcccaggcccccggccccuccguccccacccgcgagcccgagggcggcacccucgccgccuggcaggagggcgagaccgagaccgcccagcacuccggccucggccucaucaacuccuucgccuccggcgaggucaccaccaacggcgaggccgcccccgagaacggcgaggacggcgagcacggccuccucaccuacaucugcgacgccauggagcucggcccccagcgcgcccucaaggaggaguccggcgccaagaagaagaagaaggacgaggaguccaagcagggccuccgcaagcccgagcucgagaaggccgcccagucccgccgcuccuccgagaacugcauccccuccuccgacgagcccgacuccugcggcacccagggccccgucggcgucgagcagguccagacccagccccgcggccgcgccgcccgcggccccggcuccuccggcaccgacuccacccgcaagcccgccuccgccgucggcacccccgacaaggcccagaaggcccccggccccggccccggccaggaggucuacuucucccucaaggacauguaccucgagaacacccaggccguccgcccccucggcgaggagggcccccagacccucuccguccgcgcccccggcgagucccccaagggcaaggccccccuccgcgcccgcuccgagggcguccccggcgcccccggccagcccacccacucccucaccccccagcccacccgccccuucaaccgcaagcgcuucgccccccccaagcccaagggcgaggccaccaccgacuccaagcccaucuccucccucucccaggcccccgagugcggcgcccagucccucggcaaggcccccccccaggccuccguccagguccccaccccccccgcccgccgccgccacggcacccgcgacuccacccuccagggccaggccggccaccgcacccccggcgagguccucgagugccagaccaccaccgcccccaccauguccgccuccuccuccuccgacgucgccuccaucggcgucuccaccuccggcucccagggcaucaucgagcccauggacauggagacccaggaggacggccgcaccuccgccaaccagcgcaccggcuccaagaagaacguccaggccgacggcaagauccaggucgacggccgcacccgcggcgacggcacccagaccgcccagcgcacccgcgccgaccgcaagacccaggucgacgccggcacccaggaguccaagcgcccccaguccgaccgcuccgcccagaagggcaugaugacccagggccgcgccgagacccagcucgagaccacccaggccggcgagaagauccaggaggaccgcaaggcccaggccgacaagggcacccaggaggaccgccgcaugcagggcgagaagggcaugcagggcgagaagggcacccaguccgagggcuccgcccccaccgccauggagggccaguccgagcaggaggucgccaccucccucggcccccccucccgcacccccaagcucccccccaccgccggcccccgcgccccccucaacaucgagugcuucguccagacccccgagggcuccugcuuccccaagaagcccggcugccucccccgcuccgaggaggccgucgucaccgccucccgcaaccacgagcagaccguccucggcccccucuccggcaaccucaugcuccccgcccagcccccccacgagggcuccgucgagcaggucggcggcgagcgcugccgcggcccccaguccuccggccccgucgaggccaagcaggaggacucccccuuccagugccccaaggaggagcgccccggcggcguccccugcauggaccagggcggcugcccccucgccggccucucccaggagguccccaccaugcccucccuccccggcaccggccucaccgccucccccaaggccggccccugcuccacccccaccucccagcacggcuccaccgccaccuuccuccccuccgaggaccagguccucauguccuccgcccccacccuccaccucggccucggcacccccacccagucccacccccccgagaccauggccaccuccuccgagggcgccugcgcccagguccccgacgucgagggccgcacccccggcccccgcuccugcgaccccggccucaucgacucccucaagaacuaccuccuccuccuccucaagcucuccuccaccgagaccuccggcgccggcggcgagucccaggucggcgccgccaccggcggccucguccccuccgccacccucacccccaccgucgaggucgccggccucuccccccgcaccucccgccgcauccucgagcgcgucgagaacaaccaccucguccaguccgcccagacccuccuccucucccccugcaccucccgccgccucaccggccuccucgaccgcgagguccaggccggccgccaggcccucgccgccgcccgcggcuccuggggccccggccccuccucccucaccguccccgccaucgucgucgacgaggaggaccccggccucgccuccgagggcgccuccgagggcgagggcgaggucucccccgagggccccggccuccucggcgccucccaggaguccuccauggccggccgccucggcgaggccggcggccaggccgcccccggccagggccccuccgccgaguccaucgcccaggagcccucccaggaggagaaguuccccggcgaggcccucaccggccuccccgccgccacccccgaggagcucgcccucggcgcccgccgcaagcgcuuccuccccaagguccgcgccgccggcgacggcgaggccaccacccccgaggagcgcgagucccccaccgucuccccccgcggcccccgcaagucccucguccccggcucccccggcacccccggccgcgagcgccgcucccccacccagggccgcaaggccuccaugcucgaggucccccgcgccgaggaggagcucgccgccggcgaccucggccccucccccaaggccggcggccucgacaccgaggucgcccucgacgagggcaagcaggagacccucgccaagccccgcaaggccaaggaccuccucaaggccccccaggucauccgcaagauccgcgucgagcaguuccccgacgccuccggcucccucaagcucuggugccaguucuucaacauccucuccgacuccguccucaccugggccaaggaccagcgccccgucggcgaggucggccgcuccgccggcgacgagggccccgccgcccucgccaucguccaggccucccccgucgacugcggcgucuaccgcugcaccauccacaacgagcacggcuccgccuccaccgacuucugccucucccccgagguccucuccggcuucaucucccgcgaggagggcgaggucggcgaggagaucgagaugacccccauggucuucgccaagggccucgccgacuccggcugcuggggcgacaagcucuucggccgccucgucuccgaggagcuccgcggcggcggcuacggcugcggccuccgcaaggccucccaggccaaggucaucuacggccucgagcccaucuucgaguccggccgcaccugcaucaucaaggucuccucccuccucgucuucggccccuccuccgagaccucccucgucggccgcaacuacgacgucaccauccagggcugcaagauccagaacaugucccgcgaguacugcaagaucuucgccgccgaggcccgcgccgcccccggcuucggcgagguccccgagaucaucccccucuaccucaucuaccgccccgccaacaacauccccuacgccacccucgaggaggaccucggcaagccccucgaguccuacugcucccgcgaguggggcugcgccgaggcccccaccgccuccggcuccuccgaggccaugcagaagugccagaccuuccagcacuggcucuaccaguggaccaacggcuccuuccucgucaccgaccucgccggcgucgacuggaagaugaccgacguccagaucgccaccaagcuccgcggcuaccagggccucaaggaguccugcuuccccgcccuccucgaccgcuucgccuccucccaccagugcaacgccuacugcgagcuccucggccucaccccccucaagggccccgaggccgcccacccccaggccaaggccaagggcuccaagucccccuccgccggccgcaagggcucccagcucuccccccagccccagaagaagggccuccccuccccccagggcacccgcaaguccgcccccuccuccaaggccaccccccaggccuccgagcccgucaccacccagcuccucggccagccccccacccaggaggagggcuccaaggcccagggcaugcgcuga

SEQ ID NO: 39646 - RNA, 1608 nt, Artificial Sequence
  derived and/or modified sequence opt2 from ALPP__Homo_sapiens__NP_001623
augcucggccccugcaugcuccuccuccuccuccuccucggccuccgccuccagcucucccucggcaucauccccgucgaggaggagaaccccgacuucuggaaccgcgaggccgccgaggcccucggcgccgccaagaagcuccagcccgcccagaccgccgccaagaaccucaucaucuuccucggcgacggcaugggcgucuccaccgucaccgccgcccgcauccucaagggccagaagaaggacaagcucggccccgagaucccccucgccauggaccgcuuccccuacgucgcccucuccaagaccuacaacgucgacaagcacguccccgacuccggcgccaccgccaccgccuaccucugcggcgucaagggcaacuuccagaccaucggccucuccgccgccgcccgcuucaaccagugcaacaccacccgcggcaacgaggucaucuccgucaugaaccgcgccaagaaggccggcaaguccgucggcgucgucaccaccacccgcguccagcacgccucccccgccggcaccuacgcccacaccgucaaccgcaacugguacuccgacgccgacguccccgccuccgcccgccaggagggcugccaggacaucgccacccagcucaucuccaacauggacaucgacgucauccucggcggcggccgcaaguacauguuccgcaugggcacccccgaccccgaguaccccgacgacuacucccagggcggcacccgccucgacggcaagaaccucguccaggaguggcucgccaagcgccagggcgcccgcuacgucuggaaccgcaccgagcucaugcaggccucccucgaccccuccgucacccaccucaugggccucuucgagcccggcgacaugaaguacgagauccaccgcgacuccacccucgaccccucccucauggagaugaccgaggccgcccuccgccuccucucccgcaacccccgcggcuucuuccucuucgucgagggcggccgcaucgaccacggccaccacgagucccgcgccuaccgcgcccucaccgagaccaucauguucgacgacgccaucgagcgcgccggccagcucaccuccgaggaggacacccucucccucgucaccgccgaccacucccacgucuucuccuucggcggcuacccccuccgcggcuccuccaucuucggccucgcccccggcaaggcccgcgaccgcaaggccuacaccguccuccucuacggcaacggccccggcuacguccucaaggacggcgcccgccccgacgucaccgaguccgaguccggcucccccgaguaccgccagcaguccgccgucccccucgacgaggagacccacgccggcgaggacgucgccgucuucgcccgcggcccccaggcccaccucguccacggcguccaggagcagaccuucaucgcccacgucauggccuucgccgccugccucgagcccuacaccgccugcgaccucgccccccccgccggcaccaccgacgccgcccaccccggccgcuccgucguccccgcccuccucccccuccucgccggcacccuccuccuccucgagaccgccaccgcccccuga

SEQ ID NO: 39647 - RNA, 1599 nt, Artificial Sequence
  derived and/or modified sequence opt2 from ALPPL2__Homo_sapiens__NP_112603
augcagggccccuggguccuccuccuccucggccuccgccuccagcucucccucggcaucauccccgucgaggaggagaaccccgacuucuggaaccgccaggccgccgaggcccucggcgccgccaagaagcuccagcccgcccagaccgccgccaagaaccucaucaucuuccucggcgacggcaugggcgucuccaccgucaccgccgcccgcauccucaagggccagaagaaggacaagcucggccccgagaccuuccucgccauggaccgcuuccccuacgucgcccucuccaagaccuacuccgucgacaagcacguccccgacuccggcgccaccgccaccgccuaccucugcggcgucaagggcaacuuccagaccaucggccucuccgccgccgcccgcuucaaccagugcaacaccacccgcggcaacgaggucaucuccgucaugaaccgcgccaagaaggccggcaaguccgucggcgucgucaccaccacccgcguccagcacgccucccccgccggcgccuacgcccacaccgucaaccgcaacugguacuccgacgccgacguccccgccuccgcccgccaggagggcugccaggacaucgccacccagcucaucuccaacauggacaucgacgucauccucggcggcggccgcaaguacauguuccccaugggcacccccgaccccgaguaccccgacgacuacucccagggcggcacccgccucgacggcaagaaccucguccaggaguggcucgccaagcaccagggcgcccgcuacgucuggaaccgcaccgagcuccuccaggccucccucgaccccuccgucacccaccucaugggccucuucgagcccggcgacaugaaguacgagauccaccgcgacuccacccucgaccccucccucauggagaugaccgaggccgcccuccuccuccucucccgcaacccccgcggcuucuuccucuucgucgagggcggccgcaucgaccacggccaccacgagucccgcgccuaccgcgcccucaccgagaccaucauguucgacgacgccaucgagcgcgccggccagcucaccuccgaggaggacacccucucccucgucaccgccgaccacucccacgucuucuccuucggcggcuacccccuccgcggcuccuccaucuucggccucgcccccggcaaggcccgcgaccgcaaggccuacaccguccuccucuacggcaacggccccggcuacguccucaaggacggcgcccgccccgacgucaccgaguccgaguccggcucccccgaguaccgccagcaguccgccgucccccucgacggcgagacccacgccggcgaggacgucgccgucuucgcccgcggcccccaggcccaccucguccacggcguccaggagcagaccuucaucgcccacgucauggccuucgccgccugccucgagcccuacaccgccugcgaccucgccccccgcgccggcaccaccgacgccgcccaccccggccccuccgucguccccgcccuccucccccuccucgccggcacccuccuccuccucggcaccgccaccgcccccuga

SEQ ID NO: 39648 - RNA, 2862 nt, Artificial Sequence
  derived and/or modified sequence opt2 from ALS2CL__Homo_sapiens__NP_001177636
augugcaaccccgaggaggccgcccuccuccgccucgaggaggucuucuccgccacccucgcccacgucaacucccucguccuccagccccuccuccccgccgcccccgaccccuccgaccccuggggccgcgagugccuccgccuccuccagcagcuccacaaguccucccagcagcucugggaggucaccgaggagucccuccacucccuccaggagcgccuccgcuaccccgacuccaccggccucgagucccuccuccuccuccgcggcgccgaccgcguccuccaggcccacaucgaguacaucgaguccuacaccuccugcauggucguccaggccuuccagaaggccgccaagcgccgcuccgaguacuggcgcggccagcgcaaggcccuccgccagcuccucuccggcgucuccuccgagggcuccgucggcgccucccucggccaggcccuccaccagccccucgcccaccacguccagcaguacguccuccuccuccucucccucggcgacaccaucggcgagcaccaccccacccgcgagcucgucgucaacgccgucacccucuucggcaaccuccaguccuucaugaagcaggagcucgaccaggccgucgccacccaggcccucuggcacacccuccgcggccgccuccgcgacguccucugcacccccgcccaccgccuccuccaggacucccaggacguccccgucaccgucgccccccuccgcgccgagcgcguccuccucuucgacgacgcccucguccuccuccagggccacaacguccacaccuucgaccucaagcucgucugggucgaccccggccaggacggcugcaccuuccaccuccucacccccgaggaggaguucuccuucugcgccaaggacucccagggccaggccgucuggcaguggaaggucaccugggccguccaccaggcccuccacggcaagaaggacuuccccguccucggcgccggccucgagcccucccagccccccgacugccgcugcgccgaguacaccuuccaggccgagggccgccucugccaggccaccuacgagggcgaguggugccgcggccgcccccacggcaagggcacccucaaguggcccgacggccgcaaccacgucggcaacuucugccagggccucgagcacggcuucggcauccgccuccucccccaggccuccgaggacaaguucgacugcuacaagugccacuggcgcgagggcuccaugugcggcuacggcaucugcgaguacuccaccgacgaggucuacaagggcuacuuccaggagggccuccgccacggcuucggcguccucgaguccggcccccaggccccccagcccuuccgcuacaccggccacugggagcgcggccagcgcuccggcuacggcaucgaggaggacggcgaccgcggcgagcgcuacaucggcauguggcaggccggccagcgccacggccccggcgucauggucacccaggccggcgucugcuaccagggcaccuuccaggccgacaagaccgucggccccggcauccuccucuccgaggacgacucccucuacgagggcaccuucacccgcgaccucacccucaugggcaagggcaaggucaccuuccccaacggcuucacccucgagggcuccuucggcuccggcgccggccgcggccuccacacccagggcguccucgacaccgccgcccucccccccgaccccuccuccaccugcaagcgccagcucggcgucggcgccuuccccgucgagucccgcuggcagggcgucuacucccccuuccgcgacuucgucugcgccggcugcccccgcgaccuccaggaggcccuccucggcuucgacguccaguccucccgcgagcuccgccgcucccaggacuaccucuccugcgagcgcacccaccccgaggacuccgucggcuccauggaggacauccucgaggagcuccuccagcaccgcgagcccaaggcccuccagcucuaccuccgcaaggcccucuccaacucccuccacccccucggcaagcuccuccgcacccucaugcucaccuuccaggccaccuacgccggcgucggcgccaacaagcaccuccaggagcucgcccaggaggaggucaagcagcacgcccaggagcucugggccgccuaccgcggccuccuccgcgucgcccucgagcgcaagggccaggcccucgaggaggacgaggacaccgagacccgcgaccuccagguccacggccucguccucccccucaugcuccccuccuucuacuccgagcucuucacccucuaccuccuccuccacgagcgcgaggacuccuucuacucccagggcaucgccaaccucucccucuuccccgacacccagcuccucgaguuccucgacguccagaagcaccucuggccccucaaggaccucacccucaccuccaaccagcgcuacucccucguccgcgacaagugcuuccucuccgccaccgagugccuccagaagaucaugaccaccgucgacccccgcgagaagcucgagguccucgagcgcaccuacggcgagaucgagggcaccgucucccgcguccucggccgcgaguacaagcuccccauggacgaccuccucccccuccucaucuacgucgucucccgcgcccgcauccagcaccucggcgccgagauccaccucauccgcgacaugauggaccccaaccacaccggcggccucuacgacuuccuccucaccgcccucgaguccugcuacgagcacauccagaaggaggacaugcgccuccaccgccuccccggccacuggcacucccgcgagcucugguga

SEQ ID NO: 39649 - RNA, 1269 nt, Artificial Sequence
  derived and/or modified sequence opt2 from ALS2CR12__Homo_sapiens__NP_001120863
auguaccccaacccccucaucuacugcaccugcugggaccccuggaaccucggcccccgcaagcucaucaagaccccccagcucccccgcaagaacuccaccggcuccuccaagcucaccccccucguccccgcccccaagaaccacaacuaccuccagcccaccaagcccgucgucucccccaagaugaagauccacuccgcccgccaggaggagaccaacaaguccuucuacgaggucaucaacgucucccccggcuaccagcucguccgcaaccgcgagcagaucuccgucacccucggcgacgagauguucgaccgcaagaagcgcugggaguccgagauccccgacaagggccgcuucucccgcaccaacaucaucuccgaccucgaggagcagaucuccgagcucaccgccaucaucgagcagaugaaccgcgaccaccaguccgcccagaagcuccucuccuccgagauggaccuccgcugcgccgagaugaagcagaacuucgagaacaagaaccgcgagcucaaggaggcccacgaggccgagcucuccgagcucgagaacaacuacaaggccgcccucaaggccgagaagcucgccgcccaggagaagcucgaggagaugggcaaggaguacaaguaccucaagaacauguuccgcaccuaccaggacuccaucuacgacgagauggaggagaagugguccaagcagaaggccaaguggaagaaggacgagaaguucgagcgcgagaacauccuccuccagcagaagaagaagaugaccaagaaguucgagauggaguccggcgaggaggacaagaagaucaacgaguccugcuccgccgucuucgagaacuucauccaggagaaggaggagcuccucaagcagcaccaguccgacacccuccagcucgaggagcuccgcaagaccaaggaggucaugcaggaggagcuccacgcccaggcccucauccucgagucccucaacaccaaccucuacuacacccagcucgagcuccagaaggagaaggccaucgucggcaaccucgagaagaugcuccagaccaaguucgccgagaccgaggagaaguacaagcacaccauccagauccucaccgaggagaacauccaccucaagcagaagaucaucuccaagaacgaggagaucugcgagggcugcuccggccgccucgccuccaucaccgucuccaaggacgacuccgacaccguccaggacggcuccaagaagggccaggaguccuga

SEQ ID NO: 39650 - RNA, 1191 nt, Artificial Sequence
  derived and/or modified sequence opt2 from ALS2__Homo_sapiens__NP_001129217
auggacuccaagaagcgcuccuccaccgaggccgagggcuccaaggagcgcggccucguccacaucuggcaggccggcuccuuccccaucacccccgagcgccuccccggcuggggcggcaagaccguccuccaggccgcccucggcgucaagcacggcguccuccucaccgaggacggcgaggucuacuccuucggcacccuccccuggcgcuccggccccgucgagaucugccccuccucccccauccucgagaacgcccucgucggccaguacgucaucaccgucgccaccggcuccuuccacuccggcgccgucaccgacaacggcgucgccuacauguggggcgagaacuccgccggccagugcgccgucgccaaccagcaguacguccccgagcccaaccccgucuccaucgccgacuccgaggccuccccccuccucgccguccgcauccuccagcucgccugcggcgaggagcacacccucgcccucuccaucucccgcgagaucugggccuggggcaccggcugccagcucggccucaucaccaccgccuuccccgucaccaagccccagaaggucgagcaccucgccggccgcgucguccuccaggucgccugcggcgccuuccacucccucgcccucguccagugccuccccucccaggaccucaagcccguccccgagcgcugcaaccagugcucccagcuccucaucaccaugaccgacaaggaggaccacgucaucaucuccgacucccacugcugcccccucggcgucacccucaccgagucccaggccgagaaccacgccuccaccgcccucucccccuccaccgagacccucgaccgccaggaggaggucuucgagaacacccucgucgccaacgaccaguccgucgccaccgagcucaacgccgucuccgcccagaucaccuccuccgacgccauguccucccagcagaacgucaugggcaccaccgagaucuccuccgcccgcaacauccccuccuaccccgacacccaggccgucaacgaguaccuccgcaagcucuccgaccacuccguccgcgaggacuccgagcacggcgagaagcccguccccucccagguccccgcccaguucuacaagaucaaggucugccucgagcucaacugcaugggcuucucccucgagacccucaaguga

SEQ ID NO: 39651 - RNA, 981 nt, Artificial Sequence
  derived and/or modified sequence opt2 from ALX1__Homo_sapiens__XP_005269222
auggaguuccucuccgagaaguucgcccucaaguccccccccuccaagaacuccgacuucuacaugggcgccggcggcccccucgagcacgucauggagacccucgacaacgaguccuucuacuccaaggccuccgccggcaagugcguccaggccuucggcccccucccccgcgccgagcaccacguccgccucgagcgcaccucccccugccaggacuccuccgucaacuacggcaucaccaaggucgagggccagccccuccacaccgagcucaaccgcgccauggacaacugcaacucccuccgcaugucccccgucaagggcaugcaggagaagggcgagcucgacgagcucggcgacaagugcgacuccaacgucuccuccuccaagaagcgccgccaccgcaccaccuucaccucccuccagcucgaggagcucgagaaggucuuccagaagacccacuaccccgacgucuacguccgcgagcagcucgcccuccgcaccgagcucaccgaggcccgcguccaggucugguuccagaaccgccgcgccaaguggcgcaagcgcgagcgcuacggccagauccagcaggccaagucccacuucgccgccaccuacgacaucuccguccucccccgcaccgacuccuacccccagauccagaacaaccucugggccggcaacgccuccggcggcuccgucgucaccuccugcaugcucccccgcgacaccuccuccugcaugacccccuacucccacuccccccgcaccgacuccuccuacaccggcuucuccaaccaccagaaccaguucucccacgucccccucaacaacuucuucaccgacucccuccucaccggcgccaccaacggccacgccuucgagaccaagcccgaguucgagcgccgcuccuccuccaucgccguccuccgcaugaaggccaaggagcacaccgccaacaucuccugggccauguga

SEQ ID NO: 39652 - RNA, 1236 nt, Artificial Sequence
  derived and/or modified sequence opt2 from ALX4__Homo_sapiens__NP_068745
augaacgccgagaccugcgucuccuacugcgagucccccgccgccgccauggacgccuacuacucccccgucucccagucccgcgagggcuccucccccuuccgcgccuuccccggcggcgacaaguucggcaccaccuuccucuccgccgccgccaaggcccagggcuucggcgacgccaagucccgcgcccgcuacggcgccggccagcaggaccucgccaccccccucgaguccggcgccggcgcccgcggcuccuucaacaaguuccagccccagcccuccaccccccagccccagccccccccccagccccagccccagcagcagcagccccagccccagccccccgcccagccccaccucuaccuccagcgcggcgccugcaagaccccccccgacggcucccucaagcuccaggagggcuccuccggccacuccgccgcccuccagguccccugcuacgccaaggaguccucccucggcgagcccgagcucccccccgacuccgacaccgucggcauggacuccuccuaccucuccgucaaggaggccggcgucaagggcccccaggaccgcgccuccuccgaccuccccuccccccucgagaaggccgacuccgaguccaacaagggcaagaagcgccgcaaccgcaccaccuucaccuccuaccagcucgaggagcucgagaaggucuuccagaagacccacuaccccgacgucuacgcccgcgagcagcucgccaugcgcaccgaccucaccgaggcccgcguccaggucugguuccagaaccgccgcgccaaguggcgcaagcgcgagcgcuucggccagaugcagcagguccgcacccacuucuccaccgccuacgagcucccccuccucacccgcgccgagaacuacgcccagauccagaaccccuccuggcucggcaacaacggcgccgccucccccguccccgccugcgucguccccugcgaccccguccccgccugcauguccccccacgcccacccccccggcuccggcgccuccuccgucaccgacuuccucuccgucuccggcgccggcucccacgucggccagacccacaugggcucccucuucggcgccgccucccucucccccggccucaacggcuacgagcucaacggcgagcccgaccgcaagaccuccuccaucgccgcccuccgcaugaaggccaaggagcacuccgccgccaucuccugggccaccuga

SEQ ID NO: 39653 - RNA, 795 nt, Artificial Sequence
  derived and/or modified sequence opt2 from ALYREF__Homo_sapiens__NP_005773
augcccgacuccgcccccgccauggccgacaagauggacaugucccucgacgacaucaucaagcucaaccgcucccagcgcggcggccgcggcggcggccgcggccgcggccgcgccggcucccagggcggccgcggcggcggcgcccaggccgccgcccgcgucaaccgcggcggcggccccauccgcaaccgccccgccaucgcccgcggcgccgccggcggcggcggccgcaaccgccccgcccccuacucccgccccaagcagcuccccgacaaguggcagcacgaccucuucgacuccggcuucggcggcggcgccggcgucgagaccggcggcaagcuccucgucuccaaccucgacuucggcgucuccgacgccgacauccaggagcucuucgccgaguucggcacccucaagaaggccgccguccacuacgaccgcuccggccgcucccucggcaccgccgacguccacuucgagcgcaaggccgacgcccucaaggccaugaagcaguacaacggcgucccccucgacggccgccccaugaacauccagcucgucaccucccagaucgacgcccagcgccgccccgcccaguccgucaaccgcggcggcaugacccgcaaccgcggcgccggcggcuucggcggcggcggcggcacccgccgcggcacccgcggcggcgcccgcggccgcggccgcggcgccggccgcaacuccaagcagcagcucuccgccgaggagcucgacgcccagcucgacgccuacaacgcccgcauggacaccuccuga

SEQ ID NO: 39654 - RNA, 1185 nt, Artificial Sequence
  derived and/or modified sequence opt2 from AMACR__Homo_sapiens__NP_001161067
auggcccuccagggcaucuccgucgucgagcucuccggccucgcccccggccccuucugcgccaugguccucgccgacuucggcgcccgcgucguccgcgucgaccgccccggcucccgcuacgacgucucccgccucggccgcggcaagcgcucccucguccucgaccucaagcagccccgcggcgccgccguccuccgccgccucugcaagcgcuccgacguccuccucgagcccuuccgccgcggcgucauggagaagcuccagcucggccccgagauccuccagcgcgagaacccccgccucaucuacgcccgccucuccggcuucggccaguccggcuccuucugccgccucgccggccacgacaucaacuaccucgcccucuccggcguccucuccaagaucggccgcuccggcgagaaccccuacgccccccucaaccuccucgccgacuucgccggcggcggccucaugugcgcccucggcaucaucauggcccucuucgaccgcacccgcaccggcaagggccaggucaucgacgccaacauggucgagggcaccgccuaccucuccuccuuccucuggaagacccagaagcucucccucugggaggccccccgcggccagaacaugcucgacggcggcgcccccuucuacaccaccuaccgcaccgccgacggcgaguucauggccgucggcgccaucgagccccaguucuacgagcuccucaucaagggccucggccucaaguccgacgagcuccccaaccagauguccauggacgacuggcccgagaugaagaagaaguucgccgacgucuucgccgagaagaccaaggccgaguggugccagaucuucgacggcaccgacgccugcgucacccccguccucaccuucgaggaggucguccaccacgaccacaacaaggagcgcggcuccuucaucaccuccgaggagcaggacgucuccccccgccccgccccccuccuccucaacacccccgccauccccuccuucaagcgcgaccccuucaucggcgagcacaccgaggagauccucgaggaguucggcuucucccgcgaggagaucuaccagcucaacuccgacaagaucaucgaguccaacaaggccggcuccaaguucuggauccucuaccccacccacuccaacauccagaaguga

SEQ ID NO: 39655 - RNA, 1344 nt, Artificial Sequence
  derived and/or modified sequence opt2 from AMBN__Homo_sapiens__NP_057603
auguccgccuccaagaucccccucuucaagaugaaggaccucauccucauccucugccuccucgagauguccuucgccguccccuucuucccccagcaguccggcacccccggcauggccucccucucccucgagaccaugcgccagcucggcucccuccagcgccucaacacccucucccaguacucccgcuacggcuucggcaaguccuucaacucccucuggaugcacggccuccuccccccccacuccucccuccccuggaugcgcccccgcgagcacgagacccagcaguacgaguacucccuccccguccacccccccccccuccccucccagcccucccucaagccccagcagcccggccucaagcccuuccuccaguccgccgccgccaccaccaaccaggccaccgcccucaaggaggcccuccagccccccauccaccucggccaccucccccuccaggagggcgagcucccccucguccagcagcaggucgcccccuccgacaagccccccaagcccgagcuccccggcgucgacuucgccgacccccagggccccucccuccccggcauggacuuccccgacccccagggccccucccuccccggccucgacuucgccgacccccagggcuccaccaucuuccagaucgcccgccucaucucccacggccccaugccccagaacaagcaguccccccucuaccccggcaugcucuacguccccuucggcgccaaccagcucaacgcccccgcccgccucggcaucauguccuccgaggaggucgccggcggccgcgaggaccccauggccuacggcgccauguuccccggcuucggcggcaugcgccccggcuucgagggcaugccccacaaccccgccaugggcggcgacuucacccucgaguucgacucccccgucgccgccaccaagggccccgagaacgaggagggcggcgcccagggcucccccaugcccgaggccaaccccgacaaccucgagaaccccgccuuccucaccgagcucgagcccgccccccacgccggccuccucgcccuccccaaggacgacauccccggccucccccgcucccccuccggcaagaugaagggccuccccuccgucacccccgccgccgccgacccccucaugacccccgagcucgccgacgucuaccgcaccuacgacgccgacaugaccaccuccgucgacuuccaggaggaggccaccauggacaccaccauggcccccaacucccuccagaccuccaugcccggcaacaaggcccaggagcccgagaugaugcacgacgccuggcacuuccaggagcccuga

SEQ ID NO: 39656 - RNA, 1059 nt, Artificial Sequence
  derived and/or modified sequence opt2 from AMBP__Homo_sapiens__NP_001624
augcgcucccucggcgcccuccuccuccuccucuccgccugccucgccgucuccgccggccccguccccaccccccccgacaacauccagguccaggagaacuucaacaucucccgcaucuacggcaagugguacaaccucgccaucggcuccaccugccccuggcucaagaagaucauggaccgcaugaccgucuccacccucguccucggcgagggcgccaccgaggccgagaucuccaugaccuccacccgcuggcgcaagggcgucugcgaggagaccuccggcgccuacgagaagaccgacaccgacggcaaguuccucuaccacaaguccaaguggaacaucaccauggaguccuacgucguccacaccaacuacgacgaguacgccaucuuccucaccaagaaguucucccgccaccacggccccaccaucaccgccaagcucuacggccgcgccccccagcuccgcgagacccuccuccaggacuuccgcgucgucgcccagggcgucggcauccccgaggacuccaucuucaccauggccgaccgcggcgagugcguccccggcgagcaggagcccgagcccauccucaucccccgcguccgccgcgccguccucccccaggaggaggagggcuccggcggcggccagcucgucaccgaggucaccaagaaggaggacuccugccagcucggcuacuccgccggccccugcaugggcaugaccucccgcuacuucuacaacggcaccuccauggccugcgagaccuuccaguacggcggcugcaugggcaacggcaacaacuucgucaccgagaaggagugccuccagaccugccgcaccgucgccgccugcaaccuccccaucguccgcggccccugccgcgccuucauccagcucugggccuucgacgccgucaagggcaagugcguccucuuccccuacggcggcugccagggcaacggcaacaaguucuacuccgagaaggagugccgcgaguacugcggcguccccggcgacggcgacgaggagcuccuccgcuucuccaacuga

SEQ ID NO: 39657 - RNA, 3906 nt, Artificial Sequence
  derived and/or modified sequence opt2 from AMBRA1__Homo_sapiens__NP_001254711
augaaggucguccccgagaagaacgccguccgcauccucuggggccgcgagcgcggcgcccgcgccaugggcgcccagcgccuccuccaggagcucgucgaggacaagacccgcuggaugaagugggagggcaagcgcgucgagcuccccgacuccccccgcuccaccuuccuccucgccuucucccccgaccgcacccuccucgccuccacccacgucaaccacaacaucuacaucaccgaggucaagaccggcaagugcguccacucccucaucggccaccgccgcacccccuggugcgucaccuuccaccccaccaucuccggccucaucgccuccggcugccucgacggcgagguccgcaucugggaccuccacggcggcuccgaguccugguucaccgacuccaacaacgccaucgccucccucgccuuccaccccaccgcccagcuccuccucaucgccaccgccaacgagauccacuucugggacuggucccgccgcgagcccuucgccgucgucaagaccgccuccgagauggagcgcguccgccucguccgcuucgacccccucggccacuaccuccucaccgccaucgucaaccccuccaaccagcagggcgacgacgagcccgagauccccaucgacggcaccgagcucucccacuaccgccagcgcgcccuccuccagucccagcccguccgccgcaccccccuccuccacaacuuccuccacaugcucuccucccgcuccuccggcauccagaccgagcccuuccacccccccgagcaggccuccuccacccagcaggaccagggccuccucaaccgccccuccgccuucuccaccguccaguccuccaccgccggcaacacccuccgcaaccucucccucggccccacccgccgcucccucggcggcccccucuccucccaccccucccgcuaccaccgcgagaucgcccccggccucaccggcuccgaguggacccgcaccguccucucccucaacucccgcuccgaggccgaguccaugccccccccccgcaccuccgccuccuccgucucccuccucuccguccuccgccagcaggagggcggcucccaggccuccgucuacaccuccgccaccgagggccgcggcuuccccgccuccggccucgccaccgaguccgacggcggcaacggcuccucccagaacaacuccggcuccauccgccacgagcuccagugcgaccuccgccgcuucuuccucgaguacgaccgccuccaggagcucgaccagucccucuccggcgaggccccccagacccagcaggcccaggagaugcucaacaacaacaucgaguccgagcgccccggccccucccaccagcccaccccccacuccuccgagaacaacuccaaccucucccgcggccaccucaaccgcugccgcgccugccacaaccuccucaccuucaacaacgacacccuccgcugggagcgcaccacccccaacuacuccuccggcgaggccuccuccuccuggcagguccccuccuccuucgaguccguccccuccuccggcucccagcuccccccccucgagcgcaccgagggccagacccccuccuccucccgccucgagcucuccuccuccgccuccccccaggaggagcgcaccgucggcgucgccuucaaccaggagaccggccacugggagcgcaucuacacccaguccucccgcuccggcaccgucucccaggaggcccuccaccaggacaugcccgaggaguccuccgaggaggacucccuccgccgccgcucccucgcccucuccccccgccucgaguacuccggcgccauccucgcccacugcaagcuccgccuccccggcuccugccacucccccgccuccgccucccaggucgccggcaccaccggcgcccaccaccacgcccgccucaucuucgccuuccucgucgagauggaguuccaccacgucucccaggccggccucgagcuccucaccuccggcgaccuccccaccuccgccucccaguccgccggcaucaccggcgucucccaccgcgccuggccccgccuccucgaguccucccucaucucccucucccgcuacgacggcgccggcucccgcgagcaccccaucuaccccgaccccgcccgccucucccccgccgccuacuacgcccagcgcaugauccaguaccucucccgccgcgacuccauccgccagcgcuccaugcgcuaccagcagaaccgccuccgcuccuccaccuccuccuccuccuccgacaaccagggccccuccgucgagggcaccgaccucgaguucgaggacuucgaggacaacggcgaccgcucccgccaccgcgccccccgcaacgcccgcauguccgcccccucccucggccgcuucgucccccgccgcuuccuccuccccgaguaccuccccuacgccggcaucuuccacgagcgcggccagcccggccucgccacccacuccuccgucaaccgcguccucgccggcgccgucaucggcgacggccaguccgccgucgccuccaacaucgccaacaccaccuaccgccuccaguggugggacuucaccaaguucgaccuccccgagaucuccaacgccuccgucaacguccucguccagaacugcaagaucuacaacgacgccuccugcgacaucuccgccgacggccagcuccucgccgccuucauccccuccucccagcgcggcuuccccgacgagggcauccucgccgucuacucccucgccccccacaaccucggcgagaugcucuacaccaagcgcuucggccccaacgccaucuccgucucccucucccccaugggccgcuacgucauggucggccucgccucccgccgcauccuccuccaccccuccaccgagcacauggucgcccaggucuuccgccuccagcaggcccacggcggcgagaccuccaugcgccgcgucuucaacguccucuaccccaugcccgccgaccagcgccgccacgucuccaucaacuccgcccgcuggcuccccgagcccggccucggccucgccuacggcaccaacaagggcgaccucgucaucugccgccccgaggcccucaacuccggcgucgaguacuacugggaccagcucaacgagaccgucuucaccguccacuccaacucccgcuccuccgagcgccccggcaccucccgcgccaccuggcgcaccgaccgcgacaugggccucaugaacgccaucggccuccagccccgcaaccccgccaccuccgucaccucccagggcacccagacccucgcccuccagcuccagaacgccgagacccagaccgagcgcgagguccccgagcccggcaccgccgccuccggccccggcgagggcgagggcuccgaguacggcgccuccggcgaggacgcccucucccgcauccagcgccucauggccgagggcggcaugaccgccgucguccagcgcgagcaguccaccaccauggccuccaugggcggcuucggcaacaacaucaucgucucccaccgcauccaccgcuccucccagaccggcaccgagcccggcgccgcccacaccuccuccccccagcccuccaccucccgcggccuccuccccgaggccggccagcucgccgagcgcggccucuccccccgcaccgccuccugggaccagcccggcacccccggccgcgagcccacccagcccacccuccccuccuccucccccguccccauccccgucucccuccccuccgccgagggccccacccuccacugcgagcucaccaacaacaaccaccuccucgacggcggcuccucccgcggcgacgccgccggcccccgcggcgagccccgcaaccgcuga

SEQ ID NO: 39658 - RNA, 918 nt, Artificial Sequence
  derived and/or modified sequence opt2 from AMD1__Homo_sapiens__NP_001274143
auggaggccgcccacuucuucgagggcaccgagaagcuccucgaggucugguucucccgccagcagcccgacgccaaccagggcuccggcgaccuccgcaccauccccuccgaguccuccauguucgucuccaagcgccgcuucauccucaagaccugcggcaccacccuccuccucaaggcccucgucccccuccucaagcucgcccgcgacuacuccggcuucgacuccauccaguccuucuucuacucccgcaagaacuucaugaagcccucccaccagggcuacccccaccgcaacuuccaggaggagaucgaguuccucaacgccaucuuccccaacggcgccgccuacugcaugggccgcaugaacuccgacugcugguaccucuacacccucgacuuccccgagucccgcgucaucucccagcccgaccagacccucgagauccucauguccgagcucgaccccgccgucauggaccaguucuacaugaaggacggcgucaccgccaaggacgucacccgcgaguccggcauccgcgaccucauccccggcuccgucaucgacgccaccauguucaaccccugcggcuacuccaugaacggcaugaaguccgacggcaccuacuggaccauccacaucacccccgagcccgaguucuccuacgucuccuucgagaccaaccucucccagaccuccuacgacgaccucauccgcaaggucgucgaggucuucaagcccggcaaguucgucaccacccucuucgucaaccaguccuccaagugccgcaccguccucgccuccccccagaagaucgagggcuucaagcgccucgacugccaguccgccauguucaacgacuacaacuucgucuucaccuccuucgccaagaagcagcagcagcagcaguccuga

SEQ ID NO: 39659 - RNA, 576 nt, Artificial Sequence
  derived and/or modified sequence opt2 from AMELX__Homo_sapiens__NP_001133
augggcaccuggauccucuucgccugccuccucggcgccgccuucgccaugccccuccccccccaccccggccaccccggcuacaucaacuucuccuacgagguccucaccccccucaagugguaccaguccauccgcccccccuaccccuccuacggcuacgagcccaugggcggcuggcuccaccaccagaucauccccguccucucccagcagcacccccccacccacacccuccagccccaccaccacauccccgucguccccgcccagcagcccgucaucccccagcagcccaugaugcccguccccggccagcacuccaugacccccauccagcaccaccagcccaaccuccccccccccgcccagcagcccuaccagccccagcccguccagccccagccccaccagcccaugcagccccagccccccguccaccccaugcagccccuccccccccagcccccccucccccccauguuccccaugcagccccucccccccaugcuccccgaccucacccucgaggccuggcccuccaccgacaagaccaagcgcgaggaggucgacuga

SEQ ID NO: 39660 - RNA, 579 nt, Artificial Sequence
  derived and/or modified sequence opt2 from AMELY__Homo_sapiens__NP_001134
augggcaccuggauccucuucgccugccucgucggcgccgccuucgccaugccccuccccccccaccccggccaccccggcuacaucaacuucuccuacgagguccucaccccccucaagugguaccaguccaugauccgcccccccuacuccuccuacggcuacgagcccaugggcggcuggcuccaccaccagaucauccccgucgucucccagcagcacccccucacccacacccuccagucccaccaccacauccccgucguccccgcccagcagccccgcguccgccagcaggcccucaugcccguccccggccagcaguccaugacccccacccagcaccaccagcccaaccucccccuccccgcccagcagcccuuccagccccagcccguccagccccagccccaccagcccaugcagccccagccccccguccagcccaugcagccccuccucccccagcccccccucccccccauguucccccuccgcccccucccccccauccuccccgaccuccaccucgaggccuggcccgccaccgacaagaccaagcaggaggaggucgacuga

SEQ ID NO: 39661 - RNA, 3408 nt, Artificial Sequence
  derived and/or modified sequence opt2 from AMER1__Homo_sapiens__NP_689637
auggagacccagaaggacgaggccgcccaggccaagggcgccgccgccuccggcuccacccgcgagcagaccgccgagaagggcgccaagaacaaggccgccgaggccaccgagggccccaccuccgagcccuccuccuccggccccggccgccucaagaagaccgccaugaagcucuucggcggcaagaagggcaucugcacccuccccuccuucuucggcggcggccgcuccaagggcuccggcaagggcuccuccaagaagggccucuccaaguccaagacccacgacggccucuccgaggccgcccacggccccgaggacgucgucuccgagggcaccggcuucucccucccccuccccgagcuccccugccaguuccccuccucccaguccgcccacggcgcccucgagaccggcucccgcugcaagaccuccgucgccggcgccaccgagaaggccgucgccgagaaguuccccuccaugcccaagcccaagaagggccucaagggcuucuucuccuccauccgccgccaccgcaaguccaaggucaccggcgccgagcaguccgagcccggcgccaagggccccgagcgcguccgcgcccgcccccacgagcacgucuccuccgccccccagguccccugcuucgaggagaccuuccaggccccccgcaaggagaacgccaacccccaggacgcccccggccccaaggucucccccacccccgagcccuccccccccgccaccgagaagauggccugcaaggaccccgagaagcccauggaggccugcgccuccgcccacguccagcccaagcccgcccccgaggccuccucccucgaggagccccacucccccgagaccggcgagaaggucgucgccggcgaggucaacccccccaacggccccgucggcgacccccucucccuccucuucggcgacgucaccucccucaaguccuucgacucccucaccggcugcggcgacaucaucgccgagcaggacauggacuccaugaccgacuccauggccuccggcggccagcgcgccaaccgcgacggcaccaagcgcuccuccugccucgucaccuaccagggcggcggcgaggagauggcccuccccgacgacgacgacgaggaggaggaggaggaggaggaggucgagcucgaggaggaggaggaggaggucaaggaggaggaggaggacgacgaccucgaguaccucugggagaccgcccagauguacccccgccccaacaugaaccucggcuaccaccccaccaccucccccggccaccacggcuacaugcuccucgaccccguccgcuccuaccccggccucgcccccggcgagcuccucaccccccaguccgaccagcaggaguccgcccccaacuccgacgagggcuacuacgacuccaccacccccggcuucgaggacgacuccggcgaggcccucggccucguccgccgcgacugccucccccgcgacuccuacuccggcgacgcccucuacgaguucuacgagcccgacgacucccucgagaacuccccccccggcgacgacugccucuacgaccuccacggccgcuccuccgagauguucgaccccuuccucaacuucgagcccuuccucuccucccgcccccccggcgccauggagaccgaggaggagcgccucgucaccauccagaagcagcuccucuacugggagcuccgccgcgagcagcucgaggcccaggaggcccgcgcccgcgaggcccacgcccgcgaggcccacgcccgcgaggccuacacccgcgaggccuacggccgcgaggccuacgcccgcgaggcccacaccugggaggcccacggccgcgaggcccgcacccgcgaggcccaggcccgcgagguccgcugccgcgagacccagguccgcgagacccaggcccgccaggagaagcccguccucgaguaccagaugcgcccccucggccccuccgucaugggccucgccgccggcgucuccggcaccucccagaucucccaccgcggcaucaccuccgccuuccccaccaccgccuccuccgagcccgacuggcgcgacuuccgcccccucgagaagcgcuacgagggcaccugcuccaagaaggaccaguccaccugccucaugcagcucuuccaguccgacgccauguucgagcccgacaugcaggaggccaacuucggcggcuccccccgccgcgccuaccccaccuacuccccccccgaggaccccgaggaggaggaggucgagaaggagggcaacgccaccgucuccuucucccaggcccucgucgaguucaccuccaacggcaaccucuucuccuccauguccugcuccuccgacuccgacuccuccuucacccagaaccuccccgagcucccccccauggucaccuucgacaucgccgacgucgagcgcgacggcgagggcaagugcgaggagaaccccgaguuccacaacgacgaggaccucgccgccucccucgaggccuucgagcucggcuacuaccacaagcacgccuucaacaacuaccacucccgcuucuaccagggccuccccuggggcgucuccucccucccccgcuaccucggccuccccggccuccacccccgccccccccccgccgccauggcccucaaccgccgcucccgcucccucgacaccgccgagacccucgagauggagcucuccaacucccaccucguccagggcuaccucgaguccgacgagcuccaggcccagcaggaggacuccgacgaggaggacgaggaggaggaggagggcgaguggucccgcgacuccccccucucccucuacaccgagccccccggcgccuacgacuggcccgccugggcccccugcccccuccccgucggccccggccccgccuggaucucccccaaccagcucgaccgccccuccucccagucccccuaccgccaggccaccugcugcaucccccccaugaccauguccaucucccucuccguccccgagucccgcgcccccggcgaguccggcccccagcucgcccgccccucccaccuccaccuccccaugggccccugcuacaaccuccagccccaggccucccaguccaugcgcgcccgcccccgcgacguccuccuccccgucgacgagcccuccugcuccuccuccuccggcggcuucucccccuccccccucccccaggccaagcccgucggcaucacccacggcaucccccagcucccccgcguccgccccgagcacccccagccccagcccacccacuacggccccuccucccucgaccucuccaaggagcgcgccgagcagggcgccucccucgccaccuccuacuccuccaccgccaugaacggcaaccucgccaaguga

SEQ ID NO: 39662 - RNA, 2016 nt, Artificial Sequence
  derived and/or modified sequence opt2 from AMER2__Homo_sapiens__NP_689917
auggagaccucccgcucccgcggcggcggcggcgccgucuccgagcgcggcggcgccggcgccuccgucggcgucugccgccgcaaggccgaggccggcgccggcaccggcacccucgccgccgacauggaccuccacugcgacugcgccgccgagacccccgccgccgagccccccuccggcaagaucaacaaggccgccuucaagcucuucaagaagcgcaaguccggcggcaccaugcccuccaucuucggcgucaagaacaagggcgacggcaaguccuccggccccaccggccucguccgcucccgcacccacgacggccucgccgagguccucguccucgaguccggccgcaaggaggagccccgcggcggcggcgacuccggcggcggcggcggcggccgccccaaccccggccccccccgcgccgccggccccggcggcggcucccucgccuccuccuccgucgccaagucccacuccuucuucucccuccucaagaagaacggccgcuccgagaacggcaagggcgagcccgucgacgccuccaaggccggcggcaagcagaagcgcggccuccgcggccucuucuccggcaugcgcuggcaccgcaaggacaagcgcgccaaggccgaggccgccgagggccgcgcccccggcggcggccucauccuccccggcucccucaccgccucccucgagugcgucaaggaggagaccccccgcgccgcccgcgagcccgaggagcccucccaggacgccccccgcgaccccgccggcgagcccgccggcggcgaggagguccccgcccccgccgaccgcgcccccgcccgcuccugccgcgaggccgagggccucgcccaccccggcgacaccggcgcccgcggcgaggacgccgccggccaccgccgcgccgagcccggccccggcgagguccgcaccgccgaggacgccucccgcaccggcgccguccccgucaagaccgucccccucgucgacuccgagggcggcuccggccgcgcccccgccgcccccgaccccgccuccgucgacccccccuccgaccccuccgccgaccgcaucugccucauguucuccgacgucaccucccucaaguccuucgacucccucaccggcugcggcgacaucaucgccgaccaggaggaggaggccggccccuccugcgacaagcacguccccggccccggcaagcccgcccucuccaagaagaaccccggcgucgucgccuaccagggcggcggcgaggagauggccucccccgacgaggucgacgacaccuaccuccaggaguucugggacaugcucucccagaccgaggagcagggccccgagccccaggagggcgccgccaaggucgccgccgcccucgagaccaaggucguccccgagacccccaaggacacccgcugcgucgaggccgccaaggacgccuccuccgucaagcgccgccgccucaaccgcauccccaucgagccccaccccaaggaggagcccaagcaccccgagaaggagcagcaggagggcguccccaacuccgacgagggcuacugggacuccaccacccccggccccgaggaggacuccuccuccuccggcaagaaggccggcaucccccgcgacuccuacuccggcgacgcccucuacgaccucuacgccgaccccgacggcucccccgccacccuccccggcggcaaggacaacgaggagaccuccucccucucccgccucaagcccgucucccccggcaccaucaccugcccccuccgcacccccggcucccuccucaaggacuccaagauccccaucuccaucaagcaccucaccaaccuccccuccucccaccccgucguccaccagcagcccucccgcuccgagaugccccgcaccaagauccccgucuccaagguccucguccgccgcgucuccaaccgcggccucgccggcaccaccauccgcgccaccgccugccacgacuccgccaagaagcucuga

SEQ ID NO: 39663 - RNA, 2586 nt, Artificial Sequence
  derived and/or modified sequence opt2 from AMER3__Homo_sapiens__NP_001098663
auggagcucaagcgcggcaagaccuucaucaaguccucccuccaggucucccacgagaagccccccgaccccgccgccgucgccgccgcccgcgagggcaccggccccugguccguccuccccggcggccagcagcgcccccacuccgagaagggcccccaggccucccccuccgcccaggaguacgaccgcugccccaacaagggcgcccagcucgaccccaagggcggccccgccgcccucugcggcgccaccuucaagcccguccgcaagugcaagacccacgacuccauguccggcgccggccgcgccaccgccgccaccggccagcucgucggcuccgccuccuuccccggcucccccggcucccgccgcaugaucgacuaccgccacuucgucccccagaugcccuucguccccgccgucgccaaguccaucccccgcaagcgcaucucccucaagcgccccaagaagugcuuccgcaaccucuuccacauccgccgcaacaagaccgaggaccucgccucccucgccgccgagggcaagucccuccccucccccggcgaccccuccgaccccggcggccgccgcuccaaggccuuccucccccccggcgagggccccggccucgacggccucugccaggaccuccucgacuccgagcuccucgccgacgccuccuucggccucugccgcgcccucugcgaggacgucgccucccuccaguccuucgacucccucaccggcugcggcgaggucuucgccgacgaguccuccguccccucccucgagcucaacgagggccccgagucccccacccaggccgcccagggccucgaguccaaggucccccgcggcccccuccagggcuccgucgagcagcucgccucccccgcccagaacgaggccuccgacuucacccgcuucugggacuccgucaaccgcuccguccgccagcagcagcgcgcccuccucggccccuggcucuccggcccccagggcaccgaccgcgaccagucccgccucgacaccgccggccucgccgagcucccccucugccccugccgcgacccccgcuccggcuccaaggccuccuccaucgacaccggcacccccaaguccgagcagcccgaguccgucuccaccuccgacgagggcuacuacgacuccuucucccccggccucgaggaggacaagaaggaggccgagucccccggcacccccgccgccaccuucccccgcgacuccuacuccggcgacgcccucuacgagcucuuccacgaccccuccgagggcccccucggccccucccccgacgacgaccucugcgucuccgagucccucuccggccccgcccucggcaccccccucuccaucugcuccuuccgcgucggcgccgaggagaaccucgcccccgcccccggccccgaccuccucucccagggcuuccuccaguccuccuggaagggcaaggagugccuccucaagcucugcgacaccgagcucgccaucaccaugggcaucgucuccuggcuccgccgcggccccaccccccgcgccccccccacccccggccagcccgccgccccccccggcucccagggcgccccccgcgcccccaccgagaagcucggcggccgcgagggccucgccuccgacgccggcggcgccaccgucugcuccgcccccucccgccaggagcucugggcccaccccggcaccaccggccuccucgccggcgaguccaaggcccucggcggcgccacccagggcaccggcacccucucccgcgacgccucccgcgaggaggagacccgcggccacuccgagggccucuucuccuccauggaguccgccgccaccuccaccaccgacaccuccggcaagaacaaggcccccguccccuccaccuggcccugcucccagaaggagcccggcccccccggcguccucggcugcuuccgcggccccuggcgccccggccacggcggcgacacccucgacgccgagcccaugcucgccggcugcgucgcccgcgucgccgcccucaagaucuccuccaacgagcagccccccgccgccuggcccccccgccaggacaugggcuccggccucuucggccagcgcugggcccgcggccccgacaugcucgagcagaagcaguccuccuccucccccuccaugaccaccauccacggccuccccuacuccgccuccacccaggaccagcgcugccgcgaccgcguccaggaccucuccuggcuccgcgucgagcccaccggccucggcguccaggccugggccuccgucgaggaccagccccuccagcucuccaccgaggccgucgagcaggucgcccacggcucccagcucgacuccgagccccgcuccgcccccgccgcccgcugguccucccagggccaccaccccgagucccucggccucacccucaacucccagcaggagggcggcgucuccgccuccgcccccgagugccgcugcucccuccucgcccgcgagggccuccucugcggccagcccgaggucggcgccuccggccccgccauggccgagccccaccucuga

SEQ ID NO: 39664 - RNA, 1932 nt, Artificial Sequence
  derived and/or modified sequence opt2 from AMFR__Homo_sapiens__NP_001135
augccccuccucuuccucgagcgcuuccccuggcccucccuccgcaccuacaccggccucuccggccucgcccuccucggcaccaucaucuccgccuaccgcgcccucucccagcccgaggccggccccggcgagcccgaccagcucaccgccucccuccagcccgagccccccgcccccgcccgccccuccgccggcggcccccgcgcccgcgacgucgcccaguaccuccucuccgacucccucuucgucuggguccucgucaacaccgccugcugcguccucaugcucgucgccaagcucauccagugcaucgucuucggcccccuccgcgucuccgagcgccagcaccucaaggacaaguucuggaacuucaucuucuacaaguucaucuucaucuucggcguccucaacguccagaccgucgaggaggucgucauguggugccucugguucgccggccucgucuuccuccaccucaugguccagcucugcaaggaccgcuucgaguaccucuccuucucccccaccacccccauguccucccacggccgcguccucucccuccucgucgccaugcuccucuccugcugcggccucgccgccgucugcuccaucaccggcuacacccacggcaugcacacccucgccuucauggccgccgagucccuccucgucaccguccgcaccgcccacgucauccuccgcuacgucauccaccucugggaccucaaccacgagggcaccugggagggcaagggcaccuacgucuacuacaccgacuucgucauggagcucacccuccucucccucgaccucaugcaccacauccacaugcuccucuucggcaacaucuggcucuccauggccucccucgucaucuucaugcagcuccgcuaccucuuccacgagguccagcgccgcauccgccgccacaagaacuaccuccgcgucgucggcaacauggaggcccgcuucgccgucgccacccccgaggagcucgccgucaacaacgacgacugcgccaucugcugggacuccaugcaggccgcccgcaagcuccccugcggccaccucuuccacaacuccugccuccgcuccuggcucgagcaggacaccuccugccccaccugccgcaugucccucaacaucgccgacaacaaccgcguccgcgaggagcaccagggcgagaaccucgacgagaaccucguccccgucgccgccgccgagggccgcccccgccucaaccagcacaaccacuucuuccacuucgacggcucccgcaucgccuccuggcuccccuccuucuccgucgaggucaugcacaccaccaacauccucggcaucacccaggccuccaacucccagcucaacgccauggcccaccagauccaggagauguucccccagguccccuaccaccucguccuccaggaccuccagcucacccgcuccgucgagaucaccaccgacaacauccucgagggccgcauccagguccccuuccccacccagcgcuccgacuccauccgccccgcccucaacucccccgucgagcgccccuccuccgaccaggaggagggcgagaccuccgcccagaccgagcgcgucccccucgaccucuccccccgccucgaggagacccucgacuucggcgaggucgaggucgagcccuccgaggucgaggacuucgaggcccgcggcucccgcuucuccaaguccgccgacgagcgccagcgcaugcucguccagcgcaaggacgagcuccuccagcaggcccgcaagcgcuuccucaacaaguccuccgaggacgacgccgccuccgaguccuuccuccccuccgagggcgccuccuccgaccccgucacccuccgccgccgcaugcucgccgccgccgccgagcgccgccuccagaagcagcagaccuccuga

SEQ ID NO: 39665 - RNA, 1683 nt, Artificial Sequence
  derived and/or modified sequence opt2 from AMH__Homo_sapiens__NP_000470
augcgcgaccucccccucaccucccucgcccucguccucuccgcccucggcgcccuccucggcaccgaggcccuccgcgccgaggagcccgccgucggcaccuccggccucaucuuccgcgaggaccucgacuggccccccggcuccccccaggagccccucugccucgucgcccucggcggcgacuccaacggcuccuccuccccccuccgcgucgucggcgcccucuccgccuacgagcaggccuuccucggcgccguccagcgcgcccgcuggggcccccgcgaccucgccaccuucggcgucugcaacaccggcgaccgccaggccgcccuccccucccuccgccgccucggcgccuggcuccgcgaccccggcggccagcgccucgucguccuccaccucgaggaggucaccugggagcccacccccucccuccgcuuccaggagcccccccccggcggcgccggcccccccgagcucgcccuccucguccucuaccccggccccggccccgaggucaccgucacccgcgccggccuccccggcgcccagucccucugccccucccgcgacacccgcuaccucguccucgccgucgaccgccccgccggcgccuggcgcggcuccggccucgcccucacccuccagccccgcggcgaggacucccgccucuccaccgcccgccuccaggcccuccucuucggcgacgaccaccgcugcuucacccgcaugacccccgcccuccuccuccucccccgcuccgagcccgccccccuccccgcccacggccagcucgacaccguccccuucccccccccccgccccuccgccgagcucgaggaguccccccccuccgccgaccccuuccucgagacccucacccgccucguccgcgcccuccgcgucccccccgcccgcgccuccgccccccgccucgcccucgaccccgacgcccucgccggcuucccccagggccucgucaaccucuccgaccccgccgcccucgagcgccuccucgacggcgaggagccccuccuccuccuccuccgccccaccgccgccaccaccggcgaccccgccccccuccacgaccccaccuccgcccccugggccaccgcccucgcccgccgcgucgccgccgagcuccaggccgccgccgccgagcuccgcucccuccccggccucccccccgccaccgccccccuccucgcccgccuccucgcccucugccccggcggccccggcggccucggcgacccccuccgcgcccuccuccuccucaaggcccuccagggccuccgcgucgaguggcgcggccgcgacccccgcggccccggccgcgcccagcgcuccgccggcgccaccgccgccgacggccccugcgcccuccgcgagcucuccgucgaccuccgcgccgagcgcuccguccucauccccgagaccuaccaggccaacaacugccagggcgucugcggcuggccccaguccgaccgcaacccccgcuacggcaaccacgucguccuccuccucaagaugcaggcccgcggcgccgcccucgcccgcccccccugcugcguccccaccgccuacgccggcaagcuccucaucucccucuccgaggagcgcaucuccgcccaccacguccccaacauggucgccaccgagugcggcugccgcuga

SEQ ID NO: 39666 - RNA, 1437 nt, Artificial Sequence
  derived and/or modified sequence opt2 from AMHR2__Homo_sapiens__NP_001158162
augcucggcucccucggccucugggcccuccuccccaccgccgucgaggccccccccaaccgccgcaccugcgucuucuucgaggcccccggcguccgcggcuccaccaagacccucggcgagcuccucgacaccggcaccgagcucccccgcgccauccgcugccucuacucccgcugcugcuucggcaucuggaaccucacccaggaccgcgcccaggucgagaugcagggcugccgcgacuccgacgagcccggcugcgagucccuccacugcgaccccuccccccgcgcccaccccucccccggcuccacccucuucaccugcuccugcggcaccgacuucugcaacgccaacuacucccaccuccccccccccggcucccccggcacccccggcucccagggcccccaggccgcccccggcgaguccaucuggauggcccucguccuccucggccucuuccuccuccuccuccuccuccucggcuccaucauccucgcccuccuccagcgcaagaacuaccgcguccgcggcgagcccguccccgagccccgccccgacuccggccgcgacugguccgucgagcuccaggagcuccccgagcucugcuucucccaggucauccgcgagggcggccacgccgucgucugggccggccagcuccagggcaagcucgucgccaucaaggccuuccccccccgcuccgucgcccaguuccaggccgagcgcgcccucuacgagcuccccggccuccagcacgaccacaucguccgcuucaucaccgccucccgcggcggccccggccgccuccucuccggcccccuccucguccucgagcuccaccccaagggcucccucugccacuaccucacccaguacaccuccgacuggggcuccucccuccgcauggcccucucccucgcccagggccucgccuuccuccacgaggagcgcuggcagaacggccaguacaagcccggcaucgcccaccgcgaccucuccucccagaacguccucauccgcgaggacggcuccugcgccaucggcgaccucggccucgcccucguccuccccggccucacccagccccccgccuggacccccacccagccccagggccccgccgccaucauggaggccggcacccagcgcuacauggcccccgagcuccucgacaagacccucgaccuccaggacuggggcauggcccuccgccgcgccgacaucuacucccucgcccuccuccucugggagauccucucccgcugccccgaccuccgccccgccguccaccaccccuccaacuggcccaugcgccagaacugggccaucccccucccccucauguccuacggccccuggcagugccgccgcggcggcguccccaccucccacccccccggcgccgcccucccccagacccucaugggcuga

SEQ ID NO: 39667 - RNA, 1185 nt, Artificial Sequence
  derived and/or modified sequence opt2 from AMICA1__Homo_sapiens__NP_001091996
auguucugcccccucaagcucauccuccuccccguccuccucgacuacucccucggccucaacgaccucaacgucuccccccccgagcucaccguccacgucggcgacuccgcccucaugggcugcgucuuccaguccaccgaggacaagugcaucuucaagaucgacuggacccucucccccggcgagcacgccaaggacgaguacguccucuacuacuacuccaaccucuccguccccaucggccgcuuccagaaccgcguccaccucaugggcgacauccucugcaacgacggcucccuccuccuccaggacguccaggaggccgaccagggcaccuacaucugcgagauccgccucaagggcgagucccaggucuucaagaaggccgucguccuccacguccuccccgaggagcccaaggagcucaugguccacgucggcggccucauccagaugggcugcgucuuccaguccaccgaggucaagcacgucaccaaggucgaguggaucuucuccggccgccgcgccaaggaggagaucgucuuccgcuacuaccacaagcuccgcauguccgucgaguacucccaguccuggggccacuuccagaaccgcgucaaccucgucggcgacaucuuccgcaacgacggcuccaucaugcuccagggcguccgcgaguccgacggcggcaacuacaccugcuccauccaccucggcaaccucgucuucaagaagaccaucguccuccacgucucccccgaggagccccgcacccucgucacccccgccgcccuccgcccccucguccucggcggcaaccagcucgucaucaucgucggcaucgucugcgccaccauccuccuccuccccguccucauccucaucgucaagaagaccugcggcaacaaguccuccgucaacuccaccguccucgucaagaacaccaagaagaccaaccccgagaucaaggagaagcccugccacuucgagcgcugcgagggcgagaagcacaucuacucccccaucaucguccgcgaggucaucgaggaggaggagcccuccgagaaguccgaggccaccuacaugaccaugcaccccgucuggcccucccuccgcuccgaccgcaacaacucccucgagaagaaguccggcggcggcaugcccaagacccagcaggccuucuga

SEQ ID NO: 39668 - RNA, 1569 nt, Artificial Sequence
  derived and/or modified sequence opt2 from AMIGO2__Homo_sapiens__NP_862830
augucccuccgcguccacacccuccccacccuccucggcgccgucguccgccccggcugccgcgagcuccucugccuccucaugaucaccgucaccgucggccccggcgccuccggcgucugccccaccgccugcaucugcgccaccgacaucgucuccugcaccaacaagaaccucuccaagguccccggcaaccucuuccgccucaucaagcgccucgaccucuccuacaaccgcaucggccuccucgacuccgaguggauccccgucuccuucgccaagcucaacacccucauccuccgccacaacaacaucaccuccaucuccaccggcuccuucuccaccacccccaaccucaagugccucgaccucuccuccaacaagcucaagaccgucaagaacgccgucuuccaggagcucaagguccucgagguccuccuccucuacaacaaccacaucuccuaccucgaccccuccgccuucggcggccucucccagcuccagaagcucuaccucuccggcaacuuccucacccaguuccccauggaccucuacgucggccgcuucaagcucgccgagcucauguuccucgacgucuccuacaaccgcauccccuccaugcccaugcaccacaucaaccucguccccggcaagcagcuccgcggcaucuaccuccacggcaaccccuucgucugcgacugcucccucuacucccuccucgucuucugguaccgccgccacuucuccuccgucauggacuucaagaacgacuacaccugccgccucugguccgacucccgccacucccgccagguccuccuccuccaggacuccuucaugaacugcuccgacuccaucaucaacggcuccuuccgcgcccucggcuucauccacgaggcccaggucggcgagcgccucaugguccacugcgacuccaagaccggcaacgccaacaccgacuucaucugggucggccccgacaaccgccuccucgagcccgacaaggagauggagaacuucuacgucuuccacaacggcucccucgucaucgaguccccccgcuucgaggacgccggcgucuacuccugcaucgccaugaacaagcagcgccuccucaacgagaccgucgacgucaccaucaacgucuccaacuucaccgucucccgcucccacgcccacgaggccuucaacaccgccuucaccacccucgccgccugcgucgccuccaucguccucguccuccucuaccucuaccucacccccugccccugcaagugcaagaccaagcgccagaagaacaugcuccaccaguccaacgcccacuccuccauccucucccccggccccgccuccgacgccuccgccgacgagcgcaaggccggcgccggcaagcgcgucgucuuccucgagccccucaaggacaccgccgccggccagaacggcaagguccgccucuuccccuccgaggccgucaucgccgagggcauccucaaguccacccgcggcaaguccgacuccgacuccgucaacuccgucuucuccgacacccccuucgucgccuccaccuga

SEQ ID NO: 39669 - RNA, 891 nt, Artificial Sequence
  derived and/or modified sequence opt2 from AMMECR1__Homo_sapiens__NP_001020751
auggccgccggcugcugcggcgucaagaagcagaagcucuccuccuccccccccuccggcuccggcggcggcggcggcgccuccuccuccucccacugcuccggcgagucccagugccgcgccggcgagcucggccucggcggcgccggcacccgccucaacggccucggcggccucaccggcggcggcuccggcuccggcugcacccucucccccccccagggcugcggcggcggcggcggcggcaucgcccucucccccccccccuccugcggcgucggcacccuccucuccacccccgccgccgccaccuccuccucccccuccuccuccuccgccgccuccuccuccucccccggcucccgcaagauggucgucuccgccgagaugugcugcuucugcuucgacguccucuacugccaccucuacggcuaccagcagccccgcaccccccgcuucaccaacgagcccuacgcccucaaggacucccgcuucccccccaugacccgcgacgagcucccccgccucuucugcuccgucucccuccucaccaacuucgaggacgucugcgacuaccucgacugggaggucggcguccacggcauccgcaucgaguucaucaacgagaagggcuccaagcgcaccgccaccuaccuccccgaggucgccaaggagcagggcugggaccacauccagaccaucgacucccuccuccgcaagggcggcuacaaggcccccaucaccaacgaguuccgcaagaccaucaagcucacccgcuaccgcuccgagaagaugacccucuccuacgccgaguaccucgcccaccgccagcaccaccacuuccagaacggcaucggccacccccucccccccuacaaccacuacuccuga

SEQ ID NO: 39670 - RNA, 1362 nt, Artificial Sequence
  derived and/or modified sequence opt2 from AMN__Homo_sapiens__NP_112205
augggcguccucggccgcguccuccucuggcuccagcucugcgcccucacccaggccgucuccaagcucuggguccccaacaccgacuucgacgucgccgccaacuggucccagaaccgcacccccugcgccggcggcgccgucgaguuccccgccgacaagauggucuccguccucguccaggagggccacgccgucuccgacaugcuccucccccucgacggcgagcucguccucgccuccggcgccggcuucggcgucuccgacgucggcucccaccucgacugcggcgccggcgagcccgccgucuuccgcgacuccgaccgcuucuccuggcacgacccccaccucuggcgcuccggcgacgaggcccccggccucuucuucgucgacgccgagcgcguccccugccgccacgacgacgucuucuucccccccuccgccuccuuccgcgucggccucggccccggcgccucccccguccgcguccgcuccaucuccgcccucggccgcaccuucacccgcgacgaggaccucgccgucuuccucgccucccgcgccggccgccuccgcuuccacggccccggcgcccucuccgucggccccgaggacugcgccgaccccuccggcugcgucugcggcaacgccgaggcccagcccuggaucugcgccgcccuccuccagccccucggcggccgcugcccccaggccgccugccacuccgcccuccgcccccagggccagugcugcgaccucugcggcgccgucguccuccucacccacggccccgccuucgaccucgagcgcuaccgcgcccgcauccucgacaccuuccucggccucccccaguaccacggccuccaggucgccgucuccaaggucccccgcuccucccgccuccgcgaggccgacaccgagauccaggucguccucgucgagaacggccccgagaccggcggcgccggccgccucgcccgcgcccuccucgccgacgucgccgagaacggcgaggcccucggcguccucgaggccaccaugcgcgaguccggcgcccacgucuggggcuccuccgccgccggccucgccggcggcgucgccgccgccguccuccucgcccuccucguccuccucgucgcccccccccuccuccgccgcgccggccgccuccgcuggcgccgccacgaggccgccgcccccgccggcgccccccucggcuuccgcaaccccgucuucgacgucaccgccuccgaggagcucccccucccccgccgccucucccucguccccaaggccgccgccgacuccaccucccacuccuacuucgucaacccccucuucgccggcgccgaggccgaggccuga

SEQ ID NO: 39671 - RNA, 2028 nt, Artificial Sequence
  derived and/or modified sequence opt2 from AMOT__Homo_sapiens__XP_005262147
augccccgcgcccagcccuccuccgccuccuaccagcccguccccgccgaccccuucgccaucgucucccgcgcccagcagauggucgagauccucuccgacgagaaccgcaaccuccgccaggagcucgagggcugcuacgagaaggucgcccgccuccagaaggucgagaccgagauccagcgcgucuccgaggccuacgagaaccucgucaaguccuccuccaagcgcgaggcccucgagaaggccaugcgcaacaagcucgagggcgagauccgccgcaugcacgacuucaaccgcgaccuccgcgagcgccucgagaccgccaacaagcagcucgccgagaaggaguacgagggcuccgaggacacccgcaagaccaucucccagcucuucgccaagaacaaggagucccagcgcgagaaggagaagcucgaggccgagcucgccaccgcccgcuccaccaacgaggaccagcgccgccacaucgagauccgcgaccaggcccucuccaacgcccaggccaaggucgucaagcucgaggaggagcucaagaagaagcaggucuacgucgacaaggucgagaagaugcagcaggcccucguccagcuccaggccgccugcgagaagcgcgagcagcucgagcaccgccuccgcacccgccucgagcgcgagcucgagucccuccgcauccagcagcgccagggcaacugccagcccaccaacgucuccgaguacaacgccgccgcccucauggagcuccuccgcgagaaggaggagcgcauccucgcccucgaggccgacaugaccaagugggagcagaaguaccucgaggagaacgucaugcgccacuucgcccucgacgccgccgccaccgucgccgcccagcgcgacaccaccgucaucucccacucccccaacaccuccuacgacaccgcccucgaggcccgcauccagaaggaggaggaggagauccucauggccaacaagcgcugccucgacauggagggccgcaucaagacccuccacgcccagaucaucgagaaggacgccaugaucaagguccuccagcagcgcucccgcaaggagcccuccaagaccgagcagcucuccugcaugcgccccgccaagucccucauguccaucuccaacgccggcuccggccuccucucccacuccuccacccucaccggcucccccaucauggaggagaagcgcgacgacaaguccuggaagggcucccucggcauccuccucggcggcgacuaccgcgccgaguacguccccuccacccccucccccgucccccccuccaccccccuccucuccgcccacuccaagaccggcucccgcgacugcuccacccagaccgagcgcggcaccgaguccaacaagaccgccgccgucgcccccaucuccguccccgcccccgucgccgccgccgccaccgccgccgccaucaccgccaccgccgccaccaucaccaccaccauggucgccgccgcccccgucgccgucgccgccgccgccgcccccgccgccgccgccgcccccucccccgccaccgccgccgccaccgccgccgccgucucccccgccgccgccggccagauccccgccgccgccuccgucgccuccgccgccgccgucgcccccuccgccgccgccgccgccgccguccaggucgcccccgccgcccccgcccccguccccgcccccgcccucguccccguccccgcccccgccgccgcccaggccuccgcccccgcccagacccaggcccccaccuccgcccccgccgucgcccccacccccgcccccacccccacccccgccgucgcccaggccgagguccccgccucccccgccaccggccccggcccccaccgccucuccauccccucccucaccugcaaccccgacaagaccgacggccccgucuuccacuccaacacccucgagcgcaagacccccauccagauccucggccaggagcccgacgccgagauggucgaguaccucaucuga

SEQ ID NO: 39672 - RNA, 2721 nt, Artificial Sequence
  derived and/or modified sequence opt2 from AMOTL1__Homo_sapiens__NP_001287936
auguggcgcgccaagcuccgccgcggcaccugcgagcccgccgucaaggucgaggacccccucugcaacuuccacucccccaacuuccuccgcaucuccgaggucgagaugcgcggcuccgaggacgccgccgccggcaccguccuccagcgccucauccaggagcagcuccgcuacggcacccccaccgagaacaugaaccuccucgccauccagcaccaggccaccggcuccgccggccccgcccaccccaccaacaacuucuccuccaccgagaaccucacccaggaggacccccagauggucuaccaguccgcccgccaggagccccagggccaggagcaccaggucgacaacaccgucauggagaagcagguccgcuccacccagccccagcagaacaacgaggagcuccccaccuacgaggaggccaaggcccagucccaguucuuccgcggccagcagcagcagcagcagcagcagggcgccgucggccacggcuacuacauggccggcggcaccucccagaagucccgcaccgagggccgccccaccgucaaccgcgccaacuccggccaggcccacaaggacgaggcccucaaggagcucaagcagggccacguccgcucccucuccgagcgcaucaugcagcucucccucgagcgcaacggcgccaagcagcaccuccccggcuccggcaacggcaagggcuucaaggucggcggcggccccucccccgcccagcccgccggcaagguccucgacccccgcggccccccccccgaguaccccuucaagaccaagcagaugaugucccccgucuccaagacccaggagcacggccucuucuacggcgaccagcaccccggcaugcuccacgagauggucaagcccuaccccgccccccagcccguccgcaccgacgucgccguccuccgcuaccagcccccccccgaguacggcgucaccucccgccccugccagcuccccuuccccuccaccaugcagcagcacucccccauguccucccagaccuccuccgccuccggcccccuccacuccgucucccucccccucccccuccccauggcccucggcgccccccagcccccccccgccgccucccccucccagcagcucggccccgacgccuucgccaucgucgagcgcgcccagcagauggucgagauccucaccgaggagaaccgcguccuccaccaggagcuccagggcuacuacgacaacgccgacaagcuccacaaguucgagaaggagcuccagcgcaucuccgaggccuacgagucccucgucaaguccaccaccaagcgcgagucccucgacaaggccaugcgcaacaagcucgagggcgagauccgccgccuccacgacuucaaccgcgaccuccgcgaccgccucgagaccgccaaccgccagcucuccucccgcgaguacgagggccacgaggacaaggccgccgagggccacuacgccucccagaacaaggaguuccucaaggagaaggagaagcucgagauggagcucgccgccguccgcaccgccuccgaggaccaccgccgccacaucgagauccucgaccaggcccucuccaacgcccaggcccgcgucaucaagcucgaggaggagcuccgcgagaagcaggccuacgucgagaaggucgagaagcuccagcaggcccucacccagcuccaguccgccugcgagaagcgcgagcagauggagcgccgccuccgcaccuggcucgagcgcgagcucgacgcccuccgcacccagcagaagcacggcaacggccagcccgccaacaugcccgaguacaacgcccccgcccuccucgagcucguccgcgagaaggaggagcgcauccucgcccucgaggccgacaugaccaagugggagcagaaguaccucgaggaguccaccauccgccacuucgccaugaacgccgccgccaccgccgccgccgagcgcgacaccaccaucaucaaccacucccgcaacggcuccuacggcgaguccucccucgaggcccacaucuggcaggaggaggaggaggucguccaggccaaccgccgcugccaggacauggaguacaccaucaagaaccuccacgccaagaucaucgagaaggacgccaugaucaagguccuccagcagcgcucccgcaaggacgccggcaagaccgacuccuccucccuccgccccgcccgcuccguccccuccaucgccgccgccaccggcacccacucccgccagaccucccucaccuccucccagcucgccgaggagaagaaggaggagaagaccuggaagggcuccaucggccuccuccucggcaaggagcaccacgagcacgccuccgccccccuccucccccccccccccaccuccgcccucuccuccaucgccuccaccaccgccgccuccuccgcccacgccaagaccggcuccaaggacuccuccacccagaccgacaaguccgccgagcucuucuggcccuccauggccucccuccccucccgcggccgccucuccaccacccccgcccacucccccguccucaagcaccccgccgccaagggcaccgccgagaagcucgagaacucccccggccacggcaagucccccgaccaccgcggccgcgucuccucccuccuccacaagcccgaguuccccgacggcgagaugauggagguccucaucuga

SEQ ID NO: 39673 - RNA, 1785 nt, Artificial Sequence
  derived and/or modified sequence opt2 from AMPD2__Homo_sapiens__XP_011539550
augcgcaagcucacccacggcaccggcccccgcccccgcgucggcuccggccagcccuaccgcggcgucgucgccgcccacgucgccccccgcaagcgcaagaaguggcgcggcggcgucggccgccgccgccgcggccaggccggcgccggcccccgcgccgccgagcccggcgccgagcccgcccgcuucugguggggccucaccugcugcgucacccccccccaguccggccgcggcucccccacccucaacgcccagggcguccuccgcgagaucuggaccuccuucggcucccgcucccucggcuccaccuggcccaccucccucuccaucgccggccucggcggccgcgacaccggcgucgcccuccgccccguccgccucccccgcuccgccggcguccaccuccgccccgccggcaacuucgagcgccuccccuacuucccccaccucuccgcccgcgccggcgcccucggcgucaccuggcucggcuccgucgcccgcucccccugccgccccuccggccccggccucuccgccguccagaccucccgcggccagcccccccucggcacccgcgccuccuggccccaggagcucuucacccgcucccucgccgaguccgagcuccgcuccgcccccuacgaguuccccgaggagucccccaucgagcagcucgaggagcgccgccagcgccucgagcgccagaucucccaggacgucaagcucgagcccgacauccuccuccgcgccaagcaggacuuccucaagaccgacuccgacuccgaccuccagcucuacaaggagcagggcgagggccagggcgaccgcucccuccgcgagcgcgacguccucgagcgcgaguuccagcgcgucaccaucuccggcgaggagaagugcggcguccccuucaccgaccuccucgacgccgccaaguccgucguccgcgcccucuucauccgcgagaaguacauggcccucucccuccaguccuucugccccaccacccgccgcuaccuccagcagcucgccgagaagccccucgagacccgcaccuacgagcagggccccgacacccccgucuccgccgacgcccccguccacccccccgcccucgagcagcaccccuacgagcacugcgagcccuccaccaugcccggcgaccucggccucggccuccgcaugguccgcggcgucguccacgucuacacccgccgcgagcccgacgagcacugcuccgaggucgagcuccccuaccccgaccuccaggaguucgucgccgacgucaacguccucauggcccucaucaucaacggccccaucaaguccuucugcuaccgccgccuccaguaccucuccuccaaguuccagaugcacguccuccucaacgagaugaaggagcucgccgcccagaagaaggucccccaccgcgacuucuacaacauccgcaaggucgacacccacauccacgccuccuccugcaugaaccagaagcaccuccuccgcuucaucaagcgcgccaugaagcgccaccucgaggagaucguccacgucgagcagggccgcgagcagacccuccgcgaggucuucgaguccaugaaccucaccgccuacgaccucuccgucgacacccucgacguccacgccgaccgcaacaccuuccaccgcuucgacaaguucaacgccaaguacaaccccaucggcgaguccguccuccgcgagaucuucaucaagaccgacaaccgcgucuccggcaaguacuucgcccacaucaucaaguga

SEQ ID NO: 39674 - RNA, 2331 nt, Artificial Sequence
  derived and/or modified sequence opt2 from AMPD3__Homo_sapiens__NP_000471
auggcccucuccuccgagcccgccgagaugccccgccaguuccccaagcucaacaucuccgaggucgacgagcagguccgccuccucgccgagaaggucuucgccaagguccuccgcgaggaggacuccaaggacgcccucucccucuucaccguccccgaggacugccccaucggccagaaggaggccaaggagcgcgagcuccagaaggagcucgccgagcagaaguccgucgagaccgccaagcgcaagaaguccuucaagaugauccgcucccagucccucucccuccagaugcccccccagcaggacuggaagggcccccccgccgccucccccgccaugucccccaccacccccgucgucaccggcgccaccucccuccccacccccgcccccuacgccaugcccgaguuccagcgcgucaccaucuccggcgacuacugcgccggcaucacccucgaggacuacgagcaggccgccaagucccucgccaaggcccucaugauccgcgagaaguacgcccgccucgccuaccaccgcuucccccgcaucaccucccaguaccucggccacccccgcgccgacaccgccccccccgaggagggccuccccgacuuccacccccccccccucccccaggaggaccccuacugccucgacgacgccccccccaaccucgacuaccucguccacaugcagggcggcauccucuucgucuacgacaacaagaagaugcucgagcaccaggagccccacucccuccccuaccccgaccucgagaccuacaccgucgacaugucccacauccucgcccucaucaccgacggccccaccaagaccuacugccaccgccgccucaacuuccucgaguccaaguucucccuccacgagaugcucaacgagauguccgaguucaaggagcucaaguccaacccccaccgcgacuucuacaacguccgcaaggucgacacccacauccacgccgccgccugcaugaaccagaagcaccuccuccgcuucaucaagcacaccuaccagaccgagcccgaccgcaccgucgccgagaagcgcggccgcaagaucacccuccgccaggucuucgacggccuccacauggaccccuacgaccucaccgucgacucccucgacguccacgccggccgccagaccuuccaccgcuucgacaaguucaacuccaaguacaaccccgucggcgccuccgagcuccgcgaccucuaccucaagaccgagaacuaccucggcggcgaguacuucgcccgcauggucaaggaggucgcccgcgagcucgaggaguccaaguaccaguacuccgagccccgccucuccaucuacggccgcucccccgaggaguggcccaaccucgccuacugguucauccagcacaaggucuacucccccaacaugcgcuggaucauccaggucccccgcaucuacgacaucuuccgcuccaagaagcuccuccccaacuucggcaagaugcucgagaacaucuuccucccccucuucaaggccaccaucaacccccaggaccaccgcgagcuccaccucuuccucaaguacgucaccggcuucgacuccgucgacgacgaguccaagcacuccgaccacauguucuccgacaagucccccaaccccgacgucuggaccuccgagcagaacccccccuacuccuacuaccucuacuacauguacgccaacaucaugguccucaacaaccuccgccgcgagcgcggccucuccaccuuccucuuccgcccccacugcggcgaggccggcuccaucacccaccucgucuccgccuuccucaccgccgacaacaucucccacggccuccuccucaagaagucccccguccuccaguaccucuacuaccucgcccagauccccaucgccauguccccccucuccaacaacucccucuuccucgaguacuccaagaacccccuccgcgaguuccuccacaagggccuccacgucucccucuccaccgacgaccccaugcaguuccacuacaccaaggaggcccucauggaggaguacgccaucgccgcccaggucuggaagcucuccaccugcgaccucugcgagaucgcccgcaacuccguccuccaguccggccucucccaccaggagaagcagaaguuccucggccagaacuacuacaaggagggccccgagggcaacgacauccgcaagaccaacgucgcccagauccgcauggccuuccgcuacgagacccucugcaacgagcucuccuuccucuccgacgccaugaaguccgaggagaucaccgcccucaccaacuga

SEQ ID NO: 39675 - RNA, 2088 nt, Artificial Sequence
  derived and/or modified sequence opt2 from AMPH__Homo_sapiens__NP_001626
auggccgacaucaagaccggcaucuucgccaagaacguccagaagcgccucaaccgcgcccaggagaagguccuccagaagcucggcaaggccgacgagaccaaggacgagcaguucgaggaguacguccagaacuucaagcgccaggaggccgagggcacccgccuccagcgcgagcuccgcggcuaccucgccgccaucaagggcaugcaggaggccuccaugaagcucaccgagucccuccacgaggucuacgagcccgacugguacggccgcgaggacgucaagauggucggcgagaagugcgacguccucugggaggacuuccaccagaagcucgucgacggcucccuccucacccucgacaccuaccucggccaguuccccgacaucaagaaccgcaucgccaagcgcucccgcaagcucgucgacuacgacuccgcccgccaccaccucgaggcccuccaguccuccaagcgcaaggacgagucccgcaucuccaaggccgaggaggaguuccagaaggcccagaaggucuucgaggaguucaacgucgaccuccaggaggagcuccccucccucuggucccgccgcgucggcuucuacgucaacaccuucaagaacgucuccucccucgaggccaaguuccacaaggagaucgccguccucugccacaagcucuacgaggucaugaccaagcucggcgaccagcacgccgacaaggccuucaccauccagggcgcccccuccgacuccggcccccuccgcaucgccaagacccccuccccccccgaggagcccuccccccuccccucccccaccgccucccccaaccacacccucgcccccgccucccccgcccccgcccgcccccgcucccccucccagacccgcaagggcccccccguccccccccuccccaaggucacccccaccaaggagcuccagcaggagaacaucaucuccuucuucgaggacaacuucguccccgagaucuccgucaccacccccucccagaacgagguccccgaggucaagaaggaggagacccuccucgaccucgacuucgaccccuucaagcccgaggucacccccgccggcuccgccggcgucacccacucccccaugucccagacccuccccugggaccucuggaccaccuccaccgaccucguccagcccgccuccggcggcuccuucaacggcuucacccagccccaggacaccucccucuucaccaugcagaccgaccaguccaugaucugcaaccucgccgaguccgagcaggccccccccaccgagcccaaggccgaggagccccucgccgccgucacccccgccgucggccucgaccucggcauggacacccgcgccgaggagcccgucgaggaggccgucaucauccccggcgccgacgccgacgccgccgucggcacccucgucuccgccgccgagggcgcccccggcgaggaggccgaggccgagaaggccaccguccccgccggcgagggcgucucccucgaggaggccaagaucggcaccgagaccaccgagggcgccgaguccgcccagcccgaggccgaggagcucgaggccaccgucccccaggagaaggucauccccuccgucgucaucgagcccgccuccaaccacgaggaggagggcgagaacgagaucaccaucggcgccgagcccaaggagaccaccgaggacgccgccccccccggccccaccuccgagacccccgagcucgccaccgagcagaagcccauccaggacccccagcccacccccuccgcccccgccaugggcgccgccgaccagcucgccuccgcccgcgaggccucccaggagcucccccccggcuuccucuacaaggucgagacccuccacgacuucgaggccgccaacuccgacgagcucacccuccagcgcggcgacgucguccucgucguccccuccgacuccgaggccgaccaggacgccggcuggcucgucggcgucaaggaguccgacuggcuccaguaccgcgaccucgccaccuacaagggccucuuccccgagaacuucacccgccgccucgacuga

SEQ ID NO: 39676 - RNA, 1212 nt, Artificial Sequence
  derived and/or modified sequence opt2 from AMT__Homo_sapiens__NP_000472
augcagcgcgccgucuccgucgucgcccgccucggcuuccgccuccaggccuucccccccgcccucugccgcccccucuccugcgcccaggagguccuccgccgcaccccccucuacgacuuccaccucgcccacggcggcaagauggucgccuucgccggcuggucccuccccguccaguaccgcgacucccacaccgacucccaccuccacacccgccagcacugcucccucuucgacgucucccacaugcuccagaccaagauccucggcuccgaccgcgucaagcucauggagucccucgucgucggcgacaucgccgagcuccgccccaaccagggcacccucucccucuucaccaacgaggccggcggcauccucgacgaccucaucgucaccaacaccuccgagggccaccucuacgucgucuccaacgccggcugcugggagaaggaccucgcccucaugcaggacaagguccgcgagcuccagaaccagggccgcgacgucggccucgagguccucgacaacgcccuccucgcccuccagggccccaccgccgcccagguccuccaggccggcgucgccgacgaccuccgcaagcuccccuucaugaccuccgccgucauggaggucuucggcgucuccggcugccgcgucacccgcugcggcuacaccggcgaggacggcgucgagaucuccguccccgucgccggcgccguccaccucgccaccgccauccucaagaaccccgaggucaagcucgccggccucgccgcccgcgacucccuccgccucgaggccggccucugccucuacggcaacgacaucgacgagcacaccacccccgucgagggcucccucuccuggacccucggcaagcgccgccgcgccgccauggacuuccccggcgccaaggucaucgucccccagcucaagggccgcguccagcgccgccgcgucggccucaugugcgagggcgcccccaugcgcgcccacucccccauccucaacauggagggcaccaagaucggcaccgucaccuccggcugccccucccccucccucaagaagaacgucgccaugggcuacguccccugcgaguacucccgccccggcaccaugcuccucgucgagguccgccgcaagcagcagauggccgucgucuccaagaugcccuucguccccaccaacuacuacacccucaaguga

SEQ ID NO: 39677 - RNA, 1497 nt, Artificial Sequence
  derived and/or modified sequence opt2 from AMZ1__Homo_sapiens__XP_011513452
augcuccagugccgccccgcccaggaguucuccuucggcccccgcgcccucaaggacgcccucgucuccaccgacgccgcccuccagcagcucuacgucuccgccuucucccccgccgagcgccucuuccucgccgaggccuacaacccccagcgcacccucuucugcacccuccucauccgcaccggcuucgacuggcuccucucccgccccgaggcccccgaggacuuccagaccuuccacgccucccuccagcaccgcaagccccgccucgcccgcaagcacaucuaccuccagcccaucgaccucuccgaggagcccgucggcuccucccuccuccaccagcucugcuccugcaccgaggccuucuuccucggccuccgcgucaagugccuccccuccgucgccgccgccuccauccgcugcuccucccgccccucccgcgacuccgaccgccuccagcuccacaccgacggcauccucuccuuccucaagaacaacaagcccggcgacgcccucugcguccucggccucacccucuccgaccucuacccccacgaggccugguccuucaccuucuccaaguuccuccccggccacgaggucggcgucugcuccuucgcccgcuucuccggcgaguuccccaaguccggccccuccgcccccgaccucgcccucgucgaggccgccgccgacggccccgaggccccccuccaggaccgcggcugggcccucugcuucuccgcccucggcaugguccagugcugcaaggucaccugccacgagcucugccaccuccucggccucggcaacugccgcuggcuccgcugccucaugcagggcgcccucucccucgacgaggcccuccgccgcccccucgaccucugccccaucugccuccgcaagcuccagcacguccucggcuuccgccucaucgagcgcuaccagcgccucuacaccuggacccaggccgucgucggcaccuggcccucccaggaggccggcgagcccuccgucugggaggacaccccccccgccuccgccgacuccggcaugugcugcgaguccgacuccgagcccggcaccuccgucuccgagccccucacccccgacgccggcucccacaccuucgccuccggccccgaggagggccucuccuaccucgccgccuccgaggccccccucccccccggcggccccgccgaggccaucaaggagcacgagcgcuggcucgccaugugcauccaggcccuccagcgcgaggucgccgaggaggaccucguccaggucgaccgcgccgucgacgcccucgaccgcugggagauguucaccggccagcuccccgccacccgccaggacccccccuccucccgcgacuccgucggccuccgcaagguccucggcgacaaguucuccucccuccgccgcaagcucuccgcccgcaagcucgcccgcgccgaguccgccccccgccccugggacggcgaggaguccuga

SEQ ID NO: 39678 - RNA, 591 nt, Artificial Sequence
  derived and/or modified sequence opt2 from ANAPC10__Homo_sapiens__NP_001243638
augggcggcgucaaggagaccaacauccucaagaugaccacccccaacaagaccccccccggcgccgaccccaagcagcucgagcgcaccggcaccguccgcgagaucggcucccaggccgucuggucccucuccuccugcaagcccggcuucggcgucgaccagcuccgcgacgacaaccucgagaccuacuggcaguccgacggcucccagccccaccucgucaacauccaguuccgccgcaagaccaccgucaagacccucugcaucuacgccgacuacaaguccgacgaguccuacacccccuccaagaucuccguccgcgucggcaacaacuuccacaaccuccaggagauccgccagcucgagcucgucgagcccuccggcuggauccacgucccccucaccgacaaccacaagaagcccacccgcaccuucaugauccagaucgccguccucgccaaccaccagaacggccgcgacacccacaugcgccagaucaagaucuacacccccgucgaggaguccuccaucggcaaguucccccgcugcaccaccaucgacuucaugauguaccgcuccauccgcuga

SEQ ID NO: 39679 - RNA, 591 nt, Artificial Sequence
  derived and/or modified sequence opt2 from ANAPC11__Homo_sapiens__NP_001002244
augaaggucaagaucaagugcuggaacggcgucgccaccuggcucugggucgccaacgacgagaacugcggcaucugccgcauggccuucaacggcugcugccccgacugcccccuccacggcgaguccaucucccgcugccucggcuggugcccccagcccguccccguccucggcggccgcgcccacccccagguccccaucaacaccgccucccccacccccggccagcacaccggcucccucaugucccgcgaggaguccucccgcucccccgaccccaccccccccgcccucgaccaggagaccuccucccuccuccgcugcaccucccccuggugccucgaccacuccugcgaccucuucggcaucaccgaccaggucuccgccgacggcccccgcgccugccgccagggcgcccgccgccgccuccccgccggcgucggccccguccucccccuccucccccacgcccuccacccccaggucgccgcccgcaccgccggcgccgccgcccucccccacgucccccccggcauggagguccagggcguccgccccgaccucgcccucgccggcggcgccuccuga

SEQ ID NO: 39680 - RNA, 225 nt, Artificial Sequence
  derived and/or modified sequence opt2 from ANAPC13__Homo_sapiens__NP_001229304
auggacuccgagguccagcgcgacggccgcauccucgaccucaucgacgacgccuggcgcgaggacaagcuccccuacgaggacgucgccaucccccucaacgagcuccccgagcccgagcaggacaacggcggcaccaccgaguccgucaaggagcaggagaugaaguggaccgaccucgcccuccaguaccuccacgagaacgucccccccaucggcaacuga

SEQ ID NO: 39681 - RNA, 5835 nt, Artificial Sequence
  derived and/or modified sequence opt2 from ANAPC1__Homo_sapiens__NP_073153
auguccaacuucuacgaggagcgcaccaccaugaucgccgcccgcgaccuccaggaguucguccccuucggccgcgaccacugcaagcaccaccccaacgcccucaaccuccagcuccgccagcuccagcccgccuccgagcucugguccuccgacggcgccgccggccucgucggcucccuccaggaggucaccauccacgagaagcagaaggaguccuggcagcuccgcaagggcgucuccgagaucggcgaggacgucgacuacgacgaggagcucuacgucgccggcaacauggucaucugguccaagggcuccaagucccaggcccucgccgucuacaaggccuucaccgucgacucccccguccagcaggcccucuggugcgacuucaucaucucccaggacaaguccgagaaggccuacuccuccaacgaggucgagaagugcaucugcauccuccaguccuccugcaucaacaugcacuccaucgagggcaaggacuacaucgccucccuccccuuccaggucgccaacgucuggcccaccaaguacggccuccucuucgagcgcuccgccuccucccacgaggucccccccggcuccccccgcgagccccuccccaccauguucuccaugcuccacccccucgacgagaucaccccccucgucugcaaguccggcucccucuucggcuccucccgcguccaguacgucgucgaccacgccaugaagaucgucuuccucaacaccgaccccuccaucgucaugaccuacgacgccguccagaacguccacuccgucuggacccuccgccgcgucaaguccgaggaggagaacgucguccucaaguucuccgagcagggcggcaccccccagaacgucgccaccuccuccucccucaccgcccaccuccgcucccucuccaagggcgacucccccgucaccucccccuuccagaacuacuccuccauccacucccagucccgcuccaccuccucccccucccuccacucccgcucccccuccaucuccaacauggccgcccucucccgcgcccacucccccgcccucggcguccacuccuucuccggcguccagcgcuucaacaucuccucccacaaccagucccccaagcgccacuccaucucccacucccccaacuccaacuccaacggcuccuuccucgcccccgagaccgagcccaucguccccgagcucugcaucgaccaccucuggaccgagaccaucaccaacauccgcgagaagaacucccaggccuccaaggucuucaucaccuccgaccucugcggccagaaguuccucugcuuccucgucgagucccagcuccagcuccgcugcgucaaguuccaggaguccaacgacaagacccagcucaucuucggcuccgucaccaacauccccgccaaggacgccgcccccgucgagaagaucgacaccaugcucguccucgagggcuccggcaaccucguccucuacaccggcgucguccgcgucggcaaggucuucauccccggccuccccgcccccucccucaccauguccaacaccaugccccgccccuccaccccccucgacggcgucuccacccccaagccccucuccaagcuccucggcucccucgacgaggucguccuccucucccccguccccgagcuccgcgacuccuccaagcuccacgacucccucuacaacgaggacugcaccuuccagcagcucggcaccuacauccacuccauccgcgaccccguccacaaccgcgucacccucgagcucuccaacggcuccaugguccgcaucaccauccccgagaucgccaccuccgagcucguccagaccugccuccaggccaucaaguucauccuccccaaggagaucgccguccagaugcucgucaagugguacaacguccacuccgcccccggcggccccuccuaccacuccgaguggaaccucuucgucaccugccucaugaacaugaugggcuacaacaccgaccgccucgccuggacccgcaacuucgacuucgagggcucccucucccccgucaucgcccccaagaaggcccgccccuccgagaccggcuccgacgacgacugggaguaccuccucaacuccgacuaccaccagaacgucgagucccaccuccucaaccgcucccucugccucucccccuccgaggccucccagaugaaggacgaggacuucucccagaaccucucccucgacuccuccacccuccucuucacccacauccccgccaucuucuucguccuccaccucgucuacgaggagcucaagcucaacacccucaugggcgagggcaucugcucccucgucgagcuccucguccagcucgcccgcgaccucaagcucggccccuacgucgaccacuacuaccgcgacuaccccacccucguccgcaccaccggccaggucugcaccaucgaccccggccagaccggcuucaugcaccaccccuccuucuucaccuccgagccccccuccaucuaccagugggucuccuccugccucaagggcgagggcaugccccccuaccccuaccuccccggcaucugcgagcgcucccgccucgucguccucuccaucgcccucuacauccucggcgacgagucccucgucuccgacgaguccucccaguaccucacccgcaucaccaucgccccccagaagcuccaggucgagcaggaggagaaccgcuucuccuuccgccacuccaccuccgucuccucccucgccgagcgccucgucgucuggaugaccaacgucggcuucacccuccgcgaccucgagacccuccccuucggcaucgcccuccccauccgcgacgccaucuaccacugccgcgagcagcccgccuccgacuggcccgaggccgucugccuccucaucggccgccaggaccucuccaagcaggccugcgagggcaaccuccccaagggcaaguccguccucuccuccgacguccccuccggcaccgagaccgaggaggaggacgacggcaugaacgacaugaaccacgaggucaugucccucaucugguccgaggaccuccgcguccaggacguccgccgccuccuccaguccgcccaccccguccgcgucaacgucguccaguaccccgagcucuccgaccacgaguucaucgaggagaaggagaaccgccuccuccagcucugccagcgcaccauggcccuccccgucggccgcggcauguucacccucuucuccuaccaccccguccccaccgagccccuccccauccccaagcucaaccucaccggccgcgcccccccccgcaacaccaccgucgaccucaacuccggcaacaucgacgucccccccaacaugaccuccugggccuccuuccacaacggcgucgccgccggccucaagaucgcccccgccucccagaucgacuccgccuggaucgucuacaacaagcccaagcacgccgagcucgccaacgaguacgccggcuuccucauggcccucggccucaacggccaccucaccaagcucgccacccucaacauccacgacuaccucaccaagggccacgagaugaccuccaucggccuccuccucggcgucuccgccgccaagcucggcaccauggacauguccaucacccgccuccucuccauccacauccccgcccuccucccccccaccuccaccgagcucgacgucccccacaacguccaggucgccgccgucgucggcaucggccucgucuaccagggcaccgcccaccgccacaccgccgagguccuccucgccgagaucggccgcccccccggccccgagauggaguacugcaccgaccgcgaguccuacucccucgccgccggccucgcccucggcauggucugccucggccacggcuccaaccucaucggcauguccgaccucaacguccccgagcagcucuaccaguacauggucggcggccaccgccgcuuccagaccggcaugcaccgcgagaagcacaagucccccuccuaccagaucaaggagggcgacaccaucaacgucgacgucaccugccccggcgccacccucgcccucgccaugaucuaccucaagaccaacaaccgcuccaucgccgacuggcuccgcgcccccgacaccauguaccuccucgacuucgucaagcccgaguuccuccuccuccgcacccucgcccgcugccucauccucugggacgacauccuccccaacuccaagugggucgacuccaacgucccccagaucauccgcgagaacuccaucucccucuccgagaucgagcuccccugcuccgaggaccucaaccucgagacccucucccaggcccacgucuacaucaucgccggcgccugccucucccucggcuuccgcuucgccggcuccgagaaccucuccgccuucaacugccuccacaaguucgccaaggacuucaugaccuaccucuccgcccccaacgccuccgucaccggcccccacaaccucgagaccugccucuccgucguccuccucucccucgccauggucauggccggcuccggcaaccucaagguccuccagcucugccgcuuccuccacaugaagaccggcggcgagaugaacuacggcuuccaccucgcccaccacauggcccucggccuccucuuccucggcggcggccgcuacucccucuccaccuccaacuccuccaucgccgcccuccucugcgcccucuacccccacuuccccgcccacuccaccgacaaccgcuaccaccuccaggcccuccgccaccucuacguccucgccgccgagccccgccuccucguccccgucgacgucgacaccaacacccccugcuacgcccuccucgaggucaccuacaagggcacccagugguacgagcagaccaaggaggagcucauggcccccacccuccuccccgagcuccaccuccucaagcagaucaaggucaagggcccccgcuacugggagcuccucaucgaccucuccaagggcacccagcaccucaaguccauccucuccaaggacggcguccucuacgucaagcuccgcgccggccagcucuccuacaaggaggaccccaugggcuggcagucccuccucgcccagaccgucgccaaccgcaacuccgaggcccgcgccuucaagcccgagaccaucuccgccuucaccuccgaccccgcccuccucuccuucgccgaguacuucugcaagcccaccgucaacaugggccagaagcaggagauccucgaccucuucuccuccguccucuacgagugcgucacccaggagacccccgagaugcuccccgccuacaucgccauggaccaggccauccgccgccucggccgccgcgagauguccgagaccuccgagcucuggcagaucaagcucguccucgaguucuucuccucccgcucccaccaggagcgccuccagaaccaccccaagcgcggccucuucaugaacuccgaguuccuccccgucgucaagugcaccaucgacaacacccucgaccaguggcuccaggucggcggcgacaugugcguccacgccuaccucuccggccagccccucgaggagucccagcucuccaugcucgccugcuuccucgucuaccacuccguccccgccccccagcaccucccccccaucggccucgagggcuccaccuccuucgccgagcuccucuucaaguucaagcagcucaagaugcccguccgcgcccuccuccgccucgccccccuccuccucggcaacccccagcccauggucauguga

SEQ ID NO: 39682 - RNA, 2469 nt, Artificial Sequence
  derived and/or modified sequence opt2 from ANAPC2__Homo_sapiens__NP_037498
auggccgccgccgucgucgucgccgagggcgacuccgacucccgccccggccaggagcuccucgucgccuggaacaccgucuccaccggccucgucccccccgccgcccucggccucgucuccucccgcaccuccggcgccgucccccccaaggaggaggagcuccgcgccgccgucgagguccuccgcggccacggccuccacuccguccucgaggagugguucgucgagguccuccagaacgaccuccaggccaacaucucccccgaguucuggaacgccaucucccagugcgagaacuccgccgacgagccccagugccuccuccuccuccucgacgccuucggccuccucgagucccgccucgaccccuaccuccgcucccucgagcuccucgagaaguggacccgccucggccuccucaugggcaccggcgcccagggccuccgcgaggagguccacaccaugcuccgcggcguccucuucuucuccaccccccgcaccuuccaggagaugauccagcgccucuacggcugcuuccuccgcgucuacaugcaguccaagcgcaagggcgagggcggcaccgaccccgagcucgagggcgagcucgacucccgcuacgcccgccgccgcuacuaccgccuccuccaguccccccucugcgccggcugcuccuccgacaagcagcagugcuggugccgccaggcccucgagcaguuccaccagcucucccagguccuccaccgccucucccuccucgagcgcgucuccgccgaggccgucaccaccacccuccaccaggucacccgcgagcgcauggaggaccgcugccgcggcgaguacgagcgcuccuuccuccgcgaguuccacaaguggaucgagcgcgucgucggcuggcucggcaaggucuuccuccaggacggccccgcccgccccgccucccccgaggccggcaacacccuccgccgcuggcgcugccacguccagcgcuucuucuaccgcaucuacgccucccuccgcaucgaggagcucuucuccaucguccgcgacuuccccgacucccgccccgccaucgaggaccucaaguacugccucgagcgcaccgaccagcgccagcagcuccucgucucccucaaggccgcccucgagacccgccuccuccaccccggcgucaacaccugcgacaucaucacccucuacaucuccgccaucaaggcccuccgcguccucgaccccuccauggucauccucgaggucgccugcgagcccauccgccgcuaccuccgcacccgcgaggacaccguccgccagaucgucgccggccucaccggcgacuccgacggcaccggcgaccucgccgucgagcucuccaagaccgaccccgccucccucgagaccggccaggacuccgaggacgacuccggcgagcccgaggacuggguccccgaccccgucgacgccgaccccggcaaguccuccuccaagcgccgcuccuccgacaucaucucccuccucgucuccaucuacggcuccaaggaccucuucaucaacgaguaccgcucccuccucgccgaccgccuccuccaccaguucuccuucucccccgagcgcgagauccgcaacgucgagcuccucaagcuccgcuucggcgaggcccccaugcacuucugcgaggucaugcucaaggacauggccgacucccgccgcaucaacgccaacauccgcgaggaggacgagaagcgccccgccgaggagcagccccccuucggcgucuacgccgucauccucuccuccgaguucuggccccccuucaaggacgagaagcucgagguccccgaggacauccgcgccgcccucgaggccuacugcaagaaguacgagcagcucaaggccaugcgcacccucuccuggaagcacacccucggccucgucaccauggacgucgagcucgccgaccgcacccucuccgucgccgucacccccguccaggccgucauccuccucuacuuccaggaccaggccuccuggacccucgaggagcucuccaaggccgucaagaugcccgucgcccuccuccgccgccgcauguccgucuggcuccagcagggcguccuccgcgaggagccccccggcaccuucuccgucaucgaggaggagcgcccccaggaccgcgacaacaugguccucaucgacuccgacgacgaguccgacuccggcauggccucccaggccgaccagaaggaggaggagcuccuccucuucuggaccuacauccaggccaugcucaccaaccucgagucccucucccucgaccgcaucuacaacaugcuccgcauguucgucgucaccggccccgcccucgccgagaucgaccuccaggagcuccagggcuaccuccagaagaagguccgcgaccagcagcucgucuacuccgccggcgucuaccgccuccccaagaacugcuccuga

SEQ ID NO: 39683 - RNA, 2430 nt, Artificial Sequence
  derived and/or modified sequence opt2 from ANAPC4__Homo_sapiens__NP_001273685
augcuccgcuuccccaccugcuuccccuccuuccgcgucgucggcgagaagcagcucccccaggagaucaucuuccucgucuggucccccaagcgcgaccucaucgcccucgccaacaccgccggcgagguccuccuccaccgccucgccuccuuccaccgcgucugguccuucccccccaacgagaacaccggcaaggaggucaccugccucgccuggcgccccgacggcaagcuccucgccuucgcccucgccgacaccaagaagaucguccucugcgacgucgagaagcccgagucccuccacuccuucuccgucgaggcccccgucuccugcaugcacuggauggaggucaccgucgaguccuccguccucaccuccuucuacaacgccgaggacgaguccaaccuccuccuccccaagcuccccacccuccccaagaacuacuccaacaccuccaagaucuucuccgaggagaacuccgacgagaucaucaagcuccucggcgacguccgccucaacauccucguccucggcggcuccuccggcuucaucgagcucuacgccuacggcauguucaagaucgcccgcgucaccggcaucgccggcaccugccucgcccucugccucuccuccgaccucaagucccucuccgucgucaccgaggucuccaccaacggcgccuccgaggucuccuacuuccagcucgagaccaaccuccucuacuccuuccuccccgaggucacccgcauggcccgcaaguucacccacaucuccgcccuccuccaguacaucaaccucucccucaccugcaugugcgaggccugggaggagauccucaugcagauggacucccgccucaccaaguucguccaggagaagaacaccaccaccuccguccaggacgaguucaugcaccuccuccucuggggcaaggccuccgccgagcuccagacccuccucaugaaccagcucaccgucaagggccucaagaagcucggccaguccaucgaguccuccuacuccuccauccagaagcucgucaucucccaccuccaguccggcuccgagucccuccucuaccaccucuccgagcucaagggcauggccuccuggaagcagaaguacgagccccucggccucgacgccgccggcaucgaggaggccaucaccgccgucggcuccuucauccucaaggccaacgagcuccuccaggucaucgacuccuccaugaagaacuucaaggccuucuuccgcuggcucuacgucgccaugcuccgcaugaccgaggaccacguccuccccgagcucaacaaggucaugacccagaaggacaucaccuucgucgccgaguuccucaccgagcacuucaacgaggcccccgaccucuacaaccgcaagggcaaguacuucaacgucgagcgcgucggccaguaccucaaggacgaggacgacgaccucgucuccccccccaacaccgagggcaaccagugguacgacuuccuccagaacuccucccaccucaaggaguccccccuccucuuccccuacuacccccgcaagucccuccacuucgucaagcgccgcauggagaacaucaucgaccagugccuccagaagcccgccgacgucaucggcaaguccaugaaccaggccaucugcaucccccucuaccgcgacacccgcuccgaggacuccacccgccgccucuucaaguuccccuuccucuggaacaacaagaccuccaaccuccacuaccuccucuucaccauccucgaggacucccucuacaagaugugcauccuccgccgccacaccgacaucucccaguccgucuccaacggccucaucgccaucaaguucggcuccuucaccuacgccaccaccgagaagguccgccgcuccaucuacuccugccucgacgcccaguucuacgacgacgagaccgucaccgucguccucaaggacaccgucggccgcgagggccgcgaccgccuccucguccagcucccccucucccucgucuacaacuccgaggacuccgccgaguaccaguucaccggcaccuacuccacccgccucgacgagcagugcuccgccauccccacccgcaccaugcacuucgagaagcacuggcgccuccucgaguccaugaaggcccaguacgucgccggcaacggcuuccgcaaggucuccugcguccucuccuccaaccuccgccacguccgcgucuucgagauggacaucgacgacgagugggagcucgacgaguccuccgacgaggaggaggaggccuccaacaagcccgucaagaucaaggaggagguccucuccgaguccgaggccgagaaccagcaggccggcgccgccgcccucgcccccgagaucgucaucaaggucgagaagcucgaccccgagcucgacuccuga

SEQ ID NO: 39684 - RNA, 1932 nt, Artificial Sequence
  derived and/or modified sequence opt2 from ANAPC5__Homo_sapiens__NP_001131031
auggccgagggcgagcucaaggacauggagcaguucuucgacgaccucuccgacuccuucuccggcaccgagcccgagguccacaagaccuccgucgucggccucuuccuccgccacaugauccucgccuacuccaagcucuccuucucccaggucuucaagcucuacaccgcccuccagcaguacuuccagaacggcgagaagaagaccgucgaggacgccgacauggagcucaccucccgcgacgagggcgagcgcaagauggagaaggaggagcucgacgucuccguccgcgaggaggaggucuccugcuccggcccccucucccagaagcaggccgaguucuuccucucccagcaggccucccuccucaagaacgacgagaccaaggcccucacccccgccucccuccagaaggagcucaacaaccuccucaaguucaaccccgacuucgccgaggcccacuaccucuccuaccucaacaaccuccgcguccaggacgucuucuccuccacccacucccuccuccacuacuucgaccgccucauccucaccggcgccgaguccaaguccaacggcgaggagggcuacggccgcucccuccgcuacgccgcccucaaccucgccgcccuccacugccgcuucggccacuaccagcaggccgagcucgcccuccaggaggccauccgcaucgcccaggaguccaacgaccacgucugccuccagcacugccucuccuggcucuacguccucggccagaagcgcuccgacuccuacguccuccucgagcacuccgucaagaaggccguccacuucggccucccccgcgccuucgccggcaagaccgccaacaagcucauggacgcccucaaggacuccgaccuccuccacuggaagcacucccucuccgagcucaucgacaucuccaucgcccagaagaccgccaucuggcgccucuacggccgcuccaccauggcccuccagcaggcccagaugcuccucuccaugaacucccucgaggccgucaacgccggcguccagcagaacaacaccgaguccuucgccgucgcccucugccaccucgccgagcuccacgccgagcagggcugcuucgccgccgccuccgagguccucaagcaccucaaggagcgcuucccccccaacucccagcacgcccagcucuggaugcucugcgaccagaagauccaguucgaccgcgccaugaacgacggcaaguaccaccucgccgacucccucgucaccggcaucaccgcccucaacuccaucgagggcgucuaccgcaaggccgucguccuccaggcccagaaccagauguccgaggcccacaagcuccuccagaagcuccucguccacugccagaagcucaagaacaccgagauggucaucuccguccuccucuccgucgccgagcucuacuggcgcuccuccucccccaccaucgcccuccccaugcuccuccaggcccucgcccucuccaaggaguaccgccuccaguaccucgccuccgagaccguccucaaccucgccuucgcccagcucauccucggcauccccgagcaggcccucucccuccuccacauggccaucgagcccauccucgccgacggcgccauccucgacaagggccgcgccauguuccucgucgccaagugccaggucgccuccgccgccuccuacgaccagcccaagaaggccgaggcccucgaggccgccaucgagaaccucaacgaggccaagaacuacuucgccaaggucgacugcaaggagcgcauccgcgacgucgucuacuuccaggcccgccucuaccacacccucggcaagacccaggagcgcaaccgcugcgccaugcucuuccgccagcuccaccaggagcuccccucccacggcgucccccucaucaaccaccucuga

SEQ ID NO: 39685 - RNA, 1614 nt, Artificial Sequence
  derived and/or modified sequence opt2 from ANAPC7__Homo_sapiens__NP_001131136
auggaccccggcgacgccgccauccucgaguccucccuccgcauccucuaccgccucuucgaguccguccuccccccccuccccgccgcccuccagucccgcaugaacgucaucgaccacguccgcgacauggccgccgccggccuccacuccaacguccgccuccucuccucccuccuccucaccauguccaacaacaaccccgagcucuucucccccccccagaaguaccagcuccucgucuaccacgccgacucccucuuccacgacaaggaguaccgcaacgccgucuccaaguacaccauggcccuccagcagaagaaggcccucuccaagaccuccaagguccgccccuccaccggcaacuccgccuccaccccccagucccagugccuccccuccgagaucgaggucaaguacaagauggccgagugcuacaccaugcucaagcaggacaaggacgccaucgccauccucgacggcauccccucccgccagcgcacccccaagaucaacaugaugcucgccaaccucuacaagaaggccggccaggagcgccccuccgucaccuccuacaaggagguccuccgccagugcccccucgcccucgacgccauccucggccuccucucccucuccgucaagggcgccgaggucgccuccaugaccaugaacgucauccagaccguccccaaccucgacuggcucuccgucuggaucaaggccuacgccuucguccacaccggcgacaacucccgcgccaucuccaccaucugcucccucgagaagaagucccuccuccgcgacaacgucgaccuccucggcucccucgccgaccucuacuuccgcgccggcgacaacaagaacuccguccucaaguucgagcaggcccagaugcucgaccccuaccucaucaagggcauggacgucuacggcuaccuccucgcccgcgagggccgccucgaggacgucgagaaccucggcugccgccucuucaacaucuccgaccagcacgccgagcccugggucgucuccggcugccacuccuucuacuccaagcgcuacucccgcgcccucuaccucggcgccaaggccauccagcucaacuccaacuccguccaggcccuccuccucaagggcgccgcccuccgcaacaugggccgcguccaggaggccaucauccacuuccgcgaggccauccgccucgcccccugccgccucgacugcuacgagggccucaucgagugcuaccucgccuccaacuccauccgcgaggccauggucauggccaacaacgucuacaagacccucggcgccaacgcccagacccucacccuccucgccaccgucugccucgaggaccccgucacccaggagaaggccaagacccuccucgacaaggcccucacccagcgccccgacuacaucaaggccgucgucaagaaggccgagcuccucucccgcgagcagaaguacgaggacggcaucgcccuccuccgcaacgcccucgccaaccaguccgacugcguccuccaccgcauccucggcgacuuccucgucgccgucaacgaguaccaggaggccauggaccaguacuccaucgcccuccgcuga

SEQ ID NO: 39686 - RNA, 444 nt, Artificial Sequence
  derived and/or modified sequence opt2 from ANG__Homo_sapiens__NP_001091046
auggucaugggccucggcguccuccuccucgucuucguccucggccucggccucaccccccccacccucgcccaggacaacucccgcuacacccacuuccucacccagcacuacgacgccaagccccagggccgcgacgaccgcuacugcgaguccaucaugcgccgccgcggccucaccucccccugcaaggacaucaacaccuucauccacggcaacaagcgcuccaucaaggccaucugcgagaacaagaacggcaacccccaccgcgagaaccuccgcaucuccaaguccuccuuccaggucaccaccugcaagcuccacggcggcucccccuggccccccugccaguaccgcgccaccgccggcuuccgcaacgucgucgucgccugcgagaacggccuccccguccaccucgaccaguccaucuuccgccgccccuga

SEQ ID NO: 39687 - RNA, 1497 nt, Artificial Sequence
  derived and/or modified sequence opt2 from ANGPT1__Homo_sapiens__NP_001137
augaccgucuuccucuccuucgccuuccucgccgccauccucacccacaucggcugcuccaaccagcgccgcucccccgagaacuccggccgccgcuacaaccgcauccagcacggccagugcgccuacaccuucauccuccccgagcacgacggcaacugccgcgaguccaccaccgaccaguacaacaccaacgcccuccagcgcgacgccccccacgucgagcccgacuucuccucccagaagcuccagcaccucgagcacgucauggagaacuacacccaguggcuccagaagcucgagaacuacaucgucgagaacaugaaguccgagauggcccagauccagcagaacgccguccagaaccacaccgccaccaugcucgagaucggcaccucccuccucucccagaccgccgagcagacccgcaagcucaccgacgucgagacccagguccucaaccagaccucccgccucgagauccagcuccucgagaacucccucuccaccuacaagcucgagaagcagcuccuccagcagaccaacgagauccucaagauccacgagaagaacucccuccucgagcacaagauccucgagauggagggcaagcacaaggaggagcucgacacccucaaggaggagaaggagaaccuccagggccucgucacccgccagaccuacaucauccaggagcucgagaagcagcucaaccgcgccaccaccaacaacuccguccuccagaagcagcagcucgagcucauggacaccguccacaaccucgucaaccucugcaccaaggagggcguccuccucaagggcggcaagcgcgaggaggagaagcccuuccgcgacugcgccgacgucuaccaggccggcuucaacaaguccggcaucuacaccaucuacaucaacaacaugcccgagcccaagaaggucuucugcaacauggacgucaacggcggcggcuggaccgucauccagcaccgcgaggacggcucccucgacuuccagcgcggcuggaaggaguacaagaugggcuucggcaaccccuccggcgaguacuggcucggcaacgaguucaucuucgccaucaccucccagcgccaguacaugcuccgcaucgagcucauggacugggagggcaaccgcgccuacucccaguacgaccgcuuccacaucggcaacgagaagcagaacuaccgccucuaccucaagggccacaccggcaccgccggcaagcaguccucccucauccuccacggcgccgacuucuccaccaaggacgccgacaacgacaacugcaugugcaagugcgcccucaugcucaccggcggcuggugguucgacgccugcggccccuccaaccucaacggcauguucuacaccgccggccagaaccacggcaagcucaacggcaucaaguggcacuacuucaagggccccuccuacucccuccgcuccaccaccaugaugauccgcccccucgacuucuga

SEQ ID NO: 39688 - RNA, 1488 nt, Artificial Sequence
  derived and/or modified sequence opt2 from ANGPT2__Homo_sapiens__NP_001112359
auguggcagaucgucuucuucacccucuccugcgaccucguccucgccgccgccuacaacaacuuccgcaaguccauggacuccaucggcaagaagcaguaccagguccagcacggcuccugcuccuacaccuuccuccuccccgagauggacaacugccgcuccuccuccucccccuacgucuccaacgccguccagcgcgacgccccccucgaguacgacgacuccguccagcgccuccagguccucgagaacaucauggagaacaacacccaguggcucaugaagcucgagaacuacauccaggacaacaugaagaaggagauggucgagauccagcagaacgccguccagaaccagaccgccgucaugaucgagaucggcaccaaccuccucaaccagaccgccgagcagacccgcaagcucaccgacgucgaggcccagguccucaaccagaccacccgccucgagcuccagcuccucgagcacucccucuccaccaacaagcucgagaagcagauccucgaccagaccuccgagaucaacaagcuccaggacaagaacuccuuccucgagaagaagguccucgccauggaggacaagcacaucauccagcuccaguccaucaaggaggagaaggaccagcuccagguccucgucuccaagcagaacuccaucaucgaggagcucgagaagaagaucgucaccgccaccgucaacaacuccguccuccagaagcagcagcacgaccucauggagaccgucaacaaccuccucaccaugauguccaccuccaacuccaaggaccccaccgucgccaaggaggagcagaucuccuuccgcgacugcgccgaggucuucaaguccggccacaccaccaacggcaucuacacccucaccuuccccaacuccaccgaggagaucaaggccuacugcgacauggaggccggcggcggcggcuggaccaucauccagcgccgcgaggacggcuccgucgacuuccagcgcaccuggaaggaguacaaggucggcuucggcaaccccuccggcgaguacuggcucggcaacgaguucgucucccagcucaccaaccagcagcgcuacguccucaagauccaccucaaggacugggagggcaacgaggccuacucccucuacgagcacuucuaccucuccuccgaggagcucaacuaccgcauccaccucaagggccucaccggcaccgccggcaagaucuccuccaucucccagcccggcaacgacuucuccaccaaggacggcgacaacgacaagugcaucugcaagugcucccagaugcucaccggcggcuggugguucgacgccugcggccccuccaaccucaacggcauguacuacccccagcgccagaacaccaacaaguucaacggcaucaagugguacuacuggaagggcuccggcuacucccucaaggccaccaccaugaugauccgccccgccgacuucuga

SEQ ID NO: 39689 - RNA, 1512 nt, Artificial Sequence
  derived and/or modified sequence opt2 from ANGPT4__Homo_sapiens__NP_057069
augcucucccagcucgccaugcuccagggcucccuccuccucgucgucgccaccauguccgucgcccagcagacccgccaggaggccgaccgcggcugcgagacccucgucguccagcacggccacugcuccuacaccuuccuccuccccaaguccgagcccugcccccccggccccgaggucucccgcgacuccaacacccuccagcgcgagucccucgccaacccccuccaccucggcaagcuccccacccagcaggucaagcagcucgagcaggcccuccagaacaacacccaguggcucaagaagcucgagcgcgccaucaagaccauccuccgcuccaagcucgagcagguccagcagcagauggcccagaaccagaccgcccccaugcucgagcucggcaccucccuccucaaccagaccaccgcccagauccgcaagcucaccgacauggaggcccagcuccucaaccagaccucccgcauggacgcccagaugcccgagaccuuccucuccaccaacaagcucgagaaccagcuccuccuccagcgccagaagcuccagcagcuccagggccagaacuccgcccucgagaagcgccuccaggcccucgagaccaagcagcaggaggagcucgccuccauccucuccaagaaggccaagcuccucaacacccucucccgccaguccgccgcccucaccaacaucgagcgcggccuccgcggcguccgccacaacuccucccuccuccaggaccagcagcacucccuccgccagcuccucguccuccuccgccaccucguccaggagcgcgccaacgccuccgcccccgccuucaucauggccggcgagcaggucuuccaggacugcgccgagauccagcgcuccggcgccuccgccuccggcgucuacaccauccaggucuccaacgccaccaagccccgcaaggucuucugcgaccuccaguccuccggcggccgcuggacccucauccagcgccgcgagaacggcaccgucaacuuccagcgcaacuggaaggacuacaagcagggcuucggcgaccccgccggcgagcacuggcucggcaacgaggucguccaccagcucacccgccgcgccgccuacucccuccgcgucgagcuccaggacugggagggccacgaggccuacgcccaguacgagcacuuccaccucggcuccgagaaccagcucuaccgccucuccgucgucggcuacuccggcuccgccggccgccaguccucccucguccuccagaacaccuccuucuccacccucgacuccgacaacgaccacugccucugcaagugcgcccaggucauguccggcggcuggugguucgacgccugcggccucuccaaccucaacggcgucuacuaccacgcccccgacaacaaguacaagauggacggcauccgcuggcacuacuucaagggccccuccuacucccuccgcgccucccgcaugaugauccgcccccucgacaucuga

SEQ ID NO: 39690 - RNA, 1476 nt, Artificial Sequence
  derived and/or modified sequence opt2 from ANGPTL1__Homo_sapiens__NP_004664
augaagaccuucaccuggacccucggcguccucuucuuccuccucgucgacaccggccacugccgcggcggccaguucaagaucaagaagaucaaccagcgccgcuacccccgcgccaccgacggcaaggaggaggccaagaagugcgccuacaccuuccucguccccgagcagcgcaucaccggccccaucugcgucaacaccaagggccaggacgccuccaccaucaaggacaugaucacccgcauggaccucgagaaccucaaggacguccucucccgccagaagcgcgagaucgacguccuccagcucgucgucgacgucgacggcaacaucgucaacgaggucaagcuccuccgcaaggagucccgcaacaugaacucccgcgucacccagcucuacaugcagcuccuccacgagaucauccgcaagcgcgacaacucccucgagcucucccagcucgagaacaagauccucaacgucaccaccgagaugcucaagauggccacccgcuaccgcgagcucgaggucaaguacgccucccucaccgaccucgucaacaaccaguccgucaugaucacccuccucgaggagcagugccuccgcaucuucucccgccaggacacccacgucucccccccccucguccaggucgucccccagcacauccccaacucccagcaguacacccccggccuccucggcggcaacgagauccagcgcgaccccggcuacccccgcgaccucaugcccccccccgaccucgccaccucccccaccaagucccccuucaagaucccccccgucaccuucaucaacgagggccccuucaaggacugccagcaggccaaggaggccggccacuccgucuccggcaucuacaugaucaagcccgagaacuccaacggccccaugcagcucuggugcgagaacucccucgaccccggcggcuggaccgucauccagaagcgcaccgacggcuccgucaacuucuuccgcaacugggagaacuacaagaagggcuucggcaacaucgacggcgaguacuggcucggccucgagaacaucuacaugcucuccaaccaggacaacuacaagcuccucaucgagcucgaggacugguccgacaagaaggucuacgccgaguacuccuccuuccgccucgagcccgaguccgaguucuaccgccuccgccucggcaccuaccagggcaacgccggcgacuccaugauguggcacaacggcaagcaguucaccacccucgaccgcgacaaggacauguacgccggcaacugcgcccacuuccacaagggcggcuggugguacaacgccugcgcccacuccaaccucaacggcgucugguaccgcggcggccacuaccgcuccaagcaccaggacggcaucuucugggccgaguaccgcggcggcuccuacucccuccgcgccguccagaugaugaucaagcccaucgacuga

SEQ ID NO: 39691 - RNA, 1482 nt, Artificial Sequence
  derived and/or modified sequence opt2 from ANGPTL2__Homo_sapiens__NP_036230
augcgcccccucugcgucaccugcugguggcucggccuccucgccgccaugggcgccgucgccggccaggaggacggcuucgagggcaccgaggagggcuccccccgcgaguucaucuaccucaaccgcuacaagcgcgccggcgagucccaggacaagugcaccuacaccuucaucgucccccagcagcgcgucaccggcgccaucugcgucaacuccaaggagcccgagguccuccucgagaaccgcguccacaagcaggagcucgagcuccucaacaacgagcuccucaagcagaagcgccagaucgagacccuccagcagcucgucgaggucgacggcggcaucgucuccgaggucaagcuccuccgcaaggagucccgcaacaugaacucccgcgucacccagcucuacaugcagcuccuccacgagaucauccgcaagcgcgacaacgcccucgagcucucccagcucgagaaccgcauccucaaccagaccgccgacaugcuccagcucgccuccaaguacaaggaccucgagcacaaguaccagcaccucgccacccucgcccacaaccaguccgagaucaucgcccagcucgaggagcacugccagcgcguccccuccgcccgccccgucccccagcccccccccgccgcccccccccgcgucuaccagccccccaccuacaaccgcaucaucaaccagaucuccaccaacgagauccaguccgaccagaaccucaagguccucccccccccccuccccaccaugcccacccucaccucccuccccuccuccaccgacaagcccuccggccccuggcgcgacugccuccaggcccucgaggacggccacgacaccuccuccaucuaccucgucaagcccgagaacaccaaccgccucaugcaggucuggugcgaccagcgccacgaccccggcggcuggaccgucauccagcgccgccucgacggcuccgucaacuucuuccgcaacugggagaccuacaagcagggcuucggcaacaucgacggcgaguacuggcucggccucgagaacaucuacuggcucaccaaccagggcaacuacaagcuccucgucaccauggaggacugguccggccgcaaggucuucgccgaguacgccuccuuccgccucgagcccgaguccgaguacuacaagcuccgccucggccgcuaccacggcaacgccggcgacuccuucaccuggcacaacggcaagcaguucaccacccucgaccgcgaccacgacgucuacaccggcaacugcgcccacuaccagaagggcggcuggugguacaacgccugcgcccacuccaaccucaacggcgucugguaccgcggcggccacuaccgcucccgcuaccaggacggcgucuacugggccgaguuccgcggcggcuccuacucccucaagaaggucgucaugaugauccgccccaaccccaacaccuuccacuga

SEQ ID NO: 39692 - RNA, 1107 nt, Artificial Sequence
  derived and/or modified sequence opt2 from ANGPTL4__Homo_sapiens__NP_001034756
auguccggcgcccccaccgccggcgccgcccucaugcucugcgccgccaccgccguccuccucuccgcccagggcggccccguccaguccaaguccccccgcuucgccuccugggacgagaugaacguccucgcccacggccuccuccagcucggccagggccuccgcgagcacgccgagcgcacccgcucccagcucuccgcccucgagcgccgccucuccgccugcggcuccgccugccagggcaccgagggcuccaccgaccucccccucgcccccgagucccgcgucgaccccgagguccuccacucccuccagacccagcucaaggcccagaacucccgcauccagcagcucuuccacaaggucgcccagcagcagcgccaccucgagaagcagcaccuccgcauccagcaccuccagucccaguucggccuccucgaccacaagcaccucgaccacgaggucgccaagcccgcccgccgcaagcgccuccccgagauggcccagcccgucgaccccgcccacaacgucucccgccuccaccacggcggcuggaccgucauccagcgccgccacgacggcuccgucgacuucaaccgccccugggaggccuacaaggccggcuucggcgacccccacggcgaguucuggcucggccucgagaagguccacuccaucaccggcgaccgcaacucccgccucgccguccagcuccgcgacugggacggcaacgccgagcuccuccaguucuccguccaccucggcggcgaggacaccgccuacucccuccagcucaccgcccccgucgccggccagcucggcgccaccaccgucccccccuccggccucuccguccccuucuccaccugggaccaggaccacgaccuccgccgcgacaagaacugcgccaagucccucuccggcggcuggugguucggcaccugcucccacuccaaccucaacggccaguacuuccgcuccaucccccagcagcgccagaagcucaagaagggcaucuucuggaagaccuggcgcggccgcuacuacccccuccaggccaccaccaugcucauccagcccauggccgccgaggccgccuccuga

SEQ ID NO: 39693 - RNA, 1413 nt, Artificial Sequence
  derived and/or modified sequence opt2 from ANGPTL6__Homo_sapiens__NP_114123
augggcaagcccuggcuccgcgcccuccagcuccuccuccuccucggcgccuccugggcccgcgccggcgccccccgcugcaccuacaccuucguccuccccccccagaaguucaccggcgccgucugcugguccggccccgccuccacccgcgccacccccgaggccgccaacgccuccgagcucgccgcccuccgcaugcgcgucggccgccacgaggagcuccuccgcgagcuccagcgccucgccgccgccgacggcgccgucgccggcgagguccgcgcccuccgcaaggagucccgcggccucuccgcccgccucggccagcuccgcgcccagcuccagcacgaggccggccccggcgccggccccggcgccgaccucggcgccgagcccgccgccgcccucgcccuccucggcgagcgcguccucaacgccuccgccgaggcccagcgcgccgccgcccgcuuccaccagcucgacgucaaguuccgcgagcucgcccagcucgucacccagcaguccucccucaucgcccgccucgagcgccucugccccggcggcgccggcggccagcagcagguccuccccccccccccccucguccccgucguccccguccgccucgucggcuccaccuccgacaccucccgcaugcucgaccccgcccccgagccccagcgcgaccagacccagcgccagcaggagcccauggccucccccaugcccgccggccaccccgccguccccaccaagcccgucggccccuggcaggacugcgccgaggcccgccaggccggccacgagcaguccggcgucuacgagcuccgcgucggccgccacgucgucuccgucuggugcgagcagcagcucgagggcggcggcuggaccgucauccagcgccgccaggacggcuccgucaacuucuucaccaccuggcagcacuacaaggccggcuucggccgccccgacggcgaguacuggcucggccucgagcccgucuaccagcucaccucccgcggcgaccacgagcuccucguccuccucgaggacuggggcggccgcggcgcccgcgcccacuacgacggcuucucccucgagcccgaguccgaccacuaccgccuccgccucggccaguaccacggcgacgccggcgacucccucuccuggcacaacgacaagcccuucuccaccgucgaccgcgaccgcgacuccuacuccggcaacugcgcccucuaccagcgcggcggcuggugguaccacgccugcgcccacuccaaccucaacggcgucuggcaccacggcggccacuaccgcucccgcuaccaggacggcgucuacugggccgaguuccgcggcggcgccuacucccuccgcaaggccgccaugcucauccgcccccucaagcucuga

SEQ ID NO: 39694 - RNA, 5643 nt, Artificial Sequence
  derived and/or modified sequence opt2 from ANK1__Homo_sapiens__NP_000028
augcccuacuccgucggcuuccgcgaggccgacgccgccaccuccuuccuccgcgccgcccgcuccggcaaccucgacaaggcccucgaccaccuccgcaacggcgucgacaucaacaccugcaaccagaacggccucaacggccuccaccucgccuccaaggagggccacgucaagauggucgucgagcuccuccacaaggagaucauccucgagaccaccaccaagaagggcaacaccgcccuccacaucgccgcccucgccggccaggacgaggucguccgcgagcucgucaacuacggcgccaacgucaacgcccagucccagaagggcuucaccccccucuacauggccgcccaggagaaccaccucgaggucgucaaguuccuccucgagaacggcgccaaccagaacgucgccaccgaggacggcuucaccccccucgccgucgcccuccagcagggccacgagaacgucgucgcccaccucaucaacuacggcaccaagggcaagguccgccuccccgcccuccacaucgccgcccgcaacgacgacacccgcaccgccgccguccuccuccagaacgaccccaaccccgacguccucuccaagaccggcuucaccccccuccacaucgccgcccacuacgagaaccucaacgucgcccagcuccuccucaaccgcggcgccuccgucaacuucaccccccagaacggcaucaccccccuccacaucgccucccgccgcggcaacgucaucaugguccgccuccuccucgaccgcggcgcccagaucgagaccaagaccaaggacgagcucaccccccuccacugcgccgcccgcaacggccacguccgcaucuccgagauccuccucgaccacggcgcccccauccaggccaagaccaagaacggccucucccccauccacauggccgcccagggcgaccaccucgacugcguccgccuccuccuccaguacgacgccgagaucgacgacaucacccucgaccaccucaccccccuccacgucgccgcccacugcggccaccaccgcgucgccaagguccuccucgacaagggcgccaagcccaacucccgcgcccucaacggcuucaccccccuccacaucgccugcaagaagaaccacguccgcgucauggagcuccuccucaagaccggcgccuccaucgacgccgucaccgaguccggccucaccccccuccacgucgccuccuucaugggccaccuccccaucgucaagaaccuccuccagcgcggcgccucccccaacgucuccaacgucaaggucgagaccccccuccacauggccgcccgcgccggccacaccgaggucgccaaguaccuccuccagaacaaggccaaggucaacgccaaggccaaggacgaccagaccccccuccacugcgccgcccgcaucggccacaccaacauggucaagcuccuccucgagaacaacgccaaccccaaccucgccaccaccgccggccacaccccccuccacaucgccgcccgcgagggccacgucgagaccguccucgcccuccucgagaaggaggccucccaggccugcaugaccaagaagggcuucaccccccuccacgucgccgccaaguacggcaagguccgcgucgccgagcuccuccucgagcgcgacgcccaccccaacgccgccggcaagaacggccucaccccccuccacgucgccguccaccacaacaaccucgacaucgucaagcuccuccucccccgcggcggcuccccccacucccccgccuggaacggcuacaccccccuccacaucgccgccaagcagaaccaggucgaggucgcccgcucccuccuccaguacggcggcuccgccaacgccgaguccguccagggcgucaccccccuccaccucgccgcccaggagggccacgccgagauggucgcccuccuccucuccaagcaggccaacggcaaccucggcaacaaguccggccucaccccccuccaccucgucgcccaggagggccacguccccgucgccgacguccucaucaagcacggcgucauggucgacgccaccacccgcaugggcuacaccccccuccacgucgccucccacuacggcaacaucaagcucgucaaguuccuccuccagcaccaggccgacgucaacgccaagaccaagcucggcuacuccccccuccaccaggccgcccagcagggccacaccgacaucgucacccuccuccucaagaacggcgccucccccaacgaggucuccuccgacggcaccaccccccucgccaucgccaagcgccucggcuacaucuccgucaccgacguccucaaggucgucaccgacgagaccuccuucguccucgucuccgacaagcaccgcauguccuuccccgagaccgucgacgagauccucgacgucuccgaggacgagggcgaggagcucaucuccuucaaggccgagcgccgcgacucccgcgacgucgacgaggagaaggagcuccucgacuucguccccaagcucgaccaggucgucgagucccccgccaucccccgcauccccugcgccaugcccgagaccgucgucauccgcuccgaggagcaggagcaggccuccaaggaguacgacgaggacucccucauccccuccucccccgccaccgagaccuccgacaacaucucccccgucgccucccccguccacaccggcuuccucgucuccuucauggucgacgcccgcggcggcuccaugcgcggcucccgccacaacggccuccgcgucgucauccccccccgcaccugcgccgcccccacccgcaucaccugccgccucgucaagccccagaagcucuccaccccccccccccucgccgaggaggagggccucgccucccgcaucaucgcccucggccccaccggcgcccaguuccucucccccgucaucgucgagaucccccacuucgccucccacggccgcggcgaccgcgagcucgucguccuccgcuccgagaacggcuccgucuggaaggagcaccgcucccgcuacggcgaguccuaccucgaccagauccucaacggcauggacgaggagcucggcucccucgaggagcucgagaagaagcgcgucugccgcaucaucaccaccgacuucccccucuacuucgucaucaugucccgccucugccaggacuacgacaccaucggccccgagggcggcucccucaaguccaagcucgucccccucguccaggccaccuuccccgagaacgccgucaccaagcgcgucaagcucgcccuccaggcccagcccguccccgacgagcucgucaccaagcuccucggcaaccaggccaccuucucccccaucgucaccgucgagccccgccgccgcaaguuccaccgccccaucggccuccgcaucccccucccccccuccuggaccgacaacccccgcgacuccggcgagggcgacaccaccucccuccgccuccucugcuccgucaucggcggcaccgaccaggcccagugggaggacaucaccggcaccaccaagcucgucuacgccaacgagugcgccaacuucaccaccaacgucuccgcccgcuucuggcucuccgacugcccccgcaccgccgaggccgucaacuucgccacccuccucuacaaggagcucaccgccguccccuacauggccaaguucgucaucuucgccaagaugaacgacccccgcgagggccgccuccgcugcuacugcaugaccgacgacaaggucgacaagacccucgagcagcacgagaacuucgucgaggucgcccgcucccgcgacaucgagguccucgagggcaugucccucuucgccgagcucuccggcaaccucguccccgucaagaaggccgcccagcagcgcuccuuccacuuccaguccuuccgcgagaaccgccucgccaugcccgucaagguccgcgacuccucccgcgagcccggcggcucccucuccuuccuccgcaaggccaugaaguacgaggacacccagcacauccucugccaccucaacaucaccaugccccccugcgccaagggcuccggcgccgaggaccgccgccgcacccccaccccccucgcccuccgcuacuccauccucuccgaguccacccccggcucccucuccggcaccgagcaggccgagaugaagauggccgucaucuccgagcaccucggccucuccugggccgagcucgcccgcgagcuccaguucuccgucgaggacaucaaccgcauccgcgucgagaaccccaacucccuccucgagcaguccgucgcccuccucaaccucugggucauccgcgagggccagaacgccaacauggagaaccucuacaccgcccuccaguccaucgaccgcggcgagaucgucaacaugcucgagggcuccggccgccagucccgcaaccucaagcccgaccgccgccacaccgaccgcgacuacucccucucccccucccagaugaacggcuacuccucccuccaggacgagcuccucucccccgccucccucggcugcgcccucuccuccccccuccgcgccgaccaguacuggaacgaggucgccguccucgacgccaucccccucgccgccaccgagcacgacaccaugcucgagauguccgacaugcaggucugguccgccggccucacccccucccucgucaccgccgaggacuccucccucgagugcuccaaggccgaggacuccgacgccaccggccacgaguggaagcucgagggcgcccucuccgaggagccccgcggccccgagcucggcucccucgagcucgucgaggacgacaccgucgacuccgacgccaccaacggccucaucgaccuccucgagcaggaggagggccagcgcuccgaggagaagcuccccggcuccaagcgccaggacgacgccaccggcgccggccaggacuccgagaacgaggucucccucgucuccggccaccagcgcggccaggcccgcaucacccacucccccaccgucucccaggucaccgagcgcucccaggaccgccuccaggacugggacgccgacggcuccaucgucuccuaccuccaggacgccgcccagggcuccuggcaggaggaggucacccagggcccccacuccuuccagggcaccuccaccaugaccgagggccucgagcccggcggcucccaggaguacgagaagguccucgucuccgucuccgagcacaccuggaccgagcagcccgaggccgaguccucccaggccgaccgcgaccgccgccagcagggccaggaggagcagguccaggaggccaagaacaccuucacccaggucguccagggcaacgaguuccagaacauccccggcgagcaggucaccgaggagcaguucaccgacgagcagggcaacaucgucaccaagaagaucauccgcaaggucguccgccagaucgaccucuccuccgccgacgccgcccaggagcacgaggaggucgagcuccgcggcuccggccuccagcccgaccucaucgagggccgcaagggcgcccagaucgucaagcgcgccucccucaagcgcggcaagcaguga

SEQ ID NO: 39695 - RNA, 5592 nt, Artificial Sequence
  derived and/or modified sequence opt2 from ANK2__Homo_sapiens__NP_001120965
augaccaccaugcuccagaaguccgacuccaacgccuccuuccuccgcgccgcccgcgccggcaaccucgacaaggucgucgaguaccucaagggcggcaucgacaucaacaccugcaaccagaacggccucaacgcccuccaccucgccgccaaggagggccacgucggccucguccaggagcuccucggccgcggcuccuccgucgacuccgccaccaagaagggcaacaccgcccuccacaucgccucccucgccggccaggccgaggucgucaagguccucgucaaggagggcgccaacaucaacgcccagucccagaacggcuucaccccccucuacauggccgcccaggagaaccacaucgacgucgucaaguaccuccucgagaacggcgccaaccaguccaccgccaccgaggacggcuucaccccccucgccgucgcccuccagcagggccacaaccaggccgucgccauccuccucgagaacgacaccaagggcaagguccgccuccccgcccuccacaucgccgcccgcaaggacgacaccaaguccgccgcccuccuccuccagaacgaccacaacgccgacguccaguccaagaugauggucaaccgcaccaccgaguccggcuucaccccccuccacaucgccgcccacuacggcaacgucaacgucgccacccuccuccucaaccgcggcgccgccgucgacuucaccgcccgcaacggcaucaccccccuccacgucgccuccaagcgcggcaacaccaacauggucaagcuccuccucgaccgcggcggccagaucgacgccaagacccgcgacggccucaccccccuccacugcgccgcccgcuccggccacgaccaggucgucgagcuccuccucgagcgcggcgccccccuccucgcccgcaccaagaacggccucuccccccuccacauggccgcccagggcgaccacgucgagugcgucaagcaccuccuccagcacaaggcccccgucgacgacgucacccucgacuaccucaccgcccuccacgucgccgcccacugcggccacuaccgcgucaccaagcuccuccucgacaagcgcgccaaccccaacgcccgcgcccucaacggcuucaccccccuccacaucgccugcaagaagaaccgcaucaaggucauggagcuccucgucaaguacggcgccuccauccaggccaucaccgaguccggccucacccccauccacgucgccgccuucaugggccaccucaacaucguccuccuccuccuccagaacggcgccucccccgacgucaccaacauccgcggcgagaccgcccuccacauggccgcccgcgccggccaggucgaggucguccgcugccuccuccgcaacggcgcccucgucgacgcccgcgcccgcgaggagcagaccccccuccacaucgccucccgccucggcaagaccgagaucguccagcuccuccuccagcacauggcccaccccgacgccgccaccaccaacggcuacaccccccuccacaucuccgcccgcgagggccaggucgacgucgccuccguccuccucgaggccggcgccgcccacucccucgccaccaagaagggcuucaccccccuccacgucgccgccaaguacggcucccucgacgucgccaagcuccuccuccagcgccgcgccgccgccgacuccgccggcaagaacggccucaccccccuccacgucgccgcccacuacgacaaccagaaggucgcccuccuccuccucgagaagggcgccuccccccacgccaccgccaagaacggcuacaccccccuccacaucgccgccaagaagaaccagaugcagaucgccuccacccuccucaacuacggcgccgagaccaacaucgucaccaagcagggcgucaccccccuccaccucgccucccaggagggccacaccgacauggucacccuccuccucgacaagggcgccaacauccacauguccaccaaguccggccucaccucccuccaccucgccgcccaggaggacaaggucaacgucgccgacauccucaccaagcacggcgccgaccaggacgcccacaccaagcucggcuacaccccccucaucgucgccugccacuacggcaacgucaagauggucaacuuccuccucaagcagggcgccaacgucaacgccaagaccaagaacggcuacaccccccuccaccaggccgcccagcagggccacacccacaucaucaacguccuccuccagcacggcgccaagcccaacgccaccaccgccaacggcaacaccgcccucgccaucgccaagcgccucggcuacaucuccgucgucgacacccucaaggucgucaccgaggaggucaccaccaccaccaccaccaucaccgagaagcacaagcucaacguccccgagaccaugaccgagguccucgacgucuccgacgaggagggcgacgacaccaugaccggcgacggcggcgaguaccuccgccccgaggaccucaaggagcucggcgacgacucccuccccuccucccaguuccucgacggcaugaacuaccuccgcuacucccucgagggcggccgcuccgacucccuccgcuccuucuccuccgaccgcucccacacccucucccacgccuccuaccuccgcgacuccgccgucauggacgacuccgucgucauccccucccaccaggucuccacccucgccaaggaggccgagcgcaacuccuaccgccucuccuggggcaccgagaaccucgacaacgucgcccucuccuccucccccauccacuccggccgcgccucccccugccucgagcgcgacaacuccuccuuccucgucuccuucauggucgacgcccgcggcggcgccaugcgcggcugccgccacaacggccuccgcaucaucauccccccccgcaagugcaccgcccccacccgcgucaccugccgccucgucaagcgccaccgccucgccaccaugccccccauggucgagggcgagggccucgccucccgccucaucgaggucggccccuccggcgcccaguuccucggcaagcuccaccuccccaccgccccccccccccucaacgagggcgagucccucgucucccgcauccuccagcucggcccccccggcaccaaguuccucggccccgucaucgucgagaucccccacuucgccgcccuccgcggcaaggagcgcgagcucgucguccuccgcuccgagaacggcgacuccuggaaggagcacuucugcgacuacaccgaggacgagcucaacgagauccucaacggcauggacgagguccucgacucccccgaggaccucgagaagaagcgcaucugccgcaucaucacccgcgacuucccccaguacuucgccgucgucucccgcaucaagcaggacuccaaccucaucggccccgagggcggcguccucuccuccaccgucgucccccagguccaggccgucuuccccgagggcgcccucaccaagcgcauccgcgucggccuccaggcccagcccaugcacuccgagcucgucaagaagauccucggcaacaaggccaccuucucccccaucgucacccucgagccccgccgccgcaaguuccacaagcccaucaccaugaccauccccguccccaaggccuccuccgacgucaugcucaacggcuucggcggcgacgcccccacccuccgccuccucugcuccaucaccggcggcaccacccccgcccagugggaggacaucaccggcaccaccccccucaccuucgucaacgagugcgucuccuucaccaccaacgucuccgcccgcuucuggcucaucgacugccgccagauccaggaguccgucaccuucgccucccaggucuaccgcgagaucaucugcguccccuacauggccaaguucgucgucuucgccaagucccacgaccccaucgaggcccgccuccgcugcuucugcaugaccgacgacaaggucgacaagacccucgagcagcaggagaacuucgccgaggucgcccgcucccgcgacgucgagguccucgagggcaagcccaucuacgucgacugcuucggcaaccucgucccccucaccaaguccggccagcaccacaucuucuccuucuucgccuucaaggagaaccgccucccccucuucgucaagguccgcgacaccacccaggagcccugcggccgccucuccuucaugaaggagcccaaguccacccgcggccucguccaccaggccaucugcaaccucaacaucacccuccccaucuacaccaaggaguccgaguccgaccaggagcaggaggaggagaucgacaugaccuccgagaagaacccccaggacgagcaggagcgcaucgaggagcgccucgccuacaucgccgaccaccucggcuucuccuggaccgagcucgcccgcgagcucgacuucaccgaggagcagauccaccagauccgcaucgagaaccccaacucccuccaggaccagucccacgcccuccucaaguacuggcucgagcgcgacggcaagcacgccaccgacaccaaccucgucgagugccucaccaagaucaaccgcauggacaucguccaccucauggagaccaacaccgagccccuccaggagcgcaucucccacuccuacgccgagaucgagcagaccaucacccucgaccacuccgagggcuucuccguccuccaggaggagcucugcaccgcccagcacaagcagaaggaggagcaggccgucuccaaggaguccgagaccugcgaccacccccccaucgucuccgaggaggacaucuccgucggcuacuccaccuuccaggacggcguccccaagaccgagggcgacuccuccgccaccgcccucuucccccagacccacaaggagcagguccagcaggacuucuccggcaagaugcaggaccuccccgaggaguccucccucgaguaccagcaggaguacuucgucaccacccccggcaccgagaccuccgagacccagaaggccaugaucguccccuccucccccuccaagacccccgaggaggucuccacccccgccgaggaggagaagcucuaccuccagacccccaccuccuccgagcgcggcggcucccccaucauccaggagcccgaggagcccuccgagcaccgcgaggaguccuccccccgcaagaccucccucgucaucgucgaguccgccgacaaccagcccgagaccugcgagcgccucgacgaggacgccgccuucgagaagggcgacgacaugcccgagaucccccccgagaccgucaccgaggaggaguacaucgacgagcacggccacaccgucgucaagaaggucacccgcaagaucauccgccgcuacgucuccuccgagggcaccgagaaggaggagaucaugguccagggcaugccccaggagcccgucaacaucgaggagggcgacggcuacuccaaggucaucaagcgcgucguccucaaguccgacaccgagcaguccgaggacaacaacgaguga

SEQ ID NO: 39696 - RNA, 5586 nt, Artificial Sequence
  derived and/or modified sequence opt2 from ANK3__Homo_sapiens__NP_001191332
auggccuccuccgccuccuccucccccgccggcaccgaggacuccgcccccgcccagggcggcuucggcuccgacuacucccgcuccucccgcaaguccgacgccaacgccuccuaccuccgcgccgcccgcgccggccaccucgagaaggcccucgacuacaucaagaacggcgucgacaucaacaucugcaaccagaacggccucaacgcccuccaccucgccuccaaggagggccacgucgaggucgucuccgagcuccuccagcgcgaggccaacgucgacgccgccaccaagaagggcaacaccgcccuccacaucgccucccucgccggccaggccgaggucgucaagguccucgucaccaacggcgccaacgucaacgcccagucccagaacggcuucaccccccucuacauggccgcccaggagaaccaccucgaggucgucaaguuccuccucgacaacggcgccucccagucccucgccaccgaggacggcuucaccccccucgccgucgcccuccagcagggccacgaccaggucgucucccuccuccucgagaacgacaccaagggcaagguccgccuccccgcccuccacaucgccgcccgcaaggacgacaccaaggccgccgcccuccuccuccagaacgacaacaacgccgacgucgaguccaaguccggcuucaccccccuccacaucgccgcccacuacggcaacaucaacgucgccacccuccuccucaaccgcgccgccgccgucgacuucaccgcccgcaacgacaucaccccccuccacgucgccuccaagcgcggcaacgccaacauggucaagcuccuccucgaccgcggcgccaagaucgacgccaagacccgcgacggccucaccccccuccacugcggcgcccgcuccggccacgagcaggucgucgagaugcuccucgaccgcgccgcccccauccucuccaagaccaagaacggccucuccccccuccacauggccacccagggcgaccaccucaacugcguccagcuccuccuccagcacaacguccccgucgacgacgucaccaacgacuaccucaccgcccuccacgucgccgcccacugcggccacuacaaggucgccaagguccuccucgacaagaaggccaaccccaacgccaaggcccucaacggcuucaccccccuccacaucgccugcaagaagaaccgcaucaaggucauggagcuccuccucaagcacggcgccuccauccaggccgucaccgaguccggccucacccccauccacgucgccgccuucaugggccacgucaacaucgucucccagcucaugcaccacggcgccucccccaacaccaccaacguccgcggcgagaccgcccuccacauggccgcccgcuccggccaggccgaggucguccgcuaccucguccaggacggcgcccaggucgaggccaaggccaaggacgaccagaccccccuccacaucuccgcccgccucggcaaggccgacaucguccagcagcuccuccagcagggcgccucccccaacgccgccaccaccuccggcuacaccccccuccaccucuccgcccgcgagggccacgaggacgucgccgccuuccuccucgaccacggcgccucccucuccaucaccaccaagaagggcuucaccccccuccacgucgccgccaaguacggcaagcucgaggucgccaaccuccuccuccagaaguccgccucccccgacgccgccggcaaguccggccucaccccccuccacgucgccgcccacuacgacaaccagaaggucgcccuccuccuccucgaccagggcgccuccccccacgccgccgccaagaacggcuacaccccccuccacaucgccgccaagaagaaccagauggacaucgccaccacccuccucgaguacggcgccgacgccaacgccgucacccgccagggcaucgccuccguccaccucgccgcccaggagggccacgucgacauggucucccuccuccucggccgcaacgccaacgucaaccucuccaacaaguccggccucaccccccuccaccucgccgcccaggaggaccgcgucaacgucgccgagguccucgucaaccagggcgcccacgucgacgcccagaccaagaugggcuacaccccccuccacgucggcugccacuacggcaacaucaagaucgucaacuuccuccuccagcacuccgccaaggucaacgccaagaccaagaacggcuacaccccccuccaccaggccgcccagcagggccacacccacaucaucaacguccuccuccagaacaacgccucccccaacgagcucaccgucaacggcaacaccgcccucggcaucgcccgccgccucggcuacaucuccgucgucgacacccucaagaucgucaccgaggagaccaugaccaccaccaccgucaccgagaagcacaagaugaacguccccgagaccaugaacgagguccucgacauguccgacgacgagguccgcaaggccaacgcccccgagaugcucuccgacggcgaguacaucuccgacgucgaggagggcgaggacgccaugaccggcgacaccgacaaguaccucggcccccaggaccucaaggagcucggcgacgacucccuccccgccgagggcuacaugggcuucucccucggcgcccgcuccgccucccuccgcuccuucuccuccgaccgcuccuacacccucaaccgcuccuccuacgcccgcgacuccaugaugaucgaggagcuccucguccccuccaaggagcagcaccucaccuucacccgcgaguucgacuccgacucccuccgccacuacuccugggccgccgacacccucgacaacgucaaccucgucuccucccccauccacuccggcuuccucgucuccuucauggucgacgcccgcggcggcuccaugcgcggcucccgccaccacggcaugcgcaucaucauccccccccgcaagugcaccgcccccacccgcaucaccugccgccucgucaagcgccacaagcucgccaaccccccccccauggucgagggcgagggccucgccucccgccucgucgagaugggccccgccggcgcccaguuccucggccccgucaucgucgagaucccccacuucggcuccaugcgcggcaaggagcgcgagcucaucguccuccgcuccgagaacggcgagaccuggaaggagcaccaguucgacuccaagaacgaggaccucaccgagcuccucaacggcauggacgaggagcucgacucccccgaggagcucggcaagaagcgcaucugccgcaucaucaccaaggacuucccccaguacuucgccgucgucucccgcaucaagcaggaguccaaccagaucggccccgagggcggcauccucuccuccaccaccgucccccucguccaggccuccuuccccgagggcgcccucaccaagcgcauccgcgucggccuccaggcccagcccguccccgacgagaucgucaagaagauccucggcaacaaggccaccuucucccccaucgucaccgucgagccccgccgccgcaaguuccacaagcccaucaccaugaccauccccguccccccccccuccggcgagggcgucuccaacggcuacaagggcgacaccacccccaaccuccgccuccucugcuccaucaccggcggcaccucccccgcccagugggaggacaucaccggcaccaccccccucaccuucaucaaggacugcgucuccuucaccaccaacgucuccgcccgcuucuggcucgccgacugccaccagguccucgagaccgucggccucgccacccagcucuaccgcgagcucaucugcguccccuacauggccaaguucgucgucuucgccaagaugaacgaccccgucgaguccucccuccgcugcuucugcaugaccgacgacaaggucgacaagacccucgagcagcaggagaacuucgaggaggucgcccgcuccaaggacaucgagguccucgagggcaagcccaucuacgucgacugcuacggcaaccucgccccccucaccaagggcggccagcagcucgucuucaacuucuacuccuucaaggagaaccgccuccccuucuccaucaagauccgcgacaccucccaggagcccugcggccgccucuccuuccucaaggagcccaagaccaccaagggccucccccagaccgccgucugcaaccucaacaucacccuccccgcccacaagaagaucgagaagaccgaccgccgccaguccuucgccucccucgcccuccgcaagcgcuacuccuaccucaccgagcccggcauguccccccagucccccugcgagcgcaccgacauccgcauggccaucgucgccgaccaccucggccucuccuggaccgagcucgcccgcgagcucaacuucuccgucgacgagaucaaccagauccgcgucgagaaccccaacucccucaucucccaguccuucaugcuccucaagaagugggucacccgcgacggcaagaacgccaccaccgacgcccucaccuccguccucaccaagaucaaccgcaucgacaucgucacccuccucgagggccccaucuucgacuacggcaacaucuccggcacccgcuccuucgccgacgagaacaacgucuuccacgaccccgucgacggcuaccccucccuccaggucgagcucgagacccccaccggccuccacuacaccccccccacccccuuccagcaggacgacuacuucuccgacaucuccuccaucgaguccccccuccgcacccccucccgccucuccgacggccucguccccucccagggcaacaucgagcacuccgccgacggcccccccgucgucaccgccgaggacgccucccucgaggacuccaagcucgaggacuccgucccccucaccgagaugcccgaggccgucgacgucgacgagucccagcucgagaacgucugccucuccuggcagaacgagaccuccuccggcaaccucgaguccugcgcccaggcccgccgcgucaccggcggccuccucgaccgccucgacgacucccccgaccagugccgcgacuccaucaccuccuaccucaagggcgaggccggcaaguucgaggccaacggcucccacaccgagaucacccccgaggccaagaccaaguccuacuuccccgagucccagaacgacgucggcaagcaguccaccaaggagacccucaagcccaagauccacggcuccggccacgucgaggagcccgccuccccccucgccgccuaccagaagucccucgaggagaccuccaagcucaucaucgaggagaccaagcccugcguccccgucuccaugaagaagaugucccgcaccucccccgccgacggcaagccccgccucucccuccacgaggaggagggcuccuccggcuccgagcagaagcagggcgagggcuucaaggucaagaccaagaaggagauccgccacgucgagaagaagucccacuccuga

SEQ ID NO: 39697 - RNA, 2292 nt, Artificial Sequence
  derived and/or modified sequence opt2 from ANKFN1__Homo_sapiens__NP_694960
auggaggccucccucacccgccgccuccucuucaaggaccgccacuucaccugcuccaagaucaucggccgccgcuucgccugcuucgcccagcgccucucccaccgccgcaagcagucccagugcgaccuccucaacgaguccaccggccagcuccccaccaccugcuccuccgccgccuccaacuccaucaacuggaacugccgcgucaagaugacccagcagaugcagaaccuccaccucugccaguccaagaagcacuccgcccccuccucccccaacgccgccaagcgccucuaccgcaaccucuccgagaagcucaagggcucccacuccuccuucgacgaggccuacuuccgcacccgcaccgaccgccucucccuccgcaagaccuccgucaacuuccagggcaacgaggccauguucgaggccgucgagcagcaggacauggacgccguccagauccuccucuaccaguacacccccgaggagcucgaccucaacacccccaacuccgagggccucaccccccucgacaucgccaucaugaccaacaacguccccaucgcccgcauccuccuccgcaccggcgcccgcgaguccccccacuucgucucccucgagucccgcgccaugcaccucaacacccucguccaggaggcccaggagcgcgucuccgagcucuccgcccaggucgagaacgagggcuucacccucgacaacaccgagaaggagaagcagcucaaggccugggaguggcgcuaccgccucuaccgccgcaugaagaccggcuucgagcacgcccgcgcccccgagaugcccaccaacgucugccucauggucaccuccuccaccucccucaccgucuccuuccaggagccccucuccgucaacgccgccgucgucacccgcuacaaggucgagugguccauguccgaggacuucuccccccucgccggcgagaucaucauggacaaccuccagacccuccgcugcaccaucaccggccucaccaugggccagcaguacuucguccaggucuccgccuacaacaugaagggcuggggccccgcccagaccaccacccccgccugcgccucccccuccaacuggaaggacuacgacgaccgcgagccccgccacaagggccaguccgagguccucgagggccuccuccagcagguccgcgcccuccaccagcacuacuccugccgcgaguccaccaagcuccagaccaccggccgcaagcaguccgucucccgcucccucaagcaccucuuccacuccuccaacaaguucgucaagacccucaagcgcggccucuacaucgccgucaucuucuacuacaaggacaacauccucgucaccaacgaggaccagguccccaucgucgagaucgacgacucccacaccuccuccaucacccaggacuuccucugguucaccaagcucuccugcaugugggaggacauccgcuggcuccgccaguccauccccaucuccuccuccuccuccaccguccuccagacccgccagaagaugcucgccgccaccgcccagcuccagaaccuccucggcacccacaaccucggccgcgucuacuacgagcccaucaaggaccgccacggcaacauccucaucgucaccauccgcgaggucgagaugcucuacuccuucuucaacggcaaguggaugcagaucuccaagcuccagucccagcgcaagucccucuccacccccgaggagcccaccgcccucgacauccuccucaucaccauccaggacauccucuccuaccacaagcgcucccaccagcgccucuuccccggccucuaccucggcuaccucaagcucugcuccuccgucgaccagaucaagguccucgucacccagaagcuccccaacauccucugccacgucaagauccgcgagaacaacaacaucucccgcgaggagugggaguggauccagaagcucuccggcuccgaguccauggaguccgucgaccacaccuccgacugccccaugcagcucuucuucuacgagcuccagauggccgucaaggcccuccuccagcagaucaacaucccccuccaccaggcccgcaacuuccgccucuacacccaggagguccucgagaugggccacaacgucuccuuccuccuccuccuccccgccuccgacgacgucugcaccgcccccggccagaacaaccccuacaccccccacuccggcuuccucaaccucccccuccagauguucgagcucggcaucgucgccugcuucaccuga

SEQ ID NO: 39698 - RNA, 3513 nt, Artificial Sequence
  derived and/or modified sequence opt2 from ANKFY1__Homo_sapiens__NP_057460
auggccgaggaggaggucgccaagcucgagaagcaccucaugcuccuccgccaggaguacgucaagcuccagaagaagcucgccgagaccgagaagcgcugcgcccuccucgccgcccaggccaacaaggaguccuccuccgaguccuucaucucccgccuccucgccaucgucgccgaccucuacgagcaggagcaguacuccgaccucaagaucaaggucggcgaccgccacaucuccgcccacaaguucguccucgccgcccgcuccgacuccuggucccucgccaaccucuccuccaccaaggagcucgaccucuccgacgccaaccccgaggucaccaugaccaugcuccgcuggaucuacaccgacgagcucgaguuccgcgaggacgacgucuuccucaccgagcucaugaagcucgccaaccgcuuccagcuccagcuccuccgcgagcgcugcgagaagggcgucaugucccucgucaacguccgcaacugcauccgcuucuaccagaccgccgaggagcucaacgccuccacccucaugaacuacugcgccgagaucaucgccucccacugggacgaccuccgcaaggaggacuucuccuccauguccgcccagcuccucuacaagaugaucaaguccaagaccgaguacccccuccacaaggccaucaaggucgagcgcgaggacgucgucuuccucuaccucaucgagauggacucccagcuccccggcaagcucaacgaggccgaccacaacggcgaccucgcccucgaccucgcccucucccgccgccucgaguccaucgccaccacccucgucucccacaaggccgacgucgacauggucgacaaguccggcuggucccuccuccacaagggcauccagcgcggcgaccucuucgccgccaccuuccucaucaagaacggcgccuucgucaacgccgccacccucggcgcccaggagaccccccuccaccucgucgcccucuacuccuccaagaagcacuccgccgacgucauguccgagauggcccagaucgccgaggcccuccuccaggccggcgccaaccccaacaugcaggacuccaagggccgcaccccccuccacgucuccaucauggccggcaacgaguacgucuucucccagcuccuccagugcaagcagcucgaccucgagcucaaggaccacgagggcuccaccgcccucuggcucgccguccagcacaucaccgucuccuccgaccaguccgucaaccccuucgaggacguccccgucgucaacggcaccuccuucgacgagaacuccuucgccgcccgccucauccagcgcggcucccacaccgacgcccccgacaccgccaccggcaacugccuccuccagcgcgccgccggcgccggcaacgaggccgccgcccucuuccucgccaccaacggcgcccacgucaaccaccgcaacaaguggggcgagaccccccuccacaccgccugccgccacggccucgccaaccucaccgccgagcuccuccagcagggcgccaaccccaaccuccagaccgaggaggcccucccccuccccaaggaggccgccucccucaccucccucgccgacuccguccaccuccagaccccccuccacauggccaucgccuacaaccaccccgacgucgucuccgucauccucgagcagaaggccaacgcccuccacgccaccaacaaccuccagaucauccccgacuucucccucaaggacucccgcgaccagaccguccucggccucgcccucuggaccggcaugcacaccaucgccgcccagcuccucggcuccggcgccgccaucaacgacaccauguccgacggccagacccuccuccacauggccauccagcgccaggacuccaaguccgcccucuuccuccucgagcaccaggccgacaucaacgucucccgcacccaggacggcgagaccgcccuccagcucgccauccgcaaccagcucccccucgucgucgacgccaucugcacccgcggcgccgacauguccguccccgacgagaagggcaaccccccccucuggcucgcccucgccaacaaccucgaggacaucgccuccacccucguccgccacggcugcgacgccaccugcuggggccccggccccggcggcugccuccagacccuccuccaccgcgccaucgacgagaacaacgagcccaccgccugcuuccucauccgcuccggcugcgacgucaacuccccccgccagcccggcgccaacggcgagggcgaggaggaggcccgcgacggccagaccccccuccaccucgccgccuccuggggccucgaggagaccguccagugccuccucgaguucggcgccaacgucaacgcccaggacgccgagggccgcacccccauccacgucgccaucuccucccagcacggcgucaucauccagcuccucgucucccaccccgacauccaccucaacguccgcgaccgccagggccucacccccuucgccugcgccaugaccuucaagaacaacaaguccgccgaggccauccucaagcgcgaguccggcgccgccgagcaggucgacaacaagggccgcaacuuccuccacgucgccguccagaacuccgacaucgaguccguccucuuccucaucuccguccacgccaacgucaacucccgcguccaggacgccuccaagcucaccccccuccaccucgccguccaggccggcuccgagaucaucguccgcaaccuccuccucgccggcgccaaggucaacgagcucaccaagcaccgccagaccgcccuccaccucgccgcccagcaggaccuccccaccaucugcuccguccuccucgagaacggcgucgacuucgccgccgucgacgagaacggcaacaacgcccuccaccucgccgucaugcacggccgccucaacaacauccgcguccuccucaccgagugcaccgucgacgccgaggccuucaaccuccgcggccaguccccccuccacauccucggccaguacggcaaggagaacgccgccgccaucuucgaccucuuccucgagugcaugcccggcuacccccucgacaagcccgacgccgacggcuccaccguccuccuccucgccuacaugaagggcaacgccaaccucugccgcgccaucguccgcuccggcgcccgccucggcgucaacaacaaccagggcgucaacaucuucaacuaccaggucgccaccaagcagcuccucuuccgccuccucgacaugcucuccaaggagccccccuggugcgacggcuccuacugcuacgagugcaccgcccgcuucggcgucaccacccgcaagcaccacugccgccacugcggccgccuccucugccacaagugcuccaccaaggagauccccaucaucaaguucgaccucaacaagcccguccgcgucugcaacaucugcuucgacguccucacccucggcggcgucuccuga

SEQ ID NO: 39699 - RNA, 7854 nt, Artificial Sequence
  derived and/or modified sequence opt2 from ANKHD1-EIF4EBP3__Homo_sapiens__NP_065741
augcucaccgacuccggcggcggcggcaccuccuucgaggaggaccucgacuccgucgccccccgcuccgcccccgccggcgccuccgagccccccccccccggcggcgucggccucggcauccgcaccguccgccucuucggcgaggccggccccgccuccggcgucggcuccuccggcggcggcggcuccggcuccggcaccggcggcggcgacgccgcccucgacuucaagcucgccgccgccguccuccgcaccggcggcggcggcggcgccuccggcuccgacgaggacgaggucuccgaggucgaguccuucauccucgaccaggaggaccucgacaaccccguccucaagaccaccuccgagaucuuccucuccuccaccgccgagggcgccgaccuccgcaccgucgaccccgagacccaggcccgccucgaggcccuccucgaggccgccggcaucggcaagcucuccaccgccgacggcaaggccuucgccgaccccgagguccuccgccgccucaccuccuccgucuccugcgcccucgacgaggccgccgccgcccucacccgcaugaaggccgagaacucccacaacgccggccaggucgacacccgcucccucgccgaggccugcuccgacggcgacgucaacgccguccgcaagcuccucgacgagggccgcuccgucaacgagcacaccgaggagggcgagucccuccucugccucgccugcuccgccggcuacuacgagcucgcccagguccuccucgccaugcacgccaacgucgaggaccgcggcaacaagggcgacaucaccccccucauggccgccuccuccggcggcuaccucgacaucgucaagcuccuccuccuccacgacgccgacgucaacucccaguccgccaccggcaacaccgcccucaccuacgccugcgccggcggcuucgucgacaucgucaagguccuccucaacgagggcgccaacaucgaggaccacaacgagaacggccacaccccccucauggaggccgccuccgccggccacgucgaggucgcccgcguccuccucgaccacggcgccggcaucaacacccacuccaacgaguucaaggaguccgcccucacccucgccugcuacaagggccaccucgacaugguccgcuuccuccucgaggccggcgccgaccaggagcacaagaccgacgagaugcacaccgcccucauggaggccugcauggacggccacgucgaggucgcccgccuccuccucgacuccggcgcccaggucaacaugcccgccgacuccuucgaguccccccucacccucgccgccugcggcggccacgucgagcucgccgcccuccucaucgagcgcggcgccaaccucgaggaggucaacgacgagggcuacaccccccucauggaggccgcccgcgagggccacgaggagauggucgcccuccuccucgcccagggcgccaacaucaacgcccagaccgaggagacccaggagaccgcccucacccucgccugcugcggcggcuucuccgaggucgccgacuuccucaucaaggccggcgccgacaucgagcucggcugcuccaccccccucauggaggccucccaggagggccaccucgagcucgucaaguaccuccucgccuccggcgccaacguccacgccaccaccgccaccggcgacaccgcccucaccuacgccugcgagaacggccacaccgacgucgccgacguccuccuccaggccggcgccgaccucgagcacgaguccgagggcggccgcaccccccucaugaaggccgcccgcgccggccaccucugcaccguccaguuccucaucuccaagggcgccaacgucaaccgcgccaccgccaacaacgaccacaccgucgucucccucgccugcgccggcggccaccucgccgucgucgagcuccuccucgcccacggcgccgaccccacccaccgccucaaggacggcuccaccaugcucaucgaggccgccaagggcggccacaccaacgucgucuccuaccuccucgacuaccccaacaacguccucuccguccccaccaccgacgucucccagcuccccccccccucccaggaccagucccaggucccccgcguccccacccacacccucgccauggucguccccccccaggagcccgaccgcaccucccaggagaacucccccgcccuccucggcguccagaagggcaccuccaagcagaaguccuccucccuccaggucgccgaccaggaccuccuccccuccuuccaccccuaccagccccucgagugcaucgucgaggagaccgagggcaagcucaacgagcucggccagcgcaucuccgccaucgagaaggcccagcucaagucccucgagcucauccagggcgagccccucaacaaggacaagaucgaggagcucaagaagaaccgcgaggagcagguccagaagaagaagaagauccucaaggagcuccagaaggucgagcgccagcuccagaugaagacccagcagcaguucaccaaggaguaccucgagaccaagggccagaaggacaccgucucccuccaccagcagugcucccaccgcggcgucuuccccgagggcgagggcgacggcucccuccccgaggaccacuucuccgagcucccccaggucgacaccauccucuucaaggacaacgacgucgacgacgagcagcaguccccccccuccgccgagcagaucgacuucguccccguccagccccucuccuccccccagugcaacuucuccuccgaccucggcuccaacggcaccaacucccucgagcuccagaaggucuccggcaaccagcagaucgucggccagccccagaucgccaucaccggccacgaccagggccuccucguccaggagcccgacggccucauggucgccacccccgcccagacccucaccgacacccucgacgaccucaucgccgccgucuccacccgcguccccaccggcuccaacuccuccucccagaccaccgagugccucacccccgaguccugcucccagaccaccuccaacgucgccucccaguccaugccccccgucuaccccuccgucgacaucgacgcccacaccgaguccaaccacgacaccgcccucacccucgccugcgccggcggccacgaggagcucgucuccguccucaucgcccgcgacgccaagaucgagcaccgcgacaagaagggcuucaccccccucauccucgccgccaccgccggccacgucggcgucgucgagauccuccucgacaagggcggcgacaucgaggcccaguccgagcgcaccaaggacaccccccucucccucgccugcuccggcggccgccaggaggucgucgaccuccuccucgcccgcggcgccaacaaggagcaccgcaacgucuccgacuacaccccccucucccucgccgccuccggcggcuacgucaacaucaucaagauccuccucaacgccggcgccgagaucaacucccgcaccggcuccaagcucggcaucuccccccucaugcucgccgccaugaacggccacguccccgccgucaagcuccuccucgacaugggcuccgacaucaacgcccagaucgagaccaaccgcaacaccgcccucacccucgccugcuuccagggccgcgccgaggucgucucccuccuccucgaccgcaaggccaacgucgagcaccgcgccaagaccggccucaccccccucauggaggccgccuccggcggcuacgccgaggucggccgcguccuccucgacaagggcgccgacgucaacgccccccccguccccuccucccgcgacaccgcccucaccaucgccgccgacaagggccacuacaaguucugcgagcuccucauccaccgcggcgcccacaucgacguccgcaacaagaagggcaacaccccccucuggcucgccuccaacggcggccacuucgacgucguccagcuccucguccaggccggcgccgacgucgacgccgccgacaaccgcaagaucaccccccucauguccgccuuccgcaagggccacgucaaggucguccaguaccucgucaaggaggucaaccaguuccccuccgacaucgagugcaugcgcuacaucgccaccaucaccgacaaggagcuccucaagaagugccaccagugcgucgagaccaucgucaaggccaaggaccagcaggccgccgaggccaacaagaacgccuccauccuccucaaggagcucgaccucgagaagucccgcgaggagucccgcaagcaggcccucgccgccaagcgcgagaagcgcaaggagaagcgcaagaagaagaaggaggagcagaagcgcaagcaggaggaggacgaggagaacaagcccaaggagaacuccgagcuccccgaggacgaggacgaggaggagaacgacgaggacgucgagcaggagguccccaucgagccccccuccgccaccaccaccaccaccaucggcaucuccgccaccuccgccaccuucaccaacgucuucggcaagaagcgcgccaacgucgucaccacccccuccaccaaccgcaagaacaagaagaacaagaccaaggagaccccccccaccgcccaccucauccuccccgagcagcacaugucccucgcccagcagaaggccgacaagaacaagaucaacggcgagccccgcggcggcggcgccggcggcaacuccgacuccgacaaccucgacuccaccgacugcaacuccgaguccuccuccggcggcaagucccaggagcucaacuucgucauggacgucaacuccuccaaguaccccucccuccuccuccacucccaggaggagaagaccuccaccgccaccuccaagacccagacccgccucgagggcgaggucacccccaacucccucuccaccuccuacaagaccgucucccucccccucuccucccccaacaucaagcucaaccucaccucccccaagcgcggccagaagcgcgaggagggcuggaaggaggucguccgccgcuccaagaagcucuccguccccgccuccgucgucucccgcaucaugggccgcggcggcugcaacaucaccgccauccaggacgucaccggcgcccacaucgacgucgacaagcagaaggacaagaacggcgagcgcaugaucaccauccgcggcggcaccgaguccacccgcuacgccguccagcucaucaacgcccucauccaggaccccgccaaggagcucgaggaccucauccccaagaaccacauccgcacccccgccuccaccaaguccauccacgccaacuucuccuccggcgucggcaccaccgccgccuccuccaagaacgccuucccccucggcgcccccacccucgucaccucccaggccaccacccucuccaccuuccagcccgccaacaagcucaacaagaacguccccaccaacguccgcuccuccuuccccgucucccucccccucgccuacccccacccccacuucgcccuccucgccgcccagaccaugcagcagauccgccacccccgccuccccauggcccaguucggcggcaccuucucccccucccccaacaccuggggccccuuccccguccgccccgucaaccccggcaacaccaacuccucccccaagcacaacaacaccucccgccuccccaaccagaacggcaccguccuccccuccgaguccgccggccucgccaccgccuccugccccaucaccgucuccuccgucgucgccgccucccagcagcucugcgucaccaacacccgcacccccuccuccguccgcaagcagcucuucgccugcguccccaagaccuccccccccgccaccgucaucuccuccgucaccuccaccugcuccucccuccccuccgucuccuccgcccccaucaccuccggccaggcccccaccaccuuccuccccgccuccaccucccaggcccagcucuccucccagaagauggaguccuucuccgccgucccccccaccaaggagaaggucuccacccaggaccagcccauggccaaccucugcacccccuccuccaccgccaacuccugcuccuccuccgccuccaacacccccggcgcccccgagacccaccccuccuccucccccacccccaccuccuccaacacccaggaggaggcccagcccuccuccgucuccgaccucucccccauguccaugcccuucgccuccaacuccgagcccgccccccucacccucaccuccccccgcauggucgccgccgacaaccaggacaccuccaaccucccccagcucgccguccccgccccccgcgucucccaccgcaugcagccccgcggcuccuucuacuccaugguccccaacgccaccauccaccaggacccccaguccaucuucgucaccaaccccgucacccucacccccccccagggcccccccgccgccguccagcucuccuccgccgucaacaucaugaacggcucccagaugcacaucaaccccgccaacaagucccucccccccaccuucggccccgccacccucuucaaccacuucuccucccucuucgacuccucccagguccccgccaaccagggcuggggcgacggcccccucuccucccgcgucgccaccgacgccuccuucaccguccaguccgccuuccucggcaacuccguccucggccaccucgagaacaugcaccccgacaacuccaaggcccccggcuuccgcccccccucccagcgcgucuccaccucccccgucggccuccccuccaucgaccccuccggcuccucccccuccuccuccuccgccccccucgccuccuucuccggcauccccggcacccgcgucuuccuccagggccccgcccccgucggcacccccuccuucaaccgccagcacuucuccccccaccccuggaccuccgccuccaacuccuccaccuccgccccccccacccucggccagcccaagggcgucuccgccucccaggaccgcaagauccccccccccaucggcaccgagcgccucgcccgcauccgccagggcggcuccgucgcccaggcccccgccggcaccuccuucgucgcccccgucggccacuccggcaucugguccuucggcgucaacgccgucuccgagggccucuccggcuggucccaguccgucaugggcaaccaccccaugcaccagcagcucuccgaccccuccaccuucucccagcaccagcccauggagcgcgacgacuccggcauggucgcccccuccaacaucuuccaccagcccauggccuccggcuucgucgacuucuccaagggccuccccaucuccauguacggcggcaccaucauccccucccacccccagcucgccgacguccccggcggcccccucuucaacggccuccacaaccccgaccccgccuggaaccccaugaucaaggucauccagaacuccaccgagugcaccgacgcccagcaggccucccuccuccccuccguccccgcccucaagggcgagauccccuccccccagcucacccgccccaagaagcgcaucggccgccccauggucgccucccccaaccagcgccaccaggaccaccuccgccccaagguccccgccggcguccaggagcucacccacugccccgacaccccccuccucccccccuccgacucccgcggccacaacuccuccaacucccccucccuccaggccggcggcgccgagggcgccggcgaccgcggccgcgacacccgcuga

SEQ ID NO: 39700 - RNA, 7629 nt, Artificial Sequence
  derived and/or modified sequence opt2 from ANKHD1__Homo_sapiens__NP_060217
augcucaccgacuccggcggcggcggcaccuccuucgaggaggaccucgacuccgucgccccccgcuccgcccccgccggcgccuccgagccccccccccccggcggcgucggccucggcauccgcaccguccgccucuucggcgaggccggccccgccuccggcgucggcuccuccggcggcggcggcuccggcuccggcaccggcggcggcgacgccgcccucgacuucaagcucgccgccgccguccuccgcaccggcggcggcggcggcgccuccggcuccgacgaggacgaggucuccgaggucgaguccuucauccucgaccaggaggaccucgacaaccccguccucaagaccaccuccgagaucuuccucuccuccaccgccgagggcgccgaccuccgcaccgucgaccccgagacccaggcccgccucgaggcccuccucgaggccgccggcaucggcaagcucuccaccgccgacggcaaggccuucgccgaccccgagguccuccgccgccucaccuccuccgucuccugcgcccucgacgaggccgccgccgcccucacccgcaugaaggccgagaacucccacaacgccggccaggucgacacccgcucccucgccgaggccugcuccgacggcgacgucaacgccguccgcaagcuccucgacgagggccgcuccgucaacgagcacaccgaggagggcgagucccuccucugccucgccugcuccgccggcuacuacgagcucgcccagguccuccucgccaugcacgccaacgucgaggaccgcggcaacaagggcgacaucaccccccucauggccgccuccuccggcggcuaccucgacaucgucaagcuccuccuccuccacgacgccgacgucaacucccaguccgccaccggcaacaccgcccucaccuacgccugcgccggcggcuucgucgacaucgucaagguccuccucaacgagggcgccaacaucgaggaccacaacgagaacggccacaccccccucauggaggccgccuccgccggccacgucgaggucgcccgcguccuccucgaccacggcgccggcaucaacacccacuccaacgaguucaaggaguccgcccucacccucgccugcuacaagggccaccucgacaugguccgcuuccuccucgaggccggcgccgaccaggagcacaagaccgacgagaugcacaccgcccucauggaggccugcauggacggccacgucgaggucgcccgccuccuccucgacuccggcgcccaggucaacaugcccgccgacuccuucgaguccccccucacccucgccgccugcggcggccacgucgagcucgccgcccuccucaucgagcgcggcgccaaccucgaggaggucaacgacgagggcuacaccccccucauggaggccgcccgcgagggccacgaggagauggucgcccuccuccucgcccagggcgccaacaucaacgcccagaccgaggagacccaggagaccgcccucacccucgccugcugcggcggcuucuccgaggucgccgacuuccucaucaaggccggcgccgacaucgagcucggcugcuccaccccccucauggaggccucccaggagggccaccucgagcucgucaaguaccuccucgccuccggcgccaacguccacgccaccaccgccaccggcgacaccgcccucaccuacgccugcgagaacggccacaccgacgucgccgacguccuccuccaggccggcgccgaccucgagcacgaguccgagggcggccgcaccccccucaugaaggccgcccgcgccggccaccucugcaccguccaguuccucaucuccaagggcgccaacgucaaccgcgccaccgccaacaacgaccacaccgucgucucccucgccugcgccggcggccaccucgccgucgucgagcuccuccucgcccacggcgccgaccccacccaccgccucaaggacggcuccaccaugcucaucgaggccgccaagggcggccacaccaacgucgucuccuaccuccucgacuaccccaacaacguccucuccguccccaccaccgacgucucccagcuccccccccccucccaggaccagucccaggucccccgcguccccacccacacccucgccauggucguccccccccaggagcccgaccgcaccucccaggagaacucccccgcccuccucggcguccagaagggcaccuccaagcagaaguccuccucccuccaggucgccgaccaggaccuccuccccuccuuccaccccuaccagccccucgagugcaucgucgaggagaccgagggcaagcucaacgagcucggccagcgcaucuccgccaucgagaaggcccagcucaagucccucgagcucauccagggcgagccccucaacaaggacaagaucgaggagcucaagaagaaccgcgaggagcagguccagaagaagaagaagauccucaaggagcuccagaaggucgagcgccagcuccagaugaagacccagcagcaguucaccaaggaguaccucgagaccaagggccagaaggacaccgucucccuccaccagcagugcucccaccgcggcgucuuccccgagggcgagggcgacggcucccuccccgaggaccacuucuccgagcucccccaggucgacaccauccucuucaaggacaacgacgucgacgacgagcagcaguccccccccuccgccgagcagaucgacuucguccccguccagccccucuccuccccccagugcaacuucuccuccgaccucggcuccaacggcaccaacucccucgagcuccagaaggucuccggcaaccagcagaucgucggccagccccagaucgccaucaccggccacgaccagggccuccucguccaggagcccgacggccucauggucgccacccccgcccagacccucaccgacacccucgacgaccucaucgccgccgucuccacccgcguccccaccggcuccaacuccuccucccagaccaccgagugccucacccccgaguccugcucccagaccaccuccaacgucgccucccaguccaugccccccgucuaccccuccgucgacaucgacgcccacaccgaguccaaccacgacaccgcccucacccucgccugcgccggcggccacgaggagcucgucuccguccucaucgcccgcgacgccaagaucgagcaccgcgacaagaagggcuucaccccccucauccucgccgccaccgccggccacgucggcgucgucgagauccuccucgacaagggcggcgacaucgaggcccaguccgagcgcaccaaggacaccccccucucccucgccugcuccggcggccgccaggaggucgucgaccuccuccucgcccgcggcgccaacaaggagcaccgcaacgucuccgacuacaccccccucucccucgccgccuccggcggcuacgucaacaucaucaagauccuccucaacgccggcgccgagaucaacucccgcaccggcuccaagcucggcaucuccccccucaugcucgccgccaugaacggccacguccccgccgucaagcuccuccucgacaugggcuccgacaucaacgcccagaucgagaccaaccgcaacaccgcccucacccucgccugcuuccagggccgcgccgaggucgucucccuccuccucgaccgcaaggccaacgucgagcaccgcgccaagaccggccucaccccccucauggaggccgccuccggcggcuacgccgaggucggccgcguccuccucgacaagggcgccgacgucaacgccccccccguccccuccucccgcgacaccgcccucaccaucgccgccgacaagggccacuacaaguucugcgagcuccucauccaccgcggcgcccacaucgacguccgcaacaagaagggcaacaccccccucuggcucgccuccaacggcggccacuucgacgucguccagcuccucguccaggccggcgccgacgucgacgccgccgacaaccgcaagaucaccccccucauguccgccuuccgcaagggccacgucaaggucguccaguaccucgucaaggaggucaaccaguuccccuccgacaucgagugcaugcgcuacaucgccaccaucaccgacaaggagcuccucaagaagugccaccagugcgucgagaccaucgucaaggccaaggaccagcaggccgccgaggccaacaagaacgccuccauccuccucaaggagcucgaccucgagaagucccgcgaggagucccgcaagcaggcccucgccgccaagcgcgagaagcgcaaggagaagcgcaagaagaagaaggaggagcagaagcgcaagcaggaggaggacgaggagaacaagcccaaggagaacuccgagcuccccgaggacgaggacgaggaggagaacgacgaggacgucgagcaggagguccccaucgagccccccuccgccaccaccaccaccaccaucggcaucuccgccaccuccgccaccuucaccaacgucuucggcaagaagcgcgccaacgucgucaccacccccuccaccaaccgcaagaacaagaagaacaagaccaaggagaccccccccaccgcccaccucauccuccccgagcagcacaugucccucgcccagcagaaggccgacaagaacaagaucaacggcgagccccgcggcggcggcgccggcggcaacuccgacuccgacaaccucgacuccaccgacugcaacuccgaguccuccuccggcggcaagucccaggagcucaacuucgucauggacgucaacuccuccaaguaccccucccuccuccuccacucccaggaggagaagaccuccaccgccaccuccaagacccagacccgccucgagggcgaggucacccccaacucccucuccaccuccuacaagaccgucucccucccccucuccucccccaacaucaagcucaaccucaccucccccaagcgcggccagaagcgcgaggagggcuggaaggaggucguccgccgcuccaagaagcucuccguccccgccuccgucgucucccgcaucaugggccgcggcggcugcaacaucaccgccauccaggacgucaccggcgcccacaucgacgucgacaagcagaaggacaagaacggcgagcgcaugaucaccauccgcggcggcaccgaguccacccgcuacgccguccagcucaucaacgcccucauccaggaccccgccaaggagcucgaggaccucauccccaagaaccacauccgcacccccgccuccaccaaguccauccacgccaacuucuccuccggcgucggcaccaccgccgccuccuccaagaacgccuucccccucggcgcccccacccucgucaccucccaggccaccacccucuccaccuuccagcccgccaacaagcucaacaagaacguccccaccaacguccgcuccuccuuccccgucucccucccccucgccuacccccacccccacuucgcccuccucgccgcccagaccaugcagcagauccgccacccccgccuccccauggcccaguucggcggcaccuucucccccucccccaacaccuggggccccuuccccguccgccccgucaaccccggcaacaccaacuccucccccaagcacaacaacaccucccgccuccccaaccagaacggcaccguccuccccuccgaguccgccggccucgccaccgccuccugccccaucaccgucuccuccgucgucgccgccucccagcagcucugcgucaccaacacccgcacccccuccuccguccgcaagcagcucuucgccugcguccccaagaccuccccccccgccaccgucaucuccuccgucaccuccaccugcuccucccuccccuccgucuccuccgcccccaucaccuccggccaggcccccaccaccuuccuccccgccuccaccucccaggcccagcucuccucccagaagauggaguccuucuccgccgucccccccaccaaggagaaggucuccacccaggaccagcccauggccaaccucugcacccccuccuccaccgccaacuccugcuccuccuccgccuccaacacccccggcgcccccgagacccaccccuccuccucccccacccccaccuccuccaacacccaggaggaggcccagcccuccuccgucuccgaccucucccccauguccaugcccuucgccuccaacuccgagcccgccccccucacccucaccuccccccgcauggucgccgccgacaaccaggacaccuccaaccucccccagcucgccguccccgccccccgcgucucccaccgcaugcagccccgcggcuccuucuacuccaugguccccaacgccaccauccaccaggacccccaguccaucuucgucaccaaccccgucacccucacccccccccagggcccccccgccgccguccagcucuccuccgccgucaacaucaugaacggcucccagaugcacaucaaccccgccaacaagucccucccccccaccuucggccccgccacccucuucaaccacuucuccucccucuucgacuccucccagguccccgccaaccagggcuggggcgacggcccccucuccucccgcgucgccaccgacgccuccuucaccguccaguccgccuuccucggcaacuccguccucggccaccucgagaacaugcaccccgacaacuccaaggcccccggcuuccgcccccccucccagcgcgucuccaccucccccgucggccuccccuccaucgaccccuccggcuccucccccuccuccuccuccgccccccucgccuccuucuccggcauccccggcacccgcgucuuccuccagggccccgcccccgucggcacccccuccuucaaccgccagcacuucuccccccaccccuggaccuccgccuccaacuccuccaccuccgccccccccacccucggccagcccaagggcgucuccgccucccaggaccgcaagauccccccccccaucggcaccgagcgccucgcccgcauccgccagggcggcuccgucgcccaggcccccgccggcaccuccuucgucgcccccgucggccacuccggcaucugguccuucggcgucaacgccgucuccgagggccucuccggcuggucccaguccgucaugggcaaccaccccaugcaccagcagcucuccgaccccuccaccuucucccagcaccagcccauggagcgcgacgacuccggcauggucgcccccuccaacaucuuccaccagcccauggccuccggcuucgucgacuucuccaagggccuccccaucuccauguacggcggcaccaucauccccucccacccccagcucgccgacguccccggcggcccccucuucaacggccuccacaaccccgaccccgccuggaaccccaugaucaaggucauccagaacuccaccgagugcaccgacgcccagcagaucuggcccggcaccugggccccccacaucggcaacaugcaccucaaguacgucaacuga

SEQ ID NO: 39701 - RNA, 1479 nt, Artificial Sequence
  derived and/or modified sequence opt2 from ANKH__Homo_sapiens__NP_473368
auggucaaguuccccgcccucacccacuacuggccccucauccgcuuccucgucccccucggcaucaccaacaucgccaucgacuucggcgagcaggcccucaaccgcggcaucgccgccgucaaggaggacgccgucgagaugcucgccuccuacggccucgccuacucccucaugaaguucuucaccggccccauguccgacuucaagaacgucggccucgucuucgucaacuccaagcgcgaccgcaccaaggccguccucugcauggucgucgccggcgccaucgccgccgucuuccacacccucaucgccuacuccgaccucggcuacuacaucaucaacaagcuccaccacgucgacgaguccgucggcuccaagacccgccgcgccuuccucuaccucgccgccuuccccuucauggacgccauggccuggacccacgccggcauccuccucaagcacaaguacuccuuccucgucggcugcgccuccaucuccgacgucaucgcccaggucgucuucgucgccauccuccuccacucccaccucgagugccgcgagccccuccucauccccauccucucccucuacaugggcgcccucguccgcugcaccacccucugccucggcuacuacaagaacauccacgacaucauccccgaccgcuccggccccgagcucggcggcgacgccaccauccgcaagaugcucuccuucugguggccccucgcccucauccucgccacccagcgcaucucccgccccaucgucaaccucuucgucucccgcgaccucggcggcuccuccgccgccaccgaggccgucgccauccucaccgccaccuaccccgucggccacaugcccuacggcuggcucaccgagauccgcgccgucuaccccgccuucgacaagaacaaccccuccaacaagcucgucuccaccuccaacaccgucaccgccgcccacaucaagaaguucaccuucgucugcauggcccucucccucacccucugcuucgucauguucuggacccccaacgucuccgagaagauccucaucgacaucaucggcgucgacuucgccuucgccgagcucugcgucgucccccuccgcaucuucuccuucuuccccguccccgucaccguccgcgcccaccucaccggcuggcucaugacccucaagaagaccuucguccucgcccccuccuccguccuccgcaucaucguccucaucgccucccucgucguccuccccuaccucggcguccacggcgccacccucggcgucggcucccuccucgccggcuucgucggcgaguccaccauggucgccaucgccgccugcuacgucuaccgcaagcagaagaagaagauggagaacgaguccgccaccgagggcgaggacuccgccaugaccgacaugccccccaccgaggaggucaccgacaucgucgagaugcgcgaggagaacgaguga

SEQ ID NO: 39702 - RNA, 2298 nt, Artificial Sequence
  derived and/or modified sequence opt2 from ANKK1__Homo_sapiens__NP_848605
auggccgccgaccccaccgagcuccgccucggcucccuccccgucuucacccgcgacgacuucgagggcgacuggcgccucgucgccuccggcggcuucucccaggucuuccaggcccgccaccgccgcuggcgcaccgaguacgccaucaagugcgcccccugccucccccccgacgccgccuccuccgacgucaacuaccucaucgaggaggccgccaagaugaagaagaucaaguuccagcacaucgucuccaucuacggcgucugcaagcagccccucggcaucgucauggaguucauggccaacggcucccucgagaagguccucuccacccacucccucugcuggaagcuccgcuuccgcaucauccacgagaccucccucgccaugaacuuccuccacuccaucaagcccccccuccuccaccucgaccucaagcccggcaacauccuccucgacuccaacaugcacgucaagaucuccgacuucggccucuccaaguggauggagcaguccacccgcaugcaguacaucgagcgcuccgcccuccgcggcaugcucuccuacaucccccccgagauguuccucgaguccaacaaggcccccggccccaaguacgacgucuacuccuucgccaucgucaucugggagcuccucacccagaagaagcccuacuccggcuucaacaugaugaugaucaucauccgcgucgccgccggcaugcgccccucccuccagcccgucuccgaccaguggcccuccgaggcccagcagauggucgaccucaugaagcgcugcugggaccaggaccccaagaagcgccccugcuuccucgacaucaccaucgagaccgacauccuccucucccuccuccagucccgcgucgccguccccgaguccaaggcccucgcccgcaaggucuccugcaagcucucccuccgccagcccggcgaggucaacgaggacaucucccaggagcucauggacuccgacuccggcaacuaccucaagcgcgcccuccagcucuccgaccgcaagaaccucgucccccgcgacgaggagcucugcaucuacgagaacaaggucaccccccuccacuuccucgucgcccagggcuccgucgagcagguccgccuccuccucgcccacgaggucgacgucgacugccagaccgccuccggcuacaccccccuccucaucgccgcccaggaccagcagcccgaccucugcgcccuccuccucgcccacggcgccgacgccaaccgcgucgacgaggacggcugggccccccuccacuucgccgcccagaacggcgacgacggcaccgcccgccuccuccucgaccacggcgccugcgucgacgcccaggagcgcgagggcuggaccccccuccaccucgccgcccagaacaacuucgagaacgucgcccgccuccucgucucccgccaggccgaccccaaccuccacgaggccgagggcaagaccccccuccacgucgccgccuacuucggccacgucucccucgucaagcuccucaccucccagggcgccgagcucgacgcccagcagcgcaaccuccgcaccccccuccaccucgccgucgagcgcggcaagguccgcgccauccagcaccuccucaaguccggcgccguccccgacgcccucgaccaguccggcuacggcccccuccacaccgccgccgcccgcggcaaguaccucaucugcaagaugcuccuccgcuacggcgccucccucgagcuccccacccaccagggcuggaccccccuccaccucgccgccuacaagggccaccucgagaucauccaccuccucgccgagucccacgccaacaugggcgcccucggcgccgucaacuggaccccccuccaccucgccgcccgccacggcgaggaggccgucgucuccgcccuccuccagugcggcgccgaccccaacgccgccgagcaguccggcuggaccccccuccaccucgccguccagcgcuccaccuuccucuccgucaucaaccuccucgagcaccacgccaacguccacgcccgcaacaaggucggcuggacccccgcccaccucgccgcccucaagggcaacaccgccauccucaagguccucgucgaggccggcgcccagcucgacguccaggacggcgucuccugcaccccccuccagcucgcccuccgcucccgcaagcagggcaucauguccuuccucgagggcaaggagcccuccgucgccacccucggcggcuccaagcccggcgccgagauggagaucuga

SEQ ID NO: 39703 - RNA, 1956 nt, Artificial Sequence
  derived and/or modified sequence opt2 from ANKLE1__Homo_sapiens__NP_001265373
auguggacccccguccgccgcggcgccgccuggcucggcacccuccucggccccggcgagggcccccccgagccccgcggcggcgccgcccacgcccacaagccccccgccggcucccgcaaguccaccgaccaggccguccgcuucggccccucccagggcaugugcuccgaggcccgccucgcccgccgccuccgcgacgcccuccgcgaggaggagcccugggccgucgaggagcuccuccgcugcggcgccgaccccaaccucguccucgaggacggcgccgccgccguccaccucgccgccggcgcccgccacccccgcggccuccgcugccucggcgcccuccuccgccagggcggcgaccccaacgcccgcuccgucgaggcccucaccccccuccacgucgccgccgccuggggcugccgccgcggccucgagcuccuccucucccagggcgccgaccccgcccuccgcgaccaggacggccuccgcccccucgaccucgcccuccagcagggccaccucgagugcgcccgcguccuccaggaccucgacacccgcacccgcacccgcacccgcaucggcgccgagacccaggagcccgagcccgcccccggcacccccggccucuccggccccaccgacgagacccucgacuccaucgcccuccagaagcagcccugccgcggcgacaaccgcgacaucggccucgaggccgaccccggcccccccucccuccccgucccccucgagaccgucgacaagcacggcuccuccgccuccccccccggccacugggacuacuccuccgacgccuccuucgucaccgccgucgaggucuccggcgccgaggaccccgccuccgacaccccccccugggccggcucccucccccccacccgccagggccuccuccacgucguccacgccaaccagcgcgucccccgcucccagggcaccgaggccgagcucaacgcccgccuccaggcccucacccucaccccccccaacgccgccggcuuccaguccucccccuccuccaugccccuccucgaccgcucccccgcccacucccccccccgcacccccacccccggcgccuccgacugccacugccucugggagcaccagaccuccaucgacuccgacauggccacccucuggcucaccgaggacgaggccuccuccaccggcggccgcgagcccgucggccccugccgccaccuccccgucuccaccgucuccgaccucgagcuccucaagggccuccgcgcccucggccccgaguucuccggccacucccucgagcucgccgccgcccuccgcaccggcugcauccccgacguccaggccgacgaggacgcccucgcccagcaguucgagcagcccgaccccgcccgccgcuggcgcgagggcgucgucaaguccuccuucaccuaccuccuccucgacccccgcgagacccaggaccuccccgcccgcgccuucucccucacccccgccgagcgccuccagaccuucauccgcgccaucuucuacgucggcaagggcacccgcgcccgccccuacguccaccucugggaggcccucggccaccacggccgcucccgcaagcagggcucccgccgcucccccacccgcuccaagggcaccgccauggagugguggcaggccggccaccuccucgucgccggcgccuggggcugcaccugcugcaccguccccucccucuccuccuggcucaaggccuccgacuccuucaucccccgcaccucccgccccggcgccgagugcuggggcgucggccaccccgccuggggcgagauguucgagugcuccuccugccccaugcucaccgccgcccccaucuccggcuuccgccgcggcgucugcgucugcgucugcgucugcgucugcgucugcgucugccucugcgucugcgucugcgucuga

SEQ ID NO: 39704 - RNA, 2817 nt, Artificial Sequence
  derived and/or modified sequence opt2 from ANKLE2__Homo_sapiens__NP_055929
augcucuggccccgccucgccgccgccgagugggccgcccucgccugggagcuccucggcgccuccguccuccucaucgccguccgcuggcucguccgccgccucggcccccgccccggcggccucggccgcuccggcacccccguccccccccccuccgccgccgccgcccccgccuccggcgagaugaccauggacgcccuccucgcccgccucaagcuccucaaccccgacgaccuccgcgaggagaucgucaaggccggccucaagugcggccccaucaccuccaccacccgcuucaucuucgagaagaagcucgcccaggcccuccucgagcagggcggccgccucuccuccuucuaccaccacgaggccggcgucaccgcccucucccaggacccccagcgcauccucaagcccgccgagggcaaccccaccgaccaggccggcuucuccgaggaccgcgacuucggcuacuccgucggccucaacccccccgaggaggaggccgucaccuccaagaccugcuccgucccccccuccgacaccgacaccuaccgcgccggcgccaccgccuccaaggagcccccccucuacuacggcgucugccccgucuacgaggacguccccgcccgcaacgagcgcaucuacgucuacgagaacaagaaggaggcccuccaggccgucaagaugaucaagggcucccgcuucaaggccuucuccacccgcgaggacgccgagaaguucgcccgcggcaucugcgacuacuuccccucccccuccaagaccucccucccccucucccccgucaagaccgccccccucuucuccaacgaccgccucaaggacggccucugccucuccgaguccgagaccgucaacaaggagcgcgccaacuccuacaagaacccccgcacccaggaccucaccgccaagcuccgcaaggccgucgagaagggcgaggaggacaccuucuccgaccucaucugguccaacccccgcuaccucaucggcuccggcgacaaccccaccaucguccaggagggcugccgcuacaacgucaugcacgucgccgccaaggagaaccaggccuccaucugccagcucacccucgacguccucgagaaccccgacuucaugcgccucauguaccccgacgacgacgaggccaugcuccagaagcgcauccgcuacgucgucgaccucuaccucaacacccccgacaagaugggcuacgacaccccccuccacuucgccugcaaguucggcaacgccgacgucgucaacguccucuccucccaccaccucaucgucaagaacucccgcaacaaguacgacaagacccccgaggacgucaucugcgagcgcuccaagaacaaguccgucgagcucaaggagcgcauccgcgaguaccucaagggccacuacuacgucccccuccuccgcgccgaggagaccuccucccccgucaucggcgagcucuggucccccgaccagaccgccgaggccucccacgucucccgcuacggcggcuccccccgcgaccccguccucacccuccgcgccuucgccggcccccucucccccgccaaggccgaggacuuccgcaagcucuggaagacccccccccgcgagaaggccggcuuccuccaccacgucaagaaguccgaccccgagcgcggcuucgagcgcgucggccgcgagcucgcccacgagcucggcuaccccugggucgaguacugggaguuccucggcugcuucgucgaccucuccucccaggagggccuccagcgccucgaggaguaccucacccagcaggagaucggcaagaaggcccagcaggagaccggcgagcgcgaggccuccugccgcgacaaggccaccaccuccggcuccaacuccaucuccguccgcgccuuccucgacgaggacgacaugucccucgaggagaucaagaaccgccagaacgccgcccgcaacaacuccccccccaccgucggcgccuucggccacacccgcugcuccgccuucccccucgagcaggaggccgaccucaucgaggccgccgagcccggcggcccccacuccucccgcaacggccucugccacccccucaaccacucccgcacccucgccggcaagcgccccaaggccccccgcggcgaggaggcccaccucccccccgucuccgaccucaccgucgaguucgacaagcucaaccuccagaacaucggccgcuccgucuccaagacccccgacgaguccaccaagaccaaggaccagauccucaccucccgcaucaacgccgucgagcgcgaccuccucgagcccucccccgccgaccagcucggcaacggccaccgccgcaccgaguccgagauguccgcccgcaucgccaagaugucccucucccccuccuccccccgccacgaggaccagcucgaggucacccgcgagcccgcccgccgccucuuccucuucggcgaggagcccuccaagcucgaccaggacguccucgccgcccucgagugcgccgacgucgacccccaccaguuccccgccguccaccgcuggaaguccgccguccucugcuacucccccuccgaccgccaguccuggcccucccccgccgucaagggccgcuucaagucccagcuccccgaccucuccggcccccacuccuacucccccggccgcaacuccgucgccggcuccaaccccgccaagcccggccucggcucccccggccgcuacucccccguccacggcucccagcuccgccgcauggcccgccucgccgagcucgccgcccucuga

SEQ ID NO: 39705 - RNA, 3093 nt, Artificial Sequence
  derived and/or modified sequence opt2 from ANKMY1__Homo_sapiens__NP_001269700
auggagggcgcccacgccucccucucccucgaggacgaggucuccggcgccggcucccgccagcgcccccucgagggcaagggcggcgagacccccgccgccgaggagcccggcucccucaagaacuacgccgucuucgccacccgcgacgucuccgccgcccccgagaaggaggaggaggaggccgagggcccccuccgcgcccaggaccuccgcgaguccuacauccagcucguccagggcguccaggaguggcaggacggcugcauguaccagggcgaguucggccucaacaugaagcucggcuacggcaaguucuccuggcccaccggcgaguccuaccacggccaguucuaccgcgaccacugccacggccucggcaccuacauguggcccgacggcuccuccuucaccggcaccuucuaccucucccaccgcgagggcuacggcaccauguacaugaagacccgccucuuccagggccucuacaaggccgaccagcgcuucggccccggcgucgagaccuaccccgacggcucccaggacgucggccucugguuccgcgagcagcucaucaagcucugcacccagauccccuccggcuucucccuccuccgcuaccccgaguucuccuccuucaucacccacucccccgcccgcaucucccucuccgaggaggagaagaccgaguggggccuccaggagggccaggaccccuucuucuacgacuacaagcgcuuccuccucaacgacaaccucacccucccccccgagauguacgucuacuccaccaacuccgaccaccuccccaugaccuccuccuuccgcaaggagcucgacgcccgcaucuuccucaacgagaucccccccuucgucgaggacggcgagcccugguucaucaucaacgagaccccccuccucgucaagauccagaagcagaccuacaaguuccgcaacaagcccgcccacaccuccuggaacaugggcgccauccucgagggcaagcgcuccggcuucgcccccugcggccccaaggagcagcucuccauggagaugauccucaaggccgaggagggcaaccacgaguggaucugccgcauccucaaggacaacuucgccuccgccgacgucgccgacgccaagggcuacaccguccucgccgccgccgccacccacugccacaacgacaucgucaaccuccuccucgacugcggcgccgacgucaacaagugcuccgacgagggccucaccgcccucuccaugugcuuccuccuccacuaccccgcccaguccuucaagcccaacgucgccgagcgcaccauccccgagccccaggagccccccaaguuccccgucguccccauccucuccuccuccuucauggacaccaaccucgagucccucuacuacgaggucaacguccccucccagggcuccuacgagcuccgccccccccccgccccccuccuccucccccgcgucuccggcucccacgagggcggccacuuccaggacaccggccagugcggcggcuccaucgaccaccgcuccuccucccucaagggcgacuccccccucgucaagggcucccucggccacgucgaguccggccucgaggacguccucggcaacaccgaccgcggcucccucugcuccgccgagaccaaguucgaguccaacgucugcgucugcgacuucuccaucgagcucucccaggccaugcucgagcgcuccgcccagucccacucccuccucaagauggccucccccucccccugcaccuccuccuucgacaagggcaccaugcgccgcauggcccucuccaugaucgagcgccgcaagcgcuggcgcaccaucaagcuccuccuccgccgcggcgccgaccccaaccucugcugcguccccaugcagguccucuuccucgccgucaaggccggcgacgucgacggcguccgccuccuccucgagcacggcgcccgcaccgacaucugcuuccccccccagcucuccacccucaccccccuccacaucgccgccgcccuccccggcgaggagggcguccagaucgucgagcuccuccuccacgccaucaccgacgucgacgccaaggccuccgacgaggacgacaccuacaagcccggcaagcucgaccuccuccccuccucccucaagcucuccaacgagcccggccccccccaggccuacuacuccaccgacaccgcccuccccgaggagggcggccgcaccgcccuccacauggccugcgagcgcgaggacgacaacaagugcgcccgcgacaucguccgccuccuccucucccacggcgccaaccccaaccuccucugguccggccacuccccccucucccucuccaucgccuccggcaacgagcucgucgucaaggagcuccucacccagggcgccgaccccaaccucccccucaccaagggccucggcuccgcccucugcgucgccugcgaccucaccuacgagcaccagcgcaacauggacuccaagcucgcccucaucgaccgccucaucucccacggcgccgacauccucaagcccgucaugcuccgccagggcgagaaggaggccgucggcaccgccgucgacuacggcuacuuccgcuucuuccaggaccgccgcaucgcccgcugccccuuccacacccucaugcccgccgagcgcgagaccuuccucgcccgcaagcgccuccucgaguacaugggccuccagcuccgccaggccgucuucgccaaggagucccagugggaccccaccuggcucuaccucugcaagcgcgccgagcucauccccucccaccgcaugaagaagaagggccccucccucccccgcggccucgacgucaaggagcagggccagauccccuucuucaaguucugcuaccagugcggccgcuccaucggcguccgccuccuccccugcccccgcugcuacggcauccucaccugcuccaaguacugcaagaccaaggccuggaccgaguuccacaagaaggacugcggcgaccucgucgccaucgucacccagcucgagcaggucucccgccgccgcgaggaguuccaguga

SEQ ID NO: 39706 - RNA, 663 nt, Artificial Sequence
  derived and/or modified sequence opt2 from ANKRD10__Homo_sapiens__NP_001273650
auguccgccgccggcgccggcgccggcgucgaggccggcuucuccuccgaggagcuccucucccuccgcuucccccuccaccgcgccugccgcgacggcgaccucgccacccucugcucccuccuccagcagaccccccacgcccaccucgccuccgaggacuccuucuacggcuggacccccguccacugggccgcccacuucggcaagcucgagugccucguccagcucguccgcgccggcgccacccucaacgucuccaccacccgcuacgcccagacccccgcccacaucgccgccuucggcggccacccccagugccucgucuggcucauccaggccggcgccaacaucaacaagcccgacugcgagggcgagacccccauccacaaggccgcccgcuccggcucccucgagugcaucuccgcccucgucgccaacggcgcccacgucgaguucaucucccaguccuccguccacuccugccuccccggcgagcuccagcacggcgucaccuucgaccccuccguccucauccagugccucaagcccgagaagugccaguggcccgacuccucccgccacugcaccaaccccggcuucccccgcgucugccccgucucccucgagccccccgagcucuccuccgagcccuuccucuga

SEQ ID NO: 39707 - RNA, 7992 nt, Artificial Sequence
  derived and/or modified sequence opt2 from ANKRD11__Homo_sapiens__NP_037407
augcccaagggcggcugccccaaggccccccagcaggaggagcucccccucuccuccgacauggucgagaagcagaccggcaagaaggacaaggacaaggucucccucaccaagacccccaagcucgagcgcggcgacggcggcaaggagguccgcgagcgcgccuccaagcgcaagcuccccuucaccgccggcgccaacggcgagcagaaggacuccgacaccgagaagcagggccccgagcgcaagcgcaucaagaaggagcccgucacccgcaaggccggccuccucuucggcaugggccucuccggcauccgcgccggcuacccccucuccgagcgccagcaggucgcccuccucaugcagaugaccgccgaggaguccgccaacucccccgucgacaccacccccaagcaccccucccaguccaccgucugccagaagggcacccccaacuccgccuccaagaccaaggacaaggucaacaagcgcaacgagcgcggcgagacccgccuccaccgcgccgccauccgcggcgacgcccgccgcaucaaggagcucaucuccgagggcgccgacgucaacgucaaggacuucgccggcuggaccgcccuccacgaggccugcaaccgcggcuacuacgacgucgccaagcagcuccucgccgccggcgccgaggucaacaccaagggccucgacgacgacaccccccuccacgacgccgccaacaacggccacuacaaggucgucaagcuccuccuccgcuacggcggcaacccccagcaguccaaccgcaagggcgagaccccccucaaggucgccaacucccccaccauggucaaccuccuccucggcaagggcaccuacaccuccuccgaggaguccuccaccgaguccuccgaggaggaggacgcccccuccuucgcccccuccuccuccgucgacggcaacaacaccgacuccgaguucgagaagggccucaagcacaaggccaagaaccccgagccccagaaggccaccgcccccgucaaggacgaguacgaguucgacgaggacgacgagcaggaccgcgucccccccgucgacgacaagcaccuccucaagaaggacuaccgcaaggagaccaaguccaacuccuucaucuccauccccaagauggaggucaaguccuacaccaagaacaacaccaucgcccccaagaaggccucccaccgcauccucuccgacaccuccgacgaggaggacgccuccgucaccgucggcaccggcgagaagcuccgccucuccgcccacaccauccuccccggcuccaagacccgcgagcccuccaacgccaagcagcagaaggagaagaacaaggucaagaagaagcgcaagaaggagaccaagggccgcgagguccgcuucggcaagcgcuccgacaaguucugcuccuccgaguccgaguccgaguccuccgaguccggcgaggacgaccgcgacucccucggcuccuccggcugccucaagggcuccccccucguccucaaggaccccucccucuucuccucccucuccgccuccuccaccuccucccacggcuccuccgccgcccagaagcagaaccccucccacaccgaccagcacaccaagcacuggcgcaccgacaacuggaagaccaucuccucccccgccugguccgaggucuccucccucuccgacuccacccgcacccgccucaccuccgaguccgacuacuccuccgagggcuccuccgucgagucccucaagcccguccgcaagcgccaggagcaccgcaagcgcgccucccucuccgagaagaagucccccuuccucuccuccgccgagggcgccguccccaagcucgacaaggagggcaaggucgucaagaagcacaagaccaagcacaagcacaagaacaaggagaagggccagugcuccaucucccaggagcucaagcucaaguccuucaccuacgaguacgaggacuccaagcagaaguccgacaaggccauccuccucgagaacgaccucuccaccgagaacaagcucaagguccucaagcacgaccgcgaccacuucaagaaggaggagaagcucuccaagaugaagcucgaggagaaggaguggcucuucaaggacgagaagucccucaagcgcaucaaggacaccaacaaggacaucucccgcuccuuccgcgaggagaaggaccgcuccaacaaggccgagaaggagcgcucccucaaggagaagucccccaaggaggagaagcuccgccucuacaaggaggagcgcaagaagaaguccaaggaccgccccuccaagcucgagaagaagaacgaccucaaggaggacaagaucuccaaggagaaggagaagaucuucaaggaggacaaggagaagcucaagaaggagaaggucuaccgcgaggacuccgccuucgacgaguacugcaacaagaaccaguuccucgagaacgaggacaccaaguucucccucuccgacgaccagcgcgaccgcugguucuccgaccucuccgacuccuccuucgacuucaagggcgaggacuccugggacucccccgucaccgacuaccgcgacaugaaguccgacuccgucgccaagcucauccucgagaccgucaaggaggacuccaaggagcgccgccgcgacucccgcgcccgcgagaagcgcgacuaccgcgagcccuucuuccgcaagaaggaccgcgacuaccucgacaagaacuccgagaagcgcaaggagcagaccgagaagcacaaguccguccccggcuaccucuccgagaaggacaagaagcgccgcgaguccgccgaggccggccgcgaccgcaaggacgcccucgaguccugcaaggagcgccgcgacggccgcgccaagcccgaggaggcccaccgcgaggagcucaaggagugcggcugcgaguccggcuucaaggacaaguccgacggcgacuucggcaagggccucgagcccugggagcgccaccaccccgcccgcgagaaggagaagaaggacggccccgacaaggagcgcaaggagaagaccaagcccgagcgcuacaaggagaaguccuccgacaaggacaaguccgagaaguccauccucgagaagugccagaaggacaaggaguucgacaagugcuucaaggagaagaaggacaccaaggagaagcacaaggacacccacggcaaggacaaggagcgcaaggccucccucgaccagggcaaggagaagaaggagaaggccuuccccggcaucaucuccgaggacuucuccgagaagaaggacgacaagaagggcaaggagaaguccugguacaucgccgacaucuucaccgacgaguccgaggacgaccgcgacuccugcaugggcuccggcuucaagaugggcgaggccuccgaccucccccgcaccgacggccuccaggagaaggaggagggccgcgaggccuacgccuccgaccgccaccgcaaguccuccgacaagcagcaccccgagcgccagaaggacaaggagccccgcgaccgccgcaaggaccgcggcgccgccgacgccggccgcgacaagaaggagaaggucuucgagaagcacaaggagaagaaggacaaggaguccaccgagaaguacaaggaccgcaaggaccgcgccuccgucgacuccacccaggacaagaagaacaagcagaagcuccccgagaaggccgagaagaagcacgccgccgaggacaaggccaaguccaagcacaaggagaaguccgacaaggagcacuccaaggagcgcaaguccucccgcuccgccgacgccgagaagucccuccucgagaagcucgaggaggaggcccuccacgaguaccgcgaggacuccaacgacaagaucuccgaggucuccuccgacuccuucaccgaccgcggccaggagcccggccucaccgccuuccucgaggucuccuucaccgagccccccggcgacgacaagccccgcgaguccgccugccuccccgagaagcucaaggagaaggagcgccaccgccacuccuccuccuccuccaagaagucccacgaccgcgagcgcgccaagaaggagaaggccgagaagaaggagaagggcgaggacuacaaggagggcggcucccgcaaggacuccggccaguacgagaaggacuuccucgaggccgacgccuacggcgucuccuacaacaugaaggccgacaucgaggacgagcucgacaagaccaucgagcucuucuccaccgagaagaaggacaagaacgacuccgagcgcgagcccuccaagaagaucgagaaggagcucaagcccuacggcuccuccgccaucaacauccucaaggagaagaagaagcgcgagaagcaccgcgagaaguggcgcgacgagaaggagcgccaccgcgaccgccacgccgacggccuccuccgccaccaccgcgacgagcuccuccgccaccaccgcgacgagcagaagcccgccacccgcgacaaggacucccccccccgcguccucaaggacaagucccgcgacgagggcccccgccucggcgacgccaagcucaaggagaaguucaaggacggcgccgagaaggagaagggcgaccccgucaagauguccaacggcaacgacaaggucgcccccuccaaggaccccggcaagaaggacgcccgcccccgcgagaagcuccucggcgacggcgaccucaugaugaccuccuucgagcgcaugcucucccagaaggaccucgagaucgaggagcgccacaagcgccacaaggagcgcaugaagcagauggagaagcuccgccaccgcuccggcgaccccaagcucaaggagaaggccaagcccgccgacgacggccgcaagaagggccucgacauccccgccaagaagccccccggccucgacccccccuucaaggacaagaagcucaaggaguccacccccaucccccccgccgccgagaacaagcuccaccccgccuccggcgccgacuccaaggacuggcucgccggcccccacaugaaggagguccuccccgccuccccccgccccgaccagucccgccccaccggcguccccacccccaccuccguccucuccugccccuccuacgaggaggucaugcacaccccccgcacccccuccugcuccgccgacgacuacgccgaccucgucuucgacugcgccgacucccagcacuccacccccguccccaccgcccccaccuccgccugcucccccuccuucuucgaccgcuucuccgucgccuccuccggccucuccgagaacgccucccaggcccccgcccgcccccucuccaccaaccucuaccgcuccgucuccgucgacauccgccgcacccccgaggaggaguucuccgucggcgacaagcucuuccgccagcaguccguccccgccgccuccuccuacgacucccccaugccccccuccauggaggaccgcgccccccucccccccguccccgccgagaaguucgccugccucucccccggcuacuacucccccgacuacggccuccccucccccaaggucgacgcccuccacugcccccccgccgccgucgucaccgucacccccucccccgagggcgucuucuccucccuccaggccaagcccucccccuccccccgcgccgagcuccucguccccucccucgagggcgcccucccccccgaccucgacaccuccgaggaccagcaggccaccgccgccaucaucccccccgagcccuccuaccucgagccccucgacgagggccccuucuccgccgucaucaccgaggagcccgucgagugggcccaccccuccgagcaggcccucgccuccucccucaucggcggcaccuccgagaaccccgucuccuggcccgucggcuccgaccuccuccucaaguccccccagcgcuuccccgagucccccaagcgcuucugccccgccgacccccuccacuccgccgcccccggccccuucuccgccuccgaggcccccuaccccgccccccccgccucccccgcccccuacgcccuccccgucgccgagcccggccucgaggacgucaaggacggcgucgacgccguccccgccgccaucuccaccuccgaggccgcccccuacgccccccccuccggccucgaguccuucuucuccaacugcaagucccuccccgaggccccccucgacgucgcccccgagcccgccugcgucgccgccgucgcccaggucgaggcccucggcccccucgagaacuccuuccucgacggcucccgcggccucucccaccucggccaggucgagcccguccccugggccgacgccuucgccggccccgaggacgaccucgaccucggccccuucucccuccccgagcucccccuccagaccaaggacgccgccgacggcgaggccgagcccgucgaggagucccucgccccccccgaggagaugccccccggcgcccccggcgucaucaacggcggcgacgucuccaccgucgucgccgaggagccccccgcccucccccccgaccaggccuccacccgccuccccgccgagcucgagcccgagcccuccggcgagcccaagcucgacgucgcccucgaggccgccgucgaggccgagaccguccccgaggagcgcgcccgcggcgaccccgacuccuccgucgagcccgcccccgucccccccgagcagcgcccccucggcuccggcgaccagggcgccgaggccgagggcccccccgccgccucccucugcgcccccgacggccccgcccccaacaccgucgcccaggcccaggccgccgacggcgccggccccgaggacgacaccgaggccucccgcgccgccgcccccgccgagggcccccccggcggcauccagcccgaggccgccgagcccaagcccaccgccgaggcccccaaggccccccgcgucgaggagaucccccagcgcaugacccgcaaccgcgcccagaugcucgccaaccaguccaagcagggccccccccccuccgagaaggagugcgcccccacccccgcccccgucacccgcgccaaggcccgcggcuccgaggacgacgacgcccaggcccagcacccccgcaagcgccgcuuccagcgcuccacccagcagcuccagcagcagcucaacaccuccacccagcagacccgcgaggucauccagcagacccucgccgccaucgucgacgccaucaagcucgacgccaucgagcccuaccacuccgaccgcgccaaccccuacuucgaguaccuccagauccgcaagaagaucgaggagaagcgcaagauccucugcugcaucaccccccaggccccccagugcuacgccgaguacgucaccuacaccggcuccuaccuccucgacggcaagccccucuccaagcuccacauccccgucaucgcccccccccccucccucgccgagccccucaaggagcucuuccgccagcaggaggccguccgcggcaagcuccgccuccagcacuccaucgagcgcgagaagcucaucgucuccugcgagcaggagauccuccgcguccacugccgcgccgcccgcaccaucgccaaccaggccguccccuucuccgccugcaccaugcuccucgacuccgaggucuacaacaugccccucgagucccagggcgacgagaacaaguccguccgcgaccgcuucaacgcccgccaguucaucuccuggcuccaggacgucgacgacaaguacgaccgcaugaagaccugccuccucaugcgccagcagcacgaggccgccgcccucaacgccguccagcgcauggaguggcagcucaagguccaggagcucgaccccgccggccacaagucccucugcgucaacgagguccccuccuucuacguccccauggucgacgucaacgacgacuucguccuccuccccgccuga

SEQ ID NO: 39708 - RNA, 6120 nt, Artificial Sequence
  derived and/or modified sequence opt2 from ANKRD12__Homo_sapiens__NP_001190985
augcccaaguccggcuucaccaagcccauccaguccgagaacuccgacuccgacuccaacauggucgagaagcccuacggccgcaaguccaaggacaagaucgccuccuacuccaagacccccaagaucgagcgcuccgacgucuccaaggagaugaaggagaaguccuccaugaagcgcaagcuccccuucaccaucucccccucccgcaacgaggagcgcgacuccgacaccgagaaggagggccccgagaagaagaagaccaagaaggaggccggcaacaagaaguccacccccgucuccauccucuucggcuacccccucuccgagcgcaagcagauggcccuccucaugcagaugaccgcccgcgacaacucccccgacuccacccccaaccaccccucccagaccacccccgcccagaagaagacccccuccuccuccucccgccagaaggacaaggucaacaagcgcaacgagcgcggcgagaccccccuccacauggccgccauccgcggcgacgucaagcaggucaaggagcucaucucccucggcgccaacgucaacgucaaggacuucgccggcuggaccccccuccacgaggccugcaacgucggcuacuacgacgucgccaagauccucaucgccgccggcgccgacgucaacacccagggccucgacgacgacaccccccuccacgacuccgccuccuccggccaccgcgacaucgucaagcuccuccuccgccacggcggcaaccccuuccaggccaacaagcacggcgagcgccccgucgacgucgccgagaccgaggagcucgagcuccuccucaagcgcgaggucccccucuccgacgacgacgaguccuacaccgacuccgaggaggcccaguccgucaaccccuccuccgucgacgagaacaucgacuccgagaccgagaaggacucccucaucugcgaguccaagcagauccuccccuccaagaccccccuccccuccgcccucgacgaguacgaguucaaggacgacgacgacgaggagaucaacaagaugaucgacgaccgccacauccuccgcaaggagcagcgcaaggagaacgagcccgaggccgagaagacccaccucuucgccaagcaggagaaggccuucuaccccaaguccuucaaguccaagaagcagaagcccucccgcguccucuacuccuccaccgaguccuccgacgaggaggcccuccagaacaagaagaucuccaccuccugcuccgucauccccgagaccuccaacuccgacaugcagaccaagaaggaguacgucgucuccggcgagcacaagcagaagggcaaggucaagcgcaagcucaagaaccagaacaagaacaaggagaaccaggagcucaagcaggagaaggagggcaaggagaacacccgcaucaccaaccucaccgucaacaccggccucgacugcuccgagaagacccgcgaggagggcaacuuccgcaaguccuucucccccaaggacgacaccucccuccaccucuuccacaucuccaccggcaagucccccaagcacuccugcggccucuccgagaagcaguccaccccccucaagcaggagcacaccaagaccugccucucccccggcuccuccgagaugucccuccagcccgaccucguccgcuacgacaacaccgaguccgaguuccuccccgaguccuccuccgucaaguccugcaagcacaaggagaaguccaagcaccagaaggacuuccaccucgaguucggcgagaaguccaacgccaagaucaaggacgaggaccacucccccaccuucgagaacuccgacugcacccucaagaagauggacaaggagggcaagacccucaagaagcacaagcucaagcacaaggagcgcgagaaggagaagcacaagaaggagaucgagggcgagaaggagaaguacaagaccaaggacuccgccaaggagcuccagcgcuccgucgaguucgaccgcgaguucuggaaggagaacuucuucaaguccgacgagaccgaggaccucuuccucaacauggagcacgagucccucacccucgagaagaaguccaagcucgagaagaacaucaaggacgacaaguccaccaaggagaagcacgucuccaaggagcgcaacuucaaggaggagcgcgacaagaucaagaaggaguccgagaaguccuuccgcgaggagaagaucaaggaccucaaggaggagcgcgagaacauccccaccgacaaggacuccgaguucaccucccucggcauguccgccaucgaggaguccaucggccuccaccucgucgagaaggagaucgacaucgagaagcaggagaagcacaucaaggaguccaaggagaagcccgagaagcgcucccagaucaaggagaaggacaucgagaagauggagcgcaagaccuucgagaaggagaagaagaucaagcacgagcacaaguccgagaaggacaagcucgaccucuccgagugcgucgacaagaucaaggagaaggacaagcucuacucccaccacaccgagaagugccacaaggagggcgagaaguccaagaacaccgccgccaucaagaagaccgacgaccgcgagaagucccgcgagaagauggaccgcaagcacgacaaggagaagcccgagaaggagcgccaccucgccgaguccaaggagaagcaccucauggagaagaagaacaagcaguccgacaacuccgaguacuccaaguccgagaagggcaagaacaaggagaaggaccgcgagcucgacaagaaggagaagucccgcgacaaggaguccaucaacaucaccaacuccaagcacauccaggaggagaagaaguccuccaucgucgacggcaacaaggcccagcacgagaagccccucucccucaaggagaagaccaaggacgagccccucaagacccccgacggcaaggagaaggacaagaaggacaaggacaucgaccgcuacaaggagcgcgacaagcacaaggacaagauccagaucaacucccuccucaagcucaaguccgaggccgacaagcccaagcccaaguccucccccgccuccaaggacacccgccccaaggagaagcgccucgucaacgacgaccucaugcagaccuccuucgagcgcaugcucucccucaaggaccucgagaucgagcaguggcacaagaagcacaaggagaagaucaagcagaaggagaaggagcgccuccgcaaccgcaacugccucgagcucaagaucaaggacaaggagaagaccaagcacacccccaccgaguccaagaacaaggagcucacccgcuccaaguccuccgaggucaccgacgccuacaccaaggagaagcagcccaaggacgccgucuccaaccgcucccaguccgucgacaccaagaacgucaugacccucggcaaguccuccuucgucuccgacaacucccucaaccgcuccccccgcuccgagaacgagaagcccggccucuccucccgcuccgucuccaugaucuccgucgccuccuccgaggacuccugccacaccaccgucaccaccccccgcccccccgucgaguacgacuccgacuucaugcucgaguccuccgagucccagauguccuucucccagucccccuuccucuccaucgccaagucccccgcccuccacgagcgcgagcucgacucccucgccgaccuccccgagcgcaucaagccccccuacgccaaccgccucuccaccucccaccuccgcuccuccuccgucgaggacgucaagcucaucaucuccgagggccgccccaccaucgagguccgccgcugcuccaugcccuccgucaucugcgagcacaccaagcaguuccagaccaucuccgaggaguccaaccagggcucccuccucaccguccccggcgacaccucccccucccccaagcccgaggucuucuccaacguccccgagcgcgaccucuccaacgucuccaacauccacuccuccuucgccaccucccccaccggcgccuccaacuccaaguacgucuccgccgaccgcaaccucaucaagaacaccgcccccgucaacaccgucauggacucccccguccaccucgagcccuccucccaggucggcgucauccagaacaaguccugggagaugcccgucgaccgccucgagacccucuccacccgcgacuucaucugccccaacuccaacauccccgaccaggaguccucccuccaguccuucugcaacuccgagaacaagguccucaaggagaacgccgacuuccucucccuccgccagaccgagcuccccggcaacuccugcgcccaggaccccgccuccuucaugcccccccagcagcccugcuccuuccccucccagucccucuccgacgccgaguccaucuccaagcacaugucccucuccuacgucgccaaccaggagcccggcauccuccagcagaagaacgccguccagaucaucuccuccgcccucgacaccgacaacgaguccaccaaggacaccgagaacaccuucguccucggcgacguccagaagaccgacgccuucguccccgucuacuccgacuccaccauccaggaggccucccccaacuucgagaaggccuacacccuccccguccuccccuccgagaaggacuucaacggcuccgacgccuccacccagcucaacacccacuacgccuucuccaagcucaccuacaaguccuccuccggccacgaggucgagaacuccaccaccgacacccaggucaucucccacgagaaggagaacaagcucgagucccucguccucacccaccucucccgcugcgacuccgaccucugcgagaugaacgccggcaugcccaagggcaaccucaacgagcaggaccccaagcacugccccgaguccgagaagugccuccucuccaucgaggacgaggagucccagcaguccauccucuccucccucgagaaccacucccagcaguccacccagcccgagaugcacaaguacggccagcucgucaaggucgagcucgaggagaacgccgaggacgacaagaccgagaaccagaucccccagcgcaugacccgcaacaaggccaacaccauggccaaccaguccaagcagauccucgccuccugcacccuccucuccgagaaggacuccgaguccuccuccccccgcggccgcauccgccucaccgaggacgacgacccccagauccaccacccccgcaagcgcaaggucucccgcgucccccagcccguccaggucucccccucccuccuccaggccaaggagaagacccagcagucccucgccgccaucgucgacucccucaagcucgacgagauccagcccuacuccuccgagcgcgccaaccccuacuucgaguaccuccacauccgcaagaagaucgaggagaagcgcaagcuccucugcuccgucaucccccaggccccccaguacuacgacgaguacgucaccuucaacggcuccuaccuccucgacggcaacccccucuccaagaucugcauccccaccaucacccccccccccucccucuccgacccccucaaggagcucuuccgccagcaggaggucguccgcaugaagcuccgccuccagcacuccaucgagcgcgagaagcucaucgucuccaacgagcaggagguccuccgcguccacuaccgcgccgcccgcacccucgccaaccagacccuccccuucuccgccugcaccguccuccucgacgccgaggucuacaacgucccccucgacucccaguccgacgacuccaagaccuccguccgcgaccgcuucaacgcccgccaguucauguccuggcuccaggacgucgacgacaaguucgacaagcucaagaccugccuccucaugcgccagcagcacgaggccgccgcccucaacgccguccagcgccucgaguggcagcucaagcuccaggagcucgaccccgccaccuacaaguccaucuccaucuacgagauccaggaguucuacgucccccucgucgacgucaacgacgacuucgagcucacccccaucuga

SEQ ID NO: 39709 - RNA, 2979 nt, Artificial Sequence
  derived and/or modified sequence opt2 from ANKRD18A__Homo_sapiens__NP_671728
augcgcaagcucuucuccuucggccgccgccucggccaggcccuccucuccuccauggaccaggaguacgccggccccggcuacgacauccgcgacugggagcuccgcaagauccaccgcgccgccaucaagggcgacgccgccgaggucgagcgcugccucacccgccgcuuccgcgaccucgacgcccgcgaccgcaaggaccgcaccguccuccaccucgccugcgcccacggccgcguccaggucgucacccuccuccuccaccgccgcugccagaucgacaucugcgaccgccucaaccgcaccccccucaugaaggccguccacucccaggaggaggccugcgccaucguccuccucgagugcggcgccaaccccaacaucgaggacaucuacggcaacaccgcccuccacuacgccgucuacaacaagggcaccucccucgccgagcgccuccucucccaccacgccaacaucgaggcccucaacaaggagggcaacaccccccuccucuucgccaucaacucccgccgccagcacauggucgaguuccuccucaagaaccaggccaacauccacgccgucgacaacuucaagcgcaccgcccucauccucgccguccagcacaaccucuccuccaucgucacccuccuccuccagcagaacauccgcaucuccucccaggacauguucggccagaccgccgaggacuacgcccucugcuccgaccuccgcuccauccgccagcagauccucgagcacaagaacaagaugcucaagaaccaccuccgcaacgacaaccaggagaccgccgccaugaagcccgccaaccucaagaagcgcaaggagcgcgccaaggccgagcacaaccucaaggucgccuccgaggagaagcaggagcgccuccagcgcuccgagaacaagcagccccaggacucccaguccuacggcaagaagaaggacgccauguacggcaacuucaugcucaagaaggacaucgccaugcucaaggaggagcucuacgccaucaagaacgacucccuccgcaaggagaagaaguacauccaggagaucaaguccaucaccgagaucaacgccaacuucgagaaguccguccgccucaacgagaagaugaucaccaagaccgucgcccgcuacucccagcagcucaacgaccucaaggccgagaacgcccgccucaacuccgagcucgagaaggagaagcacaacaaggagcgccucgaggccgaggucgagucccuccacuccucccucgccaccgccaucaacgaguacaacgagaucgucgagcgcaaggaccucgagcucguccucuggcgcgccgacgacgucucccgccacgagaagaugggcuccaacaucucccagcucaccgacaagaacgagcuccucaccgagcagguccacaaggcccgcgucaaguucaacacccucaagggcaagcuccgcgagacccgcgacgcccuccgcgagaagacccucgcccucggcuccguccagcucgaccuccgccaggcccagcaccgcaucaaggagaugaagcagaugcaccccaacggcgaggccaaggagucccaguccaucggcaagcagaacucccucgaggagcgcauccgccagcaggagcucgagaaccuccuccucgagcgccagcucgaggacgcccgcaaggagggcgacaacaaggagaucgucaucaacauccaccgcgacugccucgagaacggcaaggaggaccuccucgaggagcgcaacaaggagcucaugaaggaguacaacuaccucaaggagaagcuccuccagugcgagaaggagaaggccgagcgcgaggucaucguccgcgaguuccaggaggagcucgucgaccaccucaagaccuucuccaucuccgaguccccccucgagggcaccucccacugccacaucaaccucaacgagaccuggaccuccaagaagaagcucuuccaggucgagauccagcccgaggagaagcacgaggaguuccgcaagcucuucgagcucaucucccuccucaacuacaccgccgaccagauccgcaagaagaaccgcgagcucgaggaggaggccaccggcuacaagaagugccucgagaugaccaucaacaugcucaacgccuucgccaacgaggacuucuccugccacggcgaccucaacaccgaccagcucaagauggacauccucuucaagaagcucaagcagaaguucaacgaccucgucgccgagaaggaggccgucuccuccgagugcgucaaccucgccaaggacaacgagguccuccaccaggagcuccucuccaugcgcaacguccaggagaagugcgagaagcucgagaaggacaagaagaugcucgaggaggagguccucaaccucaagacccacauggagaaggacauggucgagcucggcaagcuccaggaguacaaguccgagcucgacgagcgcgccguccaggagaucgagaagcucgaggagauccaccuccagaagcaggccgaguacgagaagcagcucgagcagcucaacaaggacaacaccgccucccucaagaagaaggagcucacccucaaggacgucgagugcaaguucuccaagaugaagaccgccuacgaggaggucaccaccgagcucgaggaguucaaggaggccuucgccggcgccgucaaggccaacaacuccauguccaagaagcucaugaaguccgacaagaagaucgccgucaucuccaccaagcucuucaccgagaagcagcgcaugaaguacuuccucuccacccuccccacccgccccgagcccgagcuccccugcgucgagaaccucaacuccaucgagcucaaccgcaaguacauccccaagaccgccauccgcauccccaccuccaacccccagaccuccaacaacugcaagaacuuccucaccgagguccuccucugcuga

SEQ ID NO: 39710 - RNA, 960 nt, Artificial Sequence
  derived and/or modified sequence opt2 from ANKRD1__Homo_sapiens__NP_055206
augaugguccucaaggucgaggagcucgucaccggcaagaagaacggcaacggcgaggccggcgaguuccuccccgaggacuuccgcgacggcgaguacgaggccgccgucacccucgagaagcaggaggaccucaagacccuccucgcccaccccgucacccucggcgagcagcaguggaaguccgagaagcagcgcgaggccgagcucaagaagaagaagcucgagcagcgcuccaagcucgagaaccucgaggaccucgagaucaucauccagcucaagaagcgcaagaaguaccgcaagaccaagguccccgucgucaaggagcccgagcccgagaucaucaccgagcccgucgacguccccaccuuccucaaggccgcccucgagaacaagcuccccgucgucgagaaguuccucuccgacaagaacaaccccgacgucugcgacgaguacaagcgcaccgcccuccaccgcgccugccucgagggccaccucgccaucgucgagaagcucauggaggccggcgcccagaucgaguuccgcgacaugcucgaguccaccgccauccacugggccucccgcggcggcaaccucgacguccucaagcuccuccucaacaagggcgccaagaucuccgcccgcgacaagcuccucuccaccgcccuccacgucgccguccgcaccggccacuacgagugcgccgagcaccucaucgccugcgaggccgaccucaacgccaaggaccgcgagggcgacaccccccuccacgacgccguccgccucaaccgcuacaagaugauccgccuccucaucauguacggcgccgaccucaacaucaagaacugcgccggcaagacccccauggaccucguccuccacuggcagaacggcaccaaggccaucuucgacucccuccgcgagaacuccuacaagaccucccgcaucgccaccuucuga

SEQ ID NO: 39711 - RNA, 918 nt, Artificial Sequence
  derived and/or modified sequence opt2 from ANKRD23__Homo_sapiens__NP_659431
auggacuucaucuccauccagcagcucgucuccggcgagcgcgucgagggcaagguccucggcuucggccacggcguccccgaccccggcgccuggcccuccgacuggcgccgcggcccccaggaggccgucgcccgcgagaagcucaagcucgaggaggagaagaagaagaagcucgagcgcuucaacuccacccgcuucaaccucgacaaccucgccgaccucgagaaccucguccagcgccgcaagaagcgccuccgccaccgcguccccccccgcaagcccgagccccucgucaagccccagucccaggcccaggucgagcccgucggccucgagauguuccucaaggccgccgccgagaaccaggaguaccucaucgacaaguaccucaccgacggcggcgaccccaacgcccacgacaagcuccaccgcaccgcccuccacugggccugccucaagggccacucccagcucgucaacaagcuccucgucgccggcgccaccgucgacgcccgcgaccuccucgaccgcacccccgucuucugggccugccgcggcggccaccucgucauccucaagcagcuccucaaccagggcgcccgcgucaacgcccgcgacaagaucggcuccaccccccuccacgucgccguccgcacccgccaccccgacugccucgagcaccucaucgagugcggcgcccaccucaacgcccaggacaaggagggcgacaccgcccuccacgaggccguccgccacggcuccuacaaggccaugaagcuccuccuccucuacggcgccgagcucggcguccgcaacgccgccuccgucacccccguccagcucgcccgcgacuggcagcgcggcauccgcgaggcccuccaggcccacgucgcccacccccgcacccgcugcuga

SEQ ID NO: 39712 - RNA, 5133 nt, Artificial Sequence
  derived and/or modified sequence opt2 from ANKRD26__Homo_sapiens__NP_055730
augaagaagaucuucuccaagaagggcgaguccccccucggcuccuucgcccgccgccagcgcuccuccgccggcggcggcggcgagcccggcgagggcgccuacucccagcccggcuaccacguccgcgaccgcgaccucggcaagauccacaaggccgccuccgccggcaacgucgccaagguccagcagauccuccuccuccgcaagaacggccucaacgaccgcgacaagaugaaccgcaccgcccuccaccucgccugcgccaacggccaccccgaggucgucacccuccucgucgaccgcaagugccagcucaacgucugcgacaacgagaaccgcaccgcccucaugaaggccguccagugccaggaggagaagugcgccaccauccuccucgagcacggcgccgaccccaaccucgccgacguccacggcaacaccgcccuccacuacgccgucuacaacgaggacaucuccgucgccaccaagcuccuccucuacgacgccaacaucgaggccaagaacaaggacgaccucaccccccuccuccucgccgucuccggcaagaagcagcagauggucgaguuccucaucaagaagaaggccaacgucaacgccgucgacaagcucgaguccucccaccagcucaucuccgaguacaaggaggagcgcauccccaagcacuccucccagaacuccaacuccgucgacgaguccuccgaggacucccucucccgccucuccggcaagcccggcgucgacgacuccuggcccaccuccgacgacgaggaccucaacuucgacaccaagaacguccccaagcccucccucgccaagcucaugaccgccucccagcagucccgcaagaaccucgaggccaccuacggcaccguccgcaccggcaaccgcacccucuucgaggaccgcgacuccgacucccaggacgaggucgucgucgagucccuccccaccaccuccaucaagguccagugcuucucccaccccaccuaccagucccccgaccuccuccccaagcccucccacaagucccucgccaaccccggccucaugaaggaggagcccaccaagcccggcaucgccaagaaggagaacggcaucgacaucaucgaguccgccccccucgagcagaccaacaacgacaaccucaccuacgucgacgagguccacaagaacaaccgcuccgacaugauguccgcccucggccucggccaggaggaggacaucgagucccccugggacuccgaguccaucuccgagaacuucccccagaaguacgucgacccccucgccggcgccgccgacggcaaggagaagaacaucggcaacgagcaggccgaggacgucuucuacauccccuccugcauguccggcucccgcaacuucaagauggccaagcucgaggacacccgcaacgucggcaugcccgucgcccacauggagucccccgagcgcuaccuccaccucaagcccaccaucgagaugaaggacuccguccccaacaaggccggcggcaugaaggacguccagaccuccaaggccgccgagcacgaccucgaggucgccuccgaggaggagcaggagcgcgagggcuccgagaacaaccagccccaggucgaggaggagcgcaagaagcaccgcaacaacgagauggaggucuccgccaacauccacgacggcgccaccgacgacgccgaggacgacgacgacgacgacggccucauccagaagcgcaaguccggcgagaccgaccaccagcaguucccccgcaaggagaacaaggaguacgccuccuccggccccgcccuccagaugaaggaggucaaguccaccgagaaggagaagcgcaccuccaaggaguccgucaacucccccgucuucggcaaggccucccuccucaccggcggccuccuccaggucgacgacgacuccucccucuccgagaucgacgaggacgagggccgccccaccaagaagaccuccaacgagaagaacaaggucaagaaccagauccaguccauggacgacgucgacgaccucacccaguccuccgagaccgccuccgaggacugcgagcucccccacuccuccuacaagaacuucaugcuccucaucgagcagcucggcauggagugcaaggacuccgucucccuccucaagauccaggacgccgcccucuccugcgagcgccuccucgagcucaagaagaaccacugcgagcuccucaccgucaagaucaagaagauggaggacaaggucaacguccuccagcgcgagcucuccgagaccaaggagaucaagucccagcucgagcaccagaaggucgagugggagcgcgagcucugcucccuccgcuucucccucaaccaggaggaggagaagcgccgcaacgccgacacccucuacgagaagauccgcgagcagcuccgccgcaaggaggagcaguaccgcaaggaggucgaggucaagcagcagcucgagcucucccuccagacccucgagauggagcuccgcaccgucaaguccaaccucaaccaggucguccaggagcgcaacgacgcccagcgccagcucucccgcgagcagaacgcccgcaugcuccaggacggcauccucaccaaccaccucuccaagcagaaggagaucgagauggcccagaagaagaugaacuccgagaacucccacucccacgaggaggagaaggaccucucccacaagaacuccaugcuccaggaggagaucgccaugcuccgccucgagaucgacaccaucaagaaccagaaccaggagaaggagaagaagugcuucgaggaccucaagaucgucaaggagaagaacgaggaccuccagaagaccaucaagcagaacgaggagacccucacccagaccaucucccaguacaacggccgccucuccguccucaccgccgagaacgccaugcucaacuccaagcucgagaacgagaagcaguccaaggagcgccucgaggccgaggucgaguccuaccacucccgccucgccgccgccauccacgaccgcgaccaguccgagaccuccaagcgcgagcucgagcucgccuuccagcgcgcccgcgacgagugcucccgccuccaggacaagaugaacuucgacgucuccaaccucaaggacaacaacgagauccucucccagcagcucuucaagaccgaguccaagcucaacucccucgagaucgaguuccaccacacccgcgacgcccuccgcgagaagacccucggccucgagcgcguccagaaggaccucucccagacccagugccagaugaaggagauggagcagaaguaccagaacgagcaggucaaggucaacaaguacaucggcaagcaggaguccgucgaggagcgccucucccagcuccaguccgagaacaugcuccuccgccagcagcucgacgacgcccacaacaaggccgacaacaaggagaagaccgucaucaacauccaggaccaguuccacgccaucguccagaagcuccaggccgaguccgagaagcagucccuccuccucgaggagcgcaacaaggagcucaucuccgagugcaaccaccucaaggagcgccaguaccaguacgagaacgagaaggccgagcgcgaggucgucguccgccagcuccagcaggagcucgccgacacccucaagaagcaguccauguccgaggccucccucgaggucaccucccgcuaccgcaucaaccucgaggacgagacccaggaccucaagaagaagcucggccagauccgcaaccagcuccaggaggcccaggaccgccacaccgaggccguccgcugcgccgagaagaugcaggaccacaagcagaagcucgagaaggacaacgccaagcucaaggucaccgucaagaagcagauggacaagaucgaggagcuccagaagaaccuccucaacgccaaccucuccgaggacgagaaggagcagcucaagaagcucauggagcucaagcagucccucgagugcaaccucgaccaggagaugaagaagaacgucgagcucgagcgcgagaucaccggcuucaagaaccuccucaagaugacccgcaagaagcucaacgaguacgagaacggcgaguucuccuuccacggcgaccucaagaccucccaguucgagauggacauccagaucaacaagcucaagcacaagaucgacgaccucaccgccgagcucgagaccgccggcuccaagugccuccaccucgacaccaagaaccagauccuccaggaggagcuccucuccaugaagaccguccagaagaagugcgagaagcuccagaagaacaagaagaagcucgagcaggaggucaucaaccuccgcucccacaucgagcgcaacauggucgagcucggccaggucaagcaguacaagcaggagaucgaggagcgcgcccgccaggagaucgccgagaagcucaaggaggucaaccucuuccuccaggcccaggccgccucccaggagaaccucgagcaguuccgcgagaacaacuucgccuccaugaagucccagauggagcuccgcaucaaggaccucgaguccgagcucuccaagaucaagaccucccaggaggacuucaacaagaccgagcucgagaaguacaagcagcucuaccucgaggagcucaagguccgcaagucccucuccuccaagcucaccaagaccaacgagcgccucgccgaggucaacaccaagcuccucgucgagaagcagcagucccgcucccucuucaccacccucaccacccgccccgucauggagccccccugcgucggcaaccucaacaacucccucgaccucaaccgcaagcucaucccccgcgagaaccucgucaucuccaccuccaacccccgcgccuccaacaacuccauggagaacuaccucuccaagaugcagcaggagcucgagaagaacaucacccgcgagcucaaggaggccgccgccgagcucgaguccggcuccaucgccuccccccucggcuccaccgacgaguccaaccucaaccaggaccucgucuggaaggccucccgcgaguacguccagguccucaagaagaacuacaugaucuga

SEQ ID NO: 39713 - RNA, 3162 nt, Artificial Sequence
  derived and/or modified sequence opt2 from ANKRD28__Homo_sapiens__NP_056014
auggccuuccucaagcuccgcgaccagcccucccucguccaggccaucuucaacggcgaccccgacgagguccgcgcccucaucuucaagaaggaggacgucaacuuccaggacaacgagaagcgcaccccccuccacgccgccgccuaccucggcgacgccgagaucaucgagcuccucauccucuccggcgcccgcgucaacgccaaggacuccaaguggcucaccccccuccaccgcgccgucgccuccugcuccgaggaggccguccagguccuccucaagcacuccgccgacgucaacgcccgcgacaagaacuggcagaccccccuccacaucgccgccgccaacaaggccgucaagugcgccgaggcccucgucccccuccucuccaacgucaacgucuccgaccgcgccggccgcaccgcccuccaccacgccgccuucuccggccacggcgagauggucaagcuccuccucucccgcggcgccaacaucaacgccuucgacaagaaggaccgccgcgccauccacugggccgccuacaugggccacaucgaggucgucaagcuccucgucucccacggcgccgaggucaccugcaaggacaagaaguccuacaccccccuccacgccgccgccuccuccggcaugaucuccgucgucaaguaccuccucgaccucggcgucgacaugaacgagcccaacgccuacggcaacaccccccuccacgucgccugcuacaacggccaggacgucgucgucaacgagcucaucgacugcggcgccaucgucaaccagaagaacgagaagggcuucaccccccuccacuucgccgccgccuccacccacggcgcccucugccucgagcuccucgucggcaacggcgccgacgucaacaugaaguccaaggacggcaagaccccccuccacaugaccgcccuccacggccgcuucucccgcucccagaccaucauccaguccggcgccgucaucgacugcgaggacaagaacggcaacaccccccuccacaucgccgcccgcuacggccacgagcuccucaucaacacccucaucaccuccggcgccgacaccgccaagcgcggcauccacggcauguucccccuccaccucgccgcccucuccggcuucuccgacugcugccgcaagcuccucuccuccggcuucgacaucgacacccccgacgacuucggccgcaccugccuccacgccgccgccgccggcggcaaccucgagugccucaaccuccuccucaacaccggcgccgacuucaacaagaaggacaaguucggccgcuccccccuccacuacgccgccgccaacugcaacuaccagugccucuucgcccucgucggcuccggcgccuccgucaacgaccucgacgagcgcggcugcaccccccuccacuacgccgccaccuccgacaccgacggcaagugccucgaguaccuccuccgcaacgacgccaaccccggcauccgcgacaagcagggcuacaacgccguccacuacuccgccgccuacggccaccgccucugccuccagcucaucgccuccgagaccccccucgacguccucauggagaccuccggcaccgacaugcucuccgacuccgacaaccgcgccaccaucuccccccuccaccucgccgccuaccacggccaccaccaggcccucgagguccucguccagucccuccucgaccucgacguccgcaacuccuccggccgcaccccccucgaccucgccgccuucaagggccacgucgagugcgucgacguccucaucaaccagggcgccuccauccucgucaaggacuacauccucaagcgcacccccauccacgccgccgccaccaacggccacuccgagugccuccgccuccucaucggcaacgccgagccccagaacgccgucgacauccaggacggcaacggccagaccccccucaugcucuccguccucaacggccacaccgacugcgucuacucccuccucaacaagggcgccaacgucgacgccaaggacaaguggggccgcaccgcccuccaccgcggcgccgucaccggccacgaggagugcgucgacgcccuccuccagcacggcgccaagugccuccuccgcgacucccgcggccgcacccccauccaccucuccgccgccugcggccacaucggcguccucggcgcccuccuccaguccgccgccuccauggacgccaaccccgccaccgccgacaaccacggcuacaccgcccuccacugggccugcuacaacggccacgagaccugcgucgagcuccuccucgagcaggaggucuuccagaagaccgagggcaacgccuucuccccccuccacugcgccgucaucaacgacaacgagggcgccgccgagaugcucaucgacacccucggcgccuccaucgucaacgccaccgacuccaagggccgcaccccccuccacgccgccgccuucaccgaccacgucgagugccuccagcuccuccucucccacaacgcccaggucaacuccgucgacuccaccggcaagaccccccucaugauggccgccgagaacggccagaccaacaccgucgagaugcucgucuccuccgccuccgccgagcucacccuccaggacaacuccaagaacaccgcccuccaccucgccugcuccaagggccacgagaccuccgcccuccucauccucgagaagaucaccgaccgcaaccucaucaacgccaccaacgccgcccuccagaccccccuccacgucgccgcccgcaacggccucaccauggucguccaggagcuccucggcaagggcgccuccguccucgccgucgacgagaacggcuacacccccgcccucgccugcgcccccaacaaggacgucgccgacugccucgcccucauccucgccaccaugaugcccgucuccuccuccuccccccucuccucccucaccuucaacgccaucaaccgcuacaccaacaccuccaagaccgucuccuucgaggcccuccccaucaugcgcaacgagcccuccuccuacugcuccuucaacaacaucggcggcgagcaggaguaccucuacaccgacgucgacgagcucaacgacuccgacuccgagaccuacuga

SEQ ID NO: 39714 - RNA, 984 nt, Artificial Sequence
  derived and/or modified sequence opt2 from ANKRD2__Homo_sapiens__NP_001123453
auggccaaggcccccuccugggccggcgucggcgcccucgccuacaaggcccccgaggcccucuggcccgccgaggccgucauggacggcaccauggaggacuccgaggccguccagcgcgccaccgcccucaucgagcagcgccucgcccaggaggaggagaacgagaagcuccgcggcgacgcccgccagaagcuccccauggaccuccucguccucgaggacgagaagcaccacggcgcccaguccgccgcccuccagaaggucaagggccaggagcgcguccgcaagaccucccucgaccuccgccgcgagaucaucgacgucggcggcauccagaaccucaucgagcuccgcaagaagcgcaagcagaagaagcgcgacgcccucgccgccucccacgagcccccccccgagcccgaggagaucaccggccccgucgacgaggagaccuuccucaaggccgccgucgagggcaagaugaaggucaucgagaaguuccucgccgacggcggcuccgccgacaccugcgaccaguuccgccgcaccgcccuccaccgcgccucccucgagggccacauggagauccucgagaagcuccucgacaacggcgccaccgucgacuuccaggaccgccucgacugcaccgccaugcacugggccugccgcggcggccaccucgaggucgucaagcuccuccagucccacggcgccgacaccaacguccgcgacaaggagggcgacaccgcccuccacgacgccguccgccucaaccgcuacaagaucaucaagcuccuccuccuccacggcgccgacaugaugaccaagaaccucgccggcaagacccccaccgaccucguccagcucuggcaggccgacacccgccacgcccucgagcaccccgagcccggcgccgagcacaacggccucgagggccccaacgacuccggccgcgagaccccccagcccguccccgcccaguga

SEQ ID NO: 39715 - RNA, 4026 nt, Artificial Sequence
  derived and/or modified sequence opt2 from ANKRD30A__Homo_sapiens__NP_443723
augaccaagcgcaagaagaccaucaaccucaacauccaggacgcccagaagcgcaccgcccuccacugggccugcgucaacggccacgaggaggucgucaccuuccucgucgaccgcaagugccagcucgacguccucgacggcgagcaccgcaccccccucaugaaggcccuccagugccaccaggaggccugcgccaacauccucaucgacuccggcgccgacaucaaccucgucgacgucuacggcaacaccgcccuccacuacgccgucuacuccgagauccucuccgucgucgccaagcuccucucccacggcgccgucaucgagguccacaacaaggccucccucaccccccuccuccucuccaucaccaagcgcuccgagcagaucgucgaguuccuccucaucaagaacgccaacgccaacgccgucaacaaguacaagugcaccgcccucaugcucgccgucugccacggcuccuccgagaucgucggcaugcuccuccagcagaacgucgacgucuucgccgccgacaucugcggcgucaccgccgagcacuacgccgucaccugcggcuuccaccacauccacgagcagaucauggaguacauccgcaagcucuccaagaaccaccagaacaccaaccccgagggcaccuccgccggcacccccgacgaggccgccccccucgccgagcgcacccccgacaccgccgagucccucgucgagaagacccccgacgaggccgccccccucgucgagcgcacccccgacaccgccgagucccucgucgagaagacccccgacgaggccgccucccucgucgagggcaccuccgacaagauccagugccucgagaaggccaccuccggcaaguucgagcaguccgccgaggagaccccccgcgagaucaccucccccgccaaggagaccuccgagaaguucaccuggcccgccaagggccgcccccgcaagaucgccugggagaagaaggaggacaccccccgcgagaucaugucccccgccaaggagaccuccgagaaguucaccugggccgccaagggccgcccccgcaagaucgccugggagaagaaggagacccccgucaagaccggcugcgucgcccgcgucaccuccaacaagaccaagguccucgagaagggccgcuccaagaugaucgccugccccaccaaggaguccuccaccaaggccuccgccaacgaccagcgcuuccccuccgaguccaagcaggaggaggacgaggaguacuccugcgacucccgcucccucuucgaguccuccgccaagauccaggucugcauccccgaguccaucuaccagaaggucauggagaucaaccgcgaggucgaggagccccccaagaagcccuccgccuucaagcccgccaucgagaugcagaacuccguccccaacaaggccuucgagcucaagaacgagcagacccuccgcgccgaccccauguucccccccgaguccaagcagaaggacuacgaggagaacuccugggacuccgagucccucugcgagaccgucucccagaaggacgucugccuccccaaggccacccaccagaaggagaucgacaagaucaacggcaagcucgaggagucccccaacaaggacggccuccucaaggccaccugcggcaugaaggucuccauccccaccaaggcccucgagcucaaggacaugcagaccuucaaggccgagccccccggcaagcccuccgccuucgagcccgccaccgagaugcagaaguccguccccaacaaggcccucgagcucaagaacgagcagacccuccgcgccgacgagauccuccccuccgaguccaagcagaaggacuacgaggagaacuccugggacaccgagucccucugcgagaccgucucccagaaggacgucugccuccccaaggccgcccaccagaaggagaucgacaagaucaacggcaagcucgagggcucccccgucaaggacggccuccucaaggccaacugcggcaugaaggucuccauccccaccaaggcccucgagcucauggacaugcagaccuucaaggccgagccccccgagaagcccuccgccuucgagcccgccaucgagaugcagaaguccguccccaacaaggcccucgagcucaagaacgagcagacccuccgcgccgacgagauccuccccuccgaguccaagcagaaggacuacgaggaguccuccugggacuccgagucccucugcgagaccgucucccagaaggacgucugccuccccaaggccacccaccagaaggagaucgacaagaucaacggcaagcucgaggagucccccgacaacgacggcuuccucaaggcccccugccgcaugaaggucuccauccccaccaaggcccucgagcucauggacaugcagaccuucaaggccgagccccccgagaagcccuccgccuucgagcccgccaucgagaugcagaaguccguccccaacaaggcccucgagcucaagaacgagcagacccuccgcgccgaccagauguuccccuccgaguccaagcagaagaaggucgaggagaacuccugggacuccgagucccuccgcgagaccgucucccagaaggacgucugcguccccaaggccacccaccagaaggagauggacaagaucuccggcaagcucgaggacuccaccucccucuccaagauccucgacaccguccacuccugcgagcgcgcccgcgagcuccagaaggaccacugcgagcagcgcaccggcaagauggagcagaugaagaagaaguucugcguccucaagaagaagcucuccgaggccaaggagaucaagucccagcucgagaaccagaaggucaagugggagcaggagcucugcuccguccgccucacccucaaccaggaggaggagaagcgccgcaacgccgacauccucaacgagaagauccgcgaggagcucggccgcaucgaggagcagcaccgcaaggagcucgaggucaagcagcagcucgagcaggcccuccgcauccaggacaucgagcucaaguccgucgaguccaaccucaaccaggucucccacacccacgagaacgagaacuaccuccuccacgagaacugcaugcucaagaaggagaucgccaugcucaagcucgagaucgccacccucaagcaccaguaccaggagaaggagaacaaguacuucgaggacaucaagauccucaaggagaagaacgccgagcuccagaugacccucaagcucaaggaggagucccucaccaagcgcgccucccaguacuccggccagcucaagguccucaucgccgagaacaccaugcucaccuccaagcucaaggagaagcaggacaaggagauccucgaggccgagaucgagucccaccacccccgccucgccuccgccguccaggaccacgaccagaucgucaccucccgcaagucccaggagcccgccuuccacaucgccggcgacgccugccuccagcgcaagaugaacgucgacgucuccuccaccaucuacaacaacgagguccuccaccagccccucuccgaggcccagcgcaaguccaagucccucaagaucaaccucaacuacgccggcgacgcccuccgcgagaacacccucgucuccgagcacgcccagcgcgaccagcgcgagacccagugccagaugaaggaggccgagcacauguaccagaacgagcaggacaacgucaacaagcacaccgagcagcaggagucccucgaccagaagcucuuccagcuccaguccaagaacauguggcuccagcagcagcucguccacgcccacaagaaggccgacaacaaguccaagaucaccaucgacauccacuuccucgagcgcaagaugcagcaccaccuccucaaggagaagaacgaggagaucuucaacuacaacaaccaccucaagaaccgcaucuaccaguacgagaaggagaaggccgagaccgagaacuccuga

SEQ ID NO: 39716 - RNA, 4062 nt, Artificial Sequence
  derived and/or modified sequence opt2 from ANKRD36B__Homo_sapiens__NP_079466
auggagcgccucugcuccgacggcuucgccuucccccacuacuacaucaagcccuaccaccucaagcgcauccaccgcgccguccuccgcggcaaccucgagaagcucaaguaccuccuccucaccuacuacgacgccaacaagcgcgaccgcaaggagcgcaccgcccuccaccucgccugcgccaccggccagcccgagaugguccaccuccucgucucccgccgcugcgagcucaaccucugcgaccgcgaggaccgcaccccccucaucaaggccguccagcuccgccaggaggccugcgccacccuccuccuccagaacggcgccgaccccaacaucaccgacgucuucggccgcaccgcccuccacuacgccgucuacaacgaggacaccuccaugaucgagaagcuccucucccacggcaccaacaucgaggagugcuccaagaacgaguaccagccccuccuccucgccgucucccgccgcaaggucaagauggucgaguuccuccucaagaagaaggccaacgucaacgccaucgacuaccucggccgcuccgcccucauccucgccgucacccucggcgagaaggacaucgucauccuccuccuccagcacaacaucgacgucuucucccgcgacgucuacggcaagcucgccgaggacuacgccuccgaggccgagaaccgcgucaucuucgaccucaucuacgaguacaagcgcaagcgcuacgaggaccuccccaucaacuccaaccccgucuccccccagaagcagcgcgccgagaaggccaccuccgacgacaaggacuccgucuccaacaucgccaccgagaucaaggagggccccaucuccggcaccgucuccucccagaagcagcccgccgagaaggccaccuccgacgagaaggacuccgucuccaacaucgccaccgagaucaaggagggccagcaguccggcaccgucuccccccagaagcaguccgcccagaaggucaucuucaagaagaaggucucccuccucaacaucgccacccgcaucaugggcggcggcaaguccggcaccgucuccucccagaagcagcccgccuccaagaccgccuccgacaagaccgacuccgcccucaacaccgccaccgagaucaaggacggccuccagugcggcaccgucuccucccagaagcagcaggcccucaaggccaccaccgacgaggagggcuccgucuccaacaucgccaccgagaucaaggacggcgagaaguccggcaccgucuccucccagaagaagcccgcccucaaggccaccuccgacgagaaggacuccuucuccaacaucacccgcgagaagaaggacggcgagaucucccgcaccgucuccucccagaagccccccgcccucaaggccaccuccgucaaggaggacuccguccucaacaucgcccgcgagaagaaggacggcgagaagucccgcaccgucuccuucgagcagccccccggccucaaggccacccgcgacgagaaggacucccuccucaacaucgcccgcggcaagaaggacggcgagaagacccgccgcgucuccucccacaagcagcccucccucaaggccaccuccgacaaggaggacuccguccccaacauggccaccgagaccaaggacgagcagaucuccggcaccgucuccugccagaagcagcccgcccucaaggccaccuccgacaagaaggacuccgucuccaacauccccaccgagaucaaggacggccagcaguccggcaccgucuccucccagaagcagcccgccuggaaggccaccuccgucaagaaggacuccgucuccaacaucgccaccgagaucaaggacggccagauccgcggcaccgucuccucccagcgccgccccgcccucaagaccaccggcgacgagaaggacuccgucuccaacaucgcccgcgagaucaaggacggcgagaaguccggcaccgucuccccccagaagcaguccgcccagaaggucaucuucaagaagaaggucucccuccucaacaucgccacccgcaucaccggcggcggcaaguccggcaccgaguaccccgagaaccuccgcacccucaaggccaccaucgagaacaaggacuccguccucaacaccgccaccaagaugaaggagguccagaccuccacccccgccgagcaggaccucgagauggccuccgagggcgagcagaagcgccucgaggaguacgagaacaaccagccccaggucaagaaccagauccacucccgcgacgaccucgacgacaucauccaguccucccagaccgucuccgaggacggcgacucccucugcugcaacugcaagaacgucauccuccucaucgaccagcacgagaugaagugcaaggacugcguccaccuccucaagaucaagaacaccuucugccucuggaagcgccucaucaagcucaaggacaaccacugcgagcagcuccgcgucaagauccgcaagcucaagaacaaggccuccguccuccagaagcgcaucuccgagaaggaggagaucaagucccagcucaagcacgagauccucgagcucgagaaggagcucugcucccuccgcuucgccauccagcaggagaagaagaagcgccgcaacgucgaggagcuccaccagaagguccgcgagaagcuccgcaucaccgaggagcaguaccgcaucgaggccgacgucaccaagcccaucaagcccgcccucaaguccgccgaggucgagcucaagaccggcggcaacaacuccaaccaggucuccgagaccgacgagaaggaggaccuccuccacgagaaccgccucaugcaggacgagaucgcccgccuccgccucgagaaggacaccaucaagaaccagaaccucgagaagaaguaccucaaggacuucgagaucgucaagcgcaagcacgaggaccuccagaaggcccucaagcgcaacggcgagacccucgccaagaccaucgccugcuacuccggccagcucgccgcccucaccgacgagaacaccacccuccgcuccaagcucgagaagcagcgcgagucccgccagcgccucgagaccgagaugcaguccuaccgcugccgccucaacgccgcccgcugcgaccacgaccagucccacuccuccaagcgcgaccaggagcucgccuuccagggcaccgucgacaagugccgccaccuccaggagaaccucaacucccacguccucauccucucccuccagcucuccaaggccgaguccaagucccgcguccucaagaccgagcuccacuacaccggcgaggcccucaaggagaaggcccucgucuucgagcacguccaguccgagcucaagcagaagcagucccagaugaaggacaucgagaagauguacaaguccggcuacaacaccauggagaagugcaucgagaagcaggagcgcuucugccagcucaagaagcagaacaugcuccuccagcagcagcucgacgacgcccgcaacaaggccgacaaccaggagaaggccauccucaacauccaggcccgcugcgacgcccgcguccagaaccuccaggccgagugccgcaagcaccgccuccuccucgaggaggacaacaagaugcucgucaacgagcucaaccacuccaaggagaaggagugccaguacgagaaggagaaggccgagcgcgaggucgccguccgccagcuccagcagaagcgcgacgacguccucaacaagggcuccgccaccaaggcccuccucgacgccuccucccgccacugcaccuaccucgagaacggcaugcaggacucccgcaagaagcucgaccagaugcgcucccaguuccaggagauccaggaccagcucaccgccaccauccgcugcaccaaggagauggagggcgacacccagaagcucgaggucgagcacgucaugaugcgcaagaucaucaagaagcaggacgaccagaucgagcgccucgagaagauccuccagcacuccucccucaugcuccaggucuucgaguccuga

SEQ ID NO: 39717 - RNA, 5826 nt, Artificial Sequence
  derived and/or modified sequence opt2 from ANKRD36__Homo_sapiens__NP_001157787
auggaggacggcaagcgcgagcgcuggcccacccucauggagcgccucugcuccgacggcuucgccuucccccaguaccccaucaagcccuaccaccucaagcgcauccaccgcgccguccuccacggcaaccucgagaagcucaaguaccuccuccucaccuacuacgacgccaacaagcgcgaccgcaaggagcgcaccgcccuccaccucgccugcgccaccggccagcccgagaugguccaccuccucgucucccgccgcugcgagcucaaccucugcgaccgcgaggaccgcaccccccucaucaaggccguccagcuccgccaggaggccugcgccacccuccuccuccagaacggcgccaaccccaacaucaccgacuucuucggccgcaccgcccuccacuacgccgucuacaacgaggacaccuccaugaucgagaagcuccucucccacggcaccaacaucgaggagugcuccaagugcgaguaccagccccuccucuucgccgucucccgccgcaaggucaagauggucgaguuccuccucaagaagaaggccaacgucaacgccaucgacuaccucggccgcuccgcccucauccacgccgucacccucggcgagaaggacaucgucauccuccuccuccagcacaacaucgacguccucucccgcgacgccuuccgcaagaucgccggcgacuacgccaucgaggccaagaaccgcgucaucuucgaccucaucuacgaguacgagcgcaagcgcuacgaggaccuccccaucaacuccaaccccgucuccucccagaagcagcccgcccucaaggccaccuccggcaaggaggacuccaucuccaacaucgccaccgagaucaaggacggccagaaguccggcaccgucuccucccagaagcagcccgcccucaaggacaccuccgacaaggacgacuccgucuccaacaccgccaccgagaucaaggacgagcagaaguccggcaccguccuccccgccgucgagcagugccucaaccgcucccucuaccgccccgacgccgucgcccagcccgucaccgagaacgaguucucccucgaguccgagaucaucuccaagcucuacauccccaagcgcaagaucaucuccccccgcuccaucaaggacguccucccccccgucgaggaggccgucgaccgcugccucuaccuccucgaccgcuucgcccagcccgucaccaaggacaaguucgcccucgaguccgagaacaucuccgagcccuacuucaccaaccgccgcaccaucucccagcaguccgccgagaaccucgacgccgccugcggcaucgacaagaccgagaacggcaacauguucgaggaccagaacgucgacaaggagggcaaggcccuccccgccaccggccagaaggccaacgucucccccgagcagcccccccucuucacccacaccgucaaggaccgcgaccacaucuccacccgcuuccucggcggcauggacucccucaccuccuccgaggaguccuccgagcgccccccccucuccacccucacccucaaggaggccgaccccuccuccaaggccgccaugcgccgcaaggacucccccccccccggcaaggucuccucccagaagcagcccgccgagaaggccaccuccgacgacaaggacuccgucuccaacaucgccaccgagaucaaggagggccccaucuccggcaccgucuccucccagaagcagcccgccgagaaggccaccuccgacgagaaggacuccgucuccaacaucgccaccgagaucaagaagggccagcaguccggcaccgucuccccccagaagcaguccgccuggaaggucaucuucaagaagaaggucucccuccucaacaucgccacccgcaucaugggcggcggcaaguccggcaccgucuccucccagaagcagcccgccuccaaggccaccuccgacaagaccgacuccgcccucaacaucgccaccgagaucaaggacggccuccagugcggcaccgucuccucccagaagcagcccgcccucaaggccaccaccgacgaggaggacuccgucuccaacaucgccaccgagaucaaggacggcgagaaguccggcaccgucuccucccagaagcagcccgcccucaaggccaccaccgacgaggaggacuccgucuccaacaucgccaccgagaucaaggacggcgagaaguccggcaccgucuccucccagaagcagcccgcccucaaggccaccaccgacgagaaggacuccgucuccaacaucgccaccgagaucaaggacggcgagaaguccggcaccgucuccucccagaagccccccgcccucaccgccaccuccgacgaggagggcuccguccucuccaucgcccgcgagaacaaggacggcgagaagucccgcaccgucuccucccgcaagaagcccgcccucaaggccaccuccgacgagaaggacuccuucuccaacaucacccgcggcaagaaggacggcgagaucucccgcaaggucuccucccagaagccccccacccucaagggcaccuccgacgaggaggacuccguccucggcaucgcccgcgagaacaaggacggcgagaagucccgcaccgucuccuccgagaagccccccggccucaaggccuccuccgccgagaaggacuccguccucaacaucgcccgcggcaagaaggacggcgagaagaccaagcgcgucuccucccgcaagaagcccucccucgaggccaccuccgacgagaaggacuccuucuccaacaucacccgcgagaagaaggacggcgagaucucccgcaaggucuccucccagaagccccccgcccucaagggcaccuccgacgaggaggacuccguccucggcaucgcccgcgagaacaaggacggcgagaagucccgcaccgucuccuccgagaagccccccggccucaaggccaccuccgacgagaaggacuccguccucaacaucgcccgcggcaagaaggacggcgagaagacccgcaccgucuccucccagaagccccccacccucaaggccaccuccgacgaggaggacuccguccucuccaucgcccgcgagaacaaggacggcgagaagucccgcaccgucuccuccgagaagcccuccggccucaaggccaccuccgccgagaaggacuccguccucaacaucgcccgcggcaagaaguacggcgagaagaccaagcgcgucuccucccgcaagaagcccgcccucaaggccaccuccgacgagaaggacuccguccucuacaucgcccgcgagaagaaggacggcgagaagucccgcaccgucuccucccccaagcagcccgcccucaaggccaucugcgacaaggaggacuccguccccaacauggccaccgagaagaaggacgagcagaucuccggcaccgucuccugccagaagcagcccgcccucaaggccaccuccgacaagaaggacuccgucuccaacauccccaccgagaucaaggacggccagcaguccggcaccgucuccucccagaagcagcccgccuggaaggccaccuccgucaagaaggacuccgucuccaacaucgccaccgagaucaaggacggccagauccgcggcaccggcauccucgaguacaccuucaacgucauguucgaccagaucgaggagaaguucaccucccucaacaaguccgccggcgucuccccccagaagcaguccgcccagaaggucaucuucaagaagaaggucucccuccucaacaucgccacccgcaucaccggcggcuggaaguccggcaccgaguaccccgagaaccuccccacccucaaggccaccaucgagaacaagaacuccguccucaacaccgccaccaagaugaaggacguccagaccuccacccccgccgagcaggaccucgagauggccuccgagggcgagcagaagcgccucgaggaguacgagaacaaccagccccaggucaagaaccagauccacucccgcgacgaccucgacgacaucauccaguccucccagaccgucuccgaggacggcgacucccucugcugcaacugcaagaacgucauccuccucaucgaccagcacgagaugaagugcaaggacugcguccaccuccucaagaucaagaacaccuucugccucuggaagcgccucaucaagcucaaggacaaccacugcgagcagcuccgcgucaagauccgcaagcucaagaacaaggccuccguccuccagaagcgcaucuccgagaaggaggagaucaagucccagcucaagcacgagauccucgagcucgagaaggagcucugcucccuccgcuucgccauccagcaggagaagaagaagcgccgcaacgucgaggagguccaccagaagguccgcgagaagcuccgcaucaccgaggagcaguaccgcaucgaggccgacgucaccaagcccaucaagcccgcccucaaguccgccgaggucgagcucaagaccggcggcaacaacuccaaccaggucuccgagaccgacgagaaggaggaccuccuccacgagaaccgccucaugcaggacgagaucgcccgccuccgccucgagaaggacaccaucaagaaccagaaccucgagaagaaguaccucaaggacuucgagaucgucaagcgcaagcacgaggaccuccagaaggcccucaagcgcaacggcgagacccucgccaagaccaucgccugcuacuccggccagcucgccgcccucaccgacgagaacaccacccuccgcuccaagcucgagaagcagcgcgagucccgccagcgccucgagaccgagaugcaguccuaccacugccgccucaacgccgcccgcugcgaccacgaccagucccacuccuccaagcgcgaccaggagcucgccuuccagggcaccgucgacaagugccgccaccuccaggagaaccucaacucccacguccucauccucucccuccagcucuccaaggccgaguccaagucccgcguccucaagaccgagcuccacuacaccggcgaggcccucaaggagaaggcccucgucuucgagcacguccaguccgagcucaagcagaagcagucccagaugaaggacaucgagaagauguacaaguccggcuacaacaccauggagaagugcaucgagaagcaggagcgcuucugccagcucaagaagcagaacaugcuccuccagcagcagcucgacgacgcccgcaacaaggccgacaaccaggagaaggccauccucaacauccaggcccgcugcgacgcccgcguccagaaccuccaggccgagugccgcaagcaccgccuccuccucgaggaggacaacaagaugcucgucaacgagcucaaccacuccaaggagaaggagugccaguacgagaaggagaaggccgagcgcgaggucgccguccgccagcuccagcagaagcgcgacgacguccucaacaagggcuccgccaccaaggcccuccucgacgccuccucccgccacugcaccuaccucgagaacggcaugcaggacucccgcaagaagcucgaccagaugcgcucccaguuccaggagauccaggaccagcucaccgccaccauccgcugcaccaaggagauggagggcgacacccagaagcucgaggucgagcacgucaugaugcgcaagaucaucaagaagcaggacgaccagaucgagcgccucgagaagauccuccagcacuccucccucaugcuccaggucuucgaguccuga

SEQ ID NO: 39718 - RNA, 477 nt, Artificial Sequence
  derived and/or modified sequence opt2 from ANKRD37__Homo_sapiens__NP_859077
augcuccuccucgacugcaaccccgaggucgacggccucaagcaccuccucgagaccggcgccuccgucaacgccccccccgaccccugcaagcagucccccguccaccucgccgccggcuccggccucgccugcuuccuccucuggcagcuccagaccggcgccgaccucaaccagcaggacguccucggcgaggccccccuccacaaggccgccaaggucggcucccucgagugccucucccuccucgucgccuccgacgcccagaucgaccucugcaacaagaacggccagaccgccgaggaccucgccugguccugcggcuuccccgacugcgccaaguuccucaccaccaucaagugcaugcagaccaucaaggccuccgagcaccccgaccgcaacgacugcgucgccguccuccgccagaagcgcucccucggcuccgucgagaacaccuccggcaagcgcaagugcuga

SEQ ID NO: 39719 - RNA, 2982 nt, Artificial Sequence
  derived and/or modified sequence opt2 from ANKRD44__Homo_sapiens__NP_001182073
auggccguccucaagcucaccgaccagcccccccucguccaggccaucuucuccggcgaccccgaggagauccgcaugcucauccacaagaccgaggacgucaacacccucgacuccgagaagcgcaccccccuccacgucgccgccuuccucggcgacgccgagaucaucgagcuccucauccucuccggcgcccgcgucaacgccaaggacaacauguggcucaccccccuccaccgcgccgucgccucccgcuccgaggaggccguccagguccucaucaagcacuccgccgacgucaacgcccgcgacaagaacuggcagaccccccuccacgucgccgccgccaacaaggccgucaagugcgccgaggucaucaucccccuccucuccuccgucaacgucuccgaccgcggcggccgcaccgcccuccaccacgccgcccucaacggccacgucgagauggucaaccuccuccucgccaagggcgccaacaucaacgccuucgacaagaaggaccgccgcgcccuccacugggccgccuacaugggccaccucgacgucgucgcccuccucaucaaccacggcgccgaggucaccugcaaggacaagaagggcuacaccccccuccacgccgccgccuccaacggccagaucaacgucgucaagcaccuccucaaccucggcgucgagaucgacgagaucaacgucuacggcaacaccgcccuccacaucgccugcuacaacggccaggacgccgucgucaacgagcucaucgacuacggcgccaacgucaaccagcccaacaacaacggcuucaccccccuccacuucgccgccgccuccacccacggcgcccucugccucgagcuccucgucaacaacggcgccgacgucaacauccaguccaaggacggcaaguccccccuccacaugaccgccguccacggccgcuucacccgcucccagacccucauccagaacggcggcgagaucgacugcgucgacaaggacggcaacaccccccuccacgucgccgcccgcuacggccacgagcuccucaucaacacccucaucaccuccggcgccgacaccgccaagugcggcauccacuccauguucccccuccaccucgccgcccucaacgcccacuccgacugcugccgcaagcuccucuccuccggcuucgagaucgacacccccgacaaguucggccgcaccugccuccacgccgccgccgccggcggcaacgucgagugcaucaagcuccuccaguccuccggcgccgacuuccacaagaaggacaagugcggccgcaccccccuccacuacgccgccgccaacugccacuuccacugcaucgagacccucgucaccaccggcgccaacgucaacgagaccgacgacuggggccgcaccgcccuccacuacgccgccgccuccgacauggaccgcaacaagaccauccucggcaacgcccacgacaacuccgaggagcucgagcgcgcccgcgagcucaaggagaaggaggccacccucugccucgaguuccuccuccagaacgacgccaaccccuccauccgcgacaaggagggcuacaacuccauccacuacgccgccgccuacggccaccgccagugccucgagcuccuccucgagcgcaccaacuccggcuucgaggaguccgacuccggcgccaccaaguccccccuccaccucgccgccuacaacggccaccaccaggcccucgagguccuccuccagucccucgucgaccucgacauccgcgacgagaagggccgcaccgcccucgaccucgccgccuucaagggccacaccgagugcgucgaggcccucaucaaccagggcgccuccaucuucgucaaggacaacgucaccaagcgcaccccccuccacgccuccgucaucaacggccacacccucugccuccgccuccuccucgagaucgccgacaaccccgaggccgucgacgucaaggacgccaagggccagaccccccucaugcucgccgucgccuacggccacaucgacgccgucucccuccuccucgagaaggaggccaacgucgacaccgucgacauccucggcugcaccgcccuccaccgcggcaucaugaccggccacgaggagugcguccagaugcuccucgagcaggaggucuccauccucugcaaggacucccgcggccgcaccccccuccacuacgccgccgcccgcggccacgccaccuggcucuccgagcuccuccagauggcccucuccgaggaggacugcugcuucaaggacaaccagggcuacaccccccuccacugggccugcuacaacggcaacgagaacugcaucgagguccuccucgagcagaagugcuuccgcaaguucaucggcaaccccuucaccccccuccacugcgccaucaucaacgaccacggcaacugcgccucccuccuccucggcgccaucgacuccuccaucgucuccugccgcgacgacaagggccgcaccccccuccacgccgccgccuucgccgaccacgucgagugccuccagcuccuccuccgccacuccgcccccgucaacgccgucgacaacuccggcaagaccgcccucaugauggccgccgagaacggccaggccggcgccgucgacauccucgucaacuccgcccaggccgaccucaccgucaaggacaaggaccucaacaccccccuccaccucgccugcuccaagggccacgagaagugcgcccuccucauccucgacaagauccaggacgagucccucaucaacgagaagaacaacgcccuccagaccccccuccacgucgccgcccgcaacggccucaaggucgucgucgaggagcuccucgccaagggcgccugcguccucgccgucgacgagaacgccucccgcuccaacggcccccgcuccacccccggcaccgccguccagaaggaggaguga

SEQ ID NO: 39720 - RNA, 801 nt, Artificial Sequence
  derived and/or modified sequence opt2 from ANKRD45__Homo_sapiens__XP_011507772
auggaguccgagggcccccccgaguccgaguccuccgaguucuucucccagcaggaggaggagaacgaggaggaggaggcccaggagcccgaggagaccggccccaagaacccccuccuccagcccgcccucaccggcgacgucgagggccuccagaagaucuucgaggaccccgagaacccccaccacgagcaggccaugcagcuccuccucgaggaggacaucgucggccgcaaccuccucuacgccgccugcauggccggccaguccgacgucauccgcgcccucgccaaguacggcgucaaccucaacgagaagaccacccgcggcuacacccuccuccacugcgccgccgccuggggccgccucgagacccucaaggcccucgucgagcucgacgucgacaucgaggcccucaacuuccgcgaggagcgcgcccgcgacgucgccgcccgcuacucccagaccgagugcgucgaguuccucgacugggccgacgcccgccucacccucaagaaguacaucgccaaggucucccucgccgucaccgacaccgagaagggcuccggcaagcuccucaaggaggacaagaacaccauccucuccgccugccgcgccaagaacgaguggcucgagacccacaccgaggccuccaucaacgagcucuucgagcagcgccagcagcucgaggacaucgucacccccaucuucaccaagaugaccacccccugccaggucaaguccgccaaguccgucaccucccacgaccagaagcgcucccaggacgacaccuccaacuga

SEQ ID NO: 39721 - RNA, 699 nt, Artificial Sequence
  derived and/or modified sequence opt2 from ANKRD46__Homo_sapiens__NP_001257308
auguccuacgucuucgucaacgacuccucccagaccaacgucccccuccuccaggccugcaucgacggcgacuucaacuacuccaagcgccuccucgaguccggcuucgaccccaacauccgcgacucccgcggccgcaccggccuccaccucgccgccgcccgcggcaacgucgacaucugccagcuccuccacaaguucggcgccgaccuccucgccaccgacuaccagggcaacaccgcccuccaccucugcggccacgucgacaccauccaguuccucgucuccaacggccucaagaucgacaucugcaaccaccagggcgccaccccccucguccucgccaagcgccgcggcgucaacaaggacgucauccgccuccucgagucccucgaggagcaggaggucaagggcuucaaccgcggcacccacuccaagcucgagaccaugcagaccgccgaguccgaguccgccauggagucccacucccuccucaaccccaaccuccagcagggcgagggcguccucuccuccuuccgcaccaccuggcaggaguucgucgaggaccucggcuucuggcgcguccuccuccucaucuucgucaucgcccuccucucccucggcaucgccuacuaccgccgcacccuccgccucggcuccuucgcccgccaggaccgcucccgcauccaggccaucuga

SEQ ID NO: 39722 - RNA, 3753 nt, Artificial Sequence
  derived and/or modified sequence opt2 from ANKRD50__Homo_sapiens__NP_001161354
augaagcccccccagcagucccucuaccuccucgucgacuccgucgacgagggcugcaacaucaccgagggcgagcagaccuccaccucccucuccggcaccgucgccgcccuccucgccggccaccacgaguucuucccccccuggcuccuccuccucugcuccgcccgcaagcaguccaaggccgucaccaagauguucaccggcuuccgcaagaucucccucgacgaccuccgcaaggccuacaucgucaaggacguccagcaguacauccuccaccgccucgaccaggaggaggcccuccgccagcaccucaccaaggagaccgccgagaugcucaaccagcuccacaucaaguccuccggcugcuuccucuaccucgagcgcguccucgacggcgucgucgagaacuucaucaugcuccgcgagauccgcgacauccccggcacccucaacggccucuaccucuggcucugccagcgccucuucguccgcaagcaguucgccaagguccagcccauccucaacgucauccucgccgccugccgcccccucaccaucaccgagcucuaccacgccgucuggaccaagaacaugucccucacccucgaggacuuccagcgcaagcucgacauccucuccaagcuccucgucgacggccucggcaacaccaagauccucuuccacuacuccuucgccgaguggcuccucgacgucaagcacugcacccagaaguaccucugcaacgccgccgagggccaccgcaugcucgccauguccuacaccugccaggccaagaaccucaccccccucgaggcccaggaguucgcccuccaccucaucaacuccaaccuccagcucgagaccgccgagcucgcccucuggaugaucuggaacggcacccccguccgcgacucccucuccacccucauccccaaggagcaggagguccuccagcuccucgucaaggccggcgcccacgucaacuccgaggacgaccgcaccuccugcaucguccgccaggcccucgagcgcgaggacuccauccgcacccuccucgacaacggcgccuccgucaaccagugcgacuccaacggccgcacccuccucgccaacgccgccuacuccggcucccucgacgucgucaaccuccucgucucccgcggcgccgaccucgagaucgaggacgcccacggccacaccccccucacccucgccgcccgccagggccacaccaaggucgucaacugccucaucggcugcggcgccaacaucaaccacaccgaccaggacggcuggaccgcccuccgcuccgccgccuggggcggccacaccgaggucgucuccgcccuccucuacgccggcgucaaggucgacugcgccgacgccgacucccgcaccgcccuccgcgccgccgccuggggcggccacgaggacaucguccucaaccuccuccagcacggcgccgaggucaacaaggccgacaacgagggccgcaccgcccucaucgccgccgccuacaugggccaccgcgagaucgucgagcaccuccucgaccacggcgccgaggucaaccacgaggacgucgacggccgcaccgcccucuccgucgccgcccucugcguccccgccuccaagggccacgccuccgucgucucccuccucaucgaccgcggcgccgaggucgaccacugcgacaaggacggcaugaccccccuccucgucgccgccuacgagggccacgucgacgucgucgaccuccuccucgagggcggcgccgacgucgaccacaccgacaacaacggccgcaccccccuccucgccgccgccuccaugggccacgccuccgucgucaacacccuccucuucuggggcgccgccgucgacuccaucgacuccgagggccgcaccguccucuccaucgccuccgcccagggcaacgucgaggucguccgcacccuccucgaccgcggccucgacgagaaccaccgcgacgacgccggcuggaccccccuccacauggccgccuucgagggccaccgccucaucugcgaggcccucaucgagcagggcgcccgcaccaacgagaucgacaacgacggccgcauccccuucauccucgccucccaggagggccacuacgacugcguccagauccuccucgagaacaaguccaacaucgaccagcgcggcuacgacggccgcaacgcccuccgcgucgccgcccucgagggccaccgcgacaucgucgagcuccucuucucccacggcgccgacgucaacugcaaggacgccgacggccgccccacccucuacauccucgcccucgagaaccagcucaccauggccgaguacuuccucgagaacggcgccaacgucgaggccuccgacgccgagggccgcaccgcccuccacgucuccugcuggcagggccacauggagaugguccagguccucaucgccuaccacgccgacgucaacgccgccgacaacgagaagcgcuccgcccuccaguccgccgccuggcagggccacgucaaggucguccagcuccucaucgagcacggcgccgucgucgaccacaccugcaaccagggcgccaccgcccucugcaucgccgcccaggagggccacaucgacgucguccagguccuccucgagcacggcgccgaccccaaccacgccgaccaguucggccgcaccgccaugcgcgucgccgccaagaacggccacucccagaucaucaagcuccucgagaaguacggcgccuccucccucaacggcugcucccccucccccguccacaccauggagcagaagccccuccagucccucuccuccaagguccagucccucaccaucaaguccaacuccuccggcuccaccggcggcggcgacaugcagcccucccuccgcggccuccccaacggccccacccacgccuucuccucccccuccgagucccccgacuccaccgucgaccgccagaaguccucccucuccaacaacucccucaaguccuccaagaacuccucccuccgcaccaccuccuccaccgccaccgcccagaccguccccaucgacuccuuccacaaccucuccuucaccgagcagauccagcagcacucccucccccgcucccgcucccgccaguccaucgucucccccuccuccaccacccagucccucggccagucccacaacucccccuccuccgaguucgaguggucccaggucaagcccucccucaaguccaccaaggccuccaagggcggcaaguccgagaacuccgccaaguccggcuccgccggcaagaaggccaagcaguccaacuccucccagcccaagguccucgaguacgagaugacccaguucgaccgccgcggccccaucgccaaguccggcaccgccgccccccccaagcagaugcccgccgagucccagugcaagaucaugauccccuccgcccagcaggagaucggccgcucccagcagcaguuccucauccaccagcaguccggcgagcagaagaagcgcaacggcaucaugaccaaccccaacuaccaccuccaguccaaccaggucuuccucggccgcgucuccgucccccgcaccaugcaggaccgcggccaccaggagguccucgagggcuaccccuccuccgagaccgagcucucccucaagcaggcccucaagcuccagaucgagggcuccgaccccuccuucaacuacaagaaggagaccccccucuga

SEQ ID NO: 39723 - RNA, 1845 nt, Artificial Sequence
  derived and/or modified sequence opt2 from ANKRD55__Homo_sapiens__NP_078945
augaugcgccaggccaccauggacuucuccacccccuccgucuucgaccagcagcgcggcgacuccuccgaggaggucgaccucaccauggucuaccaggccgccuccaacggcgacgucaacgcccucaccgccgucauccgcgaggaccccuccauccucgagugcugcgacuccgagggcugcaccccccucaugcacgccgucuccggccgccaggccgacaccgucaagcuccuccucaagaugggcgccaacaucaacaugcaggacgccuacggccgcaccucccucugccucgccaccuaccucggcuggcucgagggcugcgucucccuccuccgcaacggcgccaagcacaacauccccgacaagaacggccgccucccccuccacgccgccaccgccgagcccgacaugcgccuccucaccguccuccuccagcaguccaacaucuccgagaucaaccaccaggacaacgagggcaugaccccccuccacugggccgccuuccacaaccagccccagcacacccagaugcuccucaagaagggcgccgaccccacccucgucgacaaggacuucaagaccgcccuccacugggccguccaguccggcaaccgcauccucugcuccaucauccucucccaccaccagggccccuccaucaucaacuacgacgacgaguccggcaagaccugcguccacaucgccgccgccgccggcuucuccgacaucauccacgagcucgcccgcguccccgagugcaaccuccaggcccucgacgucgacgaccgcaccccccuccacugggccgccgccgccggcaaggccgagugcguccagucccuccucgagcucggcauggacuccaaccuccgcgacaucaacgaguccaccccccucgccuacgcccucuacugcggccacaccgccugcgucaagcuccucucccaggagucccgcaccgagcccacccgccccccccccucccaguccucccgcccccagaagaaggagcgccgcuucaacguccucaaccagaucuucugcaagaacaagaaggaggagcagcgcgcccaccagaaggaccccucccgcgaccgcuaccgcgaggaggacaccuccgaggucaacgacaucaucaccaccuucgacuccaucgucggcaccaacugccaggagcagcccggcgaccaggucgccauggucgaguucaagaagaagaccuccgacaacuccaaguaccuccuccccgagaagaagccccucgcccgcaagggccucccccccauccgcacccagucccucccccccaucacccucggcaacaacuuccucaccgccucccaccgcgccaccucccacgccggccucuccuccgccccccaccacauggcccagcgcucccagaagucccgcuccgagcaggaccuccucaacaaccgcaccggcugccagaugcuccucgacaaccccuggaaguccgacuccaaccaggucuucuccuacaaggucuggaccgucuccuccuccgacaagcuccucgaccgccuccucuccguccgccccggccaccaggaggucuccguccccccccaccuccgccaccuccacaaccccuccuccggccagaacuuccagcaccucucccccaaccgccacaagauccgcgaccuccccuucacccgcaacaaccucgccccccuccccgaccagaaguuccucuccggcgagccccuccgcaccaaccgcguccuccccgccauccccucccagcgccgccacuccaccgccgccgaggaguccgagcacuccgccaaccccaccuccgacgagaacuga

SEQ ID NO: 39724 - RNA, 2184 nt, Artificial Sequence
  derived and/or modified sequence opt2 from ANKRD6__Homo_sapiens__NP_001229738
augucccagcaggacgccgucgccgcccucuccgagcgccuccucgucgccgccuacaagggccagaccgagaacgucguccagcucaucaacaagggcgcccgcgucgccgucaccaagcacggccgcaccccccuccaccucgccgccaacaagggccaccuccccgucguccagauccuccucaaggccggcugcgaccucgacguccaggacgacggcgaccagaccgcccuccaccgcgccaccgucgucggcaacaccgagaucaucgccgcccucauccacgagggcugcgcccucgaccgccaggacaaggacggcaacaccgcccuccacgaggccuccuggcacggcuucucccaguccgccaagcuccucaucaaggccggcgccaacguccucgccaagaacaaggccggcaacaccgcccuccaccucgccugccagaacucccacucccaguccacccgcguccuccuccucgccggcucccgcgccgaccucaagaacaacgccggcgacaccugccuccacgucgccgcccgcuacaaccaccucuccaucauccgccuccuccucaccgccuucugcuccguccacgagaagaaccaggccggcgacaccgcccuccacgucgccgccgcccucaaccacaagaaggucgccaagauccuccucgaggccggcgccgacaccaccaucgucaacaacgccggccagaccccccucgagaccgcccgcuaccacaacaaccccgaggucgcccuccuccucaccaaggccccccagguccuccgcuucucccgcggccgcucccuccgcaagaagcgcgagcgccucaaggaggagcgccgcgcccaguccgucccccgcgacgaggucgcccaguccaagggcuccgucuccgccggcgacacccccuccuccgagcaggccgucgcccgcaaggaggaggcccgcgaggaguuccucuccgccucccccgagccccgcgccaaggacgaccgccgccgcaagucccgccccaaggucuccgccuucuccgaccccaccccccccgccgaccagcagcccggccaccagaagaaccuccacgcccacaaccaccccaagaagcgcaaccgccaccgcugcuccucccccccccccccccacgaguuccgcgccuaccagcucuacacccucuaccgcggcaaggacggcaaggucaugcaggcccccaucaacggcugccgcugcgagccccucaucaacaagcucgagaaccagcucgaggccaccgucgaggagaucaaggccgagcucggcuccguccaggacaagaugaacaccaagcucggccagauggagaacaagacccagcaccagaugcgcguccucgacaagcucauggucgagcgccucuccgccgagcgcaccgagugccucaaccgccuccagcagcacuccgacaccgagaagcacgagggcgagaagcgccagaucucccucgucgacgagcucaagaccuggugcaugcucaagauccagaaccucgagcagaagcucuccggcgacucccgcgccugccgcgccaaguccacccccuccaccugcgaguccuccaccggcgucgaccagcucgucgucaccgccggccccgccgccgccuccgacuccuccccccccgucguccgccccaaggagaaggcccucaacuccaccgccacccagcgccuccagcaggagcucuccuccuccgacugcaccggcucccgccuccgcaacgucaagguccagaccgcccuccuccccaugaacgaggccgcccgcuccgaccagcaggccggccccugcgucaaccgcggcacccagaccaagaaguccggcaaguccggccccacccgccaccgcgcccagcagcccgccgccuccuccaccugcggccagcccccccccgccaccggcuccgagcagaccggcccccacauccgcgacaccucccaggcccucgagcucacccaguacuucuucgaggccgucuccacccagauggagaagugguacgagcgcaagaucgaggaggcccgcucccaggccaaccagaaggcccagcaggacaaggccacccucaaggagcacaucaagucccucgaggaggagcucgccaagcuccgcacccgcguccagaaggagaacuga

SEQ ID NO: 39725 - RNA, 765 nt, Artificial Sequence
  derived and/or modified sequence opt2 from ANKRD7__Homo_sapiens__NP_062618
augaacaagcucuucuccuucuggaagcgcaagaacgagacccgcucccagggcuacaaccuccgcgagaaggaccucaagaagcuccaccgcgccgccuccgucggcgaccucaagaagcucaaggaguaccuccagaucaagaaguacgacgucaacaugcaggacaagaaguaccgcaccccccuccaccucgccugcgccaacggccacaccgacgucguccucuuccucaucgagcagcagugcaagaucaacguccgcgacuccgagaacaaguccccccucaucaaggccguccagugccagaacgaggacugcgccaccauccuccucaacuucggcgccgaccccgaccuccgcgacauccgcuacaacaccguccuccacuacgccgucugcggccagucccucucccucgucgagaagcuccucgaguacgaggccgaccucgaggccaagaacaaggacggcuacaccccccuccucgucgccgucaucaacaacaaccccaagauggucaaguuccuccucgagaagggcgccgacgucaacgccuccgacaacuaccagcgcaccgcccucauccucgccgucuccggcgagccccccugccucgucaagcuccuccuccagcagggcgucgagcucugcuacgagggcaucgucgacucccagcuccgcaacauguucaucuccaugguccuccuccaccgcuacccccaguucaccgccucccacggcaagaagaagcacgccaaguga

SEQ ID NO: 39726 - RNA, 3405 nt, Artificial Sequence
  derived and/or modified sequence opt2 from ANKS1A__Homo_sapiens__NP_056060
augggcaaggagcaggagcuccucgaggccgcccgcaccggccaccuccccgccgucgagaagcuccucuccggcaagcgccucuccuccggcuucggcggcggcggcggcggcggcuccggcggcggcggcggcggcuccggcggcggcggcggcggccucggcuccuccucccacccccucuccucccuccucuccauguggcgcggccccaacgucaacugcgucgacuccaccggcuacaccccccuccaccacgccgcccucaacggccacaaggacgucgucgagguccuccuccgcaacgacgcccucaccaacgucgccgacuccaagggcugcuacccccuccaccucgccgccuggaagggcgacgcccagaucguccgccuccucauccaccagggccccucccacacccgcgucaacgagcagaacaacgacaacgagaccgcccuccacugcgccgcccaguacggccacaccgaggucgucaagguccuccucgaggagcucaccgaccccaccaugcgcaacaacaaguucgagaccccccucgaccucgccgcccucuacggccgccucgaggucgucaagaugcuccucaacgcccaccccaaccuccucuccugcaacaccaagaagcacaccccccuccaccucgccgcccgcaacggccacaaggccgucguccagguccuccucgacgccggcauggacuccaacuaccagaccgagaugggcuccgcccuccacgaggccgcccucuucggcaagaccgacgucguccagauccuccucgccgccggcaccgacgucaacaucaaggacaaccacggccucaccgcccucgacaccguccgcgagcuccccucccagaagucccagcagaucgccgcccucaucgaggaccacaugaccggcaagcgcuccaccaaggaggucgacaagaccccccccccccagcccccccucaucuccuccauggacuccaucucccagaagucccagggcgacgucgagaaggccgucaccgagcucaucaucgacuucgacgccaacgccgaggaggagggccccuacgaggcccucuacaacgccaucuccugccacucccucgacuccauggccuccggccgcuccuccgaccaggacuccaccaacaaggaggccgaggccgccggcgucaagcccgccggcguccgcccccgcgagcgcccccccccccccgccaagcccccccccgacgaggaggaggaggaccacaucgacaagaaguacuucccccucaccgccuccgagguccucuccaugcgcccccgcauccacggcuccgccgcccgcgaggaggacgagcaccccuacgagcuccuccucaccgccgagaccaagaaggucguccucgucgacggcaagaccaaggaccaccgccgcuccuccuccucccgcucccaggacuccgccgagggccaggacggccagguccccgagcaguucuccggccuccuccacggcuccucccccgucugcgaggucggccaggaccccuuccagcuccucugcaccgccggccagucccaccccgacggcuccccccagcagggcgccugccacaaggccuccaugcagcucgaggagaccggcguccacgcccccggcgccucccagcccuccgcccucgaccaguccaagcgcgucggcuaccucaccggccuccccaccaccaacucccgcucccaccccgagacccucacccacaccgccuccccccaccccggcggcgccgaggagggcgaccgcuccggcgcccgcucccgcgccccccccaccuccaagcccaaggccgagcucaagcucucccgcucccucuccaaguccgacuccgaccuccucaccugcucccccaccgaggacgccaccaugggcucccgcuccgagucccucuccaacugcuccaucggcaagaagcgccucgagaagucccccuccuucgccuccgagugggacgagaucgagaagaucauguccuccaucggcgagggcaucgacuucucccaggagcgccagaagaucuccggccuccgcacccucgagcaguccgucggcgaguggcucgaguccaucggccuccagcaguacgaguccaagcuccuccucaacggcuucgacgacguccacuuccucggcuccaacgucauggaggagcaggaccuccgcgacaucggcaucuccgacccccagcaccgccgcaagcuccuccaggccgcccgcucccuccccaaggucaaggcccucggcuacgacggcaacuccccccccuccguccccuccuggcucgacucccucggccuccaggacuacguccacuccuuccucuccuccggcuacuccuccaucgacaccgucaagaaccucugggagcucgagcucgucaacguccucaagguccagcuccucggccaccgcaagcgcaucaucgccucccucgccgaccgccccuacgaggagcccccccagaagcccccccgcuucucccagcuccgcugccaggaccuccucucccagaccuccuccccccucucccagaacgacuccugcaccggccgcuccgccgaccuccuccucccccccggcgacaccggccgccgccgccacgacucccuccacgaccccgccgcccccucccgcgccgagcgcuuccgcauccaggaggagcaccgcgaggccaagcucacccuccgcccccccucccucgccgcccccuacgcccccguccaguccuggcagcaccagcccgagaagcucaucuucgaguccugcggcuacgaggccaacuaccucggcuccaugcucaucaaggaccuccgcggcaccgaguccacccaggacgccugcgccaagaugcgcaaguccaccgagcacaugaagaagauccccaccaucauccucuccaucaccuacaagggcgucaaguucaucgacgccuccaacaagaacgucaucgccgagcacgagauccgcaacaucuccugcgccgcccaggaccccgaggaccucugcaccuucgccuacaucaccaaggaccuccagaccucccaccacuacugccacgucuucuccaccgucgacgucaaccucaccuacgagaucauccucacccucggccaggccuucgaggucgccuaccagcucgcccuccaggcccagaagucccgcgccaccggcgccuccgccgccgagaugaucgagaccaaguccuccaagcccguccccaagccccgcgucggcguccgcaaguccgcccucgagccccccgacauggaccaggacgcccagucccacgccuccgucuccugggucgucgaccccaagcccgacuccaagcgcucccucuccaccaacuga

SEQ ID NO: 39727 - RNA, 1074 nt, Artificial Sequence
  derived and/or modified sequence opt2 from ANKS1B__Homo_sapiens__NP_001190995
auggccaacggcuucgacaacguccaguucaugggcuccaacgucauggaggaccaggaccuccucgagaucggcauccucaacuccggccaccgccagcgcauccuccaggccauccagcuccuccccaagaugcgccccaucggccacgacggcuaccaccccaccuccgucgccgaguggcucgacuccaucgagcucggcgacuacaccaaggccuuccucaucaacggcuacaccuccauggaccuccucaagaagaucugggaggucgagcucaucaaccaguccuccgucugcgagaucuggaccaaccagaacgccggcuuccccuucuccgccauccaccagguccacaacaccggcgacuggggcgagcccuccaucacccuccgcccccccaacgaggccaccgccuccacccccguccaguacuggcagcaccaccccgagaagcucaucuuccaguccugcgacuacaaggccuucuaccucggcuccaugcucaucaaggagcuccgcggcaccgaguccacccaggacgccugcgccaagaugcgcgccaacugccagaaguccaccgagcagaugaagaagguccccaccaucauccucuccgucuccuacaagggcgucaaguucaucgacgccaccaacaagaacaucaucgccgagcacgagauccgcaacaucuccugcgccgcccaggaccccgaggaccucuccaccuucgccuacaucaccaaggaccucaaguccaaccaccacuacugccacgucuucaccgccuucgacgucaaccucgccuacgagaucauccucacccucggccaggccuucgaggucgccuaccagcucgcccuccaggcccgcaagggcggccacuccuccacccuccccgaguccuucgagaacaagcccuccaagcccauccccaagccccgcgucuccauccgcaaguccgucaucgaccccuccgagcagaagacccucgccaaccuccccuggaucgucgagcccggccaggaggccaagcgcggcaucaacaccaaguacgagaccaccaucuucuga

SEQ ID NO: 39728 - RNA, 1254 nt, Artificial Sequence
  derived and/or modified sequence opt2 from ANKS4B__Homo_sapiens__NP_665872
auguccacccgcuaccaccaggccgccuccgacuccuaccucgagcuccucaaggaggccaccaagcgcgaccucaaccucuccgacgaggacggcaugacccccacccuccucgccgccuaccacggcaaccucgaggcccucgagaucaucugcucccgcggcggcgaccccgaccgcugcgacaucuggggcaacaccccccuccacuucgccgccuccaacggccacgcccacugcgucuccuuccucgucaacuucggcgccaacaucuucgcccucgacaacgaccuccagaccccccucgacgccgccgccucccgcgagcagaacgagugcgucgcccuccucgacaaggccgccaccgcccagaacaucaugaaccccaagaaggucacccgccucaaggagcaggcccagaagaacgcccgccgccagaucaaggagugcgagcgccuccaggagaagcaccagaacaagauggcccacaccuacuccaaggaggaguccggcacccucuccuccuccaagggcaccuucucccgcuccucccccuccaacgccuccgcccccggcaccuucggcucccucuccaagggcaucaaggacaccuucaagaucaaguucaagaagaacaaggacaccgccgagcaggucggcaaggagggccgcuccggccagcgcaacgucauggaggucuuccgcgaggaggaggaggacuccuucuccggcgacuucaaggagaagcuccagcucuccgccgaggaggacggcuccguccaccacgaguccauccucaaccgccccggccucggcuccaucgucuuccgccgcaaccgcaucuccucccccgaggacaucuccgacuccaagcgcgaguucggcuucaagcuccccuccgagcuccuccagcgccagggcgccuccgaggccgacgagggcgccgccgacgaggagggcgaggagaacggccucaaggacgaccuccccugggacgacgacgaggucgagugggaggaggacgucgucgacgccaccccccucgaggucuuccuccucucccagcaccucgaggaguuccuccccaucuucaagcgcgagcagaucgaccucgaggcccuccuccucugcuccgacgaggaccuccaguccauccagaugcagcucggcccccgcaagaagguccucaacgccaucaaccgccgcaagcagguccuccagcagcccggccagcucgucgacaccucccucuga

SEQ ID NO: 39729 - RNA, 2616 nt, Artificial Sequence
  derived and/or modified sequence opt2 from ANKS6__Homo_sapiens__NP_775822
augggcgagggcggccucccccccgccuuccagcuccuccuccgcgccugcgaccagggcgacaccgagaccgcccgccgccuccucgagcccggcgccgccgagcccgccgagcgcggcgccgagcccgaggccggcgccgagcccgccggcgccgaggucgccggccccggcgccgccgccgccggcgccgucggcgcccccguccccgucgacugcuccgacgaggccggcaacaccgcccuccaguucgccgccgccggcggccacgagccccucguccgcuuccuccuccgccgcggcgccuccgucaacucccgcaaccacuacggcugguccgcccucaugcaggccgcccgcuucggccacgucuccgucgcccaccuccuccucgaccacggcgccgacgucaacgcccagaaccgccucggcgccuccguccucaccgucgccucccgcggcggccaccucggcgucgucaagcuccuccucgaggccggcgccuucgucgaccaccaccaccccuccggcgagcagcucggccucggcggcucccgcgacgagccccucgacaucaccgcccucauggccgccauccagcacggccacgaggccgucguccgccuccucauggaguggggcgccgaccccaaccacgccgcccgcaccgucggcugguccccccucaugcucgccgcccucaccggccgccucggcgucgcccagcagcucgucgagaagggcgccaaccccgaccaccucuccguccucgagaagaccgccuucgaggucgcccucgacugcaagcaccgcgaccucgucgacuaccucgacccccucaccaccguccgccccaagaccgacgaggagaagcgccgccccgacaucuuccacgcccucaagaugggcaacuuccagcucgucaaggagaucgccgacgaggaccccucccacgucaaccucgucaacggcgacggcgccaccccccucaugcucgccgccgucaccggccagcucgcccucguccagcuccucgucgagcgccacgccgacgucgacaagcaggacuccguccacggcuggaccgcccucaugcaggccaccuaccacggcaacaaggagaucgucaaguaccuccucaaccagggcgccgacgucacccuccgcgccaagaacggcuacaccgccuucgaccucgucaugcuccucaacgaccccgacaccgagcucguccgccuccucgccuccgucugcaugcaggucaacaaggacaagggccgccccucccaccagcccccccucccccacuccaagguccgccagcccugguccauccccguccuccccgacgacaagggcggccucaaguccugguggaaccgcauguccaaccgcuuccgcaagcucaagcucaugcagacccucccccgcggccucuccuccaaccagccccuccccuucuccgacgagcccgagcccgcccucgacuccaccaugcgcgccgccccccaggacaagaccucccgcuccgcccuccccgacgccgcccccgucaccaaggacaacggccccggcuccacccgcggcgagaaggaggacacccuccucaccaccaugcuccgcaacggcgccccccucacccgccuccccuccgacaagcucaaggccgucaucccccccuuccucccccccuccuccuucgagcucugguccuccgaccgcucccgcacccgccacaacggcaaggccgaccccaugaagaccgcccucccccagcgcgccucccgcggccaccccgucggcggcggcggcaccgacaccacccccguccgccccgucaaguuccccucccucccccgcucccccgccuccuccgccaacuccggcaacuucaaccacuccccccacuccuccggcggcuccuccggcgucggcgucucccgccacggcggcgagcuccucaaccgcuccggcggcuccaucgacaacguccucucccagaucgccgcccagcgcaagaaggccgccggccuccucgagcagaagcccucccaccgcuccucccccgucggccccgcccccggcuccucccccuccgagcuccccgccucccccgccggcggcuccgcccccgucggcaagaagcucgagaccuccaagcgcccccccuccggcaccuccaccaccuccaaguccaccucccccacccucacccccucccccucccccaagggccacaccgccgaguccuccgucuccuccuccuccucccaccgccaguccaaguccuccggcggcuccuccuccggcaccaucaccgacgaggacgagcucaccggcauccucaagaagcucucccucgagaaguaccagcccaucuucgaggagcaggaggucgacauggaggccuuccucacccucaccgacggcgaccucaaggagcucggcaucaagaccgacggcucccgccagcagauccucgccgccaucuccgagcucaacgccggcaagggccgcgagcgccagauccuccaggagaccauccacaacuuccacuccuccuucgaguccuccgccuccaacacccgcgcccccggcaacucccccugcgccuga

SEQ ID NO: 39730 - RNA, 3264 nt, Artificial Sequence
  derived and/or modified sequence opt2 from ANLN__Homo_sapiens__NP_001271230
auggaccccuucaccgagaagcuccucgagcgcacccgcgcccgccgcgagaaccuccagcgcaagauggccgagcgccccaccgccgccccccgcuccaugacccacgccaagcgcgcccgccagccccucuccgaggccuccaaccagcagccccucuccggcggcgaggagaaguccugcaccaagcccucccccuccaagaagcgcugcuccgacaacaccgaggucgaggucuccaaccucgagaacaagcagcccgucgaguccaccuccgccaaguccugcucccccucccccgucuccccccagguccagccccaggccgccgacaccaucuccgacuccgucgccguccccgccucccuccucggcaugcgccgcggccucaacucccgccucgaggccaccgccgccuccuccgucaagacccgcaugcagaagcucgccgagcagcgccgccgcugggacaacgacgacaugaccgacgacauccccgaguccucccucuucucccccaugcccuccgaggagaaggccgccucccccccccgcccccuccucuccaacgccuccgccacccccgucggccgccgcggccgccucgccaaccucgccgccaccaucugcuccugggaggacgacgucaaccacuccuucgccaagcagaacuccguccaggagcagcccggcaccgccugccucuccaaguucuccuccgccuccggcgccuccgcccgcaucaacuccuccuccgucaagcaggaggccaccuucugcucccagcgcgacggcgacgccucccucaacaaggcccucuccuccuccgccgacgacgccucccucgucaacgccuccaucuccuccuccgucaaggccaccucccccgucaaguccaccaccuccaucaccgacgccaaguccugcgagggccagaaccccgagcuccuccccaagacccccaucuccccccucaagaccggcgucuccaagcccaucgucaaguccacccucucccagaccguccccuccaagggcgagcucucccgcgagaucugccuccagucccaguccaaggacaaguccaccacccccggcggcaccggcaucaagcccuuccucgagcgcuucggcgagcgcugccaggagcacuccaaggagucccccgcccgcuccaccccccaccgcacccccaucaucacccccaacaccaaggccauccaggagcgccucuucaagcaggacaccuccuccuccaccacccaccucgcccagcagcucaagcaggagcgccagaaggagcucgccugccuccgcggccgcuucgacaagggcaacaucugguccgccgagaagggcggcaacuccaaguccaagcagcucgagaccaagcaggagacccacugccaguccaccccccucaagaagcaccagggcgucuccaagacccagucccuccccgucaccgagaaggucaccgagaaccagauccccgccaagaacuccuccaccgagcccaaggaggucauccgcgagaucgagauguccgucgacgacgacgacaucaacuccuccaaggucaucaacgaccucuucuccgacguccucgaggagggcgagcucgacauggagaagucccaggaggagauggaccaggcccucgccgaguccuccgaggagcaggaggacgcccucaacaucuccuccaugucccuccucgccccccucgcccagaccgucggcgucgucucccccgagucccucgucuccaccccccgccucgagcucaaggacaccucccgcuccgacgagucccccaagcccggcaaguuccagcgcacccgcgucccccgcgccgaguccggcgacucccucggcuccgaggaccgcgaccuccucuacuccaucgacgccuaccgcucccagcgcuucaaggagaccgagcgccccuccaucaagcaggucaucguccgcaaggaggacgucaccuccaagcucgacgagaagaacaacgccuuccccugccaggucaacaucaagcagaagaugcaggagcucaacaacgagaucaacaugcagcagaccgucaucuaccaggccucccaggcccucaacugcugcgucgacgaggagcacggcaagggcucccucgaggaggccgaggccgagcgccuccuccucaucgccaccggcaagcgcacccuccucaucgacgagcucaacaagcucaagaacgagggcccccagcgcaagaacaaggccuccccccaguccgaguucaugcccuccaagggcuccgucacccucuccgagauccgccucccccucaaggccgacuucgucugcuccaccguccagaagcccgacgccgccaacuacuacuaccucaucauccucaaggccggcgccgagaacauggucgccaccccccucgccuccaccuccaacucccucaacggcgacgcccucaccuucaccaccaccuucacccuccaggacgucuccaacgacuucgagaucaacaucgaggucuacucccucguccagaagaaggaccccuccggccucgacaagaagaagaagaccuccaaguccaaggccaucacccccaagcgccuccucaccuccaucaccaccaaguccaacauccacuccuccgucauggccucccccggcggccucuccgccguccgcaccuccaacuucgcccucgucggcuccuacacccucucccucuccuccgucggcaacaccaaguucguccucgacaagguccccuuccucuccucccucgagggccacaucuaccucaagaucaagugccaggucaacuccuccgucgaggagcgcggcuuccucaccaucuucgaggacgucuccggcuucggcgccuggcaccgccgcuggugcguccucuccggcaacugcaucuccuacuggaccuaccccgacgacgagaagcgcaagaaccccaucggccgcaucaaccucgccaacugcaccucccgccagaucgagcccgccaaccgcgaguucugcgcccgccgcaacaccuucgagcucaucaccguccgcccccagcgcgaggacgaccgcgagacccucgucucccagugccgcgacacccucugcgucaccaagaacuggcucuccgccgacaccaaggaggagcgcgaccucuggaugcagaagcucaaccagguccucgucgacauccgccucuggcagcccgacgccugcuacaagcccaucggcaagcccuga

SEQ ID NO: 39731 - RNA, 1884 nt, Artificial Sequence
  derived and/or modified sequence opt2 from ANO10__Homo_sapiens__NP_001191760
augaaggucacccucuccgcccucgacaccuccgaguccuccuucaccccccucgucgucaucgagcucgcccaggacgucaaggaggagaccaaggaguggcucaagaaccgcaucaucgccaagaagaaggacggcggcgcccagcuccucuuccgcccccuccucaacaaguacgagcaggagacccucgagaaccagaaccucuaccucgucggcgccuccaagauccgcaugcuccucggcgccgaggccgucggccucgucaaggagugcaacgacaacaccaugcgcgccuucaccuaccgcacccgccagaacuucaagggcuucgacgacaacaacgacgacuuccucaccauggccgagugccaguucaucaucaagcacgagcucgagaaccuccgcgccaaggacgagaagaugauccccggcuacccccaggccaagcucuaccccggcaagucccuccuccgccgccuccucaccuccggcaucgucauccaggucuucccccuccacgacuccgaggcccucaagaagcucgaggacaccugguacacccgcuucgcccucaaguaccagcccaucgacuccauccgcggcuacuucggcgagaccaucgcccucuacuucggcuuccucgaguacuucaccuucgcccucauccccauggccgucaucggccuccccuacuaccucuucgucugggaggacuacgacaaguacgucaucuucgccuccuucaaccucaucugguccaccgucauccucgagcucuggaagcgcggcugcgccaacaugaccuaccgcuggggcacccuccucaugaagcgcaaguucgaggagccccgccccggcuuccacggcguccucggcaucaacuccaucaccggcaaggaggagccccucuaccccuccuacaagcgccagcuccgcaucuaccucgucucccuccccuucgucugccucugccucuacuucucccucuacgucaugaugaucuacuucgacauggaggucugggcccucggccuccacgagaacuccggcuccgaguggaccuccguccuccucuacguccccuccaucaucuacgccaucgucaucgagaucaugaaccgccucuaccgcuacgccgccgaguuccucaccuccugggagaaccaccgccucgaguccgccuaccagaaccaccucauccucaagguccucgucuucaacuuccucaacugcuucgccucccucuucuacaucgccuucguccucaaggacaugaagcuccuccgccagucccucgccacccuccucaucaccucccagauccucaaccagaucauggaguccuuccuccccuacuggcuccagcgcaagcacggcguccgcgucaagcgcaagguccaggcccucaaggccgacaucgacgccacccucuacgagcaggucauccucgagaaggagaugggcaccuaccucggcaccuucgacgacuaccucgagcucuuccuccaguucggcuacgucucccucuucuccugcgucuacccccucgccgccgccuucgccguccucaacaacuucaccgaggucaacuccgacgcccucaagaugugccgcgucuucaagcgccccuucuccgagcccuccgccaacaucggcgucuggcagcucgccuucgagaccauguccgucaucuccgucgucaccaacugcgcccucaucggcauguccccccaggucaacgccgucuuccccgaguccaaggccgaccucauccucaucgucgucgccgucgaggccgccuccugcaagcucgucucccucccccgcuacuccugguccaccaacuccguccccggcaccgucaucggccccggcgucuga

SEQ ID NO: 39732 - RNA, 2961 nt, Artificial Sequence
  derived and/or modified sequence opt2 from ANO1__Homo_sapiens__NP_060513
augcgcgucaacgagaaguacuccacccuccccgccgaggaccgcuccguccacaucaucaacaucugcgccaucgaggacaucggcuaccuccccuccgagggcacccuccucaacucccucuccgucgaccccgacgccgagugcaaguacggccucuacuuccgcgacggccgccgcaaggucgacuacauccucgucuaccaccacaagcgccccuccggcaaccgcacccucguccgccgcguccagcacuccgacacccccuccggcgcccgcuccgucaagcaggaccacccccuccccggcaagggcgccucccucgacgccggcuccggcgagccccccauggacuaccacgaggacgacaagcgcuuccgccgcgaggaguacgagggcaaccuccucgaggccggccucgagcucgagcgcgacgaggacaccaagauccacggcgucggcuucgucaagauccacgcccccuggaacguccucugccgcgaggccgaguuccucaagcucaagaugcccaccaagaagauguaccacaucaacgagacccgcggccuccucaagaagaucaacuccguccuccagaagaucaccgaccccauccagcccaaggucgccgagcaccgcccccagaccaugaagcgccucuccuaccccuucucccgcgagaagcagcaccucuucgaccucuccgacaaggacuccuucuucgacuccaagacccgcuccaccaucgucuacgagauccucaagcgcaccaccugcaccaaggccaaguacuccaugggcaucaccucccuccucgccaacggcgucuacgccgccgccuacccccuccacgacggcgacuacaacggcgagaacgucgaguucaacgaccgcaagcuccucuacgaggagugggcccgcuacggcgucuucuacaaguaccagcccaucgaccucguccgcaaguacuucggcgagaagaucggccucuacuucgccuggcucggcgucuacacccagaugcucauccccgccuccaucgucggcaucaucgucuuccucuacggcugcgccaccauggacgagaacauccccuccauggagaugugcgaccagcgccacaacaucaccaugugcccccucugcgacaagaccugcuccuacuggaagauguccuccgccugcgccaccgcccgcgccucccaccucuucgacaaccccgccaccgucuucuucuccgucuucauggcccucugggccgccaccuucauggagcacuggaagcgcaagcagaugcgccucaacuaccgcugggaccucaccggcuucgaggaggaggaggaggccgucaaggaccacccccgcgccgaguacgaggcccgcguccucgagaagucccucaagaaggagucccgcaacaaggagaagcgccgccacauccccgaggaguccaccaacaaguggaagcagcgcgucaagaccgccauggccggcgucaagcucaccgacaaggucaagcucaccuggcgcgaccgcuuccccgccuaccucaccaaccucgucuccaucaucuucaugaucgccgucaccuucgccaucguccucggcgucaucaucuaccgcaucuccauggccgccgcccucgccaugaacuccucccccuccguccgcuccaacauccgcgucaccgucaccgccaccgccgucaucaucaaccucgucgucaucauccuccucgacgaggucuacggcugcaucgcccgcuggcucaccaagaucgagguccccaagaccgagaaguccuucgaggagcgccucaucuucaaggccuuccuccucaaguucgucaacuccuacacccccaucuucuacgucgccuucuucaagggccgcuucgucggccgccccggcgacuacgucuacaucuuccgcuccuuccgcauggaggagugcgcccccggcggcugccucauggagcucugcauccagcucuccaucaucaugcucggcaagcagcucauccagaacaaccucuucgagaucggcauccccaagaugaagaagcucauccgcuaccucaagcucaagcagcaguccccccccgaccacgaggagugcgucaagcgcaagcagcgcuacgaggucgacuacaaccucgagcccuucgccggccucacccccgaguacauggagaugaucauccaguucggcuucgucacccucuucgucgccuccuucccccucgccccccucuucgcccuccucaacaacaucaucgagauccgccucgacgccaagaaguucgucaccgagcuccgccgccccgucgccguccgcgccaaggacaucggcaucugguacaacauccuccgcggcaucggcaagcucgccgucaucaucaacgccuucgucaucuccuucaccuccgacuucaucccccgccucgucuaccucuacauguacuccaagaacggcaccaugcacggcuucgucaaccacacccucuccuccuucaacgucuccgacuuccagaacggcaccgcccccaacgacccccucgaccucggcuacgagguccagaucugccgcuacaaggacuaccgcgagccccccugguccgagaacaaguacgacaucuccaaggacuucugggccguccucgccgcccgccucgccuucgucaucgucuuccagaaccucgucauguucauguccgacuucgucgacugggucauccccgacauccccaaggacaucucccagcagauccacaaggagaagguccucauggucgagcucuucaugcgcgaggagcaggacaagcagcagcuccucgagaccuggauggagaaggagcgccagaaggacgagccccccugcaaccaccacaacaccaaggccugccccgacucccucggcucccccgcccccucccacgccuaccacggcggcguccucuga

SEQ ID NO: 39733 - RNA, 3012 nt, Artificial Sequence
  derived and/or modified sequence opt2 from ANO2__Homo_sapiens__NP_001265525
auggccacccccggcccccgcgacaucccccuccuccccggcuccccccgccgccucuccccccaggccggcucccgcggcggccagggccccaagcacggccagcagugccucaagaugcccggcccccgcgcccccggccuccagggcggcuccaaccgcgaccccggccagcccugcggcggcgaguccacccgcuccuccuccgucaucaacaacuaccucgacgccaacgagcccgucucccucgaggcccgccucucccgcaugcacuuccacgacucccagcgcaaggucgacuacguccucgccuaccacuaccgcaagcgcggcguccaccucgcccagggcuuccccggccacucccucgccaucgucuccaacggcgagaccggcaaggagccccacgccggcggccccggcgacaucgagcucggcccccucgacgcccucgaggaggagcgcaaggagcagcgcgaggaguucgagcacaaccucauggaggccggccucgagcucgagaaggaccucgagaacaagucccagggcuccaucuucguccgcauccacgcccccuggcagguccucgcccgcgaggccgaguuccucaagaucaagguccccaccaagaaggagauguacgagaucaaggccggcggcuccaucgccaagaaguucuccgccgcccuccagaagcucuccucccaccuccagccccgcguccccgagcacuccaacaacaagaugaagaaccucuccuaccccuucucccgcgagaagauguaccucuacaacauccaggagaaggacaccuucuucgacaacgccacccgcucccgcaucguccacgagauccucaagcgcaccgccugcucccgcgccaacaacaccaugggcaucaacucccucaucgccaacaacaucuacgaggccgccuacccccuccacgacggcgaguacgacucccccgaggacgacaugaacgaccgcaagcuccucuaccaggagugggcccgcuacggcgucuucuacaaguuccagcccaucgaccucauccgcaaguacuucggcgagaagaucggccucuacuucgccuggcucggccucuacaccuccuuccucauccccuccuccgucaucggcgucaucgucuuccucuacggcugcgccaccaucgaggaggacauccccucccgcgagaugugcgaccagcagaacgccuucaccaugugcccccucugcgacaaguccugcgacuacuggaaccucuccuccgccugcggcaccgcccaggccucccaccucuucgacaaccccgccaccgucuucuucuccaucuucauggcccucugggccaccauguuccucgagaacuggaagcgccuccagaugcgccucggcuacuucugggaccucaccggcaucgaggaggaggaggagcgcgcccaggagcacucccgccccgaguacgagaccaagguccgcgagaagaugcucaaggaguccaaccaguccgccguccagaagcucgagaccaacaccaccgagugcggcgacgaggacgacgaggacaagcucaccuggaaggaccgcuuccccggcuaccucaugaacuucgccuccauccucuucaugaucgcccucaccuucuccaucgucuucggcgucaucgucuaccgcaucaccaccgccgccgcccucucccucaacaaggccacccgcuccaacguccgcgucaccgucaccgccaccgccgucaucaucaaccucgucgucauccucauccucgacgagaucuacggcgccgucgccaaguggcucaccaagaucgagguccccaagaccgagcagaccuucgaggagcgccucauccucaaggccuuccuccucaaguucgucaacgccuacucccccaucuucuacgucgccuucuucaagggccgcuucgucggccgccccggcuccuacgucuacgucuucgacggcuaccgcauggaggagugcgcccccggcggcugccucauggagcucugcauccagcucuccaucaucaugcucggcaagcagcucauccagaacaacaucuucgagaucggcguccccaagcucaagaagcucuuccgcaagcucaaggacgagaccgaggccggcgagaccgacuccgcccacuccaagcaccccgagcagugggaccucgacuacucccucgagcccuacaccggccucacccccgaguacauggagaugaucauccaguucggcuucgucacccucuucgucgccuccuucccccucgcccccgucuucgcccuccucaacaacgucaucgagguccgccucgacgccaagaaguucgucaccgagcuccgccgccccgacgccguccgcaccaaggacaucggcaucugguucgacauccucuccggcaucggcaaguucuccgucaucuccaacgccuucgucaucgccaucaccuccgacuucaucccccgccucgucuaccaguacuccuacucccacaacggcacccuccacggcuucgucaaccacacccucuccuucuucaacgucucccagcucaaggagggcacccagcccgagaacucccaguucgaccaggagguccaguucugccgcuucaaggacuaccgcgagccccccugggcccccaaccccuacgaguucuccaagcaguacugguucauccucuccgcccgccucgccuucgucaucaucuuccagaaccucgucauguuccucuccguccucgucgacuggaugauccccgacauccccaccgacaucuccgaccagaucaagaaggagaagucccuccucgucgacuucuuccucaaggaggagcacgagaagcucaagcucauggacgagcccgcccuccgcucccccggcggcggcgaccgcucccgcucccgcgccgccuccuccgcccccuccggccagucccagcucggcuccaugauguccuccggcucccagcacaccaacgucuga

SEQ ID NO: 39734 - RNA, 2946 nt, Artificial Sequence
  derived and/or modified sequence opt2 from ANO3__Homo_sapiens__NP_113606
augguccaccacuccggcuccauccaguccuucaagcagcagaagggcaugaacaucuccaaguccgagaucaccaaggagaccucccucaagcccucccgccgcucccuccccugccucgcccaguccuacgccuacuccaagucccucucccaguccaccucccucuuccaguccaccgaguccgagucccaggcccccaccuccaucacccucaucuccaccgacaaggccgagcaggucaacaccgaggagaacaagaacgacuccguccuccgcugcuccuucgccgaccucuccgacuucugccucgcccucggcaaggacaaggacuacaccgacgaguccgagcacgccaccuacgaccgcucccgccucaucaacgacuucgucaucaaggacaaguccgaguucaagaccaagcucuccaagaacgacaugaacuacaucgccuccuccggcccccucuucaaggacggcaagaagcgcaucgacuacauccucgucuaccgcaagaccaacauccaguacgacaagcgcaacaccuucgagaagaaccuccgcgccgagggccucaugcucgagaaggagcccgccaucgccucccccgacaucauguucaucaagauccacauccccugggacacccucugcaaguacgccgagcgccucaacauccgcaugcccuuccgcaagaagugcuacuacaccgacggccgcuccaaguccaugggccgcaugcagaccuacuuccgccgcaucaagaacuggauggcccagaaccccaugguccucgacaaguccgccuuccccgaccucgaggaguccgacugcuacaccggccccuucucccgcgcccgcauccaccacuucaucaucaacaacaaggacaccuucuucuccaacgccacccgcucccgcaucgucuaccacaugcucgagcgcaccaaguacgagaacggcaucuccaaggucggcauccgcaagcucaucaacaacggcuccuacaucgccgccuuccccccccacgagggcgccuacaaguccucccagcccaucaagacccacggcccccagaacaaccgccaccuccucuacgagcgcugggcccgcuggggcaugugguacaagcaccagccccucgaccucauccgccucuacuucggcgagaagaucggccucuacuucgccuggcucggcugguacaccggcaugcucauccccgccgccaucgucggccucugcgucuucuucuacggccucuucaccaugaacaacucccaggucucccaggagaucugcaaggccaccgaggucuucaugugcccccucugcgacaagaacugcucccuccagcgccucaacgacuccugcaucuacgccaaggucaccuaccucuucgacaacggcggcaccgucuucuucgccaucuucauggccaucugggccaccgucuuccucgaguucuggaagcgccgccgcuccauccucaccuacaccugggaccucaucgagugggaggaggaggaggagacccuccgcccccaguucgaggccaaguacuacaagauggagaucgucaaccccaucaccggcaagcccgagccccaccagcccuccuccgacaaggucacccgccuccucgucuccgucuccggcaucuucuucaugaucucccucgucaucaccgccgucuucggcgucgucgucuaccgccucgucgucauggagcaguucgccuccuucaaguggaacuucaucaagcaguacuggcaguucgccaccuccgccgccgccgucugcaucaacuucaucaucaucaugcuccucaaccucgccuacgagaagaucgccuaccuccucaccaaccucgaguacccccgcaccgaguccgagugggagaacuccuucgcccucaagauguuccucuuccaguucgucaaccucaacuccuccaucuucuacaucgccuucuuccucggccgcuucgucggccaccccggcaaguacaacaagcucuucgaccgcuggcgccucgaggagugccaccccuccggcugccucaucgaccucugccuccagaugggcgucaucauguuccucaagcagaucuggaacaacuucauggagcucggcuacccccucauccagaacugguggucccgccacaagaucaagcgcggcauccacgacgccuccaucccccagugggagaacgacuggaaccuccagcccaugaaccuccacggccucauggacgaguaccucgagaugguccuccaguucggcuucaccaccaucuucgucgccgccuucccccucgccccccuccucgcccuccucaacaacaucaucgagauccgccucgacgccuacaaguucgucacccaguggcgccgcccccuccccgcccgcgccaccgacaucggcaucuggcucggcauccucgagggcaucggcauccucgccgucaucaccaacgccuucgucaucgccaucaccuccgacuacaucccccgcuucgucuacgaguacaaguacggccccugcgccaaccacgucgagcccuccgagaacugccucaagggcuacgucaacaacucccucuccuucuucgaccucuccgagcucggcaugggcaaguccggcuacugccgcuaccgcgacuaccgcggcccccccugguccuccaagcccuacgaguucacccuccaguacuggcacauccucgccgcccgccucgccuucaucaucgucuucgagcaccucgucuucggcaucaaguccuucaucgccuaccucauccccgacguccccaagggccuccacgaccgcauccgccgcgagaaguaccucguccaggagaugauguacgaggccgagcucgagcaccuccagcagcagcgccgcaaguccggccagcccguccaccacgaguggcccuga

SEQ ID NO: 39735 - RNA, 2868 nt, Artificial Sequence
  derived and/or modified sequence opt2 from ANO4__Homo_sapiens__NP_001273545
auggaggccuccuccuccggcaucaccaacggcaagaccaaggucuuccaccccgagggcggcgucgaccuccagggcuaccagcucgacaugcagauccuccccgacggccccaaguccgacgucgacuucuccgagauccucaacgccauccaggagauggccaaggacgucaacauccucuucgacgagcucgaggccgucuccucccccugcaaggacgacgacucccuccuccaccccggcaaccucaccuccaccuccgacgacgccucccgccucgaggccggcggcgagaccguccccgagcgcaacaaguccaacggccucuacuuccgcgacggcaagugccgcaucgacuacauccucgucuaccgcaaguccaacccccagaccgagaagcgcgaggucuucgagcgcaacauccgcgccgagggccuccagauggagaaggaguccucccucaucaacuccgacaucaucuucgucaagcuccacgcccccugggagguccucggccgcuacgccgagcagaugaacguccgcaugcccuuccgccgcaagaucuacuaccucccccgccgcuacaaguucaugucccgcaucgacaagcagaucucccgcuuccgccgcuggcuccccaagaagcccaugcgccucgacaaggagacccuccccgaccucgaggagaacgacugcuacaccgcccccuucucccagcagcgcauccaccacuucaucauccacaacaaggagaccuucuucaacaacgccacccgcucccgcaucguccaccacauccuccagcgcaucaaguacgaggagggcaagaacaagaucggccucaaccgccuccucaccaacggcuccuacgaggccgccuucccccuccacgagggcuccuaccgcuccaagaacuccauccgcacccacggcgccgagaaccaccgccaccuccucuacgagugcugggccuccuggggcgucugguacaaguaccagccccucgaccucguccgccgcuacuucggcgagaagaucggccucuacuucgccuggcucggcugguacaccggcaugcucuuccccgccgccuucaucggccucuucgucuuccucuacggcgucaccacccucgaccacucccaggucuccaaggaggucugccaggccaccgacaucaucaugugccccgucugcgacaaguacugccccuucaugcgccucuccgacuccugcgucuacgccaaggucacccaccucuucgacaacggcgccaccgucuucuucgccgucuucauggccgucugggccaccgucuuccucgaguucuggaagcgccgccgcgccgucaucgccuacgacugggaccucaucgacugggaggaggaggaggaggagauccgcccccaguucgaggccaaguacuccaagaaggagcgcaugaaccccaucuccggcaagcccgagcccuaccaggccuucaccgacaagugcucccgccucaucgucuccgccuccggcaucuucuucaugaucugcgucgucaucgccgccgucuucggcaucgucaucuaccgcgucgucaccgucuccaccuucgccgccuucaagugggcccucauccgcaacaacucccaggucgccaccaccggcaccgccgucugcaucaacuucugcaucaucaugcuccucaacguccucuacgagaaggucgcccuccuccucaccaaccucgagcagccccgcaccgaguccgagugggagaacuccuucacccucaagauguuccucuuccaguucgucaaccucaacuccuccaccuucuacaucgccuucuuccucggccgcuucaccggccaccccggcgccuaccuccgccucaucaaccgcuggcgccucgaggagugccaccccuccggcugccucaucgaccucugcaugcagaugggcaucaucaugguccucaagcagaccuggaacaacuucauggagcucggcuacccccucauccagaacugguggacccgccgcaagguccgccaggagcacggccccgagcgcaagaucuccuucccccagugggagaaggacuacaaccuccagcccaugaacgccuacggccucuucgacgaguaccucgagaugauccuccaguucggcuucaccaccaucuucgucgccgccuucccccucgccccccuccucgcccuccucaacaacaucaucgagauccgccucgacgccuacaaguucgucacccaguggcgccgcccccucgccucccgcgccaaggacaucggcaucugguacggcauccucgagggcaucggcauccucuccgucaucaccaacgccuucgucaucgccaucaccuccgacuucaucccccgccucgucuacgccuacaaguacggccccugcgccggccagggcgaggccggccagaagugcauggucggcuacgucaacgccucccucuccgucuuccgcaucuccgacuucgagaaccgcuccgagcccgaguccgacggcuccgaguucuccggcaccccccucaaguacugccgcuaccgcgacuaccgcgaccccccccacucccucguccccuacggcuacacccuccaguucuggcacguccucgccgcccgccucgccuucaucaucgucuucgagcaccucgucuucugcaucaagcaccucaucuccuaccucauccccgaccuccccaaggaccuccgcgaccgcaugcgccgcgagaaguaccucauccaggagaugauguacgaggccgagcucgagcgccuccagaaggagcgcaaggagcgcaagaagaacggcaaggcccaccacaacgaguggcccuga

SEQ ID NO: 39736 - RNA, 2742 nt, Artificial Sequence
  derived and/or modified sequence opt2 from ANO5__Homo_sapiens__NP_998764
augggcgaccccgaccuccucgagguccucgccgaggagggcgagaaggucaacaagcacaucgacuacuccuuccagauguccgagcagucccucuccucccgcgagaccuccuuccucaucaacgaggagaccaugcccgccaagcgcuucaaccucuuccuccgccgccgccucauguuccagaagaaccagcaguccaaggacuccaucuucuuccgcgacggcauccgccagaucgacuucguccucuccuacgucgacgacgucaagaaggacgccgagcucaaggccgagcgccgcaaggaguucgagaccaaccuccgcaagaccggccucgagcucgagaucgaggacaagcgcgacuccgaggacggccgcaccuacuucgucaagauccacgcccccugggagguccucgucaccuacgccgagguccucggcaucaagaugcccaucaaggaguccgacaucccccgccccaagcacacccccaucuccuacguccucggccccguccgccucccccucuccgucaaguacccccaccccgaguacuucaccgcccaguucucccgccaccgccaggagcucuuccucaucgaggaccaggccaccuucuuccccuccuccucccgcaaccgcaucgucuacuacauccucucccgcugccccuucggcaucgaggacggcaagaagcgcuucggcaucgagcgccuccucaacuccaacaccuacuccuccgccuacccccuccacgacggccaguacuggaagcccuccgagccccccaaccccaccaacgagcgcuacacccuccaccagaacugggcccgcuucuccuacuucuacaaggagcagccccucgaccucaucaagaacuacuacggcgagaagaucggcaucuacuucgucuuccucggcuucuacaccgagaugcucuucuucgccgccgucgucggccucgccugcuucaucuacggccuccucuccauggagcacaacaccuccuccaccgagaucugcgaccccgagaucggcggccagaugaucaugugcccccucugcgaccaggucugcgacuacuggcgccucaacuccaccugccucgccuccaaguucucccaccucuucgacaacgaguccaccgucuucuucgccaucuucaugggcaucugggucacccucuuccucgaguucuggaagcagcgccaggcccgccucgaguacgagugggaccucgucgacuucgaggaggagcagcagcagcuccagcuccgccccgaguucgaggccaugugcaagcaccgcaagcucaacgccgucaccaaggagauggagcccuacaugccccucuacacccgcauccccugguacuuccucuccggcgccaccgucacccucuggaugucccucgucgucaccuccauggucgccgucaucgucuaccgccucuccgucuucgccaccuucgccuccuucauggaguccgacgccucccucaagcaggucaaguccuuccucaccccccagaucaccaccucccucaccggcuccugccucaacuucaucgucauccucauccucaacuucuucuacgagaagaucuccgccuggaucaccaagauggagaucccccgcaccuaccaggaguacgaguccucccucacccucaagauguuccucuuccaguucgucaacuucuacuccuccugcuucuacgucgccuucuucaagggcaaguucgucggcuaccccggcaaguacaccuaccucuucaacgaguggcgcuccgaggagugcgaccccggcggcugccucaucgagcucaccacccagcucaccaucaucaugaccggcaagcagaucuucggcaacaucaaggaggccaucuacccccucgcccucaacugguggcgccgccgcaaggcccgcaccaacuccgagaagcucuacucccgcugggagcaggaccacgaccucgaguccuucggcccccucggccucuucuacgaguaccucgagaccgucacccaguucggcuucgucacccucuucgucgccuccuucccccucgccccccuccucgcccucaucaacaacaucgucgagauccgcgucgacgccuggaagcucaccacccaguaccgccgcaccgucgccuccaaggcccacuccaucggcgucuggcaggacauccucuacggcauggccguccucuccgucgccaccaacgccuucaucgucgccuucaccuccgacaucaucccccgccucgucuacuacuacgccuacuccaccaacgccacccagcccaugaccggcuacgucaacaacucccucuccgucuuccucaucgccgacuuccccaaccacaccgcccccuccgagaagcgcgacuucaucaccugccgcuaccgcgacuaccgcuacccccccgacgacgagaacaaguacuuccacaacaugcaguucuggcacguccucgccgccaagaugaccuucaucaucgucauggagcacgucgucuuccucgucaaguuccuccucgccuggaugauccccgacguccccaaggacgucgucgagcgcaucaagcgcgagaagcucaugaccaucaagauccuccacgacuucgagcucaacaagcucaaggagaaccucggcaucaacuccaacgaguucgccaagcacgucaugaucgaggagaacaaggcccagcucgccaaguccacccucuga

SEQ ID NO: 39737 - RNA, 2733 nt, Artificial Sequence
  derived and/or modified sequence opt2 from ANO6__Homo_sapiens__NP_001020527
augaagaagaugucccgcaacguccuccuccagauggaggaggaggaggacgacgacgacggcgacaucguccucgagaaccucggccagaccaucguccccgaccucggcucccucgagucccagcacgacuuccgcacccccgaguucgaggaguucaacggcaagcccgacucccucuucuucaacgacggccagcgccgcaucgacuucguccucgucuacgaggacgagucccgcaaggagaccaacaagaagggcaccaacgagaagcagcgccgcaagcgccaggccuacgaguccaaccucaucugccacggccuccagcucgaggccacccgcuccguccucgacgacaagcucgucuucgucaagguccacgcccccugggagguccucugcaccuacgccgagaucaugcacaucaagcucccccucaagcccaacgaccucaagaaccgcuccuccgccuucggcacccucaacugguucaccaagguccucuccgucgacgaguccaucaucaagcccgagcaggaguucuucaccgcccccuucgagaagaaccgcaugaacgacuucuacaucgucgaccgcgacgccuucuucaaccccgccacccgcucccgcaucgucuacuucauccucucccgcgucaaguaccaggucaucaacaacgucuccaaguucggcaucaaccgccucgucaacuccggcaucuacaaggccgccuucccccuccacgacugcaaguuccgccgccaguccgaggaccccuccugccccaacgagcgcuaccuccucuaccgcgagugggcccacccccgcuccaucuacaagaagcagccccucgaccucauccgcaaguacuacggcgagaagaucggcaucuacuucgccuggcucggcuacuacacccagaugcuccuccucgccgccgucgucggcgucgccugcuuccucuacggcuaccucaaccaggacaacugcaccugguccaaggaggucugccaccccgacaucggcggcaagaucaucaugugcccccagugcgaccgccucugccccuucuggaagcucaacaucaccugcgaguccuccaagaagcucugcaucuucgacuccuucggcacccucgucuucgccgucuucaugggcgucugggucacccucuuccucgaguucuggaagcgccgccaggccgagcucgaguacgagugggacaccgucgagcuccagcaggaggagcaggcccgccccgaguacgaggcccgcugcacccacgucgucaucaacgagaucacccaggaggaggagcgcauccccuucaccgccuggggcaagugcauccgcaucacccucugcgccuccgccgucuucuucuggauccuccucaucaucgccuccgucaucggcaucaucgucuaccgccucuccgucuucaucgucuucuccgccaagcuccccaagaacaucaacggcaccgaccccauccagaaguaccucaccccccagaccgccaccuccaucaccgccuccaucaucuccuucaucaucaucaugauccucaacaccaucuacgagaaggucgccaucaugaucaccaacuucgagcucccccgcacccagaccgacuacgagaacucccucaccaugaagauguuccucuuccaguucgucaacuacuacuccuccugcuucuacaucgccuucuucaagggcaaguucgucggcuaccccggcgaccccgucuacuggcucggcaaguaccgcaacgaggagugcgaccccggcggcugccuccucgagcucaccacccagcucaccaucaucaugggcggcaaggccaucuggaacaacauccaggagguccuccuccccuggaucaugaaccucaucggccgcuuccaccgcgucuccggcuccgagaagaucaccccccgcugggagcaggacuaccaccuccagcccaugggcaagcucggccucuucuacgaguaccucgagaugaucauccaguucggcuucgucacccucuucgucgccuccuucccccucgccccccuccucgcccucgucaacaacauccucgagauccgcgucgacgccuggaagcucaccacccaguuccgccgccucguccccgagaaggcccaggacaucggcgccuggcagcccaucaugcagggcaucgccauccucgccgucgucaccaacgccaugaucaucgccuucaccuccgacaugaucccccgccucgucuacuacugguccuucuccgucccccccuacggcgaccacaccuccuacaccauggagggcuacaucaacaacacccucuccaucuucaaggucgccgacuucaagaacaaguccaagggcaaccccuacuccgaccucggcaaccacaccaccugccgcuaccgcgacuuccgcuacccccccggccacccccaggaguacaagcacaacaucuacuacuggcacgucaucgccgccaagcucgccuucaucaucgucauggagcacgucaucuacuccgucaaguucuucaucuccuacgccauccccgacgucuccaagcgcaccaaguccaagauccagcgcgagaaguaccucacccagaagcuccuccacgagaaccaccucaaggacaugaccaagaacaugggcgucaucgccgagcgcaugaucgaggccgucgacaacaaccuccgccccaaguccgaguga

SEQ ID NO: 39738 - RNA, 540 nt, Artificial Sequence
  derived and/or modified sequence opt2 from ANO7__Homo_sapiens__NP_001001666
augcgcauggccgccaccgccugggccggccuccagggccccccccuccccacccucugccccgccguccgcaccggccucuacugccgcgaccaggcccacgccgagcgcugggccaugaccuccgagaccuccuccggcucccacugcgcccgcucccgcaugcuccgccgccgcgcccaggaggaggacuccaccguccucaucgacgucuccccccccgaggccgagaagcgcggcuccuacggcuccaccgcccacgccuccgagcccggcggccagcaggccgccgccugccgcgccggcucccccgccaagccccgcaucgacuucguccucgucugggaggaggaccucaagcucgaccgccagcaggacuccgccgcccgcgaccgcaccgacaugcaccgcaccuggcgcgagaccuuccucgacaaccuccgcgccgccggccucugcgucgaccagguccgcggcggcugccacggccagggcccccgccccugcauccacuccgucacccacgaccucgccgccuga

SEQ ID NO: 39739 - RNA, 750 nt, Artificial Sequence
  derived and/or modified sequence opt2 from ANP32A__Homo_sapiens__NP_006296
auggagaugggccgccgcauccaccucgagcuccgcaaccgcacccccuccgacgucaaggagcucguccucgacaacucccgcuccaacgagggcaagcucgagggccucaccgacgaguucgaggagcucgaguuccucuccaccaucaacgucggccucaccuccaucgccaaccuccccaagcucaacaagcucaagaagcucgagcucuccgacaaccgcgucuccggcggccucgagguccucgccgagaagugccccaaccucacccaccucaaccucuccggcaacaagaucaaggaccucuccaccaucgagccccucaagaagcucgagaaccucaagucccucgaccucuucaacugcgaggucaccaaccucaacgacuaccgcgagaacgucuucaagcuccucccccagcucaccuaccucgacggcuacgaccgcgacgacaaggaggcccccgacuccgacgccgagggcuacgucgagggccucgacgacgaggaggaggacgaggacgaggaggaguacgacgaggacgcccaggucgucgaggacgaggaggacgaggacgaggaggaggagggcgaggaggaggacgucuccggcgaggaggaggaggacgaggagggcuacaacgacggcgaggucgacgacgaggaggacgaggaggagcucggcgaggaggagcgcggccagaagcgcaagcgcgagcccgaggacgagggcgaggacgacgacuga

SEQ ID NO: 39740 - RNA, 756 nt, Artificial Sequence
  derived and/or modified sequence opt2 from ANP32B__Homo_sapiens__NP_006392
auggacaugaagcgccgcauccaccucgagcuccgcaaccgcacccccgccgccguccgcgagcucguccucgacaacugcaaguccaacgacggcaagaucgagggccucaccgccgaguucgucaaccucgaguuccucucccucaucaacgucggccucaucuccgucuccaaccuccccaagcuccccaagcucaagaagcucgagcucuccgagaaccgcaucuucggcggccucgacaugcucgccgagaagcuccccaaccucacccaccucaaccucuccggcaacaagcucaaggacaucuccacccucgagccccucaagaagcucgagugccucaagucccucgaccucuucaacugcgaggucaccaaccucaacgacuaccgcgaguccgucuucaagcuccucccccagcucaccuaccucgacggcuacgaccgcgaggaccaggaggcccccgacuccgacgccgaggucgacggcgucgacgaggaggaggaggacgaggagggcgaggacgaggaggacgaggacgacgaggacggcgaggaggaggaguucgacgaggaggacgacgaggacgaggacgucgagggcgacgaggacgacgacgaggucuccgaggaggaggaggaguucggccucgacgaggaggacgaggacgaggacgaggacgaggaggaggaggagggcggcaagggcgagaagcgcaagcgcgagaccgacgacgagggcgaggacgacuga

SEQ ID NO: 39741 - RNA, 396 nt, Artificial Sequence
  derived and/or modified sequence opt2 from ANP32D__Homo_sapiens__NP_036536
auggagaugggcaaguggauccaccucgagcuccgcaaccgcacccccuccgacgucaaggagcucuuccucgacaacucccaguccaacgagggcaagcucgagggccucaccgacgaguucgaggagcucgagcuccucaacaccaucaacaucggccucaccuccaucgccaaccuccccaagcucaacaagcucaagaagcucgagcucuccuccaaccgcgccuccgucggccucgagguccucgccgagaagugccccaaccucauccaccucaaccucuccggcaacaagaucaaggaccucuccaccaucgagccccucaagaagcucgagaaccucgagucccucgaccucuucaccugcgaggucaccaaccucaacaacuacuga

SEQ ID NO: 39742 - RNA, 2904 nt, Artificial Sequence
  derived and/or modified sequence opt2 from ANPEP__Homo_sapiens__NP_001141
auggccaagggcuucuacaucuccaagucccucggcauccucggcauccuccucggcgucgccgccgucugcaccaucaucgcccucuccgucgucuacucccaggagaagaacaagaacgccaacuccucccccgucgccuccaccacccccuccgccuccgccaccaccaaccccgccuccgccaccacccucgaccaguccaaggccuggaaccgcuaccgccuccccaacacccucaagcccgacuccuaccgcgucacccuccgccccuaccucacccccaacgaccgcggccucuacgucuucaagggcuccuccaccguccgcuucaccugcaaggaggccaccgacgucaucaucauccacuccaagaagcucaacuacacccucucccagggccaccgcgucguccuccgcggcgucggcggcucccagccccccgacaucgacaagaccgagcucgucgagcccaccgaguaccucgucguccaccucaagggcucccucgucaaggacucccaguacgagauggacuccgaguucgagggcgagcucgccgacgaccucgccggcuucuaccgcuccgaguacauggagggcaacguccgcaaggucgucgccaccacccagaugcaggccgccgacgcccgcaaguccuuccccugcuucgacgagcccgccaugaaggccgaguucaacaucacccucauccaccccaaggaccucaccgcccucuccaacaugcuccccaagggccccuccaccccccuccccgaggaccccaacuggaacgucaccgaguuccacaccacccccaagauguccaccuaccuccucgccuucaucgucuccgaguucgacuacgucgagaagcaggccuccaacggcguccucauccgcaucugggcccgccccuccgccaucgccgccggccacggcgacuacgcccucaacgucaccggccccauccucaacuucuucgccggccacuacgacacccccuacccccuccccaaguccgaccagaucggccuccccgacuucaacgccggcgccauggagaacuggggccucgucaccuaccgcgagaacucccuccucuucgacccccucuccuccuccuccuccaacaaggagcgcgucgucaccgucaucgcccacgagcucgcccaccagugguucggcaaccucgucaccaucgagugguggaacgaccucuggcucaacgagggcuucgccuccuacgucgaguaccucggcgccgacuacgccgagcccaccuggaaccucaaggaccucaugguccucaacgacgucuaccgcgucauggccgucgacgcccucgccuccucccacccccucuccacccccgccuccgagaucaacacccccgcccagaucuccgagcucuucgacgccaucuccuacuccaagggcgccuccguccuccgcaugcucuccuccuuccucuccgaggacgucuucaagcagggccucgccuccuaccuccacaccuucgccuaccagaacaccaucuaccucaaccucugggaccaccuccaggaggccgucaacaaccgcuccauccagcuccccaccaccguccgcgacaucaugaaccgcuggacccuccagaugggcuuccccgucaucaccgucgacaccuccaccggcacccucucccaggagcacuuccuccucgaccccgacuccaacgucacccgccccuccgaguucaacuacgucuggaucguccccaucaccuccauccgcgacggccgccagcagcaggacuacuggcucaucgacguccgcgcccagaacgaccucuucuccaccuccggcaacgaguggguccuccucaaccucaacgucaccggcuacuaccgcgucaacuacgacgaggagaacuggcgcaagauccagacccagcuccagcgcgaccacuccgccauccccgucaucaaccgcgcccagaucaucaacgacgccuucaaccucgccuccgcccacaagguccccgucacccucgcccucaacaacacccucuuccucaucgaggagcgccaguacaugcccugggaggccgcccucuccucccucuccuacuucaagcucauguucgaccgcuccgaggucuacggccccaugaagaacuaccucaagaagcaggucaccccccucuucauccacuuccgcaacaacaccaacaacuggcgcgagauccccgagaaccucauggaccaguacuccgaggucaacgccaucuccaccgccugcuccaacggcguccccgagugcgaggagauggucuccggccucuucaagcaguggauggagaaccccaacaacaaccccauccaccccaaccuccgcuccaccgucuacugcaacgccaucgcccagggcggcgaggaggagugggacuucgccugggagcaguuccgcaacgccacccucgucaacgaggccgacaagcuccgcgccgcccucgccugcuccaaggagcucuggauccucaaccgcuaccucuccuacacccucaaccccgaccucauccgcaagcaggacgccaccuccaccaucaucuccaucaccaacaacgucaucggccagggccucgucugggacuucguccaguccaacuggaagaagcucuucaacgacuacggcggcggcuccuucuccuucuccaaccucauccaggccgucacccgccgcuucuccaccgaguacgagcuccagcagcucgagcaguucaagaaggacaacgaggagaccggcuucggcuccggcacccgcgcccucgagcaggcccucgagaagaccaaggccaacaucaagugggucaaggagaacaaggaggucguccuccagugguucaccgagaacuccaaguga

SEQ ID NO: 39743 - RNA, 1002 nt, Artificial Sequence
  derived and/or modified sequence opt2 from ANTXR1__Homo_sapiens__NP_060623
auggccaccgccgagcgccgcgcccucggcaucggcuuccaguggcucucccucgccacccucguccucaucugcgccggccagggcggccgccgcgaggacggcggccccgccugcuacggcggcuucgaccucuacuucauccucgacaaguccggcuccguccuccaccacuggaacgagaucuacuacuucgucgagcagcucgcccacaaguucaucuccccccagcuccgcauguccuucaucgucuucuccacccgcggcaccacccucaugaagcucaccgaggaccgcgagcagauccgccagggccucgaggagcuccagaagguccuccccggcggcgacaccuacaugcacgagggcuucgagcgcgccuccgagcagaucuacuacgagaaccgccagggcuaccgcaccgccuccgucaucaucgcccucaccgacggcgagcuccacgaggaccucuucuucuacuccgagcgcgaggccaaccgcucccgcgaccucggcgccaucgucuacugcgucggcgucaaggacuucaacgagacccagcucgcccgcaucgccgacuccaaggaccacgucuuccccgucaacgacggcuuccaggcccuccagggcaucauccacuccauccucaagaaguccugcaucgagauccucgccgccgagcccuccaccaucugcgccggcgaguccuuccaggucgucguccgcggcaacggcuuccgccacgcccgcaacgucgaccgcguccucugcuccuucaagaucaacgacuccgucacccucaacgagaagcccuucuccgucgaggacaccuaccuccucugccccgcccccauccucaaggaggucggcaugaaggccgcccuccaggucuccaugaacgacggccucuccuucaucuccuccuccgucaucaucaccaccacccacugcucccuccacaagaucgccuccggccccaccaccgccgccugcauggaguga

SEQ ID NO: 39744 - RNA, 1470 nt, Artificial Sequence
  derived and/or modified sequence opt2 from ANTXR2__Homo_sapiens__NP_001139266
auggucgccgagcgcucccccgcccgcucccccggcuccuggcucuuccccggccucuggcuccucguccucuccggccccggcggccuccuccgcgcccaggagcagcccuccugccgccgcgccuucgaccucuacuucguccucgacaaguccggcuccgucgccaacaacuggaucgagaucuacaacuucguccagcagcucgccgagcgcuucgucucccccgagaugcgccucuccuucaucgucuucuccucccaggccaccaucauccucccccucaccggcgaccgcggcaagaucuccaagggccucgaggaccucaagcgcgucucccccgucggcgagaccuacauccacgagggccucaagcucgccaacgagcagauccagaaggccggcggccucaagaccuccuccaucaucaucgcccucaccgacggcaagcucgacggccucguccccuccuacgccgagaaggaggccaagaucucccgcucccucggcgccuccgucuacugcgucggcguccucgacuucgagcaggcccagcucgagcgcaucgccgacuccaaggagcaggucuuccccgucaagggcggcuuccaggcccucaagggcaucaucaacuccauccucgcccaguccugcaccgagauccucgagcuccagcccuccuccgucugcgucggcgaggaguuccagaucguccucuccggccgcggcuucaugcucggcucccgcaacggcuccguccucugcaccuacaccgucaacgagaccuacaccaccuccgucaagcccgucuccguccagcucaacuccaugcucugccccgcccccauccucaacaaggccggcgagacccucgacgucuccgucuccuucaacggcggcaaguccgucaucuccggcucccucaucgucaccgccaccgagugcuccaacggcaucgccgccaucaucgucauccucguccuccuccuccuccucggcaucggccucauguggugguucuggccccucugcugcaaggucgucaucaaggaccccccccccccccccgcccccgcccccaaggaggaggaggaggagccccuccccaccaagaaguggcccaccgucgacgccuccuacuacggcggccgcggcgucggcggcaucaagcgcauggagguccgcuggggcgacaagggcuccaccgaggagggcgcccgccucgagaaggccaagaacgccgucgucaagauccccgaggagaccgaggagcccauccgcccccgccccccccgccccaagcccacccaccagcccccccagaccaagugguacacccccaucaagggccgccucgacgcccucugggcccuccuccgccgccaguacgaccgcgucucccucaugcgcccccaggagggcgacgaggucugcaucugggagugcaucgagaaggagcucaccgccuga

SEQ ID NO: 39745 - RNA, 975 nt, Artificial Sequence
  derived and/or modified sequence opt2 from ANXA10__Homo_sapiens__NP_009124
auguucugcggcgacuacguccagggcaccaucuuccccgcccccaacuucaaccccaucauggacgcccagaugcucggcggcgcccuccagggcuucgacugcgacaaggacaugcucaucaacauccucacccagcgcugcaacgcccagcgcaugaugaucgccgaggccuaccaguccauguacggccgcgaccucaucggcgacaugcgcgagcagcucuccgaccacuucaaggacgucauggccggccucauguacccccccccccucuacgacgcccacgagcucuggcacgccaugaagggcgucggcaccgacgagaacugccucaucgagauccucgccucccgcaccaacggcgagaucuuccagaugcgcgaggccuacugccuccaguacuccaacaaccuccaggaggacaucuacuccgagaccuccggccacuuccgcgacacccucaugaaccucguccagggcacccgcgaggagggcuacaccgaccccgccauggccgcccaggacgccaugguccucugggaggccugccagcagaagaccggcgagcacaagaccaugcuccagaugauccucugcaacaaguccuaccagcagcuccgccucgucuuccaggaguuccagaacaucuccggccaggacauggucgacgccaucaacgagugcuacgacggcuacuuccaggagcuccucgucgccaucguccucugcguccgcgacaagcccgccuacuucgccuaccgccucuacuccgccauccacgacuucggcuuccacaacaagaccgucauccgcauccucaucgcccgcuccgagaucgaccuccucaccauccgcaagcgcuacaaggagcgcuacggcaagucccucuuccacgacauccgcaacuucgccuccggccacuacaagaaggcccuccucgccaucugcgccggcgacgccgaggacuacuga

SEQ ID NO: 39746 - RNA, 1518 nt, Artificial Sequence
  derived and/or modified sequence opt2 from ANXA11__Homo_sapiens__NP_001265336
auguccuaccccggcuacccccccccccccggcggcuacccccccgccgcccccggcggcggccccuggggcggcgccgccuacccccccccccccuccaugccccccaucggccucgacaacgucgccaccuacgccggccaguucaaccaggacuaccucuccggcauggccgccaacauguccggcaccuucggcggcgccaacaugcccaaccucuaccccggcgcccccggcgccggcuacccccccgucccccccggcggcuucggccagccccccuccgcccagcagcccgucccccccuacggcauguaccccccccccggcggcaacccccccucccgcaugcccuccuacccccccuaccccggcgcccccguccccggccagcccaugcccccccccggccagcagccccccggcgccuaccccggccagccccccgucaccuaccccggccagccccccgucccccuccccggccagcagcagcccguccccuccuaccccggcuaccccggcuccggcaccgucacccccgccgucccccccacccaguucggcucccgcggcaccaucaccgacgcccccggcuucgacccccuccgcgacgccgagguccuccgcaaggccaugaagggcuucggcaccgacgagcaggccaucaucgacugccucggcucccgcuccaacaagcagcgccagcagauccuccucuccuucaagaccgccuacggcaaggaccucaucaaggaccucaaguccgagcucuccggcaacuucgagaagaccauccucgcccucaugaagacccccguccucuucgacaucuacgagaucaaggaggccaucaagggcgucggcaccgacgaggccugccucaucgagauccucgccucccgcuccaacgagcacauccgcgagcucaaccgcgccuacaaggccgaguucaagaagacccucgaggaggccauccgcuccgacaccuccggccacuuccagcgccuccucaucucccucucccagggcaaccgcgacgaguccaccaacgucgacaugucccucgcccagcgcgacgcccaggagcucuacgccgccggcgagaaccgccucggcaccgacgaguccaaguucaacgccguccucugcucccgcucccgcgcccaccucgucgccgucuucaacgaguaccagcgcaugaccggccgcgacaucgagaaguccaucugccgcgagauguccggcgaccucgaggagggcaugcucgccgucgucaagugccucaagaacacccccgccuucuucgccgagcgccucaacaaggccaugcgcggcgccggcaccaaggaccgcacccucauccgcaucauggucucccgcuccgagaccgaccuccucgacauccgcuccgaguacaagcgcauguacggcaagucccucuaccacgacaucuccggcgacaccuccggcgacuaccgcaagauccuccucaagaucugcggcggcaacgacuga

SEQ ID NO: 39747 - RNA, 1074 nt, Artificial Sequence
  derived and/or modified sequence opt2 from ANXA13__Homo_sapiens__NP_001003954
augggcaaccgccacucccaguccuacacccucuccgagggcucccagcagcuccccaagggcgacucccagcccuccaccgucguccagccccucucccaccccucccgcaacggcgagcccgaggccccccagcccgccaaggccuccuccccccagggcuucgacgucgaccgcgacgccaagaagcucaacaaggccugcaagggcaugggcaccaacgaggccgccaucaucgagauccucuccggccgcaccuccgacgagcgccagcagaucaagcagaaguacaaggccaccuacggcaaggagcucgaggagguccucaaguccgagcucuccggcaacuucgagaagaccgcccucgcccuccucgaccgccccuccgaguacgccgcccgccagcuccagaaggccaugaagggccucggcaccgacgaguccguccucaucgagguccucugcacccgcaccaacaaggagaucaucgccaucaaggaggccuaccagcgccucuucgaccgcucccucgaguccgacgucaagggcgacaccuccggcaaccucaagaagauccucgucucccuccuccaggccaaccgcaacgagggcgacgacgucgacaaggaccucgccggccaggacgccaaggaccucuacgacgccggcgagggccgcuggggcaccgacgagcucgccuucaacgagguccucgccaagcgcuccuacaagcagcuccgcgccaccuuccaggccuaccagauccucaucggcaaggacaucgaggaggccaucgaggaggagaccuccggcgaccuccagaaggccuaccucacccucguccgcugcgcccaggacugcgaggacuacuucgccgagcgccucuacaaguccaugaagggcgccggcaccgacgaggagacccucauccgcaucgucgucacccgcgccgaggucgaccuccagggcaucaaggccaaguuccaggagaaguaccagaagucccucuccgacaugguccgcuccgacaccuccggcgacuuccgcaagcuccucgucgcccuccuccacuga

SEQ ID NO: 39748 - RNA, 1074 nt, Artificial Sequence
  derived and/or modified sequence opt2 from ANXA1__Homo_sapiens__XP_011516910
augaaccucauccuccgcuacaccuucuccaagauggccauggucuccgaguuccucaagcaggccugguucaucgagaacgaggagcaggaguacguccagaccgucaaguccuccaagggcggccccggcuccgccgucucccccuaccccaccuucaaccccuccuccgacgucgccgcccuccacaaggccaucauggucaagggcgucgacgaggccaccaucaucgacauccucaccaagcgcaacaacgcccagcgccagcagaucaaggccgccuaccuccaggagaccggcaagccccucgacgagacccucaagaaggcccucaccggccaccucgaggaggucguccucgcccuccucaagacccccgcccaguucgacgccgacgagcuccgcgccgccaugaagggccucggcaccgacgaggacacccucaucgagauccucgccucccgcaccaacaaggagauccgcgacaucaaccgcgucuaccgcgaggagcucaagcgcgaccucgccaaggacaucaccuccgacaccuccggcgacuuccgcaacgcccuccucucccucgccaagggcgaccgcuccgaggacuucggcgucaacgaggaccucgccgacuccgacgcccgcgcccucuacgaggccggcgagcgccgcaagggcaccgacgucaacgucuucaacaccauccucaccacccgcuccuacccccagcuccgccgcgucuuccagaaguacaccaaguacuccaagcacgacaugaacaagguccucgaccucgagcucaagggcgacaucgagaagugccucaccgccaucgucaagugcgccaccuccaagcccgccuucuucgccgagaagcuccaccaggccaugaagggcgucggcacccgccacaaggcccucauccgcaucauggucucccgcuccgagaucgacaugaacgacaucaaggccuucuaccagaagauguacggcaucucccucugccaggccauccucgacgagaccaagggcgacuacgagaagauccucgucgcccucugcggcggcaacuga

SEQ ID NO: 39749 - RNA, 1074 nt, Artificial Sequence
  derived and/or modified sequence opt2 from ANXA2__Homo_sapiens__NP_001002858
augggccgccagcucgccggcugcggcgacgccggcaagaaggccuccuucaagauguccaccguccacgagauccucugcaagcucucccucgagggcgaccacuccaccccccccuccgccuacggcuccgucaaggccuacaccaacuucgacgccgagcgcgacgcccucaacaucgagaccgccaucaagaccaagggcgucgacgaggucaccaucgucaacauccucaccaaccgcuccaacgcccagcgccaggacaucgccuucgccuaccagcgccgcaccaagaaggagcucgccuccgcccucaaguccgcccucuccggccaccucgagaccgucauccucggccuccucaagacccccgcccaguacgacgccuccgagcucaaggccuccaugaagggccucggcaccgacgaggacucccucaucgagaucaucugcucccgcaccaaccaggagcuccaggagaucaaccgcgucuacaaggagauguacaagaccgaccucgagaaggacaucaucuccgacaccuccggcgacuuccgcaagcucauggucgcccucgccaagggccgccgcgccgaggacggcuccgucaucgacuacgagcucaucgaccaggacgcccgcgaccucuacgacgccggcgucaagcgcaagggcaccgacguccccaaguggaucuccaucaugaccgagcgcuccgucccccaccuccagaaggucuucgaccgcuacaaguccuacucccccuacgacaugcucgaguccauccgcaaggaggucaagggcgaccucgagaacgccuuccucaaccucguccagugcauccagaacaagccccucuacuucgccgaccgccucuacgacuccaugaagggcaagggcacccgcgacaagguccucauccgcaucauggucucccgcuccgaggucgacaugcucaagauccgcuccgaguucaagcgcaaguacggcaagucccucuacuacuacauccagcaggacaccaagggcgacuaccagaaggcccuccucuaccucugcggcggcgacgacuga

SEQ ID NO: 39750 - RNA, 582 nt, Artificial Sequence
  derived and/or modified sequence opt2 from ANXA2R__Homo_sapiens__NP_001014301
auggagcagcacuuccucggcugcgucaagcgcgccugggacuccgccgaggucgcccccgagccccagcccccccccaucgucuccuccgaggaccgcggccccuggccccucccccucuaccccguccucggcgaguacucccucgacuccugcgaccucggccuccucuccucccccugcuggcgccuccccggcgucuacuggcagaacggccucucccccggcguccaguccacccucgagcccuccaccgccaagcccaccgaguucuccuggcccggcacccagaagcagcaggaggcccccgucgaggaggucggccaggccgaggagcccgaccgccuccgccuccagcagcuccccugguccuccccccuccaccccugggaccgccagcaggacaccgaggucugcgacuccggcugccuccucgagcgccgccacccccccgcccuccagcccuggcgccaccuccccggcuucuccgacugccucgaguggauccuccgcgucggcuucgccgccuucuccguccucugggccugcugcucccgcaucugcggcgccaagcagcccuga

SEQ ID NO: 39751 - RNA, 972 nt, Artificial Sequence
  derived and/or modified sequence opt2 from ANXA3__Homo_sapiens__NP_005130
auggccuccaucugggucggccaccgcggcaccguccgcgacuaccccgacuucucccccuccgucgacgccgaggccauccagaaggccauccgcggcaucggcaccgacgagaagaugcucaucuccauccucaccgagcgcuccaacgcccagcgccagcucaucgucaaggaguaccaggccgccuacggcaaggagcucaaggacgaccucaagggcgaccucuccggccacuucgagcaccucauggucgcccucgucaccccccccgccgucuucgacgccaagcagcucaagaaguccaugaagggcgccggcaccaacgaggacgcccucaucgagauccucaccacccgcaccucccgccagaugaaggacaucucccaggccuacuacaccgucuacaagaagucccucggcgacgacaucuccuccgagaccuccggcgacuuccgcaaggcccuccucacccucgccgacggccgccgcgacgagucccucaaggucgacgagcaccucgccaagcaggacgcccagauccucuacaaggccggcgagaaccgcuggggcaccgacgaggacaaguucaccgagauccucugccuccgcuccuucccccagcucaagcucaccuucgacgaguaccgcaacaucucccagaaggacaucgucgacuccaucaagggcgagcucuccggccacuucgaggaccuccuccucgccaucgucaacugcguccgcaacacccccgccuuccucgccgagcgccuccaccgcgcccucaagggcaucggcaccgacgaguucacccucaaccgcaucauggucucccgcuccgagaucgaccuccucgacauccgcaccgaguucaagaagcacuacggcuacucccucuacuccgccaucaaguccgacaccuccggcgacuacgagaucacccuccucaagaucugcggcggcgacgacuga

SEQ ID NO: 39752 - RNA, 966 nt, Artificial Sequence
  derived and/or modified sequence opt2 from ANXA4__Homo_sapiens__NP_001307627
auggccauggccaccaagggcggcaccgucaaggccgccuccggcuucaacgccauggaggacgcccagacccuccgcaaggccaugaagggccucggcaccgacgaggacgccaucaucuccguccucgccuaccgcaacaccgcccagcgccaggagauccgcaccgccuacaaguccaccaucggccgcgaccucaucgacgaccucaaguccgagcucuccggcaacuucgagcaggucaucgucggcaugaugacccccaccguccucuacgacguccaggagcuccgccgcgccaugaagggcgccggcaccgacgagggcugccucaucgagauccucgccucccgcacccccgaggagauccgccgcaucucccagaccuaccagcagcaguacggccgcucccucgaggacgacauccgcuccgacaccuccuucauguuccagcgcguccucgucucccucuccgccggcggccgcgacgagggcaacuaccucgacgacgcccucguccgccaggacgcccaggaccucuacgaggccggcgagaagaaguggggcaccgacgaggucaaguuccucaccguccucugcucccgcaaccgcaaccaccuccuccacgucuucgacgaguacaagcgcaucucccagaaggacaucgagcaguccaucaaguccgagaccuccggcuccuucgaggacgcccuccucgccaucgucaagugcaugcgcaacaaguccgccuacuucgccgagaagcucuacaaguccaugaagggccucggcaccgacgacaacacccucauccgcgucauggucucccgcgccgagaucgacaugcucgacauccgcgcccacuucaagcgccucuacggcaagucccucuacuccuucaucaagggcgacaccuccggcgacuaccgcaagguccuccucguccucugcggcggcgacgacuga

SEQ ID NO: 39753 - RNA, 963 nt, Artificial Sequence
  derived and/or modified sequence opt2 from ANXA5__Homo_sapiens__NP_001145
auggcccagguccuccgcggcaccgucaccgacuuccccggcuucgacgagcgcgccgacgccgagacccuccgcaaggccaugaagggccucggcaccgacgaggaguccauccucacccuccucaccucccgcuccaacgcccagcgccaggagaucuccgccgccuucaagacccucuucggccgcgaccuccucgacgaccucaaguccgagcucaccggcaaguucgagaagcucaucgucgcccucaugaagcccucccgccucuacgacgccuacgagcucaagcacgcccucaagggcgccggcaccaacgagaagguccucaccgagaucaucgccucccgcacccccgaggagcuccgcgccaucaagcaggucuacgaggaggaguacggcuccucccucgaggacgacgucgucggcgacaccuccggcuacuaccagcgcaugcucgucguccuccuccaggccaaccgcgaccccgacgccggcaucgacgaggcccaggucgagcaggacgcccaggcccucuuccaggccggcgagcucaaguggggcaccgacgaggagaaguucaucaccaucuucggcacccgcuccgucucccaccuccgcaaggucuucgacaaguacaugaccaucuccggcuuccagaucgaggagaccaucgaccgcgagaccuccggcaaccucgagcagcuccuccucgccgucgucaaguccauccgcuccauccccgccuaccucgccgagacccucuacuacgccaugaagggcgccggcaccgacgaccacacccucauccgcgucauggucucccgcuccgagaucgaccucuucaacauccgcaaggaguuccgcaagaacuucgccaccucccucuacuccaugaucaagggcgacaccuccggcgacuacaagaaggcccuccuccuccucugcggcgaggacgacuga

SEQ ID NO: 39754 - RNA, 2022 nt, Artificial Sequence
  derived and/or modified sequence opt2 from ANXA6__Homo_sapiens__NP_001146
auggccaagcccgcccagggcgccaaguaccgcggcuccauccacgacuuccccggcuucgaccccaaccaggacgccgaggcccucuacaccgccaugaagggcuucggcuccgacaaggaggccauccucgacaucaucaccucccgcuccaaccgccagcgccaggaggucugccaguccuacaagucccucuacggcaaggaccucaucgccgaccucaaguacgagcucaccggcaaguucgagcgccucaucgucggccucaugcgcccccccgccuacugcgacgccaaggagaucaaggacgccaucuccggcaucggcaccgacgagaagugccucaucgagauccucgccucccgcaccaacgagcagaugcaccagcucgucgccgccuacaaggacgccuacgagcgcgaccucgaggccgacaucaucggcgacaccuccggccacuuccagaagaugcucgucguccuccuccagggcacccgcgaggaggacgacgucgucuccgaggaccucguccagcaggacguccaggaccucuacgaggccggcgagcucaaguggggcaccgacgaggcccaguucaucuacauccucggcaaccgcuccaagcagcaccuccgccucgucuucgacgaguaccucaagaccaccggcaagcccaucgaggccuccauccgcggcgagcucuccggcgacuucgagaagcucaugcucgccgucgucaagugcauccgcuccacccccgaguacuucgccgagcgccucuucaaggccaugaagggccucggcacccgcgacaacacccucauccgcaucauggucucccgcuccgagcucgacaugcucgacauccgcgagaucuuccgcaccaaguacgagaagucccucuacuccaugaucaagaacgacaccuccggcgaguacaagaagacccuccucaagcucuccggcggcgacgacgacgccgccggccaguucuuccccgaggccgcccaggucgccuaccagaugugggagcucuccgccgucgcccgcgucgagcucaagggcaccguccgccccgccaacgacuucaaccccgacgccgacgccaaggcccuccgcaaggccaugaagggccucggcaccgacgaggacaccaucaucgacaucaucacccaccgcuccaacguccagcgccagcagauccgccagaccuucaagucccacuucggccgcgaccucaugaccgaccucaaguccgagaucuccggcgaccucgcccgccucauccucggccucaugaugccccccgcccacuacgacgccaagcagcucaagaaggccauggagggcgccggcaccgacgagaaggcccucaucgagauccucgccacccgcaccaacgccgagauccgcgccaucaacgaggccuacaaggaggacuaccacaagucccucgaggacgcccucuccuccgacaccuccggccacuuccgccgcauccucaucucccucgccaccggccaccgcgaggagggcggcgagaaccucgaccaggcccgcgaggacgcccaggucgccgccgagauccucgagaucgccgacacccccuccggcgacaagaccucccucgagacccgcuucaugaccauccucugcacccgcuccuacccccaccuccgccgcgucuuccaggaguucaucaagaugaccaacuacgacgucgagcacaccaucaagaaggagauguccggcgacguccgcgacgccuucgucgccaucguccaguccgucaagaacaagccccucuucuucgccgacaagcucuacaaguccaugaagggcgccggcaccgacgagaagacccucacccgcaucauggucucccgcuccgagaucgaccuccucaacauccgccgcgaguucaucgagaaguacgacaagucccuccaccaggccaucgagggcgacaccuccggcgacuuccucaaggcccuccucgcccucugcggcggcgaggacuga

SEQ ID NO: 39755 - RNA, 1401 nt, Artificial Sequence
  derived and/or modified sequence opt2 from ANXA7__Homo_sapiens__NP_001147
auguccuaccccggcuacccccccaccggcuacccccccuuccccggcuacccccccgccggccaggaguccuccuucccccccuccggccaguaccccuaccccuccggcuucccccccaugggcggcggcgccuacccccagguccccuccuccggcuaccccggcgccggcggcuaccccgcccccggcggcuaccccgcccccggcggcuaccccggcgccccccagcccggcggcgcccccuccuaccccggcgucccccccggccagggcuucggcgucccccccggcggcgccggcuucuccggcuacccccagccccccucccaguccuacggcggcggccccgcccaggucccccuccccggcggcuuccccggcggccagaugcccucccaguaccccggcggccagcccaccuaccccucccagcccgccaccgucacccaggucacccagggcaccauccgccccgccgccaacuucgacgccauccgcgacgccgagauccuccgcaaggccaugaagggcuucggcaccgacgagcaggccaucgucgacgucgucgccaaccgcuccaacgaccagcgccagaagaucaaggccgccuucaagaccuccuacggcaaggaccucaucaaggaccucaaguccgagcucuccggcaacauggaggagcucauccucgcccucuucaugccccccaccuacuacgacgccuggucccuccgcaaggccaugcagggcgccggcacccaggagcgcguccucaucgagauccucugcacccgcaccaaccaggagauccgcgagaucguccgcugcuaccaguccgaguucggccgcgaccucgagaaggacauccgcuccgacaccuccggccacuucgagcgccuccucgucuccaugugccagggcaaccgcgacgagaaccaguccaucaaccaccagauggcccaggaggacgcccagcgccucuaccaggccggcgagggccgccucggcaccgacgaguccugcuucaacaugauccucgccacccgcuccuucccccagcuccgcgccaccauggaggccuacucccgcauggccaaccgcgaccuccucuccuccgucucccgcgaguucuccggcuacgucgaguccggccucaagaccauccuccagugcgcccucaaccgccccgccuucuucgccgagcgccucuacuacgccaugaagggcgccggcaccgacgacuccacccucguccgcaucgucgucacccgcuccgagaucgaccucguccagaucaagcagauguucgcccagauguaccagaagacccucggcaccaugaucgccggcgacaccuccggcgacuaccgccgccuccuccucgccaucgucggccaguga

SEQ ID NO: 39756 - RNA, 984 nt, Artificial Sequence
  derived and/or modified sequence opt2 from ANXA8__Homo_sapiens__NP_001035173
auggccugguggaaguccuggaucgagcaggagggcgucaccgucaaguccuccucccacuucaaccccgaccccgacgccgagacccucuacaaggccaugaagggcaucggcaccaacgagcaggccaucaucgacguccucaccaagcgcuccaacacccagcgccagcagaucgccaaguccuucaaggcccaguucggcaaggaccucaccgagacccucaaguccgagcucuccggcaaguucgagcgccucaucgucgcccucauguacccccccuaccgcuacgaggccaaggagcuccacgacgccaugaagggccucggcaccaaggagggcgucaucaucgagauccucgccucccgcaccaagaaccagcuccgcgagaucaugaaggccuacgaggaggacuacggcuccucccucgaggaggacauccaggccgacaccuccggcuaccucgagcgcauccucgucugccuccuccagggcucccgcgacgacgucuccuccuucgucgaccccggccucgcccuccaggacgcccaggaccucuacgccgccggcgagaagauccgcggcaccgacgagaugaaguucaucaccauccucugcacccgcuccgccacccaccuccuccgcgucuucgaggaguacgagaagaucgccaacaaguccaucgaggacuccaucaaguccgagacccacggcucccucgaggaggccaugcucaccgucgucaagugcacccagaaccuccacuccuacuucgccgagcgccucuacuacgccaugaagggcgccggcacccgcgacggcacccucauccgcaacaucgucucccgcuccgagaucgaccucaaccucaucaagugccacuucaagaagauguacggcaagacccucuccuccaugaucauggaggacaccuccggcgacuacaagaacgcccuccucucccucgucggcuccgaccccuga

SEQ ID NO: 39757 - RNA, 984 nt, Artificial Sequence
  derived and/or modified sequence opt2 from ANXA8L1__Homo_sapiens__NP_001092315
auggccugguggaaggccuggaucgagcaggagggcgucaccgucaaguccuccucccacuucaaccccgaccccgacgccgagacccucuacaaggccaugaagggcaucggcaccaacgagcaggccaucaucgacguccucaccaagcgcuccaacacccagcgccagcagaucgccaaguccuucaaggcccaguucggcaaggaccucaccgagacccucaaguccgagcucuccggcaaguucgagcgccucaucgucgcccucauguacccccccuaccgcuacgaggccaaggagcuccacgacgccaugaagggccucggcaccaaggagggcgucaucaucgagauccucgccucccgcaccaagaaccagcuccgcgagaucaugaaggccuacgaggaggacuacggcuccucccucgaggaggacauccaggccgacaccuccggcuaccucgagcgcauccucgucugccuccuccagggcucccgcgacgacgucuccuccuucgucgaccccgcccucgcccuccaggacgcccaggaccucuacgccgccggcgagaagauccgcggcaccgacgagaugaaguucaucaccauccucugcacccgcuccgccacccaccuccuccgcgucuucgaggaguacgagaagaucgccaacaaguccaucgaggacuccaucaaguccgagacccacggcucccucgaggaggccaugcucaccgucgucaagugcacccagaaccuccacuccuacuucgccgagcgccucuacuacgccaugaagggcgccggcacccgcgacggcacccucauccgcaacaucgucucccgcuccgagaucgaccucaaccucaucaagugccacuucaagaagauguacggcaagacccucuccuccaugaucauggaggacaccuccggcgacuacaagaacgcccuccucucccucgucggcuccgaccccuga

SEQ ID NO: 39758 - RNA, 2067 nt, Artificial Sequence
  derived and/or modified sequence opt2 from AOAH__Homo_sapiens__NP_001170977
augcagucccccuggaagauccucaccgucgccccccucuuccuccuccucucccuccaguccuccgccucccccgccaacgacgaccagucccgccccucccucuccaacggccacaccugcgucggcugcguccucgucgucuccgucaucgagcagcucgcccagguccacaacuccaccguccaggccuccauggagcgccucugcuccuaccuccccgagaagcucuuccucaagaccaccugcuaccucgucaucgacaaguucggcuccgacaucaucaagcuccucuccgccgacaugaacgccgacgucgucugccacacccucgaguucugcaagcagaacaccggccagccccucugccaccucuacccccuccccaaggagaccuggaaguucacccuccagaaggcccgccagaucgucaagaagucccccauccucaaguacucccgcuccggcuccgacaucugcucccuccccguccucgccaagaucugccagaagaucaagcucgccauggagcaguccguccccuucaaggacgucgacuccgacaaguacuccgucuuccccacccuccgcggcuaccacuggcgcggccgcgacugcaacgacuccgacgaguccgucuaccccggccgccgccccaacaacugggacguccaccaggacuccaacugcaacggcaucuggggcgucgaccccaaggacggcguccccuacgagaagaaguucugcgagggcucccagccccgcggcaucauccuccucggcgacuccgccggcgcccacuuccacaucucccccgaguggaucaccgccucccagaugucccucaacuccuucaucaaccuccccaccgcccucaccaacgagcucgacuggccccagcucuccggcgccaccggcuuccucgacuccaccgucggcaucaaggagaaguccaucuaccuccgccucuggaagcgcaaccacugcaaccaccgcgacuaccagaacaucucccgcaacggcgccuccucccgcaaccucaagaaguucaucgagucccucucccgcaacaagguccucgacuaccccgccaucgucaucuacgccaugaucggcaacgacgucugcuccggcaaguccgaccccguccccgccaugaccacccccgagaagcucuacuccaacgucaugcagacccucaagcaccucaacucccaccuccccaacggcucccacgucauccucuacggccuccccgacggcaccuuccucugggacaaccuccacaaccgcuaccacccccucggccagcucaacaaggacaugaccuacgcccagcucuacuccuuccucaacugccuccaggucucccccugccacggcuggauguccuccaacaagacccuccgcacccucaccuccgagcgcgccgagcagcucuccaacacccucaagaagaucgccgccuccgagaaguucaccaacuucaaccucuucuacauggacuucgccuuccacgagaucauccaggaguggcagaagcgcggcggccagcccuggcagcucaucgagcccgucgacggcuuccaccccaacgagcgcaaguccauccuccucaagggcauccucaugaccucccagacccucgacaaccaggaguggacccagcucaccuccuggaucaagggcaaccucaccugcgacucccgcacccgcgaguggcucugcugcugcuggcgcaucaucuccggcaagcgcugcuccuccuccggccccaaguccugggagcgccgcauccgcuccaccccccgccucaaccgcugccucgagaccaaggccggcaccgagccccuccgcuccaugcaccccuggggcgcccagggcggccgcggccucggcaagcucaucccccagacccucuggggccucccccgccaccgccccaagggccucuucuucuccuccaucuucgccaagugccucucccucaacgaggagcacaucuggaccaccguccagugcugcguccuccccggcuccgucacccucccccucuuccucaaguga

SEQ ID NO: 39759 - RNA, 2313 nt, Artificial Sequence
  derived and/or modified sequence opt2 from AOC1__Homo_sapiens__XP_011514310
augcccgcccucggcugggccgucgccgccauccucaugcuccagaccgccauggccgagcccucccccggcacccucccccgcaaggccggcgucuucuccgaccucuccaaccaggagcucaaggccguccacuccuuccucugguccaagaaggagcuccgccuccagcccuccuccaccaccaccauggccaagaacaccgucuuccucaucgagaugcuccuccccaagaaguaccacguccuccgcuuccucgacaagggcgagcgccaccccguccgcgaggcccgcgccgucaucuucuucggcgaccaggagcaccccaacgucaccgaguucgccgucggcccccuccccggccccugcuacaugcgcgcccucuccccccgccccggcuaccaguccuccugggccucccgccccaucuccaccgccgaguacgcccuccucuaccacacccuccaggaggccaccaagccccuccaccaguucuuccucaacaccaccggcuucuccuuccaggacugccacgaccgcugccucgccuucaccgacgucgccccccgcggcgucgccuccggccagcgccgcuccuggcucaucauccagcgcuacgucgagggcuacuuccuccaccccaccggccucgagcuccucgucgaccacggcuccaccgacgccggccacugggccgucgagcaggucugguacaacggcaaguucuacggcucccccgaggagcucgcccgcaaguacgccgacggcgaggucgacgucgucguccucgaggacccccuccccggcggcaagggccacgacuccaccgaggagcccccccucuucuccucccacaagccccgcggcgacuuccccucccccauccacgucuccggcccccgccucguccagccccacggcccccgcuuccgccucgagggcaacgccguccucuacggcggcugguccuucgccuuccgccuccgcuccuccuccggccuccagguccucaacguccacuucggcggcgagcgcaucgccuacgaggucuccguccaggaggccgucgcccucuacggcggccacacccccgccggcaugcagaccaaguaccucgacgucggcuggggccucggcuccgucacccacgagcucgcccccggcaucgacugccccgagaccgccaccuuccucgacaccuuccacuacuacgacgccgacgaccccguccacuacccccgcgcccucugccucuucgagaugcccaccggcgucccccuccgccgccacuucaacuccaacuucaagggcggcuucaacuucuacgccggccucaagggccagguccucguccuccgcaccaccuccaccgucuacaacuacgacuacaucugggacuucaucuucuaccccaacggcgucauggaggccaagaugcacgccaccggcuacguccacgccaccuucuacacccccgagggccuccgccacggcacccgccuccacacccaccucaucggcaacauccacacccaccucguccacuaccgcgucgaccucgacgucgccggcaccaagaacuccuuccagacccuccagaugaagcucgagaacaucaccaaccccugguccccccgccaccgcgucguccagcccacccucgagcagacccaguacuccugggagcgccaggccgccuuccgcuucaagcgcaagcuccccaaguaccuccucuucaccuccccccaggagaaccccuggggccacaagcgcaccuaccgccuccagauccacuccauggccgaccagguccucccccccggcuggcaggaggagcaggccaucaccugggcccgcaccgagggcggccagccccgcgcccucucccaggccgccucccccguccccggccgcuacccccucgccgucaccaaguaccgcgaguccgagcucugcuccuccuccaucuaccaccagaacgaccccuggcacccccccgucgucuucgagcaguuccuccacaacaacgagaacaucgagaacgaggaccucgucgccugggucaccgucggcuuccuccacaucccccacuccgaggacauccccaacaccgccacccccggcaacuccgucggcuuccuccuccgccccuucaacuucuuccccgaggaccccucccucgccucccgcgacaccgucaucgucuggccccgcgacaacggccccaacuacguccagcgcuggauccccgaggaccgcgacugcuccaugcccccccccuucuccuacaacggcaccuaccgccccgucuga

SEQ ID NO: 39760 - RNA, 2190 nt, Artificial Sequence
  derived and/or modified sequence opt2 from AOC2__Homo_sapiens__NP_001149
augcaccucaagaucguccucgccuuccucgcccucucccucaucaccaucuucgcccucgccuacguccuccucaccucccccggcggcuccucccagcccccccacugccccuccgucucccaccgcgcccagcccuggccccaccccggccagucccagcucuucgccgaccucucccgcgaggagcucaccgccgucaugcgcuuccucacccagcgccucggccccggccucgucgacgccgcccaggcccagcccuccgacaacugcaucuucuccgucgagcuccagcucccccccaaggccgccgcccucgcccaccucgaccgcggcucccccccccccgcccgcgaggcccucgccaucguccucuucggcggccagccccagcccaacgucuccgagcucgucgucggcccccucccccaccccuccuacaugcgcgacgucaccgucgagcgccacggcggcccccuccccuaccaccgccgccccguccuccgcgccgaguucacccagauguggcgccaccucaaggaggucgagcuccccaaggcccccaucuuccucuccuccaccuucaacuacaacggcuccacccucgccgccguccacgccaccccccgcggccuccgcuccggcgaccgcgccaccuggauggcccucuaccacaacaucuccggcgucggccucuuccuccaccccgucggccucgagcuccuccucgaccaccgcgcccucgaccccgcccacuggaccguccagcaggucuucuaccucggccacuacuacgccgaccucggccagcucgagcgcgaguucaaguccggccgccucgaggucguccgcgucccccuccccccccccaacggcgccuccucccuccgcucccgcaacucccccggcccccuccccccccuccaguucuccccccagggcucccaguacuccguccagggcaaccucgucgucuccucccucugguccuucaccuucggccacggcgucuucuccggccuccgcaucuucgacguccgcuuccagggcgagcgcaucgccuacgaggucuccguccaggagugcgucuccaucuacggcgccgacucccccaagaccaugcucacccgcuaccucgacuccuccuucggccucggccgcaacucccgcggccucguccgcggcgucgacugccccuaccaggccaccauggucgacauccacauccucgucggcaagggcgccguccagcuccuccccggcgccgucugcgucuucgaggaggcccagggccucccccuccgccgccaccacaacuaccuccagaaccacuucuacggcggccucgccuccuccgcccucgucguccgcuccgucuccuccgucggcaacuacgacuacaucugggacuucguccucuaccccaacggcgcccucgagggccgcguccacgccaccggcuacaucaacaccgccuuccucaagggcggcgaggagggccuccucuucggcaaccgcgucggcgagcgcguccucggcaccguccacacccacgccuuccacuucaagcucgaccucgacgucgccggccucaagaacugggucgucgccgaggacgucgucuucaagcccgucgccgcccccuggaaccccgagcacuggcuccagcgcccccagcucacccgccagguccucggcaaggaggaccucaccgccuucucccucggcuccccccucccccgcuaccucuaccucgccuccaaccagaccaacgccuggggccaccagcgcggcuaccagcucgucgucacccagcgcaaggaggaggagucccaguccuccuccaucuaccaccagaacgacaucuggacccccaccgucaccuucgccgacuucaucaacaacgagacccuccucggcgaggaccucgucgccugggucaccgccuccuuccuccacaucccccacgccgaggacauccccaacaccgucacccucggcaaccgcgucggcuuccuccuccgccccuacaacuucuucgacgaggaccccuccaucuucucccccggcuccgucuacuucgagaagggccaggacgccggccucugcuccaucaaccccgucgccugccuccccgaccucgccgccugcguccccgaccucccccccuucuccuaccacggcuucuga

SEQ ID NO: 39761 - RNA, 2292 nt, Artificial Sequence
  derived and/or modified sequence opt2 from AOC3__Homo_sapiens__NP_003725
augaaccagaagaccauccucguccuccucauccucgccgucaucaccaucuucgcccucgucugcguccuccucgucggccgcggcggcgacggcggcgagcccucccagcucccccacugccccuccgucucccccuccgcccagcccuggacccaccccggccagucccagcucuucgccgaccucucccgcgaggagcucaccgccgucaugcgcuuccucacccagcgccucggccccggccucgucgacgccgcccaggcccgccccuccgacaacugcgucuucuccgucgagcuccagcucccccccaaggccgccgcccucgcccaccucgaccgcggcucccccccccccgcccgcgaggcccucgccaucgucuucuucggccgccagccccagcccaacgucuccgagcucgucgucggcccccucccccaccccuccuacaugcgcgacgucaccgucgagcgccacggcggcccccuccccuaccaccgccgccccguccucuuccaggaguaccucgacaucgaccagaugaucuucaaccgcgagcucccccaggccuccggccuccuccaccacugcugcuucuacaagcaccgcggccgcaaccucgucaccaugaccaccgccccccgcggccuccaguccggcgaccgcgccaccugguucggccucuacuacaacaucuccggcgccggcuucuuccuccaccacgucggccucgagcuccucgucaaccacaaggcccucgaccccgcccgcuggaccauccagaaggucuucuaccagggccgcuacuacgacucccucgcccagcucgaggcccaguucgaggccggccucgucaacgucguccucauccccgacaacggcaccggcggcuccuggucccucaagucccccgucccccccggccccgcccccccccuccaguucuacccccagggcccccgcuucuccguccagggcucccgcgucgccuccucccucuggaccuucuccuucggccucggcgccuucuccggcccccgcaucuucgacguccgcuuccagggcgagcgccucgucuacgagaucucccuccaggaggcccucgccaucuacggcggcaacucccccgccgccaugaccacccgcuacgucgacggcggcuucggcaugggcaaguacaccaccccccucacccgcggcgucgacugccccuaccucgccaccuacgucgacuggcacuuccuccucgagucccaggcccccaagaccauccgcgacgccuucugcgucuucgagcagaaccagggccucccccuccgccgccaccacuccgaccucuacucccacuacuucggcggccucgccgagaccguccucgucguccgcuccauguccacccuccucaacuacgacuacgucugggacaccgucuuccaccccuccggcgccaucgagauccgcuucuacgccaccggcuacaucuccuccgccuuccucuucggcgccaccggcaaguacggcaaccaggucuccgagcacacccucggcaccguccacacccacuccgcccacuucaaggucgaccucgacgucgccggccucgagaacugggucugggccgaggacauggucuucguccccauggccguccccuggucccccgagcaccagcuccagcgccuccaggucacccgcaagcuccucgagauggaggagcaggccgccuuccucgucggcuccgccaccccccgcuaccucuaccucgccuccaaccacuccaacaaguggggccacccccgcggcuaccgcauccagaugcucuccuucgccggcgagccccucccccagaacuccuccauggcccgcggcuucuccugggagcgcuaccagcucgccgucacccagcgcaaggaggaggagcccuccuccuccuccgucuucaaccagaacgaccccugggcccccaccgucgacuucuccgacuucaucaacaacgagaccaucgccggcaaggaccucgucgccugggucaccgccggcuuccuccacaucccccacgccgaggacauccccaacaccgucaccgucggcaacggcgucggcuucuuccuccgccccuacaacuucuucgacgaggaccccuccuucuacuccgccgacuccaucuacuuccgcggcgaccaggacgccggcgccugcgaggucaacccccucgccugccucccccaggccgccgccugcgcccccgaccuccccgccuucucccacggcggcuucucccacaacuga

SEQ ID NO: 39762 - RNA, 4017 nt, Artificial Sequence
  derived and/or modified sequence opt2 from AOX1__Homo_sapiens__NP_001150
auggaccgcgccuccgagcuccucuucuacgucaacggccgcaaggucaucgagaagaacgucgaccccgagaccaugcuccuccccuaccuccgcaagaagcuccgccucaccggcaccaaguacggcugcggcggcggcggcugcggcgccugcaccgucaugaucucccgcuacaaccccaucaccaagcgcauccgccaccaccccgccaacgccugccucauccccaucugcucccucuacggcgccgccgucaccaccgucgagggcaucggcuccacccacacccgcauccaccccguccaggagcgcaucgccaagugccacggcacccagugcggcuucugcacccccggcauggucauguccaucuacacccuccuccgcaaccaccccgagcccacccucgaccagcucaccgacgcccucggcggcaaccucugccgcugcaccggcuaccgccccaucaucgacgccugcaagaccuucugcaagaccuccggcugcugccaguccaaggagaacggcgucugcugccucgaccagggcaucaacggccuccccgaguucgaggagggcuccaagaccucccccaagcucuucgccgaggaggaguuccucccccucgaccccacccaggagcucaucuucccccccgagcucaugaucauggccgagaagcagucccagcgcacccgcgucuucggcuccgagcgcaugaugugguucucccccgucacccucaaggagcuccucgaguucaaguucaaguacccccaggcccccgucaucaugggcaacaccuccgucggccccgaggucaaguucaagggcgucuuccaccccgucaucaucucccccgaccgcaucgaggagcucuccgucgucaaccacgccuacaacggccucacccucggcgccggccucucccucgcccaggucaaggacauccucgccgacgucguccagaagcuccccgaggagaagacccagauguaccacgcccuccucaagcaccucggcacccucgccggcucccagauccgcaacauggccucccucggcggccacaucaucucccgccaccccgacuccgaccucaaccccauccucgccgucggcaacugcacccucaaccuccucuccaaggagggcaagcgccagaucccccucaacgagcaguuccucuccaagugccccaacgccgaccucaagccccaggagauccucgucuccgucaacauccccuacucccgcaagugggaguucgucuccgccuuccgccaggcccagcgccaggagaacgcccucgccaucgucaacuccggcaugcgcgucuucuucggcgagggcgacggcaucauccgcgagcucugcaucuccuacggcggcgucggccccgccaccaucugcgccaagaacuccugccagaagcucaucggccgccacuggaacgagcagaugcucgacaucgccugccgccucauccucaacgaggucucccuccucggcuccgcccccggcggcaaggucgaguucaagcgcacccucaucaucuccuuccucuucaaguucuaccucgaggucucccagauccucaagaagauggaccccguccacuaccccucccucgccgacaaguacgaguccgcccucgaggaccuccacuccaagcaccacugcuccacccucaaguaccagaacaucggccccaagcagcaccccgaggaccccaucggccaccccaucaugcaccucuccggcgucaagcacgccaccggcgaggccaucuacugcgacgacaugccccucgucgaccaggagcucuuccucaccuucgucaccuccucccgcgcccacgccaagaucgucuccaucgaccucuccgaggcccucuccaugcccggcgucgucgacaucaugaccgccgagcaccucuccgacgucaacuccuucugcuucuucaccgaggccgagaaguuccucgccaccgacaaggucuucugcgucggccagcucgucugcgccguccucgccgacuccgagguccaggccaagcgcgccgccaagcgcgucaagaucgucuaccaggaccucgagccccucauccucaccaucgaggaguccauccagcacaacuccuccuucaagcccgagcgcaagcucgaguacggcaacgucgacgaggccuucaaggucgucgaccagauccucgagggcgagauccacaugggcggccaggagcacuucuacauggagacccaguccaugcucgucguccccaagggcgaggaccaggagauggacgucuacgucuccacccaguuccccaaguacauccaggacaucgucgccuccacccucaagcuccccgccaacaaggucaugugccacguccgccgcgucggcggcgccuucggcggcaagguccucaagaccggcaucaucgccgccgucaccgccuucgccgccaacaagcacggccgcgccguccgcugcguccucgagcgcggcgaggacaugcucaucaccggcggccgccaccccuaccucggcaaguacaaggccggcuucaugaacgacggccgcauccucgcccucgacauggagcacuacuccaacgccggcgccucccucgacgagucccucuucgucaucgagaugggccuccucaagauggacaacgccuacaaguuccccaaccuccgcugccgcggcugggccugccgcaccaaccuccccuccaacaccgccuuccgcggcuucggcuucccccaggccgcccucaucaccgaguccugcaucaccgaggucgccgccaagugcggccucucccccgagaagguccgcaucaucaacauguacaaggagaucgaccagacccccuacaagcaggagaucaacgccaagaaccucauccagugcuggcgcgagugcauggccauguccuccuacucccuccgcaaggucgccgucgagaaguucaacgccgagaacuacuggaagaagaagggccucgccauggucccccucaaguuccccgucggccucggcucccgcgccgccggccaggccgccgcccucguccacaucuaccucgacggcuccguccucgucacccacggcggcaucgagaugggccagggcguccacaccaagaugauccaggucgucucccgcgagcuccgcaugcccauguccaacguccaccuccgcggcaccuccaccgagaccguccccaacgccaacaucuccggcggcuccgucgucgccgaccucaacggccucgccgucaaggacgccugccagacccuccucaagcgccucgagcccaucaucuccaagaaccccaagggcaccuggaaggacugggcccagaccgccuucgacgaguccaucaaccucuccgccgucggcuacuuccgcggcuacgaguccgacaugaacugggagaagggcgagggccagcccuucgaguacuucgucuacggcgccgccugcuccgaggucgagaucgacugccucaccggcgaccacaagaacauccgcaccgacaucgucauggacgucggcugcuccaucaaccccgccaucgacaucggccagaucgagggcgccuucauccagggcaugggccucuacaccaucgaggagcucaacuacuccccccagggcauccuccacacccgcggccccgaccaguacaagauccccgccaucugcgacaugcccaccgagcuccacaucgcccuccucccccccucccagaacuccaacacccucuacuccuccaagggccucggcgaguccggcgucuuccucggcugcuccgucuucuucgccauccacgacgccgucuccgccgcccgccaggagcgcggccuccacggcccccucacccucaacuccccccucacccccgagaagauccgcauggccugcgaggacaaguucaccaagaugaucccccgcgacgagcccggcuccuacguccccuggaacguccccaucuga

SEQ ID NO: 39763 - RNA, 810 nt, Artificial Sequence
  derived and/or modified sequence opt2 from AP1AR__Homo_sapiens__NP_001121898
augggcaacugcugcuggacccagugcuucggccuccuccgcaaggaggccggccgccuccagcgcgucggcggcggcggcggcuccaaguacuuccgcaccugcucccgcggcgagcaccucaccaucgaguucgagaaccucgucgaguccgacgagggcgagucccccggcuccucccaccgcccccucaccgaggaggagaucgucgaccuccgcgagcgccacuacgacuccaucgccgagaagcagaaggaccucgacaagaagauccagaaggagcaggagcgccagcgcaucguccagcaguaccaccccuccaacaacggcgaguaccaguccuccggccccgaggacgacuucgaguccugccuccgcaacaugaagucccaguacgaggucuuccgcuccucccgccucuccuccgacgccaccguccucacccccaacaccgaguccuccugcgaccucaugaccaagaccaaguccaccuccggcaacgacgacuccaccucccucgaccucgagugggaggacgaggagggcaugaaccgcaugcuccccaugcgcgagcgcuccaagaccgaggaggacauccuccgcgccgcccucaaguacuccaacaagaagaccggcuccaaccccaccuccgccuccgacgacuccaacggccucgagugggagaacgacuucgucuccgccgagauggacgacaacggcaacuccgaguacuccggcuucgucaaccccguccucgagcucuccgacuccggcauccgccacuccgacaccgaccagcagacccgcuga

SEQ ID NO: 39764 - RNA, 2760 nt, Artificial Sequence
  derived and/or modified sequence opt2 from AP1B1__Homo_sapiens__NP_001159491
augaccgacuccaaguacuucaccaccaccaagaagggcgagaucuucgagcucaaggccgagcucaacuccgacaagaaggagaagaagaaggaggccgucaagaaggucaucgccuccaugaccgucggcaaggacgucuccgcccucuuccccgacgucgucaacugcaugcagaccgacaaccucgagcucaagaagcucgucuaccucuaccucaugaacuacgccaagucccagcccgacauggccaucauggccgucaacaccuucgucaaggacugcgaggaccccaacccccucauccgcgcccucgccguccgcaccaugggcugcauccgcgucgacaagaucaccgaguaccucugcgagccccuccgcaagugccucaaggacgaggaccccuacguccgcaagaccgccgccgucugcgucgccaagcuccacgacaucaacgcccagcucgucgaggaccagggcuuccucgacacccucaaggaccucaucuccgacuccaaccccauggucgucgccaacgccgucgccgcccucuccgagaucgccgagucccaccccuccuccaaccuccucgaccucaacccccaguccaucaacaagcuccucaccgcccucaacgagugcaccgaguggggccagaucuucauccucgacugccucgccaacuacaugcccaaggacgaccgcgaggcccaguccaucugcgagcgcgucaccccccgccucucccacgccaacuccgccgucguccucuccgccgucaagguccucaugaaguucauggagaugcucuccaaggaccucgacuacuacggcacccuccucaagaagcucgcccccccccucgucacccuccucuccgccgagcccgagcuccaguacgucgcccuccgcaacaucaaccucaucguccagaagcgccccgagauccucaagcacgagaugaaggucuucuucgucaaguacaacgaccccaucuacgucaagcucgagaagcucgacaucaugauccgccucgccucccaggccaacaucgcccagguccucgccgagcucaaggaguacgccaccgaggucgacgucgacuucguccgcaaggccguccgcgccaucggccgcugcgccaucaaggucgagcaguccgccgagcgcugcgucuccacccuccucgaccucauccagaccaaggucaacuacgucguccaggaggccaucgucgucaucaaggacaucuuccgcaaguaccccaacaaguacgaguccgucaucgccacccucugcgagaaccucgacucccucgacgagcccgaggcccgcgccgccaugaucuggaucgucggcgaguacgccgagcgcaucgacaacgccgacgagcuccucgaguccuuccucgagggcuuccacgacgaguccacccagguccagcuccagcuccucaccgccaucgucaagcucuuccucaagaagcccaccgagacccaggagcucguccagcagguccucucccucgccacccaggacuccgacaaccccgaccuccgcgaccgcggcuacaucuacuggcgccuccucuccaccgaccccgucgccgccaaggaggucguccucgccgagaagccccucaucuccgaggagaccgaccucaucgagcccacccuccucgacgagcucaucugcuacaucggcacccucgccuccgucuaccacaagccccccuccgccuucgucgagggcggccgcggcgucguccacaagucccuccccccccgcaccgccuccuccgaguccgccgagucccccgagaccgcccccaccggcgccccccccggcgagcagcccgacgucauccccgcccagggcgaccuccucggcgaccuccucaaccucgaccucggcccccccgucuccggccccccccucgccaccuccuccguccagaugggcgccgucgaccuccucggcggcggccucgacucccucaucggcggcaccaacuucgucgccccccccaccgccgccguccccgccaaccucggcgcccccaucggcuccggccucuccgaccucuucgaccucaccuccggcgucggcacccucuccggcuccuacgucgcccccaaggccgucggcuccaucuccauggaccuccagcucaccaacaaggcccuccaggucaugaccgacuucgccauccaguucaaccgcaacuccuucggccucgcccccgccgccccccuccagguccacgccccccucucccccaaccagaccgucgagaucucccucccccucuccaccgucggcuccgucaugaagauggagccccucaacaaccuccaggucgccgucaagaacaacaucgacgucuucuacuucuccacccucuacccccuccacauccucuucgucgaggacggcaagauggaccgccagauguuccucgccaccuggaaggacauccccaacgagaacgaggcccaguuccagauccgcgacugcccccucaacgccgaggccgccuccuccaagcuccaguccuccaacaucuucaccgucgccaagcgcaacgucgagggccaggacaugcucuaccagucccucaagcucaccaacggcaucuggguccucgccgagcuccgcauccagcccggcaaccccuccugcacccucucccucaagugccgcgcccccgaggucucccagcacgucuaccaggccuacgagaccauccucaagaacuga

SEQ ID NO: 39765 - RNA, 2478 nt, Artificial Sequence
  derived and/or modified sequence opt2 from AP1G1__Homo_sapiens__NP_001025178
augcccgcccccauccgccuccgcgagcucauccgcaccauccgcaccgcccgcacccaggccgaggagcgcgagaugauccagaaggagugcgccgccauccgcuccuccuuccgcgaggaggacaacaccuaccgcugccgcaacgucgccaagcuccucuacaugcacaugcucggcuaccccgcccacuucggccagcucgagugccucaagcucaucgccucccagaaguucaccgacaagcgcaucggcuaccucggcgccaugcuccuccucgacgagcgccaggacguccaccuccucaugaccaacugcaucaagaacgaccucaaccacuccacccaguucguccagggccucgcccucugcacccucggcugcaugggcuccuccgagaugugccgcgaccucgccggcgaggucgagaagcuccucaagaccuccaacuccuaccuccgcaagaaggccgcccucugcgccguccacgucauccgcaagguccccgagcucauggagauguuccuccccgccaccaagaaccuccucaacgagaagaaccacggcguccuccacaccuccgucguccuccucaccgagaugugcgagcgcucccccgacaugcucgcccacuuccgcaagaacgagaagcucgucccccagcucguccgcauccucaagaaccucaucauguccggcuacucccccgagcacgacgucuccggcaucuccgaccccuuccuccagguccgcauccuccgccuccuccgcauccucggccgcaacgacgacgacuccuccgaggccaugaacgacauccucgcccaggucgccaccaacaccgagaccuccaagaacgucggcaacgccauccucuacgagaccguccucaccaucauggacaucaaguccgaguccggccuccgcguccucgccaucaacauccucggccgcuuccuccucaacaacgacaagaacauccgcuacgucgcccucaccucccuccucaagaccguccagaccgaccacaacgccguccagcgccaccgcuccaccaucgucgacugccucaaggaccucgacgucuccaucaagcgccgcgccauggagcucuccuucgcccucgucaacggcaacaacauccgcggcaugaugaaggagcuccucuacuuccucgacuccugcgagcccgaguucaaggccgacugcgccuccggcaucuuccucgccgccgagaaguacgcccccuccaagcgcuggcacaucgacaccaucaugcgcguccucaccaccgccggcuccuacguccgcgacgacgccguccccaaccucauccagcucaucaccaacuccgucgagaugcacgccuacaccguccagcgccucuacaaggccauccucggcgacuacucccagcagccccucguccaggucgccgccuggugcaucggcgaguacggcgaccuccucgucuccggccagugcgaggaggaggagcccauccaggucaccgaggacgagguccucgacauccucgaguccguccucaucuccaacauguccaccuccgucacccgcggcuacgcccucaccgccaucaugaagcucuccacccgcuucaccugcaccgucaaccgcaucaagaaggucgucuccaucuacggcuccuccaucgacgucgagcuccagcagcgcgccgucgaguacaacgcccucuucaagaaguacgaccacaugcgcuccgcccuccucgagcgcaugcccgucauggagaaggucaccaccaacggccccaccgagaucguccagaccaacggcgagaccgagcccgccccccucgagaccaagcccccccccuccggcccccagcccaccucccaggccaacgaccuccucgaccuccucggcggcaacgacaucacccccgucauccccaccgcccccaccuccaagcccuccuccgccggcggcgagcuccucgaccuccucggcgacaucaaccucaccggcgcccccgccgccgcccccgcccccgccuccgucccccagaucucccagccccccuuccuccucgacggccucuccucccagccccucuucaacgacaucgccgccggcauccccuccaucaccgccuacuccaagaacggccucaagaucgaguucaccuucgagcgcuccaacaccaaccccuccgucaccgucaucaccauccaggccuccaacuccaccgagcucgacaugaccgacuucgucuuccaggccgccguccccaagaccuuccagcuccagcuccucucccccuccuccuccaucguccccgccuucaacaccggcaccaucacccaggucaucaagguccucaacccccagaagcagcagcuccgcaugcgcaucaagcucaccuacaaccacaagggcuccgccaugcaggaccucgccgaggucaacaacuuccccccccaguccuggcaguga

SEQ ID NO: 39766 - RNA, 1308 nt, Artificial Sequence
  derived and/or modified sequence opt2 from AP1M1__Homo_sapiens__NP_001123996
auguccgccuccgccgucuacguccucgaccucaagggcaagguccucaucugccgcaacuaccgcggcgacgucgacauguccgaggucgagcacuucaugcccauccucauggagaaggaggaggagggcaugcucucccccauccucgcccacggcggcguccgcuucauguggaucaagcacaacaaccucuaccucgucgccaccuccaagaagaacgccugcgucucccucgucuucuccuuccucuacaaggucguccaggucuucuccgaguacuucaaggagcucgaggaggaguccauccgcgacaacuucgucaucaucuacgagcuccucgacgagcucauggacuucggcuacccccagaccaccgacuccaagauccuccaggaguacaucacccaggagggccacaagcucgagaccggcgccccccgcccccccgccaccgucaccaacgccgucuccuggcgcuccgagggcaucaaguaccgcaagaacgaggucuuccucgacgucaucgaguccgucaaccuccucggcaaguaccccggcgucggcuggcucggccacaccgucuccgccaacggcaacguccuccgcuccgagaucgucggcuccaucaagaugcgcgucuuccucuccggcaugcccgagcuccgccucggccucaacgacaagguccucuucgacaacaccggccgcggcaaguccaaguccgucgagcucgaggacgucaaguuccaccagugcguccgccucucccgcuucgagaacgaccgcaccaucuccuucaucccccccgacggcgaguucgagcucauguccuaccgccucaacacccacgucaagccccucaucuggaucgaguccgucaucgagaagcacucccacucccgcaucgaguacaugaucaaggccaagucccaguucaagcgccgcuccaccgccaacaacgucgagauccacauccccguccccaacgacgccgacucccccaaguucaagaccaccgucggcuccgucaaguggguccccgagaacuccgagaucgucugguccaucaaguccuuccccggcggcaaggaguaccucaugcgcgcccacuucggccuccccuccgucgaggccgaggacaaggagggcaagccccccaucuccgucaaguucgagauccccuacuucaccaccuccggcauccagguccgcuaccucaagaucaucgagaaguccggcuaccaggcccuccccuggguccgcuacaucacccagaacggcgacuaccagcuccgcacccaguga

SEQ ID NO: 39767 - RNA, 1272 nt, Artificial Sequence
  derived and/or modified sequence opt2 from AP1M2__Homo_sapiens__NP_005489
auguccgccuccgccgucuucauccucgacgucaagggcaagccccucaucucccgcaacuacaagggcgacgucgccauguccaagaucgagcacuucaugccccuccucguccagcgcgaggaggagggcgcccucgccccccuccucucccacggccagguccacuuccucuggaucaagcacuccaaccucuaccucgucgccaccaccuccaagaacgccaacgccucccucgucuacuccuuccucuacaagaccaucgaggucuucugcgaguacuucaaggagcucgaggaggaguccauccgcgacaacuucgucaucgucuacgagcuccucgacgagcucauggacuucggcuucccccagaccaccgacuccaagauccuccaggaguacaucacccagcaguccaacaagcucgagaccggcaagucccgcgucccccccaccgucaccaacgccgucuccuggcgcuccgagggcaucaaguacaagaagaacgaggucuucaucgacgucaucgaguccgucaaccuccucgucaacgccaacggcuccguccuccucuccgagaucgucggcaccaucaagcucaaggucuuccucuccggcaugcccgagcuccgccucggccucaacgaccgcguccucuucgagcucaccggccgcuccaagaacaaguccgucgagcucgaggacgucaaguuccaccagugcguccgccucucccgcuucgacaacgaccgcaccaucuccuucaucccccccgacggcgacuucgagcucauguccuaccgccucuccacccaggucaagccccucaucuggaucgaguccgucaucgagaaguucucccacucccgcgucgagaucauggucaaggccaagggccaguucaagaagcaguccgucgccaacggcgucgagaucuccguccccguccccuccgacgccgacuccccccgcuucaagaccuccgucggcuccgccaaguacguccccgagcgcaacgucgucaucugguccaucaaguccuuccccggcggcaaggaguaccucaugcgcgcccacuucggccuccccuccgucgagaaggaggaggucgagggccgcccccccaucggcgucaaguucgagauccccuacuucaccgucuccggcauccagguccgcuacaugaagaucaucgagaaguccggcuaccaggcccuccccuggguccgcuacaucacccaguccggcgacuaccagcuccgcaccuccuga

SEQ ID NO: 39768 - RNA, 477 nt, Artificial Sequence
  derived and/or modified sequence opt2 from AP1S1__Homo_sapiens__NP_001274
augaugcgcuucaugcuccucuucucccgccagggcaagcuccgccuccagaagugguaccucgccaccuccgacaaggagcgcaagaagaugguccgcgagcucaugcaggucguccucgcccgcaagcccaagaugugcuccuuccucgaguggcgcgaccucaaggucgucuacaagcgcuacgccucccucuacuucugcugcgccaucgagggccaggacaacgagcucaucacccucgagcucauccaccgcuacgucgagcuccucgacaaguacuucggcuccgucugcgagcucgacaucaucuucaacuucgagaaggccuacuucauccucgacgaguuccucaugggcggcgacguccaggacaccuccaagaaguccguccucaaggccaucgagcaggccgaccuccuccaggaggaggacgaguccccccgcuccguccucgaggagaugggccucgccuga

SEQ ID NO: 39769 - RNA, 483 nt, Artificial Sequence
  derived and/or modified sequence opt2 from AP1S2__Homo_sapiens__NP_001259000
augcaguucaugcuccucuucucccgccagggcaagcuccgccuccagaagugguacgucccccucuccgacaaggagaagaagaagaucacccgcgagcucguccagaccguccucgcccgcaagcccaagaugugcuccuuccucgaguggcgcgaccucaagaucgucuacaagcgcuacgccucccucuacuucugcugcgccaucgaggaccaggacaacgagcucaucacccucgagaucauccaccgcuacgucgagcuccucgacaaguacuucggcuccgucugcgagcucgacaucaucuucaacuucgagaaggccuacuucauccucgacgaguuccuccucggcggcgagguccaggagaccuccaagaagaacguccucaaggccaucgagcaggccgaccuccuccaggaggacgccaaggaggccgagaccccccgcuccguccucgaggagaucggccucaccuga

SEQ ID NO: 39770 - RNA, 465 nt, Artificial Sequence
  derived and/or modified sequence opt2 from AP1S3__Homo_sapiens__NP_001034658
augauccacuucauccuccucuucucccgccagggcaagcuccgccuccagaagugguacaucacccuccccgacaaggagcgcaagaagaucacccgcgagaucguccagaucauccucucccgcggccaccgcaccuccuccuucgucgacuggaaggagcucaagcucgucuacaagcgcuacgccucccucuacuucugcugcgccaucgagaaccaggacaacgagcuccucacccucgagaucguccaccgcuacgucgagcuccucgacaaguacuucggcaacgucugcgagcucgacaucaucuucaacuucgagaaggccuacuucauccucgacgaguucaucaucggcggcgagauccaggagaccuccaagaagaucgccgucaaggccaucgaggacuccgacaugcuccaggagaccauggaggaguacaugaacaagcccaccuucuga

SEQ ID NO: 39771 - RNA, 2934 nt, Artificial Sequence
  derived and/or modified sequence opt2 from AP2A1__Homo_sapiens__NP_055018
augcccgccgucuccaagggcgacggcaugcgcggccucgccgucuucaucuccgacauccgcaacugcaaguccaaggaggccgagaucaagcgcaucaacaaggagcucgccaacauccgcuccaaguucaagggcgacaaggcccucgacggcuacuccaagaagaaguacgucugcaagcuccucuucaucuuccuccucggccacgacaucgacuucggccacauggaggccgucaaccuccucuccuccaacaaguacaccgagaagcagaucggcuaccucuucaucuccguccucgucaacuccaacuccgagcucauccgccucaucaacaacgccaucaagaacgaccucgccucccgcaaccccaccuucaugugccucgcccuccacugcaucgccaacgucggcucccgcgagaugggcgaggccuucgccgccgacaucccccgcauccucgucgccggcgacuccauggacuccgucaagcaguccgccgcccucugccuccuccgccucuacaaggccucccccgaccucguccccaugggcgaguggaccgcccgcgucguccaccuccucaacgaccagcacaugggcgucgucaccgccgccgucucccucaucaccugccucugcaagaagaaccccgacgacuucaagaccugcgucucccucgccgucucccgccucucccgcaucgucuccuccgccuccaccgaccuccaggacuacaccuacuacuucguccccgcccccuggcucuccgucaagcuccuccgccuccuccagugcuaccccccccccgaggacgccgccgucaagggccgccucgucgagugccucgagaccguccucaacaaggcccaggagccccccaaguccaagaagguccagcacuccaacgccaagaacgccauccucuucgagaccaucucccucaucauccacuacgacuccgagcccaaccuccucguccgcgccugcaaccagcucggccaguuccuccagcaccgcgagaccaaccuccgcuaccucgcccucgaguccaugugcacccucgccuccuccgaguucucccacgaggccgucaagacccacaucgacaccgucaucaacgcccucaagaccgagcgcgacgucuccguccgccagcgcgccgccgaccuccucuacgccaugugcgaccgcuccaacgccaagcagaucgucuccgagaugcuccgcuaccucgagaccgccgacuacgccauccgcgaggagaucguccucaaggucgccauccucgccgagaaguacgccgucgacuacuccugguacgucgacaccauccucaaccucauccgcaucgccggcgacuacgucuccgaggaggucugguaccgcguccuccagaucgucaccaaccgcgacgacguccagggcuacgccgccaagaccgucuucgaggcccuccaggcccccgccugccacgagaacauggucaaggucggcggcuacauccucggcgaguucggcaaccucaucgccggcgacccccgcuccuccccccccguccaguucucccuccuccacuccaaguuccaccucugcuccgucgccacccgcgcccuccuccucuccaccuacaucaaguucaucaaccucuuccccgagaccaaggccaccauccagggcguccuccgcgccggcucccagcuccgcaacgccgacgucgagcuccagcagcgcgccgucgaguaccucacccucuccuccgucgccuccaccgacguccucgccaccguccucgaggagaugccccccuuccccgagcgcgaguccuccauccucgccaagcucaagcgcaagaagggccccggcgccggcuccgcccucgacgacggccgccgcgaccccuccuccaacgacaucaacggcggcauggagcccacccccuccaccgucuccacccccucccccuccgccgaccuccucggccuccgcgccgcccccccccccgccgccccccccgccuccgccggcgccggcaaccuccucgucgacgucuucgacggccccgccgcccagcccucccucggccccacccccgaggaggccuuccucuccgagcucgagccccccgcccccgagucccccauggcccuccucgccgaccccgcccccgccgccgaccccggccccgaggacaucggcccccccauccccgaggccgacgagcuccucaacaaguucgucugcaagaacaacggcguccucuucgagaaccagcuccuccagaucggcgucaaguccgaguuccgccagaaccucggccgcauguaccucuucuacggcaacaagaccuccguccaguuccagaacuucucccccaccgucguccaccccggcgaccuccagacccagcucgccguccagaccaagcgcgucgccgcccaggucgacggcggcgcccagguccagcagguccucaacaucgagugccuccgcgacuuccucacccccccccuccucuccguccgcuuccgcuacggcggcgccccccaggcccucacccucaagcuccccgucaccaucaacaaguucuuccagcccaccgagauggccgcccaggacuucuuccagcgcuggaagcagcucucccucccccagcaggaggcccagaagaucuucaaggccaaccaccccauggacgccgaggucaccaaggccaagcuccucggcuucggcuccgcccuccucgacaacgucgaccccaaccccgagaacuucgucggcgccggcaucauccagaccaaggcccuccaggucggcugccuccuccgccucgagcccaacgcccaggcccagauguaccgccucacccuccgcaccuccaaggagcccgucucccgccaccucugcgagcuccucgcccagcaguucuga

SEQ ID NO: 39772 - RNA, 2856 nt, Artificial Sequence
  derived and/or modified sequence opt2 from AP2B1__Homo_sapiens__NP_001025177
augaccgacuccaaguacuucaccaccaacaagaagggcgagaucuucgagcucaaggccgagcucaacaacgagaagaaggagaagcgcaaggaggccgucaagaaggucaucgccgccaugaccgucggcaaggacgucuccucccucuuccccgacgucgucaacugcaugcagaccgacaaccucgagcucaagaagcucgucuaccucuaccucaugaacuacgccaagucccagcccgacauggccaucauggccgucaacuccuucgucaaggacugcgaggaccccaacccccucauccgcgcccucgccguccgcaccaugggcugcauccgcgucgacaagaucaccgaguaccucugcgagccccuccgcaagugccucaaggacgaggaccccuacguccgcaagaccgccgccgucugcgucgccaagcuccacgacaucaacgcccagauggucgaggaccagggcuuccucgacucccuccgcgaccucaucgccgacuccaaccccauggucgucgccaacgccgucgccgcccucuccgagaucuccgagucccaccccaacuccaaccuccucgaccucaacccccagaacaucaacaagcuccucaccgcccucaacgagugcaccgaguggggccagaucuucauccucgacugccucuccaacuacaaccccaaggacgaccgcgaggcccaguccaucugcgagcgcgucaccccccgccucucccacgccaacuccgccgucguccucuccgccgucaagguccucaugaaguuccucgagcuccuccccaaggacuccgacuacuacaacaugcuccucaagaagcucgcccccccccucgucacccuccucuccggcgagcccgagguccaguacgucgcccuccgcaacaucaaccucaucguccagaagcgccccgagauccucaagcaggagaucaaggucuucuucgucaaguacaacgaccccaucuacgucaagcucgagaagcucgacaucaugauccgccucgccucccaggccaacaucgcccagguccucgccgagcucaaggaguacgccaccgaggucgacgucgacuucguccgcaaggccguccgcgccaucggccgcugcgccaucaaggucgagcaguccgccgagcgcugcgucuccacccuccucgaccucauccagaccaaggucaacuacgucguccaggaggccaucgucgucauccgcgacaucuuccgcaaguaccccaacaaguacgaguccaucaucgccacccucugcgagaaccucgacucccucgacgagcccgacgcccgcgccgccaugaucuggaucgucggcgaguacgccgagcgcaucgacaacgccgacgagcuccucgaguccuuccucgagggcuuccacgacgaguccacccagguccagcucacccuccucaccgccaucgucaagcucuuccucaagaagcccuccgagacccaggagcucguccagcagguccucucccucgccacccaggacuccgacaaccccgaccuccgcgaccgcggcuacaucuacuggcgccuccucuccaccgaccccgucaccgccaaggaggucguccucuccgagaagccccucaucuccgaggagaccgaccucaucgagcccacccuccucgacgagcucaucugccacaucggcucccucgccuccgucuaccacaagccccccaacgccuucgucgagggcucccacggcauccaccgcaagcaccuccccauccaccacggcuccaccgacgccggcgacucccccgucggcaccaccaccgccaccaaccucgagcagccccaggucauccccucccagggcgaccuccucggcgaccuccucaaccucgaccucggcccccccgucaacgucccccaggucuccuccaugcagaugggcgccgucgaccuccucggcggcggccucgacucccuccucggcuccgaccucggcggcggcaucggcggcucccccgccgucggccaguccuucauccccuccuccguccccgccaccuucgcccccucccccacccccgccgucgucuccuccggccucaacgaccucuucgagcucuccaccggcaucggcauggcccccggcggcuacgucgcccccaaggccgucuggcuccccgccgucaaggccaagggccucgagaucuccggcaccuucacccaccgccagggccacaucuacauggagaugaacuucaccaacaaggcccuccagcacaugaccgacuucgccauccaguucaacaagaacuccuucggcgucauccccuccaccccccucgccauccacaccccccucaugcccaaccaguccaucgacgucucccucccccucaacacccucggccccgucaugaagauggagccccucaacaaccuccaggucgccgucaagaacaacaucgacgucuucuacuucuccugccucaucccccucaacguccucuucgucgaggacggcaagauggagcgccaggucuuccucgccaccuggaaggacauccccaacgagaacgagcuccaguuccagaucaaggagugccaccucaacgccgacaccgucuccuccaagcuccagaacaacaacgucuacaccaucgccaagcgcaacgucgagggccaggacaugcucuaccagucccucaagcucaccaacggcaucuggauccucgccgagcuccgcauccagcccggcaaccccaacuacacccucucccucaagugccgcgcccccgaggucucccaguacaucuaccaggucuacgacuccauccucaagaacuga

SEQ ID NO: 39773 - RNA, 1302 nt, Artificial Sequence
  derived and/or modified sequence opt2 from AP2M1__Homo_sapiens__NP_001020376
augaucggcggccucuucaucuacaaccacaagggcgagguccucaucucccgcgucuaccgcgacgacaucggccgcaacgccgucgacgccuuccgcgucaacgucauccacgcccgccagcagguccgcucccccgucaccaacaucgcccgcaccuccuucuuccacgucaagcgcuccaacaucuggcucgccgccgucaccaagcagaacgucaacgccgccauggucuucgaguuccucuacaagaugugcgacgucauggccgccuacuucggcaagaucuccgaggagaacaucaagaacaacuucguccucaucuacgagcuccucgacgagauccucgacuucggcuacccccagaacuccgagaccggcgcccucaagaccuucaucacccagcagggcaucaagucccagaccaaggaggagcagucccagaucaccucccaggucaccggccagaucggcuggcgccgcgagggcaucaaguaccgccgcaacgagcucuuccucgacguccucgaguccgucaaccuccucauguccccccagggccagguccucuccgcccacgucuccggccgcgucgucaugaaguccuaccucuccggcaugcccgagugcaaguucggcaugaacgacaagaucgucaucgagaagcagggcaagggcaccgccgacgagaccuccaaguccggcaagcaguccaucgccaucgacgacugcaccuuccaccagugcguccgccucuccaaguucgacuccgagcgcuccaucuccuucaucccccccgacggcgaguucgagcucaugcgcuaccgcaccaccaaggacaucauccuccccuuccgcgucaucccccucguccgcgaggucggccgcaccaagcucgaggucaaggucgucaucaaguccaacuucaagcccucccuccucgcccagaagaucgagguccgcauccccaccccccucaacaccuccggcguccaggucaucugcaugaagggcaaggccaaguacaaggccuccgagaacgccaucgucuggaagaucaagcgcauggccggcaugaaggagucccagaucuccgccgagaucgagcuccuccccaccaacgacaagaagaagugggcccgcccccccaucuccaugaacuucgagguccccuucgcccccuccggccucaagguccgcuaccucaaggucuucgagcccaagcucaacuacuccgaccacgacgucaucaaguggguccgcuacaucggccgcuccggcaucuacgagacccgcugcuga

SEQ ID NO: 39774 - RNA, 429 nt, Artificial Sequence
  derived and/or modified sequence opt2 from AP2S1__Homo_sapiens__NP_004060
augauccgcuucauccucauccagaaccgcgccggcaagacccgccucgccaagugguacaugcaguucgacgacgacgagaagcagaagcucaucgaggagguccacgccgucgucaccguccgcgacgccaagcacaccaacuucgucgaguuccgcaacuucaagaucaucuaccgccgcuacgccggccucuacuucugcaucugcgucgacgucaacgacaacaaccucgccuaccucgaggccauccacaacuucgucgagguccucaacgaguacuuccacaacgucugcgagcucgaccucgucuucaacuucuacaaggucuacaccgucgucgacgagauguuccucgccggcgagauccgcgagaccucccagaccaagguccucaagcagcuccucaugcuccagucccucgaguga

SEQ ID NO: 39775 - RNA, 3138 nt, Artificial Sequence
  derived and/or modified sequence opt2 from AP3B1__Homo_sapiens__NP_001258698
augcucgaguccaacaaggacuccgccaagcucgacgccaugaagcgcaucgucggcaugaucgccaagggcaagaacgccuccgagcucuuccccgccgucgucaagaacgucgccuccaagaacaucgagaucaagaagcucgucuacgucuaccucguccgcuacgccgaggagcagcaggaccucgcccuccucuccaucuccaccuuccagcgcgcccucaaggaccccaaccagcucauccgcgccuccgcccuccgcguccucuccuccauccgcguccccaucaucguccccaucaugaugcucgccaucaaggaggccuccgccgaccucucccccuacguccgcaagaacgccgcccacgccauccagaagcucuacucccucgaccccgagcagaaggagaugcucaucgaggucaucgagaagcuccucaaggacaaguccacccucgucgccggcuccgucgucauggccuucgaggaggucugccccgaccgcaucgaccucauccacaagaacuaccgcaagcucugcaaccuccucgucgacgucgaggaguggggccaggucgucaucauccacaugcucacccgcuacgcccgcacccaguucgucucccccuggaaggagggcgacgagcucgaggacaacggcaagaacuucuacgaguccgacgacgaccagaaggagaagaccgacaagaagaagaagcccuacaccauggaccccgaccaccgccuccucauccgcaacaccaagccccuccuccagucccgcaacgccgccgucgucauggccgucgcccagcucuacuggcacaucucccccaaguccgaggccggcaucaucuccaagucccucguccgccuccuccgcuccaaccgcgagguccaguacaucguccuccagaacaucgccaccauguccauccagcgcaagggcauguucgagcccuaccucaaguccuucuacguccgcuccaccgaccccaccaugaucaagacccucaagcucgagauccucaccaaccucgccaacgaggccaacaucuccacccuccuccgcgaguuccagaccuacgucaagucccaggacaagcaguucgccgccgccaccauccagaccaucggccgcugcgccaccaacauccucgaggucaccgacaccugccucaacggccucgucugccuccucuccaaccgcgacgagaucgucgucgccgaguccgucgucgucaucaagaagcuccuccagaugcagcccgcccagcacggcgagaucaucaagcacauggccaagcuccucgacuccaucaccguccccgucgcccgcgccuccauccucuggcucaucggcgagaacugcgagcgcguccccaagaucgcccccgacguccuccgcaagauggccaaguccuucaccuccgaggacgaccucgucaagcuccagauccucaaccucggcgccaagcucuaccucaccaacuccaagcagaccaagcuccucacccaguacauccucaaccucggcaaguacgaccagaacuacgacauccgcgaccgcacccgcuucauccgccagcucaucguccccaacgucaaguccggcgcccucuccaaguacgccaagaagaucuuccucgcccagaagcccgccccccuccucgagucccccuucaaggaccgcgaccacuuccagcucggcacccucucccacacccucaacaucaaggccaccggcuaccucgagcucuccaacuggcccgaggucgcccccgaccccuccguccgcaacgucgaggucaucgagcucgccaaggaguggacccccgccggcaaggccaagcaggagaacuccgccaagaaguucuacuccgaguccgaggaggaggaggacuccuccgacuccuccuccgacuccgaguccgaguccggcuccgaguccggcgagcagggcgaguccggcgaggagggcgacuccaacgaggacuccuccgaggacuccuccuccgagcaggacuccgaguccggccgcgaguccggccucgagaacaagcgcaccgccaagcgcaacuccaaggccaagggcaaguccgacuccgaggacggcgagaaggagaacgagaaguccaagaccuccgacuccuccaacgacgaguccuccuccaucgaggacuccuccuccgacuccgaguccgaguccgagcccgaguccgaguccgagucccgccgcgucaccaaggagaaggagaagaagaccaagcaggaccgcaccccccucaccaaggacgucucccuccucgaccucgacgacuucaaccccgucuccacccccgucgcccuccccacccccgcccucucccccucccucauggccgaccucgagggccuccaccucuccaccuccuccuccgucaucuccgucuccacccccgccuucguccccaccaagacccacguccuccuccaccgcauguccggcaagggccucgccgcccacuacuucuucccccgccagcccugcaucuucggcgacaagauggucuccauccagaucacccucaacaacaccaccgaccgcaagaucgagaacauccacaucggcgagaagaagcuccccaucggcaugaagaugcacgucuucaaccccaucgacucccucgagcccgagggcuccaucaccgucuccaugggcaucgacuucugcgacuccacccagaccgccuccuuccagcucugcaccaaggacgacugcuucaacgucaacauccagccccccgucggcgagcuccuccuccccgucgccauguccgagaaggacuucaagaaggagcagggcguccucaccggcaugaacgagaccuccgccgucaucaucgccgccccccagaacuucacccccuccgucaucuuccagaaggucgucaacgucgccaacgucggcgccguccccuccggccaggacaacauccaccgcuucgccgccaagaccguccacuccggcucccucaugcucgucaccgucgagcucaaggagggcuccaccgcccagcucaucaucaacaccgagaagaccgucaucggcuccguccuccuccgcgagcucaagcccguccucucccagggcuga

SEQ ID NO: 39776 - RNA, 3648 nt, Artificial Sequence
  derived and/or modified sequence opt2 from AP3D1__Homo_sapiens__NP_001248755
auggcccucaagauggucaagggcuccaucgaccgcauguucgacaagaaccuccaggaccucguccgcggcauccgcaaccacaaggaggacgaggccaaguacaucucccagugcaucgacgagaucaagcaggagcucaagcaggacaacaucgccgucaaggccaacgccgucugcaagcucaccuaccuccagaugcucggcuacgacaucuccugggccgccuucaacaucaucgaggucauguccgccuccaaguucaccuucaagcgcaucggcuaccucgccgccucccaguccuuccacgagggcaccgacgucaucaugcucaccaccaaccagauccgcaaggaccucuccucccccucccaguacgacaccggcgucgcccucaccggccucuccugcuucgucacccccgaccucgcccgcgaccucgccaacgacaucaugacccucaugucccacaccaagcccuacauccgcaagaaggccguccucaucauguacaaggucuuccucaaguaccccgagucccuccgccccgccuucccccgccucaaggagaagcucgaggaccccgaccccggcguccaguccgccgccgucaacgucaucugcgagcucgcccgccgcaaccccaagaacuaccucucccucgccccccucuucuucaagcucaugaccuccuccaccaacaacuggguccucaucaagaucaucaagcucuucggcgcccucaccccccucgagccccgccucggcaagaagcucaucgagccccucaccaaccucauccacuccaccuccgccaugucccuccucuacgagugcgucaacaccgucaucgccguccucaucucccucuccuccggcaugcccaaccacuccgccuccauccagcucugcguccagaagcuccgcauccucaucgaggacuccgaccagaaccucaaguaccucggccuccucgccauguccaagauccucaagacccaccccaaguccguccagucccacaaggaccucauccuccagugccucgacgacaaggacgaguccauccgccuccgcgcccucgaccuccucuacggcauggucuccaagaagaaccucauggagaucgucaagaagcucaugacccacgucgacaaggccgagggcaccaccuaccgcgacgagcuccucaccaagaucaucgacaucugcucccaguccaacuaccaguacaucaccaacuucgagugguacaucuccauccucgucgagcucacccgccucgagggcacccgccacggccaccucaucgccgcccagaugcucgacgucgccauccgcgucaaggccauccgcaaguucgccgucucccagauguccgcccuccucgacuccgcccaccuccucgccuccuccacccagcgcaacggcaucugcgagguccucuacgccgccgccuggaucugcggcgaguucuccgagcaccuccaggagccccaccacacccucgaggccaugcuccgcccccgcgucaccacccuccccggccacauccaggccgucuacguccagaacgucgucaagcucuacgccuccauccuccagcagaaggagcaggccggcgaggccgagggcgcccaggccgucacccagcucauggucgaccgccucccccaguucguccaguccgccgaccucgagguccaggagcgcgccuccugcauccuccagcucgucaagcacauccagaagcuccaggccaaggacguccccgucgccgaggaggucuccgcccucuucgccggcgagcucaaccccgucgcccccaaggcccagaagaagguccccguccccgagggccucgaccucgacgccuggaucaacgagccccucuccgacuccgaguccgaggacgagcgcccccgcgccgucuuccacgaggaggagcagcgccgccccaagcaccgccccuccgaggccgacgaggaggagcucgcccgccgccgcgaggcccgcaagcaggagcaggccaacaaccccuucuacaucaaguccucccccuccccccagaagcgcuaccaggacacccccggcgucgagcacauccccgucguccagaucgaccucuccgucccccucaagguccccggccuccccauguccgaccaguacgucaagcucgaggaggagcgccgccaccgccagaagcucgagaaggacaagcgccgcaagaagcgcaaggagaaggagaagaagggcaagcgccgccacuccucccuccccaccgaguccgacgaggacaucgcccccgcccagcaggucgacaucgucaccgaggagaugcccgagaacgcccuccccuccgacgaggacgacaaggaccccaacgaccccuaccgcgcccucgacaucgaccucgacaagccccucgccgacuccgagaagcuccccauccagaagcaccgcaacaccgagaccuccaagucccccgagaaggacguccccauggucgagaagaaguccaagaagcccaagaagaaggagaagaagcacaaggagaaggagcgcgacaaggagaagaagaaggagaaggagaagaaggccgaggaccucgacuucuggcucuccaccacccccccccccgcccccgcccccgcccccgcccccguccccuccaccggcgagcucuccgucaacaccgucaccacccccaaggacgagugcgaggacgccaagaccgaggcccagggcgaggaggacgacgccgagggccaggaccaggacaagaagucccccaagcccaagaagaagaagcaccgcaaggagaaggaggagcgcaccaagggcaagaagaaguccaagaagcagccccccggcuccgaggaggccgccggcgagcccguccagaacggcgcccccgaggaggagcagcucccccccgaguccuccuacucccuccucgccgagaacuccuacgucaagaugaccugcgacauccgcggcucccuccaggaggacucccaggucaccgucgccaucguccucgagaaccgcuccuccuccauccucaagggcauggagcucuccguccucgacucccucaacgcccgcauggcccgcccccagggcuccuccguccacgacggcguccccguccccuuccagcucccccccggcgucuccaacgaggcccaguacgucuucaccauccaguccaucgucauggcccagaagcucaagggcacccucuccuucaucgccaagaacgacgagggcgccacccacgagaagcucgacuuccgccuccacuucuccugcuccuccuaccucaucaccacccccugcuacuccgacgccuucgccaagcuccucgaguccggcgaccucuccauguccuccaucaaggucgacggcauccgcauguccuuccagaaccuccucgccaagaucugcuuccaccaccacuucuccgucgucgagcgcgucgacuccugcgccuccauguacucccgcuccauccagggccaccacgucugccuccucgucaagaagggcgagaacuccgucuccgucgacggcaagugcuccgacuccacccuccucuccaaccuccucgaggagaugaaggccacccucgccaagugcuga

SEQ ID NO: 39777 - RNA, 1257 nt, Artificial Sequence
  derived and/or modified sequence opt2 from AP3M2__Homo_sapiens__NP_006794
augauccacucccucuuccucaucaacuccuccggcgacaucuuccucgagaagcacuggaaguccgucgucucccgcuccgucugcgacuacuucuucgaggcccaggagcgcgccaccgaggccgagaacgucccccccgucauccccaccccccaccacuaccuccucuccgucuaccgccacaagaucuucuucgucgccgucauccagaccgagguccccccccucuucgucaucgaguuccuccaccgcgucgucgacaccuuccaggacuacuucggcgucugcuccgagcccgucaucaaggacaacgucgucgucgucuacgagguccucgaggagaugcucgacaacggcuucccccucgccaccgaguccaacauccucaaggagcucaucaagccccccaccauccuccgcaccgucgucaacaccaucaccggcuccaccaacgucggcgaccagcuccccaccggccagcucuccgucguccccuggcgccgcaccggcgucaaguacaccaacaacgaggccuacuucgacgucaucgaggagaucgacgccaucaucgacaaguccggcuccaccaucaccgccgagauccagggcgucaucgacgccugcgucaagcucaccggcaugcccgaccucacccucuccuucaugaacccccgccuccucgacgacgucuccuuccaccccugcguccgcuucaagcgcugggaguccgagcgcauccucuccuucaucccccccgacggcaacuuccgccuccucuccuaccacgucuccgcccagaaccucgucgccauccccgucuacgucaagcacaacaucuccuuccgcgacuccuccucccucggccgcuucgagaucaccgucggccccaagcagaccaugggcaagaccaucgagggcgucaccgucaccucccagaugcccaagggcguccucaacaugucccucacccccucccagggcacccacaccuucgaccccgucaccaagaugcucuccugggacgucggcaagaucaacccccagaagcuccccucccucaagggcaccaugucccuccaggccggcgccuccaagcccgacgagaaccccaccaucaaccuccaguucaagauccagcagcucgccaucuccggccucaaggucaaccgccucgacauguacggcgagaaguacaagcccuucaagggcaucaaguacaugaccaaggccggcaaguuccagguccgcaccuga

SEQ ID NO: 39778 - RNA, 582 nt, Artificial Sequence
  derived and/or modified sequence opt2 from AP3S1__Homo_sapiens__NP_001275
augaucaaggccauccucaucuucaacaaccacggcaagccccgccucuccaaguucuaccagcccuacuccgaggacacccagcagcagaucauccgcgagaccuuccaccucgucuccaagcgcgacgagaacgucugcaacuuccucgagggcggccuccucaucggcggcuccgacaacaagcucaucuaccgccacuacgccacccucuacuucgucuucugcgucgacuccuccgaguccgagcucggcauccucgaccucauccaggucuucgucgagacccucgacaagugcuucgagaacgucugcgagcucgaccucaucuuccacgucgacaagguccacaacauccucgccgagauggucaugggcggcaugguccucgagaccaacaugaacgagaucgucacccagaucgacgcccagaacaagcucgagaaguccgaggccggccucgccggcgcccccgcccgcgccgucuccgccgucaagaacaugaaccuccccgagaucccccgcaacaucaacaucggcgacaucuccaucaagguccccaaccuccccuccuucaaguga

SEQ ID NO: 39779 - RNA, 582 nt, Artificial Sequence
  derived and/or modified sequence opt2 from AP3S2__Homo_sapiens__NP_005820
augauccaggccauccucgucuucaacaaccacggcaagccccgccucguccgcuucuaccagcgcuuccccgaggagauccagcagcagaucguccgcgagaccuuccaccucguccucaagcgcgacgacaacaucugcaacuuccucgagggcggcucccucaucggcggcuccgacuacaagcucaucuaccgccacuacgccacccucuacuucgucuucugcgucgacuccuccgaguccgagcucggcauccucgaccucauccaggucuucgucgagacccucgacaagugcuucgagaacgucugcgagcucgaccucaucuuccacauggacaagguccacuacauccuccaggaggucgucaugggcggcaugguccucgagaccaacaugaacgagaucgucgcccagaucgaggcccagaaccgccucgagaaguccgagggcggccucuccgccgcccccgcccgcgccgucuccgccgucaagaacaucaaccuccccgagaucccccgcaacaucaacaucggcgaccucaacaucaagguccccaaccucucccaguucgucuga

SEQ ID NO: 39780 - RNA, 1995 nt, Artificial Sequence
  derived and/or modified sequence opt2 from AP4B1__Homo_sapiens__XP_011538826
augcccuaccucggcuccgaggacgucgucaaggagcucaagaaggcccucugcaacccccacauccaggccgaccgccuccgcuaccgcaacgucauccagcgcgucauccgcaugcccggcguccaggaguacauccagcagcccauccucaacggccuccgcgacaaggccuccuacguccgccgcgucgccguccucggcugcgccaagaugcacaaccuccacggcgacuccgaggucgacggcgcccucgucaacgagcucuacucccuccuccgcgaccaggaccccaucgucgucgucaacugccuccgcucccucgaggagauccucaagcaggagggcggcgucgucaucaacaagcccaucgcccaccaccuccucaaccgcauguccaagcucgaccaguggggccaggccgagguccucaacuuccuccuccgcuaccagccccgcuccgaggaggagcucuucgacauccucaaccuccucgacuccuuccucaaguccuccucccccggcgucgucaugggcgccaccaagcucuuccucauccucgccaagauguucccccacguccagaccgacguccucguccgcgucaagggcccccuccucgccgccugcuccuccgagucccgcgagcucugcuucgucgcccucugccacguccgccagauccuccacucccuccccggccacuucuccucccacuacaagaaguucuucugcuccuacuccgagccccacuacaucaagcuccagaaggucgagguccucugcgagcucgucaacgacgagaacguccagcagguccucgaggagcuccgcggcuacugcaccgacgucuccgccgacuucgcccaggccgccaucuucgccaucggcggcaucgcccgcaccuacaccgaccagugcguccagauccucaccgagcuccucggccuccgccaggagcacaucaccaccgucgucguccagaccuuccgcgaccucgucuggcucugcccccagugcaccgaggccgucugccaggcccuccccggcugcgaggagaacauccaggacuccgagggcaagcaggcccucaucuggcuccucggcguccacggcgagcgcauccccaacgcccccuacguccucgaggacuucgucgagaacgucaaguccgagaccuuccccgccgucaagauggagcuccucaccgcccuccuccgccucuuccucucccgccccgccgagugccaggacaugcucggccgccuccucuacuacugcaucgaggaggagaaggacauggccguccgcgaccgcggccucuucuacuaccgccuccuccucgucggcaucgacgaggucaagcgcauccucugcucccccaaguccgaccccacccucggccuccucgaggaccccgccgagcgccccgucaacuccugggccuccgacuucaacacccucguccccgucuacggcaaggcccacugggccaccaucuccaagugccagggcgccgagcgcugcgaccccgagcuccccaagaccuccuccuucgccgccuccggcccccucauccccgaggagaacaaggagcgcguccaggagcuccccgacuccggcgcccucaugcucguccccaaccgccagcucaccgccgacuacuucgagaagaccuggcucucccucaaggucgcccaccagcagguccuccccuggcgcggcgaguuccaccccgacacccuccagauggcccuccaggucgucaacauccagaccaucgccaugucccgcgccggcucccgccccuggaaggccuaccucuccgcccaggacgacaccggcugccucuuccucaccgagcuccuccucgagcccggcaacuccgagaugcagaucuccgucaagcagaacgaggcccgcaccgagacccucaacuccuucaucuccguccucgagaccgucaucggcaccaucgaggagaucaaguccuga

SEQ ID NO: 39781 - RNA, 3414 nt, Artificial Sequence
  derived and/or modified sequence opt2 from AP4E1__Homo_sapiens__NP_031373
auguccgacaucgucgagaagacccucaccgcccuccccggccucuuccuccagaaccagcccggcggcggccccgccgccgccaaggccuccuucuccucccgccucggcucccucguccgcggcaucaccgcccucaccuccaagcacgaggaggagaagcucauccagcaggagcucuccucccucaaggccaccgucuccgcccccaccaccacccucaagaugaugaaggagugcaugguccgccucaucuacugcgagaugcucggcuacgacgccuccuucggcuacauccacgccaucaagcucgcccagcagggcaaccuccucgagaagcgcgucggcuaccucgccgucucccucuuccuccacgagucccacgagcuccuccuccuccucgucaacaccgucgucaaggaccuccaguccaccaaccucgucgaggucugcauggcccucaccgucgucucccagaucuuccccugcgagaugauccccgccguccucccccucaucgaggacaagcuccagcacuccaaggagaucguccgccgcaaggccguccucgcccucuacaaguuccaccucaucgcccccaaccagguccagcacauccacaucaaguuccgcaaggcccucugcgaccgcgacgucggcgucauggccgccucccuccacaucuaccuccgcaugaucaaggagaacuccuccggcuacaaggaccucaccggcuccuucgucaccauccucaagcaggucgucggcggcaagcuccccgucgaguucaacuaccacuccguccccgcccccuggcuccagauccagcuccuccgcauccucggccuccucggcaaggacgaccagcgcaccuccgagcucauguacgacguccucgacgagucccuccgccgcgccgagcucaaccacaacgucaccuacgccauccucuucgagugcguccacaccgucuacuccaucuaccccaaguccgagcuccucgagaaggccgccaagugcaucggcaaguucguccucucccccaagaucaaccucaaguaccucggccucaaggcccucaccuacgucauccagcaggaccccacccucgcccuccagcaccagaugaccaucaucgagugccucgaccaccccgaccccaucaucaagcgcgagacccucgagcuccucuaccgcaucaccaacgcccagaacaucaccgucaucguccagaagaugcucgaguaccuccaccaguccaaggaggaguacgucaucgucaaccucgucggcaagaucgccgagcucgccgagaaguacgcccccgacaacgccugguucauccagaccaugaacgccgucuucuccgucggcggcgacgucaugcaccccgacauccccaacaacuuccuccgccuccucgccgagggcuucgacgacgagaccgaggaccagcagcuccgccucuacgccguccaguccuaccucacccuccucgacauggagaacgucuucuacccccagcgcuuccuccaggucauguccuggguccucggcgaguacuccuaccuccucgacaaggagacccccgaggaggucaucgccaagcucuacaagcuccucaugaacgacuccgucuccuccgagaccaaggccuggcucaucgccgccgucaccaagcucaccucccaggcccacuccuccaacaccgucgagcgccucauccacgaguucaccaucucccucgacaccugcaugcgccagcacgccuucgagcucaagcaccuccacgagaacgucgagcucaugaagucccuccuccccgucgaccgcuccugcgaggaccucgucgucgacgccucccucuccuuccucgacggcuucgucgccgagggccucucccagggcgccgcccccuacaagcccccccaccagcgccaggaggagaagcucucccaggagaagguccucaacuucgagcccuacggccucuccuucuccuccuccggcuucaccggccgccagucccccgccggcaucucccucggcuccgacgucuccggcaacuccgccgagaccggccucaaggagaccaacucccucaagcucgagggcaucaagaagcucuggggcaaggagggcuaccuccccaagaaggaguccaagaccggcgacgaguccggcgcccuccccgucccccaggaguccaucauggagaacgucgaccaggccaucaccaagaaggaccagucccagguccucacccaguccaaggaggagaaggagaagcagcuccucgccuccucccucuucgucggccucggcuccgaguccaccaucaaccuccucggcaaggccgacaccgucucccacaaguuccgccgcaaguccaaggucaaggaggccaaguccggcgagaccaccuccacccacaacaugaccugcuccuccuucuccucccucuccaacgucgccuacgaggacgacuacuacuccaacacccuccacgacaccggcgacaaggagcucaagaaguucucccucaccuccgagcuccucgacuccgagucccucaccgagcucccccucgucgagaaguucuccuacugcucccucuccacccccucccucuucgccaacaacaacauggagaucuuccaccccccccaguccaccgccgccuccgucgccaaggaguccucccucgccuccuccuuccucgaggagaccaccgaguacauccacuccaacgccauggaggucugcaacaacgagaccaucuccgucuccuccuacaagaucuggaaggacgacugccuccucauggucugguccgucaccaacaaguccggccucgagcucaaguccgccgaccucgagaucuuccccgccgagaacuucaaggucaccgagcagcccggcugcugccuccccgucauggaggccgaguccaccaaguccuuccaguacuccguccagaucgagaagcccuucaccgagggcaaccucaccggcuucaucuccuaccacaugauggacacccacuccgcccagcucgaguucuccgucaaccucucccuccucgacuucauccgcccccucaagaucuccuccgacgacuucggcaagcucuggcucuccuucgccaacgacgucaagcagaacgucaagauguccgagucccaggccgcccuccccuccgcccucaagacccuccagcagaagcuccgccuccacaucaucgagaucaucggcaacgagggccuccucgccugccagcuccuccccuccauccccugccuccuccacugccgcguccacgccgacguccucgcccucugguuccgcuccuccugcuccacccuccccgacuaccuccucuaccagugccagaaggucauggagggcuccuga

SEQ ID NO: 39782 - RNA, 1362 nt, Artificial Sequence
  derived and/or modified sequence opt2 from AP4M1__Homo_sapiens__NP_004713
augaucucccaguucuucauccucuccuccaagggcgacccccucaucuacaaggacuuccgcggcgacuccggcggccgcgacgucgccgagcucuucuaccgcaagcucaccggccuccccggcgacgagucccccgucgucaugcaccaccacggccgccacuucauccacauccgccacuccggccucuaccucgucgucaccaccuccgagaacgucucccccuucucccuccucgagcuccucucccgccucgccacccuccucggcgacuacugcggcucccucggcgagggcaccaucucccgcaacgucgcccucgucuacgagcuccucgacgagguccucgacuacggcuacguccagaccaccuccaccgagaugcuccgcaacuucauccagaccgaggccgucgucuccaagcccuucucccucuucgaccucuccuccgucggccucuucggcgccgagacccagcaguccaaggucgcccccuccuccgccgccucccgccccguccucuccucccgcuccgaccagucccagaagaacgaggucuuccucgacgucgucgagcgccucuccguccucaucgccuccaacggcucccuccucaaggucgacguccagggcgagauccgccucaaguccuuccuccccuccggcuccgagaugcgcaucggccucaccgaggaguucugcgucggcaaguccgagcuccgcggcuacggccccggcauccgcgucgacgaggucuccuuccacuccuccgucaaccucgacgaguucgagucccaccgcauccuccgccuccagcccccccagggcgagcucaccgucaugcgcuaccagcucuccgacgaccuccccuccccccuccccuuccgccucuuccccuccguccagugggaccgcggcuccggccgccuccaggucuaccucaagcuccgcugcgaccuccucuccaagucccaggcccucaacguccgccuccaccucccccucccccgcggcgucgucucccucucccaggagcucuccucccccgagcagaaggccgagcucgccgagggcgcccuccgcugggaccucccccgcguccagggcggcucccagcucuccggccucuuccagauggacguccccggcccccccggcccccccucccacggccucuccaccuccgccuccccccucggccucggccccgccucccucuccuucgagcucccccgccacaccugcuccggccuccagguccgcuuccuccgccucgccuuccgccccugcggcaacgccaacccccacaaguggguccgccaccucucccacuccgacgccuacgucauccgcaucuga

SEQ ID NO: 39783 - RNA, 435 nt, Artificial Sequence
  derived and/or modified sequence opt2 from AP4S1__Homo_sapiens__NP_001121598
augaucaaguucuuccucauggucaacaagcagggccagacccgccucuccaaguacuacgagcacgucgacaucaacaagcgcacccuccucgagaccgaggucaucaaguccugccucucccgcuccaacgagcagugcuccuucaucgaguacaaggacuucaagcucaucuaccgccaguacgccgcccucuucaucgucgucggcgucaacgacaccgagaacgagauggccaucuacgaguucauccacaacuucgucgagguccucgacgaguacuucucccgcgucuccgagcucgacaucauguucaaccucgacaagguccacaucauccucgacgagaugguccucaacggcugcaucgucgagaccaaccgcgcccgcauccucgccccccuccucauccucgacaagauguccgaguccuga

SEQ ID NO: 39784 - RNA, 1473 nt, Artificial Sequence
  derived and/or modified sequence opt2 from AP5M1__Homo_sapiens__NP_060699
auggcccagcgcgccgucuggcucaucucccacgagcccggcaccccccucugcggcaccguccgcuucucccgccgcuaccccaccgucgagaagcgcgcccgcgucuucaacggcgccuccuacguccccguccccgaggacggccccuuccucaaggcccuccucuucgagcuccgccuccucgacgacgacaaggacuucgucgagucccgcgacuccugcucccgcaucaacaagaccuccaucuacggccuccucaucggcggcgaggagcucuggcccgucgucgccuuccucaagaacgacaugaucuacgccugcgucccccucgucgagcagacccucuccccccgccccccccucaucuccgucuccggcgucucccagggcuucgaguuccucuucggcauccaggacuuccucuacuccggccagaagaacgacuccgagcucaacaccaagcucucccagcuccccgaccuccuccuccaggccugccccuucggcacccuccucgacgccaaccuccagaacucccucgacaacaccaacuucgccuccgucacccagccccagaagcagcccgccuggaagaccggcaccuacaagggcaagccccaggucuccaucuccaucaccgagaaggucaaguccaugcaguacgacaagcagggcaucgccgacaccuggcaggucgucggcaccgucaccugcaagugcgaccucgagggcaucaugcccaacgucaccaucucccucucccuccccaccaacggcuccccccuccaggacauccucguccaccccugcgucaccucccucgacuccgccauccucaccuccuccuccaucgacgccauggacgacuccgccuucuccggccccuacaaguuccccuucacccccccccucgaguccuucaaccucugcuucuacaccucccagguccccgucccccccauccucggcuucuaccagaugaaggaggaggagguccagcuccgcaucaccaucaaccucaagcuccacgaguccgucaagaacaacuucgaguucugcgaggcccacauccccuucuacaaccgcggccccaucacccaccucgaguacaagaccuccuucggccagcucgaggucuuccgcgagaagucccuccucaucuggaucaucggccagaaguuccccaaguccauggagaucucccucuccggcaccgucaccuucggcgccaagucccacgagaagcagcccuucgaccccaucugcaccggcgagaccgccuaccucaagcuccacuuccgcauccucgacuacacccucaccggcugcuacgccgaccagcacuccguccaggucuucgccuccggcaagcccaagaucuccgcccaccgcaagcucaucuccuccgacuacuacaucuggaacuccaaggcccccgcccccgucaccuacggcucccuccuccucuga

SEQ ID NO: 39785 - RNA, 2424 nt, Artificial Sequence
  derived and/or modified sequence opt2 from AP5Z1__Homo_sapiens__NP_055670
auguucuccgccggcgccgagucccuccuccaccaggcccgcgagauccaggacgaggagcucaagaaguucugcucccgcaucugcaagcuccuccaggccgaggaccucggccccgacacccucgacucccuccagcgccucuuccucaucaucuccgccaccaaguacucccgccgccucgagaagaccugcgucgaccuccuccaggccacccucggccuccccgccugccccgagcagcuccagguccucugcgccgccauccuccgcgagaugucccccuccgacucccucucccucgccugggaccacacccagaacucccgccagcucucccucgucgccuccguccuccucgcccagggcgaccgcaacgaggagguccgcgccgucggccagggcguccuccgcgcccucgagucccgccagcccgagggccccucccuccgccaccuccuccccgucauggccaaggucgucguccucucccccggcacccuccaggaggaccaggccacccuccucuccaagcgccucgucgacuggcuccgcuacgccucccuccagcagggccucccccacuccggcggcuucuucuccaccccccgcgcccgccagcccggccccgucaccgaggucgacggcgccgucgccaccgacuucuucaccguccucuccuccggccaccgcuucaccgacgaccaguggcucaacguccaggccuucuccaugcuccgcgccuggcuccuccacuccggccccgagggccccggcacccucgacaccgacgaccgcuccgagcaggagggcuccacccucuccgucaucuccgccaccuccuccgccggccgccuccuccccccccgcgagcgccuccgcgaggucgccuucgaguacugccagcgccucaucgagcaguccaaccgccgcgcccuccgcaagggcgacuccgaccuccagaaggccugccucgucgaggccguccucguccucgacguccucugccgccaggaccccuccuuccucuaccgcucccucuccugccucaaggcccuccacggccgcguccgcggcgaccccgccuccguccgcguccuccucccccucgcccacuucuuccucucccacggcgaggccgccgccgucgacuccgaggccgucuaccagcaccucuucacccgcauccccgucgagcaguuccacucccccaugcucgccuucgaguucauccaguucugccgcgacaaccuccaccucuucuccggccaccucuccacccuccgccucuccuuccccaaccucuucaaguuccucgccuggaacucccccccccucaccuccgaguucgucgcccuccuccccgcccucgucgacgccggcaccgcccucgagaugcuccacgcccuccucgaccuccccugccucaccgccguccucgaccuccagcuccgcuccgcccccgccgccuccgagcgcccccucugggacaccucccuccgcgcccccuccugccucgaggccuuccgcgacccccaguuccagggccucuuccaguaccuccuccgccccaaggccuccggcgccaccgagcgccucgccccccuccaccagcuccuccagcccauggccggcugcgcccgcgucgcccagugcgcccaggccguccccacccuccuccaggccuucuucuccgccgucacccaggucgccgacggcucccucaucaaccagcucgcccuccuccuccucggccgcuccgacucccucuaccccgcccccggcuacgccgccggcguccacuccguccucuccucccaguuccucgcccucugcacccucaagcccucccucgucgucgagcucgcccgcgaccuccucgaguuccucggcuccgucaacggccucugcucccgcgccucccucgucaccuccgucgucugggccaucggcgaguaccucuccgucaccuacgaccgccgcugcaccgucgagcagaucaacaaguucuucgaggcccucgaggcccuccucuucgaggucacccagugccgccccuccgccgcccucccccgcugccccccccaggucgucaccguccucaugaccacccucaccaagcucgccucccgcucccaggaccucaucccccgcgccucccuccuccucuccaagaugcgcacccucgcccacucccccgccaccuccuccacccacuccgaggagggcgccgaggccauccgcacccgcgccaccgagcuccucacccuccucaagaugcccuccgucgcccaguucguccucacccccuccaccgaggucugcuccccccgcuaccaccgcgacgccaacaccgcccucccccucgcccuccgcaccgucucccgccucgucgagcgcgaggccggccucaugcccggcuga

SEQ ID NO: 39786 - RNA, 3585 nt, Artificial Sequence
  derived and/or modified sequence opt2 from APAF1__Homo_sapiens__NP_001151
auggacgccaaggcccgcaacugccuccuccagcaccgcgaggcccucgagaaggacaucaagaccuccuacaucauggaccacaugaucuccgacggcuuccucaccaucuccgaggaggagaagguccgcaacgagcccacccagcagcagcgcgccgccaugcucaucaagaugauccucaagaaggacaacgacuccuacgucuccuucuacaacgcccuccuccacgagggcuacaaggaccucgccgcccuccuccacgacggcauccccgucgucuccuccuccuccguccgcaccguccucugcgagggcggcgucccccagcgccccgucgucuucgucacccgcaagaagcucgucaacgccauccagcagaagcucuccaagcucaagggcgagcccggcugggucaccauccacggcauggccggcugcggcaaguccguccucgccgccgaggccguccgcgaccacucccuccucgagggcugcuuccccggcggcguccacugggucuccgucggcaagcaggacaaguccggccuccucaugaagcuccagaaccucugcacccgccucgaccaggacgaguccuucucccagcgccucccccucaacaucgaggaggccaaggaccgccuccgcauccucaugcuccgcaagcacccccgcucccuccucauccucgacgacgucugggacuccuggguccucaaggccuucgacucccagugccagauccuccucaccacccgcgacaaguccgucaccgacuccgucaugggccccaaguacgucguccccgucgaguccucccucggcaaggagaagggccucgagauccucucccucuucgucaacaugaagaaggccgaccuccccgagcaggcccacuccaucaucaaggagugcaagggcuccccccucgucgucucccucaucggcgcccuccuccgcgacuuccccaaccgcugggaguacuaccucaagcagcuccagaacaagcaguucaagcgcauccgcaaguccuccuccuacgacuacgaggcccucgacgaggccauguccaucuccgucgagaugcuccgcgaggacaucaaggacuacuacaccgaccucuccauccuccagaaggacgucaagguccccaccaagguccucugcauccucugggacauggagaccgaggaggucgaggacauccuccaggaguucgucaacaagucccuccucuucugcgaccgcaacggcaaguccuuccgcuacuaccuccacgaccuccaggucgacuuccucaccgagaagaacugcucccagcuccaggaccuccacaagaagaucaucacccaguuccagcgcuaccaccagccccacacccucucccccgaccaggaggacugcauguacugguacaacuuccucgccuaccacauggccuccgccaagaugcacaaggagcucugcgcccucauguucucccucgacuggaucaaggccaagaccgagcucgucggccccgcccaccucauccacgaguucgucgaguaccgccacauccucgacgagaaggacugcgccgucuccgagaacuuccaggaguuccucucccucaacggccaccuccucggccgccagcccuuccccaacaucguccagcucggccucugcgagcccgagaccuccgaggucuaccagcaggccaagcuccaggccaagcaggaggucgacaacggcaugcucuaccucgaguggaucaacaagaagaacaucaccaaccucucccgccucgucguccgcccccacaccgacgccgucuaccacgccugcuucuccgaggacggccagcgcaucgccuccugcggcgccgacaagacccuccaggucuucaaggccgagaccggcgagaagcuccucgagaucaaggcccacgaggacgagguccucugcugcgccuucuccaccgacgaccgcuucaucgccaccugcuccgucgacaagaaggucaagaucuggaacuccaugaccggcgagcucguccacaccuacgacgagcacuccgagcaggucaacugcugccacuucaccaacuccucccaccaccuccuccucgccaccggcuccuccgacugcuuccucaagcucugggaccucaaccagaaggagugccgcaacaccauguucggccacaccaacuccgucaaccacugccgcuucucccccgacgacaagcuccucgccuccugcuccgccgacggcacccucaagcucugggacgccaccuccgccaacgagcgcaaguccaucaacgucaagcaguucuuccucaaccucgaggacccccaggaggacauggaggucaucgucaagugcugcuccugguccgccgacggcgcccgcaucauggucgccgccaagaacaagaucuuccucuggaacaccgacucccgcuccaaggucgccgacugccgcggccaccucuccuggguccacggcgucauguucucccccgacggcuccuccuuccucaccuccuccgacgaccagaccauccgccucugggagaccaagaaggucugcaagaacuccgccgucaugcucaagcaggaggucgacgucgucuuccaggagaacgaggucaugguccucgccgucgaccacauccgccgccuccagcucaucaacggccgcaccggccagaucgacuaccucaccgaggcccaggucuccugcugcugccucuccccccaccuccaguacaucgccuucggcgacgagaacggcgccaucgagauccucgagcucgucaacaaccgcaucuuccagucccgcuuccagcacaagaagaccgucuggcacauccaguucaccgccgacgagaagacccucaucuccuccuccgacgacgccgagauccaggucuggaacuggcagcucgacaagugcaucuuccuccgcggccaccaggagaccgucaaggacuuccgccuccucaagaacucccgccuccucuccugguccuucgacggcaccgucaaggucuggaacaucaucaccggcaacaaggagaaggacuucgucugccaccagggcaccguccucuccugcgacaucucccacgacgccaccaaguucuccuccaccuccgccgacaagaccgccaagaucugguccuucgaccuccuccucccccuccacgagcuccgcggccacaacggcugcguccgcugcuccgccuucuccgucgacuccacccuccucgccaccggcgacgacaacggcgagauccgcaucuggaacgucuccaacggcgagcuccuccaccucugcgccccccucuccgaggagggcgccgccacccacggcggcugggucaccgaccucugcuucucccccgacggcaagaugcucaucuccgccggcggcuacaucaagugguggaacgucgucaccggcgaguccucccagaccuucuacaccaacggcaccaaccucaagaagauccacgucucccccgacuucaagaccuacgucaccgucgacaaccucggcauccucuacauccuccagacccucgaguga

SEQ ID NO: 39787 - RNA, 2514 nt, Artificial Sequence
  derived and/or modified sequence opt2 from APBA1__Homo_sapiens__XP_011516919
augaaccaccucgagggcuccgccgaggucgaggucaccgacgaggccgccggcggcgaggucaacgaguccgucgaggccgaccucgagcaccccgaggucgaggaggagcagcagcagcccccccagcagcagcacuacgucggccgccaccagcgcggccgcgcccucgaggaccuccgcgcccagcucggccaggaggaggaggagcgcggcgagugccucgcccgcuccgccuccaccgaguccggcuuccacaaccacaccgacaccgccgagggcgacgucaucgccgccgcccgcgacggcuacgacgccgagcgcgcccaggaccccgaggacgaguccgccuacgccguccaguaccgccccgaggccgaggaguacaccgagcaggccgaggccgagcacgccgaggccacccaccgccgcgcccuccccaaccaccuccacuuccacucccucgagcacgaggaggccaugaacgccgccuacuccggcuacgucuacacccaccgccucuuccaccgcggcgaggacgagcccuacuccgagcccuacgccgacuacggcggccuccaggagcacgucuacgaggagaucggcgacgcccccgagcucgacgcccgcgacggccuccgccucuacgagcaggagcgcgacgaggccgccgccuaccgccaggaggcccucggcgcccgccuccaccacuacgacgagcgcuccgacggcgaguccgacucccccgagaaggaggccgaguucgcccccuacccccgcauggacuccuacgagcaggaggaggacaucgaccagaucgucgccgaggucaagcaguccauguccucccagucccucgacaaggccgccgaggacaugcccgaggccgagcaggaccucgagcgcccccccacccccgccggcggccgccccgacucccccggccuccaggcccccgccggccagcagcgcgccgucggccccgccggcggcggcgaggccggccagcgcuacuccaaggagaagcgcgacgccaucucccucgccaucaaggacaucaaggaggccaucgaggaggucaagacccgcaccauccgcucccccuacacccccgacgagcccaaggagcccaucugggucaugcgccaggacaucucccccacccgcgacugcgacgaccagcgccccauggacggcgacucccccucccccggcuccuccuccccccucggcgccgaguccuccuccaccucccuccaccccuccgaccccgucgaggccuccaccaacaaggagucccgcaagucccucgccuccuuccccaccuacgucgagguccccggccccugcgaccccgaggaccucaucgacggcaucaucuucgccgccaacuaccucggcuccacccagcuccucuccgacaagacccccuccaagaacguccgcaugaugcaggcccaggaggccgucucccgcaucaagauggcccagaagcucgccaagucccgcaagaaggcccccgagggcgagucccagcccaugaccgaggucgaccucuucaucuccacccagcgcaucaagguccucaacgccgacacccaggagaccaugauggaccacccccuccgcaccaucuccuacaucgccgacaucggcaacaucgucguccucauggcccgccgccgcaugccccgcuccaacucccaggagaacgucgaggccucccaccccucccaggacggcaagcgccaguacaagaugaucugccacgucuucgaguccgaggacgcccagcucaucgcccaguccaucggccaggccuucuccgucgccuaccaggaguuccuccgcgccaacggcaucaaccccgaggaccucucccagaaggaguacuccgaccuccucaacacccaggacauguacaacgacgaccucauccacuucuccaaguccgagaacugcaaggacgucuucaucgagaagcagaagggcgagauccucggcgucgucaucgucgaguccggcuggggcuccauccuccccaccgucaucaucgccaacaugaugcacggcggccccgccgagaaguccggcaagcucaacaucggcgaccagaucauguccaucaacggcaccucccucgucggccucccccucuccaccugccaguccaucaucaagggccucaagaaccagucccgcgucaagcucaacaucguccgcugcccccccgucaccaccguccucauccgccgccccgaccuccgcuaccagcucggcuucuccguccagaacggcaucaucugcucccucaugcgcggcggcaucgccgagcgcggcggcguccgcgucggccaccgcaucaucgagaucaacggccaguccgucgucgccaccccccacgagaagaucguccacauccucuccaacgccgucggcgagauccacaugaagaccaugcccgccgccauguaccgccuccucaccgcccaggagcagcccgucuacaucuga

SEQ ID NO: 39788 - RNA, 2214 nt, Artificial Sequence
  derived and/or modified sequence opt2 from APBA2__Homo_sapiens__XP_006725606
auggcccaccgcaagcucgaguccgucggcuccggcaugcucgaccaccgcguccgccccggccccgucccccacucccaggagcccgaguccgaggacauggagcucccccucgagggcuacguccccgagggccucgagcucgccgcccuccgccccgagucccccgcccccgaggagcaggagugccacaaccacucccccgacggcgacuccuccuccgacuacgucaacaacaccuccgaggaggaggacuacgacgagggccuccccgaggaggaggagggcaucaccuacuacauccgcuacugccccgaggacgacuccuaccucgagggcauggacugcaacggcgaggaguaccucgcccacuccgcccaccccgucgacaccgacgagugccaggaggccgucgaggaguggaccgacuccgccggcccccacccccacggccacgaggccgagggcucccaggacuaccccgacggccagcuccccauccccgaggacgagcccuccguccucgaggcccacgaccaggaggaggacggccacuacugcgccuccaaggagggcuaccaggacuacuaccccgaggaggccaacggcaacaccggcgccucccccuaccgccuccgccgcggcgacggcgaccucgaggaccaggaggaggacaucgaccagaucgucgccgagaucaagaugucccucuccaugaccuccaucaccuccgccuccgaggccucccccgagcacggccccgagcccggccccgaggacuccgucgaggccugcccccccaucaaggccuccugcucccccucccgccacgaggcccgccccaagucccucaaccuccuccccgaggccaagcaccccggcgacccccagcgcggcuucaagcccaagacccgcacccccgaggagcgccucaaguggccccacgagcaggucugcaacggccucgagcagccccgcaagcagcagcgcuccgaccucaacggccccgucgacaacaacaacauccccgagaccaagaaggucgccuccuuccccuccuucgucgccguccccggccccugcgagcccgaggaccucaucgacggcaucaucuucgccgccaacuaccucggcuccacccagcuccucuccgagcgcaaccccuccaagaacauccgcaugaugcaggcccaggaggccgucucccgcgucaagaacuccgagggcgacgcccagacccucaccgaggucgaccucuucaucuccacccagcgcaucaagguccucaacgccgacacccaggagaccaugauggaccacgcccuccgcaccaucuccuacaucgccgacaucggcaacaucgucguccucauggcccgccgccgcaugccccgcuccgccucccaggacugcaucgagaccacccccggcgcccaggagggcaagaagcaguacaagaugaucugccacgucuucgaguccgaggacgcccagcucaucgcccaguccaucggccaggccuucuccgucgccuaccaggaguuccuccgcgccaacggcaucaaccccgaggaccucucccagaaggaguacuccgacaucaucaacacccaggagauguacaacgacgaccucauccacuucuccaacuccgagaacugcaaggagcuccagcucgagaagcacaagggcgagauccucggcgucgucgucgucgaguccggcuggggcuccauccuccccaccgucauccucgccaacaugaugaacggcggccccgccgcccgcuccggcaagcucuccaucggcgaccagaucauguccaucaacggcaccucccucgucggccucccccucgccaccugccagggcaucaucaagggccucaagaaccagacccaggucaagcucaacaucgucuccugcccccccgucaccaccguccucaucaagcgccccgaccucaaguaccagcucggcuucuccguccagaacggcaucaucugcucccucaugcgcggcggcaucgccgagcgcggcggcguccgcgucggccaccgcaucaucgagaucaacggccaguccgucgucgccaccgcccacgagaagaucguccaggcccucuccaacuccgucggcgagauccacaugaagaccaugcccgccgccauguuccgccuccucaccggccaggagaccccccucuacaucuga

SEQ ID NO: 39789 - RNA, 1728 nt, Artificial Sequence
  derived and/or modified sequence opt2 from APBA3__Homo_sapiens__NP_004877
auggacuuccccaccaucucccgcucccccuccggcccccccgccauggaccucgagggcccccgcgacauccucguccccuccgaggaccucacccccgacucccagugggaccccaugcccggcggccccggcucccucucccgcauggagcucgacgaguccucccuccaggagcucguccagcaguucgaggcccuccccggcgaccucgucggccccucccccggcggcgcccccugcccccuccacaucgccaccggccacggccucgccucccaggagaucgccgacgcccacggccuccucuccgccgaggccggccgcgacgaccuccucggccuccuccacugcgaggagugcccccccucccagaccggccccgaggagccccucgagcccgccccccgccuccuccagccccccgaggaccccgacgaggacuccgacucccccgagugggucgagggcgccuccgccgagcaggagggcucccgcuccuccuccuccucccccgagcccuggcucgagaccgucccccucgucacccccgaggagccccccgccggcgcccagucccccgagacccucgccuccuaccccgccccccaggagguccccggccccugcgaccacgaggaccuccucgacggcgucaucuucggcgcccgcuaccucggcuccacccagcucgucuccgagcgcaacccccccaccuccacccgcauggcccaggcccgcgaggccauggaccgcgucaaggcccccgacggcgagacccagcccaugaccgaggucgaccucuucgucuccaccaagcgcaucaagguccucaccgccgacucccaggaggccaugauggaccacgcccuccacaccaucuccuacaccgccgacaucggcugcguccucguccucauggcccgccgccgccucgcccgccgccccgccccccaggaccacggccgccgccucuacaagaugcucugccacgucuucuacgccgaggacgcccagcucaucgcccaggccaucggccaggccuucgccgccgccuacucccaguuccuccgcgaguccggcaucgaccccucccaggucggcguccaccccucccccggcgccugccaccuccacaacggcgaccucgaccacuucuccaacuccgacaacugccgcgagguccaccucgagaagcgccgcggcgagggccucggcgucgcccucgucgaguccggcuggggcucccuccuccccaccgccgucaucgccaaccuccuccacggcggccccgccgagcgcuccggcgcccucuccaucggcgaccgccucaccgccaucaacggcaccucccucgucggccucccccucgccgccugccaggccgccguccgcgagaccaagucccagaccuccgucacccucuccaucguccacugcccccccgucaccaccgccaucauccaccgcccccacgcccgcgagcagcucggcuucugcgucgaggacggcaucaucugcucccuccuccgcggcggcaucgccgagcgcggcggcauccgcgucggccaccgcaucaucgagaucaacggccaguccgucgucgccaccccccacgcccgcaucaucgagcuccucaccgaggccuacggcgagguccacaucaagaccaugcccgccgccaccuaccgccuccucaccggccaggagcagcccgucuaccucuga

SEQ ID NO: 39790 - RNA, 1473 nt, Artificial Sequence
  derived and/or modified sequence opt2 from APBB1__Homo_sapiens__NP_001244248
auguccgccauguucucccaggacuucuuccucgccaucauccuccaggacuccuccgccgacuccuucuggaaccccaacgccuucgagaccgacuccgaccuccccgccggcuggaugcgcguccaggacaccuccggcaccuacuacuggcacauccccaccggcaccacccagugggagccccccggccgcgccucccccucccagggcuccuccccccaggaggagucccagcucaccuggaccggcuucgcccacggcgagggcuucgaggacggcgaguucuggaaggacgagcccuccgacgaggcccccauggagcucggccucaaggagcccgaggagggcacccucaccuuccccgcccagucccucucccccgagccccucccccaggaggaggagaagcuccccccccgcaacaccaaccccggcaucaagugcuucgccguccgcucccucggcugggucgagaugaccgaggaggagcucgcccccggccgcuccuccgucgccgucaacaacugcauccgccagcucuccuaccacaagaacaaccuccacgaccccauguccggcggcuggggcgagggcaaggaccuccuccuccagcucgaggacgagacccucaagcucgucgagccccagucccaggcccuccuccacgcccagcccaucaucuccauccgcgucuggggcgucggccgcgacuccggccgcgagcgcgacuucgccuacgucgcccgcgacaagcucacccagaugcucaagugccacgucuuccgcugcgaggcccccgccaagaacaucgccaccucccuccacgagaucugcuccaagaucauggccgagcgccgcaacgcccgcugccucgucaacggccucucccucgaccacuccaagcucgucgacguccccuuccaggucgaguuccccgcccccaagaacgagcucguccagaaguuccaggucuacuaccucggcaacguccccgucgccaagcccgucggcgucgacgucaucaacggcgcccucgaguccguccucuccuccuccucccgcgagcaguggacccccucccacgucuccgucgcccccgccacccucaccauccuccaccagcagaccgaggccguccucggcgagugccgcguccgcuuccucuccuuccucgccgucggccgcgacguccacaccuucgccuucaucauggccgccggccccgccuccuucugcugccacauguucuggugcgagcccaacgccgccucccucuccgaggccguccaggccgccugcaugcuccgcuaccagaagugccucgacgcccgcucccaggccuccaccuccugccuccccgccccccccgccgaguccgucgcccgccgcgucggcuggaccguccgccgcggcguccagucccucuggggcucccucaagcccaagcgccucggcgcccacacccccuga

SEQ ID NO: 39791 - RNA, 2001 nt, Artificial Sequence
  derived and/or modified sequence opt2 from APBB1IP__Homo_sapiens__XP_006717514
augggcgaguccuccgaggacaucgaccagauguucuccacccuccucggcgagauggaccuccucacccagucccucggcgucgacacccuccccccccccgaccccaaccccccccgcgccgaguucaacuacuccgucggcuucaaggaccucaacgagucccucaacgcccucgaggaccaggaccucgacgcccucauggccgaccucgucgccgacaucuccgaggccgagcagcgcaccauccaggcccagaaggagucccuccagaaccagcaccacuccgccucccuccaggccuccaucuucuccggcgccgccucccucggcuacggcaccaacgucgccgccaccggcaucucccaguacgaggacgaccucccccccccccccgccgaccccguccucgaccucccccuccccccccccccccccgagccccucucccaggaggaggaggaggcccaggccaaggccgacaagaucaagcucgcccucgagaagcucaaggaggccaaggucaagaagcucgucgucaagguccacaugaacgacaacuccaccaagucccucauggucgacgagcgccagcucgcccgcgacguccucgacaaccucuucgagaagacccacugcgacugcaacgucgacuggugccucuacgagaucuaccccgagcuccagaucgagcgcuucuucgaggaccacgagaacgucgucgagguccucuccgacuggacccgcgacaccgagaacaagauccucuuccucgagaaggaggagaaguacgccgucuucaagaacccccagaacuucuaccucgacaaccgcggcaagaaggaguccaaggagaccaacgagaagaugaacgccaagaacaaggagucccuccucgaggaguccuucugcggcaccuccaucaucguccccgagcucgagggcgcccucuaccucaaggaggacggcaagaaguccuggaagcgccgcuacuuccuccuccgcgccuccggcaucuacuacguccccaagggcaagaccaagaccucccgcgaccucgccugcuucauccaguucgagaacgucaacaucuacuacggcacccagcacaagaugaaguacaaggcccccaccgacuacugcuucguccucaagcacccccagauccagaaggagucccaguacaucaaguaccucugcugcgacgacacccgcacccucaaccagugggucaugggcauccgcaucgccaaguacggcaagacccucuacgacaacuaccagcgcgccgucgccaaggccggccucgccucccgcuggaccaaccucggcaccgucaacgccgccgcccccgcccagcccuccaccggccccaagaccggcaccacccagcccaacggccagaucccccaggccacccacuccgucuccgccguccuccaggaggcccagcgccacgccgagaccuccaaggacaagaagcccgcccucggcaaccaccacgaccccgccgucccccgcgccccccacgcccccaaguccucccuccccccccccccccccguccgccgcuccuccgacaccuccggcucccccgccaccccccucaaggccaagggcaccggcggcggcggccuccccgccccccccgacgacuuccuccccccccccccccccccccccccccucgacgaccccgagcuccccccccccccccccgacuucauggagcccccccccgacuucguccccccccccccccccuccuacgccggcaucgccggcuccgagcucccccccccccccccccccccccccgcccccgcccccgcccccguccccgacuccgcccgccccccccccgccgucgccaagcgcccccccgucccccccaagcgccaggagaaccccggccaccccggcggcgccggcggcggcgagcaggacuucauguccgaccucaugaaggcccuccagaagaagcgcggcaacgucuccuga

SEQ ID NO: 39792 - RNA, 2277 nt, Artificial Sequence
  derived and/or modified sequence opt2 from APBB2__Homo_sapiens__NP_001159522
auguccgagguccuccccgccgacuccggcgucgacacccucgccgucuucauggccuccuccggcaccaccgacgucaccaaccgcaacucccccgccaccccccccaacacccucaaccuccgcuccucccacaacgagcuccucaacgccgagaucaagcacaccgagaccaagaacuccaccccccccaagugccgcaagaaguacgcccucaccaacauccaggccgccaugggccucuccgaccccgccgcccagccccuccucggcaacggcuccgccaacaucaagcucgucaagaacggcgagaaccagcuccgcaaggccgccgagcagggccagcaggaccccaacaagaaccucucccccaccgccgucaucaacaucaccuccgagaagcucgagggcaaggagccccacccccaggacuccuccuccugcgagauccuccccucccagccccgccgcaccaaguccuuccucaacuacuacgccgaccucgagaccuccgcccgcgagcucgagcagaaccgcggcaaccaccacggcaccgccgaggagaagucccagcccguccagggccaggccuccaccaucaucggcaacggcgaccuccuccuccagaagcccaaccgcccccaguccucccccgaggacggccaggucgccaccgucuccuccucccccgagaccaagaaggaccaccccaagaccggcgccaagaccgacugcgcccuccaccgcauccagaaccucgcccccuccgacgaggaguccuccuggaccacccucucccaggacuccgccucccccuccucccccgacgagaccgacaucugguccgaccacuccuuccagaccgaccccgaccucccccccggcuggaagcgcgucuccgacaucgccggcaccuacuacuggcacauccccaccggcaccacccagugggagcgccccgucuccauccccgccgaccuccagggcucccgcaagggcucccucuccuccgucacccccucccccacccccgagaacgagaagcagcccugguccgacuucgccguccucaacggcggcaagaucaacuccgacaucuggaaggaccuccacgccgccaccgucaaccccgaccccucccucaaggaguucgagggcgccacccuccgcuacgccucccucaagcuccgcaacgccccccaccccgacgacgacgacuccugcuccaucaacuccgaccccgaggccaagugcuucgccguccgcucccucggcugggucgagauggccgaggaggaccucgcccccggcaaguccuccgucgccgucaacaacugcauccgccagcucuccuacugcaagaacgacauccgcgacaccgucggcaucuggggcgagggcaaggacauguaccucauccucgagaacgacaugcucucccucgucgaccccauggaccgcuccguccuccacucccagcccaucgucuccauccgcgucuggggcgucggccgcgacaacggccgcgacuucgccuacgucgcccgcgacaaggacacccgcauccucaagugccacgucuuccgcugcgacacccccgccaaggccaucgccaccucccuccacgagaucugcuccaagaucauggccgagcgcaagaacgccaaggcccucgccugcuccucccuccaggagcgcgccaacgucaaccucgacgucccccuccaggucgacuuccccacccccaagaccgagcucguccagaaguuccacguccaguaccucggcaugcuccccgucgacaagcccgucggcauggacauccucaacuccgccaucgagaaccucaugaccuccuccaacaaggaggacuggcucuccgucaacaugaacgucgccgacgccaccgucaccgucaucuccgagaagaacgaggaggagguccucgucgagugccgcguccgcuuccucuccuucaugggcgucggcaaggacguccacaccuucgccuucaucauggacaccggcaaccagcgcuucgagugccacgucuucuggugcgagcccaacgccggcaacgucuccgaggccguccaggccgccugcaugcuccgcuaccagaagugccucgucgcccgcccccccucccagaagguccgccccccccccccccccgccgacuccgucacccgccgcgucaccaccaacgucaagcgcggcguccucucccucaucgacacccucaagcagaagcgccccgucaccgagaugcccuga

SEQ ID NO: 39793 - RNA, 1482 nt, Artificial Sequence
  derived and/or modified sequence opt2 from APBB3__Homo_sapiens__NP_006042
augcucggcaaggacuacaugcucgccaucauccucgucaacugcgacgacgaccucuggggcgaccacucccucgaggucgaggccggccucccccccggcuggcgcaagauccacgacgccgccggcaccuacuacuggcacguccccuccggcuccacccaguggcagcgccccaccugggagcucggcgacgccgaggaccccggcaccggcaccgagggcaucuggggccuccgcccccccaagggccgcuccuucuccucccucgaguccucccucgaccgcuccaacucccucuccugguacggcggcgaguccuacauccaguccauggagcccggcgccaagugcuucgccguccgcucccucggcugggucgagguccccgaggaggaccucgcccccggcaaguccuccaucgccgucaacaacugcauccagcagcucgcccagacccgcucccgcucccagccccccgacggcgccuggggcgagggccagaacaugcucaugauccucaagaaggacgccaugucccucgucaacccccucgaccacucccucauccacugccagccccucguccacauccgcgucuggggcgucggcuccuccaagggccgcgacucccccaucuccgcccccgcccgcgacuucgccuucgucgccuccgacaaggacuccugcaugcucaagugccacgucuucugcugcgacguccccgccaaggccaucgccuccgcccuccacggccucugcgcccagauccucuccgagcgcgucgaggucuccggcgacgccuccugcugcucccccgaccccaucucccccgaggaccucccccgccaggucgagcuccucgacgccgucucccaggccgcccagaaguacgaggcccucuacaugggcacccuccccgucaccaaggccaugggcauggacguccucaacgaggccaucggcacccucaccgcccgcggcgaccgcaacgccuggguccccaccaugcucuccgucuccgacucccucaugaccgcccaccccauccaggccgaggccuccaccgaggaggagccccucuggcagugccccguccgccucgucaccuucaucggcgucggccgcgacccccacaccuucggccucaucgccgaccucggccgccaguccuuccagugcgccgccuucuggugccagccccacgccggcggccucuccgaggccguccaggccgccugcaugguccaguaccagaagugccucgucgccuccgccgcccgcggcaaggccuggggcgcccaggcccgcgcccgccuccgccucaagcgcaccuccuccauggacucccccggcggcccccucccccucccccuccucaagggcggcgucggcggcgccggcgccaccccccgcaagcgcggcgucuucuccuuccucgacgccuuccgccucaagcccucccuccuccacaugcccuga

SEQ ID NO: 39794 - RNA, 6984 nt, Artificial Sequence
  derived and/or modified sequence opt2 from APC2__Homo_sapiens__XP_005259532
augggccuccucggccuccucucccuccuccacuccgccuucuucggcgaccagacccuccaggagcucaagauggccuccuccgucgcccccuacgagcagcucguccgccaggucgaggcccucaaggccgagaacucccaccuccgccaggagcuccgcgacaacuccucccaccucuccaagcucgagaccgagaccuccggcaugaaggagguccucaagcaccuccagggcaagcucgagcaggaggcccgcguccucgucuccuccggccagaccgagguccucgagcagcucaaggcccuccagauggacaucaccucccucuacaaccucaaguuccagccccccacccucggccccgagcccgccgcccgcacccccgagggcucccccguccacggcuccggccccuccaaggacuccuucggcgagcucucccgcgccaccauccgccuccucgaggagcucgaccgcgagcgcugcuuccuccucaacgagaucgagaaggaggagaaggagaagcucugguacuacucccagcuccagggccucuccaagcgccucgacgagcucccccacgucgagacccaguucuccaugcagauggaccucauccgccagcagcucgaguucgaggcccagcacauccgcucccucauggaggagcgcuucggcaccuccgacgagaugguccagcgcgcccagauccgcgccucccgccucgagcagaucgacaaggagcuccucgaggcccaggaccgcguccagcagaccgagccccaggcccuccucgccgucaaguccguccccgucgacgaggaccccgagaccgagguccccacccaccccgaggacggcaccccccagcccggcaacuccaaggucgaggucgucuucuggcuccucuccaugcucgccacccgcgaccaggaggacaccgcccgcacccuccucgccauguccuccucccccgaguccugcgucgccaugcgccgcuccggcugccucccccuccuccuccagauccuccacggcaccgaggccgccgccggcggccgcgccggcgcccccggcgcccccggcgccaaggacgcccgcaugcgcgccaacgccgcccuccacaacaucgucuucucccagcccgaccagggccucgcccgcaaggagaugcgcguccuccacguccucgagcagauccgcgccuacugcgagaccugcugggacuggcuccaggcccgcgacggcggccccgagggcggcggcgccggcuccgcccccauccccaucgagccccagaucugccaggccaccugcgccgucaugaagcucuccuucgacgaggaguaccgccgcgccaugaacgagcucggcggccuccaggccgucgccgagcuccuccaggucgacuacgagaugcacaagaugacccgcgacccccucaaccucgcccuccgccgcuacgccggcaugacccucaccaaccucaccuucggcgacgucgccaacaaggccacccucugcgcccgccgcggcugcauggaggccaucgucgcccagcucgccuccgacuccgaggagcuccaccaggucgucuccuccauccuccgcaaccucuccuggcgcgccgacaucaacuccaagaagguccuccgcgaggccggcuccgucaccgcccucguccagugcguccuccgcgccaccaaggaguccacccucaaguccguccucuccgcccucuggaaccucuccgcccacuccaccgagaacaaggccgccaucugccaggucgacggcgcccucggcuuccucgucuccacccucaccuacaagugccaguccaacucccucgccaucaucgaguccggcggcggcauccuccgcaacgucuccucccucgucgccacccgcgaggacuaccgccagguccuccgcgaccacaacugccuccagacccuccuccagcaccucaccucccacucccucaccaucgucuccaacgccugcggcacccucuggaaccucuccgcccgcuccgcccgcgaccaggagcuccucugggaccucggcgccgucggcaugcuccgcaaccucguccacuccaagcacaagaugaucgccaugggcuccgccgccgcccuccgcaaccuccucgcccaccgccccgccaagcaccaggccgccgccaccgccgucucccccggcuccugcguccccucccucuacguccgcaagcagcgcgcccucgaggccgagcucgacgcccgccaccucgcccaggcccucgagcaccucgagaagcagggcccccccgccgccgaggccgccaccaagaagccccuccccccccuccgccaccucgacggccucgcccaggacuacgccuccgacuccggcugcuucgacgacgacgacgcccccuccucccucgccgccgccgccgccaccggcgagcccgccucccccgccgcccucucccucuuccucggcucccccuuccuccagggccaggcccucgcccgcaccccccccacccgccgcggcggcaaggaggccgagaaggacaccuccggcgaggccgccgucgccgccaaggccaaggccaagcucgcccucgccgucgcccgcaucgaccagcucgucgaggacaucuccgcccuccacaccuccuccgacgacuccuucucccucuccuccggcgaccccggccaggaggccccccgcgagggccgcgcccaguccugcucccccugccgcggccccgagggcggccgccgcgaggccggcucccgcgcccacccccuccuccgccucaaggccgcccacgccucccucuccaacgacucccucaacuccggcuccgccuccgacggcuacugcccccgcgagcacaugcuccccugcccccucgccgcccucgccucccgccgcgaggacccccgcugcggccagccccgccccucccgccucgaccucgaccuccccggcugccaggccgagccccccgcccgcgaggccaccuccgccgacgcccgcguccgcaccaucaagcucucccccaccuaccagcacgucccccuccucgagggcgccucccgcgccggcgccgagccccucgccggccccggcaucucccccggcgcccgcaagcaggccuggcuccccgccgaccaccucuccaagguccccgagaagcucgccgccgccccccucuccgucgccuccaaggcccuccagaagcucgccgcccaggagggcccccucucccucucccgcugcuccucccucuccucccucuccuccgccggccgccccggccccuccgagggcggcgaccucgacgacuccgacuccucccucgagggccucgaggaggccggccccuccgaggccgagcucgacuccaccuggcgcgcccccggcgccaccucccuccccgucgccauccccgccccccgccgcaaccgcggccgcggccucggcgucgaggacgccacccccuccuccuccuccgagaacuacguccaggagaccccccucguccucucccgcugcuccuccgucuccucccucggcuccuucgagucccccuccaucgccuccuccauccccuccgagcccugcuccggccagggcuccggcaccaucucccccuccgagcuccccgacucccccggccagaccaugccccccucccgcuccaagacccccccccucgcccccgccccccagggcccccccgaggccacccaguucucccuccagugggaguccuacgucaagcgcuuccucgacaucgccgacugccgcgagcgcugccgccuccccuccgagcucgacgccggcuccguccgcuucaccgucgagaagcccgacgagaacuucuccugcgccuccucccucuccgcccucgcccuccacgagcacuacguccagcaggacgucgagcuccgccuccuccccuccgccugccccgagcgcggcggcggcgccggcggcgccggccuccacuucgccggccaccgccgccgcgaggagggccccgcccccaccggcucccgcccccgcggcgccgccgaccaggagcucgagcuccuccgcgagugccucggcgccgccguccccgcccgccuccgcaaggucgccuccgcccucguccccggccgccgcgcccuccccguccccgucuacaugcucguccccgcccccgcccccgcccaggaggacgacuccugcaccgacuccgccgagggcacccccgucaacuucuccuccgccgccucccucuccgacgagacccuccagggccccccccgcgaccagcccggcggccccgccggccgccagcgccccaccggccgccccaccuccgcccgccaggccaugggccaccgccacaaggccggcggcgccggccgcuccgccgagcagucccgcggcgccggcaagaaccgcgccggccucgagcucccccucggccgcccccccuccgcccccgccgacaaggacggcuccaagcccggccgcacccgcggcgacggcgcccuccagucccucugccucaccacccccaccgaggaggccgucuacugcuucuacggcaacgacuccgacgaggagccccccgccgccgcccccacccccacccaccgccgcaccuccgccaucccccgcgccuucacccgcgagcgcccccagggccgcaaggaggcccccgcccccuccaaggccgcccccgccgcccccccccccgcccgcacccagcccucccucaucgccgacgagaccccccccugcuacucccucuccuccuccgccuccucccucuccgagcccgagcccuccgagccccccgccguccacccccgcggccgcgagcccgccgucaccaaggaccccggccccggcggcggccgcgacuccucccccuccccccgcgccgccgaggagcuccuccagcgcugcaucuccuccgcccucccccgccgccgcccccccgucuccggccuccgccgccgcaagccccgcgccacccgccucgacgagcgccccgccgagggcucccgcgagcgcggcgaggaggccgccggcuccgaccgcgccuccgaccucgacuccgucgaguggcgcgccauccaggagggcgccaacuccaucgucaccuggcuccaccaggccgccgccgccacccgcgaggccuccuccgaguccgacuccauccucuccuucgucuccggccucuccgucggcuccacccuccagccccccaagcaccgcaagggccgccaggccgagggcgagaugggcuccgcccgccgccccgagaagcgcggcgccgccuccgucaagaccuccggcuccccccgcucccccgccggccccgagaagccccgcggcacccagaagaccacccccggcguccccgccguccuccgcggccgcaccgucaucuacguccccucccccgccccccgcgcccagcccaagggcacccccggcccccgcgccaccccccgcaaggucgccccccccugccucgcccagcccgccgcccccgccaagguccccucccccggccagcagcgcucccgcucccuccaccgccccgccaagaccuccgagcucgccacccucucccagcccccccgcuccgccaccccccccgcccgccucgccaagacccccuccuccuccuccucccagaccucccccgccucccagccccucccccgcaagcgcccccccgucacccaggccgccggcgcccuccccggccccggcgccucccccguccccaagacccccgcccgcacccuccucgccaagcagcacaagacccagcgcucccccguccgcauccccuucaugcagcgccccgcccgccgcggcccccccccccucgcccgcgccguccccgagcccggcccccgcggccgcgccggcaccgaggccggccccggcgcccgcggcggccgccucggccucguccgcgucgccuccgcccucuccuccggcuccgaguccuccgaccgcuccggcuuccgccgccagcucaccuucaucaaggagucccccggccuccgccgccgccgcuccgagcucuccuccgccgaguccgccgccuccgccccccagggcgccuccccccgccgcggccgccccgcccuccccgccgucuuccucugcuccucccgcugcgaggagcuccgcgccgccccccgccagggccccgcccccgcccgccagcgcccccccgccgcccgccccucccccggcgagcgccccgcccgccgcaccaccuccgagucccccucccgccuccccguccgcgcccccgccgcccgccccgagaccgucaagcgcuacgccucccucccccacaucuccgucgcccgccgccccgacggcgccguccccgccgcccccgccuccgccgacgccgcccgccgcuccuccgacggcgagccccgcccccucccccgcgucgccgcccccggcaccaccuggcgccgcauccgcgacgaggacgucccccacauccuccgcuccacccuccccgccaccgcccucccccuccgcggcuccacccccgaggacgcccccgccggcccccccccccgcaagaccuccgacgccgucguccagaccgaggaggucgccgcccccaagaccaacuccuccaccucccccucccucgagacccgcgagccccccggcgcccccgccggcggccagcucucccuccucggcuccgacgucgacggccccucccucgccaaggcccccaucuccgcccccuucguccacgagggccucggcgucgccgucggcggcuuccccgccucccgccacggcucccccucccgcuccgcccgcgucccccccuucaacuacguccccucccccauggucgucgccgccaccaccgacuccgccgccgagaaggcccccgccaccgccuccgccacccuccucgaguga

SEQ ID NO: 39795 - RNA, 1545 nt, Artificial Sequence
  derived and/or modified sequence opt2 from APCDD1__Homo_sapiens__NP_694545
auguccuggccccgccgccuccuccuccgcuaccucuuccccgcccuccuccuccacggccucggcgagggcuccgcccuccuccaccccgacucccgcucccacccccgcucccucgagaaguccgccuggcgcgccuucaaggagucccagugccaccacaugcucaagcaccuccacaacggcgcccgcaucaccguccagaugccccccaccaucgagggccacugggucuccaccggcugcgagguccgcuccggccccgaguucaucacccgcuccuaccgcuucuaccacaacaacaccuucaaggccuaccaguucuacuacggcuccaaccgcugcaccaaccccaccuacacccucaucauccgcggcaagauccgccuccgccaggccuccuggaucauccgcggcggcaccgaggccgacuaccagcuccacaacguccaggucaucugccacaccgaggccgucgccgagaagcucggccagcaggucaaccgcaccugccccggcuuccucgccgacggcggccccuggguccaggacgucgccuacgaccucuggcgcgaggagaacggcugcgagugcaccaaggccgucaacuucgccaugcacgagcuccagcucauccgcgucgagaagcaguaccuccaccacaaccucgaccaccucgucgaggagcucuuccucggcgacauccacaccgacgccacccagcgcauguucuaccgccccuccuccuaccagcccccccuccagaacgccaagaaccacgaccacgccugcaucgccugccgcaucaucuaccgcuccgacgagcaccacccccccauccucccccccaaggccgaccucaccaucggccuccacggcgagugggucucccagcgcugcgagguccgccccgagguccucuuccucacccgccacuucaucuuccacgacaacaacaacaccugggagggccacuacuaccacuacuccgaccccgucugcaagcaccccaccuucuccaucuacgcccgcggccgcuacucccgcggcguccucuccucccgcgucaugggcggcaccgaguucgucuucaaggucaaccacaugaaggucacccccauggacgccgccaccgccucccuccucaacgucuucaacggcaacgagugcggcgccgagggcuccuggcaggucggcauccagcaggacgucacccacaccaacggcugcgucgcccucggcaucaagcucccccacaccgaguacgagaucuucaagauggagcaggacgcccgcggccgcuaccuccucuucaacggccagcgccccuccgacggcuccucccccgaccgccccgagaagcgcgccaccuccuaccagaugccccucguccagugcgccuccuccuccccccgcgccgaggaccucgccgaggacuccggcuccucccucuacggccgcgcccccggccgccacaccuggucccuccuccucgccgcccucgccugccucgucccccuccuccacuggaacauccgccgcuga

SEQ ID NO: 39796 - RNA, 1539 nt, Artificial Sequence
  derived and/or modified sequence opt2 from APCDD1L__Homo_sapiens__NP_001291716
auggccgagaacuccggccccggcguccgcccccccggcugggaggcccagaucaacaucaucuccacccgccucgcccucgcccacaccgcccccgccgccggcgaggccggcggcuccugccuccgcugggagccccacugccagcagccccuccccgaccgcguccccuccaccgccauccuccccccccgccucaacggccccuggaucuccaccggcugcgagguccgccccggccccgaguuccucacccgcgccuacaccuucuaccccucccgccucuuccgcgcccaccaguucuacuacgaggaccccuucugcggcgagcccgcccacucccuccucgucaagggcaagguccgccuccgccgcgccuccugggucacccgcggcgccaccgaggccgacuaccaccuccacaaggucggcaucgucuuccacucccgccgcgcccucgucgacgucaccggccgccucaaccagacccgcgccggccgcgacugcgcccgccgccucccccccgcccgcgccuggcuccccggcgcccucuacgagcuccgcuccgcccgcgcccagggcgacugccucgaggcccucggccucaccaugcacgagcucucccucguccgcguccagcgccgccuccagccccagccccgcgccuccccccgccucgucgaggagcucuaccucggcgacauccacaccgaccccgccgagcgccgccacuaccgccccaccggcuaccagcgcccccuccaguccgcccuccaccacguccagcccugccccgccugcggccucaucgcccgcuccgacguccaccacccccccguccucccccccccccucgcccucccccuccaccucggcggcuggugggucuccuccggcugcgagguccgccccgccguccucuuccucacccgccucuucaccuuccacggccacucccgcuccugggagggcuacuaccaccacuucuccgaccccgccugccgccagcccaccuucaccgucuacgccgccggccgcuacacccgcggcacccccuccacccgcguccgcggcggcaccgagcucgucuucgaggucacccgcgcccacgucacccccauggaccaggucaccaccgccaugcucaacuucuccgagcccuccuccugcggcggcgccggcgccugguccaugggcaccgagcgcgacgucaccgccaccaacggcugccucccccucggcauccgccucccccacgucgaguacgagcucuucaagauggagcaggacccccucggccagucccuccucuucaucggccagcgccccaccgacggcuccucccccgacacccccgagaagcgccccaccuccuaccaggccccccucguccucugccacggcgaggcccccgacuucucccgccccccccagcaccgccccucccuccagaagcaccccuccaccggcggccuccacaucgcccccuucccccuccucccccucguccucggccucgccuuccuccacuggcucuga

SEQ ID NO: 39797 - RNA, 8532 nt, Artificial Sequence
  derived and/or modified sequence opt2 from APC__Homo_sapiens__NP_001120982
auggccgccgccuccuacgaccagcuccucaagcaggucgaggcccucaagauggagaacuccaaccuccgccaggagcucgaggacaacuccaaccaccucaccaagcucgagaccgaggccuccaacaugaaggagguccucaagcagcuccagggcuccaucgaggacgaggccauggccuccuccggccagaucgaccuccucgagcgccucaaggagcucaaccucgacuccuccaacuuccccggcgucaagcuccgcuccaagaugucccuccgcuccuacggcucccgcgagggcuccgucuccucccgcuccggcgagugcucccccguccccaugggcuccuucccccgccgcggcuucgucaacggcucccgcgaguccaccggcuaccucgaggagcucgagaaggagcgcucccuccuccucgccgaccucgacaaggaggagaaggagaaggacugguacuacgcccagcuccagaaccucaccaagcgcaucgacucccucccccucaccgagaacuucucccuccagaccgacaugacccgccgccagcucgaguacgaggcccgccagauccgcgucgccauggaggagcagcucggcaccugccaggacauggagaagcgcgcccagcgccgcaucgcccgcauccagcagaucgagaaggacauccuccgcauccgccagcuccuccagucccaggccaccgaggccgagcgcuccucccagaacaagcacgagaccggcucccacgacgccgagcgccagaacgagggccagggcgucggcgagaucaacauggccaccuccggcaacggccagggcuccaccacccgcauggaccacgagaccgccuccguccucuccuccuccuccacccacuccgccccccgccgccucaccucccaccucggcaccaaggucgagauggucuacucccuccucuccaugcucggcacccacgacaaggacgacaugucccgcacccuccucgccauguccuccucccaggacuccugcaucuccaugcgccaguccggcugccucccccuccucauccagcuccuccacggcaacgacaaggacuccguccuccucggcaacucccgcggcuccaaggaggcccgcgcccgcgccuccgccgcccuccacaacaucauccacucccagcccgacgacaagcgcggccgccgcgagauccgcguccuccaccuccucgagcagauccgcgccuacugcgagaccugcugggaguggcaggaggcccacgagcccggcauggaccaggacaagaaccccaugcccgcccccgucgagcaccagaucugccccgccgucugcguccucaugaagcucuccuucgacgaggagcaccgccacgccaugaacgagcucggcggccuccaggccaucgccgagcuccuccaggucgacugcgagauguacggccucaccaacgaccacuacuccaucacccuccgccgcuacgccggcauggcccucaccaaccucaccuucggcgacgucgccaacaaggccacccucugcuccaugaagggcugcaugcgcgcccucgucgcccagcucaaguccgaguccgaggaccuccagcaggucaucgccuccguccuccgcaaccucuccuggcgcgccgacgucaacuccaagaagacccuccgcgaggucggcuccgucaaggcccucauggagugcgcccucgaggucaagaaggaguccacccucaaguccguccucuccgcccucuggaaccucuccgcccacugcaccgagaacaaggccgacaucugcgccgucgacggcgcccucgccuuccucgucggcacccucaccuaccgcucccagaccaacacccucgccaucaucgaguccggcggcggcauccuccgcaacgucuccucccucaucgccaccaacgaggaccaccgccagauccuccgcgagaacaacugccuccagacccuccuccagcaccucaagucccacucccucaccaucgucuccaacgccugcggcacccucuggaaccucuccgcccgcaaccccaaggaccaggaggcccucugggacaugggcgccgucuccaugcucaagaaccucauccacuccaagcacaagaugaucgccaugggcuccgccgccgcccuccgcaaccucauggccaaccgccccgccaaguacaaggacgccaacaucaugucccccggcuccucccuccccucccuccacguccgcaagcagaaggcccucgaggccgagcucgacgcccagcaccucuccgagaccuucgacaacaucgacaaccucucccccaaggccucccaccgcuccaagcagcgccacaagcagucccucuacggcgacuacgucuucgacaccaaccgccacgacgacaaccgcuccgacaacuucaacaccggcaacaugaccguccucucccccuaccucaacaccaccguccuccccuccuccuccuccucccgcggcucccucgacuccucccgcuccgagaaggaccgcucccucgagcgcgagcgcggcaucggccucggcaacuaccaccccgccaccgagaaccccggcaccuccuccaagcgcggccuccagaucuccaccaccgccgcccagaucgccaaggucauggaggaggucuccgccauccacaccucccaggaggaccgcuccuccggcuccaccaccgagcuccacugcgucaccgacgagcgcaacgcccuccgccgcuccuccgccgcccacacccacuccaacaccuacaacuucaccaaguccgagaacuccaaccgcaccugcuccaugcccuacgccaagcucgaguacaagcgcuccuccaacgacucccucaacuccgucuccuccuccgacggcuacggcaagcgcggccagaugaagcccuccaucgaguccuacuccgaggacgacgaguccaaguucugcuccuacggccaguaccccgccgaccucgcccacaagauccacuccgccaaccacauggacgacaacgacggcgagcucgacacccccaucaacuacucccucaaguacuccgacgagcagcucaacuccggccgccagucccccucccagaacgagcgcugggcccgccccaagcacaucaucgaggacgagaucaagcaguccgagcagcgccagucccgcaaccaguccaccaccuaccccgucuacaccgaguccaccgacgacaagcaccucaaguuccagccccacuucggccagcaggagugcgucucccccuaccgcucccgcggcgccaacggcuccgagaccaaccgcgucggcuccaaccacggcaucaaccagaacgucucccagucccucugccaggaggacgacuacgaggacgacaagcccaccaacuacuccgagcgcuacuccgaggaggagcagcacgaggaggaggagcgccccaccaacuacuccaucaaguacaacgaggagaagcgccacgucgaccagcccaucgacuacucccucaaguacgccaccgacauccccuccucccagaagcaguccuucuccuucuccaaguccuccuccggccaguccuccaagaccgagcacauguccuccuccuccgagaacaccuccacccccuccuccaacgccaagcgccagaaccagcuccaccccuccuccgcccagucccgcuccggccagccccagaaggccgccaccugcaaggucuccuccaucaaccaggagaccauccagaccuacugcgucgaggacacccccaucugcuucucccgcugcuccucccucuccucccucuccuccgccgaggacgagaucggcugcaaccagaccacccaggaggccgacuccgccaacacccuccagaucgccgagaucaaggagaagaucggcacccgcuccgccgaggaccccgucuccgagguccccgccgucucccagcacccccgcaccaaguccucccgccuccagggcuccucccucuccuccgaguccgcccgccacaaggccgucgaguucuccuccggcgccaagucccccuccaaguccggcgcccagacccccaaguccccccccgagcacuacguccaggagaccccccucauguucucccgcugcaccuccgucuccucccucgacuccuucgagucccgcuccaucgccuccuccguccaguccgagcccugcuccggcauggucuccggcaucaucucccccuccgaccuccccgacucccccggccagaccaugccccccucccgcuccaagaccccccccccccccccccagaccgcccagaccaagcgcgagguccccaagaacaaggcccccaccgccgagaagcgcgaguccggccccaagcaggccgccgucaacgccgccguccagcgcguccagguccuccccgacgccgacacccuccuccacuucgccaccgaguccacccccgacggcuucuccugcuccuccucccucuccgcccucucccucgacgagcccuucauccagaaggacgucgagcuccgcaucaugccccccguccaggagaacgacaacggcaacgagaccgaguccgagcagcccaaggaguccaacgagaaccaggagaaggaggccgagaagaccaucgacuccgagaaggaccuccucgacgacuccgacgacgacgacaucgagauccucgaggagugcaucaucuccgccaugcccaccaaguccucccgcaaggccaagaagcccgcccagaccgccuccaagcuccccccccccgucgcccgcaagcccucccagcuccccgucuacaagcuccuccccucccagaaccgccuccagccccagaagcacgucuccuucacccccggcgacgacaugccccgcgucuacugcgucgagggcacccccaucaacuucuccaccgccaccucccucuccgaccucaccaucgaguccccccccaacgagcucgccgccggcgagggcguccgcggcggcgcccaguccggcgaguucgagaagcgcgacaccauccccaccgagggccgcuccaccgacgaggcccagggcggcaagaccuccuccgucaccauccccgagcucgacgacaacaaggccgaggagggcgacauccucgccgagugcaucaacuccgccaugcccaagggcaagucccacaagcccuuccgcgucaagaagaucauggaccagguccagcaggccuccgccuccuccuccgcccccaacaagaaccagcucgacggcaagaagaagaagcccaccucccccgucaagcccaucccccagaacaccgaguaccgcacccgcguccgcaagaacgccgacuccaagaacaaccucaacgccgagcgcgucuucuccgacaacaaggacuccaagaagcagaaccucaagaacaacuccaaggucuucaacgacaagcuccccaacaacgaggaccgcguccgcggcuccuucgccuucgacuccccccaccacuacacccccaucgagggcacccccuacugcuucucccgcaacgacucccucuccucccucgacuucgacgacgacgacgucgaccucucccgcgagaaggccgagcuccgcaaggccaaggagaacaaggaguccgaggccaaggucaccucccacaccgagcucaccuccaaccagcaguccgccaacaagacccaggccaucgccaagcagcccaucaaccgcggccagcccaagcccauccuccagaagcaguccaccuucccccaguccuccaaggacauccccgaccgcggcgccgccaccgacgagaagcuccagaacuucgccaucgagaacacccccgucugcuucucccacaacuccucccucuccucccucuccgacaucgaccaggagaacaacaacaaggagaacgagcccaucaaggagaccgagccccccgacucccagggcgagcccuccaagccccaggccuccggcuacgcccccaaguccuuccacgucgaggacacccccgucugcuucucccgcaacuccucccucuccucccucuccaucgacuccgaggacgaccuccuccaggagugcaucuccuccgccaugcccaagaagaagaagcccucccgccucaagggcgacaacgagaagcacuccccccgcaacaugggcggcauccucggcgaggaccucacccucgaccucaaggacauccagcgccccgacuccgagcacggccucucccccgacuccgagaacuucgacuggaaggccauccaggagggcgccaacuccaucgucuccucccuccaccaggccgccgccgccgccugccucucccgccaggccuccuccgacuccgacuccauccucucccucaaguccggcaucucccucggcucccccuuccaccucacccccgaccaggaggagaagcccuucaccuccaacaagggcccccgcauccucaagcccggcgagaaguccacccucgagaccaagaagaucgaguccgaguccaagggcaucaagggcggcaagaaggucuacaagucccucaucaccggcaagguccgcuccaacuccgagaucuccggccagaugaagcagccccuccaggccaacaugcccuccaucucccgcggccgcaccaugauccacauccccggcguccgcaacuccuccuccuccaccucccccgucuccaagaagggccccccccucaagacccccgccuccaagucccccuccgagggccagaccgccaccaccuccccccgcggcgccaagcccuccgucaaguccgagcucucccccgucgcccgccagaccucccagaucggcggcuccuccaaggcccccucccgcuccggcucccgcgacuccacccccucccgccccgcccagcagccccucucccgccccauccagucccccggccgcaacuccaucucccccggccgcaacggcaucuccccccccaacaagcucucccagcucccccgcaccuccucccccuccaccgccuccaccaaguccuccggcuccggcaagauguccuacaccucccccggccgccagaugucccagcagaaccucaccaagcagaccggccucuccaagaacgccuccuccaucccccgcuccgaguccgccuccaagggccucaaccagaugaacaacggcaacggcgccaacaagaaggucgagcucucccgcauguccuccaccaaguccuccggcuccgaguccgaccgcuccgagcgccccguccucguccgccaguccaccuucaucaaggaggcccccucccccacccuccgccgcaagcucgaggaguccgccuccuucgagucccucucccccuccucccgccccgccucccccacccgcucccaggcccagacccccguccucucccccucccuccccgacaugucccucuccacccacuccuccguccaggccggcggcuggcgcaagcucccccccaaccucucccccaccaucgaguacaacgacggccgccccgccaagcgccacgacaucgcccgcucccacuccgagucccccucccgccuccccaucaaccgcuccggcaccuggaagcgcgagcacuccaagcacuccuccucccucccccgcgucuccaccuggcgccgcaccggcuccuccuccuccauccucuccgccuccuccgaguccuccgagaaggccaaguccgaggacgagaagcacgucaacuccaucuccggcaccaagcaguccaaggagaaccaggucuccgccaagggcaccuggcgcaagaucaaggagaacgaguucucccccaccaacuccaccucccagaccgucuccuccggcgccaccaacggcgccgaguccaagacccucaucuaccagauggcccccgccgucuccaagaccgaggacgucuggguccgcaucgaggacugccccaucaacaacccccgcuccggccgcucccccaccggcaacaccccccccgucaucgacuccgucuccgagaaggccaaccccaacaucaaggacuccaaggacaaccaggccaagcagaacgucggcaacggcuccguccccaugcgcaccgucggccucgagaaccgccucaacuccuucauccaggucgacgcccccgaccagaagggcaccgagaucaagcccggccagaacaaccccguccccgucuccgagaccaacgaguccuccaucgucgagcgcacccccuucuccuccuccuccuccuccaagcacuccucccccuccggcaccgucgccgcccgcgucacccccuucaacuacaaccccuccccccgcaaguccuccgccgacuccaccuccgcccgccccucccagauccccacccccgucaacaacaacaccaagaagcgcgacuccaagaccgacuccaccgaguccuccggcacccagucccccaagcgccacuccggcuccuaccucgucaccuccgucuga

SEQ ID NO: 39798 - RNA, 672 nt, Artificial Sequence
  derived and/or modified sequence opt2 from APCS__Homo_sapiens__NP_001630
augaacaagccccuccucuggaucuccguccucaccucccuccucgaggccuucgcccacaccgaccucuccggcaaggucuucgucuucccccgcgaguccgucaccgaccacgucaaccucaucaccccccucgagaagccccuccagaacuucacccucugcuuccgcgccuacuccgaccucucccgcgccuacucccucuucuccuacaacacccagggccgcgacaacgagcuccucgucuacaaggagcgcgucggcgaguacucccucuacaucggccgccacaaggucaccuccaaggucaucgagaaguuccccgcccccguccacaucugcgucuccugggaguccuccuccggcaucgccgaguucuggaucaacggcaccccccucgucaagaagggccuccgccagggcuacuucgucgaggcccagcccaagaucguccucggccaggagcaggacuccuacggcggcaaguucgaccgcucccaguccuucgucggcgagaucggcgaccucuacaugugggacuccguccucccccccgagaacauccucuccgccuaccagggcaccccccuccccgccaacauccucgacuggcaggcccucaacuacgagauccgcggcuacgucaucaucaagccccucgucugggucuga

SEQ ID NO: 39799 - RNA, 2199 nt, Artificial Sequence
  derived and/or modified sequence opt2 from APEH__Homo_sapiens__NP_001631
auggagcgccagguccuccucuccgagcccgaggaggccgccgcccucuaccgcggccucucccgccagcccgcccucuccgccgccugccucggccccgaggucaccacccaguacggcggccaguaccgcaccguccacaccgaguggacccagcgcgaccucgagcgcauggagaacauccgcuucugccgccaguaccucgucuuccacgacggcgacuccgucgucuucgccggccccgccggcaacuccgucgagacccgcggcgagcuccucucccgcgagucccccuccggcaccaugaaggccguccuccgcaaggccggcggcaccggccccggcgaggagaagcaguuccucgaggucugggagaagaaccgcaagcucaaguccuucaaccucuccgcccucgagaagcacggccccgucuacgaggacgacugcuucggcugccucuccuggucccacuccgagacccaccuccucuacgucgccgagaagaagcgccccaaggccgaguccuucuuccagaccaaggcccucgacgucuccgccuccgacgacgagaucgcccgccucaagaagcccgaccaggccaucaagggcgaccaguucgucuucuacgaggacuggggcgagaacauggucuccaaguccauccccguccucugcguccucgacgucgaguccggcaacaucuccguccucgagggcguccccgagaacgucucccccggccaggccuucugggcccccggcgacgccggcgucgucuucgucggcugguggcacgagcccuuccgccucggcauccgcuucugcaccaaccgccgcuccgcccucuacuacgucgaccucaucggcggcaagugcgagcuccucuccgacgacucccucgccgucuccuccccccgccucucccccgaccagugccgcaucgucuaccuccaguaccccucccucaucccccaccaccagugcucccagcucugccucuacgacugguacaccaaggucaccuccgucgucgucgacgucgucccccgccagcucggcgagaacuucuccggcaucuacugcucccuccucccccucggcugcugguccgccgacucccagcgcgucgucuucgacuccgcccagcgcucccgccaggaccucuucgccgucgacacccaggucggcaccgucaccucccucaccgccggcggcuccggcggcuccuggaagcuccucaccaucgaccaggaccucauggucgcccaguucuccacccccucccucccccccacccucaaggucggcuuccuccccuccgccggcaaggagcaguccguccucugggucucccucgaggaggccgagcccauccccgacauccacuggggcauccgcguccuccagcccccccccgagcaggagaacguccaguacgccggccucgacuucgaggccauccuccuccagcccggcuccccccccgacaagacccagguccccauggucgucaugccccacggcggcccccacuccuccuucgucaccgccuggaugcucuuccccgccaugcucugcaagaugggcuucgccguccuccucgucaacuaccgcggcuccaccggcuucggccaggacuccauccucucccuccccggcaacgucggccaccaggacgucaaggacguccaguucgccgucgagcagguccuccaggaggagcacuucgacgccucccacgucgcccucaugggcggcucccacggcggcuucaucuccugccaccucaucggccaguaccccgagaccuaccgcgccugcgucgcccgcaaccccgucaucaacaucgccuccaugcucggcuccaccgacauccccgacuggugcgucgucgaggccggcuuccccuucuccuccgacugccuccccgaccucuccgucugggccgagaugcucgacaagucccccauccgcuacaucccccaggucaagaccccccuccuccucaugcucggccaggaggaccgccgcguccccuucaagcagggcauggaguacuaccgcgcccucaagacccgcaacguccccguccgccuccuccucuaccccaaguccacccacgcccucuccgaggucgaggucgaguccgacuccuucaugaacgccguccucuggcuccgcacccaccucggcuccuga

SEQ ID NO: 39800 - RNA, 957 nt, Artificial Sequence
  derived and/or modified sequence opt2 from APEX1__Homo_sapiens__XP_005267638
augcccaagcgcggcaagaagggcgccgucgccgaggacggcgacgagcuccgcaccgagcccgaggccaagaaguccaagaccgccgccaagaagaacgacaaggaggccgccggcgagggccccgcccucuacgaggacccccccgaccagaagaccucccccuccggcaagcccgccacccucaagaucugcuccuggaacgucgacggccuccgcgccuggaucaagaagaagggccucgacugggucaaggaggaggcccccgacauccucugccuccaggagaccaagugcuccgagaacaagcuccccgccgagcuccaggagcuccccggccucucccaccaguacugguccgcccccuccgacaaggagggcuacuccggcgucggccuccucucccgccagugcccccucaaggucuccuacggcaucggcgacgaggagcacgaccaggagggccgcgucaucgucgccgaguucgacuccuucguccucgucaccgccuacguccccaacgccggccgcggccucguccgccucgaguaccgccagcgcugggacgaggccuuccgcaaguuccucaagggccucgccucccgcaagccccucguccucugcggcgaccucaacgucgcccacgaggagaucgaccuccgcaaccccaagggcaacaagaagaacgccggcuucaccccccaggagcgccagggcuucggcgagcuccuccaggccgucccccucgccgacuccuuccgccaccucuaccccaacacccccuacgccuacaccuucuggaccuacaugaugaacgcccgcuccaagaacgucggcuggcgccucgacuacuuccuccucucccacucccuccuccccgcccucugcgacuccaagauccgcuccaaggcccucggcuccgaccacugccccaucacccucuaccucgcccucuga

SEQ ID NO: 39801 - RNA, 1557 nt, Artificial Sequence
  derived and/or modified sequence opt2 from APEX2__Homo_sapiens__NP_055296
augcuccgcgucgucuccuggaacaucaacggcauccgccgcccccuccagggcgucgccaaccaggagcccuccaacugcgccgccgucgccgucggccgcauccucgacgagcucgacgccgacaucgucugccuccaggagaccaaggucacccgcgacgcccucaccgagccccucgccaucgucgagggcuacaacuccuacuucuccuucucccgcaaccgcuccggcuacuccggcgucgccaccuucugcaaggacaacgccacccccgucgccgccgaggagggccucuccggccucuucgccacccagaacggcgacgucggcugcuacggcaacauggacgaguucacccaggaggagcuccgcgcccucgacuccgagggccgcgcccuccucacccagcacaagauccgcaccugggagggcaaggagaagacccucacccucaucaacgucuacugcccccacgccgaccccggccgccccgagcgccucgucuucaagaugcgcuucuaccgccuccuccagauccgcgccgaggcccuccucgccgccggcucccacgucaucauccucggcgaccucaacaccgcccaccgccccaucgaccacugggacgccgucaaccucgagugcuucgaggaggaccccggccgcaaguggauggacucccuccucuccaaccucggcugccaguccgccucccacgucggccccuucaucgacuccuaccgcugcuuccagcccaagcaggagggcgccuucaccugcugguccgccgucaccggcgcccgccaccucaacuacggcucccgccucgacuacguccucggcgaccgcacccucgucaucgacaccuuccaggccuccuuccuccuccccgaggucaugggcuccgaccacugccccgucggcgccguccucuccgucuccuccguccccgccaagcagugccccccccucugcacccgcuuccuccccgaguucgccggcacccagcucaagauccuccgcuuccucgucccccucgagcagucccccguccucgagcaguccacccuccagcacaacaaccagacccgcguccagaccugccagaacaaggcccagguccgcuccacccgcccccagcccucccaggucggcuccucccgcggccagaagaaccucaaguccuacuuccagcccucccccuccugcccccaggccucccccgacaucgagcuccccucccucccccucauguccgcccucaugacccccaagacccccgaggagaaggccgucgccaaggucgucaagggccaggccaagaccuccgaggccaaggacgagaaggagcuccgcaccuccuucuggaaguccguccucgccggcccccuccgcaccccccucugcggcggccaccgcgagcccugcgucaugcgcaccgucaagaagcccggccccaaccucggccgccgcuucuacaugugcgcccgcccccgcggcccccccaccgaccccuccucccgcugcaacuucuuccucuggucccgccccuccuga

SEQ ID NO: 39802 - RNA, 651 nt, Artificial Sequence
  derived and/or modified sequence opt2 from APH1B__Homo_sapiens__NP_001139118
augaccgccgccgucuucuucggcugcgccuucaucgccuucggccccgcccucgcccucuacgucuucaccaucgccaccgagccccuccgcaucaucuuccucaucgccggcgccuucuucuggcucgucucccuccucaucuccucccucgucugguucauggcccgcgucaucaucgacaacaaggacggccccacccagaaguaccuccucaucuucggcgccuucgucuccgucuacauccaggagauguuccgcuucgccuacuacaagcuccucaagaaggccuccgagggccucaaguccaucaaccccggcgagaccgcccccuccaugcgccuccucgccuacgccuucaugacccucgucaucauccuccuccacgucuucuggggcaucgucuucuucgacggcugcgagaagaagaaguggggcauccuccucaucguccuccucacccaccuccucgucuccgcccagaccuucaucuccuccuacuacggcaucaaccucgccuccgccuucaucauccucguccucaugggcaccugggccuuccucgccgccggcggcuccugccgcucccucaagcucugccuccucugccaggacaagaacuuccuccucuacaaccagcgcucccgcuga

SEQ ID NO: 39803 - RNA, 1575 nt, Artificial Sequence
  derived and/or modified sequence opt2 from API5__Homo_sapiens__NP_001136402
augcccaccgucgaggagcucuaccgcaacuacggcauccucgccgacgccaccgagcaggucggccagcacaaggacgccuaccaggucauccucgacggcgucaagggcggcaccaaggagaagcgccucgccgcccaguucauccccaaguucuucaagcacuuccccgagcucgccgacuccgccaucaacgcccagcucgaccucugcgaggacgaggacgucuccauccgccgccaggccaucaaggagcucccccaguucgccaccggcgagaaccucccccgcgucgccgacauccucacccagcuccuccagaccgacgacuccgccgaguucaaccucgucaacaacgcccuccucuccaucuucaagauggacgccaagggcacccucggcggccucuucucccagauccuccagggcgaggacaucguccgcgagcgcgccaucaaguuccucuccaccaagcucaagacccuccccgacgagguccucaccaaggaggucgaggagcucauccucaccgaguccaagaagguccucgaggacgucaccggcgaggaguucguccucuucaugaagauccucuccggccucaagucccuccagaccgucuccggccgccagcagcucgucgagcucgucgccgagcaggccgaccucgagcagaccuucaaccccuccgaccccgacugcgucgaccgccuccuccagugcacccgccaggccgucccccucuucuccaagaacguccacuccacccgcuucgucaccuacuucugcgagcagguccuccccaaccucggcacccucaccacccccgucgagggccucgacauccagcucgagguccucaagcuccucgccgagauguccuccuucugcggcgacauggagaagcucgagaccaaccuccgcaagcucuucgacaagcuccucgaguacaugccccucccccccgaggaggccgagaacggcgagaacgccggcaacgaggagcccaagcuccaguucuccuacgucgagugccuccucuacuccuuccaccagcucggccgcaagcuccccgacuuccucaccgccaagcucaacgccgagaagcucaaggacuucaagauccgccuccaguacuucgcccgcggccuccaggucuacauccgccagcuccgccucgcccuccagggcaagaccggcgaggcccucaagaccgaggagaacaagaucaaggucgucgcccucaagaucaccaacaacaucaacguccucaucaaggaccucuuccacaucccccccuccuacaaguccaccgucacccucuccuggaagcccguccagaaggucgagaucggccagaagcgcgccuccgaggacaccaccuccggcuccccccccaagaaguccuccgccggccccaagcgcgacgcccgccagaucuacaacccccccuccggcaaguacuccuccaaccucggcaacuucaacuacgagcagcgcggcgccuuccgcggcucccgcggcggccgcggcuggggcacccgcggcaaccgcucccgcggccgccucuacuga

SEQ ID NO: 39804 - RNA, 729 nt, Artificial Sequence
  derived and/or modified sequence opt2 from APIP__Homo_sapiens__NP_057041
auguccggcugcgacgcccgcgagggcgacugcugcucccgccgcugcggcgcccaggacaaggagcacccccgcuaccucauccccgagcucugcaagcaguucuaccaccucggcugggucaccggcaccggcggcggcaucucccucaagcacggcgacgagaucuacaucgcccccuccggcguccagaaggagcgcauccagcccgaggacauguucgucugcgacaucaacgagaaggacaucuccggccccucccccuccaagaagcucaagaagucccagugcaccccccucuucaugaacgccuacaccaugcgcggcgccggcgccgucauccacacccacuccaaggccgccgucauggccacccuccucuuccccggccgcgaguucaagaucacccaccaggagaugaucaagggcaucaagaagugcaccuccggcggcuacuaccgcuacgacgacaugcucgucguccccaucaucgagaacacccccgaggagaaggaccucaaggaccgcauggcccacgccaugaacgaguaccccgacuccugcgccguccucguccgccgccacggcgucuacgucuggggcgagaccugggagaaggccaagaccaugugcgagugcuacgacuaccucuucgacaucgccgucuccaugaagaaggucggccucgaccccucccagcuccccgucggcgagaacggcaucgucuga

SEQ ID NO: 39805 - RNA, 234 nt, Artificial Sequence
  derived and/or modified sequence opt2 from APLN__Homo_sapiens__NP_059109
augaaccuccgccucugcguccaggcccuccuccuccucuggcucucccucaccgccgucugcggcggcucccucaugccccuccccgacggcaacggccucgaggacggcaacguccgccaccucguccagccccgcggcucccgcaacggccccggccccuggcagggcggccgccgcaaguuccgccgccagcgcccccgccucucccacaagggccccaugcccuucuga

SEQ ID NO: 39806 - RNA, 1143 nt, Artificial Sequence
  derived and/or modified sequence opt2 from APLNR__Homo_sapiens__NP_005152
auggaggagggcggcgacuucgacaacuacuacggcgccgacaaccaguccgagugcgaguacaccgacuggaaguccuccggcgcccucauccccgccaucuacaugcucgucuuccuccucggcaccaccggcaacggccucguccucuggaccgucuuccgcuccucccgcgagaagcgccgcuccgccgacaucuucaucgccucccucgccgucgccgaccucaccuucgucgucacccucccccucugggccaccuacaccuaccgcgacuacgacuggcccuucggcaccuucuucugcaagcucuccuccuaccucaucuucgucaacauguacgccuccgucuucugccucaccggccucuccuucgaccgcuaccucgccaucguccgccccgucgccaacgcccgccuccgccuccgcgucuccggcgccgucgccaccgccguccucuggguccucgccgcccuccucgccaugcccgucaugguccuccgcaccaccggcgaccucgagaacaccaccaagguccagugcuacauggacuacuccauggucgccaccgucuccuccgagugggccugggaggucggccucggcgucuccuccaccaccgucggcuucgucguccccuucaccaucaugcucaccugcuacuucuucaucgcccagaccaucgccggccacuuccgcaaggagcgcaucgagggccuccgcaagcgccgccgccuccucuccaucaucgucguccucgucgucaccuucgcccucugcuggaugcccuaccaccucgucaagacccucuacaugcucggcucccuccuccacuggcccugcgacuucgaccucuuccucaugaacaucuuccccuacugcaccugcaucuccuacgucaacuccugccucaaccccuuccucuacgccuucuucgacccccgcuuccgccaggccugcaccuccaugcucugcugcggccagucccgcugcgccggcaccucccacuccuccuccggcgagaaguccgccuccuacuccuccggccacucccagggccccggccccaacaugggcaagggcggcgagcagaugcacgagaaguccauccccuacucccaggagacccucgucgucgacuga

SEQ ID NO: 39807 - RNA, 1956 nt, Artificial Sequence
  derived and/or modified sequence opt2 from APLP1__Homo_sapiens__NP_001019978
augggccccgccucccccgccgcccgcggccucucccgccgccccggccagcccccccucccccuccuccucccccuccuccuccuccuccuccgcgcccagcccgccaucggcucccucgccggcggcucccccggcgccgccgaggcccccggcuccgcccaggucgccggccucugcggccgccucacccuccaccgcgaccuccgcaccggccgcugggagcccgacccccagcgcucccgccgcugccuccgcgacccccagcgcguccucgaguacugccgccagauguaccccgagcuccagaucgcccgcgucgagcaggccacccaggccauccccauggagcgcuggugcggcggcucccgcuccggcuccugcgcccacccccaccaccaggucguccccuuccgcugccuccccggcgaguucgucuccgaggcccuccucguccccgagggcugccgcuuccuccaccaggagcgcauggaccagugcgaguccuccacccgccgccaccaggaggcccaggaggccugcuccucccagggccucauccuccacggcuccggcaugcuccuccccugcggcuccgaccgcuuccgcggcgucgaguacgucugcugccccccccccggcacccccgaccccuccggcaccgccgucggcgaccccuccacccgcuccuggccccccggcucccgcgucgagggcgccgaggacgaggaggaggaggaguccuucccccagcccgucgacgacuacuucgucgagcccccccaggccgaggaggaggaggagaccguccccccccccuccucccacacccucgccgucgucggcaaggucacccccaccccccgccccaccgacggcgucgacaucuacuucggcaugcccggcgagaucuccgagcacgagggcuuccuccgcgccaagauggaccucgaggagcgccgcaugcgccagaucaacgaggucaugcgcgagugggccauggccgacaaccaguccaagaaccuccccaaggccgaccgccaggcccucaacgagcacuuccaguccauccuccagacccucgaggagcaggucuccggcgagcgccagcgccucgucgagacccacgccacccgcgucaucgcccucaucaacgaccagcgccgcgccgcccucgagggcuuccucgccgcccuccaggccgaccccccccaggccgagcgcguccuccucgcccuccgccgcuaccuccgcgccgagcagaaggagcagcgccacacccuccgccacuaccagcacgucgccgccgucgaccccgagaaggcccagcagaugcgcuuccagguccacacccaccuccaggucaucgaggagcgcgucaaccagucccucggccuccucgaccagaacccccaccucgcccaggagcuccgcccccagauccaggagcuccuccacuccgagcaccucggccccuccgagcucgaggcccccgcccccggcggcuccuccgaggacaagggcggccuccagccccccgacuccaaggacgccgacacccccaugacccuccccaagggcuccaccgagcaggacgccgccucccccgagaaggagaagaugaacccccucgagcaguacgagcgcaaggucaacgccuccgucccccgcggcuuccccuuccacuccuccgagauccagcgcgacgagcucgcccccgccggcaccggcgucucccgcgaggccgucuccggccuccucaucaugggcgccggcggcggcucccucaucguccucuccaugcuccuccuccgccgcaagaagcccuacggcgccaucucccacggcgucgucgaggucgaccccaugcucacccucgaggagcagcagcuccgcgagcuccagcgccacggcuacgagaaccccaccuaccgcuuccucgaggagcgccccuga

SEQ ID NO: 39808 - RNA, 2256 nt, Artificial Sequence
  derived and/or modified sequence opt2 from APLP2__Homo_sapiens__NP_001135748
auggccgccaccggcaccgccgccgccgccgccaccggccgccuccuccuccuccuccucgucggccucaccgcccccgcccucgcccucgccggcuacaucgaggcccucgccgccaacgccggcaccggcuucgccgucgccgagccccagaucgccauguucugcggcaagcucaacaugcacgucaacauccagaccggcaagugggagcccgaccccaccggcaccaaguccugcuucgagaccaaggaggagguccuccaguacugccaggagauguaccccgagcuccagaucaccaacgucauggaggccaaccagcgcgucuccaucgacaacuggugccgccgcgacaagaagcagugcaagucccgcuucgucacccccuucaagugccucgucggcgaguucgucuccgacguccuccucguccccgagaagugccaguucuuccacaaggagcgcauggaggucugcgagaaccaccagcacuggcacaccgucgucaaggaggccugccucacccagggcaugacccucuacuccuacggcaugcuccuccccugcggcgucgaccaguuccacggcaccgaguacgucugcugcccccagaccaagaucaucggcuccgucuccaaggaggaggaggaggaggacgaggaggaggaggaggaggaggacgaggaggaggacuacgacgucuacaaguccgaguuccccaccgaggccgaccucgaggacuucaccgaggccgccgucgacgaggacgacgaggacgaggaggagggcgaggaggucgucgaggaccgcgacuacuacuacgacaccuucaagggcgacgacuacaacgaggagaaccccaccgagcccggcuccgacggcaccauguccgacaaggagaucacccacgacgucaaggccgucugcucccaggaggccaugaccggccccugccgcgccgucaugccccgcugguacuucgaccucuccaagggcaagugcguccgcuucaucuacggcggcugcggcggcaaccgcaacaacuucgaguccgaggacuacugcauggccgucugcaaggccaugaucccccccaccccccuccccaccaacgacgucgacgucuacuucgagaccuccgccgacgacaacgagcacgcccgcuuccagaaggccaaggagcagcucgagauccgccaccgcaaccgcauggaccgcgucaagaaggagugggaggaggccgagcuccaggccaagaaccuccccaaggccgagcgccagacccucauccagcacuuccaggccauggucaaggcccucgagaaggaggccgccuccgagaagcagcagcucgucgagacccaccucgcccgcgucgaggccaugcucaacgaccgccgccgcauggcccucgagaacuaccucgccgcccuccaguccgaccccccccgcccccaccgcauccuccaggcccuccgccgcuacguccgcgccgagaacaaggaccgccuccacaccauccgccacuaccagcacguccucgccgucgaccccgagaaggccgcccagaugaagucccaggucaugacccaccuccacgucaucgaggagcgccgcaaccagucccucucccuccucuacaagguccccuacgucgcccaggagauccaggaggagaucgacgagcuccuccaggagcagcgcgccgacauggaccaguucaccgccuccaucuccgagacccccgucgacguccgcgucuccuccgaggaguccgaggagaucccccccuuccaccccuuccaccccuuccccgcccuccccgagaacgagggcuccggcgucggcgagcaggacggcggccucaucggcgccgaggagaaggucaucaacuccaagaacaaggucgacgagaacauggucaucgacgagacccucgacgucaaggagaugaucuucaacgccgagcgcgucggcggccucgaggaggagcgcgaguccgucggcccccuccgcgaggacuucucccucuccuccuccgcccucaucggccuccucgucaucgccgucgccaucgccaccgucaucgucaucucccucgucaugcuccgcaagcgccaguacggcaccaucucccacggcaucgucgaggucgaccccaugcucacccccgaggagcgccaccucaacaagaugcagaaccacggcuacgagaaccccaccuacaaguaccucgagcagaugcagaucuga

SEQ ID NO: 39809 - RNA, 867 nt, Artificial Sequence
  derived and/or modified sequence opt2 from APOA1BP__Homo_sapiens__NP_658985
augucccgccuccgcgcccuccucggccucggccuccucgucgccggcucccgcgucccccgcaucaagucccagaccaucgccugccgcuccggccccaccugguggggcccccagcgccucaacuccggcggccgcugggacuccgaggucauggccuccaccgucgucaaguaccucucccaggaggaggcccaggccgucgaccaggagcucuucaacgaguaccaguucuccgucgaccagcucauggagcucgccggccucuccugcgccaccgccaucgccaaggccuacccccccaccuccaugucccgcuccccccccaccguccucgucaucugcggccccggcaacaacggcggcgacggccucgucugcgcccgccaccucaagcucuucggcuacgagcccaccaucuacuaccccaagcgccccaacaagccccucuucaccgcccucgucacccagugccagaagauggacauccccuuccucggcgagaugcccgccgagcccaugaccaucgacgagcucuacgagcucgucgucgacgccaucuucggcuucuccuucaagggcgacguccgcgagcccuuccacuccauccucuccguccucaagggccucaccguccccaucgccuccaucgacauccccuccggcugggacgucgagaagggcaacgccggcggcauccagcccgaccuccucaucucccucaccgcccccaagaaguccgccacccaguucaccggccgcuaccacuaccucggcggccgcuucgucccccccgcccucgagaagaaguaccagcucaaccucccccccuaccccgacaccgagugcgucuaccgccuccaguga

SEQ ID NO: 39810 - RNA, 303 nt, Artificial Sequence
  derived and/or modified sequence opt2 from APOA2__Homo_sapiens__NP_001634
augaagcuccucgccgccaccguccuccuccucaccaucugcucccucgagggcgcccucguccgccgccaggccaaggagcccugcgucgagucccucgucucccaguacuuccagaccgucaccgacuacggcaaggaccucauggagaaggucaagucccccgagcuccaggccgaggccaaguccuacuucgagaaguccaaggagcagcucaccccccucaucaagaaggccggcaccgagcucgucaacuuccucuccuacuucgucgagcucggcacccagcccgccacccaguga

SEQ ID NO: 39811 - RNA, 1191 nt, Artificial Sequence
  derived and/or modified sequence opt2 from APOA4__Homo_sapiens__NP_000473
auguuccucaaggccgucguccucacccucgcccucgucgccgucgccggcgcccgcgccgaggucuccgccgaccaggucgccaccgucaugugggacuacuucucccagcucuccaacaacgccaaggaggccgucgagcaccuccagaaguccgagcucacccagcagcucaacgcccucuuccaggacaagcucggcgaggucaacaccuacgccggcgaccuccagaagaagcucguccccuucgccaccgagcuccacgagcgccucgccaaggacuccgagaagcucaaggaggagaucggcaaggagcucgaggagcuccgcgcccgccuccucccccacgccaacgaggucucccagaagaucggcgacaaccuccgcgagcuccagcagcgccucgagcccuacgccgaccagcuccgcacccaggucuccacccaggccgagcagcuccgccgccagcucacccccuacgcccagcgcauggagcgcguccuccgcgagaacgccgacucccuccaggccucccuccgcccccacgccgacgagcucaaggccaagaucgaccagaacgucgaggagcucaagggccgccucacccccuacgccgacgaguucaaggucaagaucgaccagaccgucgaggagcuccgccgcucccucgcccccuacgcccaggacacccaggagaagcucaaccaccagcucgagggccucaccuuccagaugaagaagaacgccgaggagcucaaggcccgcaucuccgccuccgccgaggagcuccgccagcgccucgccccccucgccgaggacguccgcggcaaccuccgcggcaacaccgagggccuccagaagucccucgccgagcucggcggccaccucgaccagcaggucgaggaguuccgccgccgcgucgagcccuacggcgagaacuucaacaaggcccucguccagcagauggagcagcuccgccagaagcucggcccccacgccggcgacgucgagggccaccucuccuuccucgagaaggaccuccgcgacaaggucaacuccuucuucuccaccuucaaggagaaggagucccaggacaagacccucucccuccccgagcucgagcagcagcaggagcagcagcaggagcagcagcaggagcagguccagaugcucgccccccucgaguccuga

SEQ ID NO: 39812 - RNA, 1101 nt, Artificial Sequence
  derived and/or modified sequence opt2 from APOA5__Homo_sapiens__NP_001160070
auggccuccauggccgccguccucaccugggcccucgcccuccucuccgccuucuccgccacccaggcccgcaagggcuucugggacuacuucucccagaccuccggcgacaagggccgcgucgagcagauccaccagcagaagauggcccgcgagcccgccacccucaaggacucccucgagcaggaccucaacaacaugaacaaguuccucgagaagcuccgcccccucuccggcuccgaggccccccgccucccccaggaccccgucggcaugcgccgccagcuccaggaggagcucgaggaggucaaggcccgccuccagcccuacauggccgaggcccacgagcucgucggcuggaaccucgagggccuccgccagcagcucaagcccuacaccauggaccucauggagcaggucgcccuccgcguccaggagcuccaggagcagcuccgcgucgucggcgaggacaccaaggcccagcuccucggcggcgucgacgaggccugggcccuccuccagggccuccagucccgcgucguccaccacaccggccgcuucaaggagcucuuccaccccuacgccgagucccucgucuccggcaucggccgccacguccaggagcuccaccgcuccgucgccccccacgcccccgccucccccgcccgccucucccgcugcguccagguccucucccgcaagcucacccucaaggccaaggcccuccacgcccgcauccagcagaaccucgaccagcuccgcgaggagcucucccgcgccuucgccggcaccggcaccgaggagggcgccggccccgacccccagaugcucuccgaggagguccgccagcgccuccaggccuuccgccaggacaccuaccuccagaucgccgccuucacccgcgccaucgaccaggagaccgaggagguccagcagcagcucgccccccccccccccggccacuccgccuucgcccccgaguuccagcagaccgacuccggcaagguccucuccaagcuccaggcccgccucgacgaccucugggaggacaucacccacucccuccacgaccagggccacucccaccucggcgaccccuga

SEQ ID NO: 39813 - RNA, 711 nt, Artificial Sequence
  derived and/or modified sequence opt2 from APOBEC1__Homo_sapiens__NP_001291495
augaccuccgagaagggccccuccaccggcgaccccacccuccgccgccgcaucgagcccugggaguucgacgucuucuacgacccccgcgagcuccgcaaggaggccugccuccucuacgagaucaaguggggcaugucccgcaagaucuggcgcuccuccggcaagaacaccaccaaccacgucgaggucaacuucaucaagaaguucaccuccgagcgcgacuuccaccccuccauguccugcuccaucaccugguuccucuccuggucccccugcugggagugcucccaggccauccgcgaguuccucucccgccaccccggcgucacccucgucaucuacgucgcccgccucuucuggcacauggaccagcagaaccgccagggccuccgcgaccucgucaacuccggcgucaccauccagaucaugcgcgccuccgaguacuaccacugcuggcgcaacuucgucaacuacccccccggcgacgaggcccacuggccccaguaccccccccucuggaugaugcucuacgcccucgagcuccacugcaucauccucucccucccccccugccucaagaucucccgccgcuggcagaaccaccucaccuucuuccgccuccaccuccagaacugccacuaccagaccauccccccccacauccuccucgccaccggccucauccaccccuccgucgccuggcgcuga

SEQ ID NO: 39814 - RNA, 675 nt, Artificial Sequence
  derived and/or modified sequence opt2 from APOBEC2__Homo_sapiens__NP_006780
auggcccagaaggaggaggccgccgucgccaccgaggccgccucccagaacggcgaggaccucgagaaccucgacgaccccgagaagcucaaggagcucaucgagcucccccccuucgagaucgucaccggcgagcgccuccccgccaacuucuucaaguuccaguuccgcaacgucgaguacuccuccggccgcaacaagaccuuccucugcuacgucgucgaggcccagggcaagggcggccagguccaggccucccgcggcuaccucgaggacgagcacgccgccgcccacgccgaggaggccuucuucaacaccauccuccccgccuucgaccccgcccuccgcuacaacgucaccugguacgucuccuccucccccugcgccgccugcgccgaccgcaucaucaagacccucuccaagaccaagaaccuccgccuccucauccucgucggccgccucuucaugugggaggagcccgagauccaggccgcccucaagaagcucaaggaggccggcugcaagcuccgcaucaugaagccccaggacuucgaguacgucuggcagaacuucgucgagcaggaggagggcgaguccaaggccuuccagcccugggaggacauccaggagaacuuccucuacuacgaggagaagcucgccgacauccucaaguga

SEQ ID NO: 39815 - RNA, 600 nt, Artificial Sequence
  derived and/or modified sequence opt2 from APOBEC3A_B__Homo_sapiens__XP_011545347
auggaggccucccccgccuccggcccccgccaccucauggacccccacaucuucaccuccaacuucaacaacggcaucggccgccacaagaccuaccucugcuacgaggucgagcgccucgacaacggcaccuccgucaagauggaccagcaccgcggcuuccuccacaaccaggccaagaaccuccucugcggcuucuacggccgccacgccgagcuccgcuuccucgaccucguccccucccuccagcucgaccccgcccagaucuaccgcgucaccugguucaucuccuggucccccugcuucuccuggggcugcgccggcgagguccgcgccuuccuccaggagaacacccacguccgccuccgcaucuucgccgcccgcaucuacgacuacgacccccucuacaaggaggcccuccagaugcuccgcgacgccggcgcccaggucuccaucaugaccuacgacgaguucaagcacugcugggacaccuucgucgaccaccagggcugccccuuccagcccugggacggccucgacgagcacucccaggcccucuccggccgccuccgcgccauccuccagaaccagggcaacuga

SEQ ID NO: 39816 - RNA, 1074 nt, Artificial Sequence
  derived and/or modified sequence opt2 from APOBEC3B__Homo_sapiens__NP_001257340
augaacccccagauccgcaaccccauggagcgcauguaccgcgacaccuucuacgacaacuucgagaacgagcccauccucuacggccgcuccuacaccuggcucugcuacgaggucaagaucaagcgcggccgcuccaaccuccucugggacaccggcgucuuccgcggccaggucuacuucaagccccaguaccacgccgagaugugcuuccucuccugguucugcggcaaccagcuccccgccuacaagugcuuccagaucaccugguucgucuccuggacccccugccccgacugcgucgccaagcucgccgaguuccucuccgagcaccccaacgucacccucaccaucuccgccgcccgccucuacuacuacugggagcgcgacuaccgccgcgcccucugccgccucucccaggccggcgcccgcgucaagaucauggacuacgaggaguucgccuacugcugggagaacuucgucuacaacgagggccagcaguucaugcccugguacaaguucgacgagaacuacgccuuccuccaccgcacccucaaggagauccuccgcuaccucauggaccccgacaccuucaccuucaacuucaacaacgacccccucguccuccgccgccgccagaccuaccucugcuacgaggucgagcgccucgacaacggcaccuggguccucauggaccagcacaugggcuuccucugcaacgagcucgaccccgcccagaucuaccgcgucaccugguucaucuccuggucccccugcuucuccuggggcugcgccggcgagguccgcgccuuccuccaggagaacacccacguccgccuccgcaucuucgccgcccgcaucuacgacuacgacccccucuacaaggaggcccuccagaugcuccgcgacgccggcgcccaggucuccaucaugaccuacgacgaguucgaguacugcugggacaccuucgucuaccgccagggcugccccuuccagcccugggacggccucgaggagcacucccaggcccucuccggccgccuccgcgccauccuccagaaccagggcaacuga

SEQ ID NO: 39817 - RNA, 573 nt, Artificial Sequence
  derived and/or modified sequence opt2 from APOBEC3C__Homo_sapiens__NP_055323
augaacccccagauccgcaaccccaugaaggccauguaccccggcaccuucuacuuccaguucaagaaccucugggaggccaacgaccgcaacgagaccuggcucugcuucaccgucgagggcaucaagcgccgcuccgucgucuccuggaagaccggcgucuuccgcaaccaggucgacuccgagacccacugccacgccgagcgcugcuuccucuccugguucugcgacgacauccucucccccaacaccaaguaccaggucaccugguacaccuccuggucccccugccccgacugcgccggcgaggucgccgaguuccucgcccgccacuccaacgucaaccucaccaucuucaccgcccgccucuacuacuuccaguaccccugcuaccaggagggccuccgcucccucucccaggagggcgucgccgucgagaucauggacuacgaggacuucaaguacugcugggagaacuucgucuacaacgacaacgagcccuucaagcccuggaagggccucaagaccaacuuccgccuccucaagcgccgccuccgcgagucccuccaguga

SEQ ID NO: 39818 - RNA, 306 nt, Artificial Sequence
  derived and/or modified sequence opt2 from APOBEC3F__Homo_sapiens__NP_001006667
augaagccccacuuccgcaacaccgucgagcgcauguaccgcgacaccuucuccuacaacuucuacaaccgccccauccucucccgccgcaacaccgucuggcucugcuacgaggucaagaccaagggccccucccgcccccgccucgacgccaagaucuuccgcggccaggucccccgcuccuucauccgcgcccccuuccagguccucuccucccccuucggccagugcgcccccccccacggcaccgcccagguccaguggcccccccagcucaccgccggccgcgagcagggccgccccuga

SEQ ID NO: 39819 - RNA, 1155 nt, Artificial Sequence
  derived and/or modified sequence opt2 from APOBEC3G__Homo_sapiens__NP_068594
augaagccccacuuccgcaacaccgucgagcgcauguaccgcgacaccuucuccuacaacuucuacaaccgccccauccucucccgccgcaacaccgucuggcucugcuacgaggucaagaccaagggccccucccgccccccccucgacgccaagaucuuccgcggccaggucuacuccgagcucaaguaccaccccgagaugcgcuucuuccacugguucuccaaguggcgcaagcuccaccgcgaccaggaguacgaggucaccugguacaucuccuggucccccugcaccaagugcacccgcgacauggccaccuuccucgccgaggaccccaaggucacccucaccaucuucgucgcccgccucuacuacuucugggaccccgacuaccaggaggcccuccgcucccucugccagaagcgcgacggcccccgcgccaccaugaagaucaugaacuacgacgaguuccagcacugcugguccaaguucgucuacucccagcgcgagcucuucgagcccuggaacaaccuccccaaguacuacauccuccuccacaucaugcucggcgagauccuccgccacuccauggacccccccaccuucaccuucaacuucaacaacgagcccuggguccgcggccgccacgagaccuaccucugcuacgaggucgagcgcaugcacaacgacaccuggguccuccucaaccagcgccgcggcuuccucugcaaccaggccccccacaagcacggcuuccucgagggccgccacgccgagcucugcuuccucgacgucauccccuucuggaagcucgaccucgaccaggacuaccgcgucaccugcuucaccuccuggucccccugcuucuccugcgcccaggagauggccaaguucaucuccaagaacaagcacgucucccucugcaucuucaccgcccgcaucuacgacgaccagggccgcugccaggagggccuccgcacccucgccgaggccggcgccaagaucuccaucaugaccuacuccgaguucaagcacugcugggacaccuucgucgaccaccagggcugccccuuccagcccugggacggccucgacgagcacucccaggaccucuccggccgccuccgcgccauccuccagaaccaggagaacuga

SEQ ID NO: 39820 - RNA, 549 nt, Artificial Sequence
  derived and/or modified sequence opt2 from APOBEC3H__Homo_sapiens__NP_001159474
auggcccuccucaccgccgagaccuuccgccuccaguucaacaacaagcgccgccuccgccgccccuacuacccccgcaaggcccuccucugcuaccagcucaccccccagaacggcuccacccccacccgcggcuacuucgagaacaagaagaagugccacgccgagaucugcuucaucaacgagaucaaguccaugggccucgacgagacccagugcuaccaggucaccugcuaccucaccuggucccccugcuccuccugcgccugggagcucgucgacuucaucaaggcccacgaccaccucaaccucggcaucuucgccucccgccucuacuaccacuggugcaagccccagcagaagggccuccgccuccucugcggcucccagguccccgucgaggucaugggcuuccccgaguucgccgacugcugggagaacuucgucgaccacgagaagccccucuccuucaaccccuacaagaugcucgaggagcucgacaagaacucccgcgccaucaagcgccgccucgagcgcaucaaguccuga

SEQ ID NO: 39821 - RNA, 13692 nt, Artificial Sequence
  derived and/or modified sequence opt2 from APOB__Homo_sapiens__NP_000375
auggaccccccccgccccgcccuccucgcccuccucgcccuccccgcccuccuccuccuccuccucgccggcgcccgcgccgaggaggagaugcucgagaacgucucccucgucugccccaaggacgccacccgcuucaagcaccuccgcaaguacaccuacaacuacgaggccgaguccuccuccggcguccccggcaccgccgacucccgcuccgccacccgcaucaacugcaaggucgagcucgaggucccccagcucugcuccuucauccucaagaccucccagugcacccucaaggaggucuacggcuucaaccccgagggcaaggcccuccucaagaagaccaagaacuccgaggaguucgccgccgccaugucccgcuacgagcucaagcucgccauccccgagggcaagcaggucuuccucuaccccgagaaggacgagcccaccuacauccucaacaucaagcgcggcaucaucuccgcccuccucgucccccccgagaccgaggaggccaagcagguccucuuccucgacaccgucuacggcaacugcuccacccacuucaccgucaagacccgcaagggcaacgucgccaccgagaucuccaccgagcgcgaccucggccagugcgaccgcuucaagcccauccgcaccggcaucuccccccucgcccucaucaagggcaugacccgcccccucuccacccucaucuccuccucccaguccugccaguacacccucgacgccaagcgcaagcacgucgccgaggccaucugcaaggagcagcaccucuuccuccccuucuccuacaagaacaaguacggcauggucgcccaggucacccagacccucaagcucgaggacacccccaagaucaacucccgcuucuucggcgagggcaccaagaagaugggccucgccuucgaguccaccaaguccaccuccccccccaagcaggccgaggccguccucaagacccuccaggagcucaagaagcucaccaucuccgagcagaacauccagcgcgccaaccucuucaacaagcucgucaccgagcuccgcggccucuccgacgaggccgucaccucccuccucccccagcucaucgaggucuccucccccaucacccuccaggcccucguccagugcggccagccccagugcuccacccacauccuccaguggcucaagcgcguccacgccaacccccuccucaucgacgucgucaccuaccucgucgcccucauccccgagcccuccgcccagcagcuccgcgagaucuucaacauggcccgcgaccagcgcucccgcgccacccucuacgcccucucccacgccgucaacaacuaccacaagaccaaccccaccggcacccaggagcuccucgacaucgccaacuaccucauggagcagauccaggacgacugcaccggcgacgaggacuacaccuaccucauccuccgcgucaucggcaacaugggccagaccauggagcagcucacccccgagcucaaguccuccauccucaagugcguccaguccaccaagcccucccucaugauccagaaggccgccauccaggcccuccgcaagauggagcccaaggacaaggaccaggagguccuccuccagaccuuccucgacgacgccucccccggcgacaagcgccucgccgccuaccucaugcucaugcgcucccccucccaggccgacaucaacaagaucguccagauccuccccugggagcagaacgagcaggucaagaacuucgucgccucccacaucgccaacauccucaacuccgaggagcucgacauccaggaccucaagaagcucgucaaggaggcccucaaggagucccagcuccccaccgucauggacuuccgcaaguucucccgcaacuaccagcucuacaaguccgucucccuccccucccucgaccccgccuccgccaagaucgagggcaaccucaucuucgaccccaacaacuaccuccccaaggaguccaugcucaagaccacccucaccgccuucggcuucgccuccgccgaccucaucgagaucggccucgagggcaagggcuucgagcccacccucgaggcccucuucggcaagcagggcuucuuccccgacuccgucaacaaggcccucuacugggucaacggccagguccccgacggcgucuccaagguccucgucgaccacuucggcuacaccaaggacgacaagcacgagcaggacauggucaacggcaucaugcucuccgucgagaagcucaucaaggaccucaaguccaaggagguccccgaggcccgcgccuaccuccgcauccucggcgaggagcucggcuucgccucccuccacgaccuccagcuccucggcaagcuccuccucaugggcgcccgcacccuccagggcaucccccagaugaucggcgaggucauccgcaagggcuccaagaacgacuucuuccuccacuacaucuucauggagaacgccuucgagcuccccaccggcgccggccuccagcuccagaucuccuccuccggcgucaucgcccccggcgccaaggccggcgucaagcucgaggucgccaacaugcaggccgagcucgucgccaagcccuccgucuccgucgaguucgucaccaacaugggcaucaucauccccgacuucgcccgcuccggcguccagaugaacaccaacuucuuccacgaguccggccucgaggcccacgucgcccucaaggccggcaagcucaaguucaucauccccucccccaagcgccccgucaagcuccucuccggcggcaacacccuccaccucgucuccaccaccaagaccgaggucauccccccccucaucgagaaccgccaguccugguccgucugcaagcaggucuuccccggccucaacuacugcaccuccggcgccuacuccaacgccuccuccaccgacuccgccuccuacuacccccucaccggcgacacccgccucgagcucgagcuccgccccaccggcgagaucgagcaguacuccgucuccgccaccuacgagcuccagcgcgaggaccgcgcccucgucgacacccucaaguucgucacccaggccgagggcgccaagcagaccgaggccaccaugaccuucaaguacaaccgccaguccaugacccucuccuccgagguccagauccccgacuucgacgucgaccucggcaccauccuccgcgucaacgacgaguccaccgagggcaagaccuccuaccgccucacccucgacauccagaacaagaagaucaccgaggucgcccucaugggccaccucuccugcgacaccaaggaggagcgcaagaucaagggcgucaucuccaucccccgccuccaggccgaggcccgcuccgagauccucgcccacuggucccccgccaagcuccuccuccagauggacuccuccgccaccgccuacggcuccaccgucuccaagcgcgucgccuggcacuacgacgaggagaagaucgaguucgaguggaacaccggcaccaacgucgacaccaagaagaugaccuccaacuuccccgucgaccucuccgacuaccccaagucccuccacauguacgccaaccgccuccucgaccaccgcgucccccagaccgacaugaccuuccgccacgucggcuccaagcucaucgucgccauguccuccuggcuccagaaggccuccggcucccuccccuacacccagacccuccaggaccaccucaacucccucaaggaguucaaccuccagaacaugggccuccccgacuuccacauccccgagaaccucuuccucaaguccgacggccgcgucaaguacacccucaacaagaacucccucaagaucgagaucccccuccccuucggcggcaaguccucccgcgaccucaagaugcucgagaccguccgcacccccgcccuccacuucaaguccgucggcuuccaccuccccucccgcgaguuccagguccccaccuucaccauccccaagcucuaccagcuccaggucccccuccucggcguccucgaccucuccaccaacgucuacuccaaccucuacaacugguccgccuccuacuccggcggcaacaccuccaccgaccacuucucccuccgcgcccgcuaccacaugaaggccgacuccgucgucgaccuccucuccuacaacguccagggcuccggcgagaccaccuacgaccacaagaacaccuucacccucuccugcgacggcucccuccgccacaaguuccucgacuccaacaucaaguucucccacgucgagaagcucggcaacaaccccgucuccaagggccuccucaucuucgacgccuccuccuccuggggcccccagauguccgccuccguccaccucgacuccaagaagaagcagcaccucuucgucaaggaggucaagaucgacggccaguuccgcgucuccuccuucuacgccaagggcaccuacggccucuccugccagcgcgaccccaacaccggccgccucaacggcgaguccaaccuccgcuucaacuccuccuaccuccagggcaccaaccagaucaccggccgcuacgaggacggcacccucucccucaccuccaccuccgaccuccaguccggcaucaucaagaacaccgccucccucaaguacgagaacuacgagcucacccucaaguccgacaccaacggcaaguacaagaacuucgccaccuccaacaagauggacaugaccuucuccaagcagaacgcccuccuccgcuccgaguaccaggccgacuacgagucccuccgcuucuucucccuccucuccggcucccucaacucccacggccucgagcucaacgccgacauccucggcaccgacaagaucaacuccggcgcccacaaggccacccuccgcaucggccaggacggcaucuccaccuccgccaccaccaaccucaagugcucccuccucguccucgagaacgagcucaacgccgagcucggccucuccggcgccuccaugaagcucaccaccaacggccgcuuccgcgagcacaacgccaaguucucccucgacggcaaggccgcccucaccgagcucucccucggcuccgccuaccaggccaugauccucggcgucgacuccaagaacaucuucaacuucaaggucucccaggagggccucaagcucuccaacgacaugaugggcuccuacgccgagaugaaguucgaccacaccaacucccucaacaucgccggccucucccucgacuucuccuccaagcucgacaacaucuacuccuccgacaaguucuacaagcagaccgucaaccuccagcuccagcccuacucccucgucaccacccucaacuccgaccucaaguacaacgcccucgaccucaccaacaacggcaagcuccgccucgagccccucaagcuccacgucgccggcaaccucaagggcgccuaccagaacaacgagaucaagcacaucuacgccaucuccuccgccgcccucuccgccuccuacaaggccgacaccgucgccaagguccagggcgucgaguucucccaccgccucaacaccgacaucgccggccucgccuccgccaucgacauguccaccaacuacaacuccgacucccuccacuucuccaacgucuuccgcuccgucauggcccccuucaccaugaccaucgacgcccacaccaacggcaacggcaagcucgcccucuggggcgagcacaccggccagcucuacuccaaguuccuccucaaggccgagccccucgccuucaccuucucccacgacuacaagggcuccaccucccaccaccucgucucccgcaaguccaucuccgccgcccucgagcacaaggucuccgcccuccucacccccgccgagcagaccggcaccuggaagcucaagacccaguucaacaacaacgaguacucccaggaccucgacgccuacaacaccaaggacaagaucggcgucgagcucaccggccgcacccucgccgaccucacccuccucgacucccccaucaaggucccccuccuccucuccgagcccaucaacaucaucgacgcccucgagaugcgcgacgccgucgagaagccccaggaguucaccaucgucgccuucgucaaguacgacaagaaccaggacguccacuccaucaaccuccccuucuucgagacccuccaggaguacuucgagcgcaaccgccagaccaucaucgucguccucgagaacguccagcgcaaccucaagcacaucaacaucgaccaguucguccgcaaguaccgcgccgcccucggcaagcucccccagcaggccaacgacuaccucaacuccuucaacugggagcgccaggucucccacgccaaggagaagcucaccgcccucaccaagaaguaccgcaucaccgagaacgacauccagaucgcccucgacgacgccaagaucaacuucaacgagaagcucucccagcuccagaccuacaugauccaguucgaccaguacaucaaggacuccuacgaccuccacgaccucaagaucgccaucgccaacaucaucgacgagaucaucgagaagcucaagucccucgacgagcacuaccacauccgcgucaaccucgucaagaccauccacgaccuccaccucuucaucgagaacaucgacuucaacaaguccggcuccuccaccgccuccuggauccagaacgucgacaccaaguaccagauccgcauccagauccaggagaagcuccagcagcucaagcgccacauccagaacaucgacauccagcaccucgccggcaagcucaagcagcacaucgaggccaucgacguccgcguccuccucgaccagcucggcaccaccaucuccuucgagcgcaucaacgacguccucgagcacgucaagcacuucgucaucaaccucaucggcgacuucgaggucgccgagaagaucaacgccuuccgcgccaagguccacgagcucaucgagcgcuacgaggucgaccagcagauccagguccucauggacaagcucgucgagcucgcccaccaguacaagcucaaggagaccauccagaagcucuccaacguccuccagcaggucaagaucaaggacuacuucgagaagcucgucggcuucaucgacgacgccgucaagaagcucaacgagcucuccuucaagaccuucaucgaggacgucaacaaguuccucgacaugcucaucaagaagcucaaguccuucgacuaccaccaguucgucgacgagaccaacgacaagauccgcgaggucacccagcgccucaacggcgagauccaggcccucgagcucccccagaaggccgaggcccucaagcucuuccucgaggagaccaaggccaccgucgccgucuaccucgagucccuccaggacaccaagaucacccucaucaucaacuggcuccaggaggcccucuccuccgccucccucgcccacaugaaggccaaguuccgcgagacccucgaggacacccgcgaccgcauguaccagauggacauccagcaggagcuccagcgcuaccucucccucgucggccaggucuacuccacccucgucaccuacaucuccgacugguggacccucgccgccaagaaccucaccgacuucgccgagcaguacuccauccaggacugggccaagcgcaugaaggcccucgucgagcagggcuucaccguccccgagaucaagaccauccucggcaccaugcccgccuucgaggucucccuccaggcccuccagaaggccaccuuccagacccccgacuucaucgucccccucaccgaccuccgcauccccuccguccagaucaacuucaaggaccucaagaacaucaagauccccucccgcuucuccacccccgaguucaccauccucaacaccuuccacauccccuccuucaccaucgacuucgucgagaugaaggucaagaucauccgcaccaucgaccagaugcucaacuccgagcuccaguggcccguccccgacaucuaccuccgcgaccucaaggucgaggacaucccccucgcccgcaucacccuccccgacuuccgccuccccgagaucgccauccccgaguucaucauccccacccucaaccucaacgacuuccagguccccgaccuccacauccccgaguuccagcucccccacaucucccacaccaucgagguccccaccuucggcaagcucuacuccauccucaagauccaguccccccucuucacccucgacgccaacgccgacaucggcaacggcaccaccuccgccaacgaggccggcaucgccgccuccaucaccgccaagggcgaguccaagcucgagguccucaacuucgacuuccaggccaacgcccagcucuccaaccccaagaucaacccccucgcccucaaggaguccgucaaguucuccuccaaguaccuccgcaccgagcacggcuccgagaugcucuucuucggcaacgccaucgagggcaaguccaacaccgucgccucccuccacaccgagaagaacacccucgagcucuccaacggcgucaucgucaagaucaacaaccagcucacccucgacuccaacaccaaguacuuccacaagcucaacauccccaagcucgacuucuccucccaggccgaccuccgcaacgagaucaagacccuccucaaggccggccacaucgccuggaccuccuccggcaagggcuccuggaagugggccugcccccgcuucuccgacgagggcacccacgagucccagaucuccuucaccaucgagggcccccucaccuccuucggccucuccaacaagaucaacuccaagcaccuccgcgucaaccagaaccucgucuacgaguccggcucccucaacuucuccaagcucgagauccagucccaggucgacucccagcacgucggccacuccguccucaccgccaagggcauggcccucuucggcgagggcaaggccgaguucaccggccgccacgacgcccaccucaacggcaaggucaucggcacccucaagaacucccucuucuucuccgcccagcccuucgagaucaccgccuccaccaacaacgagggcaaccucaagguccgcuucccccuccgccucaccggcaagaucgacuuccucaacaacuacgcccucuuccucucccccuccgcccagcaggccuccuggcaggucuccgcccgcuucaaccaguacaaguacaaccagaacuucuccgccggcaacaacgagaacaucauggaggcccacgucggcaucaacggcgaggccaaccucgacuuccucaacaucccccucaccauccccgagaugcgccuccccuacaccaucaucaccacccccccccucaaggacuucucccucugggagaagaccggccucaaggaguuccucaagaccaccaagcaguccuucgaccucuccgucaaggcccaguacaagaagaacaagcaccgccacuccaucaccaacccccucgccguccucugcgaguucaucucccaguccaucaaguccuucgaccgccacuucgagaagaaccgcaacaacgcccucgacuucgucaccaaguccuacaacgagaccaagaucaaguucgacaaguacaaggccgagaagucccacgacgagcucccccgcaccuuccagauccccggcuacaccguccccgucgucaacgucgaggucucccccuucaccaucgagauguccgccuucggcuacgucuuccccaaggccgucuccaugcccuccuucuccauccucggcuccgacguccgcguccccuccuacacccucauccuccccucccucgagcuccccguccuccacgucccccgcaaccucaagcucucccuccccgacuucaaggagcucugcaccaucucccacaucuucauccccgccaugggcaacaucaccuacgacuucuccuucaaguccuccgucaucacccucaacaccaacgccgagcucuucaaccaguccgacaucgucgcccaccuccucuccuccuccuccuccgucaucgacgcccuccaguacaagcucgagggcaccacccgccucacccgcaagcgcggccucaagcucgccaccgcccucucccucuccaacaaguucgucgagggcucccacaacuccaccgucucccucaccaccaagaacauggaggucuccgucgccaccaccaccaaggcccagauccccauccuccgcaugaacuucaagcaggagcucaacggcaacaccaaguccaagcccaccgucuccuccuccauggaguucaaguacgacuucaacuccuccaugcucuacuccaccgccaagggcgccgucgaccacaagcucucccucgagucccucaccuccuacuucuccaucgaguccuccaccaagggcgacgucaagggcuccguccucucccgcgaguacuccggcaccaucgccuccgaggccaacaccuaccucaacuccaaguccacccgcuccuccgucaagcuccagggcaccuccaagaucgacgacaucuggaaccucgaggucaaggagaacuucgccggcgaggccacccuccagcgcaucuacucccucugggagcacuccaccaagaaccaccuccagcucgagggccucuucuucaccaacggcgagcacaccuccaaggccacccucgagcucucccccuggcagauguccgcccucguccagguccacgccucccagcccuccuccuuccacgacuuccccgaccucggccaggaggucgcccucaacgccaacaccaagaaccagaagauccgcuggaagaacgagguccgcauccacuccggcuccuuccagucccaggucgagcucuccaacgaccaggagaaggcccaccucgacaucgccggcucccucgagggccaccuccgcuuccucaagaacaucauccuccccgucuacgacaagucccucugggacuuccucaagcucgacgucaccaccuccaucggccgccgccagcaccuccgcgucuccaccgccuucgucuacaccaagaaccccaacggcuacuccuucuccauccccgucaagguccucgccgacaaguucaucauccccggccucaagcucaacgaccucaacuccguccucgucaugcccaccuuccacguccccuucaccgaccuccagguccccuccugcaagcucgacuuccgcgagauccagaucuacaagaagcuccgcaccuccuccuucgcccucaaccuccccacccuccccgaggucaaguuccccgaggucgacguccucaccaaguacucccagcccgaggacucccucauccccuucuucgagaucaccguccccgagucccagcucaccgucucccaguucacccuccccaaguccgucuccgacggcaucgccgcccucgaccucaacgccgucgccaacaagaucgccgacuucgagcuccccaccaucaucguccccgagcagaccaucgagauccccuccaucaaguucuccguccccgccggcaucgucauccccuccuuccaggcccucaccgcccgcuucgaggucgacucccccgucuacaacgccaccugguccgccucccucaagaacaaggccgacuacgucgagaccguccucgacuccaccugcuccuccaccguccaguuccucgaguacgagcucaacguccucggcacccacaagaucgaggacggcacccucgccuccaagaccaagggcaccuucgcccaccgcgacuucuccgccgaguacgaggaggacggcaaguacgagggccuccaggagugggagggcaaggcccaccucaacaucaagucccccgccuucaccgaccuccaccuccgcuaccagaaggacaagaagggcaucuccaccuccgccgccucccccgccgucggcaccgucggcauggacauggacgaggacgacgacuucuccaaguggaacuucuacuacuccccccaguccucccccgacaagaagcucaccaucuucaagaccgagcuccgcguccgcgaguccgacgaggagacccagaucaaggucaacugggaggaggaggccgccuccggccuccucaccucccucaaggacaacguccccaaggccaccggcguccucuacgacuacgucaacaaguaccacugggagcacaccggccucacccuccgcgaggucuccuccaagcuccgccgcaaccuccagaacaacgccgagugggucuaccagggcgccauccgccagaucgacgacaucgacguccgcuuccagaaggccgccuccggcaccaccggcaccuaccaggaguggaaggacaaggcccagaaccucuaccaggagcuccucacccaggagggccaggccuccuuccagggccucaaggacaacgucuucgacggccucguccgcgucacccaggaguuccacaugaaggucaagcaccucaucgacucccucaucgacuuccucaacuucccccgcuuccaguuccccggcaagcccggcaucuacacccgcgaggagcucugcaccauguucauccgcgaggucggcaccguccucucccaggucuacuccaagguccacaacggcuccgagauccucuucuccuacuuccaggaccucgucaucacccuccccuucgagcuccgcaagcacaagcucaucgacgucaucuccauguaccgcgagcuccucaaggaccucuccaaggaggcccaggaggucuucaaggccauccagucccucaagaccaccgagguccuccgcaaccuccaggaccuccuccaguucaucuuccagcucaucgaggacaacaucaagcagcucaaggagaugaaguucaccuaccucaucaacuacauccaggacgagaucaacaccaucuucuccgacuacauccccuacgucuucaagcuccucaaggagaaccucugccucaaccuccacaaguucaacgaguucauccagaacgagcuccaggaggccucccaggagcuccagcagauccaccaguacaucauggcccuccgcgaggaguacuucgaccccuccaucgucggcuggaccgucaaguacuacgagcucgaggagaagaucgucucccucaucaagaaccuccucgucgcccucaaggacuuccacuccgaguacaucgucuccgccuccaacuucaccucccagcucuccucccaggucgagcaguuccuccaccgcaacauccaggaguaccucuccauccucaccgaccccgacggcaagggcaaggagaagaucgccgagcucuccgccaccgcccaggagaucaucaagucccaggccaucgccaccaagaagaucaucuccgacuaccaccagcaguuccgcuacaagcuccaggacuucuccgaccagcucuccgacuacuacgagaaguucaucgccgaguccaagcgccucaucgaccucuccauccagaacuaccacaccuuccucaucuacaucaccgagcuccucaagaagcuccaguccaccaccgucaugaaccccuacaugaagcucgcccccggcgagcucaccaucauccucuga

SEQ ID NO: 39822 - RNA, 3294 nt, Artificial Sequence
  derived and/or modified sequence opt2 from APOBR__Homo_sapiens__NP_061160
auggacuuccuccgccucuaccuccccggccuccaccaggcccuccgcggcgcccucgacucccucggcaccuucgucuccuaccuccucggcgacgccguccccaccgucgagcgcgaggcccaggccgccgaggagcucggcgucgucgccgucggcaagaccggcaagaucgucgaggaggaggcccaggaggaccucgagggccuccgcggcucccagaacgagggcgccggccgccuccgcggccccggcgacgaccgccgccacgaggucggcuccuccgccgucgagcagaccuggggcuggggcgacggcuccucccacggcucccaggccgagcgccaggacuccggcgccggcgagaccgccaaggccgcccgcugccaggagcccuccgcccaccucgaggcccgcaagaaguccaaggccggcuccggcgccugccaggaccgcuccggccaggcccaggagcgccaggagucccacgagcaggaggucaaccgcgaggagcgccuccgcuccugggagcaggaggaggaggaggaggagguccgcgcccgcgagcccggcauggcccgcggcgccgaguccgaguggaccuggcacggcgagaccgagggcaaggccggcgccgucggccccaaggccgccggcgacaaccgcgagauggagcagggcguccgcgaggccgacgccggcgagaccgaggagcccggcgccgagggcgccggcaagggcgaggaggucgucgucgucgagaaggccugcgaguccacccgcgccuggggcaccuggggccccggcgccgagcccgaggacuggggcauccucggccgcgaggaggcccgcaccacccccggccgcgaggaggcccgcgccauccucgacggcgaggaggcccgcaccaucuccggcggcgaggaggccgagaccgccuccggcggcgaggaggccgagaccgccuccggcggcgaggaggccggcaccgccuccggcggcgaggaggccggcaucgccuccggcggcgaggccggcaccgccuccggcggcgaggaggccggcaccgccuccggcggcgaggaggccggcaccgccuccggcggcgacgaggccuggaccaccuccggcaaggaggaggccgaccuccucggcguccgccagaccgaguacggcgccguccccggcgagcgccuccucgaggccaccggcaaggucuggguccucgaggaggagggcgacgaggagcgcgaggccgaggucucccccuuccccaagcagccccagguccucggcaccgagcgcaccgaggaggccgccgagucccagaccgccggccgcgaggccgucggcggccaggaggccggcgaguccuucgagggccaggucgaccuccgcggcaaggaggccgagaugcgccaggaccucggcauccgcgccgaccgcgcccgcauggaggagcucguccaggccgaggaggcccaggaggagcgcggcuccucccgcgaccccgucgccgagcuccccuccgacggcgaggccgagggcaccgccgaccucgaggccacccccgaggcccgccccgaggaggagcucaccggcgaggaguccgaggccgcccagaccuccugcggccuccucggcgucgaguggggcggccucacccacuccgucaccaagggccagggccccgagcucaugggcggcgcccagacccccaccaagcagcccgaggagcgcgaggccggcgaggucgagcucaugggcguccucgcccucuccaaggaggagcaggagcgcucccucgaggccggcccccgccacgccggcuccgucaagcccgaggccuccgaggccuuccccggcgccugggagaaccgcacccgcaaggacauggagcgcggcaacacccaggaggacgccgccgacggcgagcagcgcgaggaggaggagaccgccggcggccagacccucgccgccgaggccgagggcgaccgcgaguccgagcucuccgagguccccgaggccggcggcgagggccucaccacccaggacgccggcugcggcaccgaggagggcgaggccuccgucuccgagaaccaggagcucgacggcuccaccggcgccgacgccggccccugccccucccucggcgaggccuacgcccgcgagaccgaggacgaggaggccgaggccgaccgcaccucccgccgcggcuggcgccuccaggccgucgccgucggccuccccgaccgcgaggacgcccagaccggcuccgucgccgccggcaucaugggcggcgacgucgucccccacaucuccgccgccggcgccggcgaggcccucgagggcguccucggccagggcugggacuccaaggagaaggaggaggccgccgccggcgagcacgccggcggccaggaguucggccucgagggcuccgccgaggaggaggucaccggccgcggcucccaggucgaggccuucgagucccgcgagggcggccccuggggcggccgcgucgaggccgaggaguccgccggcgccgaggacuccugcggccucgaccccgccggcucccagaccgcccgcgccgagggcaugggcgccauggucgaggccggcggccuccucgagaaguggacccuccucgaggaggaggccgucggcuggcaggagcgcgagcagcgcgaggacuccgagggccgcugcggcgacuaccaccccgagggcgaggccccccgccuccucgacgccgagggccucauggucaccggcggccgccgcgccgaggccaaggagaccgagcccgagucccucgagcacguccgcggccaggaggagcagcccacccaccaggcccccgccgaggccgcccccgaguccgucggcgaggccgagaccgccgaggccaugggcuccgcccgcggcggcgccgccaacuccugguccgaggccccccuccccggcucccuccucgacgucuccgucccccgcucccgcguccaccucucccgcuccuccucccagcgccgcucccgccccuccuuccgccgcacccccgccugggagcagcaggaggagccccccgcccccaacccccccgaggaggagcucuccgcccccgagcagcgcccccuccagcucgaggagccccucgagcccuccccccuccgccacgacggcacccccguccccgcccgccgccgcccccucggccacggcuucggccucgcccaccccggcaugaugcaggagcuccaggcccgccucggccgccccaagccccaguga

SEQ ID NO: 39823 - RNA, 252 nt, Artificial Sequence
  derived and/or modified sequence opt2 from APOC1__Homo_sapiens__NP_001636
augcgccucuuccucucccuccccguccucgucgucguccucuccaucguccucgagggccccgcccccgcccagggcacccccgacgucuccuccgcccucgacaagcucaaggaguucggcaacacccucgaggacaaggcccgcgagcucaucucccgcaucaagcaguccgagcucuccgccaagaugcgcgagugguucuccgagaccuuccagaaggucaaggagaagcucaagaucgacuccuga

SEQ ID NO: 39824 - RNA, 306 nt, Artificial Sequence
  derived and/or modified sequence opt2 from APOC2__Homo_sapiens__NP_000474
augggcacccgccuccuccccgcccucuuccucguccuccucguccucggcuucgagguccagggcacccagcagccccagcaggacgagaugcccucccccaccuuccucacccaggucaaggagucccucuccuccuacugggaguccgccaagaccgccgcccagaaccucuacgagaagaccuaccuccccgccgucgacgagaagcuccgcgaccucuacuccaaguccaccgccgccauguccaccuacaccggcaucuucaccgaccagguccucuccguccucaagggcgaggaguga

SEQ ID NO: 39825 - RNA, 300 nt, Artificial Sequence
  derived and/or modified sequence opt2 from APOC3__Homo_sapiens__NP_000031
augcagccccgcguccuccucgucgucgcccuccucgcccuccucgccuccgcccgcgccuccgaggccgaggacgccucccuccucuccuucaugcagggcuacaugaagcacgccaccaagaccgccaaggacgcccucuccuccguccaggagucccaggucgcccagcaggcccgcggcugggucaccgacggcuucuccucccucaaggacuacugguccaccgucaaggacaaguucuccgaguucugggaccucgaccccgagguccgccccaccuccgccgucgccgccuga

SEQ ID NO: 39826 - RNA, 384 nt, Artificial Sequence
  derived and/or modified sequence opt2 from APOC4__Homo_sapiens__NP_001637
augucccuccuccgcaaccgccuccaggcccuccccgcccucugccucugcguccucguccucgccugcaucggcgccugccagcccgaggcccaggagggcacccucucccccccccccaagcucaagaugucccgcuggucccucguccgcggccgcaugaaggagcuccucgagaccgucgucaaccgcacccgcgacggcuggcagugguucuggucccccuccaccuuccgcggcuucaugcagaccuacuacgacgaccaccuccgcgaccucggcccccucaccaaggccugguuccucgaguccaaggacucccuccucaagaagacccacucccucugcccccgccucgucugcggcgacaaggaccagggcuga

SEQ ID NO: 39827 - RNA, 570 nt, Artificial Sequence
  derived and/or modified sequence opt2 from APOD__Homo_sapiens__NP_001638
auggucaugcuccuccuccuccucuccgcccucgccggccucuucggcgccgccgagggccaggccuuccaccucggcaagugccccaacccccccguccaggagaacuucgacgucaacaaguaccucggccgcugguacgagaucgagaagauccccaccaccuucgagaacggccgcugcauccaggccaacuacucccucauggagaacggcaagaucaagguccucaaccaggagcuccgcgccgacggcaccgucaaccagaucgagggcgaggccacccccgucaaccucaccgagcccgccaagcucgaggucaaguucuccugguucaugcccuccgcccccuacuggauccucgccaccgacuacgagaacuacgcccucgucuacuccugcaccugcaucauccagcucuuccacgucgacuucgccuggauccucgcccgcaaccccaaccucccccccgagaccgucgacucccucaagaacauccucaccuccaacaacaucgacgucaagaagaugaccgucaccgaccaggucaacugccccaagcucuccuga

SEQ ID NO: 39828 - RNA, 1032 nt, Artificial Sequence
  derived and/or modified sequence opt2 from APOE__Homo_sapiens__NP_001289617
auguccuccggcgccucccgcaaguccugggaccccggcaaccccuggccccccgacuggcccaucaccggccgcaagaugaagguccucugggccgcccuccucgucaccuuccucgccggcugccaggccaaggucgagcaggccgucgagaccgagcccgagcccgagcuccgccagcagaccgaguggcaguccggccagcgcugggagcucgcccucggccgcuucugggacuaccuccgcuggguccagacccucuccgagcagguccaggaggagcuccucuccucccaggucacccaggagcuccgcgcccucauggacgagaccaugaaggagcucaaggccuacaaguccgagcucgaggagcagcucacccccgucgccgaggagacccgcgcccgccucuccaaggagcuccaggccgcccaggcccgccucggcgccgacauggaggacgucugcggccgccucguccaguaccgcggcgagguccaggccaugcucggccaguccaccgaggagcuccgcguccgccucgccucccaccuccgcaagcuccgcaagcgccuccuccgcgacgccgacgaccuccagaagcgccucgccgucuaccaggccggcgcccgcgagggcgccgagcgcggccucuccgccauccgcgagcgccucggcccccucgucgagcagggccgcguccgcgccgccaccgucggcucccucgccggccagccccuccaggagcgcgcccaggccuggggcgagcgccuccgcgcccgcauggaggagaugggcucccgcacccgcgaccgccucgacgaggucaaggagcaggucgccgagguccgcgccaagcucgaggagcaggcccagcagauccgccuccaggccgaggccuuccaggcccgccucaaguccugguucgagccccucgucgaggacaugcagcgccagugggccggccucgucgagaagguccaggccgccgucggcaccuccgccgcccccguccccuccgacaaccacuga

SEQ ID NO: 39829 - RNA, 981 nt, Artificial Sequence
  derived and/or modified sequence opt2 from APOF__Homo_sapiens__NP_001629
augaccggccucugcggcuacuccgcccccgacaugcgcggccuccgccucaucaugauccccgucgagcuccuccucugcuaccuccuccuccaccccgucgacgccaccuccuacggcaagcagaccaacguccucaugcacuucccccucucccucgagucccagacccccuccuccgacccccucuccugccaguuccuccaccccaagucccuccccggcuucucccacauggccccccuccccaaguuccucgucucccucgcccuccgcaacgcccucgaggaggccggcugccaggccgacgucugggcccuccagcuccagcucuaccgccagggcggcgucaacgccacccagguccucauccagcaccuccgcggccuccagaagggccgcuccaccgagcgcaacgucuccgucgaggcccucgccuccgcccuccagcuccucgcccgcgagcagcaguccaccggccgcgucggccgcucccuccccaccgaggacugcgagaacgagaaggagcaggccguccacaacgucguccagcuccuccccggcgucggcaccuucuacaaccucggcaccgcccucuacuacgccacccagaacugccucggcaaggcccgcgagcgcggccgcgacggcgccaucgaccucggcuacgaccuccucaugaccauggccggcauguccggcggccccaugggccucgccaucuccgccgcccucaagcccgcccuccgcuccggcguccagcagcucauccaguacuaccaggaccagaaggacgccaacaucucccagcccgagaccaccaaggagggccuccgcgccaucuccgacgucuccgaccucgaggagaccaccacccucgccuccuucaucuccgaggucgucuccuccgcccccuacuggggcugggccaucaucaaguccuacgaccucgaccccggcgccggcucccucgagaucuga

SEQ ID NO: 39830 - RNA, 1038 nt, Artificial Sequence
  derived and/or modified sequence opt2 from APOH__Homo_sapiens__NP_000033
augaucucccccguccucauccucuucuccuccuuccucugccacgucgccaucgccggccgcaccugccccaagcccgacgaccuccccuucuccaccgucgucccccucaagaccuucuacgagcccggcgaggagaucaccuacuccugcaagcccggcuacgucucccgcggcggcaugcgcaaguucaucugcccccucaccggccucuggcccaucaacacccucaagugcaccccccgcgucugccccuucgccggcauccucgagaacggcgccguccgcuacaccaccuucgaguaccccaacaccaucuccuucuccugcaacaccggcuucuaccucaacggcgccgacuccgccaagugcaccgaggagggcaaguggucccccgagcuccccgucugcgcccccaucaucugccccccccccuccauccccaccuucgccacccuccgcgucuacaagcccuccgccggcaacaacucccucuaccgcgacaccgccgucuucgagugccucccccagcacgccauguucggcaacgacaccaucaccugcaccacccacggcaacuggaccaagcuccccgagugccgcgaggucaagugccccuuccccucccgccccgacaacggcuucgucaacuaccccgccaagcccacccucuacuacaaggacaaggccaccuucggcugccacgacggcuacucccucgacggccccgaggagaucgagugcaccaagcucggcaacugguccgccaugcccuccugcaaggccuccugcaagguccccgucaagaaggccaccgucgucuaccagggcgagcgcgucaagauccaggagaaguucaagaacggcaugcuccacggcgacaaggucuccuucuucugcaagaacaaggagaagaagugcuccuacaccgaggacgcccagugcaucgacggcaccaucgagguccccaagugcuucaaggagcacuccucccucgccuucuggaagaccgacgccuccgacgucaagcccugcuga

SEQ ID NO: 39831 - RNA, 1143 nt, Artificial Sequence
  derived and/or modified sequence opt2 from APOL1__Homo_sapiens__NP_001130013
auggagggcgccgcccuccuccgcgucuccguccucugcaucuggguccagcagaacguccccuccggcaccgacaccggcgacccccaguccaagccccucggcgacugggccgccggcaccauggaccccgaguccuccaucuucaucgaggacgccaucaaguacuucaaggagaaggucuccacccagaaccuccuccuccuccucaccgacaacgaggccuggaacggcuucgucgccgccgccgagcucccccgcaacgaggccgacgagcuccgcaaggcccucgacaaccucgcccgccagaugaucaugaaggacaagaacuggcacgacaagggccagcaguaccgcaacugguuccucaaggaguucccccgccucaaguccgagcucgaggacaacauccgccgccuccgcgcccucgccgacggcguccagaagguccacaagggcaccaccaucgccaacgucgucuccggcucccucuccaucuccuccggcauccucacccucgucggcaugggccucgcccccuucaccgagggcggcucccucguccuccucgagcccggcauggagcucggcaucaccgccgcccucaccggcaucaccuccuccaccauggacuacggcaagaagugguggacccaggcccaggcccacgaccucgucaucaagucccucgacaagcucaaggagguccgcgaguuccucggcgagaacaucuccaacuuccucucccucgccggcaacaccuaccagcucacccgcggcaucggcaaggacauccgcgcccuccgccgcgcccgcgccaaccuccaguccgucccccacgccuccgccucccgcccccgcgucaccgagcccaucuccgccgaguccggcgagcaggucgagcgcgucaacgagcccuccauccucgagaugucccgcggcgucaagcucaccgacgucgcccccgucuccuucuuccucguccucgacgucgucuaccucgucuacgaguccaagcaccuccacgagggcgccaaguccgagaccgccgaggagcucaagaaggucgcccaggagcucgaggagaagcucaacauccucaacaacaacuacaagauccuccaggccgaccaggagcucuga

SEQ ID NO: 39832 - RNA, 1014 nt, Artificial Sequence
  derived and/or modified sequence opt2 from APOL2__Homo_sapiens__NP_663612
augaaccccgaguccuccaucuucaucgaggacuaccucaaguacuuccaggaccaggucucccgcgagaaccuccuccagcuccucaccgacgacgaggccuggaacggcuucgucgccgccgccgagcucccccgcgacgaggccgacgagcuccgcaaggcccucaacaagcucgccucccacauggucaugaaggacaagaaccgccacgacaaggaccagcagcaccgccagugguuccucaaggaguucccccgccucaagcgcgagcucgaggaccacauccgcaagcuccgcgcccucgccgaggaggucgagcagguccaccgcggcaccaccaucgccaacgucgucuccaacuccgucggcaccaccuccggcauccucacccuccucggccucggccucgcccccuucaccgagggcaucuccuucguccuccucgacaccggcaugggccucggcgccgccgccgccgucgccggcaucaccugcuccgucgucgagcucgucaacaagcuccgcgcccgcgcccaggcccgcaaccucgaccaguccggcaccaacgucgccaaggucaugaaggaguucgucggcggcaacacccccaacguccucacccucgucgacaacugguaccaggucacccagggcaucggccgcaacauccgcgccauccgccgcgcccgcgccaacccccagcucggcgccuacgccccccccccccacgucaucggccgcaucuccgccgagggcggcgagcaggucgagcgcgucgucgagggccccgcccaggccaugucccgcggcaccaugaucgucggcgccgccaccggcggcauccuccuccuccucgacgucgucucccucgccuacgaguccaagcaccuccucgagggcgccaaguccgaguccgccgaggagcucaagaagcgcgcccaggagcucgagggcaagcucaacuuccucaccaagauccacgagaugcuccagcccggccaggaccaguga

SEQ ID NO: 39833 - RNA, 1209 nt, Artificial Sequence
  derived and/or modified sequence opt2 from APOL3__Homo_sapiens__NP_663615
augggccucggccagggcuggggcugggaggccuccugcuucgccugccucauccgcuccugcugccaggucgucaccuucaccuuccccuucggcuuccagggcaucucccagucccucgagaacgucuccggcuacuacgccgacgcccgccucgaggucggcuccacccagcuccgcaccgccggcuccugcucccacuccuucaagcgcuccuuccucgagaagaagcgcuucaccgaggaggccaccaaguacuuccgcgagcgcgucucccccguccaccuccagauccuccucaccaacaacgaggccuggaagcgcuucgucaccgccgccgagcucccccgcgacgaggccgacgcccucuacgaggcccucaagaagcuccgcaccuacgccgccaucgaggacgaguacguccagcagaaggacgagcaguuccgcgagugguuccucaaggaguucccccaggucaagcgcaagauccaggaguccaucgagaagcuccgcgcccucgccaacggcaucgaggagguccaccgcggcugcaccaucuccaacgucgucuccuccuccaccggcgccgccuccggcaucaugucccucgccggccucguccucgcccccuucaccgccggcaccucccucgcccucaccgccgccggcgucggccucggcgccgccuccgccgucaccggcaucaccaccuccaucgucgagcacuccuacaccuccuccgccgaggccgaggccucccgccucaccgccaccuccaucgaccgccucaaggucuucaaggaggucaugcgcgacaucacccccaaccuccucucccuccucaacaacuacuacgaggccacccagaccaucggcuccgagauccgcgccauccgccaggcccgcgcccgcgcccgccuccccgucaccaccuggcgcaucuccgccggcuccggcggccaggccgagcgcaccaucgccggcaccacccgcgccgucucccgcggcgcccgcauccucuccgccaccaccuccggcaucuuccucgcccucgacgucgucaaccucgucuacgaguccaagcaccuccacgagggcgccaaguccgccuccgccgaggagcuccgccgccaggcccaggagcucgaggagaaccucauggagcucacccagaucuaccagcgccucaaccccugccacacccacuga

SEQ ID NO: 39834 - RNA, 1047 nt, Artificial Sequence
  derived and/or modified sequence opt2 from APOL4__Homo_sapiens__NP_085146
augggcuccuggguccagcucaucaccuccgucggcguccagcagaaccaccccggcuggaccgucgccggccaguuccaggagaagaagcgcuucaccgaggaggucaucgaguacuuccagaagaaggucucccccguccaccucaagauccuccucaccuccgacgaggccuggaagcgcuucguccgcgucgccgagcucccccgcgaggaggccgacgcccucuacgaggcccucaagaaccucacccccuacgucgccaucgaggacaaggacaugcagcagaaggagcagcaguuccgcgagugguuccucaaggaguucccccagauccgcuggaagauccaggaguccaucgagcgccuccgcgucaucgccaacgagaucgagaagguccaccgcggcugcgucaucgccaacgucgucuccggcuccaccggcauccucuccgucaucggcgucaugcucgcccccuucaccgccggccucucccucuccaucaccgccgccggcgucggccucggcaucgccuccgccaccgccggcaucgccuccuccaucgucgagaacaccuacacccgcuccgccgagcucaccgccucccgccucaccgccaccuccaccgaccagcucgaggcccuccgcgacauccuccgcgacaucacccccaacguccucuccuucgcccucgacuucgacgaggccaccaagaugaucgccaacgacguccacacccuccgccgcuccaaggccaccgucggccgcccccucaucgccuggcgcuacguccccaucaacgucgucgagacccuccgcacccgcggcgcccccacccgcaucguccgcaaggucgcccgcaaccucggcaaggccaccuccggcguccucgucguccucgacgucgucaaccucguccaggacucccucgaccuccacaagggcgccaaguccgaguccgccgagucccuccgccagugggcccaggagcucgaggagaaccucaacgagcucacccacauccaccagucccucaaggccggcuga

SEQ ID NO: 39835 - RNA, 1032 nt, Artificial Sequence
  derived and/or modified sequence opt2 from APOL6__Homo_sapiens__NP_085144
auggacaaccaggccgagcgcgaguccgaggccggcgucggccuccagcgcgacgaggacgacgccccccucugcgaggacgucgagcuccaggacggcgaccucucccccgaggagaagaucuuccuccgcgaguucccccgccucaaggaggaccucaagggcaacaucgacaagcuccgcgcccucgccgacgacaucgacaagacccacaagaaguucaccaaggccaacauggucgccaccuccaccgccgucaucuccggcgucaugucccuccucggccucgcccucgcccccgccaccggcggcggcucccuccuccucuccaccgccggccagggccucgccaccgccgccggcgucaccuccaucgucuccggcacccucgagcgcuccaagaacaaggaggcccaggcccgcgccgaggacauccuccccaccuacgaccaggaggaccgcgaggacgaggaggagaaggccgacuacgucaccgccgccggcaagaucaucuacaaccuccgcaacacccucaaguacgccaagaagaacguccgcgccuucuggaagcuccgcgccaacccccgccucgccaacgccaccaagcgccuccucaccaccggccaggucuccucccgcucccgcguccagguccagaaggccuucgccggcaccacccucgccaugaccaagaacgcccgcguccucggcggcgucauguccgccuucucccucggcuacgaccucgccacccucuccaaggaguggaagcaccucaaggagggcgcccgcaccaaguucgccgaggagcuccgcgccaaggcccucgagcucgagcgcaagcucaccgagcucacccagcucuacaagucccuccagcagaagguccgcucccgcgcccgcggcgucggcaaggaccucaccggcaccugcgagaccgaggccuacuggaaggagcuccgcgagcacgucuggauguggcucuggcucugcgucugccucugcgucugcgucuacguccaguucaccuga

SEQ ID NO: 39836 - RNA, 840 nt, Artificial Sequence
  derived and/or modified sequence opt2 from APOLD1__Homo_sapiens__NP_001123887
auguuccgcgcccccugccaccgccuccgcgcccgcggcacccgcaaggcccgcgccggcgccuggcgcggcugcaccuuccccugccucggcaagggcauggagcgccccgccgcccgcgagccccacggccccgacgcccuccgccgcuuccagggccuccuccucgaccgccgcggccgccuccacggccagguccuccgccuccgcgaggucgcccgccgccucgagcgccuccgccgccgcucccucgucgccaacgucgccggcuccucccucuccgccaccggcgcccucgccgccaucgucggccucucccucucccccgucacccucggcaccucccuccucgucuccgccgucggccucggcgucgccaccgccggcggcgccgucaccaucaccuccgaccucucccucaucuucugcaacucccgcgagcuccgccgcguccaggagaucgccgccaccugccaggaccagaugcgcgagauccucuccugccucgaguucuucugccgcuggcagggcugcggcgaccgccagcuccuccagugcggccgcaacgccuccaucgcccucuacaacuccgucuacuucaucgucuucuucggcucccgcggcuuccucaucccccgccgcgccgagggcgacaccaaggucucccaggccguccucaaggccaagauccagaagcucgccgagucccucgaguccugcaccggcgcccucgacgagcucuccgagcagcucgagucccgcguccagcucugcaccaaguccucccgcggccacgaccucaagaucuccgccgaccagcgcgccggccucuucuucuga

SEQ ID NO: 39837 - RNA, 351 nt, Artificial Sequence
  derived and/or modified sequence opt2 from APOM__Homo_sapiens__NP_001243098
auggccgccggcuccgcccccaugcagcuccaccuccgcgccaccauccgcaugaaggacggccucugcgucccccgcaaguggaucuaccaccucaccgagggcuccaccgaccuccgcaccgagggccgccccgacaugaagaccgagcucuucuccuccuccugccccggcggcaucaugcucaacgagaccggccagggcuaccagcgcuuccuccucuacaaccgcuccccccacccccccgagaagugcgucgaggaguucaagucccucaccuccugccucgacuccaaggccuuccuccucaccccccgcaaccaggaggccugcgagcucuccaacaacuga

SEQ ID NO: 39838 - RNA, 597 nt, Artificial Sequence
  derived and/or modified sequence opt2 from APOO__Homo_sapiens__NP_077027
auguucaaggucauccagcgcuccgucggccccgccucccucucccuccucaccuucaaggucuacgccgcccccaagaaggacuccccccccaagaacuccgucaaggucgacgagcucucccucuacuccguccccgagggccaguccaaguacgucgaggaggcccgcucccagcucgaggaguccaucucccagcuccgccacuacugcgagcccuacaccaccuggugccaggagaccuacucccagaccaagcccaagaugcagucccucguccaguggggccucgacuccuacgacuaccuccagaacgccccccccggcuucuucccccgccucggcgucaucggcuucgccggccucaucggccuccuccucgcccgcggcuccaagaucaagaagcucgucuacccccccggcuucaugggccucgccgccucccucuacuacccccagcaggccaucgucuucgcccaggucuccggcgagcgccucuacgacuggggccuccgcggcuacaucgucaucgaggaccucuggaaggagaacuuccagaagcccggcaacgucaagaacucccccggcaccaaguga

SEQ ID NO: 39839 - RNA, 621 nt, Artificial Sequence
  derived and/or modified sequence opt2 from APOPT1__Homo_sapiens__NP_115750
augcuccccugcgccgccggcgcccgcggccgcggcgccauggucguccuccgcgccggcaagaagaccuuccuccccccccucugccgcgccuucgccugccgcggcugccagcucgcccccgagcgcggcgccgagcgccgcgacaccgcccccuccggcgucucccgcuucugccccccccgcaaguccugccacgacuggaucggcccccccgacaaguacuccaaccuccgccccguccacuucuacauccccgagaacgaguccccccucgagcagaagcuccgcaagcuccgccaggagacccaggaguggaaccagcaguucugggccaaccagaaccucaccuucuccaaggagaaggaggaguucauccacucccgccucaagaccaagggccucggccuccgcaccgaguccggccagaaggccacccucaacgccgaggagauggccgacuucuacaaggaguuccucuccaagaacuuccagaagcacauguacuacaaccgcgacugguacaagcgcaacuucgccaucaccuucuucaugggcaaggucgcccucgagcgcaucuggaacaagcucaagcagaagcagaagaagcgcuccaacuga

SEQ ID NO: 39840 - RNA, 1758 nt, Artificial Sequence
  derived and/or modified sequence opt2 from APPBP2__Homo_sapiens__NP_006371
auggccgccgucgagcucgaguggauccccgagacccucuacaacaccgccaucuccgccgucgucgacaacuacauccgcucccgccgcgacauccgcucccuccccgagaacauccaguucgacgucuacuacaagcucuaccagcagggccgccucugccagcucggcuccgaguucugcgagcucgaggucuucgccaagguccuccgcgcccucgacaagcgccaccuccuccaccacugcuuccaggcccucauggaccacggcgucaaggucgccuccguccucgccuacuccuucucccgccgcugcuccuacaucgccgaguccgacgccgccgucaaggagaaggccauccaggucggcuucguccucggcggcuuccucuccgacgccggcugguacuccgacgccgagaaggucuuccucuccugccuccagcucugcacccuccacgacgagaugcuccacugguuccgcgccgucgagugcugcguccgccuccuccacguccgcaacggcaacugcaaguaccaccucggcgaggagaccuucaagcucgcccagaccuacauggacaagcucuccaagcacggccagcaggccaacaaggccgcccucuacggcgagcucugcgcccuccucuucgccaagucccacuacgacgaggccuacaaguggugcaucgaggccaugaaggagaucaccgccggccuccccgucaaggucgucgucgacguccuccgccaggccuccaaggccugcgucgucaagcgcgaguucaagaaggccgagcagcucaucaagcacgccgucuaccucgcccgcgaccacuucggcuccaagcaccccaaguacuccgacacccuccucgacuacggcuucuaccuccucaacgucgacaacaucugccaguccgucgccaucuaccaggccgcccucgacauccgccaguccgucuucggcggcaagaacauccacgucgccaccgcccacgaggaccucgccuacuccuccuacguccaccaguacuccuccggcaaguucgacaacgcccucuuccacgccgagcgcgccaucggcaucaucacccacauccuccccgaggaccaccuccuccucgccuccuccaagcgcgucaaggcccucauccucgaggagaucgccaucgacugccacaacaaggagaccgagcagcgccuccuccaggaggcccacgaccuccaccucuccucccuccagcucgccaagaaggccuucggcgaguucaacguccagaccgccaagcacuacggcaaccucggccgccucuaccaguccaugcgcaaguucaaggaggccgaggagaugcacaucaaggccauccagaucaaggagcagcuccucggccaggaggacuacgaggucgcccucuccgucggccaccucgccucccucuacaacuacgacaugaaccaguacgagaacgccgagaagcucuaccuccgcuccaucgccaucggcaagaagcucuucggcgagggcuacuccggccucgaguacgacuaccgcggccucaucaagcucuacaacuccaucggcaacuacgagaaggucuucgaguaccacaacguccucuccaacuggaaccgccuccgcgaccgccaguacuccgucaccgacgcccucgaggacgucuccaccuccccccaguccaccgaggaggucguccaguccuuccucaucucccagaacgucgagggccccuccugcuga

SEQ ID NO: 39841 - RNA, 2313 nt, Artificial Sequence
  derived and/or modified sequence opt2 from APP__Homo_sapiens__NP_000475
augcuccccggccucgcccuccuccuccucgccgccuggaccgcccgcgcccucgagguccccaccgacggcaacgccggccuccucgccgagccccagaucgccauguucugcggccgccucaacaugcacaugaacguccagaacggcaagugggacuccgaccccuccggcaccaagaccugcaucgacaccaaggagggcauccuccaguacugccaggaggucuaccccgagcuccagaucaccaacgucgucgaggccaaccagcccgucaccauccagaacuggugcaagcgcggccgcaagcagugcaagacccacccccacuucgucauccccuaccgcugccucgucggcgaguucgucuccgacgcccuccucguccccgacaagugcaaguuccuccaccaggagcgcauggacgucugcgagacccaccuccacuggcacaccgucgccaaggagaccugcuccgagaaguccaccaaccuccacgacuacggcaugcuccuccccugcggcaucgacaaguuccgcggcgucgaguucgucugcugcccccucgccgaggaguccgacaacgucgacuccgccgacgccgaggaggacgacuccgacgucugguggggcggcgccgacaccgacuacgccgacggcuccgaggacaaggucgucgaggucgccgaggaggaggaggucgccgaggucgaggaggaggaggccgacgacgacgaggacgacgaggacggcgacgaggucgaggaggaggccgaggagcccuacgaggaggccaccgagcgcaccaccuccaucgccaccaccaccaccaccaccaccgaguccgucgaggaggucguccgcgaggucugcuccgagcaggccgagaccggccccugccgcgccaugaucucccgcugguacuucgacgucaccgagggcaagugcgcccccuucuucuacggcggcugcggcggcaaccgcaacaacuucgacaccgaggaguacugcauggccgucugcggcuccgccaugucccagucccuccucaagaccacccaggagccccucgcccgcgaccccgucaagcuccccaccaccgccgccuccacccccgacgccgucgacaaguaccucgagacccccggcgacgagaacgagcacgcccacuuccagaaggccaaggagcgccucgaggccaagcaccgcgagcgcaugucccaggucaugcgcgagugggaggaggccgagcgccaggccaagaaccuccccaaggccgacaagaaggccgucauccagcacuuccaggagaaggucgagucccucgagcaggaggccgccaacgagcgccagcagcucgucgagacccacauggcccgcgucgaggccaugcucaacgaccgccgccgccucgcccucgagaacuacaucaccgcccuccaggccguccccccccgcccccgccacgucuucaacaugcucaagaaguacguccgcgccgagcagaaggaccgccagcacacccucaagcacuucgagcacguccgcauggucgaccccaagaaggccgcccagauccgcucccaggucaugacccaccuccgcgucaucuacgagcgcaugaaccagucccucucccuccucuacaacguccccgccgucgccgaggagauccaggacgaggucgacgagcuccuccagaaggagcagaacuacuccgacgacguccucgccaacaugaucuccgagccccgcaucuccuacggcaacgacgcccucaugcccucccucaccgagaccaagaccaccgucgagcuccuccccgucaacggcgaguucucccucgacgaccuccagcccuggcacuccuucggcgccgacuccguccccgccaacaccgagaacgaggucgagcccgucgacgcccgccccgccgccgaccgcggccucaccacccgccccggcuccggccucaccaacaucaagaccgaggagaucuccgaggucaagauggacgccgaguuccgccacgacuccggcuacgagguccaccaccagaagcucgucuucuucgccgaggacgucggcuccaacaagggcgccaucaucggccucauggucggcggcgucgucaucgccaccgucaucgucaucacccucgucaugcucaagaagaagcaguacaccuccauccaccacggcgucgucgaggucgacgccgccgucacccccgaggagcgccaccucuccaagaugcagcagaacggcuacgagaaccccaccuacaaguucuucgagcagaugcagaacuga

SEQ ID NO: 39842 - RNA, 2130 nt, Artificial Sequence
  derived and/or modified sequence opt2 from APPL1__Homo_sapiens__NP_036228
augcccggcaucgacaagcuccccaucgaggagacccucgaggacuccccccagacccgcucccuccucggcgucuucgaggaggacgccaccgccaucuccaacuacaugaaccagcucuaccaggccaugcaccgcaucuacgacgcccagaacgagcucuccgccgccacccaccucaccuccaagcuccucaaggaguacgagaagcagcgcuucccccucggcggcgacgacgaggucauguccuccacccuccagcaguucuccaaggucaucgacgagcucuccuccugccacgccguccucuccacccagcucgccgacgccaugauguuccccaucacccaguucaaggagcgcgaccucaaggagauccucacccucaaggaggucuuccagaucgccuccaacgaccacgacgccgccaucaaccgcuacucccgccucuccaagaagcgcgagaacgacaaggucaaguacgaggucaccgaggacgucuacaccucccgcaagaagcagcaccagaccaugaugcacuacuucugcgcccucaacacccuccaguacaagaagaagaucgcccuccucgagccccuccucggcuacaugcaggcccagaucuccuucuucaagaugggcuccgagaaccucaacgagcagcucgaggaguuccucgccaacaucggcaccuccguccagaacguccgccgcgagauggacuccgacaucgagaccaugcagcagaccaucgaggaccucgaggucgccuccgacccccucuacguccccgaccccgaccccaccaaguuccccgucaaccgcaaccucacccgcaaggccggcuaccucaacgcccgcaacaagaccggccucgucuccuccaccugggaccgccaguucuacuucacccagggcggcaaccucaugucccaggcccgcggcgacgucgccggcggccucgccauggacaucgacaacugcuccgucauggccgucgacugcgaggaccgccgcuacugcuuccagaucaccuccuucgacggcaagaaguccuccauccuccaggccgaguccaagaaggaccacgaggaguggaucugcaccaucaacaacaucuccaagcagaucuaccucuccgagaaccccgaggagaccgccgcccgcgucaaccaguccgcccucgaggccgucacccccucccccuccuuccagcagcgccacgagucccuccgccccgccgccggccagucccgcccccccaccgcccgcaccuccuccuccggcucccucggcuccgaguccaccaaccucgccgcccucucccucgacucccucgucgcccccgacacccccauccaguucgacaucaucucccccgucugcgaggaccagcccggccaggccaaggccuucggccagggcggccgccgcaccaaccccuucggcgaguccggcggcuccaccaaguccgagaccgaggacuccauccuccaccagcucuucaucguccgcuuccucggcuccauggaggucaaguccgacgaccaccccgacgucgucuacgagaccaugcgccagauccucgccgcccgcgccauccacaacaucuuccgcaugaccgagucccaccuccucgucaccugcgacugccucaagcucaucgacccccagacccaggucacccgccucaccuucccccuccccugcgucguccucuacgccacccaccaggagaacaagcgccucuucggcuucguccuccgcaccuccuccggccgcuccgaguccaaccucuccuccgucugcuacaucuucgaguccaacaacgagggcgagaagaucugcgacuccgucggccucgccaagcagaucgcccuccacgccgagcucgaccgccgcgccuccgagaagcagaaggagaucgagcgcgucaaggagaagcagcagaaggagcucaacaagcagaagcagaucgagaaggaccucgaggagcagucccgccucaucgccgccuccucccgccccaaccaggccuccuccgagggccaguucgucguccucuccuccucccaguccgaggaguccgaccucggcgagggcggcaagaagcgcgaguccgaggccuga

SEQ ID NO: 39843 - RNA, 2013 nt, Artificial Sequence
  derived and/or modified sequence opt2 from APPL2__Homo_sapiens__NP_001238833
augcccgccgucgacaagcuccuccucgaggaggcccuccaggacuccccccagacccgcucccuccucuccgucuucgaggaggacgccggcacccucaccgacuacaccaaccagcuccuccaggccaugcagcgcgucuacggcgcccagaacgagaugugccucgccacccagcagcucuccaagcagcuccucgccuacgagaagcagaacuucgcccucggcaagggcgacgaggaggucaucuccacccuccacuacuucuccaaggucgucgacgagcucaaccuccuccacaccgagcucgccaagcagcucgccgacaccaugguccuccccaucauccaguuccgcgagaaggaccucaccgaggucuccacccucaaggaccucuucggccucgccuccaacgacgucugccucuuccucgagcacgaccucuccauggccaaguacucccgccuccccaagaagaaggagaacgagaaggucaagaccgaggucggcaaggaggucgccgccgcccgccgcaagcagcaccucuccucccuccaguacuacugcgcccucaacgcccuccaguaccgcaagcagauggccaugauggagcccaugaucggcuucgcccacggccagaucaacuucuucaagaagggcgccgagauguucuccaagcgcauggacuccuuccucuccuccgucgccgacaugguccaguccauccaggucgagcucgaggccgaggccgagaagaugcgcgucucccagcaggagcuccucuccgucgacgaguccgucuacacccccgacuccgacgucgccgccccccagaucaaccgcaaccucauccagaaggccggcuaccucaaccuccgcaacaagaccggccucgucaccaccaccugggagcgccucuacuucuucacccagggcggcaaccucaugugccagccccgcggcgccgucgccggcggccucauccaggaccucgacaacugcuccgucauggccgucgacugcgaggaccgccgcuacugcuuccagaucaccacccccaacggcaaguccggcaucauccuccaggccgagucccgcaaggagaacgaggaguggaucugcgccaucaacaacaucucccgccagaucuaccucaccgacaaccccgaggccgucgccaucaagcucaaccagaccgcccuccaggccgucacccccaucaccuccuucggcaagaagcaggaguccuccugccccucccagaaccucaagaacuccgagauggagaacgagaacgacaagaucguccccaaggccaccgccucccuccccgaggccgaggagcucaucgcccccggcacccccauccaguucgacaucguccuccccgccaccgaguuccucgaccagaaccgcggcucccgccgcaccaaccccuucggcgagaccgaggacgaguccuuccccgaggccgaggacucccuccuccagcagauguucaucguccgcuuccucggcuccauggccgucaagaccgacuccaccaccgaggucaucuacgaggccaugcgccagguccucgccgcccgcgccauccacaacaucuuccgcaugaccgagucccaccucauggucaccucccagucccuccgccucaucgacccccagacccaggucucccgcgccaacuucgagcucaccuccgucacccaguucgccgcccaccaggagaacaagcgccucgucggcuucgucauccgcguccccgaguccaccggcgaggagucccucuccaccuacaucuucgaguccaacuccgagggcgagaagaucugcuacgccaucaaccucggcaaggagaucaucgagguccagaaggaccccgaggcccucgcccagcucaugcucuccaucccccucaccaacgacggcaaguacguccuccucaacgaccagcccgacgacgacgacggcaaccccaacgagcaccgcggcgccgaguccgaggccuga

SEQ ID NO: 39844 - RNA, 543 nt, Artificial Sequence
  derived and/or modified sequence opt2 from APRT__Homo_sapiens__NP_000476
auggccgacuccgagcuccagcucgucgagcagcgcauccgcuccuuccccgacuuccccacccccggcgucgucuuccgcgacaucucccccguccucaaggaccccgccuccuuccgcgccgccaucggccuccucgcccgccaccucaaggccacccacggcggccgcaucgacuacaucgccggccucgacucccgcggcuuccucuucggccccucccucgcccaggagcucggccucggcugcguccucauccgcaagcgcggcaagcuccccggccccacccucugggccuccuacucccucgaguacggcaaggccgagcucgagauccagaaggacgcccucgagcccggccagcgcgucgucgucgucgacgaccuccucgccaccggcggcaccaugaacgccgccugcgagcuccucggccgccuccaggccgagguccucgagugcgucucccucgucgagcucaccucccucaagggccgcgagaagcucgcccccguccccuucuucucccuccuccaguacgaguga

SEQ ID NO: 39845 - RNA, 1071 nt, Artificial Sequence
  derived and/or modified sequence opt2 from APTX__Homo_sapiens__NP_001182177
auguccaacgucaaccucuccgucuccgacuucuggcgcgucaugaugcgcgucugcuggcucguccgccaggacucccgccaccagcgcauccgccucccccaccucgaggccgucgucaucggccgcggccccgagaccaagaucaccgacaagaagugcucccgccagcagguccagcucaaggccgagugcaacaagggcuacgucaaggucaagcaggucggcgucaaccccaccuccaucgacuccgucgucaucggcaaggaccaggaggucaagcuccagcccggccagguccuccacauggucaacgagcucuaccccuacaucgucgaguucgaggaggaggccaagaaccccggccucgagacccaccgcaagcgcaagcgcuccggcaacuccgacuccaucgagcgcgacgccgcccaggaggccgaggccggcaccggccucgagcccggcuccaacuccggccagugcuccgucccccucaagaagggcaaggacgcccccaucaagaaggagucccucggccacuggucccagggccucaagaucuccaugcaggaccccaagaugcaggucuacaaggacgagcaggucgucgucaucaaggacaaguaccccaaggcccgcuaccacuggcucguccuccccuggaccuccaucuccucccucaaggccgucgcccgcgagcaccucgagcuccucaagcacaugcacaccgucggcgagaaggucaucgucgacuucgccggcuccuccaagcuccgcuuccgccucggcuaccacgccauccccuccaugucccacguccaccuccacgucaucucccaggacuucgacucccccugccucaagaacaagaagcacuggaacuccuucaacaccgaguacuuccucgagucccaggccgucaucgagaugguccaggaggccggccgcgucaccguccgcgacggcaugcccgagcuccucaagcucccccuccgcugccacgagugccagcagcuccuccccuccaucccccagcucaaggagcaccuccgcaagcacuggacccaguga

SEQ ID NO: 39846 - RNA, 906 nt, Artificial Sequence
  derived and/or modified sequence opt2 from AQP10__Homo_sapiens__NP_536354
auggucuucacccaggcccccgccgagaucaugggccaccuccgcauccgcucccuccucgcccgccagugccucgccgaguuccucggcgucuucguccucaugcuccucacccagggcgccgucgcccaggccgucaccuccggcgagaccaagggcaacuucuucaccauguuccucgccggcucccucgccgucaccaucgccaucuacgucggcggcaacgucuccggcgcccaccucaaccccgccuucucccucgccaugugcaucgucggccgccuccccugggucaagcuccccaucuacauccucguccagcuccucuccgccuucugcgccuccggcgccaccuacguccucuaccacgacgcccuccagaacuacaccggcggcaaccucaccgucaccggccccaaggagaccgccuccaucuucgccaccuaccccgcccccuaccucucccucaacaacggcuuccucgaccagguccucggcaccggcaugcucaucgucggccuccucgccauccucgaccgccgcaacaagggcguccccgccggccucgagcccgucgucgucggcaugcucauccucgcccucggccucuccaugggcgccaacugcggcaucccccucaaccccgcccgcgaccucggcccccgccucuucaccuacgucgccggcuggggccccgaggucuucuccgccggcaacggcuggugguggguccccgucgucgccccccucgucggcgccaccgucggcaccgccaccuaccagcuccucgucgcccuccaccaccccgagggccccgagcccgcccaggaccucgucuccgcccagcacaaggccuccgagcucgagacccccgccuccgcccagaugcucgagugcaagcucuga

SEQ ID NO: 39847 - RNA, 561 nt, Artificial Sequence
  derived and/or modified sequence opt2 from AQP1__Homo_sapiens__NP_001171989
augcccggcgcccgcccccucccccucguccucgucccccagaacacccucgccuggaugcagcucgacgccaaggcccccgcccacccccgcccccuccagcuccucggccgcgucggccccggcucccgccagcucgccgacggcgucaacuccggccagggccucggcaucgagaucaucggcacccuccagcucguccucugcguccucgccaccaccgaccgccgccgccgcgaccucggcggcuccgccccccucgccaucggccucuccgucgcccucggccaccuccucgccaucgacuacaccggcugcggcaucaaccccgcccgcuccuucggcuccgccgucaucacccacaacuucuccaaccacuggaucuucugggucggccccuucaucggcggcgcccucgccguccucaucuacgacuucauccucgccccccgcuccuccgaccucaccgaccgcgucaaggucuggaccuccggccaggucgaggaguacgaccucgacgccgacgacaucaacucccgcgucgagaugaagcccaaguga

SEQ ID NO: 39848 - RNA, 816 nt, Artificial Sequence
  derived and/or modified sequence opt2 from AQP2__Homo_sapiens__NP_000477
augugggagcuccgcuccaucgccuucucccgcgccgucuucgccgaguuccucgccacccuccucuucgucuucuucggccucggcuccgcccucaacuggccccaggcccuccccuccguccuccagaucgccauggccuucggccucggcaucggcacccucguccaggcccucggccacaucuccggcgcccacaucaaccccgccgucaccgucgccugccucgucggcugccacgucuccguccuccgcgccgccuucuacgucgccgcccagcuccucggcgccgucgccggcgccgcccuccuccacgagaucacccccgccgacauccgcggcgaccucgccgucaacgcccucuccaacuccaccaccgccggccaggccgucaccgucgagcucuuccucacccuccagcucguccucugcaucuucgccuccaccgacgagcgccgcggcgagaaccccggcacccccgcccucuccaucggcuucuccgucgcccucggccaccuccucggcauccacuacaccggcugcuccaugaaccccgcccgcucccucgcccccgccgucgucaccggcaaguucgacgaccacugggucuucuggaucggcccccucgucggcgccauccucggcucccuccucuacaacuacguccucuucccccccgccaagucccucuccgagcgccucgccguccucaagggccucgagcccgacaccgacugggaggagcgcgagguccgccgccgccaguccgucgagcuccacuccccccagucccucccccgcggcaccaaggccuga

SEQ ID NO: 39849 - RNA, 879 nt, Artificial Sequence
  derived and/or modified sequence opt2 from AQP3__Homo_sapiens__NP_004916
augggccgccagaaggagcucgucucccgcugcggcgagaugcuccacauccgcuaccgccuccuccgccaggcccucgccgagugccucggcacccucauccucgucauguucggcugcggcuccgucgcccaggucguccucucccgcggcacccacggcggcuuccucaccaucaaccucgccuucggcuucgccgucacccucggcauccucaucgccggccaggucuccggcgcccaccucaaccccgccgucaccuucgccaugugcuuccucgcccgcgagcccuggaucaagcuccccaucuacacccucgcccagacccucggcgccuuccucggcgccggcaucgucuucggccucuacuacgacgccaucuggcacuucgccgacaaccagcucuucgucuccggccccaacggcaccgccggcaucuucgccaccuaccccuccggccaccucgacaugaucaacggcuucuucgaccaguucaucggcaccgccucccucaucgucugcguccucgccaucgucgaccccuacaacaaccccgucccccgcggccucgaggccuucaccgucggccucgucguccucgucaucggcaccuccaugggcuucaacuccggcuacgccgucaaccccgcccgcgacuucggcccccgccucuucaccgcccucgccggcuggggcuccgccgucuucaccaccggccagcacuggugguggguccccaucgucuccccccuccucggcuccaucgccggcgucuucgucuaccagcucaugaucggcugccaccucgagcagcccccccccuccaacgaggaggagaacgucaagcucgcccacgucaagcacaaggagcagaucuga

SEQ ID NO: 39850 - RNA, 972 nt, Artificial Sequence
  derived and/or modified sequence opt2 from AQP4__Homo_sapiens__NP_001641
auguccgaccgccccaccgcccgccgcuggggcaagugcggcccccucugcacccgcgagaacaucauggucgccuucaagggcgucuggacccaggccuucuggaaggccgucaccgccgaguuccucgccaugcucaucuucguccuccucucccucggcuccaccaucaacuggggcggcaccgagaagccccuccccgucgacaugguccucaucucccucugcuucggccucuccaucgccaccaugguccagugcuucggccacaucuccggcggccacaucaaccccgccgucaccgucgccauggucugcacccgcaagaucuccaucgccaaguccgucuucuacaucgccgcccagugccucggcgccaucaucggcgccggcauccucuaccucgucaccccccccuccgucgucggcggccucggcgucaccaugguccacggcaaccucaccgccggccacggccuccucgucgagcucaucaucaccuuccagcucgucuucaccaucuucgccuccugcgacuccaagcgcaccgacgucaccggcuccaucgcccucgccaucggcuucuccgucgccaucggccaccucuucgccaucaacuacaccggcgccuccaugaaccccgcccgcuccuucggccccgccgucaucaugggcaacugggagaaccacuggaucuacugggucggccccaucaucggcgccguccucgccggcggccucuacgaguacgucuucugccccgacgucgaguucaagcgccgcuucaaggaggccuucuccaaggccgcccagcagaccaagggcuccuacauggaggucgaggacaaccgcucccaggucgagaccgacgaccucauccucaagcccggcgucguccacgucaucgacgucgaccgcggcgaggagaagaagggcaaggaccaguccggcgagguccucuccuccgucuga

SEQ ID NO: 39851 - RNA, 798 nt, Artificial Sequence
  derived and/or modified sequence opt2 from AQP5__Homo_sapiens__NP_001642
augaagaaggaggucugcuccgucgccuuccucaaggccgucuucgccgaguuccucgccacccucaucuucgucuucuucggccucggcuccgcccucaaguggcccuccgcccuccccaccauccuccagaucgcccucgccuucggccucgccaucggcacccucgcccaggcccucggccccgucuccggcggccacaucaaccccgccaucacccucgcccuccucgucggcaaccagaucucccuccuccgcgccuucuucuacgucgccgcccagcucgucggcgccaucgccggcgccggcauccucuacggcgucgccccccucaacgcccgcggcaaccucgccgucaacgcccucaacaacaacaccacccagggccaggccauggucgucgagcucauccucaccuuccagcucgcccucugcaucuucgccuccaccgacucccgccgcaccucccccgucggcucccccgcccucuccaucggccucuccgucacccucggccaccucgucggcaucuacuucaccggcugcuccaugaaccccgcccgcuccuucggccccgccgucgucaugaaccgcuucucccccgcccacugggucuucugggucggccccaucgucggcgccguccucgccgccauccucuacuucuaccuccucuuccccaacucccucucccucuccgagcgcgucgccaucaucaagggcaccuacgagcccgacgaggacugggaggagcagcgcgaggagcgcaagaagaccauggagcucaccacccgcuga

SEQ ID NO: 39852 - RNA, 849 nt, Artificial Sequence
  derived and/or modified sequence opt2 from AQP6__Homo_sapiens__NP_001643
auggacgccgucgagcccggcggccgcggcugggccuccaugcucgccugccgccucuggaaggccaucucccgcgcccucuucgccgaguuccucgccaccggccucuacgucuucuucggcgucggcuccgucaugcgcuggcccaccgcccuccccuccguccuccagaucgccaucaccuucaaccucgucaccgccauggccguccaggucaccuggaaggccuccggcgcccacgccaaccccgccgucacccucgccuuccucgucggcucccacaucucccucccccgcgccgucgccuacgucgccgcccagcucgucggcgccaccgucggcgccgcccuccucuacggcgucaugcccggcgacauccgcgagacccucggcaucaacgucguccgcaacuccgucuccaccggccaggccgucgccgucgagcuccuccucacccuccagcucguccucugcgucuucgccuccaccgacucccgccagaccuccggcucccccgccaccaugaucggcaucuccgucgcccucggccaccucaucggcauccacuucaccggcugcuccaugaaccccgcccgcuccuucggccccgccaucaucaucggcaaguucaccguccacugggucuucugggucggcccccucaugggcgcccuccucgccucccucaucuacaacuucguccucuuccccgacaccaagacccucgcccagcgccucgccauccucaccggcaccgucgaggucggcaccggcgccggcgccggcgccgagccccucaagaaggagucccagcccggcuccggcgccgucgagauggaguccgucuga

SEQ ID NO: 39853 - RNA, 1029 nt, Artificial Sequence
  derived and/or modified sequence opt2 from AQP7__Homo_sapiens__NP_001161
augguccaggccuccggccaccgccgcuccacccgcggcuccaagauggucuccugguccgucaucgccaagauccaggagauccuccagcgcaagaugguccgcgaguuccucgccgaguucauguccaccuacgucaugauggucuucggccucggcuccgucgcccacaugguccucaacaagaaguacggcuccuaccucggcgucaaccucggcuucggcuucggcgucaccaugggcguccacgucgccggccgcaucuccggcgcccacaugaacgccgccgucaccuucgccaacugcgcccucggccgcguccccuggcgcaaguuccccgucuacguccucggccaguuccucggcuccuuccucgccgccgccaccaucuacucccucuucuacaccgccauccuccacuucuccggcggccagcucauggucaccggccccgucgccaccgccggcaucuucgccaccuaccuccccgaccacaugacccucuggcgcggcuuccucaacgaggccuggcucaccggcaugcuccagcucugccucuucgccaucaccgaccaggagaacaaccccgcccuccccggcaccgaggcccucgucaucggcauccucgucgucaucaucggcgucucccucggcaugaacaccggcuacgccaucaaccccucccgcgaccuccccccccgcaucuucaccuucaucgccggcuggggcaagcaggucuucuccaacggcgagaacuggugguggguccccgucgucgccccccuccucggcgccuaccucggcggcaucaucuaccucgucuucaucggcuccaccaucccccgcgagccccucaagcucgaggacuccgucgccuacgaggaccacggcaucaccguccuccccaagaugggcucccacgagcccaccaucuccccccucacccccgucuccgucucccccgccaaccgcuccuccguccaccccgcccccccccuccacgaguccauggcccucgagcacuucuga

SEQ ID NO: 39854 - RNA, 786 nt, Artificial Sequence
  derived and/or modified sequence opt2 from AQP8__Homo_sapiens__NP_001160
auguccggcgagaucgccaugugcgagcccgaguucggcaacgacaaggcccgcgagcccuccgucggcggccgcuggcgcgucuccugguacgagcgcuucguccagcccugccucgucgagcuccucggcuccgcccucuucaucuucaucggcugccucuccgucaucgagaacggcaccgacaccggccuccuccagcccgcccucgcccacggccucgcccucggccucgucaucgccacccucggcaacaucuccggcggccacuucaaccccgccgucucccucgccgccaugcucaucggcggccucaaccucgucaugcuccuccccuacugggucucccagcuccucggcggcaugcucggcgccgcccucgccaaggccgucucccccgaggagcgcuucuggaacgccuccggcgccgccuucgucaccguccaggagcagggccaggucgccggcgcccucgucgccgagaucauccucaccacccuccucgcccucgccgucugcaugggcgccaucaacgagaagaccaagggcccccucgcccccuucuccaucggcuucgccgucaccgucgacauccucgccggcggccccgucuccggcggcugcaugaaccccgcccgcgccuucggccccgccgucgucgccaaccacuggaacuuccacuggaucuacuggcucggcccccuccucgccggccuccucgucggccuccucauccgcugcuucaucggcgacggcaagacccgccucauccucaaggcccgcuga

SEQ ID NO: 39855 - RNA, 888 nt, Artificial Sequence
  derived and/or modified sequence opt2 from AQP9__Homo_sapiens__NP_066190
augcagcccgagggcgccgagaagggcaaguccuucaagcagcgccucguccucaaguccucccucgccaaggagacccucuccgaguuccucggcaccuucauccucaucguccucggcugcggcugcgucgcccaggccauccucucccgcggccgcuucggcggcgucaucaccaucaacgucggcuucuccauggccgucgccauggccaucuacgucgccggcggcgucuccggcggccacaucaaccccgccgucucccucgccaugugccucuucggccgcaugaagugguucaagcuccccuucuacgucggcgcccaguuccucggcgccuucgucggcgccgccaccgucuucggcaucuacuacgacggccucauguccuucgccggcggcaagcuccucaucgucggcgagaacgccaccgcccacaucuucgccaccuaccccgcccccuaccucucccucgccaacgccuucgccgaccaggucgucgccaccaugauccuccucaucaucgucuucgccaucuucgacucccgcaaccucggcgccccccgcggccucgagcccaucgccaucggccuccucaucaucgucaucgccuccucccucggccucaacuccggcugcgccaugaaccccgcccgcgaccucuccccccgccucuucaccgcccucgccggcuggggcuucgaggucuuccgcgccggcaacaacuucugguggauccccgucgucggcccccucgucggcgccgucaucggcggccucaucuacguccucgucaucgagauccaccaccccgagcccgacuccgucuucaagaccgagcaguccgaggacaagcccgagaaguacgagcucuccgucaucauguga

SEQ ID NO: 39856 - RNA, 561 nt, Artificial Sequence
  derived and/or modified sequence opt2 from ARAF__Homo_sapiens__NP_001243126
auggagcccccccgcggcccccccgccaacggcgccgagcccucccgcgccgucggcaccgucaaggucuaccuccccaacaagcagcgcaccgucgucaccguccgcgacggcauguccgucuacgacucccucgacaaggcccucaagguccgcggccucaaccaggacugcugcgucgucuaccgccucaucaagggccgcaagaccgucaccgccugggacaccgccaucgccccccucgacggcgaggagcucaucgucgagguccucgaggacgucccccucaccaugcacaacuucguccgcaagaccuucuucucccucgccuucugcgacuucugccucaaguuccucuuccacggcuuccgcugccagaccugcggcuacaaguuccaccagcacugcuccuccaagguccccaccgucugcgucgacauguccaccaaccgccagcaguucuaccacuccguccaggaccucuccggcggcucccgccagcacgaggcccccuccaaccgcccccucaacgagcuccucaccccccagggcccccgcuga

SEQ ID NO: 39857 - RNA, 4353 nt, Artificial Sequence
  derived and/or modified sequence opt2 from ARAP1__Homo_sapiens__NP_001035207
auggccgaggccggcgacgccgcccucuccgucgccgaguggcuccgcgcccuccaccucgagcaguacaccggccucuucgagcagcacggccucgucugggccaccgagugccagggccucuccgacacccgccucauggacaugggcaugcuccuccccggccaccgccgccgcauccucgccggccuccuccgcgcccacaccucccccgcccccgccccccgccccaccccccgccccguccccaugaagcgccacaucuuccgcuccccccccguccccgccaccccccccgagccccuccccaccaccaccgaggacgagggccuccccgccgccccccccauccccccccgccgcuccugccucccccccaccugcuucaccacccccuccaccgccgcccccgaccccguccuccccccccuccccgccaagcgccaccucgccgagcucuccgucccccccguccccccccgcaccggccccccccgccuccucgucucccuccccaccaaggaggaggagucccuccuccccucccucuccucccccccccagccccaguccgaggagccccucuccacccucccccagggccccccccagccccccucccccccccccugcccccccgagaucccccccaagcccguccgccucuuccccgaguucgacgacuccgacuacgacgagguccccgaggagggccccggcgcccccgcccgcgucaugaccaagaaggaggagcccccccccucccgcgucccccgcgccguccgcgucgccucccuccucuccgagggcgaggagcucuccggcgacgaccagggcgacgaggaggaggacgaccacgccuacgagggcguccccaacggcggcuggcacaccuccucccucucccucucccuccccuccaccaucgccgccccccaccccauggacggcccccccggcggcuccacccccgucacccccgucaucaaggccggcuggcucgacaagaaccccccccagggcuccuacaucuaccagaagcgcuggguccgccucgacaccgaccaccuccgcuacuucgacuccaacaaggacgccuacuccaagcgcuucaucuccgucgccugcaucucccacgucgccgccaucggcgaccagaaguucgaggucaucaccaacaaccgcaccuucgccuuccgcgccgaguccgacgucgagcgcaaggaguggaugcaggcccuccagcaggccauggccgagcagcgcgcccgcgcccgccucuccuccgccuaccuccucggcguccccggcuccgagcagcccgaccgcgccggcucccucgagcuccgcggcuucaagaacaagcucuacgucgccgucgucggcgacaagguccagcucuacaagaaccucgaggaguaccaccucggcaucggcaucaccuucaucgacauguccgucggcaacgucaaggaggucgaccgccgcuccuucgaccucaccacccccuaccgcaucuucuccuucuccgccgacuccgagcucgagaaggagcaguggcucgaggccaugcagggcgccaucgccgaggcccucuccaccuccgaggucgccgagcgcaucugggccgccgcccccaaccgcuucugcgccgacugcggcgccccccagcccgacugggccuccaucaaccucugcgucgucaucugcaagcgcugcgccggcgagcaccgcggccucggcgccggcgucuccaagguccgcucccucaagauggaccgcaaggucuggaccgagacccucaucgagcucuuccuccagcucggcaacggcgccggcaaccgcuucugggccgccaacgucccccccuccgaggcccuccagcccuccuccucccccuccacccgccgcugccaccucgaggccaaguaccgcgagggcaaguaccgccgcuaccacccccucuucggcaaccaggaggagcucgacaaggcccucugcgccgccgucaccaccaccgaccucgccgagacccaggcccuccucggcugcggcgccggcaucaacugcuucuccggcgaccccgaggcccccaccccccucgcccucgccgagcaggccggccagacccuccagauggaguuccuccgcaacaaccgcaccaccgaggucccccgccucgacuccaugaagccccucgagaagcacuacuccgucguccuccccaccgucucccacuccggcuuccucuacaagaccgccuccgccggcaagcuccuccaggaccgccgcgcccgcgaggaguucucccgccgcuggugcguccucggcgacggcguccucuccuacuucgagaacgagcgcgccgucacccccaacggcgagauccgcgccuccgagaucgucugccucgccguccccccccccgacacccacggcuucgagcacaccuucgaggucuacaccgagggcgagcgccucuaccucuucggccucgaguccgccgagcaggcccacgagugggucaagugcaucgccaaggccuucguccccccccucgccgaggaccuccucgcccgcgacuucgagcgccucggccgccuccccuacaaggccggccucucccuccagcgcgcccaggagggcugguucucccucuccggcuccgagcuccgcgccgucuuccccgagggccccugcgaggagccccuccagcuccgcaagcuccaggagcucuccauccagggcgacuccgagaaccagguccucguccucgucgagcgccgccgcacccucuacauccagggcgagcgccgccucgacuucaugggcuggcucggcgccauccagaaggccgccgccuccaugggcgacacccucuccgagcagcagcucggcgacuccgacauccccgucaucgucuaccgcugcgucgacuacaucacccagugcggccucaccuccgagggcaucuaccgcaagugcggccagaccuccaagacccagcgccuccucgagucccuccgccaggacgcccgcuccguccaccucaaggagggcgagcagcacgucgacgacgucuccuccgcccucaagcgcuuccuccgcgaccuccccgacggccucuucacccgcgcccagcgccucaccuggcucgaggccuccgagaucgaggacgaggaggagaaggucucccgcuaccgcgagcuccucguccgccucccccccgucaaccgcgccaccgucaaggcccucaucucccaccucuacugcguccagugcuucuccgacaccaaccagaugaacguccacaaccucgccaucgucuucggccccacccucuuccagaccgacggccaggacuacaaggccggccgcgucgucgaggaccucaucaaccacuacgucgucgucuucuccgucgacgaggaggagcuccgcaagcagcgcgaggagaucaccgccaucgucaagaugcgcgucgccggcaccgccuccggcacccagcacgccggcgacuucaucugcaccgucuaccucgaggagaagaaggccgagaccgagcagcacaucaagguccccgccuccaugaccgccgaggagcucacccucgagauccucgaccgccgcaacgucggcauccgcgagaaggacuacuggaccugcuucgaggucaacgagcgcgaggaggccgagcgcccccuccacuucgccgagaagguccuccccauccuccacggccucggcaccgacucccaccucgucgucaagaagcaccaggccauggaggccaugcuccucuaccucgccucccgcgucggcgacaccaagcacggcaugaugaaguuccgcgaggaccgcucccuccucggccucggccuccccuccggcggcuuccacgaccgcuacuucauccucaacuccuccugccuccgccucuacaaggagguccgcucccagcgccccugguccggcgcccccgagaccucccaccgccccgagaaggaguggcccaucaagucccucaaggucuaccucggcgucaagaagaagcuccgcccccccaccugcuggggcuucaccgucguccacgagaccgagaagcacgagaagcagcagugguaccucugcugcgacacccagauggagcuccgcgagugguucgccaccuuccucuucguccagcacgacggccucgucuggcccuccgagcccucccgcgucucccgcgccguccccgagguccgccucggcuccgucucccucaucccccuccgcggcuccgagaacgagaugcgccgcuccgucgccgccuucaccgccgacccccucucccuccuccgcaacgucuga

SEQ ID NO: 39858 - RNA, 4635 nt, Artificial Sequence
  derived and/or modified sequence opt2 from ARAP3__Homo_sapiens__NP_071926
auggccgccccccaggaccucgacaucgccgucuggcucgccaccguccaccucgagcaguacgccgacaccuuccgccgccacggccucgccaccgccggcgccgcccgcggccucggccacgaggagcucaagcagcucggcaucuccgccaccggccaccgcaagcgcauccuccgccuccuccagaccggcaccgaggagggcucccucgaccccaaguccgacuccgccauggagcccucccccucccccgccccccaggcccagccccccaagcccguccccaagccccgcaccgucuucggcggccucuccggccccgccaccacccagcgccccggccucucccccgcccucggcggccccggcgucucccgcucccccgagcccuccccccgcccccccccccuccccaccuccuccuccgagcaguccuccgcccucaacaccgucgagaugaugcccaacuccaucuacuucggccucgacucccgcggccgcgcccaggccgcccaggacaaggcccccgacuccucccagaucuccgcccccacccccgcccuccgccccaccaccggcaccguccacaucauggaccccggcugccucuacuacggcguccagcccgucggcacccccggcgcccccgaccgccgcgagucccgcggcgucugccagggccgcgccgagcaccgccucucccgccaggaccucgaggcccgcgaggacgccggcuacgccucccucgagcuccccggcgacuccacccuccucucccccacccucgagaccgaggagaccuccgacgaccucaucucccccuacgccuccuucuccuucaccgccgaccgccucaccccccuccucuccggcuggcucgacaagcucuccccccagggcaacuacgucuuccagcgccgcuucguccaguucaacggccgcucccucauguacuucggcuccgacaaggaccccuuccccaagggcgucaucccccucaccgccaucgagaugacccgcuccuccaaggacaacaaguuccaggucaucaccggccagcgcgucuucgucuuccgcaccgaguccgaggcccagcgcgacauguggugcuccacccuccaguccugccucaaggagcagcgccuccucggccacccccgccccccccagcccccccgcccccuccgcaccggcaugcucgagcuccgcggccacaaggccaaggucuucgccgcccucucccccggcgagcucgcccucuacaaguccgagcaggccuucucccucggcaucggcaucugcuucaucgagcuccagggcugcuccguccgcgagaccaagucccgcuccuucgaccuccucaccccccaccgcugcuucuccuucaccgccgaguccggcggcgcccgccaguccugggccgccgcccuccaggaggccgucaccgagacccucuccgacuacgaggucgccgagaagaucugguccaaccgcgccaaccgccagugcgccgacugcggcuccucccgccccgacugggccgccgucaaccucggcgucgucaucugcaagcagugcgccggccagcaccgcgcccucggcuccggcaucuccaagguccagucccucaagcucgacaccuccgucugguccaacgagaucguccagcucuucaucguccucggcaacgaccgcgccaaccgcuucugggccggcacccucccccccggcgagggccuccaccccgacgccacccccggcccccgcggcgaguucaucucccgcaaguaccgccucggccucuuccgcaagccccacccccaguaccccgaccacucccagcuccuccaggcccucugcgccgccgucgcccgccccaaccuccucaagaacaugacccagcuccucugcgucgaggccuucgagggcgaggagcccugguucccccccgcccccgacggcuccugccccggccuccuccccuccgaccccucccccggcgucuacaacgaggucgucguccgcgccaccuacuccggcuuccucuacugcucccccgucuccaacaaggccggccccucccccccccgccgcggccgcgacgcccccccccgccucuggugcguccucggcgccgcccucgagauguucgccuccgagaacucccccgagccccucucccucauccagccccaggacaucgucugccucggcgucucccccccccccaccgaccccggcgaccgcuuccccuucuccuucgagcucauccucgccggcggccgcauccagcacuucggcaccgacggcgccgacucccucgaggccuggaccuccgccgucggcaagugguucuccccccucuccugccaccagcuccucggccccggccuccuccgccucggccgccucuggcuccgcucccccucccacaccgcccccgcccccggccucuggcucuccggcuucggccuccuccgcggcgaccaccucuuccucugcuccgcccccggccccggcccccccgcccccgaggacaugguccaccuccgccgccuccaggagaucuccgucgucuccgccgccgacacccccgacaagaaggagcaccucguccucgucgagaccggccgcacccucuaccuccagggcgagggccgccucgacuucaccgccuggaacgccgccaucggcggcgccgccggcggcggcggcaccggccuccaggagcagcagaugucccgcggcgacauccccaucaucgucgacgccugcaucuccuucgucacccagcacggccuccgccucgagggcgucuaccgcaagggcggcgcccgcgcccgcucccuccgccuccucgccgaguuccgccgcgacgcccgcuccgucaagcuccgccccggcgagcacuucgucgaggacgucaccgacacccucaagcgcuucuuccgcgagcucgacgaccccgucaccuccgcccgccuccucccccgcuggcgcgaggccgccgagcucccccagaagaaccagcgccucgagaaguacaaggacgucaucggcugccucccccgcgucaaccgccgcacccucgccacccucaucggccaccucuaccgcguccagaagugcgccgcccucaaccagaugugcacccgcaaccucgcccuccucuucgcccccuccgucuuccagaccgacggccgcggcgagcacgagguccgcguccuccaggagcucaucgacggcuacaucuccgucuucgacaucgacuccgaccaggucgcccagaucgaccucgaggucucccucaucaccaccuggaaggacguccagcucucccaggccggcgaccucaucauggaggucuacaucgagcagcagcuccccgacaacugcgucacccucaaggucucccccacccucaccgccgaggagcucaccaaccagguccucgagaugcgcggcaccgccgccggcauggaccucugggucaccuucgagauccgcgagcacggcgagcucgagcgcccccuccaccccaaggagaagguccucgagcaggcccuccaguggugccagcuccccgagcccugcuccgccucccuccuccucaagaaggucccccucgcccaggccggcugccucuucaccggcauccgccgcgaguccccccgcgucggccuccuccgcugccgcgaggagcccccccgccuccucggcucccgcuuccaggagcgcuucuuccuccuccgcggccgcugccuccuccuccucaaggagaagaaguccuccaagcccgagcgcgaguggccccucgagggcgccaaggucuaccucggcauccgcaagaagcucaagccccccacccccuggggcuucacccucauccucgagaagaugcaccucuaccucuccugcaccgacgaggacgagaugugggacuggaccaccuccauccucaaggcccagcacgacgaccagcagcccgucguccuccgccgccacuccuccuccgaccucgcccgccagaaguucggcaccaugccccuccuccccauccgcggcgacgacuccggcgccacccuccucuccgccaaccagacccuccgccgccuccacaaccgccgcacccucuccauguucuuccccaugaaguccucccagggcuccgucgaggagcaggaggagcucgaggagcccgucuacgaggagcccgucuacgaggaggucggcgccuuccccgagcucauccaggacaccuccaccuccuucuccaccacccgcgaguggaccgucaagcccgagaacccccucaccucccagaagucccucgaccagcccuuccucuccaaguccuccacccucggccaggaggagcgcccccccgagcccccccccggcccccccuccaaguccuccccccaggcccgcggcucccucgaggagcagcuccuccaggagcucuccucccucauccuccgcaagggcgagaccaccgccggccucggcucccccucccagcccuccuccccccagucccccucccccaccggccuccccacccagacccccggcuuccccacccagccccccugcaccuccuccccccccuccucccagccccucaccuga

SEQ ID NO: 39859 - RNA, 1191 nt, Artificial Sequence
  derived and/or modified sequence opt2 from ARC__Homo_sapiens__NP_056008
auggagcucgaccaccgcaccuccggcggccuccacgccuaccccggcccccgcggcggccaggucgccaagcccaacgucauccuccagaucggcaagugccgcgccgagaugcucgagcacguccgccgcacccaccgccaccuccucgccgaggucuccaagcaggucgagcgcgagcucaagggccuccaccgcuccgucggcaagcucgaguccaaccucgacggcuacguccccaccuccgacucccagcgcuggaagaaguccaucaaggccugccucugccgcugccaggagaccaucgccaaccucgagcgcugggucaagcgcgagaugcacgucuggcgcgaggucuucuaccgccucgagcgcugggccgaccgccucgaguccaccggcggcaaguaccccgucggcuccgaguccgcccgccacaccgucuccgucggcgucggcggccccgaguccuacugccacgaggccgacggcuacgacuacaccgucucccccuacgccaucacccccccccccgccgccggcgagcuccccggccaggagcccgccgaggcccagcaguaccagcccuggguccccggcgaggacggccagcccucccccggcgucgacacccagaucuucgaggacccccgcgaguuccucucccaccucgaggaguaccuccgccaggucggcggcuccgaggaguacuggcucucccagauccagaaccacaugaacggccccgccaagaaguggugggaguucaagcagggcuccgucaagaacugggucgaguucaagaaggaguuccuccaguacuccgagggcacccucucccgcgaggccauccagcgcgagcucgaccucccccagaagcagggcgagccccucgaccaguuccucuggcgcaagcgcgaccucuaccagacccucuacgucgacgccgacgaggaggagaucauccaguacgucgucggcacccuccagcccaagcucaagcgcuuccuccgccacccccuccccaagacccucgagcagcucauccagcgcggcauggagguccaggacgaccucgagcaggccgccgagcccgccggcccccaccuccccgucgaggacgaggccgagacccucacccccgcccccaacuccgaguccgucgccuccgaccgcacccagcccgaguga

SEQ ID NO: 39860 - RNA, 1272 nt, Artificial Sequence
  derived and/or modified sequence opt2 from ARCN1__Homo_sapiens__NP_001135753
augauccccgaguacugccgcgcccucgaggagaacgagaucuccgagcacugcuucgaccucaucuucgccuucgacgagaucgucgcccucggcuaccgcgagaacgucaaccucgcccagauccgcaccuucaccgagauggacucccacgaggagaaggucuuccgcgccguccgcgagacccaggagcgcgaggccaaggccgagaugcgccgcaaggccaaggagcuccagcaggcccgccgcgacgccgagcgccagggcaagaaggcccccggcuucggcggcuucggcuccuccgccgucuccggcggcuccaccgccgccaugaucaccgagaccaucaucgagaccgacaagcccaaggucgcccccgcccccgcccgccccuccggccccuccaaggcccucaagcucggcgccaagggcaaggaggucgacaacuucgucgacaagcucaaguccgagggcgagaccaucauguccuccuccaugggcaagcgcaccuccgaggccaccaagaugcacgccccccccaucaacauggaguccguccacaugaagaucgaggagaagaucacccucaccugcggccgcgacggcggccuccagaacauggagcuccacggcaugaucaugcuccgcaucuccgacgacaaguacggccgcauccgccuccacgucgagaacgaggacaagaagggcguccagcuccagacccaccccaacgucgacaagaagcucuucaccgccgagucccucaucggccucaagaaccccgagaaguccuuccccgucaacuccgacgucggcguccucaaguggcgccuccagaccaccgaggaguccuucaucccccucaccaucaacugcuggcccuccgaguccggcaacggcugcgacgucaacaucgaguacgagcuccaggaggacaaccucgagcucaacgacgucgucaucaccaucccccuccccuccggcgucggcgcccccgucaucggcgagaucgacggcgaguaccgccacgacucccgccgcaacacccucgaguggugccuccccgucaucgacgccaagaacaaguccggcucccucgaguucuccaucgccggccagcccaacgacuucuuccccguccaggucuccuucgucuccaagaagaacuacugcaacauccaggucaccaaggucacccaggucgacggcaacucccccguccgcuucuccaccgagaccaccuuccucgucgacaaguacgagauccucuga

SEQ ID NO: 39861 - RNA, 759 nt, Artificial Sequence
  derived and/or modified sequence opt2 from AREG__Homo_sapiens__NP_001648
augcgcgccccccuccucccccccgcccccgucguccucucccuccucauccucggcuccggccacuacgccgccggccucgaccucaacgacaccuacuccggcaagcgcgagcccuucuccggcgaccacuccgccgacggcuucgaggucaccucccgcuccgagauguccuccggcuccgagaucucccccgucuccgagaugcccuccuccuccgagcccuccuccggcgccgacuacgacuacuccgaggaguacgacaacgagccccagauccccggcuacaucgucgacgacuccguccgcgucgagcaggucgucaagcccccccagaacaagaccgaguccgagaacaccuccgacaagcccaagcgcaagaagaagggcggcaagaacggcaagaaccgccgcaaccgcaagaagaagaaccccugcaacgccgaguuccagaacuucugcauccacggcgagugcaaguacaucgagcaccucgaggccgucaccugcaagugccagcaggaguacuucggcgagcgcugcggcgagaaguccaugaagacccacuccaugaucgacuccucccucuccaagaucgcccucgccgccaucgccgccuucauguccgccgucauccucaccgccgucgccgucaucaccguccagcuccgccgccaguacguccgcaaguacgagggcgaggccgaggagcgcaagaagcuccgccaggagaacggcaacguccacgccaucgccuga

SEQ ID NO: 39862 - RNA, 546 nt, Artificial Sequence
  derived and/or modified sequence opt2 from ARF1__Homo_sapiens__NP_001019398
augggcaacaucuucgccaaccucuucaagggccucuucggcaagaaggagaugcgcauccucauggucggccucgacgccgccggcaagaccaccauccucuacaagcucaagcucggcgagaucgucaccaccauccccaccaucggcuucaacgucgagaccgucgaguacaagaacaucuccuucaccgucugggacgucggcggccaggacaagauccgcccccucuggcgccacuacuuccagaacacccagggccucaucuucgucgucgacuccaacgaccgcgagcgcgucaacgaggcccgcgaggagcucaugcgcaugcucgccgaggacgagcuccgcgacgccguccuccucgucuucgccaacaagcaggaccuccccaacgccaugaacgccgccgagaucaccgacaagcucggccuccacucccuccgccaccgcaacugguacauccaggccaccugcgccaccuccggcgacggccucuacgagggccucgacuggcucuccaaccagcuccgcaaccagaaguga

SEQ ID NO: 39863 - RNA, 546 nt, Artificial Sequence
  derived and/or modified sequence opt2 from ARF3__Homo_sapiens__NP_001650
augggcaacaucuucggcaaccuccucaagucccucaucggcaagaaggagaugcgcauccucauggucggccucgacgccgccggcaagaccaccauccucuacaagcucaagcucggcgagaucgucaccaccauccccaccaucggcuucaacgucgagaccgucgaguacaagaacaucuccuucaccgucugggacgucggcggccaggacaagauccgcccccucuggcgccacuacuuccagaacacccagggccucaucuucgucgucgacuccaacgaccgcgagcgcgucaacgaggcccgcgaggagcucaugcgcaugcucgccgaggacgagcuccgcgacgccguccuccucgucuucgccaacaagcaggaccuccccaacgccaugaacgccgccgagaucaccgacaagcucggccuccacucccuccgccaccgcaacugguacauccaggccaccugcgccaccuccggcgacggccucuacgagggccucgacuggcucgccaaccagcucaagaacaagaaguga

SEQ ID NO: 39864 - RNA, 543 nt, Artificial Sequence
  derived and/or modified sequence opt2 from ARF4__Homo_sapiens__NP_001651
augggccucaccaucuccucccucuucucccgccucuucggcaagaagcagaugcgcauccucauggucggccucgacgccgccggcaagaccaccauccucuacaagcucaagcucggcgagaucgucaccaccauccccaccaucggcuucaacgucgagaccgucgaguacaagaacaucugcuucaccgucugggacgucggcggccaggaccgcauccgcccccucuggaagcacuacuuccagaacacccagggccucaucuucgucgucgacuccaacgaccgcgagcgcauccaggaggucgccgacgagcuccagaagaugcuccucgucgacgagcuccgcgacgccguccuccuccucuucgccaacaagcaggaccuccccaacgccauggccaucuccgagaugaccgacaagcucggccuccagucccuccgcaaccgcaccugguacguccaggccaccugcgccacccagggcaccggccucuacgagggccucgacuggcucuccaacgagcucuccaagcgcuga

SEQ ID NO: 39865 - RNA, 528 nt, Artificial Sequence
  derived and/or modified sequence opt2 from ARF6__Homo_sapiens__NP_001654
augggcaagguccucuccaagaucuucggcaacaaggagaugcgcauccucaugcucggccucgacgccgccggcaagaccaccauccucuacaagcucaagcucggccaguccgucaccaccauccccaccgucggcuucaacgucgagaccgucaccuacaagaacgucaaguucaacgucugggacgucggcggccaggacaagauccgcccccucuggcgccacuacuacaccggcacccagggccucaucuucgucgucgacugcgccgaccgcgaccgcaucgacgaggcccgccaggagcuccaccgcaucaucaacgaccgcgagaugcgcgacgccaucauccucaucuucgccaacaagcaggaccuccccgacgccaugaagccccacgagauccaggagaagcucggccucacccgcauccgcgaccgcaacugguacguccagcccuccugcgccaccuccggcgacggccucuacgagggccucaccuggcucaccuccaacuacaaguccuga

SEQ ID NO: 39866 - RNA, 1212 nt, Artificial Sequence
  derived and/or modified sequence opt2 from ARFGAP1__Homo_sapiens__NP_001268411
auggccuccccccgcacccgcaagguccucaaggagguccgcguccaggacgagaacaacgucugcuucgagugcggcgccuucaacccccagugggucuccgucaccuacggcaucuggaucugccucgagugcuccggccgccaccgcggccucggcguccaccucuccuucguccgcuccgucaccauggacaaguggaaggacaucgagcucgagaagaugaaggccggcggcaacgccaaguuccgcgaguuccucgagucccaggaggacuacgaccccugcuggucccuccaggagaaguacaacucccgcgccgccgcccucuuccgcgacaaggucgucgcccucgccgagggccgcgaguggucccucgaguccucccccgcccagaacuggacccccccccagccccgcacccuccccuccaugguccaccgcgucuccggccagccccaguccgucaccgccuccuccgacaaggccuucgaggacuggcucaacgacgaccucggcuccuaccagggcgcccagggcaaccgcuacgucggcuucggcaacaccccccccccccagaagaaggaggacgacuuccucaacaacgccauguccucccucuacuccggcugguccuccuucaccaccggcgccucccgcuucgccuccgccgccaaggagggcgccaccaaguucggcucccaggccucccagaaggccuccgagcucggccacucccucaacgagaacguccucaagcccgcccaggagaaggucaaggagggcaagaucuucgacgacgucuccuccggcgucucccagcucgccuccaagugccagcgccgccucugcugccaccagucccacugcuccgccggccaccucggccgcgccuucugccccgucuccuggcacgaggcccucugcggccagaccggccgcgaggagcaggccucccuccucccccccaagcacgucgucggcgcccucgaggucugcgcccgcggcugcccccgcugccacgucccccacacccccggcaccgccgccgaguggcccggccgccucugccucucccgcgaguccgucguccgcgacggcggcaccuccccccccuucuuccgcggcaagcagcgcgcccccuggaccgccccccgccgcgccaccgucauccgcaccgccgucuggaccaccuccaagaccgccaccuga

SEQ ID NO: 39867 - RNA, 1482 nt, Artificial Sequence
  derived and/or modified sequence opt2 from ARFGAP2__Homo_sapiens__NP_001229761
auggccgccgagcccaacaagaccgagauccagacccucuucaagcgccuccgcgccguccccaccaacaaggccugcuucgacugcggcgccaagaaccccuccugggccuccaucaccuacggcgucuuccucugcaucgacugcuccggcguccaccgcucccucggcguccaccucuccuucauccgcuccaccgagcucgacuccaacuggaacugguuccagcuccgcugcaugcaggucggcggcaacgccaacgccaccgccuucuuccgccagcacggcugcaccgccaacgacgccaacaccaaguacaacucccgcgccgcccagauguaccgcgagaagauccgccagcucggcuccgccgcccucgcccgccacggcaccgacccccccgccugggacgcccccgccaccgagcccuccggcacccagcagcccgcccccuccaccgaguccuccggccucgcccagcccgagcacggccccaacaccgaccuccucggcaccucccccaaggccucccucgagcucaaguccuccaucaucggcaagaagaagcccgccgccgccaagaagggccucggcgccaagaagggccucggcgcccagaaggucuccucccaguccuucuccgagaucgagcgccaggcccaggucgccgagaagcuccgcgagcagcaggccgccgacgccaagaagcaggccgaggaguccauggucgccuccaugcgccucgccuaccaggagcuccagaucgaccgcaagaaggaggagaagaagcuccagaaccucgagggcaagaagcgcgagcaggccgagcgccucggcaugggccucgucucccgcuccuccgucucccacuccguccucuccgagaugcaggucaucgagcaggagacccccgucuccgccaaguccucccgcucccagcucgaccucuucgacgacgucggcaccuucgccuccggcccccccaaguacaaggacaaccccuucucccucggcgaguccuucggcucccgcugggacaccgacgccgccuggggcauggaccgcgucgaggagaaggagcccgaggucaccaucuccuccauccgccccaucuccgagcgcgccaccaaccgccgcgaggucgagucccgcuccuccggccucgaguccuccgaggcccgccagaaguucgccggcgccaaggccaucuccuccgacauguucuucggccgcgaggucgacgccgaguacgaggcccgcucccgccuccagcagcucuccggcuccuccgccaucuccuccuccgaccucuucggcgacauggacggcgcccacggcgccggcuccgucucccucggcaacguccuccccaccgccgacaucgcccaguucaagcagggcgucaaguccgucgccggcaagauggccguccucgccaacggcgucaugaacucccuccaggaccgcuacggcuccuacuga

SEQ ID NO: 39868 - RNA, 1419 nt, Artificial Sequence
  derived and/or modified sequence opt2 from ARFGAP3__Homo_sapiens__NP_001135765
augggcgaccccuccaagcaggacauccucaccaucuucaagcgccuccgcuccguccccaccaacaaggucugcuucgacugcggcgccaagaaccccuccugggccuccaucaccuacggcgucuuccucugcaucgacugcuccggcucccaccgcucccucggcguccaccucuccuucauccgcuccaccgagcucgacuccaacugguccugguuccagcuccgcugcaugcaggucggcggcaacgccuccgcccucuggcucgacuccugcgucguccccccccucucccccccccccaaggaggaggacuucuucgccucccacgucucccccgaggucuccgacaccgccugggccuccgccaucgccgagcccuccucccucaccucccgccccgucgagaccacccucgagaacaacgagggcggccaggagcagggccccuccgucgagggccucaacguccccaccaaggccacccucgaggucuccuccaucaucaagaagaagcccaaccaggccaagaagggccucggcgccaagaagggcucccucggcgcccagaagcucgccaacaccugcuucaacgagaucgagaagcaggcccaggccgccgacaagaugaaggagcaggaggaccucgccaaggucgucuccaaggaggaguccaucgucuccucccuccgccucgccuacaaggaccucgagauccagaugaagaaggacgagaagaugaacaucuccggcaagaagaacgucgacuccgaccgccucggcaugggcuucggcaacugccgcuccgucaucucccacuccgucaccuccgacaugcagaccaucgagcaggagucccccaucauggccaagccccgcaagaaguacaacgacgacuccgacgacuccuacuucaccuccuccuccuccuacuucgacgagcccgucgagcuccgcuccuccuccuucuccuccugggacgacuccuccgacuccuacuggaagaaggagaccuccaaggacaccgagaccguccucaagaccaccggcuacuccgaccgccccaccgcccgccgcaagcccgacuacgagcccgucgagaacaccgacgaggcccagaagaaguucggcaacgucaaggccaucuccuccgacauguacuucggccgccagucccaggccgacuacgagacccgcgcccgccucgagcgccucuccgccuccuccuccaucuccuccgccgaccucuucgaggagccccgcaagcagcccgccggcaacuacucccucuccuccguccuccccaacgcccccgacauggcccaguucaagcagggcguccgcuccgucgccggcaagcucuccgucuucgccaacggcgucgucaccuccauccaggaccgcuacggcuccuga

SEQ ID NO: 39869 - RNA, 5550 nt, Artificial Sequence
  derived and/or modified sequence opt2 from ARFGEF1__Homo_sapiens__NP_006412
auguacgagggcaagaagaccaagaacauguuccucacccgcgcccucgagaagauccucgccgacaaggaggucaagaaggcccaccacucccagcuccgcaaggccugcgaggucgcccucgaggagaucaaggccgagaccgagaagcagucccccccccacggcgaggccaaggccggcuccuccacccucccccccgucaaguccaagaccaacuucaucgaggccgacaaguacuuccuccccuucgagcucgccugccaguccaagugcccccgcaucgucuccaccucccucgacugccuccagaagcucaucgccuacggccaccucaccggcaacgcccccgacuccaccacccccggcaagaagcucaucgaccgcaucaucgagaccaucugcggcugcuuccagggcccccagaccgacgagggcguccagcuccagaucaucaaggcccuccucaccgccgucaccucccagcacaucgagauccacgagggcaccguccuccaggccguccgcaccugcuacaacaucuaccucgccuccaagaaccucaucaaccagaccaccgccaaggccacccucacccagaugcucaacgucaucuucgcccgcauggagaaccaggcccuccaggaggccaagcagauggagaaggagcgccaccgccagcaccaccaccuccuccagucccccgucucccaccacgagcccgaguccccccagcuccgcuaccuccccccccagaccgucgaccacaucucccaggagcacgagggcgaccucgaccuccacaccaacgacgucgacaagucccuccaggacgacaccgagcccgagaacggcuccgacaucuccuccgccgagaacgagcagaccgaggccgaccaggccaccgccgccgagacccucuccaagaacgagguccucuacgacggcgagaaccacgacugcgaggagaagccccaggacaucguccagaacaucgucgaggagauggucaacaucgucgucggcgacaugggcgagggcaccaccaucaacgccuccgccgacggcaacaucggcaccaucgaggacggcuccgacuccgagaacauccaggccaacggcauccccggcacccccaucuccgucgccuacacccccucccuccccgacgaccgccucuccgucuccuccaacgacacccaggaguccggcaacuccuccggccccucccccggcgccaaguucucccacauccuccagaaggacgccuuccucgucuuccgcucccucugcaagcucuccaugaagccccucuccgacggcccccccgaccccaagucccacgagcuccgcuccaagauccucucccuccagcuccuccucuccauccuccagaacgccggccccaucuuccgcaccaacgagauguucaucaacgccaucaagcaguaccucugcgucgcccucuccaagaacggcgucuccuccguccccgaggucuucgagcucucccucuccaucuuccucacccuccucuccaacuucaagacccaccucaagaugcagaucgaggucuucuucaaggagaucuuccucuacauccucgagaccuccaccuccuccuucgaccacaaguggauggucauccagacccucacccgcaucugcgccgacgcccaguccgucgucgacaucuacgucaacuacgacugcgaccucaacgccgccaacaucuucgagcgccucgucaacgaccucuccaagaucgcccagggccgcggcucccaggagcucggcauguccaacguccaggagcucucccuccgcaagaagggccucgagugccucgucuccauccucaagugcauggucgagugguccaaggaccaguacgucaaccccaacucccagaccacccucggccaggagaagcccuccgagcaggagauguccgagaucaagcaccccgagaccaucaaccgcuacggcucccucaacucccucgaguccaccuccuccuccggcaucggcuccuacuccacccagauguccggcaccgacaaccccgagcaguucgagguccucaagcagcagaaggagaucaucgagcagggcaucgaccucuucaacaagaagcccaagcgcggcauccaguaccuccaggagcagggcaugcucggcaccacccccgaggacaucgcccaguuccuccaccaggaggagcgccucgacuccacccaggucggcgaguuccucggcgacaacgacaaguucaacaaggaggucauguacgccuacgucgaccagcacgacuucuccggcaaggacuucgucuccgcccuccgcauguuccucgagggcuuccgccuccccggcgaggcccagaagaucgaccgccucauggagaaguucgccgcccgcuaccucgagugcaaccagggccagacccucuucgccuccgccgacaccgccuacguccucgccuacuccaucaucaugcucaccaccgaccuccacuccccccaggucaagaacaagaugaccaaggagcaguacaucaagaugaaccgcggcaucaacgacuccaaggaccuccccgaggaguaccucuccgccaucuacaacgagaucgccggcaagaagaucuccaugaaggagaccaaggagcucaccauccccaccaaguccuccaagcagaacgucgccuccgagaagcagcgccgccuccucuacaaccucgagauggagcagauggccaagaccgccaaggcccucauggaggccgucucccacguccaggcccccuucaccuccgccacccaccucgagcacguccgccccauguucaagcucgccuggacccccuuccucgccgccuucuccgucggccuccaggacugcgacgacaccgaggucgccucccucugccucgagggcauccgcugcgccauccgcaucgccugcaucuucuccauccagcucgagcgcgacgccuacguccaggcccucgcccgcuucacccuccucaccgucuccuccggcaucaccgagaugaagcagaagaacaucgacaccaucaagacccucaucaccgucgcccacaccgacggcaacuaccucggcaacuccuggcacgagauccucaagugcaucucccagcucgagcucgcccagcucaucggcaccggcgucaagccccgcuacaucuccggcaccguccgcggccgcgagggcucccucaccggcaccaaggaccaggcccccgacgaguucgucggccucggccucgucggcggcaacgucgacuggaagcagaucgccuccauccaggaguccaucggcgagaccuccucccaguccgucgucgucgccgucgaccgcaucuucaccggcuccacccgccucgacggcaacgccaucgucgacuucguccgcuggcucugcgccgucuccauggacgagcuccucuccaccacccacccccgcauguucucccuccagaagaucgucgagaucuccuacuacaacaugggccgcauccgccuccaguggucccgcaucugggaggucaucggcgaccacuucaacaaggucggcugcaaccccaacgaggacgucgccaucuucgccgucgacucccuccgccagcucuccaugaaguuccucgagaagggcgagcucgccaacuuccgcuuccagaaggacuuccuccgccccuucgagcacaucaugaagcgcaaccgcucccccaccauccgcgacauggucguccgcugcaucgcccagauggucaacucccaggccgccaacauccgcuccggcuggaagaacaucuucuccgucuuccaccucgccgccuccgaccaggacgaguccaucgucgagcucgccuuccagaccaccggccacaucgucacccucgucuucgagaagcacuuccccgccaccaucgacuccuuccaggacgccgucaagugccucuccgaguucgccugcaacgccgccuuccccgacaccuccauggaggccauccgccucauccgccacugcgccaaguacgucuccgaccgcccccaggccuucaaggaguacaccuccgacgacaugaacgucgcccccgaggaccgcgucuggguccgcggcugguuccccauccucuucgagcucuccugcaucaucaaccgcugcaagcucgacguccgcacccgcggccucaccgucauguucgagaucaugaagaccuacggccacaccuacgagaagcacugguggcaggaccucuuccgcaucgucuuccgcaucuucgacaacaugaagcuccccgagcagcagaccgagaaggccgaguggaugaccaccaccugcaaccacgcccucuacgccaucugcgacgucuucacccaguaccucgagguccucuccgacguccuccucgacgacaucuucgcccagcucuacuggugcguccagcaggacaacgagcagcucgcccgcuccggcaccaacugccucgagaacgucgucauccucaacggcgagaaguucacccucgagaucugggacaagaccugcaacugcacccucgacaucuucaagaccaccaucccccacgcccuccucaccuggcgccccaacuccggcgagaccgccccccccccccccucccccgucuccgagaagccccucgacaccaucucccagaaguccgucgacauccacgacuccauccagccccgcuccgucgacaaccgcccccaggccccccucgucuccgccuccgccgucaacgaggaggucuccaagaucaaguccaccgccaaguuccccgagcagaagcucuucgccgcccuccucaucaagugcgucguccagcucgagcucauccagaccaucgacaacaucgucuucuuccccgccaccuccaagaaggaggacgccgagaaccucgccgccgcccagcgcgacgccgucgacuucgacguccgcgucgacacccaggaccagggcauguaccgcuuccucaccucccagcagcucuucaagcuccucgacugccuccucgagucccaccgcuucgccaaggccuucaacuccaacaacgagcagcgcaccgcccucuggaaggccggcuucaagggcaaguccaagcccaaccuccucaagcaggagaccuccucccucgccugcggccuccgcauccucuuccgcauguacauggacgagucccgcgucuccgccugggaggagguccagcagcgccuccucaacgucugcuccgaggcccucuccuacuuccucacccucaccuccgagucccaccgcgaggccuggaccaaccuccuccuccucuuccucaccaagguccucaagaucuccgacaaccgcuucaaggcccacgccuccuucuacuacccccuccucugcgagaucaugcaguucgaccucauccccgagcuccgcgccguccuccgccgcuucuuccuccgcaucggcgucgucuuccagaucucccagccccccgagcaggagcucggcaucaacaagcaguga

SEQ ID NO: 39870 - RNA, 5358 nt, Artificial Sequence
  derived and/or modified sequence opt2 from ARFGEF2__Homo_sapiens__NP_006411
augcaggagucccagaccaaguccauguucgucucccgcgcccucgagaagauccucgccgacaaggaggucaagcgcccccagcacucccagcuccgccgcgccugccaggucgcccucgacgagaucaaggccgagaucgagaagcagcgccucggcaccgccgccccccccaaggccaacuucaucgaggccgacaaguacuuccuccccuucgagcucgccugccaguccaaguccccccgcgucgucuccaccucccucgacugccuccagaagcucaucgccuacggccacaucaccggcaacgcccccgacuccggcgcccccggcaagcgccucaucgaccgcaucgucgagaccaucugcuccugcuuccagggcccccagaccgacgagggcguccagcuccagaucaucaaggcccuccucaccgccgucaccuccccccacaucgagauccacgagggcaccauccuccagaccguccgcaccugcuacaacaucuaccucgccuccaagaaccucaucaaccagaccaccgccaaggccacccucacccagaugcucaacgucaucuucacccgcauggagaaccagguccuccaggaggcccgcgagcucgagaagcccauccaguccaagccccagucccccgucauccaggccgccgccgucucccccaaguucguccgccucaagcacucccaggcccaguccaagcccaccacccccgagaagaccgaccucaccaacggcgagcacgcccgcuccgacuccggcaaggucuccaccgagaacggcgacgccccccgcgagcgcggcuccucccucuccggcaccgacgacggcgcccaggaggucgucaaggacauccucgaggacgucgucaccuccgccaucaaggaggccgccgagaagcacggccucaccgagcccgagcgcguccucggcgagcucgagugccaggagugcgccaucccccccggcgucgacgagaacucccagaccaacggcaucgccgacgaccgccagucccucuccuccgccgacaaccucgaguccgacgcccagggccaccaggucgccgcccgcuucucccacguccuccagaaggacgccuuccucgucuuccgcucccucugcaagcucuccaugaagccccucggcgagggcccccccgaccccaagucccacgagcuccgcuccaaggucgucucccuccagcuccuccucuccguccuccagaacgccggccccgucuuccgcacccacgagauguucaucaacgccaucaagcaguaccucugcgucgcccucuccaagaacggcgucuccuccguccccgacgucuucgagcucucccucgccaucuuccucacccuccucuccaacuucaagaugcaccucaagaugcagaucgaggucuucuucaaggagaucuuccucaacauccucgagaccuccaccuccuccuucgagcaccgcuggauggucauccagacccucacccgcaucugcgccgacgcccagugcgucgucgacaucuacgucaacuacgacugcgaccucaacgccgccaacaucuucgagcgccucgucaacgaccucuccaagaucgcccagggccgcuccggccacgagcucggcaugaccccccuccaggagcucucccuccgcaagaagggccucgagugccucgucuccauccucaagugcauggucgagugguccaaggaccucuacgucaaccccaaccaccagaccucccucggccaggagcgccucaccgaccaggagaucggcgacggcaagggccucgacauggcccgccgcugcuccgucaccuccauggaguccaccgucuccuccggcacccagaccaccguccaggacgaccccgagcaguucgaggucaucaagcagcagaaggagaucaucgagcacggcaucgagcucuucaacaagaagcccaagcgcggcauccaguuccuccaggagcagggcaugcucggcaccuccgucgaggacaucgcccaguuccuccaccaggaggagcgccucgacuccacccaggucggcgacuuccucggcgacuccgcccgcuucaacaaggaggucauguacgccuacgucgaccagcucgacuucugcgagaaggaguucgucuccgcccuccgcaccuuccucgagggcuuccgccuccccggcgaggcccagaagaucgaccgccucauggagaaguucgccgcccgcuacaucgagugcaaccagggccagacccucuucgccuccgccgacaccgccuacguccucgccuacuccaucaucaugcucaccaccgaccuccacuccccccaggucaagaacaagaugaccaaggagcaguacaucaagaugaaccgcggcaucaacgacuccaaggaccuccccgaggaguaccucuccuccaucuacgaggagaucgagggcaagaagaucgccaugaaggagaccaaggagcucaccaucgccaccaaguccaccaagcagaacgucgccuccgagaagcagcgccgccuccucuacaaccucgagauggagcagauggccaagaccgccaaggcccucauggaggccgucucccacgccaaggcccccuucaccuccgccacccaccucgaccacguccgccccauguucaagcucgucuggaccccccuccucgccgccuacuccaucggccuccagaacugcgacgacaccgaggucgccucccucugccucgagggcauccgcugcgccauccgcaucgccugcaucuucggcaugcagcucgagcgcgacgccuacguccaggcccucgcccgcuucucccuccucaccgccuccuccuccaucaccgagaugaagcagaagaacaucgacaccaucaagacccucaucaccgucgcccacaccgacggcaacuaccucggcaacuccuggcacgagauccucaagugcaucucccagcucgagcucgcccagcucaucggcaccggcgucaagacccgcuaccucuccggcuccggccgcgagcgcgagggcucccucaagggccacacccucgccggcgaggaguucaugggccucggccucggcaaccucgucuccggcggcgucgacaagcgccagauggccuccuuccaggaguccgucggcgagaccuccucccaguccgucgucgucgccgucgaccgcaucuucaccggcuccacccgccucgacggcaacgccaucgucgacuucguccgcuggcucugcgccgucuccauggacgagcucgccuccccccaccacccccgcauguucucccuccagaagaucgucgagaucuccuacuacaacaugaaccgcauccgccuccaguggucccgcaucuggcacgucaucggcgaccacuucaacaaggucggcugcaaccccaacgaggacgucgccaucuucgccgucgacucccuccgccagcucuccaugaaguuccucgagaagggcgagcucgccaacuuccgcuuccagaaggacuuccuccgccccuucgagcacaucaugaagaagaaccgcucccccaccauccgcgacauggccauccgcugcaucgcccagauggucaacucccaggccgccaacauccgcuccggcuggaagaacaucuucgccgucuuccaccaggccgccuccgaccacgacggcaacaucgucgagcucgccuuccagaccaccugccacaucgucaccaccaucuuccagcaccacuuccccgccgccaucgacuccuuccaggacgccgucaagugccucuccgaguucgccugcaacgccgccuuccccgacaccuccauggaggccauccgccucauccgcuucugcggcaaguacgucuccgagcgcccccgcguccuccaggaguacaccuccgacgacaugaacgucgcccccggcgaccgcgucuggguccgcggcugguuccccauccucuucgagcucuccugcaucaucaaccgcugcaagcucgacguccgcacccgcggccucaccgucauguucgagaucaugaaguccuacggccacaccuucgagaagcacugguggcaggaccucuuccgcaucgucuuccgcaucuucgacaacaugaagcuccccgagcagcucuccgagaaguccgaguggaugaccaccaccugcaaccacgcccucuacgccaucugcgacgucuucacccaguucuacgaggcccucaacgagguccuccucuccgacgucuucgcccagcuccaguggugcgucaagcaggacaacgagcagcucgcccgcuccggcaccaacugccucgagaaccucgucaucuccaacggcgagaaguucucccccgaggucugggacgagaccugcaacugcaugcucgacaucuucaagaccaccaucccccacguccuccucaccuggcgccccgucggcauggaggaggacuccuccgagaagcaccucgacgucgaccucgaccgccagucccucuccuccaucgacaagaaccccuccgagcgcggccagucccagcucuccaaccccaccgacgacuccuggaagggccgccccuacgccaaccagaagcucuucgccucccuccucaucaagugcgucguccagcucgagcucauccagaccaucgacaacaucgucuucuaccccgccaccuccaagaaggaggacgccgagcacauggucgccgcccagcaggacacccucgacgccgacauccacaucgagaccgaggaccagggcauguacaaguacauguccucccagcaccucuucaagcuccucgacugccuccaggagucccacuccuucuccaaggccuucaacuccaacuacgagcagcgcaccguccucuggcgcgccggcuucaagggcaaguccaagcccaaccuccucaagcaggagaccuccucccucgccugcugccuccgcauccucuuccgcauguacgucgacgagaaccgccgcgacuccugggaggagauccagcagcgccuccucaccgucugcuccgaggcccucgccuacuucaucaccgucaacuccgagucccaccgcgaggccuggaccucccuccuccuccuccuccucaccaagacccucaagaucaacgacgagaaguucaaggcccacgccuccauguacuaccccuaccucugcgagaucaugcaguucgaccucauccccgagcuccgcgccguccuccgcaaguucuuccuccgcaucggcgucgucuacaagaucuggauccccgaggagcccucccagguccccgccgcccucucccccgucugguga

SEQ ID NO: 39871 - RNA, 6534 nt, Artificial Sequence
  derived and/or modified sequence opt2 from ARFGEF3__Homo_sapiens__NP_065073
auggaggagauccuccgcaagcuccagaaggaggccuccggcuccaaguacaaggccaucaaggaguccugcaccugggcccucgagacccucggcggccucgacaccaucgucaagauccccccccacguccuccgcgagaagugccuccucccccuccagcucgcccucgaguccaagaacgucaagcucgcccagcacgcccucgccggcaugcagaagcuccucuccgaggagcgcuucgucuccauggagaccgacuccgacgagaagcagcuccucaaccagauccucaacgccgucaaggucacccccucccucaacgaggaccuccaggucgaggucaugaagguccuccucugcaucaccuacacccccaccuucgaccucaacggcuccgccguccucaagaucgccgaggucugcaucgagaccuacaucuccuccugccaccagcgcuccaucaacaccgccguccgcgccacccucucccagaugcucuccgaccucacccuccagcuccgccagcgccaggagaacaccaucaucgagaaccccgacgucccccaggacuucggcaaccagggcuccaccgucgagucccucugcgacgacgucgucuccguccucaccguccucugcgagaagcuccaggccgccaucaacgacucccagcagcuccagcuccucuaccucgagugcauccucuccguccucuccuccuccuccuccuccaugcaccuccaccgccgcuucaccgaccucaucuggaagaaccucugccccgcccucaucgucauccucggcaaccccauccacgacaagaccaucaccuccgcccacaccuccuccaccuccaccucccucgaguccgacuccgccucccccggcgucuccgaccacggccgcggcuccggcugcuccugcaccgcccccgcccucuccggccccgucgcccgcaccaucuacuacaucgccgccgagcucguccgccucgucggcuccgucgacuccaugaagcccguccuccagucccucuaccaccgcguccuccucuacccccccccccagcaccgcgucgaggccaucaagaucaugaaggagauccucggcuccccccagcgccucugcgaccucgccggccccuccuccaccgaguccgagucccgcaagcgcuccaucuccaagcgcaagucccaccucgaccuccucaagcucaucauggacggcaugaccgaggccugcaucaagggcggcaucgaggccugcuacgccgccgucuccugcgucugcacccuccucggcgcccucgacgagcucucccagggcaagggccucuccgagggccagguccagcuccuccuccuccgccucgaggagcucaaggacggcgccgaguggucccgcgacuccauggagaucaacgaggccgacuuccgcuggcagcgccgcguccucuccuccgagcacacccccugggaguccggcaacgagcgcucccucgacaucuccaucuccgucaccaccgacaccggccagaccacccucgagggcgagcucggccagaccacccccgaggaccacuccggcaaccacaagaacucccucaagucccccgccauccccgagggcaaggagacccucuccaagguccucgagaccgaggccgucgaccagcccgacgucguccagcgcucccacaccguccccuaccccgacaucaccaacuuccucuccgucgacugccgcacccgcuccuacggcucccgcuacuccgaguccaacuucuccgucgacgaccaggaccucucccgcaccgaguucgacuccugcgaccaguacuccauggccgccgagaaggacuccggccgcuccgacgucuccgacaucggcuccgacaacugcucccucgccgacgaggagcagaccccccgcgacugccucggccaccgcucccuccgcaccgccgcccucucccucaagcuccucaagaaccaggaggccgaccagcacuccgcccgccucuucauccagucccucgagggccuccucccccgccuccucucccucuccaacgucgaggaggucgacaccgcccuccagaacuucgccuccaccuucugcuccggcaugaugcacucccccggcuucgacggcaacuccucccucuccuuccagaugcucaugaacgccgacucccucuacaccgccgcccacugcgcccuccuccucaaccucaagcucucccacggcgacuacuaccgcaagcgccccacccucgcccccggcgucaugaaggacuucaugaagcagguccagaccuccggcguccucauggucuucucccaggccuggaucgaggagcucuaccaccagguccucgaccgcaacaugcucggcgaggccggcuacuggggcucccccgaggacaacucccucccccucaucaccaugcucaccgacaucgacggccucgaguccuccgccaucggcggccagcucauggccuccgccgccaccgagucccccuucgcccagucccgccgcaucgacgacuccaccgucgccggcgucgccuucgcccgcuacauccucgucggcugcuggaagaaccucaucgacacccucuccaccccccucaccggccgcauggccggcuccuccaagggccucgccuucauccucggcgccgagggcaucaaggagcagaaccagaaggagcgcgacgccaucugcaugucccucgacggccuccgcaaggccgcccgccucuccugcgcccucggcgucgccgccaacugcgccuccgcccucgcccagauggccgccgccuccugcguccaggaggagaaggaggagcgcgaggcccaggagcccuccgacgccaucacccaggucaagcucaaggucgagcagaagcucgagcagaucggcaagguccagggcgucuggcuccacaccgcccacguccucugcauggaggccauccucuccgucggccucgagaugggcucccacaaccccgacugcuggccccacgucuuccgcgucugcgaguacgucggcacccucgagcacaaccacuucuccgacggcgccucccagcccccccucaccaucucccagccccagaaggccaccggcuccgccggccuccucggcgaccccgagugcgagggcuccccccccgagcacucccccgagcagggccgcucccucuccaccgcccccgucguccagccccucuccauccaggaccucguccgcgagggcucccgcggccgcgccuccgacuuccgcggcggcucccucauguccggcuccuccgccgccaaggucguccucacccucuccacccaggccgaccgccucuucgaggacgccaccgacaagcucaaccucauggcccucggcggcuuccucuaccagcucaagaaggccucccagucccagcucuuccacuccgucaccgacaccgucgacuacucccucgccaugcccggcgaggucaaguccacccaggaccgcaaguccgcccuccaccucuuccgccucggcaacgccaugcuccgcaucguccgcuccaaggcccgcccccuccuccacgucaugcgcugcuggucccucgucgccccccaccucgucgaggccgccugccacaaggagcgccacgucucccagaaggccgucuccuucauccacgacauccucaccgagguccucaccgacuggaacgagcccccccacuuccacuucaacgaggcccucuuccgccccuucgagcgcaucaugcagcucgagcucugcgacgaggacguccaggaccaggucgucaccuccaucggcgagcucgucgaggucugcuccacccagauccaguccggcuggcgcccccucuucuccgcccucgagaccguccacggcggcaacaaguccgagaugaaggaguaccucgucggcgacuacuccaugggcaagggccaggcccccgucuucgacgucuucgaggccuuccucaacaccgacaacauccaggucuucgccaacgccgccaccuccuacaucaugugccucaugaaguucgucaagggccucggcgaggucgacugcaaggagaucggcgacugcgcccccgcccccggcgcccccuccaccgaccucugccuccccgcccucgacuaccuccgccgcugcucccagcuccucgccaagaucuacaagaugccccucaagcccaucuuccucuccggccgccucgccggccucccccgccgccuccaggagcaguccgccuccuccgaggacggcaucgaguccguccucuccgacuucgacgacgacaccggccucaucgaggucuggaucauccuccucgagcagcucaccgccgccgucuccaacugcccccgccagcaccagccccccacccucgaccuccucuucgagcuccuccgcgacgucaccaagacccccggccccggcuucggcaucuacgccgucguccaccuccuccuccccgucauguccgucuggcuccgccgcucccacaaggaccacuccuacugggacauggccuccgccaacuucaagcacgccaucggccucuccugcgagcucgucgucgagcacauccaguccuuccuccacuccgacauccgcuacgaguccaugaucaacaccaugcucaaggaccucuucgagcuccucgucgccugcgucgccaagcccaccgagaccaucucccgcgucggcugcuccugcauccgcuacguccucgucaccgccggccccgucuucaccgaggagauguggcgccucgccugcugcgcccuccaggacgccuucuccgccacccucaagcccgucaaggaccuccucggcugcuuccacuccggcaccgaguccuucuccggcgagggcugccagguccgcgucgccgcccccuccuccucccccuccgccgaggccgaguacuggcgcauccgcgccauggcccagcaggucuucaugcucgacacccagugcucccccaagacccccaacaacuucgaccacgcccaguccugccagcucaucaucgagcucccccccgacgagaagcccaacggccacaccaagaaguccgucuccuuccgcgagaucgucgucucccuccucucccaccagguccuccuccagaaccucuacgacauccuccucgaggaguucgucaagggccccucccccggcgaggagaagaccauccagguccccgaggccaagcucgccggcuuccuccgcuacaucuccaugcagaaccucgccgucaucuucgaccuccuccucgacuccuaccgcaccgcccgcgaguucgacaccucccccggccucaagugccuccucaagaaggucuccggcaucggcggcgccgccaaccucuaccgccaguccgccauguccuucaacaucuacuuccacgcccucgucugcgccguccucaccaaccaggagaccaucaccgccgagcaggucaagaagguccucuucgaggacgacgagcgcuccaccgacuccucccagcagugcuccuccgaggacgaggacaucuucgaggagaccgcccaggucucccccccccgcggcaaggagaagcgccaguggcgcgcccgcaugccccuccucuccguccagcccgucuccaacgccgacugggucuggcucgucaagcgccuccacaagcucugcauggagcucugcaacaacuacauccagaugcaccucgaccucgagaacugcauggaggagccccccaucuucaagggcgaccccuucuucauccuccccuccuuccaguccgaguccuccacccccuccaccggcggcuucuccggcaaggagacccccuccgaggacgaccgcucccagucccgcgagcacaugggcgagucccucucccucaaggccggcggcggcgaccuccuccucccccccucccccaaggucgagaagaaggaccccucccgcaagaaggaguggugggagaacgccggcaacaagaucuacaccauggccgccgacaagaccaucuccaagcucaugaccgaguacaagaagcgcaagcagcagcacaaccucuccgccuuccccaaggaggucaaggucgagaagaagggcgagccccucggcccccgcggccaggacuccccccuccuccagcgcccccagcaccucauggaccagggccagaugcgccacuccuucuccgccggccccgagcuccuccgccaggacaagcgcccccgcuccggcuccaccggcuccucccucuccgucuccguccgcgacgccgaggcccagauccaggccuggaccaacaugguccucaccguccucaaccagauccagauccuccccgaccagaccuucaccgcccuccagcccgccgucuuccccugcaucucccagcucaccugccacgucaccgacauccgcguccgccaggccguccgcgaguggcucggccgcgucggccgcgucuacgacaucaucgucuga

SEQ ID NO: 39872 - RNA, 1122 nt, Artificial Sequence
  derived and/or modified sequence opt2 from ARFIP1__Homo_sapiens__NP_001020766
auggcccaggagucccccaagaacuccgccgccgagauccccgucaccuccaacggcgaggucgacgacucccgcgagcacuccuucaaccgcgaccucaagcacucccuccccuccggccucggccucuccgagacccagaucaccucccacggcuucgacaacaccaaggagggcgucaucgaggccggcgccuuccagggcucccccgcccccccccuccccuccgucaugucccccucccgcgucgccgccucccgccucgcccagcagggcuccgaccucaucguccccgccggcggccagcgcacccagaccaaguccggccccgucauccucgccgacgagaucaagaaccccgccauggagaagcucgagcucguccgcaaguggucccucaacaccuacaagugcacccgccagaucaucuccgagaagcucggccgcggcucccgcaccgucgaccucgagcucgaggcccagaucgacauccuccgcgacaacaagaagaaguacgagaacauccucaagcucgcccagacccucuccacccagcucuuccagaugguccacacccagcgccagcucggcgacgccuucgccgaccucucccucaagucccucgagcuccacgaggaguucggcuacaacgccgacacccagaagcuccucgccaagaacggcgagacccuccucggcgccaucaacuucuucaucgccuccgucaacacccucgucaacaagaccaucgaggacacccucaugaccgucaagcaguacgaguccgcccgcaucgaguacgacgccuaccgcaccgaccucgaggagcucaaccucggcccccgcgacgccaacacccuccccaagaucgagcagucccagcaccucuuccaggcccacaaggagaaguacgacaagaugcgcaacgacgucuccgucaagcucaaguuccucgaggagaacaaggucaagguccuccacaaccagcucguccucuuccacaacgccaucgccgccuacuucgccggcaaccagaagcagcucgagcagacccucaagcaguuccacaucaagcucaagacccccggcgucgacgcccccuccuggcucgaggagcaguga

SEQ ID NO: 39873 - RNA, 522 nt, Artificial Sequence
  derived and/or modified sequence opt2 from ARFRP1__Homo_sapiens__NP_001128230
auguacacccuccucuccggccucuacaaguacauguuccagaaggacgaguacugcauccucauccucggccucgacaacgccggcaagaccaccuuccucgagcaguccaagacccgcuucaacaagaacuacaagggcaugucccucuccaagaucaccaccaccgucggccucaacaucggcaccgucgacgucggcaaggcccgccucauguucugggaccucggcggccaggaggagcuccagucccucugggacaaguacuacgccgagugccacggcgucaucuacgucaucgacuccaccgacgaggagcgccucgccgaguccaagcaggccuucgagaaggucgucaccuccgaggcccucugcggcguccccguccucguccucgccaacaagcaggacgucgagaccugccucuccauccccgacaucaagaccgccuucuccgacugcaccuccaagaucggccgccgcgacugccucacccaggccugcuccgcccucaccggcuga

SEQ ID NO: 39874 - RNA, 969 nt, Artificial Sequence
  derived and/or modified sequence opt2 from ARG1__Homo_sapiens__NP_000036
auguccgccaagucccgcaccaucggcaucaucggcgcccccuucuccaagggccagccccgcggcggcgucgaggagggccccaccguccuccgcaaggccggccuccucgagaagcucaaggagcaggagugcgacgucaaggacuacggcgaccuccccuucgccgacauccccaacgacucccccuuccagaucgucaagaacccccgcuccgucggcaaggccuccgagcagcucgccggcaaggucgccgaggucaagaagaacggccgcaucucccucguccucggcggcgaccacucccucgccaucggcuccaucuccggccacgcccgcguccaccccgaccucggcgucaucugggucgacgcccacaccgacaucaacaccccccucaccaccaccuccggcaaccuccacggccagcccgucuccuuccuccucaaggagcucaagggcaagauccccgacguccccggcuucuccugggucacccccugcaucuccgccaaggacaucgucuacaucggccuccgcgacgucgaccccggcgagcacuacauccucaagacccucggcaucaaguacuucuccaugaccgaggucgaccgccucggcaucggcaaggucauggaggagacccucuccuaccuccucggccgcaagaagcgccccauccaccucuccuucgacgucgacggccucgaccccuccuucacccccgccaccggcacccccgucgucggcggccucaccuaccgcgagggccucuacaucaccgaggagaucuacaagaccggccuccucuccggccucgacaucauggaggucaaccccucccucggcaagacccccgaggaggucacccgcaccgucaacaccgccgucgccaucacccucgccugcuucggccucgcccgcgagggcaaccacaagcccaucgacuaccucaacccccccaaguga

SEQ ID NO: 39875 - RNA, 822 nt, Artificial Sequence
  derived and/or modified sequence opt2 from ARGLU1__Homo_sapiens__NP_060481
augggccgcucccgcucccgcuccuccucccgcuccaagcacaccaaguccuccaagcacaacaagaagcgcucccgcucccgcucccgcucccgcgacaaggagcgcguccgcaagcgcuccaagucccgcgaguccaagcgcaaccgccgccgcgagucccgcucccgcucccgcuccaccaacaccgccgucucccgccgcgagcgcgaccgcgagcgcgccuccuccccccccgaccgcaucgacaucuucggccgcaccgucuccaagcgcuccucccucgacgagaagcagaagcgcgaggaggaggagaagaaggccgaguucgagcgccagcgcaagauccgccagcaggagaucgaggagaagcucaucgaggaggagaccgcccgccgcgucgaggagcucgucgccaagcgcgucgaggaggagcucgagaagcgcaaggacgagaucgagcgcgagguccuccgccgcgucgaggaggccaagcgcaucauggagaagcagcuccucgaggagcucgagcgccagcgccaggccgagcucgccgcccagaaggcccgcgaggaggaggagcgcgccaagcgcgaggagcucgagcgcauccucgaggagaacaaccgcaagaucgccgaggcccaggccaagcucgccgaggagcagcuccgcaucgucgaggagcagcgcaagauccacgaggagcgcaugaagcucgagcaggagcgccagcgccagcagaaggaggagcagaagaucauccucggcaagggcaagucccgccccaagcucuccuucucccucaagacccaggacuga

SEQ ID NO: 39876 - RNA, 2361 nt, Artificial Sequence
  derived and/or modified sequence opt2 from ARHGAP10__Homo_sapiens__NP_078881
augggccuccagccccucgaguucuccgacugcuaccucgacucccccugguuccgcgagcgcauccgcgcccacgaggccgagcucgagcgcaccaacaaguucaucaaggagcucaucaaggacggcaagaaccucaucgccgccaccaagucccucuccgucgcccagcgcaaguucgcccacucccuccgcgacuucaaguucgaguucaucggcgacgccgucaccgacgacgagcgcugcaucgacgccucccuccgcgaguucuccaacuuccucaagaaccucgaggagcagcgcgagaucauggcccucuccgucaccgagacccucaucaagccccucgagaaguuccgcaaggagcagcucggcgccgucaaggaggagaagaagaaguucgacaaggagaccgagaagaacuacucccucaucgacaagcaccucaaccucuccgccaagaagaaggacucccaccuccaggaggccgacauccaggucgagcagaaccgccagcacuucuacgagcucucccucgaguacgucugcaagcuccaggagauccaggagcgcaagaaguucgaguucgucgagcccaugcucuccuucuuccagggcauguucaccuucuaccaccagggccacgagcucgccaaggacuucaaccacuacaagauggagcuccagaucaacauccagaacacccgcaaccgcuucgagggcacccgcuccgaggucgaggagcucaugaacaagauccgccagaaccccaaggaccacaagcgcgccucccaguucaccgccgagggcuaccucuacguccaggagaagcgccccgcccccuucggcuccuccugggucaagcacuacugcauguaccgcaaggccgccaagaaguucaacaugauccccuucgagcaccgcuccggcggcaagcucggcgacggcgaggucuucuuccucaaggagugcaccaagcgccacaccgacuccaucgaccgccgcuucugcuucgacaucgaggccgccgaccgccccggcgucucccucaccaugcaggccuucuccgaggaggagcgcaagcaguggcucgaggcccucggcggcaaggaggcccucucccacuccuucaacaccgccaucaucccccgccccgagggcaacgcccagcucgacaagaugggcuucaccaucauccgcaagugcaucuccgccgucgagacccgcggcaucaacgaccagggccucuaccgcgucgucggcgucuccuccaagguccagcgccuccucuccaugcucauggacgucaagaccugcaacgaggucgaccucgagaacuccgccgacugggaggucaagaccaucaccuccgcccucaagcaguaccuccgcucccuccccgagccccucaugaccuacgagcuccacggcgacuucaucguccccgccaaguccggcucccccgagucccgcgucaacgccauccacuuccucguccacaagcuccccgagaagaacaaggagaugcucgacauccucgucaagcaccucaccaacgucuccaaccacuccaagcagaaccucaugaccgucgccaaccucggcgucgucuucggccccacccucaugcgcccccaggaggagaccgucgccgcccucauggaccucaaguuccagaacaucgucgucgagauccucaucgagaaccacgagaagaucuuccgcaccccccccgacaccaccuuccccgagcccaccugccucuccgccuccccccccaacgcccccccccgccaguccaagcgccagggccagcgcaccaagcgccccgucgccgucuacaaccucugccucgagcucgaggacggcgacaaccccuaccccuccaaggaggacacccccaccuccucccucgacucccucuccucccccucccccgucaccaccgccguccccggcccccccggccccgacaagaaccaccuccucgccgacggcggcuccuucggcgacugggccuccaccauccccggccagacccgcuccuccaugguccaguggcucaacccccagucccccaccaccaccuccuccaacuccgccgucaccccccucucccccggcuccucccccuuccccuucuccccccccgccaccgucgccgacaagccccccgaguccauccgcucccgcaaggcccgcgccgucuaccccugcgaggccgagcacuccuccgagcucuccuucgagaucggcgccaucuucgaggacguccagaccucccgcgagcccggcuggcucgagggcacccucaacggcaagcgcggccucaucccccagaacuacgucaagcuccucuga

SEQ ID NO: 39877 - RNA, 2505 nt, Artificial Sequence
  derived and/or modified sequence opt2 from ARHGAP11A__Homo_sapiens__NP_001273408
auggacuccuccaaccucgccgucaucuucgcccccaaccuccuccagaccuccgagggccacgagaagauguccuccaacaccgagaagaagcuccgccuccaggccgccgucguccagacccucaucgacuacgccuccgacaucggccgcguccccgacuucauccucgagaagauccccgccaugcucggcaucgacggccucugcgccacccccucccucgagggcuucgaggagggcgaguacgagacccccggcgaguacaagcgcaagcgccgccaguccgucggcgacuucgucuccggcgcccucaacaaguucaagcccaaccgcacccccuccaucaccccccaggaggagcgcaucgcccagcucuccgagucccccgucauccucacccccaacgccaagcgcacccuccccgucgacuccucccacggcuucuccuccaagaagcgcaaguccaucaagcacaacuucaacuucgagcuccuccccuccaaccucuucaacuccuccuccacccccgucuccguccacaucgacaccuccuccgagggcuccucccaguccucccucucccccguccucaucggcggcaaccaccucaucaccgccggcgucccccgccgcuccaagcgcaucgccggcaagaaggucugccgcgucgaguccggcaaggccggcugcuucucccccaagaucucccacaaggagaagguccgccgcucccuccgccucaaguucaaccucggcaagaacggccgcgaggucaacggcugcuccggcgucaaccgcuacgaguccgucggcuggcgccucgccaaccagcagucccucaagaaccgcaucgaguccgucaagaccggccuccucuucucccccgacgucgacgagaagcuccccaagaagggcuccgagaagaucuccaaguccgaggagacccuccucacccccgagcgccucgucggcaccaacuaccgcauguccuggaccggccccaacaacuccuccuuccaggaggucgacgccaacgaggccuccuccauggucgagaaccucgaggucgagaacucccucgagcccgacaucauggucgagaagucccccgccaccuccugcgagcucacccccuccaaccucaacaacaagcacaacuccaacaucaccuccuccccccucuccggcgacgagaacaacaugaccaaggagacccucgucaagguccagaaggccuucuccgaguccggcuccaaccuccacgcccucaugaaccagcgccaguccuccgucaccaacgucggcaaggucaagcucaccgagcccuccuaccucgaggacucccccgaggagaaccucuucgagaccaacgaccucaccaucgucgaguccaaggagaaguacgagcaccacaccggcaagggcgagaagugcuucuccgagcgcgacuucuccccccuccagacccagaccuucaaccgcgagaccaccaucaagugcuacuccacccagaugaagauggagcacgagaaggacauccacuccaacaugcccaaggacuaccucuccaagcaggaguucuccuccgacgaggagaucaagaagcagcagucccccaaggacaagcucaacaacaagcucaaggagaacgagaacaugauggagggcaaccuccccaagugcgccgcccacuccaaggacgaggcccgcuccuccuucucccagcaguccaccugcgucgucaccaaccucuccaagccccgccccaugcgcaucgccaagcagcagucccucgagaccugcgagaagaccgucuccgaguccucccagaugaccgagcaccgcaaggucuccgaccacauccagugguucaacaagcucucccucaacgagcccaaccgcaucaaggucaaguccccccucaaguuccagcgcacccccguccgccaguccguccgccgcaucaacucccuccucgaguacucccgccagcccaccggccacaagcucgccucccucggcgacaccgccuccccccucgucaaguccgucuccugcgacggcgcccucuccuccugcaucgaguccgccuccaaggacuccuccgucuccugcaucaaguccggccccaaggagcagaaguccauguccugcgaggaguccaacaucggcgccaucuccaaguccuccauggagcuccccuccaaguccuuccucaagaugcgcaagcaccccgacuccgucaacgccucccuccgcuccaccaccgucuacaagcagaagauccucuccgacggccaggucaaggucccccucgacgaccucaccaaccacgacaucgucaagcccgucgucaacaacaacaugggcaucuccuccggcaucaacaaccgcguccuccgccgccccuccgagcgcggccgcgccugguacaagggcucccccaagcaccccaucggcaagacccagcuccuccccaccuccaagcccgucgaccucuga

SEQ ID NO: 39878 - RNA, 804 nt, Artificial Sequence
  derived and/or modified sequence opt2 from ARHGAP11B__Homo_sapiens__NP_001034930
augugggaccagcgccucgucaagcucgcccuccuccagcaccuccgcgccuucuacggcaucaaggucaagggcguccgcggccagugcgaccgccgccgccacgagaccgccgccaccgagaucggcggcaagaucuucggcguccccuucaacgcccucccccacuccgccguccccgaguacggccacauccccuccuuccucgucgacgccugcaccucccucgaggagcacauccacaccgagggccucuuccgcaaguccggcuccgucauccgccucaaggcccucaagaacaaggucgaccacggcgagggcugccucuccuccgccccccccugcgacaucgccggccuccucaagcaguucuuccgcgagcuccccgagcccauccuccccgccgaccuccacgaggcccuccucaaggcccagcagcucggcaccgaggagaagaacaaggccauccuccuccucuccugccuccucgccgaccacaccguccacguccuccgcuacuucuucaacuuccuccgcaacgucucccuccgcuccuccgagaacaagauggacuccuccaaccucgccgucaucuucgcccccaaccuccuccagaccuccgagggccacgagaagauguccuccaacgccgagaagaagggcgucuaccagacccucuccuggaagcgcuaccagcccugcuggguccucauggucuccguccuccuccaccacuggaaggcccucaagaaggucaacaugaagcuccucgucaacauccgcgagcgcgaggacaacgucuga

SEQ ID NO: 39879 - RNA, 1428 nt, Artificial Sequence
  derived and/or modified sequence opt2 from ARHGAP15__Homo_sapiens__NP_060930
augcagaaguccaccaacuccgacaccuccgucgagacccucaacuccacccgccagggcaccggcgccguccagaugcgcaucaagaacgccaacucccaccacgaccgccucucccaguccaaguccaugauccucaccgacgucggcaaggucaccgagcccaucucccgccaccgccgcaaccacucccagcacauccucaaggacgucauccccccccucgagcagcucauggucgagaaggagggcuaccuccagaaggccaagaucgccgacggcggcaagaagcuccgcaagaacugguccaccuccuggaucguccucuccucccgccgcaucgaguucuacaaggaguccaagcagcaggcccucuccaacaugaagaccggccacaagcccgaguccgucgaccucugcggcgcccacaucgagugggccaaggagaaguccucccgcaagaacgucuuccagaucaccaccgucuccggcaacgaguuccuccuccaguccgacaucgacuucaucauccucgacugguuccacgccaucaagaacgccaucgaccgccuccccaaggacuccuccugccccucccgcaaccucgagcucuucaagauccagcgcuccuccuccaccgagcuccucucccacuacgacuccgacaucaaggagcagaagcccgagcaccgcaagucccucauguuccgccuccaccacuccgccuccgacaccuccgacaagaaccgcgucaagucccgccucaagaaguucaucacccgccgccccucccucaagacccuccaggagaagggccucaucaaggaccagaucuucggcucccaccuccacaaggucugcgagcgcgagaacuccaccguccccugguucgucaagcagugcaucgaggccgucgagaagcgcggccucgacgucgacggcaucuaccgcgucuccggcaaccucgccaccauccagaagcuccgcuucaucgucaaccaggaggagaagcucaaccucgacgacucccagugggaggacauccacgucgucaccggcgcccucaagauguucuuccgcgagcuccccgagccccucuuccccuacuccuucuucgagcaguucgucgaggccaucaagaagcaggacaacaacacccgcaucgaggccgucaagucccucguccagaagcuccccccccccaaccgcgacaccaugaagguccucuucggccaccucaccaagaucgucgccaaggccuccaagaaccucauguccacccagucccucggcaucgucuucggccccacccuccuccgcgccgagaacgagaccggcaacauggccauccacauggucuaccagaaccagaucgccgagcucaugcucuccgaguacuccaagaucuucggcuccgaggaggacuga

SEQ ID NO: 39880 - RNA, 1992 nt, Artificial Sequence
  derived and/or modified sequence opt2 from ARHGAP18__Homo_sapiens__NP_277050
auguccuggcucuccuccucccagggcgucguccucaccgccuaccaccccuccggcaaggaccagaccgucggcaacucccacgccaaggccggcgaggaggccaccuccucccgccgcuacggccaguacaccaugaaccaggaguccaccaccaucaaggucauggagaagccccccuucgaccgcuccaucucccaggacucccucgacgagcucuccauggaggacuacuggaucgagcucgagaacaucaagaaguccuccgagaacucccaggaggaccaggaggucgucgucgucaaggagcccgacgagggcgagcucgaggaggaguggcucaaggaggccggccucuccaaccucuucggcgaguccgccggcgacccccaggaguccaucgucuuccucuccacccucacccgcacccaggccgccgccguccagaagcgcgucgagaccgucucccagacccuccgcaagaagaacaagcaguaccagauccccgacguccgcgacaucuucgcccagcagcgcgaguccaaggagaccgcccccggcggcaccgagucccagucccuccgcaccaacgagaacaaguaccagggccgcgacgacgaggccuccaaccucgucggcgaggagaagcucaucccccccgaggagacccccgcccccgagaccgacaucaaccucgaggucuccuucgccgagcaggcccucaaccagaaggaguccuccaaggagaagauccagaaguccaagggcgacgacgccacccuccccuccuuccgccuccccaaggacaagaccggcaccacccgcaucggcgaccucgccccccaggacaugaagaaggucugccaccucgcccucaucgagcucaccgcccucuacgacguccucggcaucgagcucaagcagcagaaggccgucaagaucaagaccaaggacuccggccucuucugcgucccccucaccgcccuccucgagcaggaccagcgcaagguccccggcaugcgcaucccccucaucuuccagaagcucaucucccgcaucgaggagcgcggccucgagaccgagggccuccuccgcauccccggcgccgccauccgcaucaagaaccucugccaggagcucgaggccaaguucuacgagggcaccuucaacugggaguccgucaagcagcacgacgccgccucccuccucaagcucuucauccgcgagcucccccagccccuccucuccgucgaguaccucaaggccuuccaggccguccagaaccuccccaccaagaagcagcagcuccaggcccucaaccuccucgucauccuccuccccgacgccaaccgcgacacccucaaggcccuccucgaguuccuccagcgcgucaucgacaacaaggagaagaacaagaugaccgucaugaacgucgccauggucauggcccccaaccucuucaugugccacgcccucggccucaaguccuccgagcagcgcgaguucgucauggccgccggcaccgccaacaccaugcaccuccucaucaaguaccagaagcuccucuggaccauccccaaguucaucgucaaccagguccgcaagcagaacaccgagaaccacaagaaggacaagcgcgccaugaagaagcuccucaagaagauggccuacgaccgcgagaaguacgagaagcaggacaaguccaccaacgacgccgacgucccccagggcgucauccgcguccaggccccccaccucuccaaggucuccauggccauccagcucaccgaggagcucaaggccuccgacguccucgcccgcuuccucucccaggaguccggcgucgcccagacccucaagaagggcgaggucuuccucuacgagaucggcggcaacaucggcgagcgcugccucgacgacgacaccuacaugaaggaccucuaccagcucaaccccaacgccgagugggucaucaaguccaagccccucuga

SEQ ID NO: 39881 - RNA, 1320 nt, Artificial Sequence
  derived and/or modified sequence opt2 from ARHGAP1__Homo_sapiens__XP_011518397
auggacccccucuccgagcuccaggacgaccucacccucgacgacaccuccgaggcccucaaccagcucaagcucgccuccaucgacgagaagaacuggcccuccgacgagaugcccgacuuccccaaguccgacgacuccaaguccuccucccccgagcucgucacccaccucaagugggacgaccccuacuacgacaucgcccgccaccagaucgucgaggucgccggcgacgacaaguacggccgcaagaucaucgucuucuccgccugccgcaugccccccucccaccagcucgaccacuccaagcuccucggcuaccucaagcacacccucgaccaguacgucgaguccgacuacacccuccucuaccuccaccacggccucaccuccgacaacaagcccucccucuccuggcuccgcgacgccuaccgcgaguucgaccgcaaguacaagaagaacaucaaggcccucuacaucguccaccccaccauguucaucaagacccuccucauccucuucaagccccucaucuccuucaaguucggccagaagaucuucuacgucaacuaccucuccgagcucuccgagcacgucaagcucgagcagcucggcaucccccgccagguccucaaguacgacgacuuccucaaguccacccagaagucccccgccaccgcccccaagcccaugcccccccgccccccccuccccaaccagcaguucggcgucucccuccagcaccuccaggagaagaaccccgagcaggagcccauccccaucguccuccgcgagaccgucgccuaccuccaggcccacgcccucaccaccgagggcaucuuccgccgcuccgccaacacccaggucguccgcgagguccagcagaaguacaacaugggccuccccgucgacuucgaccaguacaacgagcuccaccuccccgccgucauccucaagaccuuccuccgcgagcuccccgagccccuccucaccuucgaccucuacccccacgucgucggcuuccucaacaucgacgagucccagcgcguccccgccacccuccagguccuccagacccuccccgaggagaacuaccagguccuccgcuuccucaccgccuuccucguccagaucuccgcccacuccgaccagaacaagaugaccaacaccaaccucgccgucgucuucggccccaaccuccucugggccaaggacgccgccaucacccucaaggccaucaaccccaucaacaccuucaccaaguuccuccucgaccaccagggcgagcucuuccccucccccgaccccuccggccucuga

SEQ ID NO: 39882 - RNA, 3507 nt, Artificial Sequence
  derived and/or modified sequence opt2 from ARHGAP20__Homo_sapiens__NP_001245344
auguccgcccgcgagcgccagcccgcccucaagaagaagaugaagacccucgccgagcgccgccgcuccgcccccucccucauccucgacaaggcccuccagaagcgccccaccacccgcgacucccccuccgccuccgucgacaccugcaccuuccucuccucccucgucugcuccaaccgcacccuccucaucgacggccgcgccgagcucaagcgcggccuccagcgccaggagcgccaccucuuccucuucaacgaccucuucgucgucgccaagaucaaguacaacaacaacuucaagaucaagaacaagaucaagcucaccgacauguggaccgccuccugcgucgacgaggucggcgagggcaacaccaacgccaugaaguccuucguccucggcuggcccaccgucaacuucgucgccaccuucuccucccccgagcagaaggacaaguggcucucccuccuccagcgcuacaucaaccucgagaaggagaaggacuaccccaaguccaucccccucaagaucuucgccaaggacaucggcaacugcgccuacuccaagaccaucaccgucaugaacuccgacaccgccaacgaggucaucaacaugucccuccccaugcucggcaucaccggcuccgagcgcgacuaccagcucugggucaacuccggcaaggaggaggcccccuacccccucaucggccacgaguaccccuacggcaucaagaugucccaccuccgcgacuccgcccuccucacccccggcuccaaggacuccaccacccccuucaaccuccaggagcccuuccucauggagcagcucccccgcgagaugcagugccaguucauccucaagcccucccgccucgccgccgcccagcagcucuccgacuccggccacaagaccuucaagcgccgccgcuccaucaucaacugggccuucuggcgcggcuccuccacccaccucgacaaccuccccuccucccccaccucccccaugcccggccagcucuucggcaucucccuccccaacaucugcgagaacgacaaccuccccaagcccguccucgacaugcucuucuuccucaaccagaagggcccccucaccaagggcaucuuccgccaguccgccaacgucaaguccugccgcgagcucaaggagaagcucaacuccggcgucgagguccaccucgacugcgaguccaucuucgucaucgccuccguccucaaggacuuccuccgcaacauccccggcuccaucuucuccuccgaccucuacgaccacugggucuccgucauggaccagggcaacgacgaggagaagaucaacaccguccagcgccuccucgaccagcucccccgcgccaacgucguccuccuccgcuaccucuucggcguccuccacaacaucgagcagcacuccuccuccaaccagaugaccgccuucaaccucgccgucugcgucgcccccuccauccucuggccccccgccuccuccucccccgagcucgagaacgaguucaccaagaaggucucccuccucauccaguuccucaucgagaacugccuccgcaucuucggcgaggagaucaccucccucuuccgcgaggucuccguccgcugcgacacccgcgagaacgccuccgacaucuccugcuuccagcucaacgacuccuccuacgacucccucgagaacgagcucaacgaggacgucgacgcccccugcuccgaccucgucaagaagcucggccagggcucccgcuccauggacuccguccucacccucuccgacuacgaccucgaccagcccgaggucgagggccuccucacccucuccgacuucgaccucgcccacuccaaggacgaggacguccagaugaagcgcccccucgaguccaagcccgucaacauccucgucuacaccaagaucccccuccgcgaccacgcccgcgcccccuccgccaugugcacccccuccuaccucuccaccgccgccgccaacgccgccaagucccuccgccgccaccgccgcugcuccgagcccuccaucgacuaccucgacuccaagcucuccuaccuccgcgaguucuaccagaagaagcuccgcaaguccuccugcgacgccauccucucccagaaggacgaggacuaccucaagcagaaccagccccuccaggaggagggcaagaccugcuucaagcagucccucgucaccggcaccgacgucuccaagaagaacgccaccacccagaacaccaagaagaagucccucuccggcuccgagggcaaccacgucaagcucuuccccaaguccaagcccgucgccaucuccgucgccuccuacucccccauguccucccaggaccacuccaagaaccagcccuucgacgucaacaccuccggcuacucccccccccacaccgccgacgcccucaagggcccccgcacccaccgccgcugcuccgagcccaacaucgaggaccagaaccgcaagcucaccuaccuccgcggcaucuacuccaagaagcagcacaagaccuccugcgaggccggccuccuccacggcgaggaggacuaccucaagcgccacaagucccuccagauggagggccagaagcucaucaaccagucccucgucaugggcaucgaggucggcaaguccuccgccaccaaccagaacaccgagaagguccuccccccccgccucaaccucugcccccgcaccuccuacuccucccucuccucccccggcaccucccccuccggcuccuccgucuccucccaggacuccgccuucucccagaucuccgagcacuccgucuucacccccaccgagaccuccucccccaucgacugcaccuuccaggcccagcgcaagcgcgaggaccucucccccgacuucuccaacgccucccacgucuccggcaugcccggccccuccuccggccaggccugcucccgccccgccuacaccaagaaggacaccauggaguggcacucccagaugcacuccgucacccuccaccccuccaccuggcuccgcaacggcgucgccucccucaagaacuggucccucaagaagaaggccaaggccgcccgccccgaggaggagaagaucgccucccccaagggcccccucgagccccccccccacgccuccggcguccccgaggccaacucccuccaggaggagcagaaggaccucccccuccgcgccgccgagggccucucccccguccaguccgcccagcgcugcuccuccucccccuuccaggacuccgagcgccacugcuccucccccuucucccucgucgagucccgccucaagcucugcaugaagucccacgaggagaucgagcccggcucccaguccuccuccggcucccuccccugggagcgcgccuccgccuccuccuggacccucgaggacgccaccucccccgacuccggccccaccgucgucugcgacaucgaggaccgcuaccucaccaaggacaucuga

SEQ ID NO: 39883 - RNA, 5877 nt, Artificial Sequence
  derived and/or modified sequence opt2 from ARHGAP21__Homo_sapiens__XP_005252599
augauggccacccgccgcaccggccucuccgagggcgacggcgacaagcucaaggccugcgaggucuccaagaacaaggacggcaaggagcaguccgagaccgucucccucuccgaggacgagaccuucuccuggcccggccccaagaccgucacccucaagcgcaccucccagggcuucggcuucacccuccgccacuucaucgucuacccccccgaguccgccauccaguucuccuacaaggacgaggagaacggcaaccgcggcggcaagcagcgcaaccgccucgagcccauggacaccaucuucgucaagcaggucaaggagggcggccccgccuucgaggccggccucugcaccggcgaccgcaucaucaaggucaacggcgaguccgucaucggcaagaccuacucccaggucaucgcccucauccagaacuccgacaccacccucgagcucuccgucaugcccaaggacgaggacauccuccagguccuccaguucaccaaggacgucaccgcccucgccuacucccaggacgccuaccucaagggcaacgaggccuacuccggcaacgcccgcaacauccccgagcccccccccaucugcuaccccuggcuccccuccgcccccuccgccauggcccagcccgucgagaucuccccccccgacuccucccucuccaagcagcagaccuccacccccguccucacccagcccggccgcgccuaccgcauggagauccaggucccccccucccccaccgacgucgccaaguccaacaccgccgucugcgucugcaacgaguccguccgcaccgucaucguccccuccgagaaggucgucgaccuccucuccaaccgcaacaaccacaccggccccucccaccgcaccgaggagguccgcuacggcgucuccgagcagaccucccucaagaccgucucccgcaccaccucccccccccucuccauccccaccacccaccucauccaccagcccgccggcucccgcucccucgagcccuccggcauccuccucaaguccggcaacuacuccggccacuccgacggcaucuccuccucccgcucccaggccgucgaggcccccuccgucuccgucaaccacuacucccccaacucccaccagcacaucgacuggaagaacuacaagaccuacaaggaguacaucgacaaccgccgccuccacaucggcugccgcaccauccaggagcgccucgacucccuccgcgccgccucccaguccaccaccgacuacaaccaggucguccccaaccgcaccacccuccagggccgccgccgcuccaccucccacgaccgcgucccccaguccguccagauccgccagcgcuccgucucccaggagcgccucgaggacuccguccucaugaaguacugcccccgcuccgccucccagggcgcccucaccucccccuccgucuccuucuccaaccaccgcacccgcuccugggacuacaucgagggccaggacgagacccucgagaacgucaacuccggcacccccauccccgacuccaacggcgagaagaagcagaccuacaagugguccggcuucaccgagcaggacgaccgccgcggcaucugcgagcgcccccgccagcaggagauccacaaguccuuccgcggcuccaacuucaccgucgcccccuccgucgucaacuccgacaaccgccgcauguccggccgcggcgucggcuccgucucccaguucaagaagaucccccccgaccucaagacccuccaguccaaccgcaacuuccagaccaccugcggcaugucccucccccgcggcaucucccaggaccgcuccccccucgucaagguccgcuccaacucccucaaggcccccuccacccacgucaccaagcccuccuucucccagaaguccuucgucuccaucaaggaccagcgccccgucaaccaccuccaccagaacucccuccucaaccagcagaccuggguccgcaccgacuccgcccccgaccagcaggucgagaccggcaagucccccucccucuccggcgccuccgccaagcccgccccccaguccuccgagaacgccggcaccuccgaccucgagcuccccgucucccagcgcaaccaggaccucucccuccaggaggccgagaccgagcaguccgacacccucgacaacaaggaggccgucauccuccgcgagaagccccccuccggccgccagaccccccagccccuccgccaccaguccuacauccucgccgucaacgaccaggagaccggcuccgacaccaccugcuggcuccccaacgacgcccgccgcgagguccacaucaagcgcauggaggagcgcaaggccuccuccaccuccccccccggcgacucccucgccuccauccccuucaucgacgagcccaccucccccuccaucgaccacgacaucgcccacauccccgccuccgccgucaucuccgccuccaccucccagguccccuccaucgccaccgucccccccugccucaccaccuccgccccccucauccgccgccagcucucccacgaccacgaguccgucggcccccccucccucgacgcccagcccaacuccaagaccgagcgcuccaaguccuacgacgagggccucgacgacuaccgcgaggacgccaagcucuccuucaagcacgucuccucccucaagggcaucaagaucgccgacucccagaaguccuccgaggacuccggcucccgcaaggacuccuccuccgaggucuucuccgacgccgccaaggagggcuggcuccacuuccgcccccucgucaccgacaagggcaagcgcgucggcggcuccauccgccccuggaagcagauguacgucguccuccgcggccacucccucuaccucuacaaggacaagcgcgagcagaccacccccuccgaggaggagcagcccaucuccgucaacgccugccucaucgacaucuccuacuccgagaccaagcgcaagaacgucuuccgccucaccaccuccgacugcgagugccucuuccaggccgaggaccgcgacgacaugcucgccuggaucaagaccauccaggaguccuccaaccucaacgaggaggacaccggcgucaccaaccgcgaccucaucucccgccgcaucaaggaguacaacaaccucauguccaaggccgagcagcuccccaagaccccccgccagucccucuccauccgccagacccuccucggcgccaaguccgagcccaagacccaguccccccacucccccaaggaggaguccgagcgcaagcuccucuccaaggacgacaccuccccccccaaggacaagggcaccuggcgcaagggcauccccuccaucaugcgcaagaccuucgagaagaagcccaccgccaccggcaccuucggcguccgccucgacgacugcccccccgcccacaccaaccgcuacaucccccucaucgucgacaucugcugcaagcucgucgaggagcgcggccucgaguacaccggcaucuaccgcguccccggcaacaacgccgccaucuccuccaugcaggaggagcucaacaagggcauggccgacaucgacauccaggacgacaaguggcgcgaccucaacgucaucuccucccuccucaaguccuucuuccgcaagcuccccgagccccucuucaccaacgacaaguacgccgacuucaucgaggccaaccgcaaggaggacccccucgaccgccucaagacccucaagcgccucauccacgaccuccccgagcaccacuacgagacccucaaguuccucuccgcccaccucaagaccgucgccgagaacuccgagaagaacaagauggagccccgcaaccucgccaucgucuucggccccacccucguccgcaccuccgaggacaacaugacccacauggucacccacaugcccgaccaguacaagaucgucgagacccucauccagcaccacgacugguucuucaccgaggagggcgccgaggagccccucaccaccguccaggaggaguccaccgucgacucccagcccguccccaacaucgaccaccuccucaccaacaucggccgcaccggcgucucccccggcgacgucuccgacuccgccaccuccgacuccaccaaguccaagggcuccuggggcuccggcaaggaccaguacucccgcgagcuccucgucuccuccaucuucgccgccgccucccgcaagcgcaagaagcccaaggagaaggcccagcccuccuccuccgaggacgagcucgacaacgucuucuucaagaaggagaacgucgagcagugccacaacgacaccaaggaggaguccaagaaggaguccgagacccucggccgcaagcagaagaucaucaucgccaaggagaacuccacccgcaaggaccccuccaccaccaaggacgagaagaucucccucggcaaggaguccacccccuccgaggagcccucccccccccacaacuccaagcacaacaagucccccacccucuccugccgcuucgccauccucaaggaguccccccgcucccuccucgcccagaaguccucccaccucgaggagaccggcuccgacuccggcacccuccucuccaccuccucccaggccucccucgcccgcuucuccaugaagaaguccaccucccccgagaccaagcacuccgaguuccucgccaacgucuccaccaucaccuccgacuacuccaccaccuccuccgccaccuaccucaccucccucgacuccucccgccucucccccgagguccaguccgucgccgaguccaagggcgacgaggccgacgacgagcgcuccgagcucaucuccgagggccgccccgucgagaccgacuccgaguccgaguuccccgucuuccccaccgcccucaccuccgagcgccucuuccgcggcaagcuccaggaggucaccaaguccucccgccgcaacuccgagggcuccgagcucuccugcaccgagggcucccucaccuccucccucgacucccgccgccagcucuucuccucccacaagcucaucgagugcgacacccucucccgcaagaaguccgcccgcuucaaguccgacuccggcucccucggcgacgccaagaacgagaaggaggcccccucccucaccaaggucuucgacgucaugaagaagggcaaguccaccggcucccuccucacccccacccgcggcgaguccgagaagcaggagcccaccuggaagaccaagaucgccgaccgccucaagcuccgcccccgcgcccccgccgacgacauguucggcgucggcaaccacaaggucaacgccgagaccgccaagcgcaaguccauccgccgccgccacacccucggcggccaccgcgacgccaccgagaucuccguccucaacuucuggaagguccacgagcaguccggcgagcgcgaguccgagcucuccgccgucaaccgccucaagcccaagugcuccgcccaggaccucuccaucuccgacuggcucgcccgcgagcgccuccgcaccuccaccuccgaccucucccgcggcgagaucggcgacccccagaccgagaaccccuccacccgcgagaucgccaccaccgacaccccccucucccuccacugcaacaccggcuccuccuccuccacccucgccuccaccaaccgcccccuccucuccauccccccccagucccccgaccagaucaacggcgaguccuuccagaacgucuccaagaacgccuccuccgccgccaacgcccagccccacaagcucuccgagacccccggcuccaaggccgaguuccaccccugccucuga

SEQ ID NO: 39884 - RNA, 2145 nt, Artificial Sequence
  derived and/or modified sequence opt2 from ARHGAP22__Homo_sapiens__NP_001242953
augcucucccccaagauccgccaggcccgccgcgcccgcuccaagucccucgucaugggcgagcagucccgcucccccggccgcaugcccugcccccaccgccucggccccguccucaaggccggcuggcucaagaagcagcgcuccaucaugaagaacuggcagcagcgcugguucguccuccgcggcgaccagcucuucuacuacaaggacaaggacgagaucaagccccagggcuucaucucccuccagggcacccaggucaccgagcucccccccggccccgaggaccccggcaagcaccucuucgagaucucccccggcggcgccggcgagcgcgagaagguccccgccaaccccgaggcccuccuccucauggccuccucccagcgcgacauggaggacuggguccaggccauccgccgcgucaucugggccccccucggcggcggcaccgcccgccgcucccacgcccacccccucgagccccucccccccggcaucuucggccagcgccucgaggagaccguccaccacgagcgcaaguacggcccccgccucgccccccuccucgucgagcagugcgucgacuucauccgcgagcgcggccucaccgaggagggccucuuccgcaugcccggccaggccaaccucguccgcgaccuccaggacuccuucgacugcggcgagaagccccucuucgacuccaccaccgacguccacaccgucgccucccuccucaagcucuaccuccgcgagcuccccgagcccgucguccccuucgcccgcuacgaggacuuccucuccugcgcccagcuccucaccaaggacgagggcgagggcacccucgagcucgccaagcaggucuccaaccucccccaggccaacuacaaccuccuccgcuacaucugcaaguuccucgacgagguccaggccuacuccaacgucaacaagauguccguccagaaccucgccaccgucuucggccccaacauccuccgcccccaggucgaggaccccgucaccaucauggagggcaccucccucguccagcaccucaugaccguccucauccgcaagcacucccagcucuucaccgcccccguccccgagggccccaccuccccccgcggcggccuccagugcgccgucggcuggggcuccgaggaggucacccgcgacucccagggcgagcccggcggccccggccuccccgcccaccgcaccuccucccucgacggcgccgccgucgccguccucucccgcaccgcccccaccggccccggcucccgcugcucccccggcaagaagguccagacccuccccuccuggaaguccuccuuccgccagccccgcucccucuccggcucccccaagggcggcggcuccucccucgagguccccaucaucuccuccggcggcaacuggcucaugaacggccucuccucccuccgcggccaccgccgcgccuccuccggcgaccgccucaaggacuccggcuccguccagcgccucuccaccuacgacaacguccccgcccccggccucguccccggcauccccuccgucgccuccauggccugguccggcgccuccuccuccgaguccuccgucggcggcucccucuccuccugcaccgccugccgcgccuccgacuccuccgcccgcuccucccuccacaccgacugggcccucgagcccuccccccuccccuccuccuccgaggaccccaagucccucgaccucgaccacuccauggacgaggccggcgccggcgccuccaacuccgagcccuccgagcccgacucccccacccgcgagcacgcccgccgcuccgaggcccuccagggccucgucaccgagcuccgcgccgagcucugccgccagcgcaccgaguacgagcgcuccgucaagcgcaucgaggagggcuccgccgaccuccgcaagcgcaugucccgccucgaggaggagcucgaccaggagaagaagaaguacaucaugcucgagaucaagcuccgcaacuccgagcgcgcccgcgaggacgccgagcgccgcaaccagcuccuccagcgcgagauggaggaguucuucuccacccucggcucccucaccgucggcgccaagggcgcccgcgcccccaaguga

SEQ ID NO: 39885 - RNA, 4476 nt, Artificial Sequence
  derived and/or modified sequence opt2 from ARHGAP23__Homo_sapiens__NP_001186346
augaacggcgucgccuucugccucgucggcauccccccccgccccgagccccgccccccccagcucccccucggcccccgcgacggcugcuccccccgccgccccuuccccuggcagggcccccgcacccuccuccucuacaaguccccccaggacggcuucggcuucacccuccgccacuucaucgucuacccccccgaguccgccguccacugcucccucaaggaggaggagaacggcggccgcggcggcggccccuccccccgcuaccgccucgagcccauggacaccaucuucgucaagaacgucaaggaggacggccccgcccaccgcgccggccuccgcaccggcgaccgccucgucaaggucaacggcgaguccgucaucggcaagaccuacucccaggucaucgcccucauccagaacuccgacgacacccucgagcucuccaucaugcccaaggacgaggacauccuccagcucgccuacucccaggacgccuaccucaagggcaacgagcccuacuccggcgaggcccgcuccauccccgagcccccccccaucugcuacccccgcaagaccuacgccccccccgcccgcgccuccacccgcgccaccaugguccccgagcccaccuccgcccuccccuccgacccccgcucccccgccgccugguccgaccccggccuccgcgucccccccgccgcccgcgcccaccucgacaacuccucccucggcaugucccagccccgccccucccccggcgccuucccccaccucuccuccgagccccgcaccccccgcgccuuccccgagcccggcucccgcgucccccccucccgccucgagugccagcaggcccucucccacuggcucuccaaccaggucccccgccgcgccggcgagcgccgcugccccgccauggccccccgcgcccgcuccgccucccaggaccgccucgaggaggucgccgccccccgccccuggcccugcuccaccucccaggacgcccucucccagcucggccaggagggcuggcaccgcgcccgcuccgacgacuaccucucccgcgccacccgcuccgccgaggcccucggccccggcgcccucgucuccccccgcuucgagcgcugcggcugggccucccagcgcuccuccgcccgcacccccgccugccccacccgcgaccuccccggcccccaggcccccccccccuccggccuccagggccucgacgaccucggcuacaucggcuaccgcuccuacucccccuccuuccagcgccgcaccggccuccuccacgcccucuccuuccgcgacucccccuucggcggccuccccaccuucaaccucgcccagucccccgccuccuucccccccgaggccuccgagcccccccgcgucguccgccccgagcccuccacccgcgcccucgagccccccgccgaggaccgcggcgacgaggucguccuccgccagaagccccccaccggccgcaagguccagcucacccccgcccgccagaugaaccucggcuucggcgacgagucccccgagcccgaggccuccggccgcggcgagcgccucggccgcaaggucgccccccucgccaccaccgaggacucccucgccuccauccccuucaucgacgagcccaccucccccuccaucgaccuccaggccaagcacguccccgccuccgccgucgucuccuccgccaugaacuccgcccccguccucggcaccucccccuccucccccaccuucaccuucacccucggccgccacuacucccaggacugcuccuccaucaaggccggccgccgcuccuccuaccuccucgccaucaccaccgagcgcuccaaguccugcgacgacggccucaacaccuuccgcgacgagggccgcguccuccgccgccuccccaaccgcauccccucccuccgcaugcuccgcuccuucuucaccgacggcucccucgacuccuggggcaccuccgaggacgccgacgcccccuccaagcgccacuccaccuccgaccucuccgacgccaccuucuccgacauccgccgcgagggcuggcucuacuacaagcagauccucaccaagaagggcaagaaggccggcuccggccuccgccaguggaagcgcgucuacgccgcccuccgcgcccgcucccucucccucuccaaggagcgccgcgagcccggccccgccgccgccggcgccgccgccgccggcgccggcgaggacgaggccgcccccgucugcaucggcuccugccucgucgacaucuccuacuccgagaccaagcgccgccacgucuuccgccucaccaccgccgacuucugcgaguaccucuuccaggccgaggaccgcgacgacaugcucggcuggauccgcgccauccgcgagaacucccgcgccgagggcgaggaccccggcugcgccaaccaggcccucaucuccaagaagcucaacgacuaccgcaaggucucccacuccuccggccccaaggccgacuccucccccaagggcucccgcggccucggcggccucaaguccgaguuccucaagcaguccgccgcccgcggccuccgcacccaggaccuccccgccggcuccaaggacgacuccgccgccgcccccaagacccccuggggcaucaacaucaucaagaagaacaagaaggccgccccccgcgccuucggcguccgccucgaggagugccagcccgccaccgagaaccagcgcgucccccucaucgucgccgccugcugccgcaucgucgaggcccgcggccucgaguccaccggcaucuaccgcguccccggcaacaacgccgucgucuccucccuccaggagcagcucaaccgcggccccggcgacaucaaccuccaggacgagcgcuggcaggaccucaacgucaucuccucccuccucaaguccuucuuccgcaagcuccccgagccccucuucaccgacgacaaguacaacgacuucaucgaggccaaccgcaucgaggacgcccgcgagcgcaugcgcacccuccgcaagcucauccgcgaccuccccggccacuacuacgagacccucaaguuccucgucggccaccucaagaccaucgccgaccacuccgagaagaacaagauggagccccgcaaccucgcccucgucuucggccccacccucguccgcaccuccgaggacaacaugaccgacauggucacccacaugcccgaccgcuacaagaucgucgagacccucauccagcacuccgacugguucuucuccgacgaggaggacaagggcgagcgcacccccgucggcgacaaggagccccaggccguccccaacaucgaguaccuccuccccaacaucggccgcaccgucccccccggcgaccccggcuccgacuccaccaccugcuccuccgccaaguccaagggcuccugggcccccaagaaggagcccuacgcccgcgagaugcucgccaucuccuucaucuccgccgucaaccgcaagcgcaagaagcgccgcgaggcccgcggccucggcuccuccaccgacgacgacuccgagcaggaggcccacaagcccggcgccggcgccaccgcccccggcacccaggagcgcccccagggcccccuccccggcgccgucgcccccgaggcccccggccgccucuccccccccgccgcccccgaggagcgccccgccgccgacacccgcuccaucgucuccggcuacuccacccucuccaccauggaccgcuccgucugcuccggcgccuccggccgccgcgccggcgccggcgacgaggccgacgacgagcgcuccgagcucucccacgucgagaccgacaccgagggcgccgccggcgccggccccggcggccgccucacccgccgccccuccuucuccucccaccaccucaugcccugcgacacccucgcccgccgccgccucgcccgcggccgccccgacggcgagggcgccggccgcggcggcccccgcgcccccgagccccccggcuccgccuccuccuccucccaggagucccuccgcccccccgccgccgcccucgccucccgccccucccgcauggaggcccuccgccuccgccuccgcggcaccgccgacgacaugcucgccguccgccuccgccgcccccucucccccgagacccgccgccgccgcuccuccuggcgccgccacaccgucgucguccaguccccccucaccgaccucaacuucaacgaguggaaggagcucggcggcggcggcccccccgagcccgccggcgcccgcgcccacuccgacaacaaggacuccggccucuccucccucgaguccaccaaggcccgcgcccccuccuccgccgccucccagccccccgcccccggcgacaccggcucccuccagucccagcccccccgccgcuccgccgccucccgccuccaccagugccucuga

SEQ ID NO: 39886 - RNA, 1968 nt, Artificial Sequence
  derived and/or modified sequence opt2 from ARHGAP24__Homo_sapiens__NP_112595
augcccgaggaccgcaacuccggcggcugccccgccggcgcccucgccuccacccccuucauccccaagaccaccuaccgccgcaucaagcgcugcuucuccuuccgcaagggcaucuucggccagaagcucgaggacaccguccgcuacgagaagcgcuacggcaaccgccucgcccccaugcucgucgagcagugcgucgacuucauccgccagcgcggccucaaggaggagggccucuuccgccuccccggccaggccaaccucgucaaggagcuccaggacgccuucgacugcggcgagaagcccuccuucgacuccaacaccgacguccacaccgucgccucccuccucaagcucuaccuccgcgagcuccccgagcccgucauccccuacgccaaguacgaggacuuccucuccugcgccaagcuccucuccaaggaggaggaggccggcgucaaggagcucgccaagcaggucaagucccuccccgucgucaacuacaaccuccucaaguacaucugccgcuuccucgacgagguccaguccuacuccggcgucaacaagauguccguccagaaccucgccaccgucuucggccccaacauccuccgccccaaggucgaggacccccucaccaucauggagggcaccgucgucguccagcagcucauguccgucaugaucuccaagcacgacugccucuuccccaaggacgccgagcuccaguccaagccccaggacggcgucuccaacaacaacgagauccagaagaaggccaccaugggccagcuccagaacaaggagaacaacaacaccaaggacucccccucccgccagugcuccugggacaaguccgaguccccccagcgcuccuccaugaacaacggcucccccaccgcccucuccggcuccaagaccaacucccccaagaacuccguccacaagcucgacgucucccgcucccccccccucauggucaagaagaaccccgccuucaacaagggcuccggcaucgucaccaacggcuccuucuccuccuccaacgccgagggccucgagaagacccagaccacccccaacggcucccuccaggcccgccgcuccuccucccucaaggucuccggcaccaagaugggcacccacuccguccagaacggcaccguccgcaugggcauccucaacuccgacacccucggcaaccccaccaacguccgcaacauguccuggcuccccaacggcuacgucacccuccgcgacaacaagcagaaggagcaggccggcgagcucggccagcacaaccgccucuccaccuacgacaacguccaccagcaguucuccaugaugaaccucgacgacaagcaguccaucgacuccgccaccugguccaccuccuccugcgagaucucccuccccgagaacuccaacuccugccgcuccuccaccaccaccugccccgagcaggacuucuucggcggcaacuucgaggaccccguccucgacggccccccccaggacgaccucucccacccccgcgacuacgaguccaaguccgaccaccgcuccgucggcggccgcuccucccgcgccaccuccuccuccgacaacuccgagaccuucgucggcaacuccuccuccaaccacuccgcccuccacucccucgucuccucccucaagcaggagaugaccaagcagaagaucgaguacgagucccgcaucaagucccucgagcagcgcaaccucacccucgagaccgagaugaugucccuccacgacgagcucgaccaggagcgcaagaaguucaccaugaucgagaucaagaugcgcaacgccgagcgcgccaaggaggacgccgagaagcgcaacgacaugcuccagaaggagauggagcaguucuucuccaccuucggcgagcucaccgucgagccccgccgcaccgagcgcggcaacaccaucuggauccaguga

SEQ ID NO: 39887 - RNA, 1941 nt, Artificial Sequence
  derived and/or modified sequence opt2 from ARHGAP25__Homo_sapiens__NP_001007232
augucccucaagcucccccgcaacugggacuucaaccucaaggucgaggccgccaagaucgcccgcucccgcuccgucaugaccggcgagcagauggccgccuuccaccccuccuccacccccaacccccucgagcgccccaucaagaugggcuggcucaagaagcagcgcuccaucgucaagaacuggcagcagcgcuacuucguccuccgcgcccagcagcucuacuacuacaaggacgaggaggacaccaagccccagggcugcauguaccuccccggcugcaccaucaaggagaucgccaccaaccccgaggaggccggcaaguucgucuucgagaucauccccgccuccugggaccagaaccgcaugggccaggacuccuacguccucauggccuccucccaggccgagauggaggagugggucaaguuccuccgccgcgucgccggcacccccugcggcgccgucuucggccagcgccucgacgagaccgucgccuacgagcagaaguucggcccccaccucguccccauccucgucgagaagugcgccgaguucauccucgagcacggccgcaacgaggagggcaucuuccgccuccccggccaggacaaccucgucaagcagcuccgcgacgccuucgacgccggcgagcgccccuccuucgaccgcgacaccgacguccacaccgucgccucccuccucaagcucuaccuccgcgaccuccccgagcccgucguccccuggucccaguacgagggcuuccuccucugcggccagcucaccaacgccgacgaggccaaggcccagcaggagcucaugaagcagcucuccauccucccccgcgacaacuacucccuccucuccuacaucugccgcuuccuccacgagauccagcucaacugcgccgucaacaagauguccgucgacaaccucgccaccgucaucggcgucaaccucauccgcuccaaggucgaggaccccgccgucaucaugcgcggcaccccccagauccagcgcgucaugaccaugaugauccgcgaccacgagguccucuuccccaaguccaaggacaucccccucuccccccccgcccagaagaacgaccccaagaaggcccccgucgcccgcuccuccgucggcugggacgccaccgaggaccuccgcaucucccgcaccgacuccuucuccuccaugaccuccgacuccgacaccaccucccccaccggccagcagcccuccgacgccuuccccgaggacuccuccaaggucccccgcgagaagcccggcgacuggaagaugcagucccgcaagcgcacccagacccuccccaaccgcaagugcuuccucaccuccgccuuccagggcgccaacuccuccaagauggagaucuucaagaacgaguucuggucccccuccuccgaggccaaggccggcgagggccaccgccgcaccaugucccaggaccuccgccagcucuccgacucccagcgcaccuccaccuacgacaacguccccucccuccccggcucccccggcgaggaggccuccgcccucuccucccaggccugcgacuccaagggcgacacccucgccucccccaacuccgagaccggccccggcaagaagaacuccggcgaggaggagaucgacucccuccagcgcaugguccaggagcuccgcaaggagaucgagacccagaagcagauguacgaggagcagaucaagaaccucgagaaggagaacuacgacgucugggccaaggucguccgccucaacgaggagcucgagaaggagaagaagaaguccgccgcccucgagaucucccuccgcaacauggagcgcucccgcgaggacgucgagaagcgcaacaaggcccucgaggaggaggucaaggaguucgucaaguccaugaaggagcccaagaccgaggccuga

SEQ ID NO: 39888 - RNA, 2280 nt, Artificial Sequence
  derived and/or modified sequence opt2 from ARHGAP26__Homo_sapiens__NP_001129080
augggccuccccgcccucgaguucuccgacugcugccucgacuccccccacuuccgcgagacccucaagucccacgaggccgagcucgacaagaccaacaaguucaucaaggagcucaucaaggacggcaagucccucaucuccgcccucaagaaccucuccuccgccaagcgcaaguucgccgacucccucaacgaguucaaguuccagugcaucggcgacgccgagaccgacgacgagaugugcaucgcccgcucccuccaggaguucgccaccguccuccgcaaccucgaggacgagcgcauccgcaugaucgagaacgccuccgagguccucaucaccccccucgagaaguuccgcaaggagcagaucggcgccgccaaggaggccaagaagaaguacgacaaggagaccgagaaguacugcggcauccucgagaagcaccucaaccucuccuccaagaagaaggagucccagcuccaggaggccgacucccaggucgaccucguccgccagcacuucuacgaggucucccucgaguacgucuucaagguccaggagguccaggagcgcaagauguucgaguucgucgagccccuccucgccuuccuccagggccucuucaccuucuaccaccacggcuacgagcucgccaaggacuucggcgacuucaagacccagcucaccaucuccauccagaacacccgcaaccgcuucgagggcacccgcuccgaggucgagucccucaugaagaagaugaaggagaacccccucgagcacaagaccaucucccccuacaccauggagggcuaccucuacguccaggagaagcgccacuucggcaccuccugggucaagcacuacugcaccuaccagcgcgacuccaagcagaucaccaugguccccuucgaccagaaguccggcggcaagggcggcgaggacgaguccgucauccucaaguccugcacccgccgcaagaccgacuccaucgagaagcgcuucugcuucgacgucgaggccgucgaccgccccggcgucaucaccaugcaggcccucuccgaggaggaccgccgccucuggauggaggccauggacggccgcgagcccgucuacaacuccaacaaggacucccaguccgagggcaccgcccagcucgacuccaucggcuucuccaucauccgcaagugcauccacgccgucgagacccgcggcaucaacgagcagggccucuaccgcaucgucggcgucaacucccgcguccagaagcuccucuccguccucauggaccccaagaccgccuccgagaccgagaccgacaucugcgccgagugggagaucaagaccaucaccuccgcccucaagaccuaccuccgcaugcuccccggcccccucaugauguaccaguuccagcgcuccuucaucaaggccgccaagcucgagaaccaggagucccgcgucuccgagauccacucccucguccaccgccuccccgagaagaaccgccagaugcuccagcuccucaugaaccaccucgccaacgucgccaacaaccacaagcagaaccucaugaccgucgccaaccucggcgucgucuucggccccacccuccuccgcccccaggaggagaccgucgccgccaucauggacaucaaguuccagaacaucgucaucgagauccucaucgagaaccacgagaagaucuucaacaccguccccgacaugccccucaccaacgcccagcuccaccucucccgcaagaaguccuccgacuccaagccccccuccugcuccgagcgcccccucacccucuuccacaccguccaguccaccgagaagcaggagcagcgcaacuccaucaucaacuccucccucgaguccgucuccuccaaccccaacuccauccucaacuccuccuccucccuccagcccaacaugaacuccuccgaccccgaccucgccgucgucaagcccacccgccccaacucccucccccccaaccccucccccaccuccccccucucccccuccuggcccauguucuccgcccccuccucccccaugcccaccuccuccaccuccuccgacuccucccccgucuccacccccuuccgcaaggccaaggcccucuacgccugcaaggccgagcacgacuccgagcucuccuucaccgccggcaccgucuucgacaacguccaccccucccaggagcccggcuggcucgagggcacccucaacggcaagaccggccucauccccgagaacuacgucgaguuccucuga

SEQ ID NO: 39889 - RNA, 792 nt, Artificial Sequence
  derived and/or modified sequence opt2 from ARHGAP27__Homo_sapiens__NP_777579
auggccgccgacgucgucggcgacgucuacguccucgucgagcaccccuucgaguacaccggcaaggacggccgccgcgucgccauccgccccaacgagcgcuaccgccuccuccgccgcuccaccgagcacugguggcacguccgccgcgagcccggcggccgccccuucuaccuccccgcccaguacguccgcgagcuccccgcccucggcaaccccgccgccgccgccccccccggcccccaccccucccccgccgcccccgagccccucgccuacgacuaccgcuucgucuccgccgccgccaccgccggccccgacggcgcccccgaggaguccggcggccgcgccuccucccucugcggccccgcccagcgcggcgccgccacccagcgcuccucccucgcccccggccuccccgccugccucuaccuccgccccgccgcccccguccgccccgcccagucccucaacgaccucgccugcgccgccgucuccccccccgccggccuccucggcuccuccggcuccuucaaggccugcuccgucgccggcuccugggucugcccccgcccccucgcccgcuccgacuccgagaacgucuacgaggucauccaggaccuccacguccccccccccgaggaguccgccgagcagguccccccccgcgcccucggccgcggcggcggcuggcgcgcccgcgaccgcgcccgcaccgagcccggccgcaaggagacccgcuccgcccagcgccgcgcccgccgccccccccucuccgaggacuucggcuga

SEQ ID NO: 39890 - RNA, 1713 nt, Artificial Sequence
  derived and/or modified sequence opt2 from ARHGAP28__Homo_sapiens__NP_001010000
augcgcaagaaggacaagcaguccauccgcgacguccgcgacaucuucggcgucuccgagucccccccccgcgacaccugcggcaaccacaccaaccagcucgacggcaccaaggaggagcgcgagcucccccgcgucaucaagaccuccggcuccaugcccgacgacgccucccucaacuccaccacccucuccgacgccucccaggacaaggagggcuccuucgccgucccccgcuccgacuccgucgccauccucgagaccauccccguccuccccguccacuccaacggcucccccgagcccggccagcccguccagaacgccaucuccgacgacgacuuccucgagaagaacaucccccccgaggccgaggagcucuccuucgaggucuccuacuccgagauggucaccgaggcccucaagcgcaacaagcucaagaaguccgagaucaagaaggaggacuacguccucaccaaguucaacguccagaagacccgcuucggccucaccgaggccggcgaccucuccgccgaggacaugaagaagauccgccaccucucccucaucgagcucaccgccuucuucgacgccuucggcauccagcucaagcgcaacaagaccgagaaggucaagggccgcgacaacggcaucuucggcgucccccucaccguccuccucgacggcgaccgcaagaaggaccccggcgucaaggucccccucguccuccagaaguucuucgagaaggucgaggaguccggccucgaguccgagggcaucuuccgccucuccggcugcaccgccaaggucaagcaguaccgcgaggagcucgacgccaaguucaacgccgacaaguucaagugggacaagaugugccaccgcgaggccgccgucaugcucaaggccuucuuccgcgagcuccccaccucccucuuccccgucgaguacauccccgccuucaucucccucauggagcgcggcccccacgucaagguccaguuccaggcccuccaccucauggucauggcccuccccgacgccaaccgcgacgccgcccaggcccucaugaccuucuucaacaaggucaucgccaacgaguccaagaaccgcaugucccucuggaacaucuccaccgucauggcccccaaccucuucuucucccgcuccaagcacuccgacuacgaggagcuccuccucgccaacaccgccgcccacaucauccgccucaugcucaaguaccagaagauccucuggaagguccccuccuuccucaucacccagguccgccgcaugaacgaggccaccaugcuccucaagaagcagcuccccuccguccgcaagcuccuccgccgcaagacccucgagcgcgagaccgccucccccaagaccuccaagguccuccagaagucccccuccgcccgccgcauguccgacguccccgagggcgucauccgcguccacgccccccuccucuccaaggucuccauggccauccagcucaacaaccagaccaaggccaaggacauccucgccaaguuccaguacgagaacucccacggcuccuccgagugcaucaagauccagaaccagcgccucuacgagaucggcggcaacaucggcgagcacugccucgaccccgacgccuacauccucgacgucuaccgcaucaacccccaggccgagugggucaucaagccccagcaguccuccuga

SEQ ID NO: 39891 - RNA, 3306 nt, Artificial Sequence
  derived and/or modified sequence opt2 from ARHGAP30__Homo_sapiens__NP_001020769
augaagucccgccagaagggcaagaagaagggcuccgccaaggagcgcgucuucggcugcgaccuccaggagcaccuccagcacuccggccaggaggucccccagguccucaaguccugcgccgaguucgucgaggaguacggcgucgucgacggcaucuaccgccucuccggcgucuccuccaacauccagaagcuccgccaggaguucgaguccgagcgcaagcccgaccuccgccgcgacgucuaccuccaggacauccacugcgucuccucccucugcaaggccuacuuccgcgagcuccccgacccccuccucaccuaccgccucuacgacaaguucgccgaggccgucggcguccagcucgagcccgagcgccucgucaagauccucgagguccuccgcgagcuccccguccccaacuaccgcacccucgaguuccucaugcgccaccucguccacauggccuccuucuccgcccagaccaacaugcacgcccgcaaccucgccaucgucugggcccccaaccuccuccgcuccaaggacaucgaggccuccggcuucaacggcaccgccgccuucauggagguccgcguccaguccaucgucgucgaguucauccucacccacgucgaccagcucuucggcggcgccgcccucuccggcggcgaggucgaguccggcuggcgcucccuccccggcacccgcgccuccggcucccccgaggaccucaugccccgcccccuccccuaccaccuccccuccauccuccaggccggcgacggccccccccagaugcgccccuaccacaccaucaucgagaucgccgagcacaagcgcaagggcucccucaagguccgcaaguggcgcuccaucuucaaccucggccgcuccggccacgagaccaagcgcaagcucccccgcggcgccgaggaccgcgaggacaaguccaacaagggcacccuccgccccgccaaguccauggacucccucuccgccgccgccggcgccuccgacgagcccgagggccucgucggccccuccuccccccgccccuccccccuccuccccgagucccucgagaacgacuccaucgaggccgccgagggcgagcaggagcccgaggccgaggcccucggcggcaccaacuccgagcccggcaccccccgcgccggccgcuccgccauccgcgccggcggcuccucccgcgccgagcgcugcgccggcguccacaucuccgaccccuacaacgucaaccucccccuccacaucaccuccauccucuccgucccccccaacaucaucuccaacgucucccucgcccgccucacccgcggccucgagugccccgcccuccagcaccgccccucccccgccuccggccccggccccggccccggccucggccccggcccccccgacgagaagcucgaggccucccccgccuccuccccccucgccgacuccggccccgacgaccucgcccccgcccucgaggacucccucucccaggagguccaggacuccuucuccuuccucgaggacuccuccuccuccgagcccgagugggucggcgccgaggacggcgaggucgcccaggccgaggccgccggcgccgccuucucccccggcgaggacgaccccggcaugggcuaccucgaggagcuccucggcgucggcccccaggucgaggaguucuccgucgagcccccccucgacgaccucucccucgacgaggcccaguucguccucgcccccuccugcugcucccucgacuccgccggcccccgccccgaggucgaggaggagaacggcgaggaggucuuccucuccgccuacgacgaccucuccccccuccucggccccaagccccccaucuggaagggcuccggcucccucgagggcgaggccgccggcugcggccgccaggcccucggccagggcggcgaggagcaggccugcugggaggucggcgaggacaagcaggccgagcccggcggccgccucgacauccgcgaggaggccgagggcucccccgagaccaaggucgaggccggcaaggccuccgaggaccgcggcgaggccggcggcucccaggagaccaagguccgccuccgcgagggcucccgcgaggagaccgaggccaaggaggagaaguccaagggccagaagaaggccgacuccauggaggccaagggcgucgaggagcccggcggcgacgaguacaccgacgagaaggagaaggagaucgagcgcgaggaggacgagcagcgcgaggaggcccaggucgaggccggccgcgaccucgagcagggcgcccaggaggaccaggucgccgaggagaagugggaggucguccagaagcaggaggccgagggcguccgcgaggacgaggacaagggccagcgcgagaagggcuaccacgaggcccgcaaggaccagggcgacggcgaggacucccgcucccccgaggccgccaccgagggcggcgccggcgaggucuccaaggagcgcgaguccggcgacggcgaggccgagggcgaccagcgcgccggcggcuacuaccucgaggaggacacccucuccgagggcuccggcgucgccucccucgaggucgacugcgccaaggagggcaacccccacuccuccgagauggaggaggucgccccccagcccccccagcccgaggagauggagcccgagggccagcccucccccgacggcugccucugccccugcucccucggccucggcggcgucggcaugcgccucgccuccacccucguccagguccagcagguccgcuccguccccgucgucccccccaagccccaguucgccaagaugcccuccgccaugugcuccaagauccacgucgcccccgccaaccccugcccccgccccggccgccucgacggcacccccggcgagcgcgccuggggcucccgcgccucccgcuccuccuggcgcaacggcggcucccucuccuucgacgccgccgucgcccucgcccgcgaccgccagcgcaccgaggcccagggcguccgccgcacccagaccugcaccgagggcggcgacuacugccucaucccccgcaccucccccugcuccaugaucuccgcccacuccccccgcccccucuccugccucgagcuccccuccgagggcgccgagggcuccggcucccgcucccgccucucccuccccccccgcgagccccagguccccgacccccuccucuccucccagcgccgcuccuacgccuucgagacccaggccaaccccggcaagggcgagggccucuga

SEQ ID NO: 39892 - RNA, 4335 nt, Artificial Sequence
  derived and/or modified sequence opt2 from ARHGAP31__Homo_sapiens__NP_065805
augaagaacaagggcgccaagcagaagcucaagcgcaagggcgccgccuccgccuucggcugcgaccucaccgaguaccucgaguccuccggccaggacguccccuacguccucaaguccugcgccgaguucaucgagacccacggcaucgucgacggcaucuaccgccucuccggcgucaccuccaacauccagcgccuccgccaggaguucggcuccgaccagugccccgaccucacccgcgaggucuaccuccaggacauccacugcgucggcucccucugcaagcucuacuuccgcgagcuccccaacccccuccucaccuacgagcucuacgagaaguucaccgaggccgucucccacugccccgaggagggccagcucgcccgcauccagaacgucauccaggagcucccccccucccacuaccgcacccucgaguaccucauccgccaccucgcccacaucgccuccuucuccuccaagaccaacaugcacgcccgcaaccucgcccucgucugggcccccaaccuccuccgcuccaaggagaucgaggccaccggcugcaacggcgacgccgccuuccucgccguccgcguccagcaggucgucaucgaguucauccucaaccacgucgaccagaucuucaacaacggcgcccccggcucccucgagaacgacgagaaccgccccaucaugaagucccucacccuccccgcccucucccuccccaugaagcucgucucccucgaggaggcccaggcccgcucccucgccaccaaccaccccgcccgcaaggagcgccgcgagaacucccuccccgagaucgucccccccaugggcacccucuuccacaccguccucgagcuccccgacaacaagcgcaagcucuccuccaaguccaagaaguggaaguccaucuucaaccucggccgcuccggcuccgacuccaaguccaagcucucccgcaacggcuccgucuucguccgcggccagcgccucuccgucgagaaggccaccauccgccccgccaaguccauggacucccucugcuccguccccgucgagggcaaggagaccaagggcaacuucaaccgcaccgucaccaccggcggcuucuucauccccgccaccaagaugcacuccaccggcaccggcuccuccugcgaccucaccaagcaggagggcgaguggggccaggagggcaugccccccggcgccgagggcggcuucgacgucuccuccgaccgcucccaccuccagggcgcccaggcccgccccccccccgagcagcucaaggucuuccgccccgucgaggaccccgaguccgagcagaccgcccccaagaugcucggcauguucuacaccuccaacgacucccccuccaaguccgucuucaccuccucccucuuccagauggagcccuccccccgcaaccagcgcaaggcccucaacaucuccgagcccuucgccgucuccgucccccuccgcgucuccgccgucaucuccaccaacuccacccccugccgcaccccccccaaggagcuccagucccucuccucccucgaggaguucuccuuccacggcuccgaguccggcggcuggcccgaggaggagaagccccucggcgccgagaccuccgccgccuccguccccaagaaggccggccucgaggacgccaaggccguccccgaggcccccggcaccgucgagugcuccaagggccucucccaggagcccggcgcccaccucgaggagaagaagacccccgaguccucccucuccucccagcaccucaacgagcucgagaagcgccccaaccccgagaaggucgucgaggagggccgcgaggccggcgagauggaguccuccacccuccaggaguccccccgcgcccgcgccgaggccguccuccuccacgagauggacgaggacgaccucgccaacgcccucaucuggcccgagauccagcaggagcucaagaucaucgaguccgaggaggagcucuccucccuccccccccccgcccucaagaccucccccauccagcccauccucgaguccucccucggccccuucauccccuccgagccccccggcucccuccccugcggcuccuuccccgcccccgucuccaccccccucgaggucuggacccgcgaccccgccaaccaguccacccagggcgccuccaccgccgccucccgcgagaagcccgagcccgagcagggccuccaccccgaccucgccucccucgccccccucgagaucguccccuucgagaaggccuccccccaggccaccgucgaggucggcggccccggcaaccucucccccccccucccccccgccccccccccccccaccccccucgaggaguccacccccguccuccucuccaagggcggccccgagcgcgaggacuccucccgcaagcuccgcaccgaccucuacaucgaccagcucaagucccaggacucccccgagaucuccucccucugccagggcgaggaggccaccccccgccacuccgacaagcagaacuccaagaacgccgccuccgagggcaagggcugcggcuuccccucccccacccgcgaggucgagaucgucucccaggaggaggaggacgucacccacuccguccaggagcccuccgacugcgacgaggacgacaccgucaccgacaucgcccagcacggccucgagauggucgagcccugggaggagccccagugggucaccuccccccuccacucccccacccucaaggacgcccacaaggcccagguccagggccuccagggccaccagcucgagaagcgccucucccaccgccccucccuccgccagucccacucccucgacuccaagcccaccgucaagucccaguggacccucgagguccccuccuccuccuccugcgccaaccucgagaccgagcgcaacuccgacccccuccagccccaggccccccgccgcgagaucaccggcugggacgagaaggcccuccgcuccuuccgcgaguucuccggccucaagggcgccgaggccccccccaaccagaagggccccuccggcguccagcccaaccccgccgagaccucccccaucucccucgccgagggcaaggagcucggcacccaccucggccacuccuccccccagauccgccagggcggcguccccggccccgaguccuccaaggaguccucccccuccguccaggacuccaccucccccggcgagcaccccgccaagcuccagcucaaguccaccgagugcggcccccccaagggcaagaaccgccccuccucccucaaccucgaccccgccauccccaucgccgaccucuucugguucgagaacgucgccuccuucuccucccccggcaugcaggucuccgagcccggcgaccccaaggucaccuggaugaccuccuccuacugcaaggccgaccccuggcgcgucuacucccaggacccccaggaccucgacaucgucgcccacgcccucaccggccgccgcaacuccgcccccgucuccgucuccgccguccgcaccuccuucauggucaagaugugccaggcccgcgccguccccgucaucccccccaagauccaguacacccagaucccccagccccuccccucccaguccuccggcgagaacggcguccagccccucgagcgcucccaggagggccccuccuccaccuccggcaccacccagaagcccgccaaggacgacucccccuccucccucgaguccuccaaggaggagaagcccaagcaggaccccggcgccaucaaguccucccccgucgacgccaccgcccccugcaugugcgagggccccacccucucccccgagcccggcuccuccaaccuccucuccacccaggacgccgucguccagugccgcaagcgcauguccgagaccgagcccuccggcgacaaccuccucuccuccaagcucgagcgccccuccggcggcuccaagcccuuccaccgcucccgccccggccgcccccagucccucauccucuucuccccccccuuccccaucauggaccaccucccccccuccuccaccgucaccgacuccaagguccuccucucccccauccgcucccccacccagaccgucucccccggccuccucugcggcgagcucgccgagaacaccugggucacccccgagggcgucacccuccgcaacaagaugaccauccccaagaacggccagcgccucgagaccuccaccuccugcuucuaccagccccagcgccgcuccgucauccucgacggccgcuccggccgccagaucgaguga

SEQ ID NO: 39893 - RNA, 6264 nt, Artificial Sequence
  derived and/or modified sequence opt2 from ARHGAP32__Homo_sapiens__NP_001136157
auggagaccgaguccgaguccuccacccucggcgacgacuccgucuucuggcucgaguccgaggucaucauccaggucaccgacugcgaggaggaggagcgcgaggagaaguuccgcaagaugaaguccuccguccacuccgaggaggacgacuucguccccgagcuccaccgcaacguccacccccgcgagcgccccgacugggaggagacccucuccgccauggcccgcggcgccgacguccccgagauccccggcgaccucacccucaagaccugcggcuccaccgccuccaugaaggucaagcacgucaagaagcuccccuucaccaagggccacuuccccaagauggccgagugcgcccacuuccacuacgagaacgucgaguucggcuccauccagcucucccucuccgaggagcagaacgaggucaugaagaacggcugcgaguccaaggagcucgucuaccucguccagaucgccugccagggcaaguccuggaucgucaagcgcuccuacgaggacuuccgcguccucgacaagcaccuccaccucugcaucuacgaccgccgcuucucccagcucuccgagcucccccgcuccgacacccucaaggacucccccgaguccgucacccagaugcucauggccuaccucucccgccucuccgccaucgccggcaacaagaucaacugcggccccgcccucaccuggauggagaucgacaacaagggcaaccaccuccucguccacgaggaguccuccaucaacacccccgccgucggcgccgcccacgucaucaagcgcuacaccgcccgcgcccccgacgagcucacccucgaggucggcgacaucgucuccgucaucgacaugccccccaagguccucuccaccugguggcgcggcaagcacggcuuccaggucggccucuuccccggccacugcgucgagcucaucaaccagaaggucccccaguccgucaccaacuccguccccaagcccgucuccaagaagcacggcaagcucaucaccuuccuccgcaccuucaugaagucccgccccaccaagcagaagcucaagcagcgcggcauccucaaggagcgcgucuucggcugcgaccucggcgagcaccuccucaacuccggcuucgaggucccccagguccuccaguccugcaccgccuucaucgagcgcuacggcaucgucgacggcaucuaccgccucuccggcgucgccuccaacauccagcgccuccgccacgaguucgacuccgagcacguccccgaccucaccaaggagcccuacguccaggacauccacuccgucggcucccucugcaagcucuacuuccgcgagcuccccaacccccuccucaccuaccagcucuacgagaaguucuccgacgccgucuccgccgccaccgacgaggagcgccucaucaagauccacgacgucauccagcagcucccccccccccacuaccgcacccucgaguuccucaugcgccaccucucccuccucgccgacuacugcuccaucaccaacaugcacgccaagaaccucgccaucgucugggcccccaaccuccuccgcuccaagcagaucgaguccgccugcuucuccggcaccgccgccuucauggagguccgcauccaguccgucgucgucgaguucauccucaaccacgucgacguccucuucuccggccgcaucuccauggccaugcaggagggcgccgccucccucucccgccccaagucccuccucgucuccucccccuccaccaagcuccucacccucgaggaggcccaggcccgcacccaggcccaggucaacucccccaucgucaccgagaacaaguacaucgaggucggcgagggccccgccgcccuccagggcaaguuccacaccaucaucgaguucccccucgagcgcaagcgcccccagaacaagaugaagaagucccccgucggcuccuggcgcuccuucuucaaccucggcaaguccuccuccgucuccaagcgcaagcuccagcgcaacgaguccgagcccuccgagaugaaggccauggcccucaagggcggccgcgccgagggcacccuccgcuccgccaaguccgaggagucccucaccucccuccacgccgucgacggcgacuccaagcucuuccgcccccgccgcccccgcuccuccuccgacgcccucuccgccuccuucaacggcgagaugcucggcaaccgcugcaacuccuacgacaaccucccccacgacaacgaguccgaggaggagggcggccuccuccacauccccgcccucauguccccccacuccgccgaggacgucgaccucuccccccccgacaucggcgucgccucccucgacuucgaccccauguccuuccagugcuccccccccaaggccgaguccgagugccucgaguccggcgccuccuuccucgacucccccggcuacuccaaggacaagcccuccgccaacaagaaggacgccgagaccggcuccucccagugccagacccccggcuccaccgccuccuccgagcccgucuccccccuccaggagaagcucucccccuucuucacccucgaccucucccccaccgaggacaaguccuccaagcccuccuccuucaccgagaaggucgucuacgccuucucccccaagaucggccgcaagcucuccaagucccccuccauguccaucuccgagcccaucuccgucacccuccccccccgcgucuccgaggucaucggcaccgucuccaacaccaccgcccagaacgccuccuccuccaccugggacaagugcgucgaggagcgcgacgccaccaaccgcucccccacccagaucgucaagaugaagaccaacgagaccgucgcccaggaggccuacgaguccgagguccagccccucgaccaggucgccgccgaggaggucgagcuccccggcaaggaggaccaguccgucuccuccucccaguccaaggccgucgccuccggccagacccagaccggcgccgucacccacgaccccccccaggacuccguccccgucuccuccgucucccucaucccccccccccccccccccaagaacgucgcccgcaugcucgcccucgcccucgccgaguccgcccagcaggccuccacccagucccucaagcgccccggcaccucccaggccggcuacaccaacuacggcgacaucgccgucgccaccaccgaggacaaccucuccuccuccuacuccgccgucgcccucgacaaggccuacuuccagaccgaccgccccgccgagcaguuccaccuccagaacaacgcccccggcaacugcgaccacccccuccccgagaccaccgccaccggcgaccccacccacuccaacaccaccgaguccggcgagcagcaccaccaggucgaccucaccggcaaccagccccaccaggccuaccucuccggcgaccccgagaaggcccgcaucaccuccgucccccucgacuccgagaaguccgacgaccacgucuccuuccccgaggaccaguccggcaagaacuccaugcccaccgucuccuuccucgaccaggaccagucccccccccgcuucuacuccggcgaccagccccccuccuaccucggcgccuccgucgacaagcuccaccacccccucgaguucgccgacaagucccccaccccccccaaccuccccuccgacaagaucuacccccccuccggcucccccgaggagaacaccuccaccgccaccaugaccuacaugaccaccacccccgccaccgcccagauguccaccaaggaggccuccugggacgucgccgagcagcccaccaccgccgacuucgccgccgccacccuccagcgcacccaccgcaccaaccgcccccucccccccccccccucccagcgcuccgccgagcagccccccgucgucggccagguccaggccgccaccaacaucggccucaacaacucccacaagguccagggcgucguccccguccccgagcgcccccccgagccccgcgccauggacgaccccgccuccgccuucaucuccgacuccggcgccgccgccgcccagugccccauggccaccgccguccagcccggccuccccgagaagguccgcgacggcgcccgcgucccccuccuccaccuccgcgccgaguccguccccgcccaccccugcggcuuccccgccccccucccccccacccgcaugauggaguccaagaugaucgccgccauccacuccuccuccgccgacgccaccuccuccuccaacuaccacuccuucgucaccgccuccuccaccuccgucgacgacgcccucccccucccccuccccgucccccagcccaagcacgccucccagaagaccgucuacuccuccuucgcccgccccgacgucaccaccgagcccuucggccccgacaacugccuccacuucaacaugacccccaacugccaguaccgcccccaguccguccccccccaccacaacaagcucgagcagcaccaggucuacggcgcccgcuccgagccccccgccuccaugggccuccgcuacaacaccuacgucgcccccggccgcaacgccuccggccaccacuccaagcccugcucccgcgucgaguacgucuccucccucuccuccuccguccgcaacaccugcuaccccgaggacaucccccccuaccccaccauccgccgcguccagucccuccacgccccccccuccuccaugauccgcuccguccccaucucccgcaccgaggucccccccgacgacgagcccgccuacugcccccgcccccucuaccaguacaagcccuaccaguccucccaggcccgcuccgacuaccacgucacccagcuccagcccuacuucgagaacggccgcguccacuaccgcuacucccccuacuccuccuccuccuccuccuacuacucccccgacggcgcccucugcgacgucgacgccuacggcaccguccagcuccgcccccuccaccgccuccccaaccgcgacuucgccuucuacaacccccgccuccagggcaagucccucuacuccuacgccggccucgccccccgcccccgcgccaacgucaccggcuacuucucccccaacgaccacaacgucgucuccaugccccccgccgccgacgucaagcacaccuacaccuccugggaccucgaggacauggagaaguaccgcaugcaguccauccgccgcgagucccgcgcccgccagaaggucaagggccccgucaugucccaguacgacaacaugacccccgccguccaggacgaccucggcggcaucuacgucauccaccuccgcuccaaguccgaccccggcaagaccggccuccucuccgucgccgagggcaaggagucccgccacgccgccaaggccaucucccccgagggcgaggaccgcuucuaccgccgccaccccgaggccgagauggaccgcgcccaccaccacggcggccacggcuccacccagcccgagaagcccucccucccccagaagcaguccucccuccgcucccgcaagcuccccgacaugggcugcucccuccccgagcaccgcgcccaccaggaggccucccaccgccaguucugcgaguccaagaacggcccccccuacccccagggcgccggccagcucgacuacggcuccaagggcauccccgacaccuccgagcccgucuccuaccacaacuccggcgucaaguacgccgccuccggccaggagucccuccgccucaaccacaaggagguccgccucuccaaggagauggagcgccccuggguccgccagcccuccgcccccgagaagcacucccgcgacugcuacaaggaggaggagcaccucacccaguccaucguccccccccccaagcccgagcgcucccacucccucaagcuccaccacacccagaacgucgagcgcgaccccuccguccucuaccaguaccagccccacggcaagcgccaguccuccgucaccgucgucucccaguacgacaaccucgaggacuaccacucccucccccagcaccagcgcggcgucuucggcggcggcggcaugggcaccuacgucccccccggcuucccccacccccagucccgcaccuacgccaccgcccucggccagggcgccuuccuccccgccgagcucucccuccagcaccccgagacccagauccacgccgaguga

SEQ ID NO: 39894 - RNA, 4500 nt, Artificial Sequence
  derived and/or modified sequence opt2 from ARHGAP35__Homo_sapiens__NP_004482
augaugauggcccgcaagcaggacguccgcauccccaccuacaacaucuccgucgucggccucuccggcaccgagaaggagaagggccagugcggcaucggcaaguccugccucugcaaccgcuucguccgccccuccgccgacgaguuccaccucgaccacaccuccguccucuccaccuccgacuucggcggccgcgucgucaacaacgaccacuuccucuacuggggcgaggucucccgcucccucgaggacugcgucgagugcaagaugcacaucgucgagcagaccgaguucaucgacgaccagaccuuccagccccaccgcuccaccgcccuccagcccuacaucaagcgcgccgccgccaccaagcucgccuccgccgagaagcucauguacuucugcaccgaccagcucggccucgagcaggacuucgagcagaagcagaugcccgacggcaagcuccucgucgacggcuuccuccucggcaucgacgucucccgcggcaugaaccgcaacuucgacgaccagcucaaguucgucuccaaccucuacaaccagcucgccaagaccaagaagcccaucgucgucguccucaccaagugcgacgagggcgucgagcgcuacauccgcgacgcccacaccuucgcccucuccaagaagaaccuccaggucgucgagaccuccgcccgcuccaacgucaacgucgaccucgccuucuccacccucguccagcucaucgacaagucccgcggcaagaccaagaucauccccuacuucgaggcccucaagcagcagucccagcagaucgccaccgccaaggacaaguacgaguggcucgucucccgcaucgucaagaaccacaacgagaacuggcucuccgucucccgcaagaugcaggccucccccgaguaccaggacuacgucuaccucgagggcacccagaaggccaagaagcucuuccuccagcacauccaccgccucaagcacgagcacaucgagcgccgccgcaagcucuaccucgccgcccucccccucgccuucgaggcccucauccccaaccucgacgagaucgaccaccucuccugcaucaaggccaagaagcuccucgagaccaagcccgaguuccucaagugguucgucguccucgaggagacccccugggacgccaccucccacaucgacaacauggagaacgagcgcauccccuucgaccucauggacaccguccccgccgagcagcucuacgaggcccaccucgagaagcuccgcaacgagcgcaagcgcgucgagaugcgccgcgccuucaaggagaaccucgagaccucccccuucaucacccccggcaagcccugggaggaggcccgcuccuucaucaugaacgaggacuucuaccaguggcucgaggaguccgucuacauggacaucuacggcaagcaccagaagcagaucaucgacaaggccaaggaggaguuccaggagcuccuccucgaguacuccgagcucuucuacgagcucgagcucgacgccaagcccuccaaggagaagaugggcgucauccaggacguccucggcgaggagcagcgcuucaaggcccuccagaagcuccaggccgagcgcgacgcccucauccucaagcacauccacuucgucuaccaccccaccaaggagaccugccccuccugccccgccugcgucgacgccaagaucgagcaccucaucuccucccgcuucauccgccccuccgaccgcaaccagaagaacucccucuccgaccccaacaucgaccgcaucaaccucgucauccucggcaaggacggccucgcccgcgagcucgccaacgagauccgcgcccucugcaccaacgacgacaaguacgucaucgacggcaagauguacgagcucucccuccgccccaucgagggcaacguccgccuccccgucaacuccuuccagacccccaccuuccagccccacggcugccucugccucuacaacuccaaggagucccucuccuacgucgucgaguccaucgagaagucccgcgaguccacccucggccgccgcgacaaccaccucguccaccucccccucacccucauccucgucaacaagcgcggcgacaccuccggcgagacccuccacucccucauccagcagggccagcagaucgccuccaagcuccagugcgucuuccucgaccccgccuccgccggcaucggcuacggccgcaacaucaacgagaagcagaucucccagguccucaagggccuccucgacuccaagcgcaaccucaaccucgucuccuccaccgccuccaucaaggaccucgccgacgucgaccuccgcaucgucaugugccucaugugcggcgaccccuucuccgccgacgacauccucuuccccguccuccagucccagaccugcaaguccucccacugcggcuccaacaacuccguccuccucgagcuccccaucggccuccacaagaagcgcaucgagcucuccguccucuccuaccacuccuccuucuccauccgcaagucccgccucguccacggcuacaucgucuucuacuccgccaagcgcaaggccucccucgccaugcuccgcgccuuccucugcgagguccaggacaucauccccauccagcucgucgcccucaccgacggcgccgucgacguccucgacaacgaccucucccgcgagcagcucaccgagggcgaggagaucgcccaggagaucgacggccgcuucaccuccauccccugcucccagccccagcacaagcucgagaucuuccaccccuucuucaaggacgucgucgagaagaagaacaucaucgaggccacccacauguacgacaacgccgccgaggccugcuccaccaccgaggaggucuucaacuccccccgcgccggcuccccccucugcaacuccaaccuccaggacuccgaggaggacaucgagcccuccuacucccucuuccgcgaggacaccucccuccccucccucuccaaggaccacuccaagcucuccauggagcucgagggcaacgacggccucuccuucaucauguccaacuucgaguccaagcucaacaacaagguccccccccccgucaagcccaagccccccguccacuucgagaucaccaagggcgaccucuccuaccucgaccagggccaccgcgacggccagcgcaaguccgucuccuccucccccuggcucccccaggacggcuucgaccccuccgacuacgccgagcccauggacgccgucgucaagccccgcaacgaggaggagaacaucuacuccgucccccacgacuccacccagggcaagaucaucaccauccgcaacaucaacaaggcccaguccaacggcuccggcaacggcuccgacuccgagauggacaccuccucccucgagcgcggccgcaaggucuccaucgucuccaagcccguccucuaccgcacccgcugcacccgccucggccgcuucgccuccuaccgcaccuccuucuccgucggcuccgacgacgagcucggccccauccgcaagaaggaggaggaccaggccucccagggcuacaagggcgacaacgccgucauccccuacgagaccgacgaggacccccgccgccgcaacauccuccgcucccuccgccgcaacaccaagaagcccaagcccaagccccgccccuccaucaccaaggccaccugggaguccaacuacuucggcgucccccucaccaccgucgucacccccgagaagcccauccccaucuucaucgagcgcugcaucgaguacaucgaggccaccggccucuccaccgagggcaucuaccgcgucuccggcaacaaguccgagauggagucccuccagcgccaguucgaccaggaccacaaccucgaccucgccgagaaggacuucaccgucaacaccgucgccggcgccaugaaguccuucuucuccgagcuccccgacccccucguccccuacaacaugcagaucgaccucgucgaggcccacaagaucaacgaccgcgagcagaagcuccacgcccucaaggagguccucaagaaguuccccaaggagaaccacgaggucuucaaguacgucaucucccaccucaacaaggucucccacaacaacaaggucaaccucaugaccuccgagaaccucuccaucugcuucuggcccacccucaugcgccccgacuucuccaccauggacgcccucaccgccacccgcaccuaccagaccaucaucgagcucuucauccagcagugccccuucuucuucuacaaccgccccaucaccgagccccccggcgcccgccccuccucccccuccgccgucgccuccaccguccccuuccucaccuccacccccgucaccucccagcccucccccccccagucccccccccccaccccccagucccccaugcagccccuccuccccucccagcuccaggccgagcacacccucuga

SEQ ID NO: 39895 - RNA, 2625 nt, Artificial Sequence
  derived and/or modified sequence opt2 from ARHGAP42__Homo_sapiens__NP_689645
augggccuccccacccucgaguucuccgacuccuaccucgacucccccgacuuccgcgagcgccuccagugccacgagaucgagcucgagcgcaccaacaaguucaucaaggagcucaucaaggacggcucccuccucaucggcgcccuccgcaaccucuccauggccguccagaaguucucccagucccuccaggacuuccaguucgagugcaucggcgacgccgagaccgacgacgagaucuccaucgcccagucccucaaggaguucgcccgccuccucaucgccgucgaggaggagcgccgccgccucauccagaacgccaacgacguccucaucgccccccucgagaaguuccgcaaggagcagaucggcgccgccaaggacggcaagaagaaguucgacaaggaguccgagaaguacuacuccauccucgagaagcaccucaaccucuccgccaagaagaaggagucccaccuccaggaggccgacacccagaucgaccgcgagcaccagaacuucuacgaggccucccucgaguacgucuucaagauccaggagguccaggagaagaagaaguucgaguucgucgagccccuccucuccuuccuccagggccucuucaccuucuaccacgagggcuacgagcucgcccaggaguucgcccccuacaagcagcagcuccaguucaaccuccagaacacccgcaacaacuucgaguccacccgccaggaggucgagcgccucaugcagcgcaugaaguccgccaaccaggacuaccgcccccccucccaguggaccauggagggcuaccucuacguccaggagaagcgcccccucggcuucaccuggaucaagcacuacugcaccuacgacaagggcuccaagaccuucaccauguccgucuccgagaugaaguccuccggcaagaugaacggccucgucaccuccucccccgagauguucaagcucaaguccugcauccgccgcaagaccgacuccaucgacaagcgcuucugcuucgacaucgaggucgucgagcgccacggcaucaucacccuccaggccuucuccgaggccaaccgcaagcucuggcucgaggccauggacggcaaggagcccaucuacacccuccccgccaucaucuccaagaaggaggagauguaccucaacgaggccggcuucaacuucguccgcaagugcauccaggccgucgagacccgcggcaucaccauccucggccucuaccgcaucggcggcgucaacuccaagguccagaagcucaugaacaccaccuucucccccaaguccccccccgacaucgacaucgacaucgagcucugggacaacaagaccaucaccuccggccucaagaacuaccuccgcugccucgccgagccccucaugaccuacaagcuccacaaggacuucaucaucgccgucaaguccgacgaccagaacuaccgcgucgaggccguccacgcccucguccacaagcuccccgagaagaaccgcgagaugcucgacauccucaucaagcaccucgucaaggucucccuccacucccagcagaaccucaugaccgucuccaaccucggcgucaucuucggccccacccucaugcgcgcccaggaggagaccgucgccgccaugaugaacaucaaguuccagaacaucgucgucgagauccucaucgagcacuacgagaagaucuuccacaccgcccccgaccccuccaucccccucccccagccccagucccgcuccggcucccgccgcacccgcgccaucugccucuccaccggcucccgcaagccccgcggccgcuacacccccugccucgccgagcccgacuccgacuccuacuccuccucccccgacuccacccccaugggcuccaucgagucccucuccucccacuccuccgagcagaacuccaccaccaaguccgccuccugccagccccgcgagaaguccggcggcauccccuggaucgccacccccuccuccuccaacggccagaagucccucggccucuggaccaccucccccgaguccuccucccgcgaggacgccaccaagaccgacgccgaguccgacugccaguccgucgccuccgucaccucccccggcgacgucuccccccccaucgaccucgucaagaaggagcccuacggccucuccggccucaagcgcgccuccgccuccucccuccgcuccaucuccgccgccgagggcaacaaguccuacuccggcuccauccagucccucaccuccgucggcuccaaggagacccccaaggccucccccaaccccgaccucccccccaagaugugccgccgccuccgccucgacaccgccuccuccaacggcuaccagcgccccggcuccgucgucgccgccaaggcccagcucuucgagaacgucggcucccccaagcccgucuccuccggccgccaggccaaggccauguacuccugcaaggccgagcacucccacgagcucuccuucccccagggcgccaucuucuccaacgucuaccccuccgucgagcccggcuggcucaaggccaccuacgagggcaagaccggccucguccccgagaacuacgucgucuuccucuga

SEQ ID NO: 39896 - RNA, 2961 nt, Artificial Sequence
  derived and/or modified sequence opt2 from ARHGAP4__Homo_sapiens__NP_001158213
auggccgcccacggcaagcuccgccgcgagcgcggccuccaggccgaguacgagacccaggucaaggagaugcgcuggcagcucuccgagcagcuccgcugccucgagcuccagggcgagcuccgccgcgagcuccuccaggagcucgccgaguucaugcgccgccgcgccgaggucgagcucgaguacucccgcggccucgagaagcucgccgagcgcuucuccucccgcggcggccgccucggcuccucccgcgagcaccaguccuuccgcaaggagcccucccuccucuccccccuccacugcugggccguccuccuccagcacacccgccagcagucccgcgaguccgccgcccucuccgagguccucgccggcccccucgcccagcgccucucccacaucgccgaggacgucggccgccucgucaagaagucccgcgaccucgagcagcagcuccaggacgagcuccucgaggucgucuccgagcuccagaccgccaagaagaccuaccaggccuaccacauggaguccgucaacgccgaggccaagcuccgcgaggccgagcgccaggaggagaagcgcgccggccgcuccguccccaccaccaccgccggcgccaccgaggccggcccccuccgcaaguccucccucaagaagggcggccgccucgucgagaagcucuggcccccccagcgccccgucgccgccuccuccugcgcccccgucugcuggcuccaggccggcuuccucguccacccccccugguggggcgccaugugcgcccccuccacccaccagcgccaggccaaguucauggagcacaagcucaagugcaccaaggcccgcaacgaguaccuccucucccucgccuccgucaacgccgccgucuccaacuacuaccuccacgacguccucgaccucauggacugcugcgacaccggcuuccaccucgcccucggccagguccuccgcuccuacaccgccgccgagucccgcacccaggccucccagguccagggccucggcucccucgaggaggccgucgaggcccucgacccccccggcgacaaggccaagguccucgagguccacgccaccgucuucugccccccccuccgcuucgacuaccacccccacgacggcgacgaggucgccgagaucugcgucgagauggagcuccgcgacgagauccucccccgcgcccagaacauccagucccgccucgaccgccagaccaucgagaccgaggaggucaacaagacccucaaggccacccuccaggcccuccucgaggucgucgccuccgacgacggcgacguccucgacuccuuccagaccucccccuccaccgagucccucaaguccaccuccuccgaccccggcucccgccaggccggccgccgccgcggccagcagcaggagaccgagaccuucuaccucaccaagcuccaggaguaccucuccggccgcuccauccucgccaagcuccaggccaagcacgagaagcuccaggaggcccuccagcgcggcgacaaggaggagcaggaggucuccuggacccaguacacccagcgcaaguuccagaagucccgccagccccgccccuccucccaguacaaccagcgccucuucggcggcgacauggagaaguucauccaguccuccggccagcccgucccccucgucgucgaguccugcauccgcuucaucaaccucaacggccuccagcacgagggcaucuuccgcgucuccggcgcccagcuccgcgucuccgagauccgcgacgccuucgagcgcggcgaggacccccucgucgagggcugcaccgcccacgaccucgacuccgucgccggcguccucaagcucuacuuccgcucccucgagcccccccucuucccccccgaccucuucggcgagcuccucgccuccuccgagcucgaggccaccgccgagcgcgucgagcacgucucccgccuccucuggcgccuccccgcccccguccucgucguccuccgcuaccucuucaccuuccucaaccaccucgcccaguacuccgacgagaacaugauggaccccuacaaccucgccgucugcuucggccccacccuccuccccguccccgccggccaggaccccgucgcccuccagggccgcgucaaccagcucguccagacccucaucguccagcccgaccgcgucuuccccccccucaccucccuccccggccccgucuacgagaagugcauggccccccccuccgccuccugccucggcgacgcccagcucgagucccucggcgccgacaacgagcccgagcucgaggccgagaugcccgcccaggaggacgaccucgagggcgucgucgaggccgucgccugcuucgccuacaccggccgcaccgcccaggagcucuccuuccgccgcggcgacguccuccgccuccacgagcgcgccuccuccgacugguggcgcggcgagcacaacggcaugcgcggccucaucccccacaaguacaucacccuccccgccggcaccgagaagcaggucgucggcgccggccuccagaccgccggcgaguccggcuccucccccgagggccuccucgccuccgagcucguccaccgccccgagcccugcaccucccccgaggccaugggccccuccggccaccgccgccgcugccucguccccgccucccccgagcagcacgucgaggucgacaaggccgucgcccagaacauggacuccgucuucaaggagcuccucggcaagaccuccguccgccagggccucggccccgccuccaccaccucccccucccccggcccccgcucccccaaggccccccccuccucccgccucggccgcaacaagggcuucucccgcggccccggcgcccccgccucccccuccgccucccacccccagggccucgacaccacccccaagccccacuga

SEQ ID NO: 39897 - RNA, 4506 nt, Artificial Sequence
  derived and/or modified sequence opt2 from ARHGAP5__Homo_sapiens__NP_001164
augauggccaagaacaaggagccccgcccccccuccuacaccaucuccaucgucggccucuccggcaccgagaaggacaagggcaacugcggcgucggcaaguccugccucugcaaccgcuucguccgcuccaaggccgacgaguacuaccccgagcacaccuccguccucuccaccaucgacuucggcggccgcgucgucaacaacgaccacuuccucuacuggggcgacaucauccagaacuccgaggacggcgucgagugcaagauccacgucaucgagcagaccgaguucaucgacgaccagaccuuccucccccaccgcuccaccaaccuccagcccuacaucaagcgcgccgccgccuccaagcuccaguccgccgagaagcucauguacaucugcaccgaccagcucggccucgagcaggacuucgagcagaagcagaugcccgagggcaagcucaacgucgacggcuuccuccucugcaucgacgucucccagggcugcaaccgcaaguucgacgaccagcucaaguucgucaacaaccucuucguccagcucuccaaguccaagaagcccgucaucaucgccgccaccaagugcgacgagugcgucgaccacuaccuccgcgagguccaggccuucgccuccaacaagaagaaccuccucgucgucgagaccuccgcccgcuucaacgucaacaucgagaccugcuucaccgcccucguccagaugcucgacaagacccgcuccaagcccaagaucauccccuaccucgacgccuacaagacccagcgccagcucgucgucaccgccaccgacaaguucgagaagcucguccagaccguccgcgacuaccacgccaccuggaagaccgucuccaacaagcucaagaaccaccccgacuacgaggaguacaucaaccucgagggcacccgcaaggcccgcaacaccuucuccaagcacaucgagcagcucaagcaggagcacauccgcaagcgccgcgaggaguacaucaacacccucccccgcgccuucaacacccuccuccccaaccucgaggagaucgagcaccucaacugguccgaggcccucaagcucauggagaagcgcgccgacuuccagcucugcuucgucguccucgagaagacccccugggacgagaccgaccacaucgacaagaucaacgaccgccgcauccccuucgaccuccucuccacccucgaggccgagaaggucuaccagaaccacguccagcaccucaucuccgagaagcgccgcgucgagaugaaggagaaguucaagaagacccucgagaagauccaguucaucucccccggccagcccugggaggaggucaugugcuucgucauggaggacgaggccuacaaguacaucaccgaggccgacuccaaggaggucuacggccgccaccagcgcgagaucgucgagaaggccaaggaggaguuccaggagaugcucuucgagcacuccgagcucuucuacgaccucgaccucaacgccacccccuccuccgacaagauguccgagauccacaccguccucuccgaggagccccgcuacaaggcccuccagaagcucgcccccgaccgcgagucccuccuccucaagcacaucggcuucgucuaccaccccaccaaggagaccugccucuccggccagaacugcaccgacaucaaggucgagcagcuccucgccuccucccuccuccagcucgaccacggccgccuccgccucuaccacgacuccaccaacaucgacaaggucaaccucuucauccucggcaaggacggccucgcccaggagcucgccaacgagauccgcacccaguccaccgacgacgaguacgcccucgacggcaagaucuacgagcucgaccuccgccccgucgacgccaagucccccuacuuccucucccagcucuggaccgccgccuucaagccccacggcugcuucugcgucuucaacuccaucgagucccucuccuucaucggcgaguucaucggcaagauccgcaccgaggccucccagauccgcaaggacaaguacauggccaaccuccccuucacccucauccucgccaaccagcgcgacuccaucuccaagaaccuccccauccuccgccaccagggccagcagcucgccaacaagcuccagugccccuucgucgacguccccgccggcaccuacccccgcaaguucaacgagacccagaucaagcaggcccuccgcggcguccucgaguccgucaagcacaaccucgacgucgucucccccauccccgccaacaaggaccucuccgaggccgaccuccgcaucgucaugugcgccaugugcggcgaccccuucuccgucgaccucauccucucccccuuccucgacucccacuccugcuccgccgcccaggccggccagaacaacucccucaugcucgacaagaucaucggcgagaagcgccgccgcauccagaucaccauccucuccuaccacuccuccaucggcguccgcaaggacgagcucguccacggcuacauccucgucuacuccgccaagcgcaaggccuccaugggcaugcuccgcgccuuccucuccgagguccaggacaccauccccguccagcucgucgccgucaccgacucccaggccgacuucuucgagaacgaggccaucaaggagcucaugaccgagggcgagcacaucgccaccgagaucaccgccaaguucaccgcccucuacucccucucccaguaccaccgccagaccgaggucuucacccucuucuucuccgacguccucgagaagaagaacaugaucgagaacuccuaccucuccgacaacacccgcgaguccacccaccaguccgaggacgucuuccuccccuccccccgcgacugcuuccccuacaacaacuaccccgacuccgacgacgacaccgaggcccccccccccuacucccccaucggcgacgacguccagcuccuccccacccccuccgaccgcucccgcuaccgccucgaccucgagggcaacgaguaccccauccacuccacccccaacugccacgaccacgagcgcaaccacaagguccccccccccaucaagcccaagcccgucguccccaagaccaacgucaagaagcucgaccccaaccuccucaagaccaucgaggccggcaucggcaagaacccccgcaagcagaccucccgcgucccccucgcccaccccgaggacauggaccccuccgacaacuacgccgagcccaucgacaccaucuucaagcagaagggcuacuccgacgagaucuacgucguccccgacgacucccagaaccgcaucaagauccgcaacuccuucgucaacaacacccagggcgacgaggagaacggcuucuccgaccgcaccuccaagucccacggcgagcgccgccccuccaaguacaaguacaaguccaagacccucuucuccaaggccaaguccuacuaccgccgcacccacuccgacgccuccgacgacgaggccuucaccaccuccaagaccaagcgcaagggccgccaccgcggcuccgaggaggacccccuccucucccccgucgagaccuggaagggcggcaucgacaaccccgccaucaccuccgaccaggagcucgacgacaagaagaugaagaagaagacccacaaggucaaggaggacaagaagaagaagaagaccaagaacuucaacccccccacccgccgcaacugggaguccaacuacuucggcaugccccuccaggaccucgucaccgccgagaagcccaucccccucuucgucgagaagugcgucgaguucaucgaggacaccggccucugcaccgagggccucuaccgcgucuccggcaacaagaccgaccaggacaacauccagaagcaguucgaccaggaccacaacaucaaccucgucuccauggaggucaccgucaacgccgucgccggcgcccucaaggccuucuucgccgaccuccccgacccccucauccccuacucccuccaccccgagcuccucgaggccgccaagauccccgacaagaccgagcgccuccacgcccucaaggagaucgucaagaaguuccaccccgucaacuacgacgucuuccgcuacgucaucacccaccucaaccgcgucucccagcagcacaagaucaaccucaugaccgccgacaaccucuccaucugcuucuggcccacccucaugcgccccgacuucgagaaccgcgaguuccucuccaccaccaagauccaccaguccgucgucgagaccuucauccagcagugccaguucuucuucuacaacggcgagaucgucgagaccaccaacaucgucgccccccccccccccuccaaccccggccagcucgucgagcccauggucccccuccagcucccccccccccuccagccccagcucauccagccccagcuccagaccgacccccucggcaucaucuga

SEQ ID NO: 39898 - RNA, 2385 nt, Artificial Sequence
  derived and/or modified sequence opt2 from ARHGAP6__Homo_sapiens__NP_001274171
augggccaccccgucuaccgcggcgagaagccccagcuccacuacgccggcgacuucaccuggaacuccauguccggccgcuccguccgccuccgcuccguccccauccagucccucuccgagcucgagcgcgcccgccuccaggaggucgccuucuaccagcuccagcaggacugcgaccucuccugccagaucaccauccccaaggacggccagaagcgcaagaagucccuccgcaagaagcucgacucccucggcaaggagaagaacaaggacaaggaguucaucccccaggccuucggcaugccccucucccaggucaucgccaacgaccgcgccuacaagcucaagcaggaccuccagcgcgacgagcagaaggacgccuccgacuucgucgccucccuccuccccuucggcaacaagcgccagaacaaggagcucuccuccuccaacuccucccucuccuccaccuccgagacccccaacgaguccaccucccccaacacccccgagcccgccccccgcgcccgccgccgcggcgccauguccgucgacuccaucaccgaccucgacgacaaccagucccgccuccucgaggcccuccagcucucccuccccgccgaggcccaguccaagaaggagaaggcccgcgacaagaagcucucccucaaccccaucuaccgccaggucccccgccucgucgacuccugcugccagcaccucgagaagcacggccuccagaccgucggcaucuuccgcgucggcuccuccaagaagcgcguccgccagcuccgcgaggaguucgaccgcggcaucgacgucucccucgaggaggagcacuccguccacgacgucgccgcccuccucaaggaguuccuccgcgacaugcccgacccccuccucacccgcgagcucuacaccgccuucaucaacacccuccuccucgagcccgaggagcagcucggcacccuccagcuccucaucuaccuccucccccccugcaacugcgacacccuccaccgccuccuccaguuccucuccaucgucgcccgccacgccgacgacaacaucuccaaggacggccaggaggucaccggcaacaagaugaccucccucaaccucgccaccaucuucggccccaaccuccuccacaagcagaaguccuccgacaaggaguucuccguccaguccuccgcccgcgccgaggaguccaccgccaucaucgccgucguccagaagaugaucgagaacuacgaggcccucuucauggucccccccgaccuccagaacgagguccucaucucccuccucgagaccgaccccgacgucgucgacuaccuccuccgccgcaaggccucccaguccuccucccccgacaugcuccaguccgaggucuccuucuccgucggcggccgccacuccuccaccgacuccaacaaggccuccuccggcgacaucucccccuacgacaacaacucccccguccucuccgagcgcucccuccucgccaugcaggaggacgccgcccccggcggcuccgagaagcucuaccgcguccccggccaguucaugcucgucggccaccucuccuccuccaagucccgcgaguccucccccggcccccgccucggcaaggaccucuccgaggagcccuucgacaucuggggcaccuggcacuccacccucaaguccggcuccaaggaccccggcaugaccggcuccuccggcgacaucuucgaguccuccucccuccgcgccggccccugcucccucucccagggcaaccucucccccaacuggccccgcuggcagggcucccccgccgagcucgacuccgacacccagggcgcccgccgcacccaggccgccgcccccgccaccgagggccgcgcccaccccgccgucucccgcgccugcuccaccccccacguccaggucgccggcaaggccgagcgccccaccgcccgcuccgagcaguaccucacccucuccggcgcccacgaccucuccgaguccgagcucgacgucgccggccuccagucccgcgccaccccccagugccagcgcccccacggcuccggccgcgacgacaagcgcccccccccccccuaccccggccccggcaagcccgccgccgccgccgccuggauccagggcccccccgagggcgucgagacccccaccgaccagggcggccaggccgccgagcgcgagcagcaggucacccagaagaagcucuccuccgccaacucccuccccgccggcgagcaggacuccccccgccucggcgacgccggcuggcucgacuggcagcgcgagcgcuggcagaucugggagcuccucuccaccgacaaccccgacgcccuccccgagacccucgucuga

SEQ ID NO: 39899 - RNA, 1644 nt, Artificial Sequence
  derived and/or modified sequence opt2 from ARHGAP9__Homo_sapiens__NP_001073625
auguccgagccccccgucuacugcaaccucgucgaccuccgccgcugcccccgcucccccccccccggccccgccugcccccuccuccagcgccucgacgccugggagcagcaccucgaccccaacuccggccgcugcuucuacaucaacucccucaccggcugcaaguccuggaagcccccccgccgcucccgcuccgagaccaaccccggcuccauggagggcacccagacccucaagcgcaacaacgacguccuccagccccaggccaagggcuuccgcuccgacaccggcacccccgagccccucgacccccagggcucccucucccucucccagcgcaccucccagcucgacccccccgcccuccaggccccccgcccccucccccagcuccucgacgacccccacgaggucgagaaguccggccuccucaacaugaccaagaucgcccagggcggccgcaagcuccgcaagaacuggggccccuccugggucguccucaccggcaacucccucgucuucuaccgcgagcccccccccaccgcccccuccuccggcuggggccccgccggcucccgccccgaguccuccgucgaccuccgcggcgccgcccucgcccacggccgccaccucuccucccgccgcaacguccuccacauccgcaccauccccggccacgaguuccuccuccaguccgaccacgagaccgagcuccgcgccuggcaccgcgcccuccgcaccgucaucgagcgccucgaccgcgagaacccccucgagcuccgccucuccggcuccggccccgccgagcucuccgccggcgaggacgaggaggaggaguccgagcucgucuccaagccccuccuccgccucuccucccgccgcuccuccauccgcggccccgagggcaccgagcagaaccgcguccgcaacaagcucaagcgccucaucgccaagcgccccccccuccagucccuccaggagcgcggccuccuccgcgaccaggucuucggcugccagcucgagucccucugccagcgcgagggcgacaccguccccuccuuccuccgccucugcaucgccgccgucgacaagcgcggccucgacgucgacggcaucuaccgcgucuccggcaaccucgccgucguccagaagcuccgcuuccucgucgaccgcgagcgcgccgucaccuccgacggccgcuacgucuuccccgagcagcccggccaggagggccgccucgaccucgacuccaccgagugggacgacauccacgucgucaccggcgcccucaagcucuuccuccgcgagcucccccagccccucguccccccccuccuccucccccacuuccgcgccgcccucgcccucuccgaguccgagcagugccucucccagauccaggagcucaucggcuccaugcccaagcccaaccacgacacccuccgcuaccuccucgagcaccucugccgcgucaucgcccacuccgacaagaaccgcaugaccccccacaaccucggcaucgucuucggccccacccucuuccgccccgagcaggagaccuccgaccccgccgcccacgcccucuaccccggccagcucguccagcucaugcucaccaacuucaccucccucuuccccuga

SEQ ID NO: 39900 - RNA, 1014 nt, Artificial Sequence
  derived and/or modified sequence opt2 from ARHGDIA__Homo_sapiens__NP_001288171
auggccgagcaggagcccaccgccgagcagcucgcccagaucgccgccgagaacgaggaggacgagcacuccgucaacuacaagccccccgcccagaaguccauccaggagauccaggagcucgacaaggacgacgagucccuccgcaaguacaaggaggcccuccucggccgcgucgccgucuccgccgaccccaacguccccaacgucgucgucaccggccucacccucgucugcuccuccgcccccggcccccucgagcucgaccucaccggcgaccucgaguccuucaagaagcaguccuucguccucaaggagggcgucgaguaccgcaucaagaucuccuuccgcgucaaccgcgagaucgucuccggcaugaaguacauccagcacaccuaccgcaagggcgucaagaucgacaagaccgacuacaugaccaccacccgccccaccaccugccccggcuccggcaucucccccucccgccgcaccggccgcaccgagcccucccagcgccgcgccggccagaccgacggccgcaccaccgaccgccgcaugugccccccccagccccuccccucccccuaccaguccgccgaccgccccuccgucccccucccccccugguccgccucccucgccuggcucaaccgcgucccccccaccccccuccucuccccccccccccccaccggccccgccuccuccgucuccugccucgucgccgccuccgccugcgccgucggcgagcgcggccgcucccaggccuccgccgcccucuccguccccccccgcuucuaccuccccgucacccccgaggccuggcuccaggagggcgccgagcagcccuucucccgcccccgcggcugccccuggaccugcgccuccgccgcccccggcugguccuggggcgucggcugcaccgccuccuggggccccggccgcccccccgccccccuccuccccggccagccccccugccgcugccgcucccgccucaccaugaugcccuga

SEQ ID NO: 39901 - RNA, 606 nt, Artificial Sequence
  derived and/or modified sequence opt2 from ARHGDIB__Homo_sapiens__XP_011518968
augaccgagaaggcccccgagccccacgucgaggaggacgacgacgacgagcucgacuccaagcucaacuacaagccccccccccagaagucccucaaggagcuccaggagauggacaaggacgacgagucccucaucaaguacaagaagacccuccucggcgacggccccgucgucaccgaccccaaggcccccaacgucgucgucacccgccucacccucgucugcgaguccgcccccggccccaucaccauggaccucaccggcgaccucgaggcccucaagaaggagaccaucguccucaaggagggcuccgaguaccgcgucaagauccacuucaaggucaaccgcgacaucgucuccggccucaaguacguccagcacaccuaccgcaccggcgucaaggucgacaaggccaccuucauggucggcuccuacggcccccgccccgaggaguacgaguuccucacccccgucgaggaggcccccaagggcaugcucgcccgcggcaccuaccacaacaaguccuucuucaccgacgacgacaagcaggaccaccucuccugggaguggaaccucuccaucaagaaggaguggaccgaguga

SEQ ID NO: 39902 - RNA, 4035 nt, Artificial Sequence
  derived and/or modified sequence opt2 from ARHGEF10__Homo_sapiens__NP_055444
auggaccagcgcgagccccucccccccgcccccgccgagaacgagaugaaguacgacaccaacaacaacgaggaggaggagggcgagcaguucgacuucgacuccggcgacgagauccccgaggccgaccgccaggcccccuccgcccccgagaccggcggcgccggcgccuccgaggcccccgcccccaccggcggcgaggacggcgccggcgccgagaccacccccgucgccgagcccaccaagcucguccuccccaugaaggucaaccccuacuccgucaucgacaucacccccuuccaggaggaccagccccccacccccguccccuccgccgaggaggagaacgucggccuccacguccccugcggcuaccucguccccguccccugcggcuacgccguccccuccaaccucccccuccuccuccccgccuacuccucccccgucaucaucugcgccaccucccucgacgaggaggagacccccgaggucaccgaggaccgccagcccaacucccucuccuccgaggagccccccaccuccgaggaccaggucggccgcgaggacuccgcccucgcccgcugggccgccgaccccgccaacaccgccuggauggagaaccccgaggaggccaucuacgacgacgucccccgcgagaacuccgacuccgagcccgacgagaugaucuacgacgacgucgagaacggcgacgagggcggcaacuccucccucgaguacggcugguccuccuccgaguucgaguccuacgaggagcaguccgacuccgagugcaagaacggcaucccccgcuccuuccuccgcuccaaccacaagaagcagcucucccacgaccucacccgccucaaggagcacuacgagaagaagaugcgcgaccucauggccuccaccgucggcgucgucgagauccagcagcuccgccagaagcacgagcucaagaugcagaagcucgucaaggccgccaaggacggcaccaaggacggccucgagcgcacccgcgccgccgucaagcgcggccgcuccuucauccgcaccaagucccucaucgcccaggaccaccgcuccucccucgaggaggagcagaaccucuucaucgacgucgacugcaagcaccccgaggccauccucacccccaugcccgagggccucucccagcagcaggucguccgccgcuacauccucggcuccgucgucgacuccgagaagaacuacgucgacgcccucaagcgcauccucgagcaguacgagaagccccucuccgagauggagcccaagguccucuccgagcgcaagcucaagaccgucuucuaccgcgucaaggagauccuccagugccacucccucuuccagaucgcccucgccucccgcgucuccgagugggacuccgucgagaugaucggcgacgucuucgucgccuccuucuccaaguccaugguccucgacgccuacuccgaguacgucaacaacuucuccaccgccgucgccguccucaagaagaccugcgccaccaagcccgccuuccucgaguuccucaagcaggagcaggaggccucccccgaccgcaccacccucuacucccucaugaugaagcccauccagcgcuucccccaguucauccuccuccuccaggacaugcucaagaacaccuccaagggccaccccgaccgccucccccuccagauggcccucaccgagcucgagacccucgccgagaagcucaacgagcgcaagcgcgacgccgaccagcgcugcgaggucaagcagaucgccaaggccaucaacgagcgcuaccucaacaagcuccucuccuccggcucccgcuaccucauccgcuccgacgacaugaucgagaccgucuacaacgaccgcggcgagaucgucaagaccaaggagcgccgcgucuucaugcucaacgacguccucaugugcgccaccgucuccucccgccccucccacgacucccgcgucauguccucccagcgcuaccuccucaagugguccgucccccucggccacgucgacgccaucgaguacggcuccuccgccggcaccggcgagcacucccgccaccucgccguccacccccccgagucccucgccgucgucgccaacgccaagcccaacaaggucuacaugggccccggccagcucuaccaggaccuccagaaccuccuccacgaccucaacgucaucggccagaucacccagcucaucggcaaccucaagggcaacuaccagaaccucaaccaguccgucgcccacgacuggaccuccggccuccagcgccucauccucaagaaggaggacgagauccgcgccgccgacugcugccgcauccagcuccagcuccccggcaagcaggacaaguccggccgccccaccuucuucaccgccgucuucaacaccuucacccccgccaucaaggaguccugggucaacucccuccagauggccaagcucgcccucgaggaggagaaccacaugggcugguucugcgucgaggacgacggcaaccacaucaagaaggagaagcacccccuccucgucggccacaugcccgucauggucgccaagcagcaggaguucaagaucgagugcgccgccuacaaccccgagcccuaccucaacaacgagucccagcccgacuccuucuccaccgcccacggcuuccucuggaucggcuccugcacccaccagaugggccagaucgccaucgucuccuuccagaacuccacccccaaggucaucgagugcuucaacgucgagucccgcauccucugcaugcucuacguccccgucgaggagaagcgccgcgagcccggcgccccccccgaccccgagacccccgccguccgcgccuccgacguccccaccaucugcgucggcaccgaggagggcuccaucuccaucuacaaguccucccagggcuccaagaagguccgccuccagcacuucuucacccccgagaaguccaccgucaugucccucgccugcaccucccagucccucuacgccggccucgucaacggcgccgucgccuccuacgcccgcgcccccgacggcuccugggacuccgagccccagaaggucaucaagcucggcguccuccccguccgcucccuccucaugauggaggacacccucugggccgccuccggcggccaggucuucaucaucuccgucgagacccacgccgucgagggccagcucgaggcccaccaggaggagggcauggucaucucccacauggccgucuccggcgucggcaucuggaucgccuucaccuccggcuccacccuccgccucuuccacaccgagacccucaagcaccuccaggacaucaacaucgccacccccguccacaacaugcuccccggccaccagcgccucuccgucaccucccuccucgucugccacggccuccucauggucggcaccucccucggcguccucgucgcccuccccgucccccgccuccagggcauccccaaggucaccggccgcggcauggucuccuaccacgcccacaacucccccgucaaguucaucguccucgccaccgcccuccacgagaaggacaaggacaagucccgcgacucccucgcccccggccccgagccccaggacgaggaccagaaggacgcccuccccuccggcggcgccggcuccucccucucccagggcgaccccgacgccgccaucuggcucggcgacucccucggcuccaugacccagaaguccgaccucuccuccuccuccggcucccucucccucucccacggcuccuccucccucgagcaccgcuccgaggacuccaccaucuacgaccuccucaaggaccccgucucccuccgcuccaaggcccgccgcgccaagaaggccaaggccuccuccgcccucgucgucugcggcggccagggccaccgccgcguccaccgcaaggcccgccagccccaccaggaggagcucgcccccaccgucauggucuggcagaucccccuccucaacaucuga

SEQ ID NO: 39903 - RNA, 3726 nt, Artificial Sequence
  derived and/or modified sequence opt2 from ARHGEF10L__Homo_sapiens__XP_011539993
auggccuccuccaacccccccccccagcccgccaucggcgaccagcucguccccggcguccccggccccuccuccgaggccgaggacgaccccggcgaggccuucgaguucgacgacuccgacgacgaggaggacaccuccgccgcccucggcguccccucccucgcccccgagcgcgacaccgaccccccccucauccaccucgacuccauccccgucaccgaccccgaccccgccgccgccccccccggcaccggcguccccgccugggucuccaacggcgacgccgccgacgccgccuucuccggcgcccgccacuccuccuggaagcgcaaguccucccgccgcaucgaccgcuucaccuuccccgcccucgaggaggacgucaucuacgacgacguccccugcgagucccccgacgcccaccagcccgccggcgccgagcgcaaccuccucuacgaggacgcccaccgcgccggcgccccccgccaggccgaggaccucggcugguccuccuccgaguucgaguccuacuccgaggacuccggcgaggaggccaagcccgaggucgaggucgagcccgccaagcaccgcgucuccuuccagcccaagaugacccagcucaugaaggccgccaaguccggcaccaaggacggccucgagaagacccgcauggccgucaugcgcaaggucuccuuccuccaccgcaaggacguccucggcgacuccgaggaggaggacaugggccuccucgaggucuccgucuccgacaucaagccccccgcccccgagcucggccccaugcccgagggccucuccccccagcaggucguccgccgccacauccucggcuccaucguccaguccgagggcuccuacgucgagucccucaagcgcauccuccaggacuaccgcaacccccucauggagauggagcccaaggcccucuccgcccgcaagugccaggucgucuucuuccgcgucaaggagauccuccacugccacuccauguuccagaucgcccucuccucccgcgucgccgagugggacuccaccgagaagaucggcgaccucuucgucgccuccuucuccaaguccaugguccucgacgucuacuccgacuacgucaacaacuucaccuccgccauguccaucaucaagaaggccugccucaccaagcccgccuuccucgaguuccucaagcgccgccaggucugcucccccgaccgcgucacccucuacggccucauggucaagcccauccagcgcuucccccaguucauccuccuccuccaggacaugcucaagaacaccccccgcggccaccccgaccgccucucccuccagcucgcccucaccgagcucgagacccucgccgagaagcucaacgagcagaagcgccucgccgaccaggucgccgagauccagcagcucaccaaguccgucuccgaccgcuccucccucaacaagcuccucaccuccggccagcgccagcuccuccucugcgagacccucaccgagaccgucuacggcgaccgcggccagcucaucaaguccaaggagcgccgcgucuuccuccucaacgacaugcucgucugcgccaacaucaacuucaagcccgccaaccaccgcggccagcucgagaucuccucccucgucccccucggccccaaguacgucgucaaguggaacaccgcccucccccagguccaggucgucgaggucggccaggacggcggcaccuacgacaaggacaacguccucauccagcacuccggcgccaagaaggccuccgccuccggccaggcccagaacaaggucuaccucggccccccccgccucuuccaggagcuccaggaccuccagaaggaccucgccgucgucgagcagaucacccuccucaucuccacccuccacggcaccuaccagaaccucaacaugaccgucgcccaggacuggugccucgcccuccagcgccucaugcgcgucaaggaggaggagauccacuccgccaacaagugccgccuccgccuccuccuccccggcaagcccgacaaguccggccgccccaucuccuucauggucgucuucaucacccccaacccccucuccaagaucuccugggucaaccgccuccaccucgccaagaucggccuccgcgaggagaaccagcccggcuggcucugccccgacgaggacaagaaguccaaggcccccuucuggugccccauccucgccugcugcauccccgccuucuccucccgcgcccucucccuccagcucggcgcccucguccacucccccgucaacugcccccuccucggcuucuccgccgucuccaccucccucccccagggcuaccucugggucggcggcggccaggagggcgccggcggccaggucgagaucuucucccucaaccgccccuccccccgcaccgucaaguccuucccccucgccgcccccguccucugcauggaguacauccccgagcucgaggaggaggccgagucccgcgacgagucccccaccgucgccgaccccuccgccaccguccaccccaccaucugccucggccuccaggacggcuccauccuccucuacuccuccgucgacaccggcacccagugccucgucuccugccgcucccccggccuccagcccguccucugccuccgccacucccccuuccaccuccucgccggccuccaggacggcacccucgccgccuacccccgcaccuccggcggcguccucugggaccucgaguccccccccgucugccucaccgucggccccggccccguccgcacccuccucucccucgaggacgccgucugggccuccugcggcccccgcgucaccguccucgaggccaccacccuccagccccagcaguccuucgaggcccaccaggacgaggccgucuccgucacccacauggucaaggccggcuccggcgucuggauggccuucuccuccggcaccuccauccgccucuuccacaccgagacccucgagcaccuccaggagaucaacaucgccacccgcaccaccuuccuccuccccggccagaagcaccucugcgucaccucccuccucaucugccagggccuccucugggucggcaccgaccagggcgucaucguccuccuccccgucccccgccucgagggcauccccaagaucaccggcaagggcauggucucccucaacggccacugcggccccgucgccuuccucgccgucgccaccuccauccucgcccccgacauccuccgcuccgaccaggaggaggccgagggcccccgcgccgaggaggacaagcccgacggccaggcccacgagcccaugcccgacucccacgucggccgcgagcucacccgcaagaagggcauccuccuccaguaccgccuccgcuccaccgcccaccuccccggcccccuccucuccaugcgcgagcccgcccccgccgacggcgccgcccucgagcacuccgaggaggacggcuccaucuacgagauggccgacgaccccgacaucuggguccgcucccgccccugcgcccgcgacgcccaccgcaaggagaucugcuccgucgccaucaucuccggcggccagggcuaccgcaacuucggcuccgcccucggcuccuccggccgccaggcccccugcggcgagaccgacuccacccuccucaucuggcaggucccccucaugcucuga

SEQ ID NO: 39904 - RNA, 4569 nt, Artificial Sequence
  derived and/or modified sequence opt2 from ARHGEF11__Homo_sapiens__NP_055599
auguccguccgccucccccaguccaucgaccgccucuccucccucuccucccucggcgacuccgcccccgagcgcaagucccccucccaccaccgccagcccuccgacgccuccgagaccaccggccucguccagcgcugcgucaucauccagaaggaccagcacggcuucggcuucaccgucuccggcgaccgcaucguccucguccaguccguccgccccggcggcgccgccaugaaggccggcgucaaggagggcgaccgcaucaucaaggucaacggcaccauggucaccaacuccucccaccucgaggucgucaagcucaucaaguccggcgccuacgucgcccucacccuccucggcuccucccccuccuccaugggcaucuccggccuccagcaggaccccucccccgccggcgccccccgcaucaccuccgucauccccucccccccccccccccccccccucccccccccccagcgcaucaccggccccaagccccuccaggaccccgagguccagaagcacgccacccagauccuccgcaacaugcuccgccaggaggagaaggagcuccaggacauccucccccucuacggcgacaccucccagcgccccuccgagggccgccucucccucgacucccaggagggcgacuccggccucgacuccggcaccgagcgcuuccccucccucuccgagucccucaugaaccgcaacuccguccucuccgaccccggccucgacuccccccgcaccucccccgucaucauggcccgcgucgcccagcaccaccgccgccagggcuccgacgccgccguccccuccaccggcgaccagggcgucgaccagucccccaagccccucaucaucggccccgaggaggacuacgaccccggcuacuucaacaacgaguccgacaucaucuuccaggaccucgagaagcucaagucccgccccgcccaccucggcgucuuccuccgcuacaucuucucccaggccgaccccuccccccuccucuucuaccucugcgccgaggucuaccagcaggccucccccaaggacucccgcucccucggcaaggacaucuggaacaucuuccucgagaagaacgccccccuccgcgucaagauccccgagaugcuccaggccgagaucgacucccgccuccgcaacuccgaggacgcccgcggcguccucugcgaggcccaggaggccgccaugcccgagauccaggagcagauccacgacuaccgcaccaagcgcacccucggccucggcucccucuacggcgagaacgaccuccucgaccucgacggcgacccccuccgcgagcgccaggucgccgagaagcagcucgccgcccucggcgacauccucuccaaguacgaggaggaccgcuccgcccccauggacuucgcccucaacaccuacaugucccacgccggcauccgccuccgcgaggcccgccccuccaacaccgccgagaaggcccaguccgcccccgacaaggacaaguggcuccccuucuuccccaagaccaagaaguccuccaacuccaagaaggagaaggacgcccucgaggacaagaagcgcaaccccauccucaaguacaucggcaagcccaaguccuccucccaguccaccuuccacaucccccucucccccgucgaggucaagcccggcaacguccgcaacaucauccagcacuucgagaacaaccagcaguacgacgcccccgagcccggcacccagcgccucuccaccggcuccuuccccgaggaccuccucgaguccgacuccucccgcuccgagauccgccucggccgcuccgagucccucaagggccgcgaggagaugaagcgcucccgcaaggccgagaacgucccccgcucccgcuccgacgucgacauggacgccgccgccgaggccacccgccuccaccaguccgccuccuccuccaccuccucccucuccacccgcucccucgagaaccccaccccccccuucacccccaagaugggccgccgcuccaucgagucccccucccucggcuucugcaccgacacccuccucccccaccuccucgaggacgaccucggccagcucuccgaccucgagcccgagcccgacgcccagaacuggcagcacaccgucggcaaggacgucgucgccggccucacccagcgcgagaucgaccgccaggaggucaucaacgagcucuucgucaccgaggccucccaccuccgcacccuccgcguccucgaccucaucuucuaccagcgcaugaagaaggagaaccucaugccccgcgaggagcucgcccgccucuuccccaaccuccccgagcucaucgagauccacaacuccuggugcgaggccaugaagaagcuccgcgaggagggccccaucaucaaggagaucuccgaccucaugcucgcccgcuucgacggccccgcccgcgaggagcuccagcaggucgccgcccaguucugcuccuaccaguccaucgcccucgagcucaucaagaccaagcagcgcaaggagucccgcuuccagcucuucaugcaggaggccgagucccacccccagugccgccgccuccagcuccgcgaccucaucaucuccgagaugcagcgccucaccaaguacccccuccuccucgaguccaucaucaagcacaccgagggcggcaccuccgagcacgagaagcucugccgcgcccgcgaccagugccgcgagauccucaaguacgucaacgaggccgucaagcagaccgagaaccgccaccgccucgagggcuaccagaagcgccucgacgccaccgcccucgagcgcgccuccaacccccucgccgccgaguucaagucccucgaccucaccacccgcaagaugauccacgagggcccccucaccuggcgcaucuccaaggacaagacccucgaccuccacguccuccuccucgaggaccuccucguccuccuccagaagcaggacgagaagcuccuccucaagugccacuccaagaccgccgucggcuccuccgacuccaagcagaccuucucccccguccucaagcucaacgccguccucauccgcuccgucgccaccgacaagcgcgccuucuucaucaucugcaccuccaagcucggccccccccagaucuacgagcucgucgcccucaccuccuccgacaagaacaccuggauggagcuccucgaggaggccguccgcaacgccacccgccaccccggcgccgcccccaugcccguccacccccccccccccggcccccgcgagcccgcccagcagggccccacccccucccgcgucgagcucgacgacuccgacgucuuccacggcgagcccgagcccgaggagcuccccggcggcaccggcucccagcagcgcguccagggcaagcaccagguccuccucgaggaccccgagcaggagggcuccgccgaggaggaggagcucggcguccuccccugccccuccaccucccucgacggcgagaaccgcggcauccgcacccgcaaccccauccaccucgccuuccccggcccccucuucauggagggccucgccgacuccgcccucgaggacgucgagaaccuccgccaccucauccucuggucccuccuccccggccacaccauggagacccaggccgcccaggagcccgaggacgaccucacccccacccccuccgucaucuccgucaccucccaccccugggaccccggcucccccggccaggccccccccggcggcgagggcgacaacacccagcucgccggccucgagggcgagcgccccgagcaggaggacaugggccucugcucccucgagcaccuccccccccgcacccgcaacuccggcaucugggagucccccgagcucgaccgcaaccucgccgaggacgccuccuccaccgaggccgccggcggcuacaaggucguccgcaaggccgaggucgccggcuccaaggucguccccgcccuccccgaguccggccaguccgagcccggcccccccgaggucgagggcggcaccaaggccaccggcaacugcuucuacgucuccaugcccuccggcccccccgacuccuccaccgaccacuccgaggcccccaugucccccccccagcccgacucccuccccgccggccagaccgagccccagccccagcuccagggcggcaacgacgacccccgccgccccucccgcuccccccccucccucgcccuccgcgacgucggcaugaucuuccacaccaucgagcagcucacccucaagcucaaccgccucaaggacauggagcucgcccaccgcgagcuccucaagucccucggcggcgaguccuccggcggcaccacccccgucggcuccuuccacaccgaggccgcccgcuggaccgacggcucccucuccccccccgccaaggagccccucgccuccgacucccgcaacucccacgagcucggccccugccccgaggacggcuccgacgccccccucgaggacuccaccgccgacgccgccgccucccccggccccuga

SEQ ID NO: 39905 - RNA, 4578 nt, Artificial Sequence
  derived and/or modified sequence opt2 from ARHGEF12__Homo_sapiens__NP_001185594
auguccggcacccaguccaccaucaccgaccgcuucccccucaagaagcccauccgccacggcuccauccucaaccgcgagucccccaccgacaagaagcagaaggucgagcgcaucgccucccacgacuucgaccccaccggccucguccagcgcugcgucaucauccagaaggacgacaacggcuucggccucaccgucuccggcgacaaccccgucuucguccaguccgucaaggaggacggcgccgccaugcgcgccggcguccagaccggcgaccgcaucaucaaggucaacggcacccucgucacccacuccaaccaccucgaggucgucaagcucaucaaguccggcuccuacgucgcccucaccguccagggccgcccccccggcuccccccagaucccccucgccgacuccgaggucgagcccuccgucaucggccacaugucccccaucaugaccuccccccacucccccggcgccuccggcaacauggagcgcaucaccucccccguccucaugggcgaggagaacaacgucguccacaaccagaaggucgagauccuccgcaagaugcuccagaaggagcaggagcgccuccagcuccuccaggaggacuacaaccgcacccccgcccagcgccuccucaaggagauccaggaggccaagaagcacaucccccagcuccaggagcagcucuccaaggccaccggcuccgcccaggacggcgccgucgucacccccucccgcccccucggcgacacccucaccgucuccgaggccgagaccgaccccggcgacguccucggccgcaccgacugcuccuccggcgacgccucccgccccuccuccgacaacgccgacucccccaaguccggccccaaggagcgcaucuaccucgaggagaaccccgagaaguccgagaccauccaggacaccgacacccagucccucgucggcucccccuccacccgcaucgccccccacaucaucggcgccgaggacgacgacuucggcaccgagcacgagcagaucaacggccagugcuccugcuuccaguccaucgagcuccucaagucccgccccgcccaccucgccgucuuccuccaccacgucgucucccaguucgaccccgccacccuccucugcuaccucuacuccgaccucuacaagcacaccaacuccaaggagacccgccgcaucuuccucgaguuccaccaguucuuccucgaccgcuccgcccaccucaaggucuccguccccgacgagauguccgccgaccucgagaagcgccgccccgagcucauccccgaggaccuccaccgccacuacauccagaccaugcaggagcgcguccaccccgagguccagcgccaccucgaggacuuccgccagaagcgcuccaugggccucacccucgccgaguccgagcucaccaagcucgacgccgagcgcgacaaggaccgccucacccucgagaaggagcgcaccugcgccgagcagaucgucgccaagaucgaggagguccucaugaccgcccaggccgucgaggaggacaaguccuccaccaugcaguacgucauccucauguacaugaagcaccucggcgucaaggucaaggagccccgcaaccucgagcacaagcgcggccgcaucggcuuccuccccaagaucaagcaguccaugaagaaggacaaggagggcgaggagaagggcaagcgccgcggcuuccccuccauccucggccccccccgccgccccucccgccacgacaacuccgccaucggccgcgccauggagcuccagaaggcccgccaccccaagcaccucuccacccccuccuccgucucccccgagccccaggacuccgccaagcuccgccaguccggccucgccaacgagggcaccgacgccggcuaccuccccgccaacuccauguccuccgucgccuccggcgccuccuucucccaggagggcggcaaggagaacgacaccggcuccaagcaggucggcgagaccuccgcccccggcgacacccucgacggcaccccccgcacccucaacaccgucuucgacuuccccccccccccccucgaccagguccaggaggaggagugcgaggucgagcgcgucaccgagcacggcacccccaagcccuuccgcaaguucgacuccgucgccuucggcgagucccaguccgaggacgagcaguucgagaacgaccucgagaccgacccccccaacuggcagcagcucgucucccgcgagguccuccucggccucaagcccugcgagaucaagcgccaggaggucaucaacgagcucuucuacaccgagcgcgcccacguccgcacccucaagguccucgaccaggucuucuaccagcgcgucucccgcgagggcauccucucccccuccgagcuccgcaagaucuucuccaaccucgaggacauccuccagcuccacaucggccucaacgagcagaugaaggccguccgcaagcgcaacgagaccuccgucaucgaccagaucggcgaggaccuccucaccugguucuccggccccggcgaggagaagcucaagcacgccgccgccaccuucugcuccaaccagcccuucgcccucgagaugaucaagucccgccagaagaaggacucccgcuuccagaccuucguccaggacgccgaguccaacccccucugccgccgccuccagcucaaggacaucauccccacccagaugcagcgccucaccaaguacccccuccuccucgacaacaucgccaaguacaccgaguggcccaccgagcgcgagaaggucaagaaggccgccgaccacugccgccagauccucaacuacgucaaccaggccgucaaggaggccgagaacaagcagcgccucgaggacuaccagcgccgccucgacaccuccucccucaagcucuccgaguaccccaacgucgaggagcuccgcaaccucgaccucaccaagcgcaagaugauccacgagggcccccucgucuggaaggucaaccgcgacaagaccaucgaccucuacacccuccuccucgaggacauccucguccuccuccagaagcaggacgaccgccucguccuccgcugccacuccaagauccucgccuccaccgccgacuccaagcacaccuucucccccgucaucaagcucuccaccguccucguccgccaggucgccaccgacaacaaggcccucuucgucaucuccauguccgacaacggcgcccagaucuacgagcucgucgcccagaccgucuccgagaagaccgucuggcaggaccucaucugccgcauggccgccuccgucaaggagcaguccaccaagcccaucccccucccccaguccacccccggcgagggcgacaacgacgaggaggaccccuccaagcucaaggaggagcagcacggcaucuccgucaccggccuccagucccccgaccgcgaccucggccucgaguccacccucaucuccuccaagccccagucccacucccucuccaccuccggcaaguccgagguccgcgaccucuucgucgccgagcgccaguucgccaaggagcagcacaccgacggcacccucaaggaggucggcgaggacuaccagaucgccauccccgacucccaccuccccgucuccgaggagcgcugggcccucgacgcccuccgcaaccucggccuccucaagcagcuccucguccagcagcucggccucaccgagaaguccguccaggaggacuggcagcacuucccccgcuaccgcaccgccucccagggcccccagaccgacuccgucauccagaacuccgagaacaucaaggccuaccacuccggcgagggccacaugcccuuccgcaccggcaccggcgacaucgccaccugcuacuccccccgcaccuccaccgaguccuucgccccccgcgacuccgucggccucgccccccaggacucccaggccuccaacauccucgucauggaccacaugaucaugacccccgagaugcccaccauggagcccgagggcggccucgacgacuccggcgagcacuucuucgacgcccgcgaggcccacuccgacgagaaccccuccgagggcgacggcgccgucaacaaggaggagaaggacgucaaccuccgcaucuccggcaacuaccucauccucgacggcuacgaccccguccaggaguccuccaccgacgaggaggucgccuccucccucacccuccagcccaugaccggcauccccgccgucgaguccacccaccagcagcagcacuccccccagaacacccacuccgacggcgccaucucccccuucacccccgaguuccucguccagcagcgcuggggcgccauggaguacuccugcuucgagauccagucccccuccuccugcgccgacucccagucccagaucauggaguacauccacaagaucgaggccgaccucgagcaccucaagaaggucgaggaguccuacaccauccucugccagcgccucgccggcuccgcccucaccgacaagcacuccgacaaguccuga

SEQ ID NO: 39906 - RNA, 2526 nt, Artificial Sequence
  derived and/or modified sequence opt2 from ARHGEF15__Homo_sapiens__NP_776089
auguccgcccagucccuccccgccgccaccccccccacccagaagcccccccgcaucauccgcccccgcccccccucccgcucccgcgccgcccagucccccggccccccccacaacggcuccuccccccaggagcucccccgcaacuccaacgacgcccccacccccaugugcacccccaucuucugggagccccccgccgccucccucaagccccccgcccuccucccccccuccgccucccgcgccucccucgacucccagaccucccccgacucccccuccuccacccccacccccucccccgucucccgccgcuccgccucccccgagcccgccccccgcucccccguccccccccccaagcccuccggcucccccugcaccccccuccuccccauggccggcguccucgcccagaacggcuccgccuccgcccccggcaccguccgccgccucgccggccgcuucgagggcggcgccgagggccgcgcccaggacgccgacgcccccgagcccggccuccaggcccgcgccgacgucaacggcgagcgcgaggccccccucaccggcuccggcucccaggagaacggcgcccccgacgccggccucgccugcccccccugcugccccugcgucugccacaccacccgccccggccucgagcuccgcuggguccccgucggcggcuacgaggaggucccccgcgucccccgccgcgccuccccccuccgcaccucccgcucccgcccccacccccccuccaucggccaccccgccgucguccucaccuccuaccgcuccaccgccgagcgcaagcuccucccccuccucaagccccccaagcccacccgcguccgccaggacgccaccaucuucggcgaccccccccagcccgaccucgaccuccucuccgaggacggcauccagaccggcgacucccccgacgaggccccccagaacaccccccccgccaccgucgagggccgcgaggaggagggccucgagguccucaaggagcagaacugggagcucccccuccaggacgagccccucuaccagaccuaccgcgccgccguccucuccgaggagcucuggggcgucggcgaggacggcucccccucccccgccaacgccggcgacgcccccaccuucccccgcccccccggcccccgcaacacccucuggcaggagcuccccgccguccaggccuccggccuccucgacacccucuccccccaggagcgccgcaugcaggagucccucuucgaggucgucaccuccgaggccuccuaccuccgcucccuccgccuccucaccgacaccuucguccucucccaggcccuccgcgacacccucaccccccgcgaccaccacacccucuucuccaacguccagcgcguccagggcgucuccgagcgcuuccucgccacccuccucucccgcguccgcuccuccccccacaucuccgaccucugcgacgucguccacgcccacgccgucggccccuucuccgucuacgucgacuacguccgcaaccagcaguaccaggaggagaccuacucccgccucauggacaccaacguccgcuucuccgccgagcuccgccgccuccagucccuccccaagugcgagcgccucccccuccccuccuuccuccuccuccccuuccagcgcaucacccgccuccgcaugcuccuccagaacauccuccgccagaccgaggagggcuccucccgccaggagaacgcccagaaggcccucggcgccgucuccaagaucaucgagcgcugcuccgccgaggucggccgcaugaagcagaccgaggagcucauccgccucacccagcgccuccgcuuccacaaggucaaggcccucccccucgucuccuggucccgccgccucgaguuccagggcgagcucaccgagcucggcugccgccgcggcggcguccucuucgccucccgcccccgcuucaccccccucugccuccuccucuucuccgaccuccuccucaucacccagcccaaguccggccagcgccuccagguccucgacuacgcccaccgcucccucguccaggcccagcagguccccgaccccuccggcccccccaccuuccgccucucccuccucuccaaccaccagggccgccccacccaccgccuccuccaggccuccucccucuccgacaugcagcgcuggcucggcgccuuccccacccccggcccccuccccugcucccccgacaccaucuacgaggacugcgacugcucccaggagcucugcuccgaguccuccgcccccgccaagaccgagggccgcucccucgagucccgcgccgcccccaagcaccuccacaagacccccgagggcuggcucaagggccuccccggcgccuuccccgcccagcucgucugcgaggucaccggcgagcacgagcgccgccgccaccuccgccagaaccagcgccuccucgaggccgucggcuccuccuccggcacccccaacgcccccccccccuga

SEQ ID NO: 39907 - RNA, 2295 nt, Artificial Sequence
  derived and/or modified sequence opt2 from ARHGEF16__Homo_sapiens__XP_011539555
auggcccagcgccacuccgacuccucccucgaggagaagcuccucggccaccgcuuccacuccgagcuccgccucgacgccggcggcaaccccgccuccggccuccccaugguccgcggcuccccccgcguccgcgacgacgccgccuuccagccccagguccccgcccccccccagccccgcccccccggccacgaggagcccuggcccaucguccucuccaccgagucccccgccgcccucaagcucggcacccagcagcucauccccaagucccucgccgucgccuccaaggccaagacccccgcccgccaccaguccuucggcgccgccguccucucccgcgaggccgcccgccgcgaccccaagcuccuccccgcccccuccuucucccucgacgacauggacgucgacaaggaccccggcggcaugcuccgccgcaaccuccgcaaccaguccuaccgcgccgccaugaagggccucggcaagcccggcggccagggcgacgccauccagcucucccccaagcuccaggcccucgccgaggagcccucccagccccacacccgcucccccgccaagaacaagaagacccucggccgcaagcgcggccacaagggcuccuucaaggacgacccccagcucuaccaggagauccaggagcgcggccucaacaccucccaggaguccgacgacgacauccucgacgaguccuccucccccgagggcacccagaaggucgacgccaccaucgucgucaaguccuaccgccccgcccaggucaccuggucccagcuccccgaggucgucgagcucggcauccucgaccagcucuccaccgaggagcgcaagcgccaggaggccauguucgagauccucaccuccgaguucuccuaccagcacucccucuccauccucgucgaggaguuccuccaguccaaggagcuccgcgccaccgucacccagauggagcaccaccaccucuucuccaacauccucgacguccucggcgccucccagcgcugccucgucgccggccccgagcucuggcuccagggccucgaggucgagcgccucgacaugcagcuccagcccugcaccggcgaggccuggcuccuccgcggcuggcaggcccaguccggccccgucucccgcggcggcggcacccccgcccaccuccacgccggcuucuucgaggaccucgagcagcgccacaaggcccagguccucgucgaggacaucuccgacauccucgaggagcacgccgagaagcacuuccaccccuacaucgccuacugcuccaacgaggucuaccagcagcgcacccuccagaagcucaucuccuccaacgccgccuuccgcgaggcccuccgcgagaucgagcgccgccccgccugcggcggccuccccaugcucuccuuccucauccuccccaugcagcgcgucacccgccucccccuccucauggacacccucugccucaagacccagggccacuccgagcgcuacaaggccgccucccgcgcccucaaggccaucuccaagcucguccgccagugcaacgagggcgcccaccgcauggagcgcauggagcagauguacacccuccacacccagcucgacuucuccaaggucaagucccucccccucaucuccgccucccgcuggcuccucaagcgcggcgagcucuuccucgucgaggagaccggccucuuccgcaagaucgccucccgccccaccugcuaccucuuccucuucaacgacguccucgucgucaccaagaagaaguccgaggaguccuacaugguccaggacuacgcccagaugaaccacauccaggucgagaagaucgagcccuccgagcucccccuccccggcggcggcaaccgcuccuccuccgucccccaccccuuccaggucacccuccuccgcaacuccgagggccgccaggagcagcuccuccucuccuccgacuccgccuccgaccgcgcccgcuggaucgucgcccucacccacuccgagcgccaguggcagggccucuccuccaagggcgaccucccccaggucgagaucaccaaggccuucuucgccaagcaggccgacgaggucacccuccagcaggccgacgucguccucguccuccagcaggaggacggcuggcucuacggcgagcgccuccgcgacggcgagaccggcugguuccccgaggacuucgcccgcuucaucaccucccgcgucgccgucgagggcaacguccgccgcauggagcgccuccgcgucgagaccgacgucuga

SEQ ID NO: 39908 - RNA, 6192 nt, Artificial Sequence
  derived and/or modified sequence opt2 from ARHGEF17__Homo_sapiens__NP_055601
auggccgacggcgccccccgcccccagcucuaccgcuccgucuccuucaagcuccucgagcgcugguccggcggccccggccuccgcgaggaggacaccgacacccccggccuccgccgccgcgccuccugccgccccaccaccgccgcccgcggccagcccucccgccgcgucuccaagcucgccuccggcccccucgccgcccccgcccagccccgcccccuccgcucccucucccccuccguccgccagcucucccgccgcuucgacgccccccgccucgacgacggcuccgccggcacccgcgacggcggcguccuccccgccgccgccgaggaggccgccgagggccccgcccgcggcgccuggcccuccgucaccgagaugcgcaagcucuucggcggccccggcucccgccgccccuccgccgacuccgagucccccggcacccccucccccgacggcgccgccugggagccccccgcccgcgagucccgccagccccccaccccccccccccgcaccugcuucccccucgccggccuccgcuccgcccgcccccucaccggccccgagaccgagggccgccuccgccgcccccagcagcagcaggagcgcgcccagcgccccgccgacggccuccacuccuggcacaucuucucccagccccaggccggcgcccgcgccuccugcuccuccuccuccaucgccgccuccuaccccgucucccgcucccgcgccgccuccuccuccgaggaggaggaggagggccccccccagcuccccggcgcccagucccccgccuaccacggcggccacuccuccggcuccgacgacgaccgcgacggcgagggcggccaccgcuggggcggccgccccggccuccgccccggcuccucccuccucgaccaggacugccgccccgacuccgacggccucaaccucuccuccaugaacuccgccggcgucuccggcucccccgagccccccaccuccccccgcgccccccgcgaggagggccuccgcgaguggggcuccggcuccccccccugcguccccggcccccaggagggccuccgccccauguccgacuccgucggcggcgccuuccgcgucgccaaggucuccuuccccuccuaccucgccucccccgccggcucccgcggcuccucccgcuacuccuccaccgagacccucaaggacgacgaccucugguccucccgcggcuccggcggcuggggcgucuaccgcucccccuccuucggcgccggcgagggccuccuccgcucccaggcccgcacccgcgccaagggccccggcggcaccucccgcgcccuccgcgacggcggcuucgagcccgagaagucccgccagcgcaagucccucuccaaccccgacaucgccuccgagacccucacccuccucuccuuccuccgcuccgaccucuccgagcuccgcguccgcaagcccggcggcuccuccggcgaccgcggcuccaacccccucgacggccgcgacucccccuccgccggcggccccgucggccagcucgagcccauccccauccccgcccccgccucccccggcacccgccccacccucaaggaccucaccgccacccuccgccgcgccaaguccuucaccugcuccgagaagcccauggcccgccgccucccccgcaccuccgcccucaaguccuccuccuccgagcuccuccucaccggccccggcgccgaggaggacccccucccccucaucguccaggaccaguacguccaggaggcccgccaggucuucgagaagauccagcgcaugggcgcccagcaggacgacggcuccgacgccccccccggcucccccgacugggccggcgacgucacccgcggccagcgcucccaggaggagcucuccggccccgaguccucccucaccgacgagggcaucggcgccgaccccgagccccccgucgccgccuucugcggccucggcaccaccggcauguggcgcccccucuccuccuccuccgcccagaccaaccaccacggccccggcaccgaggacucccucggcggcugggcccucgucucccccgagaccccccccacccccggcgcccuccgccgccgccgcaaggucccccccuccggcuccggcggcuccgagcucuccaacggcgaggccggcgaggccuaccgcucccucuccgaccccaucccccagcgccaccgcgccgccaccuccgaggagcccaccggcuucuccgucgacuccaaccuccucggcucccucucccccaagaccggccuccccgccaccuccgccauggacgagggccucaccuccggccacuccgacugguccgucggcuccgaggaguccaagggcuaccaggaggucauccaguccaucguccagggccccggcacccucggccgcgucgucgacgaccgcaucgccggcaaggcccccaagaagaagucccucuccgaccccucccgccgcggcgagcucgccggccccggcuucgagggccccggcggcgagcccauccgcgaggucgagcccaugcucccccccuccuccuccgagcccauccucgucgagcagcgcgccgagcccgaggagcccggcgccacccgcucccgcgcccaguccgagcgcgcccuccccgaggcccuccccccccccgccaccgcccaccgcaacuuccaccucgaccccaagcucgccgacauccucuccccccgccucauccgccgcggcuccaagaagcgccccgcccgcuccucccaccaggagcuccgccgcgacgagggcucccaggaccagaccggcucccucucccgcgcccgccccuccucccgccacguccgccacgccuccguccccgccaccuucaugcccaucgucguccccgagccccccaccuccgucggcccccccgucgccguccccgagcccaucggcuuccccacccgcgcccaccccacccuccaggcccccucccucgaggacgucaccaagcaguacaugcucaaccuccacuccggcgagguccccgcccccguccccgucgacaugcccugccucccccucgccgccccccccuccgccgaggccaagccccccgaggccgcccgccccgccgacgagcccacccccgccuccaagugcugcuccaagccccaggucgacaugcgcaagcacgucgccaugacccuccucgacaccgagcaguccuacgucgagucccuccgcacccucaugcagggcuacaugcagccccucaagcagcccgagaacuccguccucugcgaccccucccucgucgacgagaucuucgaccagauccccgagcuccucgagcaccacgagcaguuccucgagcagguccgccacugcaugcagaccuggcacgcccagcagaaggucggcgcccuccucguccaguccuucuccaaggacguccucgucaacaucuacuccgccuacaucgacaacuuccucaacgccaaggacgccguccgcgucgccaaggaggcccgccccgccuuccucaaguuccucgagcaguccaugcgcgagaacaaggagaagcaggcccucuccgaccucaugaucaagcccguccagcgcaucccccgcuacgagcuccucgucaaggaccuccucaagcacacccccgaggaccaccccgaccacccccuccuccucgaggcccagcgcaacaucaagcaggucgccgagcgcaucaacaagggcguccgcuccgccgaggaggccgagcgccacgcccgcguccuccaggagaucgaggcccacaucgagggcauggaggaccuccaggccccccuccgccgcuuccuccgccaggagauggucaucgaggucaaggccaucggcggcaagaaggaccgcucccucuuccucuucaccgaccucaucgucugcaccacccucaagcgcaaguccggcucccuccgccgcuccuccaugucccucuacaccgccgccuccgucaucgacaccgccuccaaguacaagaugcucuggaagcucccccucgaggacgccgacaucaucaagggcgccucccaggccaccaaccgcgagaacauccagaaggccaucucccgccucgacgaggaccucaccacccucggccagauguccaagcucuccgagucccucggcuucccccaccagucccucgacgacgcccuccgcgaccucuccgccgccaugcaccgcgaccucuccgagaagcaggcccucugcuacgcccucuccuucccccccaccaagcucgagcucugcgccacccgccccgagggcaccgacuccuacaucuucgaguucccccaccccgacgcccgccucggcuucgagcaggccuucgacgaggccaagcgcaagcucgccuccuccaaguccugccucgaccccgaguuccucaaggccauccccaucaugaagacccgcuccggcaugcaguucuccugcgccgcccccacccucaacuccugccccgagcccucccccgaggucugggucugcaacuccgacggcuacgucggccaggucugccuccucucccuccgcgccgagcccgacgucgaggccugcaucgccgucugcuccgcccgcauccucugcaucggcgccguccccggccuccagccccgcugccaccgcgagcccccccccucccuccgcuccccccccgagaccgcccccgagcccgccggccccgagcucgacgucgaggccgccgccgacgaggaggccgccacccucgccgagcccggcccccagcccugccuccacaucuccaucgccggcuccggccucgagaugacccccggccucggcgagggcgacccccgccccgagcucguccccuucgacuccgacuccgacgacgaguccucccccucccccuccggcacccuccagucccaggccucccgcuccaccaucuccuccuccuucggcaacgaggagacccccuccuccaaggaggccaccgccgagaccaccuccuccgaggaggagcaggagcccggcuuccucccccucuccggcuccuucggccccggcggccccugcggcaccucccccauggacggccgcgcccuccgccgcuccucccacggcuccuucacccgcggcucccucgaggaccuccucuccgucgaccccgaggccuaccaguccuccgucuggcucggcaccgaggacggcugcguccacgucuaccaguccuccgacuccauccgcgaccgccgcaacuccaugaagcuccagcacgccgccuccgucaccugcauccucuaccucaacaaccaggucuucgucucccucgccaacggcgagcucgucgucuaccagcgcgaggccggccacuucugggacccccagaacuucaaguccgucacccucggcacccagggcucccccaucaccaagauggucuccgucggcggccgccucuggugcggcugccagaaccgcguccucguccucucccccgacacccuccagcucgagcacauguucuacgucggccaggacuccucccgcugcgucgccugcauggucgacuccucccucggcgucugggucacccucaagggcuccgcccacgucugccucuaccaccccgacaccuucgagcagcucgccgaggucgacgucaccccccccguccaccgcaugcucgccggcuccgacgccaucauccgccagcacaaggccgccugccuccgcaucaccgcccuccucgucugcgaggagcuccucugggucggcaccuccgccggcgucguccucaccaugcccaccucccccggcaccgucuccugcccccgcgccccccucucccccaccggccucggccagggccacaccggccacguccgcuuccucgccgccguccagcuccccgacggcuucaaccuccucugccccacccccccccccccccccgacaccggccccgagaagcuccccucccucgagcaccgcgacucccccuggcaccgcggccccgcccccgcccgccccaagaugcucgucaucuccggcggcgacggcuacgaggacuuccgccucuccuccggcggcggcuccuccuccgagaccgucggccgcgacgacuccaccaaccaccuccuccucuggcgcgucuga

SEQ ID NO: 39909 - RNA, 2640 nt, Artificial Sequence
  derived and/or modified sequence opt2 from ARHGEF1__Homo_sapiens__NP_945328
auggaggacuucgcccgcggcgccgccucccccggccccucccgccccggccucguccccgucuccaucaucggcgccgaggacgaggacuucgagaacgagcucgagaccaacuccgaggagcagaacucccaguuccagucccucgagcaggucaagcgccgccccgcccaccucauggcccuccuccagcacgucgcccuccaguucgagcccggcccccucguccuccgcguccccgucccccccaacgucgccuucgagcucgaccgcacccgcgccgaccucaucuccgaggacguccagcgccgcuucguccaggaggucguccagucccagcaggucgccgucggccgccagcucgaggacuuccgcuccaagcgccucaugggcaugacccccugggagcaggagcucgcccagcucgaggccugggucggccgcgaccgcgccuccuacgaggcccgcgagcgccacgucgccgagcgccuccucaugcaccucgaggagaugcagcacaccaucuccaccgacgaggagaaguccgccgccgucgucaacgccaucggccucuacaugcgccaccucggcguccgcaccaaguccggcgacaagaaguccggccgcaacuucuuccgcaagaaggucaugggcaaccgccgcuccgacgagcccgccaagaccaagaagggccucuccuccauccucgacgccgcccgcuggaaccgcggcgagccccagguccccgacuuccgccaccucaaggccgaggucgacgccgagaagcccggcgccaccgaccgcaagggcggcgucggcaugcccucccgcgaccgcaacaucggcgcccccggccaggacacccccggcgucucccuccacccccucucccucgacucccccgaccgcgagcccggcgccgacgccccccucgagcucggcgacuccuccccccagggccccaugucccucgagucccucgccccccccgaguccaccgacgagggcgccgagaccgagucccccgagcccggcgacgagggcgagcccggccgcuccggccucgagcucgagcccgaggagccccccggcuggcgcgagcucgucccccccgacacccuccacucccuccccaagucccaggucaagcgccaggaggucaucuccgagcuccucgucaccgaggccgcccacguccgcaugcuccgcguccuccacgaccucuucuuccagcccauggccgagugccucuucuucccccucgaggagcuccagaacaucuuccccucccucgacgagcucaucgagguccacucccucuuccucgaccgccucaugaagcgccgccaggaguccggcuaccucaucgaggagaucggcgacguccuccucgcccgcuucgacggcgccgagggcuccugguuccagaagaucuccucccgcuucugcucccgccaguccuucgcccucgagcagcucaaggccaagcagcgcaaggacccccgcuucugcgccuucguccaggaggccgagucccgcccccgcugccgccgccuccagcucaaggacaugauccccaccgagaugcagcgccucaccaaguacccccuccuccuccaguccaucggccagaacaccgaggagcccaccgagcgcgagaaggucgagcucgccgccgagugcugccgcgagauccuccaccacgucaaccaggccguccgcgacauggaggaccuccuccgccucaaggacuaccagcgccgccucgaccucucccaccuccgccaguccuccgaccccaugcucuccgaguucaagaaccucgacaucaccaagaagaagcucguccacgagggcccccucaccuggcgcgucaccaaggacaaggccgucgagguccacguccuccuccucgacgaccuccuccuccuccuccagcgccaggacgagcgccuccuccucaagucccacucccgcacccucacccccacccccgacggcaagaccaugcuccgccccguccuccgccucaccuccgccaugacccgcgaggucgccaccgaccacaaggccuucuacguccucuucaccugggaccaggaggcccagaucuacgagcucgucgcccagaccgucuccgagcgcaagaacuggugcgcccucaucaccgagaccgccggcucccucaagguccccgcccccgccucccgccccaagccccgccccucccccuccuccacccgcgagccccuccucuccuccuccgagaacggcaacggcggccgcgagaccucccccgccgacgcccgcaccgagcgcauccucuccgaccuccuccccuucugccgccccggccccgagggccagcucgccgccaccgcccuccgcaagguccucucccucaagcagcuccucuuccccgccgaggaggacaacggcgccggccccccccgcgacggcgacggcguccccggcggcggcccccucucccccgcccgcacccaggagauccaggagaaccuccucucccucgaggagaccaugaagcagcucgaggagcucgaggaggaguucugccgccuccgcccccuccucucccagcucggcggcaacuccgucccccagcccggcugcaccuga

SEQ ID NO: 39910 - RNA, 1860 nt, Artificial Sequence
  derived and/or modified sequence opt2 from ARHGEF25__Homo_sapiens__NP_001104740
augaagccccccgaccgccccgcccccggccgcaccgaccgcauccucggcgucaugggcggcaugcuccgcgccugcgcccuccccggccaggagggccccccccgccgcuccccccucggccucgucggcaccgagcccgaguccgagcgcaccgagggcgaccaccgccgcgaccgcgagcacgagguccucgccggcgcccuccagcccgaguccuacuccaucgccggcuccgagggcuccaucuccgccuccgccgccuccggccucgccgcccccuccggccccuccuccggccucuccuccggccccugcucccccggcccccccggccccgucuccggccuccgccgcuggcucgaccacuccaagcacugccucuccgucgagaccgaggccgacuccggccaggccggccccuacgagaacuggaugcucgagcccgcccucgccaccggcgaggagcuccccgagcucacccuccucaccacccuccucgagggccccggcgacaagacccagccccccgaggaggagacccucucccaggcccccgaguccgaggaggagcagaagaagaaggcccucgagcgcuccauguacguccucuccgagcucgucgagaccgagaagauguacgucgacgaccucggccagaucgucgagggcuacauggccaccauggccgcccagggcguccccgagucccuccgcggccgcgaccgcaucgucuucggcaacauccagcagaucuacgaguggcaccgcgacuacuuccuccaggagcuccagcgcugccucaaggaccccgacuggcucgcccagcucuucaucaagcacgagcgccgccuccacauguacgucgucuacugccagaacaagcccaaguccgagcacgucgucuccgaguucggcgacuccuacuucgaggagcuccgccagcagcucggccaccgccuccagcucaacgaccuccucaucaagcccguccagcgcaucaugaaguaccagcuccuccucaaggacuuccucaaguacuacaaccgcgccggcauggacaccgccgaccucgagcaggccgucgaggucaugugcuucguccccaagcgcugcaacgacaugaugacccucggccgccuccgcggcuucgagggcaagcucaccgcccagggcaagcuccucggccaggacaccuucugggucaccgagcccgaggccggcggccuccucuccucccgcggccgcgagcgccgcgucuuccucuucgagcagaucaucaucuucuccgaggcccucggcggcggcguccgcggcggcacccagcccggcuacgucuacaagaacuccaucaaggucuccugccucggccucgagggcaaccuccagggcgaccccugccgcuucgcccucaccucccgcggccccgagggcggcauccagcgcuacguccuccaggccgccgaccccgccaucucccaggccuggaucaagcacgucgcccagauccucgagucccagcgcgacuuccucaacgcccuccagucccccaucgaguaccagcgccgcgagucccagaccaacucccucggccgcccccgcggccccggcgucggcucccccggccgcauccgccucggcgaccaggcccagggcuccacccacacccccaucaacggcucccuccccucccuccuccucucccccaagggcgaggucgcccgcgcccuccucccccucgacaagcaggcccucggcgacaucccccaggccccccacgacuccccccccgucucccccacccccaagaccccccccugccaggcccgccucgccaagcucgacgaggacgagcucuga

SEQ ID NO: 39911 - RNA, 2376 nt, Artificial Sequence
  derived and/or modified sequence opt2 from ARHGEF26__Homo_sapiens__NP_001238892
auggacggcgaguccgaggucgacuucuccuccaacuccaucaccccccucuggcgccgccgcuccaucccccagccccaccagguccucggccgcuccaagccccgcccccaguccuaccagucccccaacggccuccucaucaccgacuuccccgucgaggacggcggcacccuccucgccgcccagauccccgcccagguccccaccgccuccgacucccgcaccguccaccgcuccccccuccuccucggcgcccagcgccgcgccgucgccaacggcggcaccgccucccccgaguaccgcgccgccuccccccgccuccgccgccccaagucccccaagcuccccaaggccguccccggcggcucccccaagucccccgccaacggcgccgucacccuccccgcccccccccccccccccguccuccgccccccccgcacccccaacgcccccgcccccugcacccccgaggaggaccucaccggccucaccgccucccccguccccucccccaccgccaacggccucgccgccaacaacgacucccccggcuccggcucccaguccggccgcaaggccaaggaccccgagcgcggccucuuccccggcccccagaaguccuccuccgagcagaagcucccccuccagcgccuccccucccaggagaacgagcuccucgagaaccccuccgucguccucuccaccaacucccccgccgcccucaaggucggcaagcagcagaucauccccaagucccucgccuccgagaucaagaucuccaaguccaacaaccagaacgucgagccccacaagcgccuccucaagguccgcuccauggucgagggccucggcggcccccucggccacgccggcgaggaguccgaggucgacaacgacgucgacucccccggcucccuccgccgcggccuccgcuccaccuccuaccgccgcgccgucgucuccggcuucgacuucgacucccccaccuccuccaagaagaagaaccgcaugucccagcccguccucaaggucgucauggaggacaaggagaaguucuccucccucggccgcaucaagaagaagaugcucaagggccagggcaccuucgacggcgaggagaacgccguccucuaccagaacuacaaggagaaggcccucgacaucgacuccgacgaggaguccgagcccaaggagcagaaguccgacgagaagaucgucauccaccacaagccccuccgcuccaccuggucccagcucuccgccgucaagcgcaagggccucucccagaccgucucccaggaggagcgcaagcgccaggaggccaucuucgaggucaucuccuccgagcacuccuaccuccucucccucgagauccucauccgcauguucaagaacuccaaggagcucuccgacaccaugaccaagaccgagcgccaccaccucuucuccaacaucaccgacgucugcgaggccuccaagaaguucuucaucgagcucgaggcccgccaccagaacaacaucuucaucgacgacaucuccgacaucgucgagaagcacaccgccuccaccuucgaccccuacgucaaguacugcaccaacgaggucuaccagcagcgcacccuccagaagcuccucgccaccaaccccuccuucaaggagguccucucccgcaucgagucccacgaggacugccgcaaccuccccaugaucuccuuccucauccuccccaugcagcgcgucacccgccucccccuccucauggacaccaucugccagaagacccccaaggacucccccaaguacgaggucugcaagcgcgcccucaaggaggucuccaagcucguccgccucugcaacgagggcgcccgcaagauggagcgcaccgagaugauguacaccaucaacucccagcucgaguucaagaucaagcccuucccccucgucuccuccucccgcuggcucgucaagcgcggcgagcucaccgccuacgucgaggacaccguccucuucucccgccgcaccuccaagcagcaggucuacuucuuccucuucaacgacguccucaucaucaccaagaagaaguccgaggaguccuacaacgucaacgacuacucccuccgcgaccagcuccucgucgaguccugcgacaacgaggagcucaacuccucccccggcaagaacuccuccaccaugcucuacucccgccaguccuccgccucccaccucuucacccucaccguccucuccaaccacgccaacgagaaggucgagaugcuccucggcgccgagacccaguccgagcgcgcccgcuggaucaccgcccucggccacuccuccggcaagccccccgccgaccgcaccugcggcuga

SEQ ID NO: 39912 - RNA, 5196 nt, Artificial Sequence
  derived and/or modified sequence opt2 from ARHGEF28__Homo_sapiens__NP_001073948
auggagcucuccugcuccgaggccccccucuacggccagaugaugaucuacgccaaguucgacaagaacgucuaccuccccgaggacgccgaguucuacuucaccuacgacggcucccaccagcgccacgucaugaucgccgagcgcaucgaggacaacguccuccaguccuccguccccggccacggccuccaggagaccgucaccgucuccgucugccucugcuccgagggcuacucccccgucaccaugggcuccggcuccgucaccuacgucgacaacauggccugccgccucgcccgccuccucgucacccaggccaaccgccucaccgccugcucccaccagacccuccucacccccuucgcccucaccgccggcgcccuccccgcccucgacgaggagcucguccucgcccucacccaccucgagcucccccucgaguggaccguccucggcuccuccucccucgaggucuccucccaccgcgagucccuccuccaccucgccaugcgcuggggccucgccaagcucucccaguucuuccucugccuccccggcggcguccaggcccucgcccuccccaacgaggagggcgccaccccccucgaccucgcccuccgcgagggccacuccaagcucgucgaggacgucaccaacuuccagggccgcuggucccccuccuucucccgcguccagcucuccgaggaggccucccuccacuacauccacuccuccgagacccucacccucacccucaaccacaccgccgagcaccuccucgaggccgacaucaagcucuuccgcaaguacuucugggaccgcgccuuccucgucaaggccuucgagcccgaggcccgccccgaggagcgcaccgccaugcccuccuccggcgccgagaccgaggaggagaucaagaacuccgucuccucccgcuccgccgccgagaaggaggacaucaagcgcgucaagucccucgucguccagcacaacgagcacgaggaccagcacucccucgaccucgaccgcuccuucgacauccucaagaaguccaagccccccuccacccuccucgccgccggccgccucuccgacaugcucaacggcggcgacgaggucuacgccaacugcauggucaucgaccaggucggcgaccucgacaucuccuacaucaacaucgagggcaucaccgccaccaccucccccgagucccgcggcugcacccucuggccccaguccuccaagcacacccuccccaccgagaccucccccuccgucuacccccucuccgagaacgucgagggcaccgcccacaccgaggcccagcaguccuucaugucccccuccuccuccugcgccuccaaccucaaccucuccuucggcuggcacggcuucgagaaggagcagucccaccucaagaagcgcuccuccucccucgacgcccucgacgccgacuccgagggcgagggccacuccgagcccucccacaucugcuacacccccggcucccaguccuccucccgcaccggcauccccuccggcgacgagcucgacuccuucgagaccaacaccgagcccgacuucaacaucucccgcgccgagucccucccccucuccuccaaccuccaguccaaggagucccuccucuccggcguccgcucccgcuccuacuccugcuccucccccaagaucucccucggcaagacccgccucguccgcgagcucaccgucugcuccuccuccgaggagcagcgcgccuacucccucuccgagcccccccgcgagaaccgcauccaggaggaggagugggacaaguacaucauccccgccaaguccgaguccgagaaguacaaggucucccgcaccuucuccuuccucaugaaccgcaugaccuccccccgcaacaaguccaagaccaaguccaaggacgccaaggacaaggagaagcucaaccgccaccaguucgcccccggcaccuucuccggcguccuccagugccucgucugcgacaagacccuccucggcaaggagucccuccagugcuccaacugcaacgccaacguccacaagggcugcaaggacgccgcccccgccugcaccaagaaguuccaggagaaguacaacaagaacaagccccagaccauccucggcaacuccuccuuccgcgacaucccccagcccggccucucccuccaccccuccuccuccguccccgucggccuccccaccggccgccgcgagaccgucggccagguccacccccucucccgcuccguccccggcaccacccucgaguccuuccgccgcuccgccaccucccucgaguccgaguccgaccacaacuccugccgcucccgcucccacuccgacgagcuccuccaguccaugggcuccucccccuccaccgaguccuucaucauggaggacgucgucgacuccucccucugguccgaccucuccuccgacgcccaggaguucgaggccgaguccuggucccucgucgucgaccccuccuucugcaaccgccaggagaaggacgucaucaagcgccaggacgucaucuucgagcucaugcagaccgagaugcaccacauccagacccucuucaucauguccgagaucuuccgcaagggcaugaaggaggagcuccagcucgaccacuccaccgucgacaagaucuuccccugccucgacgagcuccucgagauccaccgccacuucuucuacuccaugaaggagcgccgccaggaguccugcgccggcuccgaccgcaacuucgucaucgaccgcaucggcgacauccucguccagcaguucuccgaggagaacgccuccaagaugaagaagaucuacggcgaguucugcugccaccacaaggaggccgucaaccucuucaaggagcuccagcagaacaagaaguuccagaacuucaucaagcuccgcaacuccaaccuccucgcccgccgccgcggcauccccgagugcauccuccucgucacccagcgcaucaccaaguaccccguccucgucgagcgcauccuccaguacaccaaggagcgcaccgaggagcacaaggaccuccgcaaggcccucugccucaucaaggacaugaucgccaccgucgaccucaaggucaacgaguacgagaagaaccagaaguggcucgagauccucaacaagaucgagaacaagaccuacaccaagcucaagaacggccacgucuuccgcaagcaggcccucauguccgaggagcgcacccuccucuacgacggccucgucuacuggaagaccgccaccggccgcuucaaggacauccucgcccuccuccucaccgacguccuccucuuccuccaggagaaggaccagaaguacaucuucgccgccgucgaccagaagcccuccgucaucucccuccagaagcucaucgcccgcgaggucgccaacgaggagcgcggcauguuccucaucuccgccuccuccgccggccccgagauguacgagauccacaccaacuccaaggaggagcgcaacaacuggaugcgccgcauccagcaggccgucgaguccugccccgaggagaagggcggccgcaccuccgaguccgacgaggacaagcgcaaggccgaggcccgcgucgccaagauccagcagugccaggagauccucaccaaccaggaccagcagaucugcgccuaccucgaggagaagcuccacaucuacgccgagcucggcgagcucuccggcuucgaggacguccaccucgagccccaccuccucaucaagcccgaccccggcgagcccccccaggccgccucccuccucgccgccgcccucaaggaggccgagucccuccaggucgccgucaaggccucccagaugggcgccgucucccaguccugcgaggacuccugcggcgacuccguccucgccgacacccucuccucccacgacguccccggcucccccaccgccucccucgucaccggcggccgcgagggccgcggcugcuccgacgucgaccccggcauccagggcgucgucaccgaccucgccgucuccgacgccggcgagaaggucgagugccgcaacuuccccggcuccucccaguccgagaucauccaggccauccagaaccucacccgccuccucuacucccuccaggccgcccucaccauccaggacucccacaucgagauccaccgccucguccuccagcagcaggagggccucucccucggccacuccauccuccgcggcggcccccuccaggaccagaagucccgcgacgccgaccgccagcacgaggagcucgccaacguccaccagcuccagcaccagcuccagcaggagcagcgccgcuggcuccgccgcugcgagcagcagcagcgcgcccaggccacccgcgaguccuggcuccaggagcgcgagcgcgagugccagucccaggaggagcuccuccuccgcucccgcggcgagcucgaccuccagcuccaggaguaccagcacucccucgagcgccuccgcgagggccagcgccucgucgagcgcgagcaggcccgcaugcgcgcccagcagucccuccucggccacuggaagcacggccgccagcgcucccuccccgccguccuccuccccggcggccccgaggucauggagcucaaccgcuccgagucccucugccacgagaacuccuucuucaucaacgaggcccucguccagauguccuucaacaccuucaacaagcucaaccccuccgucauccaccaggacgccaccuaccccaccacccagucccacuccgaccucguccgcaccuccgagcaccaggucgaccucaaggucgaccccucccagcccuccaacgucucccacaagcucuggaccgccgccggcuccggccaccagauccuccccuuccacgaguccuccaaggacuccugcaagaacggcuccuccaugaccaagugcuccugcacccucaccuccccccccggccucuggaccggcaccaccuccacccucaaggaccucgacaccucccacaccgagucccccaccccccacgacuccaacucccaccgcccccagcuccaggccuucaucaccgaggccaagcucaaccuccccacccgcaccaugacccgccaggacggcgagaccggcgacggcgccaaggagaacaucgucuaccucuga

SEQ ID NO: 39913 - RNA, 2961 nt, Artificial Sequence
  derived and/or modified sequence opt2 from ARHGEF2__Homo_sapiens__NP_001155855
augucccgcaucgagucccucacccgcgcccgcaucgaccgcucccgcgagcucgccuccaagacccgcgagaaggagaagaugaaggaggccaaggacgcccgcuacaccaacggccaccucuucaccaccaucuccgucuccggcaugaccaugugcuacgccugcaacaaguccaucaccgccaaggaggcccucaucugccccaccugcaacgucaccauccacaaccgcugcaaggacacccucgccaacugcaccaaggucaagcagaagcagcagaaggccgcccuccucaagaacaacaccgcccuccaguccgucucccuccgcuccaagaccaccauccgcgagcgccccuccuccgccaucuaccccuccgacuccuuccgccagucccuccucggcucccgccgcggccgcuccucccucucccucgccaaguccgucuccaccaccaacaucgccggccacuucaacgacgaguccccccucggccuccgccgcauccucucccaguccaccgacucccucaacaugcgcaaccgcacccucuccgucgagucccucaucgacgaggccgaggucaucuacuccgagcucauguccgacuucgagauggacgagaaggacuucgccgccgacuccuggucccucgccgucgacuccuccuuccuccagcagcacaagaaggaggucaugaagcagcaggacgucaucuacgagcucauccagaccgagcuccaccacguccgcacccucaagaucaugacccgccucuuccgcaccggcaugcucgaggagcuccaccucgagcccggcgucguccagggccucuuccccugcgucgacgagcucuccgacauccacacccgcuuccucucccagcuccucgagcgccgccgccaggcccucugccccggcuccacccgcaacuucgucauccaccgccucggcgaccuccucaucucccaguucuccggccccuccgccgagcagaugugcaagaccuacuccgaguucugcucccgccacuccaaggcccucaagcucuacaaggagcucuacgcccgcgacaagcgcuuccagcaguucauccgcaaggucacccgccccgccguccucaagcgccacggcguccaggagugcauccuccucgucacccagcgcaucaccaaguacccccuccucaucucccgcauccuccagcacucccacggcaucgaggaggagcgccaggaccucaccaccgcccucggccucgucaaggagcuccucuccaacgucgacgagggcaucuaccagcucgagaagggcgcccgccuccaggagaucuacaaccgcauggacccccgcgcccagacccccguccccggcaagggccccuucggccgcgaggagcuccuccgccgcaagcucauccacgacggcugccuccucuggaagaccgccaccggccgcuucaaggacguccucguccuccucaugaccgacguccucgucuuccuccaggagaaggaccagaaguacaucuuccccacccucgacaagcccuccgucgucucccuccagaaccucaucguccgcgacaucgccaaccaggagaagggcauguuccucaucuccgccgccccccccgagauguacgagguccacaccgccucccgcgacgaccgcuccaccuggauccgcgucauccagcaguccguccgcaccugccccucccgcgaggacuucccccucaucgagaccgaggacgaggccuaccuccgccgcaucaagauggagcuccagcagaaggaccgcgcccucgucgagcuccuccgcgagaaggucggccucuucgccgagaugacccacuuccaggccgaggaggacggcggcuccggcauggcccuccccacccucccccgcggccucuuccgcuccgagucccucgaguccccccgcggcgagcgccuccuccaggacgccauccgcgaggucgagggccucaaggaccuccucgucggccccggcgucgagcuccuccucaccccccgcgagcccgcccucccccucgagcccgacuccggcggcaacaccucccccggcgucaccgccaacggcgaggcccgcaccuucaacggcuccaucgagcucugccgcgccgacuccgacuccucccagcgcgaccgcaacggcaaccagcuccgcuccccccaggaggaggcccuccagcgccucgucaaccucuacggccuccuccacggccuccaggccgccgucgcccagcaggacacccucauggaggcccgcuuccccgagggccccgagcgccgcgagaagcucugccgcgccaacucccgcgacggcgaggccggccgcgccggcgccgcccccgucgcccccgagaagcaggccaccgagcucgcccuccuccagcgccagcacgcccuccuccaggaggagcuccgccgcugccgccgccucggcgaggagcgcgccaccgaggccggcucccucgaggcccgccuccgcgaguccgagcaggcccgcgcccuccucgagcgcgaggccgaggaggcccgccgccagcucgccgcccucggccagaccgagccccuccccgccgaggcccccugggcccgccgccccgucgacccccgccgccgcucccuccccgccggcgacgcccucuaccucuccuucaaccccccccagcccucccgcggcaccgaccgccucgaccuccccgucaccacccgcuccguccaccgcaacuucgaggaccgcgagcgccaggagcucggcucccccgaggagcgccuccaggacuccuccgaccccgacaccggcuccgaggaggagggcuccucccgccucucccccccccacuccccccgcgacuucacccgcaugcaggacauccccgaggagaccgagucccgcgacggcgaggccgucgccuccgaguccuga

SEQ ID NO: 39914 - RNA, 2334 nt, Artificial Sequence
  derived and/or modified sequence opt2 from ARHGEF38__Homo_sapiens__NP_001229658
auggagcccaaggaggccaccggcaaggagaacauggucaccaagaagaagaaccucgccuuccuccgcucccgccucuacaugcucgagcgccgcaagaccgacaccgucgucgaguccuccgucuccggcgaccacuccggcacccuccgccgcucccaguccgaccgcaccgaguacaaccagaagcuccaggagaagaugaccccccagggcgagugcuccgucgccgagacccucacccccgaggaggagcaccacaugaagcgcaugauggccaagcgcgagaagaucaucaaggagcucauccagaccgagaaggacuaccucaacgaccucgagcucugcguccgcgaggucguccagccccuccgcaacaagaagaccgaccgccucgacgucgacucccucuucuccaacaucgaguccguccaccagaucuccgccaagcuccucucccuccucgaggaggccaccaccgacgucgagcccgccaugcaggucaucggcgaggucuuccuccagaucaagggcccccucgaggacaucuacaagaucuacugcuaccaccacgacgaggcccacuccauccucgaguccuacgagaaggaggaggagcucaaggagcaccucucccacugcauccagucccucaagaagaucuacaugcaggagggcaagcccaaccuccucgacaugggcucccucaugaucaagcccauccagcgcgucaugaaguacccccuccuccucugcgagcuccgcaacuccaccccccccucccaccccgacuaccgcgcccucgacgacgccuucgccgccgucaaggacaucaacgucaacaucaacgagcucaagcgccgcaaggaccucguccucaaguacaagaagaacgacgaggacgagucccucaaggacaagcucuccaagcucaacauccacuccaucuccaagaaguccaagcgcgucaccaaccaccucaagauccucacccgcggcgagucccaggucaaggacaacaccuucaaccgcgaggagaagcucuuccgcgcccucgagaagaccguccgccucugcgucaagaacaucucccucugccuccagcacauccaggacgccaugccccucgcccuccaguccgucauggaccuccaggagaucuccuacaacaaggacgacgagauggacuacuccgagacccucuccaacgcccucaacuccugccacgacuucgccucccaccuccagcgccucauccucaccccccucuccgcccuccucucccucuuccccggcccccacaagcucauccagaagcgcuacgacaagcuccucgacugcaacuccuaccuccagcgcuccaccggcgaggaguccgaccucgccaagaaggaguacgaggcccucaacgcccagcucgucgaggagcuccaggccuucaaccaggccgcccgcaagauccuccucaacugccucugcuccuucaucacccuccuccgcgaccucaugcucgucgcccagcaggccuacuccacccucguccccaugccccuccucgucuccuccaucuccgagauccagaaccagguccucgaggagauccagaaccucaacugcgucaaggagaacuccgccaccuucaucgagcgcaagcucuccuucgagaagaagaagcccguccagauccuccccgagaugccccaccagaccgacauccaccgcuccaagcuccucuccaccuacuccgccgaggagcucuaccaggccaagcgcaagugcaacgccacccaggaguacgacaucaaccuccucgagggcgaccucgucgccgucaucgagcagaaggacccccucggcuccaccucccgcuggcucgucgacaccggcaacgucaagggcuacgucuacuccuccuuccucaagcccuacaaccccgccaagaugcagaaggucgacgccgagaaccgcuucugcgacgacgacuucgagaacaucucccucuucgucuccucccgccccgccuccgacuccgucaccggcaccuccgaguccuccaucggcgacuccuccuccucccucuccggcaccugcggcaaguucgagaccaacggcaccgacgucgacuccuuccaggaggucgacgagcagaucuucuacgccguccacgccuuccaggcccgcuccgaccacgagcucucccuccaggaguaccagcgcguccacauccuccgcuucugcgaccucuccggcaacaaggagugguggcucgccgaggcccagggccagaagggcuacguccccgccaacuaccucggcaagaugaccuacgccuga

SEQ ID NO: 39915 - RNA, 1677 nt, Artificial Sequence
  derived and/or modified sequence opt2 from ARHGEF3__Homo_sapiens__NP_001122087
auggacuccuccaccgccaugaaccagugcuccugccgcggcauggaggagaacaaggagcgccccaagcgccagcgccagaacaacuuccccauguuccccucccccaaggccuggaacuuccgcggccgcaagcgcaagcaguccacccaggacgaggacgccgucucccucugcucccucgacaucuccgagcccuccaacaagcgcgucaagccccucucccgcgucaccucccucgccaaccucaucccccccgucaaggccaccccccucaagcgcuucucccagacccuccagcgcuccaucuccuuccgcuccgagucccgccccgacauccucgccccccgccccuggucccgcaacgccgcccccuccuccaccaagcgccgcgacuccaagcucugguccgagaccuucgacgucugcgucaaccagaugcucaccuccaaggagaucaagcgccaggaggccaucuucgagcucucccagggcgaggaggaccucaucgaggaccucaagcucgccaagaaggccuaccacgaccccaugcucaagcucuccaucaugaccgagcaggagcucaaccagaucuucggcacccucgacucccucaucccccuccacgaggagcuccucucccagcuccgcgacguccgcaagcccgacggcuccaccgagcacgucggccccauccucgucggcuggcuccccugccucuccuccuacgacuccuacugcuccaaccaggucgccgccaaggcccuccucgaccacaagaagcaggaccaccgcguccaggacuuccuccagcgcugccucgagucccccuucucccgcaagcucgaccucuggaacuuccucgacaucccccgcucccgccucgucaaguacccccuccuccuccgcgagauccuccgccacacccccaacgacaaccccgaccagcagcaccucgaggaggccaucaacaucauccagggcaucgucgccgagaucaacaccaagaccggcgaguccgagugccgcuacuacaaggagcgccuccucuaccucgaggagggccagaaggacucccucaucgacuccucccgcguccucugcugccacggcgagcucaagaacaaccgcggcgucaagcuccacgucuuccucuuccaggagguccucgucaucacccgcgccgucacccacaacgagcagcucugcuaccagcucuaccgccagcccauccccgucaaggaccuccuccucgaggaccuccaggacggcgagguccgccucggcggcucccuccgcggcgccuucuccaacaacgagcgcaucaagaacuucuuccgcgucuccuucaagaacggcucccagucccagacccacucccuccaggccaacgacaccuucaacaagcagcaguggcucaacugcauccgccaggccaaggagaccguccucugcgccgccggccaggccggcguccucgacuccgagggcuccuuccucaaccccaccaccggcucccgcgagcuccagggcgagaccaagcucgagcagauggaccaguccgacuccgaguccgacugcuccauggacaccuccgaggucucccucgacugcgagcgcauggagcagaccgacuccuccugcggcaacucccgccacggcgaguccaacgucuga

SEQ ID NO: 39916 - RNA, 2073 nt, Artificial Sequence
  derived and/or modified sequence opt2 from ARHGEF4__Homo_sapiens__NP_056135
augcccugggaggagcccgccggcgagaagcccuccugcucccacucccagaaggccuuccacauggagcccgcccagaagcccugcuucaccaccgacauggucaccugggcccuccucugcaucuccgccgagaccguccgcggcgaggcccccucccagccccgcggcaucccccaccgcucccccgucuccgucgacgaccucuggcucgagaagacccagcgcaagaagcuccagaagcaggcccacgucgagcgccgccuccacaucggcgccguccacaaggacggcgucaagugcuggcgcaagaccaucaucaccucccccgagucccucaaccucccccgccgcucccacccccucucccaguccgcccccaccggccucaaccacaugggcuggcccgagcacacccccggcaccgccaugcccgacggcgcccucgacaccgccgucugcgccgacgaggucggcuccgaggaggaccucuacgacgaccuccacuccuccucccaccacuacucccaccccggcggcggcggcgagcagcucgccaucaacgagcucaucuccgacggcuccgucgucugcgccgaggcccucugggaccacgucaccauggacgaccaggagcucggcuucaaggccggcgacgucaucgaggucauggacgccaccaaccgcgaguggugguggggccgcgucgccgacggcgagggcugguuccccgccuccuucguccgccuccgcgucaaccaggacgagcccgccgacgacgacgccccccucgccggcaacuccggcgccgaggacggcggcgccgaggcccaguccuccaaggaccagaugcgcaccaacgucaucaacgagauccucuccaccgagcgcgacuacaucaagcaccuccgcgacaucugcgagggcuacguccgccagugccgcaagcgcgccgacauguucuccgaggagcagcuccgcaccaucuucggcaacaucgaggacaucuaccgcugccagaaggccuucgucaaggcccucgagcagcgcuucaaccgcgagcgcccccaccucuccgagcucggcgccugcuuccucgagcaccaggccgacuuccagaucuacuccgaguacugcaacaaccaccccaacgccugcgucgagcucucccgccucaccaagcucuccaaguacgucuacuucuucgaggccugccgccuccuccagaagaugaucgacaucucccucgacggcuuccuccucacccccguccagaagaucugcaaguacccccuccagcucgccgagcuccucaaguacacccacccccagcaccgcgacuucaaggacgucgaggccgcccuccacgccaugaagaacgucgcccagcucaucaacgagcgcaagcgccgccucgagaacaucgacaagaucgcccaguggcaguccuccaucgaggacugggagggcgaggaccuccucguccgcuccuccgagcucaucuacuccggcgagcucacccgcgucacccagccccaggccaagucccagcagcgcauguucuuccucuucgaccaccagcucaucuacugcaagaaggaccuccuccgccgcgacguccucuacuacaagggccgccucgacauggacggccucgaggucgucgaccucgaggacggcaaggaccgcgaccuccacgucuccaucaagaacgccuuccgccuccaccgcggcgccaccggcgacucccaccuccucugcacccgcaagcccgagcagaagcagcgcuggcucaaggccuucgcccgcgagcgcgagcagguccagcucgaccaggagaccggcuucuccaucaccgagcuccagcgcaagcaggccaugcucaacgccuccaagcagcaggucaccggcaagcccaaggccgucggccgccccugcuaccucacccgccagaagcaccccgcccuccccuccaaccgcccccagcagcagguccucguccucgccgagccccgccgcaagcccuccaccuucuggcacuccaucucccgccucgcccccuuccgcaaguga

SEQ ID NO: 39917 - RNA, 4794 nt, Artificial Sequence
  derived and/or modified sequence opt2 from ARHGEF5__Homo_sapiens__NP_005426
auggaggccgaggaggcccagcgcggcgccuccccccccaucuccgccaucgaggaguucuccaucauccccgaggcccccaugcgcuccucccaggucuccgcccucggccucgaggcccaggaggacgaggaccccuccuacaaguggcgcgaggagcaccgccucuccgccacccagcaguccgagcuccgcgacgucugcgacuacgccaucgagaccaugcccuccuuccccaaggagggcuccgccgacgucgagcccaaccaggagucccucgucgccgaggccugcgacacccccgagcacugggaggccgucccccagucccucgccggccgccaggcccgcacccucgccccccccgagcucugggccugccccauccaguccgagcaccucgacauggcccccuucuccuccgaccucggcuccgaggaggaggaggucgaguucuggcccggccucaccucccucacccucggcuccggccaggccgaggaggaggaggagaccuccuccgacaacuccggccagacccgcuacuacucccccugcgaggagcaccccgccgagaccaaccagaacgagggcuccgaguccggcaccauccgccagggcgaggagcucccccccgaggagcuccaggagucccagggccuccuccacccccaggagguccagguccucgaggagcagggccagcaggaggccggcuuccgcggcgagggcacccuccgcgaggacgucugcgccgacggccuccucggcgaggagcagaugaucgagcaggucaacgacgagaagggcgagcagaagcagaagcaggagcagguccaggacgucaugcucggccgccagggcgagcgcaugggccucaccggcgagcccgagggccucaacgacggcgagugggagcaggaggacauggagcgcaaggcccagggccagggcggccccgagcagggcgaggagcgcaagcgcgagcuccagguccccgaggagaaccgcgccgacucccaggacgagaagucccagaccuuccucggcaaguccgaggaggucaccggcaagcaggaggaccacggcaucaaggagaagggcguccccgucuccggccaggaggccaaggagcccgaguccugggacggcggccgccucggcgccgucggccgcgcccgcucccgcgaggaggagaacgagcaccacggccccuccaugcccgcccucaucgcccccgaggacuccccccacugcgaccucuuccccggcgccuccuaccucaugacccagauccccggcacccagaccgagucccgcgccgaggagcucucccccgccgcccucucccccucccucgagcccauccgcugcucccaccagcccaucucccuccucggcuccuuccucaccgaggagucccccgacaaggagaucgaccagaacucccagcaggaggagucccgccuccgcaagggcaccgucuccucccagggcaccgaggucgucuucgccuccgccuccgucacccccccccgcacccccgacuccgccccccccucccccgccgaggccuaccccaucacccccgccuccgucuccgcccgcccccccgucgccuucccccgccgcgagaccuccugcgccgcccgcgcccccgagaccgccuccgccccccucuccauggacgaccccucccccugcggcaccuccgagaugugccccgccgcccucuacggcuuccccuccaccggcaccucccccccccgcccccccgccaacuccaccggcaccguccagcaccuccgcuccgacuccuuccccggcucccaccgcaccgagcagacccccgaccucgucggcaugcuccucuccuacucccacuccgagcucccccagcgcccccccaagcccgccaucuacuccuccgucaccccccgccgcgaccgccgcuccggccgcgacuacuccaccgucuccgccucccccaccgcccucuccacccucaagcaggacucccaggaguccaucuccaaccucgagcgccccuccuccccccccuccauccagcccugggucuccccccacaaccccgccuucgccaccgagucccccgccuacggcuccucccccuccuucgucuccauggaggacguccgcauccacgagccccucccccccccccccccccagcgccgcgacacccaccccuccgucgucgagaccgacggccacgcccgcgucgucguccccacccucaagcagcacucccacccccccccccucgcccucggcuccggccuccacgccccccacaagggcccccucccccaggccuccgaccccgccgucgcccgccagcaccgcccccuccccuccacccccgacuccucccaccacgcccaggccaccccccgcuggcgcuacaacaagccccucccccccacccccgaccucccccagccccaccucccccccaucuccgcccccggcuccucccgcaucuaccgcccccuccccccccuccccaucaucgacccccccaccgagccccccccccucccccccaagucccgcggccgcucccgcuccacccgcggcggccacaugaacuccggcggccacgccaagacccgccccgccugccaggacuggaccgucccccuccccgccuccgccggccgcaccuccuggccccccgccaccgcccgcuccaccgaguccuucaccuccaccucccgcuccaaguccgaggucucccccggcauggccuucuccaacaugaccaacuuccucugccccuccucccccaccacccccuggacccccgagcuccagggccccaccuccaaggacgaggccggcgucuccgagcaccccgaggcccccgcccgcgagccccuccgccgcaccaccccccagcagggcgccuccggccccggccgcucccccgucggccaggcccgccagcccgagaagcccucccaccuccaccucgagaaggccuccuccuggccccaccgccgcgacuccggccgcccccccggcgacuccuccggccaggccgucgcccccuccgagggcgccaacaagcacaagggcuggucccgccagggccuccgccgccccuccauccuccccgagggcuccuccgacucccgcggccccgccgucgagaagcaccccggccccuccgacaccgucgucuuccgcgagaagaagcccaaggaggucaugggcggcuucucccgccgcugcuccaagcucaucaacuccucccagcuccucuaccaggaguacuccgacgucguccucaacaaggagauccagucccagcagcgccucgagucccucuccgagacccccggccccuccuccccccgccagccccgcaaggcccucgucuccuccgaguccuaccuccagcgccucuccauggccuccuccggcucccucuggcaggagauccccgucguccgcaacuccaccguccuccucuccaugacccacgaggaccagaagcuccaggaggucaaguucgagcucaucgucuccgaggccuccuaccuccgcucccucaacaucgccgucgaccacuuccagcucuccaccucccuccgcgccacccucuccaaccaggagcaccaguggcucuucucccgccuccaggacguccgcgacgucuccgccaccuuccucuccgaccucgaggagaacuucgagaacaacaucuucuccuuccaggucugcgacgucguccucaaccacgcccccgacuuccgccgcgucuaccuccccuacgucaccaaccagaccuaccaggagcgcaccuuccagucccucaugaacuccaacuccaacuuccgcgagguccucgagaagcucgaguccgaccccgucugccagcgccucucccucaaguccuuccucauccuccccuuccagcgcaucacccgccucaagcuccuccuccagaacauccucaagcgcacccagcccggcuccuccgaggaggccgaggccaccaaggcccaccacgcccucgagcagcucauccgcgacugcaacaacaacguccaguccaugcgccgcaccgaggagcucaucuaccucucccagaagaucgaguucgagugcaagaucuucccccucaucucccagucccgcuggcucgucaaguccggcgagcucaccgcccucgaguucuccgccucccccggccuccgccgcaagcucaacacccgccccguccaccuccaccucuucaacgacugccuccuccucucccgcccccgcgagggcucccgcuuccucgucuucgaccacgcccccuucuccuccauccgcggcgagaagugcgagaugaagcuccacggcccccacaagaaccucuuccgccucuuccuccgccagaacacccagggcgcccaggccgaguuccucuuccgcaccgagacccaguccgagaagcuccgcuggaucuccgcccucgccaugccccgcgaggagcucgaccuccucgagugcuacaacuccccccagguccagugccuccgcgccuacaagccccgcgagaacgacgagcucgcccucgagaaggccgacgucgucauggucacccagcaguccuccgacggcuggcucgagggcguccgccucuccgacggcgagcgcggcugguuccccguccagcaggucgaguucaucuccaaccccgagguccgcgcccagaaccucaaggaggcccaccgcgucaagaccgccaagcuccagcucgucgagcagcaggccuga

SEQ ID NO: 39918 - RNA, 2331 nt, Artificial Sequence
  derived and/or modified sequence opt2 from ARHGEF6__Homo_sapiens__NP_004831
augaaccccgaggagcagaucgucaccuggcucaucucccucggcguccucgagucccccaagaagaccaucugcgaccccgaggaguuccucaaguccucccucaagaacggcgucguccucugcaagcucaucaaccgccucaugcccggcuccgucgagaaguucugccucgacccccagaccgaggccgacugcaucaacaacaucaacgacuuccucaagggcugcgccacccuccaggucgagaucuucgaccccgacgaccucuacuccggcgucaacuucuccaagguccucuccacccuccucgccgucaacaaggccaccgaggaccagcucuccgagcgccccugcggccgcuccuccucccucuccgccgccaacaccucccagaccaacccccagggcgccgucuccuccaccgucuccggccuccagcgccaguccaagaccgucgagaugaccgagaacggcucccaccagcucaucgucaaggcccgcuucaacuucaagcagaccaacgaggacgagcucuccgucugcaagggcgacaucaucuacgucacccgcgucgaggagggcggcuggugggagggcacccucaacggccgcaccggcugguuccccuccaacuacguccgcgagaucaaguccuccgagcgcccccucucccccaaggccgucaagggcuucgagaccgccccccucaccaagaacuacuacaccgucguccuccagaacauccucgacaccgagaaggaguacgccaaggagcuccagucccuccucgucaccuaccuccgcccccuccaguccaacaacaaccucuccaccgucgaggucaccucccuccucggcaacuucgaggaggucugcaccuuccagcagacccucugccaggcccucgaggagugcuccaaguuccccgagaaccagcacaaggucggcggcugccuccucucccucaugccccacuucaaguccauguaccucgccuacugcgccaaccaccccuccgccgucaacguccucacccagcacuccgacgagcucgagcaguucauggagaaccagggcgccuccucccccggcauccucauccucaccaccaaccucuccaagcccuucaugcgccucgagaaguacgucacccuccuccaggagcucgagcgccacauggaggacacccaccccgaccaccaggacauccucaaggccaucgucgccuucaagacccucaugggccagugccaggaccuccgcaagcgcaagcagcucgagcuccagauccucuccgagcccauccaggccugggagggcgaggacaucaagaaccucggcaacgucaucuucaugucccaggucaugguccaguacggcgccugcgaggagaaggaggagcgcuaccucaugcucuucuccaacguccucaucaugcucuccgccuccccccgcauguccggcuucaucuaccagggcaagauccccaucgccggcaccgucgucacccgccucgacgagaucgagggcaacgacugcaccuucgagaucaccggcaacaccgucgagcgcaucgucguccacugcaacaacaaccaggacuuccaggaguggcucgagcagcucaaccgccucauccgcggccccgccuccugcuccucccucuccaagaccuccuccuccuccugcuccgcccacuccuccuucuccuccaccggccagccccgcggcccccucgagcccccccagaucaucaagcccuggucccucuccugccuccgccccgcccccccccuccgccccuccgccgcccucggcuacaaggagcgcauguccuacauccucaaggaguccuccaagucccccaagaccaugaagaaguuccuccacaagcgcaagaccgagcgcaagcccuccgaggaggaguacgucauccgcaaguccaccgccgcccucgaggaggacgcccagauccucaaggucaucgaggccuacugcaccuccgccaacuuccagcagggccacggcuccuccacccgcaaggacuccaucccccagguccuccuccccgaggaggagaagcucaucaucgaggagacccgcuccaacggccagaccaucauggaggagaagucccucgucgacaccgucuacgcccucaaggacgagguccgcgagcucaagcaggagaacaagcgcaugaagcagugccucgaggaggagcucaagucccgccgcgaccucgagaagcucguccgccgccuccucaagcagaccgacgagugcauccgcggcgaguccuccuccaagaccuccauccuccccuga

SEQ ID NO: 39919 - RNA, 2412 nt, Artificial Sequence
  derived and/or modified sequence opt2 from ARHGEF7__Homo_sapiens__NP_001106983
augaacuccgccgagcagaccgucaccuggcucaucacccucggcguccucgagucccccaagaagaccaucuccgaccccgagggcuuccuccaggccucccucaaggacggcgucguccucugccgccuccucgagcgccuccuccccggcaccaucgagaaggucuaccccgagccccgcuccgaguccgagugccucuccaacauccgcgaguuccuccgcggcugcggcgccucccuccgccucgagcuccucuucccccccucccagcccccccagcaccucgucaccaccauccuccucuccgccuccaccuucgacgccaacgaccucuaccagggccagaacuucaacaagguccucuccucccucgucacccucaacaaggucaccgccgacaucggccucggcuccgacuccgucugcgcccgccccuccucccaccgcaucaaguccuucgacucccucggcucccagucccuccacacccgcaccuccaagcucuuccagggccaguaccgcucccucgacaugaccgacaacuccaacaaccagcucgucguccgcgccaaguucaacuuccagcagaccaacgaggacgagcucuccuucuccaagggcgacgucauccacgucacccgcgucgaggagggcggcuggugggagggcacccucaacggccgcaccggcugguuccccuccaacuacguccgcgaggucaaggccuccgagaagcccgucucccccaaguccggcacccucaaguccccccccaagggcuucgacaccaccgccaucaacaaguccuacuacaacgucguccuccagaacauccucgagaccgagaacgaguacuccaaggagcuccagaccguccucuccaccuaccuccgcccccuccagaccuccgagaagcucuccuccgccaacaucuccuaccucaugggcaaccucgaggagaucugcuccuuccagcagaugcucguccagucccucgaggagugcaccaagcuccccgaggcccagcagcgcgucggcggcugcuuccucaaccucaugccccagaugaagacccucuaccucaccuacugcgccaaccaccccuccgccgucaacguccucaccgagcacuccgaggagcucggcgaguucauggagaccaagggcgccuccucccccggcauccucguccucaccaccggccucuccaagcccuucaugcgccucgacaaguaccccacccuccucaaggagcucgagcgccacauggaggacuaccacaccgaccgccaggacauccagaaguccauggccgccuucaagaaccucuccgcccagugccaggagguccgcaagcgcaaggagcucgagcuccagauccucaccgaggccauccgcaacugggagggcgacgacaucaagacccucggcaacgucaccuacaugucccagguccucauccagugcgccggcuccgaggagaagaacgagcgcuaccuccuccucuuccccaacguccuccucaugcucuccgccuccccccgcauguccggcuucaucuaccagggcaagcuccccaccaccggcaugaccaucaccaagcucgaggacuccgagaaccaccgcaacgccuucgagaucuccggcuccaugaucgagcgcauccucgucuccugcaacaaccagcaggaccuccaggagugggucgagcaccuccagaagcagaccaaggucaccuccgucggcaaccccaccaucaagccccacuccguccccucccacacccuccccucccaccccgucacccccuccuccaagcacgccgacuccaagcccgccccccucacccccgccuaccacacccucccccaccccucccaccacggcaccccccacaccaccaucaacuggggcccccucgagccccccaagacccccaagcccuggucccucuccugccuccgccccgcccccccccuccgccccuccgccgcccucugcuacaaggaggaccucuccaagucccccaagaccaugaagaagcuccuccccaagcgcaagcccgagcgcaagcccuccgacgaggaguucgccucccgcaaguccaccgccgcccucgaggaggacgcccagauccucaaggucaucgaggccuacugcaccuccgccaagacccgccagacccucaacuccaccuggcagggcaccgaccucaugcacaaccacguccucgccgacgacgaccagcccucccucgacucccucggccgccgcuccucccucucccgccucgagcccuccgaccucuccgaggacuccgacuacgacuccaucuggaccgcccacuccuaccgcaugggcuccaccucccgcaaguccugcugcuccuacaucucccaccagaacuga

SEQ ID NO: 39920 - RNA, 1392 nt, Artificial Sequence
  derived and/or modified sequence opt2 from ARHGEF9__Homo_sapiens__NP_001166950
augcaguggauccgcggcggcuccggcaugcucugggucaaccaggaggacgaggucgaggagggccccuccgacguccagaacggccaccucgaccccaacuccgacugccucugccucggccgcccccuccagaaccgcgaccagaugcgcgccaacgucaucaacgagaucauguccaccgagcgccacuacaucaagcaccucaaggacaucugcgagggcuaccucaagcagugccgcaagcgccgcgacauguucuccgacgagcagcucaaggucaucuucggcaacaucgaggacaucuaccgcuuccagaugggcuucguccgcgaccucgagaagcaguacaacaacgacgacccccaccucuccgagaucggccccugcuuccucgagcaccaggacggcuucuggaucuacuccgaguacugcaacaaccaccucgacgccugcauggagcucuccaagcucaugaaggacucccgcuaccagcacuucuucgaggccugccgccuccuccagcagaugaucgacaucgccaucgacggcuuccuccucacccccguccagaagaucugcaaguacccccuccagcucgccgagcuccucaaguacaccgcccaggaccacuccgacuaccgcuacgucgccgccgcccucgccgucaugcgcaacgucacccagcagaucaacgagcgcaagcgccgccucgagaacaucgacaagaucgcccaguggcaggccuccguccucgacugggagggcgaggacauccucgaccgcuccuccgagcucaucuacaccggcgagauggccuggaucuaccagcccuacggccgcaaccagcagcgcgucuucuuccucuucgaccaccagaugguccucugcaagaaggaccucauccgccgcgacauccucuacuacaagggccgcaucgacauggacaaguacgaggucgucgacaucgaggacggccgcgacgacgacuucaacgucuccaugaagaacgccuucaagcuccacaacaaggagaccgaggagauccaccucuucuucgccaagaagcucgaggagaagauccgcuggcuccgcgccuuccgcgaggagcgcaagaugguccaggaggacgagaagaucggcuucgagaucuccgagaaccagaagcgccaggccgccaugaccguccgcaagguccccaagcagaagggcgucaacuccgcccgcuccgucccccccuccuacccccccccccaggacccccucaaccacggccaguaccucguccccgacggcaucgcccagucccaggucuucgaguucaccgagcccaagcgcucccagucccccuucuggcagaacuucucccgccucacccccuucaagaaguga

SEQ ID NO: 39921 - RNA, 2763 nt, Artificial Sequence
  derived and/or modified sequence opt2 from AR__Homo_sapiens__NP_000035
auggagguccagcucggccucggccgcgucuacccccgcccccccuccaagaccuaccgcggcgccuuccagaaccucuuccaguccguccgcgaggucauccagaaccccggcccccgccaccccgaggccgccuccgccgccccccccggcgccucccuccuccuccuccagcagcagcagcagcagcagcagcagcagcagcagcagcagcagcagcagcagcagcagcagcagcaggagaccuccccccgccagcagcagcagcagcagggcgaggacggcuccccccaggcccaccgccgcggccccaccggcuaccucguccucgacgaggagcagcagcccucccagccccaguccgcccucgagugccaccccgagcgcggcugcguccccgagcccggcgccgccgucgccgccuccaagggccucccccagcagcuccccgccccccccgacgaggacgacuccgccgcccccuccacccucucccuccucggccccaccuuccccggccucuccuccugcuccgccgaccucaaggacauccucuccgaggccuccaccaugcagcuccuccagcagcagcagcaggaggccgucuccgagggcuccuccuccggccgcgcccgcgaggccuccggcgcccccaccuccuccaaggacaacuaccucggcggcaccuccaccaucuccgacaacgccaaggagcucugcaaggccgucuccgucuccaugggccucggcgucgaggcccucgagcaccucucccccggcgagcagcuccgcggcgacugcauguacgccccccuccucggcgucccccccgccguccgccccacccccugcgccccccucgccgagugcaagggcucccuccucgacgacuccgccggcaaguccaccgaggacaccgccgaguacucccccuucaagggcggcuacaccaagggccucgagggcgagucccucggcugcuccggcuccgccgccgccggcuccuccggcacccucgagcuccccuccacccucucccucuacaaguccggcgcccucgacgaggccgccgccuaccagucccgcgacuacuacaacuucccccucgcccucgccggccccccccccccccccccccccccccacccccacgcccgcaucaagcucgagaacccccucgacuacggcuccgccugggccgccgccgccgcccagugccgcuacggcgaccucgccucccuccacggcgccggcgccgccggccccggcuccggcucccccuccgccgccgccuccuccuccuggcacacccucuucaccgccgaggagggccagcucuacggccccugcggcggcggcggcggcggcggcggcggcggcggcggcggcggcggcggcggcggcggcggcggcggcggcgaggccggcgccgucgcccccuacggcuacacccgccccccccagggccucgccggccaggaguccgacuucaccgcccccgacgucugguaccccggcggcauggucucccgcguccccuaccccucccccaccugcgucaaguccgagaugggccccuggauggacuccuacuccggccccuacggcgacaugcgccucgagaccgcccgcgaccacguccuccccaucgacuacuacuuccccccccagaagaccugccucaucugcggcgacgaggccuccggcugccacuacggcgcccucaccugcggcuccugcaaggucuucuucaagcgcgccgccgagggcaagcagaaguaccucugcgccucccgcaacgacugcaccaucgacaaguuccgccgcaagaacugccccuccugccgccuccgcaagugcuacgaggccggcaugacccucggcgcccgcaagcucaagaagcucggcaaccucaagcuccaggaggagggcgaggccuccuccaccaccucccccaccgaggagaccacccagaagcucaccgucucccacaucgagggcuacgagugccagcccaucuuccucaacguccucgaggccaucgagcccggcgucgucugcgccggccacgacaacaaccagcccgacuccuucgccgcccuccucuccucccucaacgagcucggcgagcgccagcucguccacgucgucaagugggccaaggcccuccccggcuuccgcaaccuccacgucgacgaccagauggccgucauccaguacuccuggaugggccucauggucuucgccaugggcuggcgcuccuucaccaacgucaacucccgcaugcucuacuucgcccccgaccucgucuucaacgaguaccgcaugcacaagucccgcauguacucccagugcguccgcaugcgccaccucucccaggaguucggcuggcuccagaucaccccccaggaguuccucugcaugaaggcccuccuccucuucuccaucauccccgucgacggccucaagaaccagaaguucuucgacgagcuccgcaugaacuacaucaaggagcucgaccgcaucaucgccugcaagcgcaagaaccccaccuccugcucccgccgcuucuaccagcucaccaagcuccucgacuccguccagcccaucgcccgcgagcuccaccaguucaccuucgaccuccucaucaagucccacauggucuccgucgacuuccccgagaugauggccgagaucaucuccguccagguccccaagauccucuccggcaaggucaagcccaucuacuuccacacccaguga

SEQ ID NO: 39922 - RNA, 6711 nt, Artificial Sequence
  derived and/or modified sequence opt2 from ARID1B__Homo_sapiens__NP_059989
auggcccacaacgccggcgccgccgccgccgccggcacccacuccgccaaguccggcggcuccgaggccgcccucaaggagggcggcuccgccgccgcccucuccuccuccuccuccuccuccgccgccgccgccgccgccuccuccuccuccuccuccggccccggcuccgccauggagaccggccuccuccccaaccacaagcucaagaccgucggcgaggcccccgccgcccccccccaccagcagcaccaccaccaccaccacgcccaccaccaccaccaccacgcccaccaccuccaccaccaccacgcccuccagcagcagcucaaccaguuccagcagcagcagcagcagcagcagcagcagcagcagcagcagcagcagcagcagcaccccaucuccaacaacaacucccucggcggcgccggcggcggcgccccccagcccggccccgacauggagcagccccagcacggcggcgccaaggacuccgccgccggcggccaggccgacccccccggccccccccuccucuccaagcccggcgacgaggacgacgccccccccaagaugggcgagcccgccggcggccgcuacgagcaccccggccucggcgcccucggcacccagcagccccccgucgccguccccggcggcggcggcggccccgccgccguccccgaguucaacaacuacuacggcuccgccgcccccgccuccggcggccccggcggccgcgccggccccugcuucgaccagcacggcggccagcagucccccggcaugggcaugaugcacuccgccuccgccgccgccgccggcgcccccggcuccauggacccccuccagaacucccacgagggcuaccccaacucccagugcaaccacuaccccggcuacucccgccccggcgccggcggcggcggcggcggcggcggcggcggcggcggcggcuccggcggcggcggcggcggcggcggcgccggcgccggcggcgccggcgccggcgccgucgccgccgccgccgccgccgccgccgccgccgccggcggcggcggcggcggcggcuacggcggcuccuccgccggcuacggcguccucuccuccccccgccagcagggcggcggcaugaugaugggccccggcggcggcggcgccgccucccucuccaaggccgccgccggcuccgccgccggcggcuuccagcgcuucgccggccagaaccagcaccccuccggcgccacccccacccucaaccagcuccucaccucccccucccccaugaugcgcuccuacggcggcuccuaccccgaguacuccucccccuccgcccccccccccccccccucccagccccagucccaggccgccgccgccggcgccgccgccggcggccagcaggccgccgccggcaugggccucggcaaggacaugggcgcccaguacgccgccgccucccccgccugggccgccgcccagcagcgcucccaccccgccaugucccccggcacccccggccccaccaugggccgcucccagggcucccccauggaccccauggucaugaagcgcccccagcucuacggcaugggcuccaacccccacucccagccccagcaguccucccccuaccccggcggcuccuacggcccccccggcccccagcgcuaccccaucggcauccagggccgcacccccggcgccauggccggcaugcaguacccccagcagcagaugcccccccaguacggccagcagggcgucuccggcuacugccagcagggccagcagcccuacuacucccagcagccccagcccccccaccuccccccccaggcccaguaccuccccucccagucccagcagcgcuaccagccccagcaggacaugucccaggagggcuacggcacccgcucccagcccccccucgcccccggcaagcccaaccacgaggaccucaaccucauccagcaggagcgccccuccucccuccccgaccucuccggcuccaucgacgaccuccccaccggcaccgaggccacccucuccuccgccgucuccgccuccggcuccaccuccucccagggcgaccaguccaaccccgcccagucccccuucuccccccacgccuccccccaccucuccuccauccccggcggccccucccccucccccgucggcucccccgucggcuccaaccagucccgcuccggccccaucucccccgccuccauccccggcucccagaugcccccccagccccccggcucccaguccgaguccuccucccaccccgcccucucccagucccccaugccccaggagcgcggcuucauggccggcacccagcgcaacccccagauggcccaguacggcccccagcagaccggccccuccauguccccccaccccucccccggcggccagaugcacgccggcaucuccuccuuccagcaguccaacuccuccggcaccuacggcccccagaugucccaguacggcccccagggcaacuacucccgcccccccgccuacuccggcguccccuccgccuccuacuccggccccggccccggcaugggcaucuccgccaacaaccagaugcacggccagggccccucccagcccugcggcgccgucccccucggccgcaugcccuccgccggcaugcagaaccgccccuuccccggcaacauguccuccaugacccccuccucccccggcaugucccagcagggcggccccggcaugggcccccccaugcccaccgucaaccgcaaggcccaggaggccgccgccgccgucaugcaggccgccgccaacuccgcccagucccgccagggcuccuuccccggcaugaaccaguccggccucauggccuccuccucccccuacucccagcccaugaacaacuccuccucccucaugaacacccaggccccccccuacuccauggcccccgccauggucaacuccuccgccgccuccgucggccucgccgacaugaugucccccggcgaguccaagcucccccucccccucaaggccgacggcaaggaggagggcaccccccagcccgaguccaaguccaagaaguccuccuccuccaccaccaccggcgagaagaucaccaaggucuacgagcucggcaacgagcccgagcgcaagcucugggucgaccgcuaccucaccuucauggaggagcgcggcucccccgucuccucccuccccgccgucggcaagaagccccucgaccucuuccgccucuacgucugcgucaaggagaucggcggccucgcccaggucaacaagaacaagaaguggcgcgagcucgccaccaaccucaacgucggcaccuccuccuccgccgccuccucccucaagaagcaguacauccaguaccucuucgccuucgagugcaagaucgagcgcggcgaggagcccccccccgaggucuucuccaccggcgacaccaagaagcagcccaagcuccagccccccucccccgccaacuccggcucccuccagggcccccagaccccccaguccaccggcuccaacuccauggccgagguccccggcgaccucaagccccccacccccgccuccaccccccacggccagaugacccccaugcagggcggccgcuccuccaccaucuccguccacgaccccuucuccgacgucuccgacuccuccuuccccaagcgcaacuccaugacccccaacgcccccuaccagcagggcauguccaugcccgacgucaugggccgcaugcccuacgagcccaacaaggaccccuucggcggcaugcgcaagguccccggcuccuccgagcccuucaugacccagggccagaugcccaacuccuccaugcaggacauguacaaccagucccccuccggcgccauguccaaccucggcaugggccagcgccagcaguuccccuacggcgccuccuacgaccgccgccacgagcccuacggccagcaguaccccggccagggcccccccuccggccagccccccuacggcggccaccagcccggccucuacccccagcagcccaacuacaagcgccacauggacggcauguacggcccccccgccaagcgccacgagggcgacauguacaacaugcaguacuccucccagcagcaggagauguacaaccaguacggcggcuccuacuccggccccgaccgccgccccauccagggccaguaccccuaccccuacucccgcgagcgcaugcagggccccggccagauccagacccacggcauccccccccagaugaugggcggcccccuccaguccuccuccuccgagggcccccagcagaacaugugggccgcccgcaacgacaugcccuaccccuaccagaaccgccagggccccggcggccccacccaggccccccccuaccccggcaugaaccgcaccgacgacaugaugguccccgaccagcgcaucaaccacgagucccaguggcccucccacgucucccagcgccagcccuacauguccuccuccgccuccaugcagcccaucacccgccccccccagcccuccuaccagaccccccccucccuccccaaccacaucucccgcgcccccucccccgccuccuuccagcgcucccucgagaaccgcaugucccccuccaagucccccuuccuccccuccaugaagaugcagaaggucaugcccaccguccccaccucccaggucaccggcccccccccccagcccccccccauccgccgcgagaucaccuucccccccggcuccgucgaggccucccagcccguccucaagcagcgccgcaagaucaccuccaaggacaucgucacccccgaggccuggcgcgucaugaugucccucaaguccggccuccucgccgaguccaccugggcccucgacaccaucaacauccuccucuacgacgacuccaccgucgccaccuucaaccucucccagcucuccggcuuccucgagcuccucgucgaguacuuccgcaagugccucaucgacaucuucggcauccucauggaguacgaggucggcgaccccucccagaaggcccucgaccacaacgccgcccgcaaggacgacucccagucccucgccgacgacuccggcaaggaggaggaggacgccgagugcaucgacgacgacgaggaggacgaggaggacgaggaggaggacuccgagaagaccgaguccgacgagaaguccuccaucgcccucaccgcccccgacgccgccgccgaccccaaggagaagcccaagcaggccuccaaguucgacaagcuccccaucaagaucgucaagaagaacaaccucuucgucgucgaccgcuccgacaagcucggccgcguccaggaguucaacuccggccuccuccacuggcagcucggcggcggcgacaccaccgagcacauccagacccacuucgaguccaagauggagauccccccccgccgccgccccccccccccccucuccuccgccggccgcaagaaggagcaggagggcaagggcgacuccgaggagcagcaggagaaguccaucaucgccaccaucgacgacguccucuccgcccgccccggcgcccuccccgaggacgccaaccccggcccccagaccgaguccuccaaguuccccuucggcauccagcaggccaagucccaccgcaacaucaagcuccucgaggacgagccccgcucccgcgacgagaccccccucugcaccaucgcccacuggcaggacucccucgccaagcgcugcaucugcgucuccaacaucguccgcucccucuccuucguccccggcaacgacgccgagauguccaagcaccccggccucguccucauccucggcaagcucauccuccuccaccacgagcaccccgagcgcaagcgcgccccccagaccuacgagaaggaggaggacgaggacaagggcgucgccugcuccaaggacgagugguggugggacugccucgagguccuccgcgacaacacccucgucacccucgccaacaucuccggccagcucgaccucuccgccuacaccgaguccaucugccuccccauccucgacggccuccuccacuggauggucugccccuccgccgaggcccaggaccccuuccccaccgucggccccaacuccguccucuccccccagcgccucguccucgagacccucugcaagcucuccauccaggacaacaacgucgaccucauccucgccaccccccccuucucccgccaggagaaguucuacgccacccucguccgcuacgucggcgaccgcaagaaccccgucugccgcgagauguccauggcccuccucuccaaccucgcccagggcgacgcccucgccgcccgcgccaucgccguccagaagggcuccaucggcaaccucaucuccuuccucgaggacggcgucaccauggcccaguaccagcagucccagcacaaccucaugcacaugcagccccccccccucgagccccccuccgucgacaugaugugccgcgccgccaaggcccuccucgccauggcccgcgucgacgagaaccgcuccgaguuccuccuccacgagggccgccuccucgacaucuccaucuccgccguccucaacucccucgucgccuccgucaucugcgacguccucuuccagaucggccagcucuga

SEQ ID NO: 39923 - RNA, 5508 nt, Artificial Sequence
  derived and/or modified sequence opt2 from ARID2__Homo_sapiens__NP_689854
auggccaacuccaccggcaaggccccccccgacgagcgccgcaagggccucgccuuccucgacgagcuccgccaguuccaccacucccgcggcucccccuucaagaagauccccgccgucggcggcaaggagcucgaccuccacggccucuacacccgcgucaccacccucggcggcuucgccaaggucuccgagaagaaccaguggggcgagaucgucgaggaguucaacuucccccgcuccugcuccaacgccgccuucgcccucaagcaguacuaccuccgcuaccucgagaaguacgagaagguccaccacuucggcgaggacgacgacgaggucccccccggcaaccccaagccccagcuccccaucggcgccauccccuccuccuacaacuaccagcagcacuccgucuccgacuaccuccgccaguccuacggccucuccauggacuucaacucccccaacgacuacaacaagcucguccucucccuccucuccggccuccccaacgaggucgacuucgccaucaacgucugcacccuccucuccaacgaguccaagcacgucaugcagcucgagaaggaccccaagaucaucacccuccuccucgccaacgccggcgucuucgacgacacccucggcuccuucuccaccgucuucggcgaggaguggaaggagaagaccgaccgcgacuucgucaaguucuggaaggacaucgucgacgacaacgagguccgcgaccucaucuccgaccgcaacaagucccacgagggcaccuccggcgaguggaucugggagucccucuuccaccccccccgcaagcucggcaucaacgacaucgagggccagcgcguccuccagaucgccgucauccuccgcaaccucuccuucgaggagggcaacgucaagcuccucgccgccaaccgcaccugccuccgcuuccuccuccucuccgcccacucccacuucaucucccuccgccagcucggccucgacacccucggcaacaucgccgccgagcuccuccucgaccccgucgacuucaagaccacccaccucauguuccacaccgucaccaagugccucaugucccgcgaccgcuuccucaagaugcgcggcauggagauccucggcaaccucugcaaggccgaggacaacggcguccucaucugcgaguacgucgaccaggacuccuaccgcgagaucaucugccaccucacccuccccgacguccuccucgucaucuccacccucgagguccucuacaugcucaccgagaugggcgacgucgccugcaccaagaucgccaaggucgagaaguccaucgacaugcucgucugccucgucuccauggacauccagauguucggccccgacgcccucgccgccgucaagcucaucgagcaccccuccuccucccaccagaugcucuccgagauccgcccccaggccaucgagcagguccagacccagacccacgucgccuccgcccccgccucccgcgccgucgucgcccagcacgucgcccccccccccggcaucgucgagaucgacuccgagaaguucgccugccaguggcucaacgcccacuucgaggucaaccccgacugcuccgucucccgcgccgagauguacuccgaguaccucuccaccugcuccaagcucgcccgcggcggcauccucaccuccaccggcuucuacaagugccuccgcaccgucuuccccaaccacaccgucaagcgcgucgaggacuccuccuccaacggccaggcccacauccacgucgucggcgucaagcgccgcgccaucccccuccccauccagauguacuaccagcagcagcccgucuccaccuccgucguccgcgucgacuccguccccgacgucucccccgcccccucccccgccggcaucccccacggcucccagaccaucggcaaccacuuccagcgcacccccgucgccaaccaguccuccaaccucaccgccacccagauguccuuccccguccagggcguccacaccgucgcccagaccgucucccgcaucccccagaaccccuccccccacacccaccagcagcagaacgcccccgucaccgucauccaguccaaggcccccauccccugcgaggucgucaaggccaccgucauccagaacuccaucccccagaccggcguccccgucuccaucgccgucggcggcggccccccccaguccuccgucguccagaaccacuccaccggcccccagcccgucaccgucgucaacucccagacccuccuccaccaccccuccgucaucccccagcaguccccccuccacaccgucguccccggccagauccccuccggcacccccgucaccgucauccagcaggccgucccccagucccacauguucggccgcguccagaacauccccgccugcaccuccaccgucucccagggccagcagcucaucaccaccuccccccagcccguccagaccuccucccagcagaccuccgccggcucccagucccaggacaccgucaucaucgcccccccccaguacgucaccaccuccgccuccaacaucgucuccgccaccuccguccagaacuuccaggucgccaccggccagauggucaccaucgccggcguccccuccccccaggccucccgcgucggcuuccagaacaucgcccccaagccccuccccucccagcaggucuccuccaccgucguccagcagcccauccagcagccccagcagcccacccagcaguccgucgucaucgucucccagcccgcccagcagggccagaccuacgcccccgccauccaccagaucguccucgccaaccccgccgcccuccccgccggccagaccguccagcucaccggccagcccaacaucacccccuccuccucccccucccccguccccgccaccaacaaccagguccccaccgccauguccuccuccuccaccccccagucccagggccccccccccaccgucucccagaugcucuccgucaagcgccagcagcagcagcagcacucccccgccccccccccccagcagguccagguccagguccagcagccccagcagguccagaugcagguccagccccagcaguccaacgccggcgucggccagcccgccuccggcgaguccucccucaucaagcagcuccuccuccccaagcgcggccccuccacccccggcggcaagcucauccuccccgccccccagauccccccccccaacaacgcccgcgcccccuccccccaggucgucuaccaggucgccuccaaccaggccgccggcuucggcguccagggccagacccccgcccagcagcuccucgucggccagcagaacguccagcucguccccuccgccaugccccccuccggcggcguccagaccguccccaucuccaaccuccagauccuccccggcccccucaucuccaacucccccgccaccaucuuccagggcaccuccggcaaccaggucaccaucaccgucguccccaacaccuccuucgcccccgccaccgucucccagggcaacgccacccagcucaucgcccccgccggcaucaccauguccggcacccagaccggcgucggccuccccguccagacccuccccgccacccaggccucccccgccggccaguccuccugcaccaccgccaccccccccuucaagggcgacaagaucaucugccagaaggaggaggaggccaaggaggccaccggccuccacguccacgagcgcaagaucgaggucauggagaaccccuccugccgccgcggcgccaccaacaccuccaacggcgacaccaaggagaacgagaugcacgucggcucccuccucaacggccgcaaguacuccgacuccucccucccccccuccaacuccggcaagauccaguccgagaccaaccagugcucccucaucuccaacggccccucccucgagcucggcgagaacggcgccuccggcaagcagaacuccgagcagaucgacaugcaggacaucaaguccgaccuccgcaagccccucgucaacggcaucugcgacuucgacaagggcgacggcucccaccucuccaagaacauccccaaccacaagaccuccaaccacgucggcaacggcgagaucucccccauggagccccagggcacccucgacaucacccagcaggacaccgccaagggcgaccagcucgagcgcaucuccaacggccccguccucacccucggcggcuccuccgucuccuccauccaggaggccuccaacgccgccacccagcaguucuccggcaccgaccuccucaacggcccccucgccuccucccucaacuccgacgucccccagcagcgccccuccgucgucgucuccccccacuccaccaccuccgucauccagggccaccagaucaucgccguccccgacuccggcuccaaggucucccacucccccgcccucuccuccgacguccgcuccaccaacggcaccgccgagugcaagaccgucaagcgccccgccgaggacaccgaccgcgagaccgucgccggcauccccaacaaggucggcguccgcaucgucaccaucuccgaccccaacaacgccggcugcuccgccaccauggucgccguccccgccggcgccgaccccuccaccgucgccaaggucgccaucgaguccgccguccagcagaagcagcagcacccccccaccuacguccagaacgucgucccccagaacacccccaugccccccucccccgccguccagguccagggccagcccaacuccucccagcccucccccuucuccggcuccucccagcccggcgaccccaugcgcaagcccggccagaacuucaugugccucuggcaguccugcaagaagugguuccagacccccucccaggucuucuaccacgccgccaccgagcacggcggcaaggacgucuaccccggccagugccucugggagggcugcgagcccuuccagcgccagcgcuucuccuucaucacccaccuccaggacaagcacugcuccaaggacgcccuccucgccggccucaagcaggacgagcccggccaggccggcucccagaaguccuccaccaagcagcccaccgucggcggcaccuccuccaccccccgcgcccagaaggccaucgucaaccaccccuccgccgcccucauggcccuccgccgcggcucccgcaaccucgucuuccgcgacuucaccgacgagaaggagggccccaucaccaagcacauccgccucaccgccgcccucauccucaagaacaucggcaaguacuccgagugcggccgccgccuccucaagcgccacgagaacaaccucuccguccucgccaucuccaacauggaggccuccuccacccucgccaagugccucuacgagcucaacuucaccguccaguccaaggagcaggagaaggacuccgagaugcuccaguga

SEQ ID NO: 39924 - RNA, 1782 nt, Artificial Sequence
  derived and/or modified sequence opt2 from ARID3A__Homo_sapiens__NP_005215
augaagcuccaggccgucauggagacccuccuccagcgccagcagcgcgcccgccaggagcucgaggcccgccagcagcucccccccgacccccccgccgccccccccggccgcgcccgcgccgcccccgacgaggaccgcgagcccgaguccgcccgcaugcagcgcgcccagauggccgcccucgccgccaugcgcgccgccgccgccggccucggccaccccgccucccccggcggcuccgaggacggcccccccggcuccgaggaggaggacgccgcccgcgagggcacccccggcucccccggccgcggccgcgagggccccggcgaggagcacuucgaggacauggccuccgacgaggacaugaagcccaagugggaggaggaggagauggaggaggaccucggcgaggacgaggaggaggaggaggaggacuacgaggacgaggaggaggaggaggacgaggagggccucggcccccccggccccgccucccucggcaccaccgcccucuucccccgcaaggcccagcccccccaggccuuccgcggcgacggcgucccccgcguccucggcggccaggagcgccccggccccggccccgcccaccccggcggcgccgcccacgucgccccccagcuccagccccccgaccacggcgacuggaccuacgaggagcaguucaagcagcucuacgagcucgacggcgaccccaagcgcaaggaguuccucgacgaccucuucuccuucaugcagaagcgcggcacccccgucaaccgcauccccaucauggccaagcagguccucgaccucuucaugcucuacguccucgucaccgagaagggcggccucgucgaggucaucaacaagaagcucuggcgcgagaucaccaagggccucaaccuccccaccuccaucaccuccgccgccuucacccuccgcacccaguacaugaaguaccucuaccccuacgagugcgagaagcgcggccucuccaaccccaacgagcuccaggccgccaucgacuccaaccgccgcgagggccgccgccaguccuucggcggcucccucuucgccuacucccccggcggcgcccacggcaugcucuccucccccaagcuccccgucuccucccucggccucgccgccuccaccaacggcuccuccaucacccccgcccccaagaucaagaaggaggaggacuccgccauccccaucaccguccccggccgccuccccgucucccucgccggccaccccgucgucgccgcccaggccgccgccguccaggccgccgccgcccaggccgccgucgccgcccaggccgccgcccucgagcagcuccgcgagaagcucgaguccgccgagccccccgagaagaagauggcccucgucgccgacgagcagcagcgccucaugcagcgcgcccuccagcagaacuuccucgccauggccgcccagcuccccauguccauccgcaucaacucccaggccuccgagucccgccaggacuccgccgucaaccucaccggcaccaacggcuccaacuccaucuccauguccgucgagaucaacggcaucauguacaccggcguccucuucgcccagccccccgcccccacccccaccuccgcccccaacaagggcggcggcggcggcggcggcuccuccuccaacgccggcggccgcggcggcaacaccggcaccuccggcggccaggccggccccgccggccucuccacccccuccaccuccaccuccaacaacucccuccccuga

SEQ ID NO: 39925 - RNA, 1683 nt, Artificial Sequence
  derived and/or modified sequence opt2 from ARID3B__Homo_sapiens__NP_006456
auggagccccuccagcagcagcagcagcagcagcagcagcagcagaagcagccccaccucgccccccuccagauggacgcccgcgagaagcagggccagcagaugcgcgaggcccaguuccucuacgcccagaagcucgucacccagcccacccuccucuccgccaccgccggccgccccuccggcuccaccccccucggcccccucgcccgcgucccccccaccgccgccgucgcccaggucuucgagcgcggcaacaugaacuccgagcccgaggaggaggacggcggccucgaggacgaggacggcgacgacgaggucgccgaggucgccgagaaggagacccaggccgccuccaaguacuuccacguccagaaggucgcccgccaggacccccgcgucgcccccauguccaaccuccuccccgcccccggccuccccccccacggccagcaggccaaggaggaccacaccaaggacgccuccaaggccucccccuccgucuccaccgccggccagcccaacuggaaccucgacgagcagcucaagcagaacggcggccucgccugguccgacgacgccgacggcggccgcggccgcgagaucucccgcgacuucgccaagcucuacgagcucgacggcgaccccgagcgcaaggaguuccucgacgaccucuucgucuucaugcagaagcgcggcacccccaucaaccgcauccccaucauggccaagcagauccucgaccucuacaugcucuacaagcucgucaccgagaagggcggccucgucgagaucaucaacaagaagaucuggcgcgagaucaccaagggccucaaccuccccaccuccaucaccuccgccgccuucacccuccgcacccaguacaugaaguaccucuacgccuacgagugcgagaagaaggcccucuccucccccgccgagcuccaggccgccaucgacggcaaccgccgcgagggccgccgccccuccuacuccuccucccucuucggcuacucccccgccgccgccaccgccgccgccgccgccggcgcccccgcccuccucuccccccccaagauccgcuuccccauccucggccucggcuccuccuccggcaccaacaccuccuccccccgcaucucccccgccaccacccuccgcaagggcgacggcgcccccgucaccaccguccccguccccaaccgccucgccguccccgucacccucgccucccagcaggccggcacccgcaccgccgcccucgagcagcuccgcgagcgccucgaguccggcgagcccgccgagaagaaggccucccgccucuccgaggaggagcagcgccucguccagcaggccuuccagcgcaacuucuucuccauggcccgccagcuccccaugaagauccgcaucaacggccgcgaggaccgcgccgaggccuccgccgccgcccucaaccucaccaccuccuccaucggcuccaucaacauguccgucgacaucgacggcaccaccuacgccggcguccucuucgcccagaagcccgucguccaccucaucaccggcuccgccccccagucccucggcuccuccgccuccuccuccuccuccucccacugcucccccucccccaccuccucccgcggcacccccuccgccgagcccuccaccuccuggucccucuga

SEQ ID NO: 39926 - RNA, 3774 nt, Artificial Sequence
  derived and/or modified sequence opt2 from ARID4A__Homo_sapiens__NP_002883
augaaggccgccgacgagcccgccuaccucaccgucggcaccgacgucuccgccaaguaccgcggcgccuucugcgaggccaagaucaagaccgucaagcgccucgucaaggucaagguccuccucaagcaggacaacaccacccagcucguccaggacgaccaggucaagggcccccuccgcgucggcgccaucgucgagacccgcaccuccgacggcuccuuccaggaggccaucaucuccaagcucaccgacgccuccugguacaccgucgucuucgacgacggcgacgagcgcacccuccgccgcaccucccucugccucaagggcgagcgccacuucgccgaguccgagacccucgaccagcucccccucaccaaccccgagcacuucggcacccccgucaucgccaagaagaccaaccgcggccgccgcuccucccuccccgucaccgaggacgagaaggaggaggaguccuccgaggaggaggacgaggacaagcgccgccucaacgacgagcuccucggcaaggucgucuccgucgucuccgccaccgagcgcaccgagugguaccccgcccucgucaucucccccuccugcaacgacgacaucaccgucaagaaggaccagugccucguccgcuccuucaucgacuccaaguucuacuccaucgcccgcaaggacaucaaggaggucgacauccucaaccuccccgaguccgagcucuccaccaagcccggccuccagaaggccuccaucuuccucaagacccgcgucguccccgacaacuggaagauggacaucuccgagauccucgaguccuccuccuccgacgacgaggacggccccgccgaggagaacgacgaggagaaggagaaggaggccaagaagaccgaggaggagguccccgaggaggagcucgaccccgaggagcgcgacaacuuccuccagcagcucuacaaguucauggaggaccgcggcacccccaucaacaagccccccguccucggcuacaaggaccucaaccucuucaagcucuuccgccucgucuaccaccagggcggcugcgacaacaucgacuccggcgccgucuggaagcagaucuacauggaccucggcauccccauccucaacuccgccgccuccuacaacgucaagaccgccuaccgcaaguaccucuacggcuucgaggaguacugccgcuccgccaacauccaguuccgcaccguccaccaccacgagcccaaggucaaggaggagaagaaggaccucgaggaguccauggaggaggcccucaagcucgaccaggagaugccccucaccgaggucaaguccgagcccgaggagaacaucgacuccaacuccgaguccgagcgcgaggagaucgagcucaaguccccccgcggccgccgccgcaucgcccgcgacgucaacuccaucaagaaggagaucgaggaggagaagaccgaggacaagcucaaggacaacgacaccgagaacaaggacgucgacgacgacuacgagaccgccgagaagaaggagaacgagcuccuccucggccgcaagaacacccccaagcagaaggagaagaagaucaagaagcaggaggacuccgacaaggacuccgacgaggaggaggagaagucccaggagcgcgaggagaccgaguccaagugcgacuccgagggcgaggaggacgaggaggacauggagcccugccucaccggcaccaaggucaaggucaaguacggccgcggcaagacccagaagaucuacgaggccuccaucaaguccaccgagaucgacgacggcgagguccucuaccucguccacuacuacggcuggaacguccgcuacgacgagugggucaaggccgaccgcaucaucuggccccucgacaagggcggccccaagaagaagcagaagaagaaggccaagaacaaggaggacuccgagaaggacgagaagcgcgacgaggagcgccagaaguccaagcgcggccgccccccccucaaguccacccucuccuccaacaugcccuacggccucuccaagaccgccaacuccgagggcaaguccgacuccugcuccuccgacuccgagaccgaggacgcccucgagaagaaccucaucaacgaggagcucucccucaaggacgagcucgagaagaacgagaaccucaacgacgacaagcucgacgaggagaaccccaagaucuccgcccacauccucaaggagaacgaccgcacccagaugcagccccucgagacccucaagcucgaggucggcgagaacgagcagaucguccagaucuucggcaacaagauggagaagaccgaggaggucaagaaggaggccgagaagucccccaagggcaagggccgccgcuccaagaccaaggaccucucccucgagaucaucaagaucuccuccuucggccagaacgaggccggcuccgagccccacaucgaggcccacucccucgagcucuccucccucgacaacaagaacuucuccuccgccaccgaggacgagaucgaccagugcgucaaggagaagaagcucaagcgcaagauccucggccaguccucccccgagaagaagauccgcaucgagaacggcauggagaugaccaacaccgucucccaggagcgcaccuccgacugcaucggcuccgagggcaugaagaaccucaacuucgagcagcacuucgagcgcgagaacgagggcaugcccucccucaucgccgaguccaaccagugcauccagcagcucaccuccgagcgcuucgacucccccgccgaggagaccgucaacaucccccucaaggaggacgaggacgccaugccccucaucggccccgagacccucgucugccacgaggucgaccucgacgaccucgacgagaaggacaagaccuccaucgaggacgucgccgucgaguccuccgaguccaacucccucgucuccaucccccccgcccucccccccgucguccagcacaacuucuccgucgccuccccccucacccucucccaggacgagucccgcuccgucaaguccgaguccgacaucaccaucgaggucgacuccaucgccgaggagucccaggagggccucugcgagcgcgaguccgccaacggcuucgagaccaacgucgccuccggcaccugcuccaucaucguccaggagcgcgagucccgcgagaagggccagaagcgccccuccgacggcaacuccggccucauggccaagaagcagaagcgcacccccaagcgcaccuccgccgccgccaagaacgagaagaacggcaccggccaguccuccgacuccgaggaccuccccguccucgacaacuccuccaagugcacccccgucaagcaccucaacgucuccaagccccagaagcucgcccgcucccccgcccgcaucuccccccacaucaaggacggcgagaaggacaagcaccgcgagaagcaccccaacuccuccccccgcaccuacaagugguccuuccagcucaacgagcucgacaacaugaacuccaccgagcgcaucuccuuccuccaggagaagcuccaggagauccgcaaguacuacaugucccucaaguccgaggucgccaccaucgaccgccgccgcaagcgccucaagaagaaggaccgcgaggucucccacgccggcgccuccauguccuccgccuccuccgacaccggcaugucccccuccuccuccucccccccccagaacguccucgccgucgagugccgcuga

SEQ ID NO: 39927 - RNA, 3939 nt, Artificial Sequence
  derived and/or modified sequence opt2 from ARID4B__Homo_sapiens__NP_057458
augaaggcccucgacgagccccccuaccucaccgucggcaccgacgucuccgccaaguaccgcggcgccuucugcgaggccaagaucaagaccgccaagcgccucgucaaggucaaggucaccuuccgccacgacuccuccaccgucgagguccaggacgaccacaucaagggcccccucaaggucggcgccaucgucgaggucaagaaccucgacggcgccuaccaggaggccgucaucaacaagcucaccgacgccuccugguacaccgucgucuucgacgacggcgacgagaagacccuccgccgcuccucccucugccucaagggcgagcgccacuucgccgaguccgagacccucgaccagcucccccucaccaaccccgagcacuucggcacccccgucaucggcaagaagaccaaccgcggccgccgcuccaaccacauccccgaggaggaguccuccuccuccuccuccgacgaggacgaggacgaccgcaagcagaucgacgagcuccucggcaaggucgucugcgucgacuacaucucccucgacaagaagaaggcccucugguuccccgcccucgucgucugccccgacugcuccgacgagaucgccgucaagaaggacaacauccucguccgcuccuucaaggacggcaaguucaccuccgucccccgcaaggacguccacgagaucaccuccgacaccgcccccaagcccgacgccguccucaagcaggccuucgagcaggcccucgaguuccacaagucccgcaccauccccgccaacuggaagaccgagcucaaggaggacuccuccuccuccgaggccgaggaggaggaggaggaggaggacgacgagaaggagaaggaggacaacuccuccgaggaggaggaggagaucgagcccuuccccgaggagcgcgagaacuuccuccagcagcucuacaaguucauggaggaccgcggcacccccaucaacaagcgccccguccucggcuaccgcaaccucaaccucuucaagcucuuccgccucguccacaagcucggcggcuucgacaacaucgaguccggcgccgucuggaagcaggucuaccaggaccucggcauccccguccucaacuccgccgccggcuacaacgucaagugcgccuacaagaaguaccucuacggcuucgaggaguacugccgcuccgccaacaucgaguuccagauggcccuccccgagaaggucgucaacaagcagugcaaggagugcgagaacgucaaggagaucaaggucaaggaggagaacgagaccgagaucaaggagaucaagauggaggaggagcgcaacaucaucccccgcgaggagaagcccaucgaggacgagaucgagcgcaaggagaacaucaagcccucccucggcuccaagaagaaccuccucgaguccauccccacccacuccgaccaggagaaggaggucaacaucaagaagcccgaggacaacgagaaccucgacgacaaggacgacgacaccacccgcgucgacgagucccucaacaucaaggucgaggccgaggaggagaaggccaaguccggcgacgagaccaacaaggaggaggacgaggacgacgaggaggccgaggaggaggaggaggaggaggaggaggaggaggacgaggacgacgacgacaacaacgaggaggaggaguucgagugcuacccccccggcaugaagguccagguccgcuacggccgcggcaagaaccagaagauguacgaggccuccaucaaggacuccgacgucgagggcggcgagguccucuaccucguccacuacugcggcuggaacguccgcuacgacgaguggaucaaggccgacaagaucguccgccccgccgacaagaacguccccaagaucaagcaccgcaagaagaucaagaacaagcucgacaaggagaaggacaaggacgagaaguacucccccaagaacugcaagcuccgccgccucuccaagccccccuuccagaccaaccccucccccgagauggucuccaagcucgaccucaccgacgccaagaacuccgacaccgcccacaucaaguccaucgagaucaccuccauccucaacggccuccaggccuccgaguccuccgccgaggacuccgagcaggaggacgagcgcggcgcccaggacauggacaacaacggcaaggaggaguccaagaucgaccaccucaccaacaaccgcaacgaccucaucuccaaggaggagcagaacuccuccucccuccucgaggagaacaagguccacgccgaccucgucaucuccaagcccgucuccaagucccccgagcgccuccgcaaggacaucgagguccucuccgaggacaccgacuacgaggaggacgaggucaccaagaagcgcaaggacgucaagaaggacaccaccgacaaguccuccaagccccagaucaagcgcggcaagcgccgcuacugcaacaccgaggagugccucaagaccggcucccccggcaagaaggaggagaaggccaagaacaaggagucccucugcauggagaacuccuccaacuccuccuccgacgaggacgaggaggagaccaaggccaagaugacccccaccaagaaguacaacggccucgaggagaagcgcaagucccuccgcaccaccggcuucuacuccggcuucuccgaggucgccgagaagcgcaucaagcuccucaacaacuccgacgagcgccuccagaacucccgcgccaaggaccgcaaggacgucugguccuccauccagggccaguggcccaagaagacccucaaggagcucuucuccgacuccgacaccgaggccgccgccucccccccccaccccgcccccgaggagggcgucgccgaggagucccuccagaccgucgccgaggaggaguccugcucccccuccgucgagcucgagaagcccccccccgucaacgucgacuccaagcccaucgaggagaagaccgucgaggucaacgaccgcaaggccgaguuccccuccuccggcuccaacuccguccucaacaccccccccaccacccccgagucccccuccuccgucaccgucaccgagggcucccgccagcaguccuccgucaccgucuccgagccccucgcccccaaccaggaggagguccgcuccaucaaguccgagaccgacuccaccaucgaggucgacuccgucgccggcgagcuccaggaccuccaguccgagggcaacuccucccccgccggcuucgacgccuccgucuccuccuccuccuccaaccagcccgagcccgagcaccccgagaaggccugcaccggccagaagcgcgucaaggacgcccagggcggcggcuccuccuccaagaagcagaagcgcucccacaaggccaccgucgucaacaacaagaagaagggcaagggcaccaacuccuccgacuccgaggagcucuccgccggcgaguccaucaccaagucccagcccgucaaguccgucuccaccggcaugaagucccacuccaccaagucccccgcccgcacccagucccccggcaagugcggcaagaacggcgacaaggaccccgaccucaaggagcccuccaaccgccuccccaaggucuacaagugguccuuccagauguccgaccucgagaacaugaccuccgccgagcgcaucaccauccuccaggagaagcuccaggagauccgcaagcacuaccucucccucaaguccgaggucgccuccaucgaccgccgccgcaagcgccucaagaagaaggagcgcgaguccgccgccaccuccuccuccuccuccucccccuccuccuccuccaucaccgccgccgucaugcucacccucgccgagcccuccauguccuccgccucccagaacggcauguccgucgagugccgcuga

SEQ ID NO: 39928 - RNA, 2838 nt, Artificial Sequence
  derived and/or modified sequence opt2 from ARID5B__Homo_sapiens__NP_001231567
auggcccccaaccucaagggccgcccccgcaagaagaagcccugcccccagcgccgcgacuccuucuccggcgucaaggacuccaacaacaacuccgacggcaaggccgucgccaaggucaagugcgaggcccgcuccgcccucaccaagcccaagaacaaccacaacugcaagaaggucuccaacgaggagaagcccaaggucgccaucggcgaggagugccgcgccgacgagcaggccuuccucgucgcccucuacaaguacaugaaggagcgcaagacccccaucgagcgcauccccuaccucggcuucaagcagaucaaccucuggaccauguuccaggccgcccagaagcucggcggcuacgagaccaucaccgcccgccgccaguggaagcacaucuacgacgagcucggcggcaaccccggcuccaccuccgccgccaccugcacccgccgccacuacgagcgccucauccuccccuacgagcgcuucaucaagggcgaggaggacaagccccucccccccaucaagccccgcaagcaggagaacuccucccaggagaacgagaacaagaccaaggucuccggcaccaagcgcaucaagcacgagauccccaaguccaagaaggagaaggagaacgcccccaagccccaggacgccgccgaggucuccuccgagcaggagaaggagcaggagacccucaucucccagaaguccauccccgagccccuccccgccgccgacaugaagaagaagaucgagggcuaccaggaguucuccgccaagccccucgccucccgcgucgaccccgagaaggacaacgagaccgaccagggcuccaacuccgagaaggucgccgaggaggccggcgagaagggccccacccccccccuccccuccgccccccucgcccccgagaaggacuccgcccucguccccggcgccuccaagcagccccucaccucccccuccgcccucgucgacuccaagcaggaguccaagcucugcugcuucaccgagucccccgaguccgagccccaggaggccuccuuccccuccuuccccaccacccagcccccccucgccaaccagaacgagaccgaggacgacaagcuccccgccauggccgacuacaucgccaacugcaccgucaaggucgaccagcucggcuccgacgacauccacaacgcccucaagcagacccccaagguccucgucguccaguccuucgacauguucaaggacaaggaccucaccggccccaugaacgagaaccacggccucaacuacaccccccuccucuacucccgcggcaaccccggcaucauguccccccucgccaagaagaagcuccucucccaggucuccggcgccucccucuccuccuccuaccccuacggcuccccccccccccucaucuccaagaagaagcucaucgcccgcgacgaccucugcuccucccucucccagacccaccacggccaguccaccgaccacauggccgucucccgccccuccgucauccagcacguccaguccuuccgcuccaagcccuccgaggagcgcaagaccaucaacgacaucuucaagcacgagaagcucucccgcuccgacccccaccgcugcuccuucuccaagcaccaccucaacccccucgccgacuccuacguccucaagcaggagauccaggagggcaaggacaagcuccucgagaagcgcgcccucccccacucccacaugcccuccuuccucgccgacuucuacuccuccccccaccuccacucccucuaccgccacaccgagcaccaccuccacaacgagcagaccuccaaguaccccucccgcgacauguaccgcgaguccgagaacuccuccuuccccucccaccgccaccaggagaagcuccacgucaacuaccucaccucccuccaccuccaggacaagaaguccgccgccgccgaggcccccaccgacgaccagcccaccgaccucucccuccccaagaacccccacaagcccaccggcaagguccucggccucgcccacuccaccaccggcccccaggaguccaagggcaucucccaguuccagguccucggcucccagucccgcgacugccaccccaaggccugccgcgucucccccaugaccauguccggccccaagaaguaccccgagucccucucccgcuccggcaagccccaccacguccgccucgagaacuuccgcaagauggagggcaugguccaccccauccuccaccgcaagauguccccccagaacaucggcgccgcccgccccaucaagcgcucccucgaggaccucgaccucgucaucgccggcaagaaggcccgcgccgucuccccccucgaccccuccaaggaggucuccggcaaggagaaggccuccgagcaggaguccgagggcuccaaggccgcccacggcggccacuccggcggcggcuccgagggccacaagcucccccucuccucccccaucuuccccggccucuacuccggcucccucugcaacuccggccucaacucccgccuccccgccggcuacucccacucccuccaguaccucaagaaccagaccguccucuccccccucaugcagccccucgccuuccacucccucgucaugcagcgcggcaucuucaccucccccaccaacucccagcagcucuaccgccaccucgccgccgccacccccgucggcuccuccuacggcgaccuccuccacaacuccaucuacccccucgccgccaucaacccccaggccgccuuccccuccucccagcucuccuccguccaccccuccaccaagcucuga

SEQ ID NO: 39929 - RNA, 1674 nt, Artificial Sequence
  derived and/or modified sequence opt2 from ARIH1__Homo_sapiens__NP_005735
auggacuccgacgagggcuacaacuacgaguucgacgaggacgaggagugcuccgaggaggacuccggcgccgaggaggaggaggacgaggacgacgacgagcccgacgacgacacccucgaccucggcgaggucgagcucgucgagcccggccucggcgucggcggcgagcgcgacggccuccucugcggcgagaccggcggcggcggcggcuccgcccucggccccggcggcggcggcggcggcggcggcggcggcggcggcggcggccccggccacgagcaggaggaggacuaccgcuacgagguccucaccgccgagcagauccuccagcacauggucgagugcauccgcgaggucaacgaggucauccagaaccccgccaccaucacccgcauccuccucucccacuucaacugggacaaggagaagcucauggagcgcuacuucgacggcaaccucgagaagcucuucgccgagugccacgucaucaaccccuccaagaagucccgcacccgccagaugaacacccgcuccuccgcccaggacaugcccugccagaucugcuaccucaacuaccccaacuccuacuucaccggccucgagugcggccacaaguucugcaugcagugcugguccgaguaccucaccaccaagaucauggaggagggcaugggccagaccaucuccugccccgcccacggcugcgacauccucgucgacgacaacaccgucaugcgccucaucaccgacuccaaggucaagcucaaguaccagcaccucaucaccaacuccuucgucgagugcaaccgccuccucaaguggugccccgcccccgacugccaccacgucgucaagguccaguaccccgacgccaagcccguccgcugcaagugcggccgccaguucugcuucaacugcggcgagaacuggcacgaccccgucaagugcaaguggcucaagaaguggaucaagaagugcgacgacgacuccgagaccuccaacuggaucgccgccaacaccaaggagugccccaagugccacgucaccaucgagaaggacggcggcugcaaccacauggucugccgcaaccagaacugcaaggccgaguucugcugggucugccucggccccugggagccccacggcuccgccugguacaacugcaaccgcuacaacgaggacgacgccaaggccgcccgcgacgcccaggagcgcucccgcgccgcccuccagcgcuaccucuucuacugcaaccgcuacaugaaccacaugcagucccuccgcuucgagcacaagcucuacgcccaggucaagcagaagauggaggagaugcagcagcacaacauguccuggaucgagguccaguuccucaagaaggccgucgacguccucugccagugccgcgccacccucauguacaccuacgucuucgccuucuaccucaagaagaacaaccaguccaucaucuucgagaacaaccaggccgaccucgagaacgccaccgagguccucuccggcuaccucgagcgcgacaucucccaggacucccuccaggacaucaagcagaagguccaggacaaguaccgcuacugcgagucccgccgccgcguccuccuccagcacguccacgagggcuacgagaaggaccucugggaguacaucgaggacuga

SEQ ID NO: 39930 - RNA, 591 nt, Artificial Sequence
  derived and/or modified sequence opt2 from ARL11__Homo_sapiens__NP_612459
augggcuccgucaacucccgcggccacaaggccgaggcccaggucgucaugaugggccucgacuccgccggcaagaccacccuccucuacaagcucaagggccaccagcucgucgagacccuccccaccgucggcuucaacgucgagccccucaaggcccccggccacgucucccucacccucugggacgucggcggccaggccccccuccgcgccuccuggaaggacuaccucgagggcaccgacauccucgucuacguccucgacuccaccgacgaggcccgccuccccgaguccgccgccgagcucaccgagguccucaacgaccccaacauggccggcguccccuuccucguccucgccaacaagcaggaggcccccgacgcccucccccuccucaagauccgcaaccgccucucccucgagcgcuuccaggaccacugcugggagcuccgcggcugcuccgcccucaccggcgagggccuccccgaggcccuccagucccucuggucccuccucaagucccgcuccugcaugugccuccaggcccgcgcccacggcgccgagcgcggcgacuccaagcgcuccuga

SEQ ID NO: 39931 - RNA, 771 nt, Artificial Sequence
  derived and/or modified sequence opt2 from ARL13A__Homo_sapiens__NP_001155963
auguuccgccuccucuccuccugcugcuccugccuccgcaccaccgaggagacccgccgcaacgucaccauccccaucaucggccucaacaacuccggcaagaccguccucgucgaggccuuccagaagcuccuccccuccaagaccgaccacugcaugaaguccgagcucaccacccuccuccucgacgaguacgagcucuccaucuacgaccucaacggcgaccucaagggccgcgaggccuggcccaacuacuacgcccaggcccacggccucgucuucguccucgacuccuccgacauccgccgcaugcaggaggucaagaucauccucacccaccuccucuccgacaagcgcgucgccggcaagcccauccucauccucgccaacaagcaggacaagaagaaggcccucaugcccugcgacaucaucgacuaccuccuccucaagaagcucgucaaggagaacaagugccccugccgcgucgagcccugcuccgccauccgcaaccucgagcgccgcaaccaccagcccaucgucgagggccuccgcuggcuccucgccgucaucgacaccugccagcucccccccaccuccuccaucuccaucuccaagaacaacaccggcuccggcgagcgcugcuccucccacuccuucuccacccgcaccggcauguccaaggagaagcgccagcaccucgagcagugcuccaucgaggccaagccccucaaguccauccuccagcccuccaaccaguccuacacccacuga

SEQ ID NO: 39932 - RNA, 1287 nt, Artificial Sequence
  derived and/or modified sequence opt2 from ARL13B__Homo_sapiens__NP_001167621
auguucucccucauggccuccugcugcggcugguucaagcgcuggcgcgagcccguccgcaaggucacccuccucauggucggccucgacaacgccggcaagaccgccaccgccaagggcauccagggcgaguaccccgaggacgucgcccccaccgucggcuucuccaagaucaaccuccgccagggcaaguucgaggucaccaucuucgaccucggcggcggcauccgcauccgcggcaucuggaagaacuacuacgccgaguccuacggcgucaucuucgucgucgacuccuccgacgaggagcgcauggaggagaccaaggaggccauguccgagaugcuccgccacccccgcaucuccggcaagcccauccucguccucgccaacaagcaggacaaggagggcgcccucggcgaggccgacgucaucgagugccucucccucgagaagcucgucaacgagcacaagugccucugccagaucgagcccugcuccgccaucuccggcuacggcaagaagaucgacaaguccaucaagaagggccucuacuggcuccuccacgucaucgcccgcgacuucgacgcccucaacgagcgcauccagaaggagaccaccgagcagcgcgcccucgaggagcaggagaagcaggagcgcgccgagcgcguccgcaagcuccgcgaggagcgcaagcagaacgagcaggagcaggccgagcucgacggcaccuccggccucgccgagcucgaccccgagcccaccaaccccuuccagcccaucgccuccgucaucaucgagaacgagggcaagcucgagcgcgagaagaagaaccagaagauggagaaggacuccgacggcugccaccucaagcacaagauggagcacgagcagaucgagacccagggccaggucaaccacaacggccagaagaacaacgaguucggccucgucgagaacuacaaggaggcccucacccagcagcucaagaacgaggacgagaccgaccgccccucccucgaguccgccaacggcaagaagaagaccaagaagcuccgcaugaagcgcaaccaccgcgucgagccccucaacaucgacgacugcgcccccgagucccccacccccccccccccccccccccccgucggcuggggcacccccaaggucacccgccuccccaagcucgagccccucggcgagacccaccacaacgacuucuaccgcaagccccuccccccccucgccgucccccagcgccccaacuccgacgcccacgacgucaucuccuga

SEQ ID NO: 39933 - RNA, 783 nt, Artificial Sequence
  derived and/or modified sequence opt2 from ARL14EP__Homo_sapiens__NP_689529
augauggaccccugcuccgucggcguccagcuccgcaccaccaacgagugccacaagaccuacuacacccgccacaccggcuucaagacccuccaggagcucuccuccaacgacaugcuccuccuccagcuccgcaccggcaugacccucuccggcaacaacaccaucugcuuccaccacgucaagaucuacaucgaccgcuucgaggaccuccagaaguccugcugcgaccccuucaacauccacaagaagcucgccaagaagaaccuccacgucaucgaccucgacgacgccaccuuccucuccgccaaguucggccgccagcucguccccggcuggaagcucugccccaagugcacccagaucaucaacggcuccgucgacgucgacaccgaggaccgccagaagcgcaagcccgaguccgacggccgcaccgccaaggcccuccgcucccuccaguucaccaaccccggccgccagaccgaguucgcccccgagaccggcaagcgcgagaagcgccgccucaccaagaacgccaccgccggcuccgaccgccaggucauccccgccaaguccaaggucuacgacucccagggccuccucaucuucuccggcauggaccucugcgacugccucgacgaggacugccucggcugcuucuacgccugccccgccugcggcuccaccaagugcggcgccgagugccgcugcgaccgcaaguggcucuacgagcagaucgagaucgagggcggcgagaucauccacaacaagcacgccggcuga

SEQ ID NO: 39934 - RNA, 579 nt, Artificial Sequence
  derived and/or modified sequence opt2 from ARL14__Homo_sapiens__NP_079323
augggcucccucggcuccaagaacccccagaccaagcaggcccagguccuccuccucggccucgacuccgccggcaaguccacccuccucuacaagcucaagcucgccaaggacaucaccaccauccccaccaucggcuucaacgucgagaugaucgagcucgagcgcaaccucucccucaccgucugggacgucggcggccaggagaagaugcgcaccgucuggggcugcuacugcgagaacaccgacggccucgucuacgucgucgacuccaccgacaagcagcgccucgaggagucccagcgccaguucgagcacauccucaagaacgagcacaucaagaacguccccgucguccuccucgccaacaagcaggacaugcccggcgcccucaccgccgaggacaucacccgcauguucaaggucaagaagcucugcuccgaccgcaacugguacguccagcccugcugcgcccucaccggcgagggccucgcccagggcuuccgcaagcucaccggcuucgucaagucccacaugaagucccgcggcgacacccucgccuucuucaagcagaacuga

SEQ ID NO: 39935 - RNA, 615 nt, Artificial Sequence
  derived and/or modified sequence opt2 from ARL15__Homo_sapiens__NP_061960
auguccgaccuccgcaucaccgaggccuuccucuacauggacuaccucugcuuccgcgcccucugcugcaagggccccccccccgcccgccccgaguacgaccucgucugcaucggccucaccggcuccggcaagaccucccuccucuccaagcucugcuccgagucccccgacaacgucgucuccaccaccggcuucuccaucaaggccguccccuuccagaacgccauccucaacgucaaggagcucggcggcgccgacaacauccgcaaguacuggucccgcuacuaccagggcucccagggcgucaucuucguccucgacuccgccuccuccgaggacgaccucgaggccgcccgcaacgagcuccacuccgcccuccagcacccccagcucugcacccuccccuuccucauccucgccaaccaccaggacaagcccgccgcccgcuccguccaggagaucaagaaguacuucgagcucgagccccucgcccgcggcaagcgcuggauccuccagcccugcucccucgacgacauggacgcccucaaggacuccuucucccagcucaucaaccuccucgaggagaaggaccacgaggccguccgcauguga

SEQ ID NO: 39936 - RNA, 546 nt, Artificial Sequence
  derived and/or modified sequence opt2 from ARL1__Homo_sapiens__NP_001168
augggcggcuucuucuccuccaucuucuccucccucuucggcacccgcgagaugcgcauccucauccucggccucgacggcgccggcaagaccaccauccucuaccgccuccaggucggcgaggucgucaccaccauccccaccaucggcuucaacgucgagaccgucaccuacaagaaccucaaguuccaggucugggaccucggcggccagaccuccauccgccccuacuggcgcugcuacuacuccaacaccgacgccgucaucuacgucgucgacuccugcgaccgcgaccgcaucggcaucuccaaguccgagcucgucgccaugcucgaggaggaggagcuccgcaaggccauccucgucgucuucgccaacaagcaggacauggagcaggccaugaccuccuccgagauggccaacucccucggccuccccgcccucaaggaccgcaaguggcagaucuucaagaccuccgccaccaagggcaccggccucgacgaggccauggaguggcucgucgagacccucaagucccgccaguga

SEQ ID NO: 39937 - RNA, 492 nt, Artificial Sequence
  derived and/or modified sequence opt2 from ARL2BP__Homo_sapiens__NP_036238
auggacgcccucgagggcgaguccuucgcccucuccuucuccuccgccuccgacgccgaguucgacgccgucgucggcuaccucgaggacaucaucauggacgacgaguuccagcuccuccagcgcaacuucauggacaaguacuaccucgaguucgaggacaccgaggagaacaagcucaucuacacccccaucuucaacgaguacaucucccucgucgagaaguacaucgaggagcagcuccuccagcgcauccccgaguucaacauggccgccuucaccaccacccuccagcaccacaaggacgaggucgccggcgacaucuucgacaugcuccucaccuucaccgacuuccucgccuucaaggagauguuccucgacuaccgcgccgagaaggagggccgcggccucgaccucuccuccggccucgucgucaccucccucugcaaguccuccucccuccccgccucccagaacaaccuccgccacuga

SEQ ID NO: 39938 - RNA, 474 nt, Artificial Sequence
  derived and/or modified sequence opt2 from ARL2__Homo_sapiens__NP_001186674
augggccuccucaccauccucaagaagaugaagcagaaggagcgcgagcuccgccuccucaugcucggccucgacaacgccggcaagaccaccauccucaagaaguucaacggcgaggacaucgacaccaucucccccacccucggcuucaacaucaagacccucgagcaccgcggcuucaagcucaacaucugggacgucggcggccagaagucccuccgcuccuacuggcgcaacuacuucgaguccaccgacggccucaucugggucgucgacuccgccgaccgccagcgcaugcaggacugccagcgcgagcuccagucccuccucgucgaggagguccucgagcucgacuccauccgcucccaccacuggugcauccagggcugcuccgccgucaccggcgagaaccuccuccccggcaucgacuggcuccucgacgacaucuccucccgcaucuucaccgccgacuga

SEQ ID NO: 39939 - RNA, 549 nt, Artificial Sequence
  derived and/or modified sequence opt2 from ARL3__Homo_sapiens__NP_004302
augggccuccucuccauccuccgcaagcucaaguccgcccccgaccaggagguccgcauccuccuccucggccucgacaacgccggcaagaccacccuccucaagcagcucgccuccgaggacaucucccacaucacccccacccagggcuucaacaucaaguccguccagucccagggcuucaagcucaacgucugggacaucggcggccagcgcaagauccgccccuacuggaagaacuacuucgagaacaccgacauccucaucuacgucaucgacuccgccgaccgcaagcgcuucgaggagaccggccaggagcucgccgagcuccucgaggaggagaagcucuccugcguccccguccucaucuucgccaacaagcaggaccuccucaccgccgcccccgccuccgagaucgccgagggccucaaccuccacaccauccgcgaccgcgucuggcagauccaguccugcuccgcccucaccggcgagggcguccaggacggcaugaacugggucugcaagaacgucaacgccaagaagaaguga

SEQ ID NO: 39940 - RNA, 603 nt, Artificial Sequence
  derived and/or modified sequence opt2 from ARL4A__Homo_sapiens__NP_001182325
augggcaacggccucuccgaccagaccuccauccucuccaaccuccccuccuuccaguccuuccacaucgucauccucggccucgacugcgccggcaagaccaccguccucuaccgccuccaguucaacgaguucgucaacaccguccccaccaagggcuucaacaccgagaagaucaaggucacccucggcaacuccaagaccgucaccuuccacuucugggacgucggcggccaggagaagcuccgcccccucuggaaguccuacacccgcugcaccgacggcaucgucuucgucgucgacuccgucgacgucgagcgcauggaggaggccaagaccgagcuccacaagaucacccgcaucuccgagaaccagggcguccccguccucaucgucgccaacaagcaggaccuccgcaacucccucucccucuccgagaucgagaagcuccucgccaugggcgagcucuccuccuccacccccuggcaccuccagcccaccugcgccaucaucggcgacggccucaaggagggccucgagaagcuccacgacaugaucaucaagcgccgcaagaugcuccgccagcagaagaagaagcgcuga

SEQ ID NO: 39941 - RNA, 606 nt, Artificial Sequence
  derived and/or modified sequence opt2 from ARL4C__Homo_sapiens__NP_001269360
augggcaacaucuccuccaacaucuccgccuuccagucccuccacaucgucaugcucggccucgacuccgccggcaagaccaccguccucuaccgccucaaguucaacgaguucgucaacaccguccccaccaucggcuucaacaccgagaagaucaagcucuccaacggcaccgccaagggcaucuccugccacuucugggacgucggcggccaggagaagcuccgcccccucuggaaguccuacucccgcugcaccgacggcaucaucuacgucgucgacuccgucgacgucgaccgccucgaggaggccaagaccgagcuccacaaggucaccaaguucgccgagaaccagggcaccccccuccucgucaucgccaacaagcaggaccuccccaagucccuccccgucgccgagaucgagaagcagcucgcccuccacgagcucauccccgccaccaccuaccacguccagcccgccugcgccaucaucggcgagggccucaccgagggcauggacaagcucuacgagaugauccucaagcgccgcaagucccucaagcagaagaagaagcgcaccggcgaccuccgcuccugcgaggucuga

SEQ ID NO: 39942 - RNA, 606 nt, Artificial Sequence
  derived and/or modified sequence opt2 from ARL4D__Homo_sapiens__NP_001652
augggcaaccaccucaccgagauggcccccaccgccuccuccuuccucccccacuuccaggcccuccacgucgucgucaucggccucgacuccgccggcaagaccucccuccucuaccgccucaaguucaaggaguucguccaguccguccccaccaagggcuucaacaccgagaagauccgcgucccccucggcggcucccgcggcaucaccuuccaggucugggacgucggcggccaggagaagcuccgcccccucuggcgcuccuacacccgccgcaccgacggccucgucuucgucgucgacgccgccgaggccgagcgccucgaggaggccaaggucgagcuccaccgcaucucccgcgccuccgacaaccagggcguccccguccucguccucgccaacaagcaggaccagcccggcgcccucuccgccgccgaggucgagaagcgccucgccguccgcgagcucgccgccgccacccucacccacguccagggcugcuccgccgucgacggccucggccuccagcagggccucgagcgccucuacgagaugauccucaagcgcaagaaggccgcccgcggcggcaagaagcgccgcuga

SEQ ID NO: 39943 - RNA, 429 nt, Artificial Sequence
  derived and/or modified sequence opt2 from ARL5A__Homo_sapiens__NP_001032251
augaacgaggucguccacaccucccccaccaucggcuccaacgucgaggagaucgucaucaacaacacccgcuuccucaugugggacaucggcggccaggagucccuccgcuccuccuggaacaccuacuacaccaacaccgaguucgucaucgucgucgucgacuccaccgaccgcgagcgcaucuccgucacccgcgaggagcucuacaagaugcucgcccacgaggaccuccgcaaggccggccuccucaucuucgccaacaagcaggacgucaaggagugcaugaccgucgccgagaucucccaguuccucaagcucaccuccaucaaggaccaccaguggcacauccaggccugcugcgcccucaccggcgagggccucugccagggccucgaguggaugaugucccgccucaagauccgcuga

SEQ ID NO: 39944 - RNA, 540 nt, Artificial Sequence
  derived and/or modified sequence opt2 from ARL5B__Homo_sapiens__NP_848930
augggccucaucuucgccaagcucuggucccucuucugcaaccaggagcacaaggucaucaucgucggccucgacaacgccggcaagaccaccauccucuaccaguuccucaugaacgaggucguccacaccucccccaccaucggcuccaacgucgaggagaucgucgucaagaacacccacuuccucaugugggacaucggcggccaggagucccuccgcuccuccuggaacaccuacuacuccaacaccgaguucaucauccucgucgucgacuccaucgaccgcgagcgccucgccaucaccaaggaggagcucuaccgcaugcucgcccacgaggaccuccgcaaggccgccguccucaucuucgccaacaagcaggacaugaagggcugcaugaccgccgccgagaucuccaaguaccucacccucuccuccaucaaggaccaccccuggcacauccaguccugcugcgcccucaccggcgagggccucugccagggccucgaguggaugaccucccgcaucggcguccgcuga

SEQ ID NO: 39945 - RNA, 561 nt, Artificial Sequence
  derived and/or modified sequence opt2 from ARL6__Homo_sapiens__NP_816931
augggccuccucgaccgccucuccguccuccucggccucaagaagaaggagguccacguccucugccucggccucgacaacuccggcaagaccaccaucaucaacaagcucaagcccuccaacgcccagucccagaacauccuccccaccaucggcuucuccaucgagaaguucaaguccuccucccucuccuucaccgucuucgacauguccggccagggccgcuaccgcaaccucugggagcacuacuacaaggagggccaggccaucaucuucgucaucgacuccuccgaccgccuccgcauggucgucgccaaggaggagcucgacacccuccucaaccaccccgacaucaagcaccgccgcauccccauccucuucuucgccaacaagauggaccuccgcgacgccgucaccuccgucaaggucucccagcuccucugccucgagaacaucaaggacaagcccuggcacaucugcgccuccgacgccaucaagggcgagggccuccaggagggcgucgacuggcuccaggaccagauccagaccgucaagaccuga

SEQ ID NO: 39946 - RNA, 612 nt, Artificial Sequence
  derived and/or modified sequence opt2 from ARL6IP1__Homo_sapiens__NP_055976
auggccgagggcgacaaccgcuccaccaaccuccucgccgccgagaccgccucccucgaggagcagcuccagggcuggggcgaggucaugcucauggccgacaagguccuccgcugggagcgcgccugguucccccccgccaucaugggcgucgucucccucgucuuccucaucaucuacuaccucgaccccuccguccucuccggcgucuccugcuucgucauguuccucugccucgccgacuaccucguccccauccucgccccccgcaucuucggcuccaacaaguggaccaccgagcagcagcagcgcuuccacgagaucugcuccaaccucgucaagacccgccgccgcgccgucggcugguggaagcgccucuucacccucaaggaggagaagcccaagauguacuucaugaccaugaucgucucccucgccgccgucgccugggucggccagcagguccacaaccuccuccucaccuaccucaucgucaccucccuccuccuccuccccggccucaaccagcacggcaucauccucaaguacaucggcauggccaagcgcgagaucaacaagcuccucaagcagaaggagaagaagaacgaguga

SEQ ID NO: 39947 - RNA, 567 nt, Artificial Sequence
  derived and/or modified sequence opt2 from ARL6IP5__Homo_sapiens__NP_006398
auggacgucaacaucgccccccuccgcgccugggacgacuucuuccccggcuccgaccgcuucgcccgccccgacuuccgcgacaucuccaaguggaacaaccgcgucgucuccaaccuccucuacuaccagaccaacuaccucgucgucgccgccaugaugaucuccaucgucggcuuccucucccccuucaacaugauccucggcggcaucgucgucguccucgucuucaccggcuucgucugggccgcccacaacaaggacguccuccgccgcaugaagaagcgcuaccccaccaccuucgucauggucgucaugcucgccuccuacuuccucaucuccauguucggcggcgucauggucuucgucuucggcaucaccuucccccuccuccucauguucauccacgccucccuccgccuccgcaaccucaagaacaagcucgagaacaagauggagggcaucggccucaagcgcacccccaugggcaucguccucgacgcccucgagcagcaggaggagggcaucaaccgccucaccgacuacaucuccaaggucaaggaguga

SEQ ID NO: 39948 - RNA, 927 nt, Artificial Sequence
  derived and/or modified sequence opt2 from ARMC10__Homo_sapiens__NP_001154481
augggcggcccccgcggcgccggcugggucgccgccggccuccuccucggcgccggcgccugcuacugcaucuaccgccucacccgcggccgccgccgcggcgaccgcgagcucggcauccgcuccuccaaguccgccgaggaccucaccgacggcuccuacgacgacguccucaacgccgagcagcuccagaagcuccucuaccuccucgaguccaccgaggaccccgucaucaucgagcgcgcccucaucacccucggcaacaacgccgccuucuccgucaaccaggccaucauccgcgagcucggcggcauccccaucgucgccaacaagaucaaccacuccaaccaguccaucaaggagaaggcccucaacgcccucaacaaccucuccgucaacgucgagaaccagaucaagaucaagaucuacaucucccaggucugcgaggacgucuucuccggcccccucaacuccgccguccagcucgccggccucacccuccucaccaacaugaccgucaccaacgaccaccagcacaugcuccacuccuacaucaccgaccucuuccagguccuccucaccggcaacggcaacaccaagguccagguccucaagcuccuccucaaccucuccgagaaccccgccaugaccgagggccuccuccgcgcccaggucgacuccuccuuccucucccucuacgacucccacgucgccaaggagauccuccuccgcguccucacccucuuccagaacaucaagaacugccucaagaucgagggccaccucgccguccagcccaccuucaccgagggcucccucuucuuccuccuccacggcgaggagugcgcccagaagauccgcgcccucgucgaccaccacgacgccgaggucaaggagaaggucgucaccaucauccccaagaucuga

SEQ ID NO: 39949 - RNA, 543 nt, Artificial Sequence
  derived and/or modified sequence opt2 from ARMC1__Homo_sapiens__NP_001273631
auguccgccuggcccuacuucaucuacggccccucccagcccuccucccgcccccuccgcuucgccugcuccuccauccucggccgcaugcccugcaagcagcgcaaggacgagcgccgcaccggcuacgacgucgagcucaccaagugcuacaccgagucccgccgcaaccucugcgaggaggcccuccucaagaucaagggcgucaucuccuucaccuuccagauggccguccagcgcugcgucguccgcauccgcuccgaccucaaggccgaggcccucgccuccgccaucgccuccaccaaggucaugaaggcccagcaggucgucaaguccgaguccggcgaggagaugcucguccccuuccaggacacccccgucgaggucgagcagaacaccgagcuccccgacuaccuccccgaggacgagucccccaccaaggagcaggacaaggccgucucccgcgucggcucccaccccgagggcggcgccuccuggcucuccaccgccgccaacuuccucucccgcuccuucuacugguga

SEQ ID NO: 39950 - RNA, 2604 nt, Artificial Sequence
  derived and/or modified sequence opt2 from ARMC2__Homo_sapiens__NP_115507
augcucucccccaacgacaagaugcucggcaagcucgaccccuucuaccagcccuccgucuccaagcagaagaccuccgccgagaucaucuccgaggcccgcaacgcccuccgcaccguccgcacccagcgccccuucaccccccaggaggcccagcgcaagcucuucggccccgccuccucccgcaccuccgagaaccgcccccccuccuccuucucccuccacgccuccuccuucgaguccuccgacucccgccccaucuccggcacccgccucuccccccucgagcucaagcccaagguccccgccucccccacccgcgaggaggacuccugcuucuccuuccccaagccccccgucgaccccgccaagauccgccgcgucuccaacgcccgcgcccgccucuuccgcgccgccucccagcgcgcccuccuccccgaccgcucccucccccccuccgacuccaagaagaccgucgaguccaaggagaccgucaugaugggcgacuccauggucaagaucaacggcaucuaccucaccaaguccaacgccaucugccaccucaagucccacccccuccagcucaccgacgacggcggcuucuccgagaucaaggagcaggagauguucaagggcaccaccucccuccccucccaccucaagaacggcggcgaccagggcaagcgccacgcccgcgccuccuccugccccuccuccuccgaccucucccgccuccagaccaaggccguccccaaggccgaccuccaggaggaggacgccgagaucgaggucgacgaggucuucuggaacacccgcaucguccccauccuccgcgagcucgagaaggaggagaacaucgagaccgucugcgccgccugcacccagcuccaccacgcccucgaggagggcaacaugcucggcaacaaguucaagggccgcuccauccuccucaagacccucugcaagcucgucgacgucggcuccgacucccucucccucaagcucgccaagaucauccucgcccucaaggucucccgcaagaaccuccucaacgucugcaagcucaucuucaagaucucccgcaacgagaagaacgacucccucauccagaacgacuccauccucgagucccuccucgagguccuccgcuccgaggaccuccagaccaacauggaggccuuccucuacugcaugggcuccaucaaguucaucuccggcaaccucggcuuccucaacgagaugaucuccaagggcgccgucgagauccucaucaaccucaucaagcagaucaacgagaacaucaagaagugcggcaccuuccuccccaacuccggccaccuccucguccaggucaccgccacccuccgcaaccucgucgacuccucccucguccgcuccaaguuccucaacaucuccgcccucccccagcucugcaccgccauggagcaguacaagggcgacaaggacgucugcaccaacaucgcccgcaucuucuccaagcucaccuccuaccgcgacugcugcaccgcccucgccuccuacucccgcugcuacgcccucuuccucaaccucaucaacaaguaccagaagaagcaggaccucgucguccgcgucgucuucauccucggcaaccucaccgccaagaacaaccaggcccgcgagcaguucuccaaggagaagggcuccauccagacccuccucucccucuuccagaccuuccaccagcucgaccuccacucccagaagcccgucggccagcgcggcgagcagcaccgcgcccagcgcccccccuccgaggccgaggacguccucaucaagcucacccgcguccucgccaacaucgccauccaccccggcgucggccccguccucgccgccaaccccggcaucgucggccuccuccucaccacccucgaguacaagucccucgacgacugcgaggagcucgucaucaacgccaccgccaccaucaacaaccucuccuacuaccaggucaagaacuccaucauccaggacaagaagcucuacaucgccgagcuccuccucaagcuccucgucuccaacaacauggacggcauccucgaggccguccgcgucuucggcaaccucucccaggaccacgacgucugcgacuucaucguccagaacaacguccaccgcuucaugauggcccuccucgacgcccagcaccaggacaucugcuucuccgccugcggcguccuccucaaccucaccgucgacaaggacaagcgcgucauccucaaggagggcggcggcaucaagaagcucgucgacugccuccgcgaccucggccccaccgacuggcagcucgccugccucgucugcaagacccucuggaacuucuccgagaacaucaccaacgccuccuccugcuucggcaacgaggacaccaacacccuccuccuccuccucuccuccuuccucgacgaggagcucgcccucgacggcuccuucgaccccgaccucaagaacuaccacaagcuccacugggagaccgaguucaagcccgucgcccagcagcuccucaaccgcauccagcgccaccacaccuuccucgagccccuccccauccccuccuucuga

SEQ ID NO: 39951 - RNA, 2598 nt, Artificial Sequence
  derived and/or modified sequence opt2 from ARMC3__Homo_sapiens__NP_001269674
augggcaagaagaucaagaaggaggucgagcccccccccaaggacgucuucgacccccucaugaucgaguccaagaaggccgccaccgucguccucaugcucaacucccccgaggaggagauccucgccaaggccugcgaggccaucuacaaguucgcccucaagggcgaggagaacaagaccacccuccucgagcucggcgccgucgagccccucaccaagcuccucacccacgaggacaagaucguccgccgcaacgccaccaugaucuucggcauccucgccuccaacaacgacgucaagaagcuccuccgcgagcucgacgucaugaacuccgucaucgcccagcucgcccccgaggaggaggucgucauccacgaguucgccucccucugccucgccaacauguccgccgaguacaccuccaagguccagaucuucgagcacggcggccucgagccccucauccgccuccucuccucccccgaccccgacgucaagaagaacuccauggagugcaucuacaaccucguccaggacuuccagugccgcgccaagcuccaggagcucaacgccaucccccccauccucgaccuccucaaguccgaguaccccgucauccagcuccucgcccucaagacccucggcgucaucgccaacgacaaggagucccgcaccaugcuccgcgacaaccagggccucgaccaccucaucaagauccucgagaccaaggagcucaacgaccuccacaucgaggcccucgccgucaucgccaacugccucgaggacauggacaccaugguccagauccagcagaccggcggccucaagaagcuccucuccuucgccgagaacuccaccauccccgacauccagaagaacgccgccaaggccaucaccaaggccgccuacgaccccgagaaccgcaagcucuuccacgagcaggaggucgagaagugccucgucgcccuccucggcuccgagaacgacggcaccaagaucgccgccucccaggccaucuccgccaugugcgagaacuccggcuccaaggacuucuucaacaaccagggcaucccccagcucauccagcuccucaaguccgacaacgaggagguccgcgaggccgccgcccucgcccucgccaaccucaccaccugcaaccccgccaacgccaacgccgccgccgaggccgacggcaucgacccccucaucaaccuccucuccuccaagcgcgacggcgccaucgccaacgccgccaccguccucaccaacauggccaugcaggagccccuccgccucaacauccagaaccacgacaucaugcacgccaucaucuccccccuccgcuccgccaacaccgucguccaguccaaggccgcccucgccgucaccgccaccgccugcgacgucgaggcccgcaccgagcuccgcaacuccggcggccucgagccccucgucgagcuccuccgcuccaagaacgacgagguccgcaagcacgccuccugggccgucauggucugcgccggcgacgagcucaccgccaacgagcucugccgccucggcgcccucgacauccucgaggaggucaacgucuccggcacccgcaagaacaaguucuccgaggccgccuacaacaagcuccucaacaacaaccucucccucaaguacucccagaccggcuaccucuccuccuccaacaucaucaacgacggcuucuacgacuacggccgcaucaaccccggcaccaagcuccucccccucaaggagcucugccuccaggagcccuccgaccuccgcgccguccuccucaucaacuccaaguccuacgucuccccccccuccuccauggaggacaaguccgacgucggcuacggccgcuccaucuccuccuccuccucccuccgccgcuccuccaaggagaagaacaacgccggcuucggcucccccaucgaggacaaguccgagcccgccuccggccgcaacaccguccucuccaaguccgccaccaaggagaagggcuggcgcaaguccaagggcaagaaggaggaggagaaggucaaggaggaggaggaggucauggucguccccaaguucgucggcgagggcuccuccgacaaggaguggugcccccccuccgaccccgacuucuccauguacgucuacgaggucaccaaguccauccuccccaucaccaacaucaaggagcagaucgaggaccucgccaaguacgucgccgagaagaugggcggcaagauccccaaggagaagcuccccgacuucuccugggagcuccacaucuccgagcucaaguuccagcucaaguccaacgucauccccaucggccacgucaagaagggcaucuucuaccaccgcgcccuccucuucaaggcccucgccgaccgcaucggcaucggcugcucccucguccgcggcgaguacggccgcgccuggaacgaggucaugcuccagaacgacucccgcaagggcgucaucggcggccuccccgcccccgagauguacgucaucgaccucauguuccaccccggcggccucaugaagcuccgcucccgcgaggccgaccucuaccgcuucaucuga

SEQ ID NO: 39952 - RNA, 1839 nt, Artificial Sequence
  derived and/or modified sequence opt2 from ARMC4__Homo_sapiens__NP_001276950
augcgcgacuucucccucgcccaggagaccugccagcucgccauccgcgacgucggcggccucgagguccucaucaaccuccucgagaccgacgaggucaagugcaagaucggcucccucaagauccucaaggagaucucccacaacccccagauccgccagaacaucgucgaccucggcggccuccccaucauggucaacauccucgacuccccccacaagucccucaagugccucgccgccgagaccaucgccaacgucgccaaguucaagcgcgcccgccgcgucguccgccagcacggcggcaucaccaagcucgucgcccuccucgacugcgcccacgacuccaccaagcccgcccaguccucccucuacgaggcccgcgacgucgaggucgcccgcugcggcgcccucgcccucugguccugcuccaagucccacaccaacaaggaggccauccgcaaggccggcggcaucccccuccucgcccgccuccucaagaccucccacgagaacaugcucauccccgucgucggcacccuccaggagugcgccuccgaggagaacuaccgcgccgccaucaaggccgagcgcaucaucgagaaccucgucaagaaccucaacuccgagaacgagcagcuccaggagcacugcgccauggccaucuaccagugcgccgaggacaaggagacccgcgaccucguccgccuccacggcggccucaagccccucgccucccuccucaacaacaccgacaacaaggagcgccucgccgccgucaccggcgccaucuggaagugcuccaucuccaaggagaacgucaccaaguuccgcgaguacaaggccaucgagacccucgucggccuccucaccgaccagcccgaggagguccucgucaacgucgucggcgcccucggcgagugcugccaggagcgcgagaaccgcgucaucguccgcaagugcggcggcauccagccccucgucaaccuccucgucggcaucaaccaggcccuccucgucaacgucaccaaggccgucggcgccugcgccgucgagcccgaguccaugaugaucaucgaccgccucgacggcguccgccuccucuggucccuccucaagaacccccaccccgacgucaaggccuccgccgccugggcccucugccccugcaucaagaacgccaaggacgccggcgagaugguccgcuccuucgucggcggccucgagcucaucgucaaccuccucaaguccgacaacaaggagguccucgccuccgucugcgccgccaucaccaacaucgccaaggaccaggagaaccucgccgucaucaccgaccacggcgucgucccccuccucuccaagcucgccaacaccaacaacaacaagcuccgccaccaccucgccgaggccaucucccgcugcugcauguggggccgcaaccgcgucgccuucggcgagcacaaggccgucgccccccucguccgcuaccucaaguccaacgacaccaacguccaccgcgccaccgcccaggcccucuaccagcucuccgaggacgccgacaacugcaucaccaugcacgagaacggcgccgucaagaccgagucccgccacgucgcccgccucgagugcuccgacaacgaccucggcucccuccagccccccccccccggcuucaagcgcuucuccugccucucccuccucuccuccugggacuacuccuucuacuggaucuggcucggcccccucacccgcaucucccgcaagcuccagcucgucgucuaccccaucuccgccggcuggcuccuccuccagcgccgccaggacacccucgagaucuga

SEQ ID NO: 39953 - RNA, 2808 nt, Artificial Sequence
  derived and/or modified sequence opt2 from ARMC5__Homo_sapiens__NP_001098717
auggccgccgccaagcccacccucaccgacucccucuccuucugccucgcccagcucgccgccgccgccggcgaggcccucggcggcgagaaggaccccgccaccaacgagaccccccucucccgcgcccuccucgcccuccgcacccgccacaucaaggccgccggcggcaucgagcgcuuccgcgcccgcggcggccuccgcccccuccucgcccuccuccgccgcgccgccgccgccggcuccgcccccucccaggccggccccggcuccgcccccuccuccgccgccuccggcgccuccucccccgcccccgccuccggccccgcccccuccgccgucuccuccuccucccccaccccccccguccgccuccgcaagacccucgaccucgcccucuccauccucgccgacugcugcaccgagggcgccugccgcaccgagguccgccgccucggcggcauccucccccucgucaccauccuccagugcaugaagaccgacuccauccagaaccgcaccgcccgcgcccucggcaaccucgccauggagcccgaguccugcggcgacauccacugcgccggcgccgucccccuccucgucgagucccucaccgccugccaggacucccagugccuccaguccgucguccgcgcccuccgcaaccucgccgacuccccccagcaccgccucgcccucgcccagcagggcgccguccgcccccucgccgagcuccucgccaccgcccccgacgccgcccucacccucgcccucguccgcgcccuccucgagcucucccgcggcugcucccgcgccugcgccgagcagcucucccucggcggcggccucggcccccucgucucccucgccucccaccccaagcgcgccguccgcgagggcaccauccucauccucgccaaccucugcgcccagggccucauccgccccgcccucggcaacgccggcggcgucgagguccucgucgacgagcuccgccagcgccgcgaccccaacggcgccucccccaccucccagcagccccucguccgcgccgucugccuccucugccgcgaggccaucaaccgcgcccgccuccgcgacgccggcggccucgaccuccucaugggccuccuccgcgacccccgcgccuccgccuggcacccccgcaucgucgccgcccucgucggcuuccucuacgacaccggcgcccucggccgccuccaggcccucggccucgucccccuccucgccggccagcucugcggcgaggccggcgaggaggaggaggagggccgcgaggccgccuccugggacuuccccgaggagcgcacccccgagcgcgcccagggcggcuccuuccgcucccuccgcuccuggcucaucuccgagggcuacgccaccggccccgacgacaucucccccgacuggucccccgagcagugcccccccgagcccauggagcccgccucccccgcccccacccccaccucccuccgcgccccccgcacccagcgcacccccggccgcucccccgccgccgccaucgaggagcccuggggccgcgagggccccgcccuccuccuccucucccgcuucucccaggcccccgaccccuccggcgcccucgucaccggccccgcccucuacggccuccucaccuacgucaccggcgcccccggcccccccuccccccgcgcccuccgcauccucucccgccucaccugcaaccccgccugccucgaggccuucguccgcuccuacggcgccgcccuccuccgcgccuggcucguccucggcgucgcccccgacgacuggcccgccccccgcgcccgccccacccuccacucccgccaccgcgagcucggcgagcgccuccuccagaaccucaccguccaggccgagucccccuucggcgucggcgcccucacccaccuccuccucuccggcucccccgaggaccgcgucgccugcgcccucacccuccccuucaucugccgcaagcccucccucuggcgccgccuccuccucgagcagggcggccuccgccuccuccucgccgcccucacccgccccgccccccacccccucuuccucuucuucgccgccgacucccucuccugccuccaggaccucgucucccccaccgucucccccgccgucccccaggccguccccauggaccucgacucccccucccccugccucuacgagccccuccucggccccgcccccguccccgcccccgaccuccacuuccuccucgacuccggccuccagcuccccgcccagcgcgccgccuccgccaccgccucccccuucuuccgcgcccuccucuccggcuccuucgccgaggcccagauggaccucgucccccuccgcggccucucccccggcgccgccuggcccguccuccaccaccuccacggcugccgcggcugcggcgccgcccucggccccguccccccccccggccagccccuccucggcuccgaggccgaggaggcccucgaggccgccggccgcuuccuccuccccggccucgaggaggagcucgaggaggccgucggccgcauccaccucggcccccagggcggccccgaguccgucggcgaggucuuccgccucggccgcccccgccucgccgcccacugcgcccgcuggacccucggcuccgagcagugcccccgcaagcgcggccucgcccucgucggccucgucgaggccgccggcgaggaggccggcccccucaccgaggcccuccucgccgucgucaugggcaucgagcucggcgcccgcguccccgccuga

SEQ ID NO: 39954 - RNA, 1929 nt, Artificial Sequence
  derived and/or modified sequence opt2 from ARMC8__Homo_sapiens__NP_001253970
auggccugccuccucgagacccccauccgcauguccguccucuccgaggucaccgccuccucccgccacuacgucgaccgccucuucgaccccgacccccagaagguccuccagggcgucaucgacaugaagaacgccgucaucggcaacaacaagcagaaggccaaccucaucguccucggcgccgucccccgccuccucuaccuccuccagcaggagaccuccuccaccgagcucaagaccgagugcgccgucguccucggcucccucgccaugggcaccgagaacaacgucaagucccuccucgacugccacaucauccccgcccuccuccagggccuccucucccccgaccucaaguucaucgaggccugccuccgcugccuccgcaccaucuucaccucccccgucacccccgaggagcuccucuacaccggccccgaccaccagaccauccucuucaaccacggcgccguccagaacaucgcccaccuccucaccucccucuccuacaagguccgcaugcaggcccucaagugcuucuccguccucgccuucgagaacccccaggucuccaugacccucgucaacguccucgucgacggcgagcuccucccccagaucuucgucaagaugcuccagcgcgacaagcccaucgagaugcagcucaccuccgccaagugccucaccuacaugugccgcgccggcgccauccgcaccgacgacaacugcaucguccucaagacccuccccugccucguccgcaugugcuccaaggagcgccuccucgaggagcgcgucgagggcgccgagacccucgccuaccucaucgagcccgacgucgagcuccagcgcaucgccuccaucaccgaccaccucaucgccaugcucgccgacuacuucaaguaccccuccuccgucuccgccaucaccgacaucaagcgccucgaccacgaccucaagcacgcccacgagcuccgccaggccgccuucaagcucuacgccucccucggcgccaacgacgaggacauccgcaagaagaucaucgagaccgagaacaugauggaccgcaucgucaccggccucuccgaguccuccgucaagguccgccucgccgccguccgcugccuccacucccucucccgcuccguccagcagcuccgcaccuccuuccaggaccacgccgucuggaagccccucaugaagguccuccagaacgcccccgacgagauccucgucgucgccuccuccaugcucugcaaccuccuccucgaguucucccccuccaaggagcccauccucgaguccggcgccgucgagcuccucugcggccucacccaguccgagaaccccgcccuccgcgucaacggcaucugggcccucaugaacauggccuuccaggccgagcagaagaucaaggccgacauccuccgcucccucuccaccgagcagcucuuccgccuccucuccgacuccgaccucaacguccucaugaagacccucggccuccuccgcaaccuccucuccacccgcccccacaucgacaagaucauguccacccacggcaagcagaucaugcaggccgucacccucauccucgagggcgagcacaacaucgaggucaaggagcagacccucugcauccucgccaacaucgccgacggcaccaccgccaaggaccucaucaugaccaacgacgacauccuccagaagaucaaguacuacaugggccacucccacgucaagcuccagcucgccgccauguucugcaucuccaaccucaucuggaacgaggaggagggcucccaggagcgccaggacaagcuccgcgacaugggcaucgucgacauccuccacaagcucucccagucccccgacuccaaccucugcgacaaggccaagauggcccuccagcaguaccucgccuga

SEQ ID NO: 39955 - RNA, 2457 nt, Artificial Sequence
  derived and/or modified sequence opt2 from ARMC9__Homo_sapiens__NP_001258395
augggcgacauccucgcccacgaguccgagcuccucggccucgucaaggaguaccucgacuucgccgaguucgaggacacccucaagaccuucuccaaggagugcaagaucaagggcaagccccucugcaagaccgucggcggcuccuuccgcgacuccaagucccucaccauccagaaggaccucgucgccgccuucgacaacggcgaccagaaggucuucuucgaccucugggaggagcacaucuccuccuccauccgcgacggcgacuccuucgcccagaagcucgaguucuaccuccacauccacuucgccaucuaccuccucaaguacuccgucggccgccccgacaaggaggagcucgacgagaagaucuccuacuucaagaccuaccucgagaccaagggcgccgcccucucccagaccaccgaguuccuccccuucuacgcccuccccuucguccccaaccccaugguccaccccuccuucaaggagcucuuccaggacuccuggacccccgagcucaagcucaagcucgagaaguuccucgcccucaucuccaaggccuccaacacccccaagcuccucaccaucuacaaggagaacggccaguccaacaaggagauccuccagcagcuccaccagcagcucgucgaggccgagcgccgcuccgucaccuaccucaagcgcuacaacaagauccaggccgacuaccacaaccucaucggcgucaccgccgagcucgucgacucccucgaggccaccgucuccggcaagaugaucacccccgaguaccuccaguccgucugcguccgccucuucuccaaccagaugcgccagucccucgcccacuccgucgacuucacccgccccggcaccgccuccaccaugcuccgcgccucccucgcccccgucaagcucaaggacgucccccuccuccccucccucgacuacgagaagcucaagaaggaccucauccucggcuccgaccgccucaaggccuuccuccuccaggcccuccgcuggcgccucaccaccucccaccccggcgagcagcgcgagaccguccuccaggccuacaucuccaacgaccuccucgacugcuacucccacaaccagcgcuccguccuccagcuccuccacuccaccuccgacgucguccgccaguacauggcccgccucaucaacgccuucgccucccucgccgagggccgccucuaccucgcccagaacaccaagguccuccagaugcucgagggccgccucaaggaggaggacaaggacaucaucacccgcgagaacguccucggcgcccuccagaaguucucccuccgccgcccccuccagaccgccaugauccaggacggccucaucuucuggcucgucgacguccucaaggaccccgacugccucuccgacuacacccucgaguacuccgucgcccuccucaugaaccucugccuccgcuccaccggcaagaacaugugcgccaaggucgccggccucguccucaagguccucuccgaccuccucggccacgagaaccacgagauccagcccuacgucaacggcgcccucuacuccauccucuccguccccuccauccgcgaggaggcccgcgccaugggcauggaggacauccuccgcugcuucaucaaggagggcaacgccgagaugauccgccagaucgaguucaucaucaagcagcucaacuccgaggagcuccccgacggcguccucgaguccgacgacgacgaggacgaggacgacgaggaggaccacgacaucauggaggccgaccucgacaaggacgagcucauccagccccagcucggcgagcucuccggcgagaagcuccucaccaccgaguaccucggcaucaugaccaacaccggcaagacccgccgcaagggccucgccaacguccagugguccggcgacgagccccuccagcgccccgucacccccggcggccaccgcaacggcuaccccgucgucgaggaccagcacacccccccccagaccgcccagcacgcccgcaacggccacccccaggcccuccccgccgcccacgaggccgucuaccgcgagggcaagcccuccacccccgaguccugcgucuccuccuccuccgccaucaucgccaagcccggcgaguggcucccccgcggccgccaggaggagccccgccccgcccccaccggcaccccccgccagccccgcgaggccccccaggaccccggcaacggcgucaccacccgcgagugcgccuccgccuucaccugcaagccccgcgcccccugcacccccgagaugcucgacuggaacccccccaaggccaaggccuccguccucgccccccucuucuccuccugcggcccccagcaggccucccgccccggcuccaccgccuccuccacccgcggccuccccuccucccagucccaccgcaaguga

SEQ ID NO: 39956 - RNA, 1362 nt, Artificial Sequence
  derived and/or modified sequence opt2 from ARMCX1__Homo_sapiens__NP_057692
augggccgcacccgcgaggccggcugcgucgccgccggcgucgucaucggcgccggcgccugcuacugcgucuaccgccucgccuggggccgcgacgagaacgagaagaucugggacgaggacgaggaguccaccgacaccuccgagaucggcgucgagaccgucaagggcgccaagaccaacgccggcgccggcuccggcgccaagcuccagggcgacuccgaggucaagcccgaggucucccucggccucgaggacugccccggcgucaaggagaaggcccacuccggcucccacuccggcggcggccucgaggccaaggccaaggcccucuucaacacccucaaggagcaggccuccgccaaggccggcaagggcgcccgcgucggcaccaucuccggcaaccgcacccucgcccccucccuccccugccccggcggccgcggcggcggcugccaccccacccgcuccggcucccgcgccggcggccgcgccuccggcaaguccaagggcaaggcccgcuccaaguccacccgcgcccccgccaccaccuggcccguccgccgcggcaaguucaacuuccccuacaagaucgacgacauccucuccgcccccgaccuccagaagguccucaacauccucgagcgcaccaacgaccccuucauccaggaggucgcccucgucacccucggcaacaacgccgccuacuccuucaaccagaacgccauccgcgagcucggcggcguccccaucaucgccaagcucaucaagaccaaggaccccaucauccgcgagaagaccuacaacgcccucaacaaccucuccgucaacgccgagaaccagggcaagaucaagaccuacaucucccaggucugcgacgacaccauggucugccgccucgacuccgccguccagauggccggccuccgccuccucaccaacaugaccgucaccaaccacuaccagcaccuccucuccuacuccuuccccgacuucuucgcccuccucuuccucggcaaccacuucaccaagauccagaucaugaagcucaucaucaacuucaccgagaaccccgccaugacccgcgagcucgucuccugcaagguccccuccgagcucaucucccucuucaacaaggagugggaccgcgagauccuccucaacauccucacccucuucgagaacaucaacgacaacaucaagaacgagggccucgccuccucccgcaaggaguucucccgcuccucccucuucuuccucuucaaggaguccggcgucugcgucaagaagaucaaggcccucgccaaccacaacgaccucgucgucaaggucaagguccucaagguccucaccaagcucuga

SEQ ID NO: 39957 - RNA, 324 nt, Artificial Sequence
  derived and/or modified sequence opt2 from ARMS2__Homo_sapiens__NP_001093137
augcuccgccucuaccccggccccauggucaccgaggccgagggcaagggcggccccgagauggccucccucuccuccuccgucguccccgucuccuucaucuccacccuccgcgaguccguccucgaccccggcgucggcggcgagggcgccuccgacaagcagcgcuccaagcucucccucucccacuccaugauccccgccgccaagauccacaccgagcucugccuccccgccuucuucucccccgccggcacccagcgccgcuuccagcagccccagcaccaccucacccucuccaucauccacaccgccgcccgcuga

SEQ ID NO: 39958 - RNA, 969 nt, Artificial Sequence
  derived and/or modified sequence opt2 from ARMT1__Homo_sapiens__NP_001273491
auguaccgccgcauccacgaggccaucauccaguccccccccaucgacuacuucgacgucuucaaggaguccaaggagcagaacuucuacggcucccaggaguccaucaucgcccucugcacccaccuccagcagcucauccgcaccaucgaggaccucgacgagaaccagcucaaggacgaguucuucaagcuccuccagaucucccucuggggcaacaagugcgaccucucccucuccggcggcgaguccuccucccagaacaccaacguccucaacucccucgaggaccucaagcccuucauccuccucaacgacauggagcaccucuggucccuccucuccaacugcaagaagacccgcgagaaggccuccgccacccgcgucuacaucguccucgacaacuccggcuucgagcucgucaccgaccucauccucgccgacuuccuccucuccuccgagcucgccaccgagguccacuucuacggcaagaccauccccugguucgucuccgacaccaccauccacgacuucaacuggcucaucgagcaggucaagcacuccaaccacaaguggauguccaagugcggcgccgacugggaggaguacaucaagaugggcaagugggucuaccacaaccacaucuucuggacccucccccacgaguacugcgccaugccccaggucgcccccgaccucuacgccgagcuccagaaggcccaccucauccucuucaagggcgaccucaacuaccgcaagcucaccggcgaccgcaagugggaguucuccguccccuuccaccaggcccucaacggcuuccaccccgccccccucugcaccauccgcacccucaaggccgagauccaggucggccuccagcccggccagggcgagcagcuccucgccuccgagcccuccugguggaccaccggcaaguacggcaucuuccaguacgacggcccccucuga

SEQ ID NO: 39959 - RNA, 2154 nt, Artificial Sequence
  derived and/or modified sequence opt2 from ARNT2__Homo_sapiens__NP_055677
auggccacccccgccgccgucaacccccccgagauggccuccgacauccccggcuccgucacccuccccgucgcccccauggccgccaccggccagguccgcauggccggcgccaugcccgcccgcggcggcaagcgccgcuccggcauggacuucgacgacgaggacggcgagggccccuccaaguucucccgcgagaaccacuccgagaucgagcgccgccgccgcaacaagaugacccaguacaucaccgagcucuccgacaugguccccaccugcuccgcccucgcccgcaagcccgacaagcucaccauccuccgcauggccgucucccacaugaaguccaugcgcggcaccggcaacaaguccaccgacggcgccuacaagcccuccuuccucaccgagcaggagcucaagcaccucauccucgaggccgccgacggcuuccucuucgucgucgccgccgagaccggccgcgucaucuacgucuccgacuccgucacccccguccucaaccagccccaguccgagugguucggcuccacccucuacgagcagguccaccccgacgacgucgagaagcuccgcgagcagcucugcaccuccgagaacuccaugaccggccgcauccucgaccucaagaccggcaccgucaagaaggagggccagcaguccuccaugcgcaugugcaugggcucccgccgcuccuucaucugccgcaugcgcugcggcaacgccccccucgaccaccucccccucaaccgcaucaccaccaugcgcaagcgcuuccgcaacggccucggccccgucaaggagggcgaggcccaguacgccgucguccacugcaccggcuacaucaaggccuggccccccgccggcaugaccauccccgaggaggacgccgacgucggccagggcuccaaguacugccucgucgccaucggccgccuccaggucaccuccucccccgucugcauggacaugaacggcauguccguccccaccgaguuccucucccgccacaacuccgacggcaucaucaccuucgucgacccccgcugcaucuccgucaucggcuaccagccccaggaccuccucggcaaggacauccucgaguucugccaccccgaggaccagucccaccuccgcgaguccuuccagcaggucgucaagcucaagggccagguccucuccgucauguaccgcuuccgcaccaagaaccgcgaguggaugcucauccgcaccuccuccuucaccuuccagaaccccuacuccgacgagaucgaguacaucaucugcaccaacaccaacgucaagcagcuccagcagcagcaggccgagcucgagguccaccagcgcgacggccucuccuccuacgaccucucccagguccccguccccaaccuccccgccggcguccacgaggccggcaaguccgucgagaaggccgacgccaucuucucccaggagcgcgacccccgcuucgccgagauguucgccggcaucuccgccuccgagaagaagaugauguccuccgccuccgccgccggcacccagcagaucuacucccagggcucccccuuccccuccggccacuccggcaaggccuucuccuccuccgucguccacguccccggcgucaacgacauccaguccuccuccuccaccggccagaacaugucccagaucucccgccagcucaaccagucccaggucgccuggaccggcucccgcccccccuuccccggccagcagauccccucccaguccuccaagacccaguccucccccuucggcaucggcaccucccacaccuaccccgccgaccccuccuccuacuccccccucuccucccccgccaccuccucccccuccggcaacgccuacuccucccucgccaaccgcacccccggcuucgccgaguccggccaguccuccggccaguuccagggccgccccuccgaggucuggucccaguggcagucccagcaccacggccagcaguccggcgagcagcacucccaccagcagcccggccagaccgaggucuuccaggacaugcuccccaugcccggcgaccccacccagggcaccggcaacuacaacaucgaggacuucgccgaccucggcauguucccccccuucuccgaguga

SEQ ID NO: 39960 - RNA, 2319 nt, Artificial Sequence
  derived and/or modified sequence opt2 from ARNT__Homo_sapiens__XP_011507849
auguaccaccacuggguccagccccucccccucgagacccucgaccucgaguucaaggucgaggagccccucucccgcggccuccucuccggcgaccaggccggccucaaguaccuccuccucgccuuccuccgccucgacuucgacgacgacggcgagggcaacuccaaguuccuccgcugcgacgacgaccagauguccaacgacaaggagcgcuucgcccgcgagaaccacuccgagaucgagcgccgccgccgcaacaagaugaccgccuacaucaccgagcucuccgacaugguccccaccugcuccgcccucgcccgcaagcccgacaagcucaccauccuccgcauggccgucucccacaugaagucccuccgcggcaccggcaacaccuccaccgacggcuccuacaagcccuccuuccucaccgaccaggagcucaagcaccucauccucgaggccgccgacggcuuccucuucaucgucuccugcgagaccggccgcgucgucuacgucuccgacuccgucacccccguccucaaccagccccaguccgagugguucggcuccacccucuacgaccagguccaccccgacgacgucgacaagcuccgcgagcagcucuccaccuccgagaacgcccucaccggccgcauccucgaccucaagaccggcaccgucaagaaggagggccagcaguccuccaugcgcaugugcaugggcucccgccgcuccuucaucugccgcaugcgcugcggcuccuccuccgucgaccccgucuccgucaaccgccucuccuucguccgcaaccgcugccgcaacggccucggcuccgucaaggacggcgagccccacuucgucgucguccacugcaccggcuacaucaaggccuggccccccgccggcgucucccuccccgacgacgaccccgaggccggccagggcuccaaguucugccucgucgccaucggccgccuccaggucaccuccucccccaacugcaccgacauguccaacgucugccagcccaccgaguucaucucccgccacaacaucgagggcaucuucaccuucgucgaccaccgcugcgucgccaccgucggcuaccagccccaggagcuccucggcaagaacaucgucgaguucugccaccccgaggaccagcagcuccuccgcgacuccuuccagcaggucgucaagcucaagggccagguccucuccgucauguuccgcuuccgcuccaagaaccaggaguggcucuggaugcgcaccuccuccuucaccuuccagaaccccuacuccgacgagaucgaguacaucaucugcaccaacaccaacgucaagaacuccucccaggagccccgccccacccucuccaacaccauccagcgcccccagcucggccccaccgccaaccucccccucgagaugggcuccggccagcucgccccccgccagcagcagcagcagaccgagcucgacaugguccccggccgcgacggccucgccuccuacaaccacucccaggucguccagcccgucaccaccaccggccccgagcacuccaagccccucgagaaguccgacggccucuucgcccaggaccgcgacccccgcuucuccgagaucuaccacaacaucaacgccgaccaguccaagggcaucuccuccuccaccguccccgccacccagcagcucuucucccagggcaacaccuucccccccaccccccgccccgccgagaacuuccgcaacuccggccucgccccccccgucaccaucguccagcccuccgccuccgccggccagaugcucgcccagaucucccgccacuccaaccccacccagggcgccacccccaccuggacccccaccacccgcuccggcuucuccgcccaggucgccacccaggccaccgccaagacccgcaccucccaguucggcgucggcuccuuccagacccccuccuccuucuccuccaugucccuccccggcgcccccaccgccucccccggcgccgccgccuaccccucccucaccaaccgcggcuccaacuucgcccccgagaccggccagaccgccggccaguuccagacccgcaccgccgagggcgucggcgucuggccccaguggcagggccagcagccccaccaccgcuccuccuccuccgagcagcacguccagcagccccccgcccagcagcccggccagcccgaggucuuccaggagaugcucuccaugcucggcgaccaguccaacuccuacaacaacgaggaguuccccgaccucaccauguucccccccuucuccgaguga

SEQ ID NO: 39961 - RNA, 1869 nt, Artificial Sequence
  derived and/or modified sequence opt2 from ARNTL2__Homo_sapiens__NP_001234931
auggccgccgaggaggaggccgccgccggcggcaagguccuccgcgaggagaaccagugcaucgcccccgucgucuccucccgcgucucccccggcacccgccccaccgccaugggcuccuucuccucccacaugaccgaguucccccgcaagcgcaagggcuccgacuccgaccccucccaguccggcaucaugaccgagaaggucgucgagaagcucucccagaacccccucaccuaccuccucuccacccgcaucgagaucuccgccuccuccggcucccgcgaggcccacucccagaccgagaagcgccgccgcgacaagaugaacaaccucaucgaggagcucuccgccaugaucccccagugcaaccccauggcccgcaagcucgacaagcucaccguccuccgcauggccguccagcaccuccgcucccucaagggccucaccaacuccuacgucggcuccaacuaccgccccuccuuccuccaggacaacgagcuccgccaccucauccucaagaccgccgagggcuuccucuucgucgucggcugcgagcgcggcaagauccucuucgucuccaaguccgucuccaagauccucaacuacgaccaggccucccucaccggccagucccucuucgacuuccuccaccccaaggacgucgccaaggucaaggagcagcucuccuccuucgacaucuccccccgcgagaagcucaucgacgccaagaccggccuccagguccacuccaaccuccacgccggccgcacccgcgucuacuccggcucccgccgcuccuucuucugccgcaucaaguccugcaagaucuccgucaaggaggagcacggcugccuccccaacuccaagaagaaggagcaccgcaaguucuacaccauccacugcaccggcuaccuccgcuccuggccccccaacaucgucggcauggaggaggagcgcaacuccaagaaggacaacuccaacuucaccugccucgucgccaucggccgccuccagcccuacaucgucccccagaacuccggcgagaucaacgucaagcccaccgaguucaucacccgcuucgccgucaacggcaaguucgucuacgucgaccagcgcgccaccgccauccucggcuaccucccccaggagcuccucggcaccuccugcuacgaguacuuccaccaggacgaccacaacaaccucaccgacaagcacaaggccguccuccaguccaaggagaagauccucaccgacuccuacaaguuccgcgccaaggacggcuccuucgucacccucaagucccagugguucuccuucaccaaccccuggaccaaggagcucgaguacaucgucuccgucaacacccucguccucggccacuccgagcccggcgaggccuccuuccuccccugcuccucccaguccuccgaggaguccucccgccaguccugcauguccguccccggcauguccaccggcaccguccucggcgccggcuccaucggcaccgacaucgccaacgagauccucgaccuccagcgccuccaguccuccuccuaccucgacgacuccucccccaccggccucaugaaggacacccacaccgucaacugccgcuccauguccaacaaggagcucuucccccccucccccuccgagaugggcgagcucgaggccacccgccagaaccaguccaccgucgccguccacucccacgagccccuccucuccgacggcgcccagcucgacuucgacgcccucugcgacaacgacgacaccgccauggccgccuucaugaacuaccucgaggccgagggcggccucggcgaccccggcgacuucuccgacauccaguggacccucuga

SEQ ID NO: 39962 - RNA, 1878 nt, Artificial Sequence
  derived and/or modified sequence opt2 from ARNTL__Homo_sapiens__NP_001025443
auggccgaccagcgcauggacaucuccuccaccaucuccgacuucaugucccccggccccaccgaccuccucuccuccucccucggcaccuccggcgucgacugcaaccgcaagcgcaagggcuccuccaccgacuaccaggaguccauggacaccgacaaggacgacccccacggccgccucgaguacaccgagcaccagggccgcaucaagaacgcccgcgaggcccacucccagaucgagaagcgccgccgcgacaagaugaacuccuucaucgacgagcucgccucccucguccccaccugcaacgccaugucccgcaagcucgacaagcucaccguccuccgcauggccguccagcacaugaagacccuccgcggcgccaccaaccccuacaccgaggccaacuacaagcccaccuuccucuccgacgacgagcucaagcaccucauccuccgcgccgccgacggcuuccucuucgucgucggcugcgaccgcggcaagauccucuucgucuccgaguccgucuucaagauccucaacuacucccagaacgaccucaucggccagucccucuucgacuaccuccaccccaaggacaucgccaaggucaaggagcagcucuccuccuccgacaccgccccccgcgagcgccucaucgacgccaagaccggccuccccgucaagaccgacaucacccccggccccucccgccucugcuccggcgcccgccgcuccuucuucugccgcaugaagugcaaccgccccuccgucaaggucgaggacaaggacuuccccuccaccugcuccaagaagaaggaccgcaaguccuucugcaccauccacuccaccggcuaccucaaguccuggccccccaccaagaugggccucgacgaggacaacgagcccgacaacgagggcugcaaccucuccugccucgucgccaucggccgccuccacucccacgucgucccccagcccgucaacggcgagauccgcgucaaguccauggaguacgucucccgccacgccaucgacggcaaguucgucuucgucgaccagcgcgccaccgccauccucgccuaccucccccaggagcuccucggcaccuccugcuacgaguacuuccaccaggacgacaucggccaccucgccgagugccaccgccagguccuccagacccgcgagaagaucaccaccaacugcuacaaguucaagaucaaggacggcuccuucaucacccuccgcucccgcugguucuccuucaugaaccccuggaccaaggaggucgaguacaucgucuccaccaacaccgucguccucgccaacguccucgagggcggcgaccccaccuucccccagcucaccgccuccccccacuccauggacuccaugcuccccuccggcgagggcggccccaagcgcacccaccccaccguccccggcauccccggcggcacccgcgccggcgccggcaagaucggccgcaugaucgccgaggagaucauggagauccaccgcauccgcggcuccucccccuccuccugcggcuccuccccccucaacaucaccuccacccccccccccgacgccuccucccccggcggcaagaagauccucaacggcggcacccccgacauccccuccuccggccuccucuccggccaggcccaggagaaccccggcuaccccuacuccgacuccuccuccauccucggcgagaacccccacaucggcaucgacaugaucgacaacgaccagggcuccuccucccccuccaacgacgaggccgccauggccgucaucaugucccuccucgaggccgacgccggccucggcggccccgucgacuucuccgaccuccccuggccccucuga

SEQ ID NO: 39963 - RNA, 1071 nt, Artificial Sequence
  derived and/or modified sequence opt2 from ARPC1A__Homo_sapiens__NP_001177925
augcccggcaccggcaucguccucaucgcccucucccccaacaaccacgagguccacaucuacaagaagaacggcucccagugggucaaggcccacgagcucaaggagcacaacggccacaucaccggcaucgacugggcccccaaguccgaccgcaucgucaccugcggcgccgaccgcaacgccuacgucuggucccagaaggacggcgucuggaagcccacccucgucauccuccgcaucaaccgcgccgccaccuucgucaagugguccccccucgagaacaaguucgccgucggcuccggcgcccgccucaucuccgucugcuacuucgaguccgagaacgacuggugggucuccaagcacaucaagaagcccauccgcuccaccguccucucccucgacuggcaccccaacaacguccuccucgccgccggcuccugcgacuucaagugccgcgucuucuccgccuacaucaaggaggucgacgagaagcccgccuccacccccuggggcuccaagaugcccuucggccagcucauguccgaguucggcggcuccggcaccggcggcuggguccacggcgucuccuucuccgccuccggcucccgccucgccugggucucccacgacuccaccgucuccgucgccgacgccuccaaguccguccaggucuccacccucaagaccgaguuccucccccuccucuccgucuccuucgucuccgagaacuccgucgucgccgccggccacgacugcugccccaugcucuucaacuacgacgaccgcggcugccucaccuucgucuccaagcucgacauccccaagcaguccauccagcgcaacauguccgccauggagcgcuuccgcaacauggacaagcgcgccaccaccgaggaccgcaacaccgcccucgagacccuccaccagaacuccaucacccaggucuccaucuacgaggucgacaagcaggacugccgcaaguucugcaccaccggcaucgacggcgccaugaccaucugggacuucaagacccucgaguccuccauccagggccuccgcaucauguga

SEQ ID NO: 39964 - RNA, 1119 nt, Artificial Sequence
  derived and/or modified sequence opt2 from ARPC1B__Homo_sapiens__NP_005711
auggccuaccacuccuuccucgucgagcccaucuccugccacgccuggaacaaggaccgcacccagaucgccaucugccccaacaaccacgagguccacaucuacgagaaguccggcgccaaguggaccaagguccacgagcucaaggagcacaacggccaggucaccggcaucgacugggcccccgaguccaaccgcaucgucaccugcggcaccgaccgcaacgccuacgucuggacccucaagggccgcaccuggaagcccacccucgucauccuccgcaucaaccgcgccgcccgcugcguccgcugggcccccaacgagaacaaguucgccgucggcuccggcucccgcgucaucuccaucugcuacuucgagcaggagaacgacuggugggucugcaagcacaucaagaagcccauccgcuccaccguccucucccucgacuggcaccccaacaacguccuccucgccgccggcuccugcgacuucaagugccgcaucuucuccgccuacaucaaggaggucgaggagcgccccgcccccacccccuggggcuccaagaugcccuucggcgagcucauguucgaguccuccuccuccugcggcuggguccacggcgucugcuucuccgccuccggcucccgcgucgccugggucucccacgacuccaccgucugccucgccgacgccgacaagaagauggccgucgccacccucgccuccgagacccucccccuccucgcccucaccuucaucaccgacaacucccucgucgccgccggccacgacugcuuccccguccucuucaccuacgacgccgccgccggcaugcucuccuucggcggccgccucgacguccccaagcaguccucccagcgcggccucaccgcccgcgagcgcuuccagaaccucgacaagaaggccuccuccgagggcggcaccgccgccggcgccggccucgacucccuccacaagaacuccgucucccagaucuccguccucuccggcggcaaggccaagugcucccaguucugcaccaccggcauggacggcggcauguccaucugggacgucaagucccucgaguccgcccucaaggaccucaagaucaaguga

SEQ ID NO: 39965 - RNA, 903 nt, Artificial Sequence
  derived and/or modified sequence opt2 from ARPC2__Homo_sapiens__NP_005722
augauccuccucgaggucaacaaccgcaucaucgaggagacccucgcccucaaguucgagaacgccgccgccggcaacaagcccgaggccgucgaggucaccuucgccgacuucgacggcguccucuaccacaucuccaaccccaacggcgacaagaccaaggucauggucuccaucucccucaaguucuacaaggagcuccaggcccacggcgccgacgagcuccucaagcgcgucuacggcuccuuccucgucaaccccgaguccggcuacaacgucucccuccucuacgaccucgagaaccuccccgccuccaaggacuccaucguccaccaggccggcaugcucaagcgcaacugcuucgccuccgucuucgagaaguacuuccaguuccaggaggagggcaaggagggcgagaaccgcgccgucauccacuaccgcgacgacgagaccauguacgucgaguccaagaaggaccgcgucaccgucgucuucuccaccgucuucaaggacgacgacgacgucgucaucggcaaggucuucaugcaggaguucaaggagggccgccgcgccucccacaccgccccccagguccucuucucccaccgcgagcccccccucgagcucaaggacaccgacgccgccgucggcgacaacaucggcuacaucaccuucguccucuucccccgccacaccaacgccuccgcccgcgacaacaccaucaaccucauccacaccuuccgcgacuaccuccacuaccacaucaagugcuccaaggccuacauccacacccgcaugcgcgccaagaccuccgacuuccucaagguccucaaccgcgcccgccccgacgccgagaagaaggagaugaagaccaucaccggcaagaccuucuccucccgcuga

SEQ ID NO: 39966 - RNA, 537 nt, Artificial Sequence
  derived and/or modified sequence opt2 from ARPC3__Homo_sapiens__NP_001265485
augcccgccuaccacuccucccucauggaccccgacaccaagcucaucggcaacauggcccuccuccccauccgcucccaguucaagggccccgccccccgcgagaccaaggacaccgacaucgucgacgaggccaucuacuacuucaaggccaacgucuucuucaagaacuacgagaucaagaacgaggccgaccgcacccucaucuacaucacccucuacaucuccgagugccucaagaagcuccagaagugcaacuccaagucccagggcgagaaggagauguacacccucggcaucaccaacuuccccauccccggcgagcccggcuucccccucaacgccaucuacgccaagcccgccaacaagcaggaggacgaggucaugcgcgccuaccuccagcagcuccgccaggagaccggccuccgccucugcgagaaggucuucgacccccagaacgacaagcccuccaagugguggaccugcuucgucaagcgccaguucaugaacaagucccucuccggccccggccaguga

SEQ ID NO: 39967 - RNA, 465 nt, Artificial Sequence
  derived and/or modified sequence opt2 from ARPC5__Homo_sapiens__NP_001257368
auguccaagaacaccgucuccuccgcccgcuuccgcaaggucgacgucgacgaguacgacgagaacaaguucgucgacgaggaggacggcggcgacggccaggccggccccgacgagggcgaggucgacuccugccuccgccacuccaucaccggcaacaugaccgccgcccuccaggccgcccucaagaacccccccaucaacaccaagucccaggccgucaaggaccgcgccggcuccaucguccucaagguccucaucuccuucaaggccaacgacaucgagaaggccguccagucccucgacaagaacggcgucgaccuccucaugaaguacaucuacaagggcuucgagucccccuccgacaacuccuccgccaugcuccuccaguggcacgagaaggcccucgccgccggcggcgucggcuccaucguccgcguccucaccgcccgcaagaccgucuga

SEQ ID NO: 39968 - RNA, 681 nt, Artificial Sequence
  derived and/or modified sequence opt2 from ARPIN__Homo_sapiens__NP_872422
augucccgcaucuaccacgacggcgcccuccgcaacaaggccguccaguccguccgccuccccggcgccugggaccccgccgcccaccagggcggcaacggcguccuccucgagggcgagcucaucgacgucucccgccacuccauccucgacacccacggccgcaaggagcgcuacuacguccucuacauccgccccucccacauccaccgccgcaaguucgacgccaagggcaacgagaucgagcccaacuucuccgccacccgcaaggucaacaccggcuuccucauguccuccuacaaggucgaggccaagggcgacaccgaccgccucacccccgaggcccucaagggccucgucaacaagcccgagcuccucgcccucaccgagucccucacccccgaccacaccgucgccuucuggaugcccgaguccgagauggaggucauggagcucgagcucggcgccggcguccgccucaagacccgcggcgacggccccuuccucgacucccucgccaagcucgaggccggcaccgucaccaagugcaacuucaccggcgacggcaagaccggcgccuccuggaccgacaacaucauggcccagaagugcuccaagggcgccgccgccgagauccgcgagcagggcgacggcgccgaggacgaggagugggacgacuga

SEQ ID NO: 39969 - RNA, 270 nt, Artificial Sequence
  derived and/or modified sequence opt2 from ARPP21__Homo_sapiens__NP_001020240
auguccgagcagggcgaccucaaccaggccaucgccgaggagggcggcaccgagcaggagaccgccacccccgagaacggcaucgucaaguccgagucccucgacgaggaggagaagcucgagcuccagcgccgccucgaggcccagaaccaggagcgccgcaaguccaaguccggcgccggcaagggcaagcucacccgcucccucgccgucugcgaggaguccuccgcccgccccggcggcgagucccuccaggaccagacccucuga

SEQ ID NO: 39970 - RNA, 1167 nt, Artificial Sequence
  derived and/or modified sequence opt2 from ARR3__Homo_sapiens__NP_004303
auguccaaggucuucaagaagaccuccuccaacggcaagcucuccaucuaccucggcaagcgcgacuucgucgaccacgucgacaccgucgagcccaucgacggcgucguccucgucgaccccgaguaccucaagugccgcaagcucuucgucaugcucaccugcgccuuccgcuacggccgcgacgaccucgaggucaucggccucaccuuccgcaaggaccucuacguccagacccuccaggucguccccgccgaguccuccuccccccagggcccccucaccguccuccaggagcgccuccuccacaagcucggcgacaacgccuaccccuucacccuccagauggucaccaaccuccccugcuccgucacccuccagcccggccccgaggacgccggcaagcccugcggcaucgacuucgaggucaaguccuucugcgccgagaaccccgaggagaccgucuccaagcgcgacuacguccgccucgucguccgcaagguccaguucgccccccccgaggccggccccggccccuccgcccagaccauccgccgcuuccuccucuccgcccagccccuccagcuccaggccuggauggaccgcgagguccacuaccacggcgagcccaucuccgucaacgucuccaucaacaacugcaccaacaaggucaucaagaagaucaagaucuccgucgaccagaucaccgacgucguccucuacucccucgacaaguacaccaagaccgucuucauccaggaguucaccgagaccgucgccgccaacuccuccuucucccaguccuucgccgucacccccauccucgccgccuccugccagaagcgcggccucgcccucgacggcaagcucaagcacgaggacaccaaccucgccuccuccaccaucauccgccccggcauggacaaggagcuccucggcauccucgucuccuacaagguccgcgucaaccucauggucuccugcggcggcauccucggcgaccucaccgccuccgacgucggcgucgagcucccccucguccucauccaccccaagcccucccacgaggccgccuccuccgaggacaucgucaucgaggaguucacccgcaagggcgaggaggagucccagaaggccgucgaggccgagggcgacgagggcuccuga

SEQ ID NO: 39971 - RNA, 1257 nt, Artificial Sequence
  derived and/or modified sequence opt2 from ARRB1__Homo_sapiens__NP_004032
augggcgacaagggcacccgcgucuucaagaaggccucccccaacggcaagcucaccgucuaccucggcaagcgcgacuucgucgaccacaucgaccucgucgaccccgucgacggcgucguccucgucgaccccgaguaccucaaggagcgccgcgucuacgucacccucaccugcgccuuccgcuacggccgcgaggaccucgacguccucggccucaccuuccgcaaggaccucuucgucgccaacguccaguccuucccccccgcccccgaggacaagaagccccucacccgccuccaggagcgccucaucaagaagcucggcgagcacgccuaccccuucaccuucgagaucccccccaaccuccccugcuccgucacccuccagcccggccccgaggacaccggcaaggccugcggcgucgacuacgaggucaaggccuucugcgccgagaaccucgaggagaagauccacaagcgcaacuccguccgccucgucauccgcaagguccaguacgcccccgagcgccccggcccccagcccaccgccgagaccacccgccaguuccucauguccgacaagccccuccaccucgaggccucccucgacaaggagaucuacuaccacggcgagcccaucuccgucaacguccacgucaccaacaacaccaacaagaccgucaagaagaucaagaucuccguccgccaguacgccgacaucugccucuucaacaccgcccaguacaagugccccgucgccauggaggaggccgacgacaccgucgcccccuccuccaccuucugcaaggucuacacccucacccccuuccucgccaacaaccgcgagaagcgcggccucgcccucgacggcaagcucaagcacgaggacaccaaccucgccuccuccacccuccuccgcgagggcgccaaccgcgagauccucggcaucaucgucuccuacaaggucaaggucaagcucgucgucucccgcggcggccuccucggcgaccucgccuccuccgacgucgccgucgagcuccccuucacccucaugcaccccaagcccaaggaggagcccccccaccgcgagguccccgagaacgagacccccgucgacaccaaccucaucgagcucgacaccaacgacgacgacaucgucuucgaggacuucgcccgccagcgccucaagggcaugaaggacgacaaggaggaggaggaggacggcaccggcuccccccagcucaacaaccgcuga

SEQ ID NO: 39972 - RNA, 993 nt, Artificial Sequence
  derived and/or modified sequence opt2 from ARRB2__Homo_sapiens__NP_001244258
augggcgagaagcccggcacccgcgucuucaagaaguccucccccaacugcaagcucaccgucuaccucggcaagcgcgacuucgucgaccaccucgacaaggucgaccccgucgacggcgucguccucgucgaccccgacuaccucaaggaccgcaaggucuucgucacccucaccugcgccuuccgcuacggccgcgaggaccucgacguccucggccucuccuuccgcaaggaccucuucaucgccaccuaccaggccuucccccccguccccaaccccccccgcccccccacccgccuccaggaccgccuccuccgcaagcucggccagcacgcccaccccuucuucuucaccaucccccagaaccuccccugcuccgucacccuccagcccggccccgaggacaccggcaaggccugcggcgucgacuucgagauccgcgccuucugcgccaagucccucgaggagaagucccacaagcgcaacuccguccgccucgucauccgcaagguccaguucgcccccgagaagcccggcccccagcccuccgccgagaccacccgccacuuccucauguccgaccgcucccuccaccucgaggccucccucgacaaggagcucuacuaccacggcgagccccucaacgucaacguccacgucaccaacaacuccaccaagaccgucaagaagaucaaggucuccguccgccaguacgccgacaucugccucuucuccaccgcccaguacaagugccccgucgcccagcucgagcaggacgaccagcgcgagggcggcugccagcagggcggcgccggcaaccccggcguccuccagggccagggcgaggccggcggcgucucccgccgcggcugccucugcggcgccgccuucugcuccuacgccccccaggccccccgcccccacccccccccccagacccccgucucccgcuccggcgaccgcugccccugcggccaccagccccacuga

SEQ ID NO: 39973 - RNA, 1209 nt, Artificial Sequence
  derived and/or modified sequence opt2 from ARRDC2__Homo_sapiens__NP_001020775
augcgcuccggcggcguccgcuccuucgcccucgagcucgcccgcggccccggcggcgccuaccgcggcggcgagcgccucugcggccgcguccuccucgaggccgccgccccccuccgcguccgcgcccucgaggucaaggcccgcggcggcgccgccacccacuggcucgagggccgcuccgucggcgucaacgccgucuccuccgacuacgccgccgccgagaccuaccuccgccgccgccagcuccuccuccgcgacaccggcgagaccaccacccucccccccggccgccacgaguuccucuucuccuuccagcucccccccacccucgucaccuccuucgagggcaagcacggcuccguccgcuacugcaucaaggccacccuccaccgccccuggguccccgcccgccgcgcccgcaaggucuucaccgucaucgagcccgucgacaucaacacccccgcccuccucgccccccaggccggcgcccgcgagaaggucgcccgcuccugguacugcaaccgcggccucgucucccucuccgccaagaucgaccgcaagggcuacacccccggcgaggucauccccgucuucgccgagaucgacaacggcuccacccgccccguccucccccgcgccgccgucguccagacccagaccuucauggcccgcggcgcccgcaagcagaagcgcgccgucgucgccucccucgccggcgagcccgucggccccggccagcgcgcccucuggcagggccgcgcccuccgcaucccccccgucggccccuccauccuccacugccgcguccuccacgucgacuacgcccucaaggucugcgucgacauccccggcaccuccaagcuccuccucgagcucccccucgucaucggcaccaucccccuccaccccuucggcucccgcuccuccuccgucggcucccacgccuccuuccuccucgacuggcgccucggcgcccuccccgagcgccccgaggccccccccgaguacuccgaggucgucgccgacaccgaggaggccgcccucggccagucccccuucccccucccccaggaccccgacaugucccucgagggccccuucuucgccuacauccaggaguuccgcuaccgcccccccccccucuacuccgaggaggaccccaacccccuccucggcgacaugcgcccccgcugcaugaccugcuga

SEQ ID NO: 39974 - RNA, 1245 nt, Artificial Sequence
  derived and/or modified sequence opt2 from ARRDC3__Homo_sapiens__NP_065852
augguccucggcaaggucaagucccucaccaucuccuucgacugccucaacgacuccaacguccccgucuacuccuccggcgacaccgucuccggccgcgucaaccucgaggucaccggcgagauccgcgucaagucccucaagauccacgcccgcggccacgccaagguccgcuggaccgagucccgcaacgccggcuccaacaccgccuacacccagaacuacaccgaggaggucgaguacuucaaccacaaggacauccucaucggccacgagcgcgacgacgacaacuccgaggagggcuuccacaccauccacuccggccgccacgaguacgccuucuccuucgagcucccccagaccccccucgccaccuccuucgagggccgccacggcuccguccgcuacugggucaaggccgagcuccaccgccccuggcuccuccccgucaagcucaagaaggaguucaccgucuucgagcacaucgacaucaacacccccucccuccucuccccccaggccggcaccaaggagaagacccucugcugcugguucugcaccuccggccccaucucccucuccgccaagaucgagcgcaagggcuacacccccggcgaguccauccagaucuucgccgagaucgagaacugcuccucccgcauggucguccccaaggccgccaucuaccagacccaggccuucuacgccaagggcaagaugaaggaggucaagcagcucgucgccaaccuccgcggcgagucccucuccuccggcaagaccgagaccuggaacggcaagcuccucaagaucccccccgucucccccuccauccucgacugcuccaucauccgcgucgaguacucccucauggucuacgucgacauccccggcgccauggaccucuuccucaaccucccccucgucaucggcaccaucccccuccaccccuucggcucccgcaccuccuccgucuccucccagugcuccaugaacaugaacuggcucucccucucccuccccgagcgccccgaggccccccccuccuacgccgaggucgucaccgaggagcagcgccgcaacaaccucgcccccgucuccgccugcgacgacuucgagcgcgcccuccagggcccccucuucgccuacauccaggaguuccgcuuccucccccccccccucuacuccgagaucgaccccaaccccgaccaguccgccgacgaccgccccuccugccccucccgcuga

SEQ ID NO: 39975 - RNA, 1257 nt, Artificial Sequence
  derived and/or modified sequence opt2 from ARRDC4__Homo_sapiens__NP_899232
augggcggcgaggccggcugcgccgccgccgucggcgccgagggccgcgucaagucccucggccucgucuucgaggacgagcgcaagggcugcuacuccuccggcgagaccgucgccggccacguccuccucgaggccuccgagcccgucgcccuccgcgcccuccgccucgaggcccagggccgcgccaccgccgccuggggccccuccaccugcccccgcgccuccgccuccaccgccgcccucgccgucuucuccgaggucgaguaccucaacguccgccucucccuccgcgagccccccgccggcgagggcaucauccuccuccagcccggcaagcacgaguuccccuuccgcuuccagcuccccuccgagccccucgucaccuccuucaccggcaaguacggcuccauccaguacugcguccgcgccguccucgagcgccccaagguccccgaccaguccgucaagcgcgagcuccaggucgucucccacgucgacgucaacacccccgcccuccucacccccguccucaagacccaggagaagauggucggcugcugguucuucaccuccggccccgucucccucuccgccaagaucgagcgcaagggcuacugcaacggcgaggccauccccaucuacgccgagaucgagaacugcuccucccgccucaucguccccaaggccgccaucuuccagacccagaccuaccucgccuccggcaagaccaagaccauccgccacauggucgccaacguccgcggcaaccacaucgccuccggcuccaccgacaccuggaacggcaagacccucaagaucccccccgucacccccuccauccucgacugcugcaucauccgcgucgacuacucccucgccgucuacauccacauccccggcgccaagaagcucaugcucgagcucccccucgucaucggcaccauccccuacaacggcuucggcucccgcaacuccuccaucgccucccaguucuccauggacauguccuggcucacccucacccuccccgagcagcccgaggccccccccaacuacgccgacgucgucuccgaggaggaguucucccgccacaucccccccuacccccagccccccaacugcgagggcgaggucugcugccccgucuucgccugcauccaggaguuccgcuuccagccccccccccucuacuccgaggucgacccccaccccuccgacgucgaggagucccagcccgucuccuucauccucuga

SEQ ID NO: 39976 - RNA, 1530 nt, Artificial Sequence
  derived and/or modified sequence opt2 from ARSA__Homo_sapiens__NP_001078895
auguccaugggcgccccccgcucccuccuccucgcccucgccgccggccucgccgucgcccgcccccccaacaucguccucaucuucgccgacgaccucggcuacggcgaccucggcugcuacggccaccccuccuccaccacccccaaccucgaccagcucgccgccggcggccuccgcuucaccgacuucuacguccccgucucccucugcacccccucccgcgccgcccuccucaccggccgccuccccguccgcaugggcauguaccccggcguccucguccccuccucccgcggcggccucccccucgaggaggucaccgucgccgagguccucgccgcccgcggcuaccucaccggcauggccggcaaguggcaccucggcgucggccccgagggcgccuuccuccccccccaccagggcuuccaccgcuuccucggcauccccuacucccacgaccagggccccugccagaaccucaccugcuucccccccgccacccccugcgacggcggcugcgaccagggccucguccccaucccccuccucgccaaccucuccgucgaggcccagccccccuggcuccccggccucgaggcccgcuacauggccuucgcccacgaccucauggccgacgcccagcgccaggaccgccccuucuuccucuacuacgccucccaccacacccacuacccccaguucuccggccaguccuucgccgagcgcuccggccgcggccccuucggcgacucccucauggagcucgacgccgccgucggcacccucaugaccgccaucggcgaccucggccuccucgaggagacccucgucaucuucaccgccgacaacggccccgagaccaugcgcaugucccgcggcggcugcuccggccuccuccgcugcggcaagggcaccaccuacgagggcggcguccgcgagcccgcccucgccuucuggcccggccacaucgcccccggcgucacccacgagcucgccuccucccucgaccuccuccccacccucgccgcccucgccggcgccccccuccccaacgucacccucgacggcuucgaccucuccccccuccuccucggcaccggcaaguccccccgccagucccucuucuucuaccccuccuaccccgacgagguccgcggcgucuucgccguccgcaccggcaaguacaaggcccacuucuucacccagggcuccgcccacuccgacaccaccgccgaccccgccugccacgccuccuccucccucaccgcccacgagcccccccuccucuacgaccucuccaaggaccccggcgagaacuacaaccuccucggcggcgucgccggcgccacccccgagguccuccaggcccucaagcagcuccagcuccucaaggcccagcucgacgccgccgucaccuucggccccucccaggucgcccgcggcgaggaccccgcccuccagaucugcugccaccccggcugcaccccccgccccgccugcugccacugccccgacccccacgccuga

SEQ ID NO: 39977 - RNA, 1602 nt, Artificial Sequence
  derived and/or modified sequence opt2 from ARSB__Homo_sapiens__NP_000037
augggcccccgcggcgccgccucccucccccgcggccccggcccccgccgccuccuccuccccgucguccucccccuccuccuccuccuccuccucgccccccccggcuccggcgccggcgccucccgccccccccaccucgucuuccuccucgccgacgaccucggcuggaacgacgucggcuuccacggcucccgcauccgcaccccccaccucgacgcccucgccgccggcggcguccuccucgacaacuacuacacccagccccucugcacccccucccgcucccagcuccucaccggccgcuaccagauccgcaccggccuccagcaccagaucaucuggcccugccagcccuccugcgucccccucgacgagaagcuccucccccagcuccucaaggaggccggcuacaccacccacauggucggcaaguggcaccucggcauguaccgcaaggagugccuccccacccgccgcggcuucgacaccuacuucggcuaccuccucggcuccgaggacuacuacucccacgagcgcugcacccucaucgacgcccucaacgucacccgcugcgcccucgacuuccgcgacggcgaggaggucgccaccggcuacaagaacauguacuccaccaacaucuucaccaagcgcgccaucgcccucaucaccaaccacccccccgagaagccccucuuccucuaccucgcccuccaguccguccacgagccccuccagguccccgaggaguaccucaagcccuacgacuucauccaggacaagaaccgccaccacuacgccggcauggucucccucauggacgaggccgucggcaacgucaccgccgcccucaaguccuccggccucuggaacaacaccgucuucaucuucuccaccgacaacggcggccagacccucgccggcggcaacaacuggccccuccgcggccgcaaguggucccucugggagggcggcguccgcggcgucggcuucgucgccuccccccuccucaagcagaagggcgucaagaaccgcgagcucauccacaucuccgacuggcuccccacccucgucaagcucgcccgcggccacaccaacggcaccaagccccucgacggcuucgacgucuggaagaccaucuccgagggcucccccuccccccgcaucgagcuccuccacaacaucgaccccaacuucgucgacuccucccccugcccccgcaacuccauggcccccgccaaggacgacuccucccuccccgaguacuccgccuucaacaccuccguccacgccgccauccgccacggcaacuggaagcuccucaccggcuaccccggcugcggcuacugguuccccccccccucccaguacaacgucuccgagauccccuccuccgacccccccaccaagacccucuggcucuucgacaucgaccgcgaccccgaggagcgccacgaccucucccgcgaguacccccacaucgucaccaagcuccucucccgccuccaguucuaccacaagcacuccguccccgucuacuuccccgcccaggacccccgcugcgaccccaaggccaccggcgucuggggccccuggauguga

SEQ ID NO: 39978 - RNA, 1782 nt, Artificial Sequence
  derived and/or modified sequence opt2 from ARSD__Homo_sapiens__NP_001660
augcgcuccgccgcccgccgcggccgcgccgcccccgccgcccgcgacucccuccccguccuccucuuccucugccuccuccucaagaccugcgagcccaagaccgccaacgccuucaagcccaacauccuccucaucauggccgacgaccucggcaccggcgaccucggcugcuacggcaacaacacccuccgcacccccaacaucgaccagcucgccgaggagggcguccgccucacccagcaccucgccgccgccccccucugcacccccucccgcgccgccuuccucaccggccgccacuccuuccgcuccggcauggacgccuccaacggcuaccgcgcccuccaguggaacgccggcuccggcggccuccccgagaacgagaccaccuucgcccgcauccuccagcagcacggcuacgccaccggccucaucggcaaguggcaccagggcgucaacugcgccucccgcggcgaccacugccaccacccccucaaccacggcuucgacuacuucuacggcaugcccuucacccucaccaacgacugcgaccccggccgcccccccgaggucgacgccgcccuccgcgcccagcucuggggcuacacccaguuccucgcccucggcauccucacccucgccgccggccagaccugcggcuucuucuccgucuccgcccgcgccgucaccggcauggccggcgucggcugccucuucuucaucuccugguacuccuccuucggcuucguccgccgcuggaacugcauccucaugcgcaaccacgacgucaccgagcagcccaugguccucgagaagaccgccucccucaugcucaaggaggccgucuccuacaucgagcgccacaagcacggccccuuccuccucuuccucucccuccuccacguccacaucccccucgucaccaccuccgccuuccucggcaagucccagcacggccucuacggcgacaacgucgaggagauggacuggcucaucggcaagguccucaacgccaucgaggacaacggccucaagaacuccaccuucaccuacuucaccuccgaccacggcggccaccucgaggcccgcgacggccacucccagcucggcggcuggaacggcaucuacaagggcggcaagggcaugggcggcugggagggcggcauccgcguccccggcaucuuccacuggcccggcguccuccccgccggccgcgucaucggcgagcccaccucccucauggacgucuuccccaccgucguccagcucgucggcggcgaggucccccaggaccgcgucaucgacggccacucccucgucccccuccuccagggcgccgaggcccgcuccgcccacgaguuccucuuccacuacugcggccagcaccuccacgccgcccgcuggcaccagaaggacuccggcuccgucuggaagguccacuacaccaccccccaguuccaccccgagggcgccggcgccugcuacggccgcggcgucugccccugcuccggcgagggcgucacccaccaccgccccccccuccucuucgaccucucccgcgaccccuccgaggcccgcccccucacccccgacuccgagccccucuaccacgccgucaucgcccgcgucggcgccgccgucuccgagcaccgccagacccucucccccgucccccagcaguucuccauguccaacauccucuggaagcccuggcuccagcccugcugcggccacuuccccuucugcuccugccacgaggacggcgacggcacccccuga

SEQ ID NO: 39979 - RNA, 1845 nt, Artificial Sequence
  derived and/or modified sequence opt2 from ARSE__Homo_sapiens__NP_001269557
augcgccccgucaucaaccgcugcgcccccggcucccucgaccucaugcucccccaggccgccuccgagggcaucgucuuccacucccuccagaucucccucugcuuccgcuccuggcuccccgccaugcucgccguccuccucucccucgcccccuccgccuccuccgacaucuccgccucccgccccaacauccuccuccucauggccgacgaccucggcaucggcgacaucggcugcuacggcaacaacaccaugcgcacccccaacaucgaccgccucgccgaggacggcgucaagcucacccagcacaucuccgccgccucccucugcacccccucccgcgccgccuuccucaccggccgcuaccccguccgcuccggcauggucuccuccaucggcuaccgcguccuccaguggaccggcgccuccggcggccuccccaccaacgagaccaccuucgccaagauccucaaggagaagggcuacgccaccggccucaucggcaaguggcaccucggccucaacugcgaguccgccuccgaccacugccaccacccccuccaccacggcuucgaccacuucuacggcaugcccuucucccucaugggcgacugcgcccgcugggagcucuccgagaagcgcgucaaccucgagcagaagcucaacuuccucuuccagguccucgcccucgucgcccucacccucgucgccggcaagcucacccaccucauccccgucuccuggaugcccgucaucugguccgcccucuccgccguccuccuccucgccuccuccuacuucgucggcgcccucaucguccacgccgacugcuuccucaugcgcaaccacaccaucaccgagcagcccaugugcuuccagcgcaccaccccccucauccuccaggaggucgccuccuuccucaagcgcaacaagcacggccccuuccuccucuucgucuccuuccuccacguccacaucccccucaucaccauggagaacuuccucggcaagucccuccacggccucuacggcgacaacgucgaggagauggacuggauggucggccgcauccucgacacccucgacgucgagggccucuccaacuccacccucaucuacuucaccuccgaccacggcggcucccucgagaaccagcucggcaacacccaguacggcggcuggaacggcaucuacaagggcggcaagggcaugggcggcugggagggcggcauccgcguccccggcaucuuccgcuggcccggcguccuccccgccggccgcgucaucggcgagcccaccucccucauggacgucuuccccaccgucguccgccucgccggcggcgaggucccccaggaccgcgucaucgacggccaggaccuccucccccuccuccucggcaccgcccagcacuccgaccacgaguuccucaugcacuacugcgagcgcuuccuccacgccgcccgcuggcaccagcgcgaccgcggcaccauguggaagguccacuucgucacccccgucuuccagcccgagggcgccggcgccugcuacggccgcaaggucugccccugcuucggcgagaaggucguccaccacgaccccccccuccucuucgaccucucccgcgaccccuccgagacccacauccucacccccgccuccgagcccgucuucuaccaggucauggagcgcguccagcaggccgucugggagcaccagcgcacccucucccccgucccccuccagcucgaccgccucggcaacaucuggcgccccuggcuccagcccugcugcggccccuucccccucugcuggugccuccgcgaggacgacccccaguga

SEQ ID NO: 39980 - RNA, 1773 nt, Artificial Sequence
  derived and/or modified sequence opt2 from ARSF__Homo_sapiens__NP_004033
augcgcccccgccgcccccucgucuucaugucccucgucugcgcccuccucaacaccugccaggcccaccgcguccacgacgacaagcccaacaucguccucaucauggucgacgaccucggcaucggcgaccucggcugcuacggcaacgacaccaugcgcaccccccacaucgaccgccucgcccgcgagggcguccgccucacccagcacaucuccgccgccucccucugcucccccucccgcuccgccuuccucaccggccgcuaccccauccgcuccggcauggucuccuccggcaaccgccgcgucauccagaaccucgccguccccgccggccucccccucaacgagaccacccucgccgcccuccucaagaagcagggcuacuccaccggccucaucggcaaguggcaccagggccucaacugcgacucccgcuccgaccagugccaccaccccuacaacuacggcuucgacuacuacuacggcaugcccuucacccucgucgacuccugcuggcccgaccccucccgcaacaccgagcucgccuucgagucccagcucuggcucugcguccagcucgucgccaucgccauccucacccucaccuucggcaagcucuccggcugggucuccguccccuggcuccucaucuucuccaugauccucuucaucuuccuccucggcuacgccugguucuccucccacaccuccccccucuacugggacugccuccucaugcgcggccacgagaucaccgagcagcccaugaaggccgagcgcgccggcuccaucauggucaaggaggccaucuccuuccucgagcgccacuccaaggagaccuuccuccucuucuucuccuuccuccacguccacaccccccuccccaccaccgacgacuucaccggcaccuccaagcacggccucuacggcgacaacgucgaggagauggacuccauggucggcaagauccucgacgccaucgacgacuucggccuccgcaacaacacccucgucuacuucaccuccgaccacggcggccaccucgaggcccgccgcggccacgcccagcucggcggcuggaacggcaucuacaagggcggcaagggcaugggcggcugggagggcggcauccgcguccccggcaucguccgcuggcccggcaagguccccgccggccgccucaucaaggagcccaccucccucauggacauccuccccaccgucgccuccgucuccggcggcucccucccccaggaccgcgucaucgacggccgcgaccucaugccccuccuccagggcaacguccgccacuccgagcacgaguuccucuuccacuacugcggcuccuaccuccacgccguccgcuggauccccaaggacgacuccggcuccgucuggaaggcccacuacgucacccccgucuuccagccccccgccuccggcggcugcuacgucaccucccucugccgcugcuucggcgagcaggucaccuaccacaaccccccccuccucuucgaccucucccgcgaccccuccgaguccaccccccucacccccgccaccgagccccuccacgacuucgucaucaagaaggucgccaacgcccucaaggagcaccaggagaccaucguccccgucaccuaccagcucuccgagcucaaccagggccgcaccuggcucaagcccugcugcggcgucuuccccuucugccucugcgacaaggaggaggaggucucccagccccgcggccccaacgagaagcgcuga

SEQ ID NO: 39981 - RNA, 1578 nt, Artificial Sequence
  derived and/or modified sequence opt2 from ARSG__Homo_sapiens__NP_055775
augggcuggcucuuccucaagguccuccucgccggcgucuccuucuccggcuuccucuacccccucgucgacuucugcaucuccggcaagacccgcggccagaagcccaacuucgucaucauccucgccgacgacaugggcuggggcgaccucggcgccaacugggccgagaccaaggacaccgccaaccucgacaagauggccuccgagggcaugcgcuucgucgacuuccacgccgccgccuccaccugcucccccucccgcgccucccuccucaccggccgccucggccuccgcaacggcgucacccgcaacuucgccgucaccuccgucggcggccucccccucaacgagaccacccucgccgagguccuccagcaggccggcuacgucaccggcaucaucggcaaguggcaccucggccaccacggcuccuaccaccccaacuuccgcggcuucgacuacuacuucggcauccccuacucccacgacaugggcugcaccgacacccccggcuacaaccacccccccugccccgccugcccccagggcgacggccccucccgcaaccuccagcgcgacugcuacaccgacgucgcccucccccucuacgagaaccucaacaucgucgagcagcccgucaaccucuccucccucgcccagaaguacgccgagaaggccacccaguucauccagcgcgccuccaccuccggccgccccuuccuccucuacgucgcccucgcccacaugcacgucccccuccccgucacccagcuccccgccgccccccgcggccgcucccucuacggcgccggccucugggagauggacucccucgucggccagaucaaggacaaggucgaccacaccgucaaggagaacaccuuccucugguucaccggcgacaacggccccugggcccagaagugcgagcucgccggcuccgucggccccuucaccggcuucuggcagacccgccagggcggcucccccgccaagcagaccaccugggagggcggccaccgcguccccgcccucgccuacuggcccggccgcguccccgucaacgucaccuccaccgcccuccucuccguccucgacaucuuccccaccgucgucgcccucgcccaggccucccucccccagggccgccgcuucgacggcgucgacgucuccgagguccucuucggccgcucccagcccggccaccgcguccucuuccaccccaacuccggcgccgccggcgaguucggcgcccuccagaccguccgccucgagcgcuacaaggccuucuacaucaccggcggcgcccgcgccugcgacggcuccaccggccccgagcuccagcacaaguucccccucaucuucaaccucgaggacgacaccgccgaggccgucccccucgagcgcggcggcgccgaguaccaggccguccuccccgagguccgcaagguccucgccgacguccuccaggacaucgccaacgacaacaucuccuccgccgacuacacccaggaccccuccgucacccccugcugcaaccccuaccagaucgccugccgcugccaggccgccuga

SEQ ID NO: 39982 - RNA, 1689 nt, Artificial Sequence
  derived and/or modified sequence opt2 from ARSH__Homo_sapiens__NP_001011719
augacccgcaacgcccgccccaacaucguccuccucauggccgacgaccucggcgucggcgaccucugcugcuacggcaacaacuccgucuccacccccaacaucgaccgccucgccuccgagggcguccgccucacccagcaccucgccgccgccuccaugugcacccccucccgcgccgccuuccucaccggccgcuaccccauccgcuccggcauggucuccgccuacaaccucaaccgcgccuucaccuggcucggcggcuccggcggccuccccaccaacgagaccaccuucgccaagcuccuccagcaccgcggcuaccgcaccggccucaucggcaaguggcaccucggccucuccugcgccucccgcaacgaccacugcuaccacccccucaaccacggcuuccacuacuucuacggcguccccuucggccuccucuccgacugccaggccuccaagacccccgagcuccaccgcuggcuccgcaucaagcucuggaucuccaccgucgcccucgcccucguccccuuccuccuccucauccccaaguucgcccgcugguucuccguccccuggaaggucaucuucgucuucgcccuccucgccuuccucuucuucaccuccugguacuccuccuacggcuucacccgccgcuggaacugcauccucaugcgcaaccacgagaucauccagcagcccaugaaggaggagaaggucgccucccucaugcucaaggaggcccucgccuucaucgagcgcuacaagcgcgagcccuuccuccucuucuucuccuuccuccacguccacaccccccucaucuccaagaagaaguucgucggccgcuccaaguacggccgcuacggcgacaacgucgaggagauggacuggauggucggcaagauccucgacgcccucgaccaggagcgccucgccaaccacacccucgucuacuucaccuccgacaacggcggccaccucgagccccucgacggcgccguccagcucggcggcuggaacggcaucuacaagggcggcaagggcaugggcggcugggagggcggcauccgcguccccggcaucuuccgcuggcccuccguccucgaggccggccgcgucaucaacgagcccaccucccucauggacaucuaccccacccucuccuacaucggcggcggcauccucucccaggaccgcgucaucgacggccagaaccucaugccccuccucgagggccgcgccucccacuccgaccacgaguuccucuuccacuacugcggcgucuaccuccacaccguccgcuggcaccagaaggacugcgccaccgucuggaaggcccacuacgucacccccaaguucuaccccgagggcaccggcgccugcuacggcuccggcaucugcuccugcuccggcgacgucaccuaccacgaccccccccuccucuucgacaucucccgcgaccccuccgaggcccucccccucaaccccgacaacgagccccucuucgacuccgucaucaagaagauggaggccgccauccgcgagcaccgccgcacccucacccccgucccccagcaguucuccgucuucaacaccaucuggaagcccuggcuccagcccugcugcggcaccuuccccuucugcggcugcgacaaggaggacgacauccuccccauggcccccuga

SEQ ID NO: 39983 - RNA, 1710 nt, Artificial Sequence
  derived and/or modified sequence opt2 from ARSI__Homo_sapiens__NP_001012301
augcacacccucaccggcuucucccucgucucccuccucuccuucggcuaccucuccugggacugggccaagcccuccuucgucgccgacggccccggcgaggccggcgagcagcccuccgccgcccccccccagcccccccacaucaucuucauccucaccgacgaccagggcuaccacgacgucggcuaccacggcuccgacaucgagacccccacccucgaccgccucgccgccaagggcgucaagcucgagaacuacuacauccagcccaucugcacccccucccgcucccagcuccucaccggccgcuaccagauccacaccggccuccagcacuccaucauccgcccccagcagcccaacugccucccccucgaccaggucacccucccccagaagcuccaggaggccggcuacuccacccacauggucggcaaguggcaccucggcuucuaccgcaaggagugccuccccacccgccgcggcuucgacaccuuccucggcucccucaccggcaacgucgacuacuacaccuacgacaacugcgacggccccggcgucugcggcuucgaccuccacgagggcgagaacgucgccuggggccucuccggccaguacuccaccaugcucuacgcccagcgcgccucccacauccucgccucccacuccccccagcgcccccucuuccucuacgucgccuuccaggccguccacaccccccuccaguccccccgcgaguaccucuaccgcuaccgcaccaugggcaacgucgcccgccgcaaguacgccgccauggucaccugcauggacgaggccguccgcaacaucaccugggcccucaagcgcuacggcuucuacaacaacuccgucaucaucuucuccuccgacaacggcggccagaccuucuccggcggcuccaacuggccccuccgcggccgcaagggcaccuacugggagggcggcguccgcggccucggcuucguccacuccccccuccucaagcgcaagcagcgcaccucccgcgcccucaugcacaucaccgacugguaccccacccucgucggccucgccggcggcaccaccuccgccgccgacggccucgacggcuacgacgucuggcccgccaucuccgagggccgcgccuccccccgcaccgagauccuccacaacaucgacccccucuacaaccacgcccagcacggcucccucgagggcggcuucggcaucuggaacaccgccguccaggccgccauccgcgucggcgaguggaagcuccucaccggcgaccccggcuacggcgacuggauccccccccagacccucgccaccuuccccggcuccugguggaaccucgagcgcauggccuccguccgccaggccgucuggcucuucaacaucuccgccgaccccuacgagcgcgaggaccucgccggccagcgccccgacgucguccgcacccuccucgcccgccucgccgaguacaaccgcaccgccauccccguccgcuaccccgccgagaacccccgcgcccaccccgacuucaacggcggcgccuggggccccugggccuccgacgaggaggaggaggaggaggagggccgcgcccgcuccuucucccgcggccgccgcaagaagaagugcaagaucugcaagcuccgcuccuucuuccgcaagcucaacacccgccucaugucccagcgcaucuga

SEQ ID NO: 39984 - RNA, 1800 nt, Artificial Sequence
  derived and/or modified sequence opt2 from ARSJ__Homo_sapiens__NP_078866
auggccccccgcggcugcgccggccacccccccccccccuccccccaggccugcgucugccccggcaagaugcucgccaugggcgcccucgccggcuucuggauccucugccuccucaccuacggcuaccucuccuggggccaggcccucgaggaggaggaggagggcgcccuccucgcccaggccggcgagaagcucgagcccuccaccaccuccaccucccagccccaccucaucuucauccucgccgacgaccagggcuuccgcgacgucggcuaccacggcuccgagaucaagacccccacccucgacaagcucgccgccgagggcgucaagcucgagaacuacuacguccagcccaucugcacccccucccgcucccaguucaucaccggcaaguaccagauccacaccggccuccagcacuccaucauccgccccacccagcccaacugccucccccucgacaacgccacccucccccagaagcucaaggaggucggcuacuccacccacauggucggcaaguggcaccucggcuucuaccgcaaggagugcaugcccacccgccgcggcuucgacaccuucuucggcucccuccucggcuccggcgacuacuacacccacuacaagugcgacucccccggcaugugcggcuacgaccucuacgagaacgacaacgccgccugggacuacgacaacggcaucuacuccacccagauguacacccagcgcguccagcagauccucgccucccacaaccccaccaagcccaucuuccucuacaucgccuaccaggccguccacuccccccuccaggcccccggccgcuacuucgagcacuaccgcuccaucaucaacaucaaccgccgccgcuacgccgccaugcucuccugccucgacgaggccaucaacaacgucacccucgcccucaagaccuacggcuucuacaacaacuccaucaucaucuacuccuccgacaacggcggccagcccaccgccggcggcuccaacuggccccuccgcggcuccaagggcaccuacugggagggcggcauccgcgccgucggcuucguccacuccccccuccucaagaacaagggcaccgucugcaaggagcucguccacaucaccgacugguaccccacccucaucucccucgccgagggccagaucgacgaggacauccagcucgacggcuacgacaucugggagaccaucuccgagggccuccgcuccccccgcgucgacauccuccacaacaucgaccccaucuacaccaaggccaagaacggcuccugggccgccggcuacggcaucuggaacaccgccauccaguccgccauccgcguccagcacuggaagcuccucaccggcaaccccggcuacuccgacuggguccccccccaguccuucuccaaccucggccccaaccgcuggcacaacgagcgcaucacccucuccaccggcaaguccgucuggcucuucaacaucaccgccgaccccuacgagcgcgucgaccucuccaaccgcuaccccggcaucgucaagaagcuccuccgccgccucucccaguucaacaagaccgccguccccguccgcuacccccccaaggacccccgcuccaacccccgccucaacggcggcgucuggggccccugguacaaggaggagaccaagaagaagaagcccuccaagaaccaggccgagaagaagcagaagaaguccaagaagaagaagaagaagcagcagaaggccgucuccggcuccaccugccacuccggcgucaccugcggcuga

SEQ ID NO: 39985 - RNA, 1611 nt, Artificial Sequence
  derived and/or modified sequence opt2 from ARSK__Homo_sapiens__NP_937793
augcuccuccucugggucuccgucgucgccgcccucgcccucgccguccucgcccccggcgccggcgagcagcgccgccgcgccgccaaggcccccaacgucguccucgucgucuccgacuccuucgacggccgccucaccuuccaccccggcucccaggucgucaagcuccccuucaucaacuucaugaagacccgcggcaccuccuuccucaacgccuacaccaacucccccaucugcugccccucccgcgccgccaugugguccggccucuucacccaccucaccgaguccuggaacaacuucaagggccucgaccccaacuacaccaccuggauggacgucauggagcgccacggcuaccgcacccagaaguucggcaagcucgacuacaccuccggccaccacuccaucuccaaccgcgucgaggccuggacccgcgacgucgccuuccuccuccgccaggagggccgccccauggucaaccucauccgcaaccgcaccaagguccgcgucauggagcgcgacuggcagaacaccgacaaggccgucaacuggcuccgcaaggaggccaucaacuacaccgagcccuucgucaucuaccucggccucaaccucccccaccccuaccccucccccuccuccggcgagaacuucggcuccuccaccuuccacaccucccucuacuggcucgagaaggucucccacgacgccaucaagauccccaagugguccccccucuccgagaugcaccccgucgacuacuacuccuccuacaccaagaacugcaccggccgcuucaccaagaaggagaucaagaacauccgcgccuucuacuacgccaugugcgccgagaccgacgccaugcucggcgagaucauccucgcccuccaccagcucgaccuccuccagaagaccaucgucaucuacuccuccgaccacggcgagcucgccauggagcaccgccaguucuacaagauguccauguacgaggccuccgcccacgucccccuccucaugaugggccccggcaucaaggccggccuccaggucuccaacgucgucucccucgucgacaucuaccccaccaugcucgacaucgccggcaucccccucccccagaaccucuccggcuacucccuccucccccucuccuccgagaccuucaagaacgagcacaaggucaagaaccuccacccccccuggauccucuccgaguuccacggcugcaacgucaacgccuccaccuacaugcuccgcaccaaccacuggaaguacaucgccuacuccgacggcgccuccauccucccccagcucuucgaccucuccuccgaccccgacgagcucaccaacgucgccgucaaguuccccgagaucaccuacucccucgaccagaagcuccacuccaucaucaacuaccccaaggucuccgccuccguccaccaguacaacaaggagcaguucaucaaguggaagcaguccaucggccagaacuacuccaacgucaucgccaaccuccgcuggcaccaggacuggcagaaggagccccgcaaguacgagaacgccaucgaccaguggcucaagacccacaugaacccccgcgccgucuga

SEQ ID NO: 39986 - RNA, 984 nt, Artificial Sequence
  derived and/or modified sequence opt2 from ART1__Homo_sapiens__NP_004305
augcagaugcccgccaugaugucccuccuccucgucuccgucggccucauggaggcccuccaggcccagucccaccccaucacccgccgcgaccucuucucccaggagauccagcucgacauggcccucgccuccuucgacgaccaguacgccggcugcgccgccgccaugaccgccgcccuccccgaccucaaccacaccgaguuccaggccaaccaggucuacgccgacuccuggacccucgccuccucccaguggcaggagcgccaggcccgcuggcccgaguggucccucucccccacccgccccuccccccccccccucggcuuccgcgacgagcacggcgucgcccuccucgccuacaccgccaacuccccccuccacaaggaguucaacgccgccguccgcgaggccggccgcucccgcgcccacuaccuccaccacuucuccuucaagacccuccacuuccuccucaccgaggcccuccagcuccucggcuccggccagcgccccccccgcugccaccaggucuuccgcggcguccacggccuccgcuuccgccccgccggcccccgcgccaccguccgccucggcggcuucgccuccgccucccucaagcacgucgccgcccagcaguucggcgaggacaccuucuucggcaucuggaccugccucggcgcccccaucaagggcuacuccuucuuccccggcgaggaggagguccucaucccccccuucgagaccuuccaggucaucaacgccucccgccucgcccagggccccgcccgcaucuaccuccgcgcccucggcaagcacuccaccuacaacugcgaguacaucaaggacaagaagugcaaguccggccccugccaccucgacaacuccgccaugggccaguccccccucuccgccgucuggucccuccuccuccuccucugguuccucgucguccgcgccuuccccgacggccccggccuccucuga

SEQ ID NO: 39987 - RNA, 1170 nt, Artificial Sequence
  derived and/or modified sequence opt2 from ART3__Homo_sapiens__NP_001123488
augaagaccggccacuucgagaucgucaccaugcuccucgccaccaugauccucgucgacaucuuccaggucaaggccgagguccucgacauggccgacaacgccuucgacgacgaguaccucaagugcaccgaccgcauggagaucaaguacgucccccagcuccucaaggaggagaaggccucccaccagcagcucgacaccgucugggagaacgccaaggccaagugggccgcccgcaagacccagaucuuccuccccaugaacuucaaggacaaccacggcaucgcccucauggccuacaucuccgaggcccaggagcagacccccuucuaccaccucuucuccgaggccgucaagauggccggccagucccgcgaggacuacaucuacggcuuccaguucaaggccuuccacuucuaccucacccgcgcccuccagcuccuccgcaagcccugcgaggccuccuccaagaccgucgucuaccgcaccucccagggcaccuccuucaccuucggcggccucaaccaggcccgcuucggccacuucacccucgccuacuccgccaagccccaggccgccaacgaccagcucaccguccucuccaucuacaccugccucggcgucgacaucgagaacuuccucgacaaggaguccgagcgcaucacccucaucccccucaacgaggucuuccaggucucccaggagggcgccggcaacaaccucauccuccaguccaucaacaagaccugcucccacuacgagugcgccuuccucggcggccucaagaccgagaacugcaucgagaaccucgaguacuuccagcccaucuacgucuacaaccccggcgagaagaaccagaagcucgaggaccacuccgagaagaacuggaagcucgaggaccacggcgagaagaaccagaagcucgaggaccacggcgucaagauccucgagcccacccagauccccggcaugaagauccccgagcccuucccccuccccgaggacaagucccagggcaacaucaacaaccccacccccggccccguccccguccccggccccaagucccaccccuccgccuccuccggcaagcuccuccucccccaguucggcauggucaucauccucaucuccgucuccgccaucaaccucuucgucgcccucuga

SEQ ID NO: 39988 - RNA, 945 nt, Artificial Sequence
  derived and/or modified sequence opt2 from ART4__Homo_sapiens__NP_066549
augggcccccucaucaaccgcugcaagaagauccuccuccccaccaccgucccccccgccaccaugcgcaucuggcuccucggcggccuccuccccuuccuccuccuccucuccggccuccagcgccccaccgagggcuccgaggucgccaucaagaucgacuucgacuucgcccccggcuccuucgacgaccaguaccagggcugcuccaagcaggucauggagaagcucacccagggcgacuacuucaccaaggacaucgaggcccagaagaacuacuuccgcauguggcagaaggcccaccucgccuggcucaaccagggcaagguccucccccagaacaugaccaccacccacgccgucgccauccucuucuacacccucaacuccaacguccacuccgacuucacccgcgccauggccuccgucgcccgcaccccccagcaguacgagcgcuccuuccacuucaaguaccuccacuacuaccucaccuccgccauccagcuccuccgcaaggacuccaucauggagaacggcacccucugcuacgagguccacuaccgcaccaaggacguccacuucaacgccuacaccggcgccaccauccgcuucggccaguuccucuccaccucccuccucaaggaggaggcccaggaguucggcaaccagacccucuucaccaucuucaccugccucggcgcccccguccaguacuucucccucaagaaggagguccucaucccccccuacgagcucuucaaggucaucaacauguccuaccacccccgcggcgacuggcuccagcuccgcuccaccggcaaccucuccaccuacaacugccagcuccucaaggccuccuccaagaagugcauccccgaccccaucgccaucgccucccucuccuuccucaccuccgucaucaucuucuccaagucccgcgucuga

SEQ ID NO: 39989 - RNA, 2871 nt, Artificial Sequence
  derived and/or modified sequence opt2 from ARVCF__Homo_sapiens__XP_005261300
auggaggacugcaacguccacuccgccgccuccauccucgccuccgucaaggagcaggaggcccgcuucgagcgccucacccgcgcccucgagcaggagcgccgccacgucgcccuccagcucgagcgcgcccagcagcccggcauggucuccggcggcaugggcuccggccagccccuccccauggccuggcagcagcucguccuccaggagcagucccccggcucccaggccucccucgccaccaugcccgaggcccccgacguccucgaggagaccgucaccgucgaggaggaccccggcacccccaccucccacgucuccaucgucaccuccgaggacggcaccacccgccgcaccgagaccaaggucaccaagaccgucaagaccgucaccacccgcaccguccgccagguccccgucggccccgacggccucccccuccucgacggcggccccccccucggccccuucgccgacggcgcccucgaccgccacuuccuccuccgcggcggcggccccgucgccacccucucccgcgccuaccucuccuccggcggcggcuuccccgagggccccgagccccgcgacucccccuccuacggcucccucucccgcggccucggcaugcgccccccccgcgccggcccccucggccccggccccggcgacggcugcuucacccuccccggccaccgcgaggccuuccccgucggccccgagcccggcccccccggcggccgcucccuccccgagcgcuuccaggccgagcccuacggccucgaggacgacacccgcucccucgccgccgacgacgagggcggccccgagcucgagcccgacuacggcaccgccacccgccgccgccccgagugcggccgcggccuccacacccgcgccuacgaggacaccgccgacgacggcggcgagcucgccgacgagcgccccgccuuccccauggucaccgccccccucgcccagcccgagcgcggcuccaugggcucccucgaccgccucguccgccgcucccccuccgucgacuccgcccgcaaggagccccgcuggcgcgaccccgagcuccccgagguccucgccaugcuccgccaccccgucgaccccgucaaggccaacgccgccgccuaccuccagcaccucugcuucgagaacgagggcgucaagcgccgcguccgccagcuccgcggccucccccuccucgucgcccuccucgaccacccccgcgccgagguccgccgccgcgccugcggcgcccuccgcaaccucuccuacggccgcgacaccgacaacaaggccgccauccgcgacugcggcggcguccccgcccucguccgccuccuccgcgccgcccgcgacaacgagguccgcgagcucgucaccggcacccucuggaaccucuccuccuacgagccccucaagauggucaucaucgaccacggccuccagacccucacccacgaggucaucgucccccacuccggcugggagcgcgagcccaacgaggacuccaagccccgcgacgccgaguggaccaccgucuucaagaacaccuccggcugccuccgcaacgucuccuccgacggcgccgaggcccgccgccgccuccgcgagugcgagggccucgucgacgcccuccuccacgcccuccaguccgccgucggccgcaaggacaccgacaacaaguccgucgagaacugcgucugcaucaugcgcaaccucuccuaccacguccacaaggagguccccggcgccgaccgcuaccaggaggccgagcccggcccccucggcuccgccgucggcucccagcgccgccgccgcgacgacgccuccugcuucggcggcaagaaggccaagggcaagaaggacggcgagauggaccgcaacuucgacacccucgaccuccccaagcgcaccgaggccgccaagggcuucgagcuccucuaccagcccgaggucguccgccucuaccucucccuccucaccgagucccgcaacuucaacacccucgaggccgccgccggcgcccuccagaaccucuccgccggcaacuggaugugggccaccuacauccgcgccaccguccgcaaggagcgcggccuccccguccucgucgagcuccuccaguccgagaccgacaaggucguccgcgccgucgccaucgcccuccgcaaccucucccucgaccgccgcaacaaggaccucaucggcuccuacgccauggccgagcucguccgcaacguccgcaacgcccaggcccccccccgccccggcgccugccucgaggaggacaccgucgucgccguccucaacaccauccacgagaucgucuccgacucccucgacaacgcccgcucccuccuccaggcccgcggcguccccgcccucgucgcccucgucgccuccucccaguccguccgcgaggccaaggccgccucccacguccuccagaccgucugguccuacaaggagcuccgcggcacccuccagaaggacggcuggaccaaggcccgcuuccaguccgccgccgccaccgccaagggccccaagggcgcccucucccccggcggcuucgacgacuccacccucccccucgucgacaagucccucgagggcgagaagaccggcucccgcgacgucauccccauggacgcccucggccccgacggcuacuccaccgucgaccgccgcgagcgccgcccccgcggcgccuccuccgccggcgaggccuccgagaaggagccccucaagcucgaccccucccgcaaggcccccccccccggccccucccgccccgccguccgccucgucgacgccgucggcgacgccaagccccagcccgucgacuccugggucuga

SEQ ID NO: 39990 - RNA, 1689 nt, Artificial Sequence
  derived and/or modified sequence opt2 from ARX__Homo_sapiens__NP_620689
auguccaaccaguaccaggaggagggcugcuccgagcgccccgagugcaaguccaagucccccacccuccucuccuccuacugcaucgacuccauccucggccgccgcucccccugcaagaugcgccuccucggcgccgcccagucccuccccgccccccucaccucccgcgccgaccccgagaaggccguccagggcucccccaaguccuccuccgcccccuucgaggccgagcuccaccucccccccaagcuccgccgccucuacggccccggcggcggccgccuccuccagggcgccgccgccgccgccgccgccgccgccgccgccgccgccgccgccgccaccgccaccgccggcccccgcggcgaggccccccccccccccccccccaccgcccgccccggcgagcgccccgacggcgccggcgccgccgccgccgccgccgccgccgccgccgccgccugggacacccucaagaucucccaggccccccaggucuccaucucccgcuccaaguccuaccgcgagaacggcgcccccuucgucccccccccccccgcccucgacgagcucggcggccccggcggcgucacccaccccgaggagcgccucggcgucgccggcggccccggcuccgcccccgccgccggcggcggcaccggcaccgaggacgacgaggaggagcuccucgaggacgaggaggacgaggacgaggaggaggagcuccucgaggacgacgaggaggagcuccucgaggacgacgcccgcgcccuccucaaggagccccgccgcugccccgucgccgccaccggcgccgucgccgccgccgccgccgccgccgucgccaccgagggcggcgagcucucccccaaggaggagcuccuccuccaccccgaggacgccgagggcaaggacggcgaggacuccgucugccucuccgccggcuccgacuccgaggagggccuccucaagcgcaagcagcgccgcuaccgcaccaccuucaccuccuaccagcucgaggagcucgagcgcgccuuccagaagacccacuaccccgacgucuucacccgcgaggagcucgccaugcgccucgaccucaccgaggcccgcguccaggucugguuccagaaccgccgcgccaaguggcgcaagcgcgagaaggccggcgcccagacccacccccccggccuccccuuccccggcccccucuccgccacccacccccucucccccuaccucgacgccucccccuuccccccccaccaccccgcccucgacuccgccuggaccgccgccgccgccgccgccgccgccgccuuccccucccucccccccccccccggcuccgccucccucccccccuccggcgccccccucggccucuccaccuuccucggcgccgccgucuuccgccaccccgccuucaucucccccgccuucggccgccucuucuccaccauggccccccucaccuccgccuccaccgccgccgcccuccuccgccagcccacccccgccgucgagggcgccgucgccuccggcgcccucgccgaccccgccaccgccgccgccgaccgccgcgccuccuccaucgccgcccuccgccucaaggccaaggagcacgccgcccagcucacccagcucaacauccuccccggcaccuccaccggcaaggaggucugcuga

SEQ ID NO: 39991 - RNA, 1128 nt, Artificial Sequence
  derived and/or modified sequence opt2 from AS3MT__Homo_sapiens__NP_065733
auggccgcccuccgcgacgccgagauccagaaggacguccagaccuacuacggccagguccucaagcgcuccgccgaccuccagaccaacggcugcgucaccaccgcccgccccguccccaagcacauccgcgaggcccuccagaacguccacgaggaggucgcccuccgcuacuacggcugcggccucgucauccccgagcaccucgagaacugcuggauccucgaccucggcuccggcuccggccgcgacugcuacguccucucccagcucgucggcgagaagggccacgucaccggcaucgacaugaccaagggccaggucgaggucgccgagaaguaccucgacuaccacauggagaaguacggcuuccaggccuccaacgucaccuucauccacggcuacaucgagaagcucggcgaggccggcaucaagaacgagucccacgacaucgucgucuccaacugcgucaucaaccucguccccgacaagcagcagguccuccaggaggccuaccgcguccucaagcacggcggcgagcucuacuucuccgacgucuacaccucccucgagcuccccgaggagauccgcacccacaagguccucuggggcgagugccucggcggcgcccucuacuggaaggagcucgccguccucgcccagaagaucggcuucugccccccccgccucgucaccgccaaccucaucaccauccagaacaaggagcucgagcgcgucaucggcgacugccgcuucgucuccgccaccuuccgccucuucaagcacuccaagaccggccccaccaagcgcugccaggucaucuacaacggcggcaucaccggccacgagaaggagcucauguucgacgccaacuucaccuucaaggagggcgagaucgucgaggucgacgaggagaccgccgccauccucaagaacucccgcuucgcccaggacuuccucauccgccccaucggcgagaagcuccccaccuccggcggcugcuccgcccucgagcucaaggacaucaucaccgaccccuucaagcucgccgaggaguccgacuccaugaagucccgcugcguccccgacgccgccggcggcugcugcggcaccaagaaguccugcuga

SEQ ID NO: 39992 - RNA, 1170 nt, Artificial Sequence
  derived and/or modified sequence opt2 from ASAH1__Homo_sapiens__NP_001120977
augaacugcugcaucggccucggcgagaaggcccgcggcucccaccgcgccuccuaccccucccucuccgcccucuucaccgaggccuccauccucggcuucggcuccuucgccgucaaggcccaguggaccgaggacugccgcaaguccaccuacccccccuccggccccaccgucuuccccgccgucauccgcuaccgcggcgccguccccugguacaccaucaaccucgaccucccccccuacaagcgcuggcacgagcucaugcucgacaaggcccccguccccggccuccucggcaacuuccccggccccuucgaggaggagaugaagggcaucgccgccgucaccgacaucccccucggcgagaucaucuccuucaacaucuucuacgagcucuucaccaucugcaccuccaucgucgccgaggacaagaagggccaccucauccacggccgcaacauggacuucggcgucuuccucggcuggaacaucaacaacgacaccugggucaucaccgagcagcucaagccccucaccgucaaccucgacuuccagcgcaacaacaagaccgucuucaaggccuccuccuucgccggcuacgucggcaugcucaccggcuucaagcccggccucuucucccucacccucaacgagcgcuucuccaucaacggcggcuaccucggcauccucgaguggauccucggcaagaaggacgucauguggaucggcuuccucacccgcaccguccucgagaacuccaccuccuacgaggaggccaagaaccuccucaccaagaccaagauccucgcccccgccuacuucauccucggcggcaaccaguccggcgagggcugcgucaucacccgcgaccgcaaggagucccucgacgucuacgagcucgacgccaagcagggccgcugguacgucguccagaccaacuacgaccgcuggaagcaccccuucuuccucgacgaccgccgcacccccgccaagaugugccucaaccgcaccucccaggagaacaucuccuucgagaccauguacgacguccucuccaccaagcccguccucaacaagcucaccgucuacaccacccucaucgacgucaccaagggccaguucgagaccuaccuccgcgacugccccgaccccugcaucggcugguga

SEQ ID NO: 39993 - RNA, 2238 nt, Artificial Sequence
  derived and/or modified sequence opt2 from ASAH2__Homo_sapiens__NP_001137446
auggccaagcgcaccuucuccaaccucgagaccuuccucaucuuccuccucgucaugauguccgccaucaccgucgcccuccucucccuccucuucaucaccuccggcaccaucgagaaccacaaggaccucggcggccacuucuucuccaccacccaguccccccccgccacccagggcuccaccgccgcccagcgcuccaccgccacccagcacuccaccgccacccaguccuccaccgccacccagaccucccccgucccccucacccccgaguccccccucuuccagaacuucuccggcuaccacaucggcgucggccgcgccgacugcaccggccaggucgccgacaucaaccucaugggcuacggcaaguccggccagaacgcccagggcauccucacccgccucuacucccgcgccuucaucauggccgagcccgacggcuccaaccgcaccgucuucgucuccaucgacaucggcauggucucccagcgccuccgccucgagguccucaaccgccuccaguccaaguacggcucccucuaccgccgcgacaacgucauccucuccggcacccacacccacuccggccccgccggcuacuuccaguacaccgucuucgucaucgccuccgagggcuucuccaaccagaccuuccagcacauggucaccggcauccucaaguccaucgacaucgcccacaccaacaugaagcccggcaagaucuucaucaacaagggcaacgucgacggcguccagaucaaccgcucccccuacuccuaccuccagaacccccaguccgagcgcgcccgcuacuccuccaacaccgacaaggagaugaucguccucaagauggucgaccucaacggcgacgaccucggccucaucuccugguucgccauccaccccgucuccaugaacaacuccaaccaccucgucaacuccgacaacgucggcuacgccuccuaccuccucgagcaggagaagaacaagggcuaccuccccggccagggccccuucgucgccgccuucgccuccuccaaccucggcgacgucucccccaacauccucggcccccgcugcaucaacaccggcgaguccugcgacaacgccaacuccaccugccccaucggcggccccuccaugugcaucgccaagggccccggccaggacauguucgacuccacccagaucaucggccgcgccauguaccagcgcgccaaguccaagaccugcaagcccgcccucggcuacuccuucgccgccggcaccaucgacggcgucggcggccucaacuucacccagggcaagaccgagggcgaccccuucugggacaccauccgcgaccagauccucggcaagcccuccgaggagaucaaggagugccacaagcccaagcccauccuccuccacaccggcgagcucuccaagccccaccccuggcaccccgacaucgucgacguccagaucaucacccucggcucccucgccaucaccgccauccccggcgaguucaccaccauguccggccgccgccuccgcgaggccguccaggccgaguucgccucccacggcaugcagaacaugaccgucgucaucuccggccucugcaacgucuacacccacuacaucaccaccuacgaggaguaccaggcccagcgcuacgaggccgccuccaccaucuacggcccccacacccucuccgccuacauccagcucuuccgcaaccucgccaaggccaucgccaccgacaccgucgccaaccucucccgcggccccgagccccccuucuucaagcagcucaucgucccccucauccccuccaucgucgaccgcgcccccaagggccgcaccuucggcgacguccuccagcccgccaagcccgaguaccgcgucggcgaggucgccgaggucaucuucgucggcgccaaccccaagaacuccguccagaaccagacccaccagaccuuccucaccgucgagaaguacgaggccaccuccaccuccuggcagaucgucugcaacgacgccuccugggagacccgcuucuacuggcacaagggccuccucggccucuccaacgccaccgucgaguggcacauccccgacaccgcccagcccggcaucuaccgcauccgcuacuucggccacaaccgcaagcaggacauccucaagcccgccgucauccucuccuucgagggcaccucccccgccuucgaggucgucaccaucuga

SEQ ID NO: 39994 - RNA, 3390 nt, Artificial Sequence
  derived and/or modified sequence opt2 from ASAP1__Homo_sapiens__NP_060952
augcgcuccuccgccucccgccucuccuccuucuccucccgcgacucccucuggaaccgcaugcccgaccagaucuccgucuccgaguucaucgccgagaccaccgaggacuacaacucccccaccaccuccuccuucaccacccgccuccacaacugccgcaacaccgucacccuccucgaggaggcccucgaccaggaccgcaccgcccuccagaaggucaagaaguccgucaaggccaucuacaacuccggccaggaccacguccagaacgaggagaacuacgcccagguccucgacaaguucggcuccaacuuccucucccgcgacaaccccgaccucggcaccgccuucgucaaguucuccacccucaccaaggagcucuccacccuccucaagaaccuccuccagggccucucccacaacgucaucuucacccucgacucccuccucaagggcgaccucaagggcgucaagggcgaccucaagaagcccuucgacaaggccuggaaggacuacgagaccaaguucaccaagaucgagaaggagaagcgcgagcacgccaagcagcacggcaugauccgcaccgagaucaccggcgccgagaucgccgaggagauggagaaggagcgccgccucuuccagcuccagaugugcgaguaccucaucaaggucaacgagaucaagaccaagaagggcgucgaccuccuccagaaccucaucaaguacuaccacgcccagugcaacuucuuccaggacggccucaagaccgccgacaagcucaagcaguacaucgagaagcucgccgccgaccucuacaacaucaagcagacccaggacgaggagaagaagcagcucaccgcccuccgcgaccucaucaaguccucccuccagcucgaccagaaggaggacucccagucccgccagggcggcuacuccaugcaccagcuccagggcaacaaggaguacggcuccgagaagaagggcuaccuccucaagaaguccgacggcauccgcaaggucuggcagcgccgcaagugcuccgucaagaacggcauccucaccaucucccacgccaccuccaaccgccagcccgccaagcucaaccuccucaccugccaggucaagcccaacgccgaggacaagaaguccuucgaccucaucucccacaaccgcaccuaccacuuccaggccgaggacgagcaggacuacgucgccuggaucuccguccucaccaacuccaaggaggaggcccucaccauggccuuccgcggcgagcaguccgccggcgagaacucccucgaggaccucaccaaggccaucaucgaggacguccagcgccuccccggcaacgacaucugcugcgacugcggcuccuccgagcccaccuggcucuccaccaaccucggcauccucaccugcaucgagugcuccggcauccaccgcgagaugggcguccacaucucccgcauccagucccucgagcucgacaagcucggcaccuccgagcuccuccucgccaagaacgucggcaacaacuccuucaacgacaucauggaggccaaccuccccucccccucccccaagcccacccccuccuccgacaugaccguccgcaaggaguacaucaccgccaaguacgucgaccaccgcuucucccgcaagaccugcuccaccuccuccgccaagcucaacgagcuccucgaggccaucaagucccgcgaccuccucgcccucauccaggucuacgccgagggcgucgagcucauggagccccuccucgagcccggccaggagcucggcgagaccgcccuccaccucgccguccgcaccgccgaccagaccucccuccaccucgucgacuuccucguccagaacugcggcaaccucgacaagcagaccgcccucggcaacaccguccuccacuacugcuccauguacuccaagcccgagugccucaagcuccuccuccgcuccaagcccaccgucgacaucgucaaccaggccggcgagaccgcccucgacaucgccaagcgccucaaggccacccagugcgaggaccuccucucccaggccaaguccggcaaguucaacccccacguccacgucgaguacgaguggaaccuccgccaggaggagaucgacgaguccgacgacgaccucgacgacaagcccucccccaucaagaaggagcgcuccccccgcccccaguccuucugccacuccuccuccaucuccccccaggacaagcucgcccuccccggcuucuccaccccccgcgacaagcagcgccucuccuacggcgccuucaccaaccagaucuucgucuccaccuccaccgacucccccaccucccccaccaccgaggcccccccccuccccccccgcaacgccggcaagggccccaccggcccccccuccacccucccccucuccacccagaccuccuccggcuccuccacccucuccaagaagcgcccccccccccccccccccggccacaagcgcacccucuccgacccccccuccccccucccccacggcccccccaacaagggcgccguccccuggggcaacgacggcggccccuccuccuccuccaagaccaccaacaaguucgagggccucucccagcaguccuccaccuccuccgccaagaccgcccucggcccccgcguccuccccaagcucccccagaaggucgcccuccgcaagaccgaccaccucucccucgacaaggccaccaucccccccgagaucuuccagaaguccucccagcucgccgagcucccccagaagcccccccccggcgaccucccccccaagcccaccgagcucgcccccaagccccagaucggcgaccucccccccaagcccggcgagcucccccccaagccccagcucggcgaccucccccccaagccccagcucuccgaccucccccccaagccccagaugaaggaccucccccccaagccccagcucggcgaccuccucgccaagucccagaccggcgacgucucccccaaggcccagcagcccuccgaggucacccucaagucccacccccucgaccucucccccaacguccagucccgcgacgccauccagaagcaggccuccgaggacuccaacgaccucacccccacccuccccgagacccccgucccccucccccgcaagaucaacaccggcaagaacaagguccgccgcgucaagaccaucuacgacugccaggccgacaacgacgacgagcucaccuucaucgagggcgaggucaucaucgucaccggcgaggaggaccaggagugguggaucggccacaucgagggccagcccgagcgcaagggcgucuuccccgucuccuucguccacauccucuccgacuga

SEQ ID NO: 39995 - RNA, 2886 nt, Artificial Sequence
  derived and/or modified sequence opt2 from ASAP2__Homo_sapiens__NP_001128663
augcccgaccagaucuccgucuccgaguucgucgccgagacccacgaggacuacaaggcccccaccgccuccuccuucaccacccgcaccgcccagugccgcaacaccgucgccgccaucgaggaggcccucgacgucgaccgcaugguccucuacaagaugaagaaguccgucaaggccaucaacuccuccggccucgcccacgucgagaacgaggagcaguacacccaggcccucgagaaguucggcggcaacugcgucugccgcgacgaccccgaccucggcuccgccuuccucaaguucuccgucuucaccaaggagcucaccgcccucuucaagaaccucauccagaacaugaacaacaucaucuccuucccccucgacucccuccucaagggcgaccucaagggcgucaagggcgaccucaagaagcccuucgacaaggccuggaaggacuacgagaccaagaucaccaagaucgagaaggagaagaaggagcacgccaagcuccacggcaugauccgcaccgagaucuccggcgccgagaucgccgaggagauggagaaggagcgccgcuucuuccagcuccagaugugcgaguaccuccucaaggucaacgagaucaagaucaagaagggcgucgaccuccuccagaaccucaucaaguacuuccacgcccagugcaacuucuuccaggacggccucaaggccgucgagucccucaagcccuccaucgagacccucuccaccgaccuccacaccaucaagcaggcccaggacgaggagcgccgccagcucauccagcuccgcgacauccucaaguccgcccuccaggucgagcagaaggaggacucccagauccgccaguccaccgccuacucccuccaccagccccagggcaacaaggagcacggcaccgagcgcaacggcucccucuacaagaaguccgacggcauccgcaaggucuggcagaagcgcaagugcuccgucaagaacggcuuccucaccaucucccacggcaccgccaaccgcccccccgccaagcucaaccuccucaccugccaggucaagaccaaccccgaggagaagaagugcuucgaccucaucucccacgaccgcaccuaccacuuccaggccgaggacgagcaggagugccagaucuggauguccguccuccagaacuccaaggaggaggcccucaacaacgccuucaagggcgacgacaacaccggcgagaacaacaucguccaggagcucaccaaggagaucaucuccgagguccagcgcaugaccggcaacgacgucugcugcgacugcggcgcccccgaccccaccuggcucuccaccaaccucggcauccucaccugcaucgagugcuccggcauccaccgcgagcucggcguccacuacucccgcaugcagucccucacccucgacguccucggcaccuccgagcuccuccucgccaagaacaucggcaacgccggcuucaacgagaucauggagugcugccuccccgccgaggacuccgucaagcccaaccccggcuccgacaugaacgcccgcaaggacuacaucaccgccaaguacaucgagcgccgcuacgcccgcaagaagcacgccgacaacgccgccaagcuccacucccucugcgaggccgucaagacccgcgacaucuucggccuccuccaggccuacgccgacggcgucgaccucaccgagaagaucccccucgccaacggccacgagcccgacgagaccgcccuccaccucgccguccgcuccgucgaccgcaccucccuccacaucgucgacuuccucguccagaacuccggcaaccucgacaagcagaccggcaagggcuccaccgcccuccacuacugcugccucaccgacaacgccgagugccucaagcuccuccuccgcggcaaggccuccaucgagaucgccaacgaguccggcgagaccccccucgacaucgccaagcgccucaagcacgagcacugcgaggagcuccucacccaggcccucuccggccgcuucaacucccacguccacgucgaguacgaguggcgccuccuccacgaggaccucgacgaguccgacgacgacauggacgagaagcuccagcccucccccaaccgccgcgaggaccgccccaucuccuucuaccagcucggcuccaaccagcuccaguccaacgccgucucccucgcccgcgacgccgccaaccucgccaaggagaagcagcgcgccuucaugcccuccauccuccagaacgagaccuacggcgcccuccucuccggcucccccccccccgcccagcccgccgcccccuccaccaccuccgcccccccccuccccccccgcaacgucggcaaggacccccucacccccaccccccccccccccgucgccaagacccccuccgucauggaggcccucucccagcccuccaagcccgccccccccggcaucucccagauccgcccccccccccuccccccccagccccccucccgccucccccagaagaagcccgcccccggcgccgacaaguccaccccccucaccaacaagggccagccccgcggccccgucgaccucuccgccaccgaggcccucggcccccucuccaacgccaugguccuccagccccccgcccccaugccccgcaagucccaggccaccaagcucaagcccaagcgcgucaaggcccucuacaacugcgucgccgacaaccccgacgagcucaccuucuccgagggcgacgucaucaucgucgacggcgaggaggaccaggagugguggaucggccacaucgacggcgaccccggccgcaagggcgccuuccccgucuccuucguccacuucaucgccgacuga

SEQ ID NO: 39996 - RNA, 1404 nt, Artificial Sequence
  derived and/or modified sequence opt2 from ASB10__Homo_sapiens__NP_001135931
augcucauguccuggucccccgaggagugcaagggccagggcgagccccucgacgaccgccacccccucugcgcccgccucgucgagaagcccucccgcggcuccgaggagcaccucaaguccggccccggccccaucgucacccgcaccgccuccggccccgcccucgccuucuggcaggccguccucgccggcgacgucggcugcgucucccgcauccucgccgacuccuccaccggccucgcccccgacuccgucuucgacaccuccgaccccgagcgcuggcgcgacuuccgcuucaacauccgcgcccuccgccucuggucccucaccuacgaggaggagcucaccaccccccuccacgucgccgccucccgcggccacaccgagguccuccgccuccuccuccgccgccgcgcccgccccgacuccgcccccggcggccgcaccgcccuccacgaggccugcgccgccggccacaccgccugcguccacguccuccucgucgccggcgccgaccccaacaucgccgaccaggacggcaagcgcccccuccaccucugccgcggccccggcacccucgagugcgccgagcuccuccuccgcuucggcgcccgcgucgacggccgcuccgaggaggaggaggagaccccccuccacgucgccgcccgccucggccacgucgagcucgccgaccuccuccuccgccgcggcgccugccccgacgcccgcaacgccgagggcuggaccccccuccucgccgccugcgacguccgcugccaguccaucaccgacgccgaggccaccaccgcccgcugccuccagcucugcucccuccuccucuccgccggcgccgacgccgacgccgccgaccaggacaagcagcgcccccuccaccucgccugccgccgcggccacgccgccgucgucgagcuccuccucuccugcggcgucuccgccaacaccauggacuacggcggccacaccccccuccacugcgcccuccagggccccgccgccgcccucgcccagucccccgagcacgucguccgcgcccuccucaaccacggcgccguccgcgucuggcccggcgcccuccccaagguccucgagcgcugguccaccugcccccgcaccaucgagguccucaugaacaccuacuccgucguccagcuccccgaggaggccgucggccucgucacccccgagacccuccagaagcaccagcgcuucuacuccucccucuucgcccucguccgccagccccgcucccuccagcaccucucccgcugcgcccuccgcucccaccucgagggcucccucccccaggcccucccccgccucccccuccccccccgccuccuccgcuaccuccagcucgacuucgagggcguccucuacuga

SEQ ID NO: 39997 - RNA, 837 nt, Artificial Sequence
  derived and/or modified sequence opt2 from ASB13__Homo_sapiens__NP_078977
auggagccccgcgccgccgacggcugcuuccucggcgacgucggcuucugggucgagcgcacccccguccacgaggccgcccagcgcggcgagucccuccagcuccagcagcucaucgaguccggcgccugcgucaaccaggucaccgucgacuccaucaccccccuccacgccgccucccuccagggccaggcccgcugcguccagcuccuccucgccgccggcgcccaggucgacgcccgcaacaucgacggcuccaccccccucugcgacgccugcgccuccggcuccaucgagugcgucaagcuccuccucuccuacggcgccaaggucaaccccccccucuacaccgccuccccccuccacgaggccugcauguccggcuccuccgagugcguccgccuccucaucgacgucggcgccaaccucgaggcccacgacugccacuucggcaccccccuccacgucgccugcgcccgcgagcaccucgacugcgucaagguccuccucaacgccggcgccaacgucaacgccgccaagcuccacgagaccgcccuccaccacgccgccaaggucaagaacgucgaccucaucgagaugcucaucgaguucggcggcaacaucuacgcccgcgacaaccgcggcaagaagcccuccgacuacaccugguccuccuccgcccccgccaagugcuucgaguacuacgagaagaccccccucacccucucccagcucugccgcgucaaccuccgcaaggccaccggcguccgcggccucgagaagaucgccaagcucaacauccccccccgccucaucgacuaccucuccuacaacuga

SEQ ID NO: 39998 - RNA, 1767 nt, Artificial Sequence
  derived and/or modified sequence opt2 from ASB15__Homo_sapiens__XP_005250203
auggacaccaacgacgaccccgacgaggaccaccucaccuccuacgacauccagcucuccauccaggaguccaucgaggccuccaagaccgcccucugccccgagcgcuucgucccccucuccgcccagaaccgcaagcucgucgaggccaucaagcagggccacauccccgagcuccaggaguacgucaaguacaaguacgccauggacgaggccgacgagaagggcugguucccccuccacgaggccgucguccagcccauccagcagauccucgagaucguccucgacgccuccuacaagacccucugggaguucaagaccugcgacggcgagaccccccucacccucgccgucaaggccggccucgucgagaacguccgcacccuccucgagaagggcgucuggcccaacaccaagaacgacaagggcgagaccccccuccucaucgccgucaagaagggcuccuacgacauggucuccacccucaucaagcacaacaccucccucgaccagcccugcgucaagcgcugguccgccaugcacgaggccgccaagcagggccgcaaggacaucgucgcccuccuccucaagcacggcggcaacguccaccuccgcgacggcuucggcgucaccccccucggcgucgccgccgaguacggccacugcgacguccucgagcaccucauccacaagggcggcgacguccucgcccucgccgacgacggcgccuccguccucuucgaggccgccggcggcggcaaccccgacugcaucucccuccuccucgaguacggcggcuccggcaacguccccaaccgcgccggccaccuccccauccaccgcgccgccuacgagggccacuaccucgcccucaaguaccucauccccgucaccuccaagaacgccauccgcaaguccggccucacccccauccacuccgccgccgacggccagaacgcccagugccucgagcuccucaucgagaacggcuucgacgucaacacccuccucgccgaccacaucucccaguccuacgacgacgagcgcaagaccgcccucuacuucggcgucuccaacaacgacguccacugcaccgagguccuccucgccgccggcgccgaccccaaccucgacccccucaacugccuccucgucgccguccgcgccaacaacuacgagaucguccgccuccuccucucccacggcgccaacgucaacugcuacuucaugcacgucaacgacacccgcuuccccuccgucauccaguacgcccucaacgacgaggucaugcuccgccuccuccucaacaacggcuaccaggucgagaugugcuucgacugcaugcacggcgacaucuucggcaacuccuucgucugguccgagauccaggaggagguccuccccggcuggaccuccugcgucaucaaggacaaccccuucugcgaguucaucaccguccccuggaugaagcaccucgucggccgcgucacccgcguccucaucgacuacauggacuacgucccccucugcgccaagcucaaguccgcccucgagguccagcgcgaguggcccgagauccgccagauccucgagaaccccugcucccucaagcaccucugccgccucaagauccgccgccucaugggccuccagaagcucugccagcccgccuccgucgagaagcucccccucccccccgccauccagcgcuacauccucuucaaggaguacgaccucuacggccaggagcucaagcucaccuga

SEQ ID NO: 39999 - RNA, 1401 nt, Artificial Sequence
  derived and/or modified sequence opt2 from ASB18__Homo_sapiens__NP_997721
auguccaacuccgacuaccuccccgacuacccccucaacuccgaccucgucaagcgccucaaguccgcccucgacgccaaggacgaggagcgcguccgcgaccucaucugcaccgagaucacccccgucgacgccgucaucgagcucgccaacgacgacuggaugaaggaccccuccgcccagcuccccaccggcaugcuccucggcgaccucgaccaccucaagccccucauggaccaguucuuccaggacgccaacgucgucuucgagaucaacaaggacgagauggaguggcaggucaagucccccgccaccuucggccucuccggccucuggacccucgaguacaagcgcgagcucaccaccccccucugcaucgccgccgcccacggccacaccgccugcguccgccaccuccucggccgcggcgccgaccccgacgccucccccggcggccgcggcgcccuccacgaggccugccucggcggccacaccgccugcguccgccuccuccuccagcaccgcgccgaccccgaccuccucuccgccgagggccucgccccccuccaccucugccgcaccgccgccucccucggcugcgcccaggcccuccucgagcacggcgccuccguccagcgcgucggcggcaccggccgcgacaccccccuccacgucgccgcccagcgcggccucgacgagcacgcccgccucuaccucggccgcggcgcccacgucgacgcccgcaacggccgcggcgagaccgcccucuccgccgccugcggcgccgcccgccgccccgacgagcacggccgcugccuccgccucugcgcccuccuccuccgccgcggcgccgaggccgacgcccgcgacgaggacgagcgcuccccccuccacaaggccugcggccacgccucccacucccucgcccgccuccuccuccgccacggcgccgacgccggcgcccucgacuacggcggcgccuccccccucggccgcguccuccagaccgccuccugcgcccuccaggccuccccccagcgcaccguccaggcccuccucaaccacggcucccccaccgucuggcccgacgccuuccccaagguccucaagaccugcgccuccguccccgccgucaucgagguccucuucaacuccuacccccagcucugccucuccgaguccuggaaggaggucauccccgaggaggucuuccagaugcacaagcccuucuaccagucccucuucgcccucgcccucaccccccgcugccuccagcaccucugccgcugcgcccuccgccgccucuucggcaagcgcugcuucgaccucaucccccuccucccccuccccaagccccuccagaacuaccuccuccucgagccccagggcguccuccacuga

SEQ ID NO: 40000 - RNA, 1008 nt, Artificial Sequence
  derived and/or modified sequence opt2 from ASB1__Homo_sapiens__NP_001035535
auggccgagggcggcucccccgacggccgcgccggccccggcuccgccggccgcaaccucaaggaguggcuccgcgagcaguucugcgaccacccccucgagcacugcgaggacacccgccuccacgacgccgccuacgucggcgaccuccagacccuccgcucccuccuccaggaggaguccuaccgcucccgcaucaacgagaaguccgucuggugcugcggcuggcuccccugcaccccccuccgcaucgccgccaccgccggccacggcuccugcgucgacuuccucauccgcaagggcgccgaggucgaccucgucgacgucaagggccagaccgcccucuacgucgccgucgucaacggccaccucgaguccacccagauccuccucgaggccggcgccgaccccaacggcucccgccaccaccgcuccacccccgucuaccacgccucccgcgucggccgcgccgacauccucaaggcccucauccgcuacggcgccgacgucgacgucaaccaccaccucacccccgacguccagccccgcuucucccgccgccucaccucccucgucgucugcccccucuacaucuccgccgccuaccacaaccuccagugcuuccgccuccuccuccucgccggcgccaaccccgacuucaacugcaacggccccgucaacacccagggcuucuaccgcggcucccccggcugcgucauggacgccguccuccgccacggcugcgaggccgccuucgucucccuccucgucgaguucggcgccaaccucaaccucgucaagugggagucccucggccccgagucccgcggccgccgcaaggucgaccccgaggcccuccaggucuucaaggaggcccgcuccgucccccgcacccuccucugccucugccgcgucgccguccgccgcgcccucggcaagcaccgccuccaccucauccccucccucccccuccccgaccccaucaagaaguuccuccuccacgaguga

SEQ ID NO: 40001 - RNA, 1764 nt, Artificial Sequence
  derived and/or modified sequence opt2 from ASB2__Homo_sapiens__NP_057234
augacccgcuucuccuacgccgaguacuucucccucuuccacuccugcuccgcccccucccgcuccaccgccccccccgaguccucccccgcccgcgcccccaugggccucuuccagggcgucaugcagaaguacuccuccucccucuucaagaccucccagcucgcccccgccgacccccucaucaaggccaucaaggacggcgacgaggaggcccucaagaccaugaucaaggagggcaagaaccucgccgagcccaacaaggagggcuggcucccccuccacgaggccgccuacuacggccaggucggcugccucaagguccuccagcgcgccuaccccggcaccaucgaccagcgcacccuccaggaggagaccgccgucuaccucgccaccugccgcggccaccucgacugccuccucucccuccuccaggccggcgccgagcccgacaucuccaacaagucccgcgagaccccccucuacaaggccugcgagcgcaagaacgccgaggccgucaagauccucguccagcacaacgccgacaccaaccaccgcugcaaccgcggcuggaccgcccuccacgaguccgucucccgcaacgaccucgaggucaugcagauccucgucuccggcggcgccaaggucgaguccaagaacgccuacggcaucaccccccucuucgucgccgcccaguccggccagcucgaggcccuccgcuuccucgccaaguacggcgccgacaucaacacccaggccuccgacaacgccuccgcccucuacgaggccugcaagaacgagcacgaggaggucgucgaguuccuccucucccagggcgccgacgccaacaagaccaacaaggacggccuccucccccuccacaucgccuccaagaagggcaacuaccgcaucguccagaugcuccuccccgucaccucccgcacccgcauccgccgcuccggcgucuccccccuccaccucgccgccgagcgcaaccacgacgagguccucgaggcccuccucuccgcccgcuucgacgucaacaccccccucgcccccgagcgcgcccgccucuacgaggaccgccgcuccuccgcccucuacuucgccgucgucaacaacaacgucuacgccaccgagcuccuccuccagcacggcgccgaccccaaccgcgacgucaucuccccccuccucgucgccauccgccacggcugccuccgcaccaugcagcuccuccucgaccacggcgccaacaucgacgccuacaucgccacccaccccaccgccuuccccgccaccaucauguucgccaugaagugccucucccuccucaaguuccucauggaccucggcugcgacggcgagcccugcuucuccugccucuacggcaacggcccccacccccccgccccccagcccuccucccgcuucaacgacgcccccgccgccgacaaggagcccuccgucguccaguucugcgaguucgucuccgcccccgaggucucccgcugggccggccccaucaucgacguccuccucgacuacgucggcaacguccagcucugcucccgccucaaggagcacaucgacuccuucgaggacugggccgucaucaaggagaaggccgagcccccccgcccccucgcccaccucugccgccuccgcguccgcaaggccaucggcaaguaccgcaucaagcuccucgacacccucccccuccccggccgccucauccgcuaccucaaguacgagaacacccaguga

SEQ ID NO: 40002 - RNA, 1266 nt, Artificial Sequence
  derived and/or modified sequence opt2 from ASB6__Homo_sapiens__NP_060343
augcccuuccuccacggcuuccgccgcaucaucuucgaguaccagccccucgucgacgccauccucggcucccucggcauccaggaccccgagcgccaggagucccucgaccgccccuccuacgucgccuccgaggagucccgcauccucguccucaccgagcuccucgagcgcaaggcccacucccccuucuaccaggagggcgucuccaacgcccuccucaagauggccgagcucggccucacccgcgccgccgacguccuccuccgccacggcgccaaccucaacuucgaggaccccgucaccuacuacaccgcccuccacaucgccguccuccgcaaccagcccgacauggucgagcuccucguccaccacggcgccgacgucaaccgccgcgaccgcauccacgaguccuccccccucgaccucgccuccgaggagcccgagcgccuccccugccuccagcgccuccucgaccucggcgccgacgucaacgccgccgacaagcacggcaagaccgcccuccuccacgcccucgccuccuccgacggcguccagauccacaacaccgagaacauccgccuccuccucgagggcggcgccgacgucaaggccaccaccaaggacggcgacaccgucuucaccugcaucaucuuccuccucggcgagaccgucggcggcgacaaggaggaggcccagaugaucaaccgcuucugcuuccaggucacccgccuccuccucgcccacggcgccgaccccuccgagugccccgcccacgagucccucacccacaucugccucaaguccuucaagcuccacuucccccuccuccgcuuccuccucgaguccggcgccgccuacaacugcucccuccacggcgccuccugcugguccggcuuccacaucaucuucgagcgccucugcucccaccccggcugcaccgaggacgagucccacgccgaccuccuccgcaaggccgagaccguccucgaccucauggucaccaacucccagaagcuccagcuccccgagaacuucgacauccaccccgucggcucccucgccgagaagauccaggcccuccacuucucccuccgccagcucgaguccuacccccccccccucaagcaccucugccgcgucgccauccgccucuaccuccagcccuggcccgucgacgucaaggucaaggcccucccccuccccgaccgccucaagugguaccuccucuccgagcacuccggcuccgucgaggacgacaucuga

SEQ ID NO: 40003 - RNA, 825 nt, Artificial Sequence
  derived and/or modified sequence opt2 from ASB7__Homo_sapiens__NP_078984
augcuccaccaccacugccgccgcaaccccgagcuccaggaggagcuccagauccaggccgccgucgccgccggcgacguccacaccguccgcaagaugcucgagcagggcuacucccccaacggccgcgacgccaacggcuggacccuccuccacuucuccgccgcccgcggcaaggagcgcugcguccgcgucuuccucgagcacggcgccgaccccaccgucaaggaccucaucggcggcuucaccgcccuccacuacgccgccaugcacggccgcgcccgcaucgcccgccucaugcucgaguccgaguaccgcuccgacaucaucaacgccaaguccaacgacggcuggaccccccuccacgucgccgcccacuacggccgcgacuccuucguccgccuccuccucgaguucaaggccgaggucgacccccucuccgacaagggcaccaccccccuccagcucgccaucauccgcgagcgcuccuccugcgucaagauccuccucgaccacaacgccaacaucgacauccagaacggcuuccuccuccgcuacgccgucaucaaguccaaccacuccuacugccgcauguuccuccagcgcggcgccgacaccaaccucggccgccucgaggacggccagaccccccuccaccucuccgcccuccgcgacgacguccucugcgcccgcaugcucuacaacuacggcgccgacaccaacacccgcaacuacgagggccagaccccccucgccgucuccaucuccaucuccggcuccucccgccccugccucgacuuccuccaggaggucaccuccauguga

SEQ ID NO: 40004 - RNA, 1074 nt, Artificial Sequence
  derived and/or modified sequence opt2 from ASCC1__Homo_sapiens__NP_001185727
auggagguccuccgcccccagcucauccgcaucgacggccgcaacuaccgcaagaaccccguccaggagcagaccuaccagcacgaggaggacgaggaggacuucuaccagggcuccauggagugcgccgacgagcccugcgacgccuacgaggucgagcagaccccccagggcuuccgcuccacccuccgcgcccccucccuccucuacaagcacaucgucggcaagcgcggcgacacccgcaagaagaucgagauggagaccaagaccuccaucuccauccccaagcccggccaggacggcgagaucgucaucaccggccagcaccgcaacggcgucaucuccgcccgcacccgcaucgacguccuccucgacaccuuccgccgcaagcagcccuucacccacuuccucgccuucuuccucaacgaggucgagguccaggagggcuuccuccgcuuccaggaggagguccucgccaagugcuccauggaccacggcgucgacuccuccaucuuccagaaccccaagaagcuccaccucaccaucggcaugcucguccuccucuccgaggaggagauccagcagaccugcgagaugcuccagcagugcaaggaggaguucaucaacgacaucuccggcggcaagccccucgaggucgagauggccggcaucgaguacaugaacgacgaccccggcauggucgacguccucuacgccaagguccacaugaaggacggcuccaaccgccuccaggagcucgucgaccgcguccucgagcgcuuccaggccuccggccucaucgucaaggaguggaacuccgucaagcuccacgccaccgucaugaacacccucuuccgcaaggaccccaacgccgagggccgcuacaaccucuacaccgccgagggcaaguacaucuucaaggagcgcgaguccuucgacggccgcaacauccucaagcucuucgagaacuucuacuucggcucccucaagcucaacuccauccacaucucccagcgcuucaccgucgacuccuucggcaacuacgccuccugcggccagaucgacuucuccuga

SEQ ID NO: 40005 - RNA, 2046 nt, Artificial Sequence
  derived and/or modified sequence opt2 from ASCC2__Homo_sapiens__NP_001229835
augcccgcccucccccucgaccagcuccagaucacccacaaggaccccaagaccggcaagcuccgcaccucccccgcccucgucaucuucgacgagacccuccagaagugccucgacuccuaccuccgcuacgucccccgcaaguucgacgagggcgucgccuccgcccccgaggucgucgacaugcagaagcgccuccaccgcuccgucuuccucaccuuccuccgcauguccacccacaaggaguccaagauccucgaccucugcguccucuucggcaagggcaacuccccccuccuccagaagaugaucggcaacaucuucacccagcagcccuccuacuacuccgaccucgacgagacccuccccaccauccuccaggucuucuccaacauccuccagcacugcggccuccagggcgacggcgccaacaccaccccccagaagcucgaggagcgcggccgccucacccccuccgacaugccccuccucgagcucaaggacaucguccucuaccucugcgacaccugcaccacccucugggccuuccucgacaucuucccccucgccugccagaccuuccagaagcacgacuucugcuaccgccucgccuccuucuacgaggccgccauccccgagauggaguccgccaucaagaagcgccgccucgaggacuccaagcuccucggcgaccucuggcagcgccucucccacucccgcaagaagcucauggagaucuuccacaucauccucaaccagaucugccuccuccccauccucgaguccuccugcgacaacauccagggcuucaucgaggaguuccuccagaucuucuccucccuccuccaggagaagcgcuuccuccgcgacuacgacgcccucuuccccgucgccgaggacaucucccuccuccagcaggccuccuccguccucgacgagacccgcaccgccuacauccuccaggccgucgaguccgccugggagggcgucgaccgccgcaaggccaccgacgccaaggaccccuccgucaucgaggagcccaacggcgagcccaacggcgucaccgucaccgccgaggccgucucccaggccuccucccaccccgagaacuccgaggaggaggagugcaugggcgccgccgccgccgucggccccgccaugugcggcgucgagcucgacucccucaucucccaggucaaggaccuccuccccgaccucggcgagggcuucauccucgccugccucgaguacuaccacuacgaccccgagcaggucaucaacaacauccucgaggagcgccucgcccccacccucucccagcucgaccgcaaccucgaccgcgagaugaagcccgaccccaccccccuccucaccucccgccacaacgucuuccagaacgacgaguucgacgucuucucccgcgacuccgucgaccucucccgcguccacaagggcaaguccacccgcaaggaggagaacacccgcucccuccucaacgacaagcgcgccgucgccgcccagcgccagcgcuacgagcaguacuccgucgucgucgaggaggucccccuccagcccggcgagucccuccccuaccacuccgucuacuacgaggacgaguacgacgacaccuacgacggcaaccaggucggcgccaacgacgccgacuccgacgacgagcucaucucccgccgccccuucaccaucccccagguccuccgcaccaaggucccccgcgagggccaggaggaggacgacgacgacgaggaggacgacgccgacgaggaggcccccaagcccgaccacuucguccaggaccccgccguccuccgcgagaaggccgaggcccgccgcauggccuuccucgccaagaagggcuaccgccacgacuccuccaccgccgucgccggcuccccccgcggccacggccagucccgcgagaccacccaggagcgccgcaagaaggaggccaacaaggccacccgcgccaaccacaaccgccgcaccauggccgaccgcaagcgcuccaagggcaugauccccuccuga

SEQ ID NO: 40006 - RNA, 2196 nt, Artificial Sequence
  derived and/or modified sequence opt2 from ASCC3__Homo_sapiens__NP_001271200
auggcccucccccgccucaccggcgcccuccgcuccuucuccaacgucaccaagcaggacaacuacaacgaggaggucgccgaccucaagaucaagcgcuccaagcuccacgagcagguccucgaccucggccucaccuggaagaagaucaucaaguuccucaacgagaagcucgagaaguccaagaugcaguccaucaacgaggaccucaaggacauccuccacgccgccaagcagaucgucggcaccgacaacggccgcgaggccaucgaguccggcgccgccuuccucuucaugaccuuccaccucaaggacuccgucggccacaaggagaccaaggccaucaagcagauguucggccccuuccccuccuccuccgccaccgccgccugcaacgccaccaaccgcaucaucucccacuucucccaggacgaccucaccgcccucguccagaugaccgagaaggagcacggcgaccgcgucuucuucggcaagaaccucgccuucuccuucgacaugcacgaccucgaccacuucgacgagcuccccaucaacggcgagacccagaagaccaucucccucgacuacaagaaguuccucaacgagcaccuccaggaggccugcacccccgagcucaagcccgucgagaagaccaacggcuccuuccucuggugcgaggucgagaaguaccucaacuccacccucaaggagaugaccgaggucccccgcgucgaggaccucugcugcacccucuacgacaugcucgccuccaucaaguccggcgacgagcuccaggacgagcucuucgagcuccucggccccgagggccucgagcucaucgagaagcuccuccagaaccgcaucaccaucgucgaccgcuuccucaacuccuccaacgaccaccgcuuccaggcccuccaggacaacugcaagaagauccucggcgagaacgccaagcccaacuacggcugccaggucaccauccaguccgagcaggagaagcagcucaugaagcaguaccgccgcgaggagaagcgcaucgcccgccgcgagaagaaggccggcgaggaccucgaggucuccgagggccucaugugcuucgaccccaaggagcuccgcauccagcgcgagcaggcccuccucaacgcccgcuccguccccauccucucccgccagcgcgacgccgacgucgagaagauccacuacccccacgucuacgacucccaggccgaggccaugaagaccuccgccuucaucgccggcgccaagaugauccuccccgagggcauccagcgcgagaacaacaagcucuacgaggagguccgcauccccuacuccgagcccaugccccucuccuucgaggagaagcccgucuacauccaggaccucgacgagaucggccagcucgccuucaagggcaugaagcgccucaaccgcauccaguccaucgucuucgagaccgccuacaacaccaacgagaacaugcucaucugcgcccccaccggcgccggcaagaccaacaucgccaugcucaccguccuccacgagauccgccagcacuuccagcagggcgucaucaagaagaacgaguucaagaucgucuacgucgcccccaugaaggcccucgccgccgagaugaccgacuacuucucccgccgccucgagccccucggcaucaucgucaaggagcucaccggcgacaugcagcucuccaaguccgagauccuccgcacccagaugcucgucaccacccccgagaagugggacgucgucacccgcaaguccgucggcgacgucgcccucucccagaucguccgccuccucauccucgacgagguccaccuccuccacgaggaccgcggccccguccucgaguccaucgucgcccgcacccuccgccaggucgaguccacccaguccaugauccgcauccucggccucuccgccacccuccccaacuaccucgacgucgccaccuuccuccacgucaaccccuacaucggccucuucuucuucgacggccgcuuccgccccgucccccucggccagaccuuccucggcaucaagugcgccaacaagaugcagcagcucaacaacauggacgaggucugcuacgagaacguccucaagcaggucaaggccggccaccagguccaccucuucuaccuccuccuccaccucuucaucugcuucuga

SEQ ID NO: 40007 - RNA, 711 nt, Artificial Sequence
  derived and/or modified sequence opt2 from ASCL1__Homo_sapiens__NP_004307
auggaguccuccgccaagauggaguccggcggcgccggccagcagccccagccccagccccagcagcccuuccucccccccgccgccugcuucuucgccaccgccgccgccgccgccgccgccgccgccgccgccgccgcccaguccgcccagcagcagcagcagcagcagcagcagcagcagcaggccccccagcuccgccccgccgccgacggccagcccuccggcggcggccacaaguccgcccccaagcaggucaagcgccagcgcuccuccucccccgagcucaugcgcugcaagcgccgccucaacuucuccggcuucggcuacucccucccccagcagcagcccgccgccgucgcccgccgcaacgagcgcgagcgcaaccgcgucaagcucgucaaccucggcuucgccacccuccgcgagcacguccccaacggcgccgccaacaagaagauguccaaggucgagacccuccgcuccgccgucgaguacauccgcgcccuccagcagcuccucgacgagcacgacgccgucuccgccgccuuccaggccggcguccucucccccaccaucucccccaacuacuccaacgaccucaacuccauggccggcucccccgucuccuccuacuccuccgacgagggcuccuacgacccccucucccccgaggagcaggagcuccucgacuucaccaacugguucuga

SEQ ID NO: 40008 - RNA, 582 nt, Artificial Sequence
  derived and/or modified sequence opt2 from ASCL2__Homo_sapiens__NP_005161
auggacggcggcacccucccccgcuccgccccccccgccccccccguccccgucggcugcgccgcccgccgccgccccgccucccccgagcuccuccgcugcucccgccgccgccgccccgccaccgccgagaccggcggcggcgccgccgccgucgcccgccgcaacgagcgcgagcgcaaccgcgucaagcucgucaaccucggcuuccaggcccuccgccagcacgucccccacggcggcgccuccaagaagcucuccaaggucgagacccuccgcuccgccgucgaguacauccgcgcccuccagcgccuccucgccgagcacgacgccguccgcaacgcccucgccggcggccuccgcccccaggccguccgccccuccgccccccgcggcccccccggcaccacccccgucgccgccucccccucccgcgccuccuccucccccggccgcggcggcuccuccgagcccggcuccccccgcuccgccuacuccuccgacgacuccggcugcgagggcgcccucucccccgccgagcgcgagcuccucgacuucuccuccuggcucggcggcuacuga

SEQ ID NO: 40009 - RNA, 522 nt, Artificial Sequence
  derived and/or modified sequence opt2 from ASCL4__Homo_sapiens__NP_982260
augauggagacccgcaagcccgccgagcgccucgcccuccccuacucccuccgcaccgccccccucggcguccccggcacccuccccggccucccccgccgcgacccccuccgcgucgcccuccgccucgacgccgccugcugggagugggcccgcuccggcugcgcccgcggcuggcaguaccuccccgucccccucgacuccgccuucgagcccgccuuccuccgcaagcgcaacgagcgcgagcgccagcgcguccgcugcgucaacgagggcuacgcccgccuccgcgaccaccucccccgcgagcucgccgacaagcgccucuccaaggucgagacccuccgcgccgccaucgacuacaucaagcaccuccaggagcuccucgagcgccaggccuggggccucgagggcgccgccggcgccgucccccagcgccgcgccgagugcaacuccgacggcgaguccaaggccuccuccgcccccucccccuccuccgagcccgaggagggcggcuccuga

SEQ ID NO: 40010 - RNA, 615 nt, Artificial Sequence
  derived and/or modified sequence opt2 from ASF1A__Homo_sapiens__NP_054753
auggccaagguccaggucaacaacgucgucguccucgacaaccccucccccuucuacaaccccuuccaguucgagaucaccuucgagugcaucgaggaccucuccgaggaccucgaguggaagaucaucuacgucggcuccgccgaguccgaggaguacgaccagguccucgacuccguccucgucggccccguccccgccggccgccacauguucgucuuccaggccgacgcccccaaccccggccucauccccgacgccgacgccgucggcgucaccgucguccucaucaccugcaccuaccgcggccaggaguucauccgcgucggcuacuacgucaacaacgaguacaccgagaccgagcuccgcgagaacccccccgucaagcccgacuucuccaagcuccagcgcaacauccucgccuccaacccccgcgucacccgcuuccacaucaacugggaggacaacaccgagaagcucgaggacgccgaguccuccaaccccaaccuccagucccuccucuccaccgacgcccuccccuccgccuccaagggcugguccaccuccgagaacucccucaacgucaugcucgagucccacauggacugcauguga

SEQ ID NO: 40011 - RNA, 609 nt, Artificial Sequence
  derived and/or modified sequence opt2 from ASF1B__Homo_sapiens__NP_060624
auggccaaggucuccguccucaacgucgccguccucgagaaccccucccccuuccacucccccuuccgcuucgagaucuccuucgagugcuccgaggcccucgccgacgaccucgaguggaagaucaucuacgucggcuccgccgaguccgaggaguucgaccagauccucgacuccguccucgucggccccguccccgccggccgccacauguucgucuuccaggccgacgcccccaaccccucccucauccccgagaccgacgccgucggcgucaccgucguccucaucaccugcaccuaccacggccaggaguucauccgcgucggcuacuacgucaacaacgaguaccucaaccccgagcuccgcgagaacccccccaugaagcccgacuucucccagcuccagcgcaacauccucgccuccaacccccgcgucacccgcuuccacaucaacugggacaacaacauggaccgccucgaggccaucgagacccaggaccccucccucggcugcggccucccccucaacugcacccccaucaagggccucggccuccccggcugcauccccggccuccuccccgagaacuccauggacugcaucuga

SEQ ID NO: 40012 - RNA, 8895 nt, Artificial Sequence
  derived and/or modified sequence opt2 from ASH1L__Homo_sapiens__XP_006711513
auggacccccgcaacaccgccaugcucggccucggcuccgacuccgagggcuucucccgcaagucccccuccgccaucuccaccggcacccucgucuccaagcgcgaggucgagcucgagaagaacaccaaggaggaggaggaccuccgcaagcgcaaccgcgagcgcaacaucgaggccggcaaggacgacggccucaccgacgcccagcagcaguucuccgucaaggagaccaacuucuccgagggcaaccucaagcucaagaucggccuccaggccaagcgcaccaagaagccccccaagaaccucgagaacuacgucugccgccccgccaucaagaccaccaucaagcacccccgcaaggcccucaaguccggcaagaugaccgacgagaagaacgagcacugccccuccaagcgcgaccccuccaagcucuacaagaaggccgacgacgucgccgccaucgagugccaguccgaggaggucauccgccuccacucccagggcgagaacaacccccucuccaagaagcucucccccguccacuccgagauggccgacuacaucaacgccacccccuccacccuccucggcucccgcgaccccgaccucaaggaccgcgcccuccucaacggcggcaccuccgucaccgagaagcucgcccagcucaucgccaccugcccccccuccaaguccuccaagaccaagcccaagaagcucggcaccggcaccaccgccggccucgucuccaaggaccucauccgcaaggccggcgucggcuccgucgccggcaucauccacaaggaccucaucaagaagcccaccaucuccaccgccgucggccucgucaccaaggaccccggcaagaagcccgucuucaacgccgccgucggccucgucaacaaggacuccgucaagaagcucggcaccggcaccaccgccgucuucaucaacaagaaccucggcaagaagcccggcaccaucaccaccgucggccuccucuccaaggacuccggcaagaagcucggcaucggcaucguccccggccucguccacaaggaguccggcaagaagcucggccucggcaccgucgucggccucgucaacaaggaccucggcaagaagcucggcuccaccgucggccucgucgccaaggacugcgccaagaagaucgucgccuccuccgccaugggccucgucaacaaggacaucggcaagaagcucauguccugcccccucgccggccucaucuccaaggacgccaucaaccucaaggccgaggcccuccuccccacccaggagccccucaaggccuccugcuccaccaacaucaacaaccaggagucccaggagcucuccgagucccucaaggacuccgccaccuccaagaccuucgagaagaacgucguccgccagaacaaggaguccauccucgagaaguucuccguccgcaaggagaucaucaaccucgagaaggagauguucaacgagggcaccugcauccagcaggacuccuucuccuccuccgagaagggcuccuacgagaccuccaagcacgagaagcagccccccgucuacugcaccucccccgacuucaagaugggcggcgccuccgacgucuccaccgccaagucccccuucuccgccgucggcgaguccaaccuccccucccccucccccaccgucuccgucaacccccucacccgcuccccccccgagaccuccucccagcucgcccccaacccccuccuccucuccuccaccaccgagcucaucgaggagaucuccgaguccgucggcaagaaccaguucaccuccgaguccacccaccucaacgucggccaccgcuccgucggccacuccaucuccaucgagugcaagggcaucgacaaggaggucaacgacuccaagaccacccacaucgacaucccccgcaucuccuccucccucggcaagaagcccucccucaccuccgaguccuccauccacaccaucacccccuccgucgucaacuucaccucccucuucuccaacaagcccuuccucaagcucggcgccgucuccgccuccgacaagcacugccaggucgccgagucccucuccaccucccuccaguccaagccccucaagaagcgcaagggccgcaagccccgcuggaccaaggucgucgcccgcuccaccugccgcucccccaagggccucgagcucgagcgcuccgagcucuucaagaacgucuccugcuccucccucuccaacuccaacuccgagcccgccaaguucaugaagaacaucggcccccccuccuucgucgaccacgacuuccucaagcgccgccuccccaagcucuccaaguccaccgcccccucccucgcccuccucgccgacuccgagaagcccucccacaaguccuucgccacccacaagcucuccuccuccaugugcgucuccuccgaccuccucuccgacaucuacaagcccaagcgcggccgccccaaguccaaggagaugccccagcucgagggcccccccaagcgcacccucaagauccccgccuccaaggucuucucccuccaguccaaggaggagcaggagccccccauccuccagcccgagaucgagauccccuccuucaagcagggccucuccgucucccccuuccccaagaagcgcggccgccccaagcgccagaugcgcucccccgucaagaugaagccccccguccucuccgucgcccccuucgucgccaccgagucccccuccaagcucgaguccgaguccgacaaccaccgcuccuccuccgacuucuucgaguccgaggaccagcuccaggaccccgacgaccucgacgacucccaccgccccuccgucugcuccauguccgaccucgagauggagcccgacaagaagaucaccaagcgcaacaacggccagcucaugaagaccaucauccgcaagaucaacaagaugaagacccucaagcgcaagaagcuccucaaccagauccucuccuccuccgucgaguccuccaacaagggcaagguccaguccaagcuccacaacaccgucuccucccucgccgccaccuucggcuccaagcucggccagcagaucaacgucuccaagaagggcaccaucuacaucggcaagcgccgcggccgcaagcccaagaccguccucaacggcauccucuccggcucccccaccucccucgccguccucgagcagaccgcccagcaggccgccggcuccgcccucggccagauccuccccccccuccuccccuccuccgccuccuccuccgagauccuccccucccccaucugcucccaguccuccggcaccuccggcggccagucccccgucuccuccgacgccggcuucgucgagcccuccuccguccccuaccuccaccuccacucccgccagggcuccaugauccagacccucgccaugaagaaggccuccaagggccgccgccgccucuccccccccacccuccuccccaacucccccucccaccucuccgagcucaccucccucaaggaggccacccccucccccaucuccgagucccacuccgacgagaccauccccuccgacuccggcaucggcaccgacaacaacuccaccuccgaccgcgccgagaaguucugcggccagaagaagcgccgccacuccuucgagcacgucucccucaucccccccgagaccuccaccguccucuccucccucaaggagaagcacaagcacaagugcaagcgccgcaaccacgacuaccucuccuacgacaagaugaagcgccagaagcgcaagcgcaagaagaaguacccccagcuccgcaaccgccaggaccccgacuucaucgccgagcucgaggagcucaucucccgccucuccgagauccgcaucacccaccgcucccaccacuucaucccccgcgaccuccuccccaccaucuuccgcaucaacuucaacuccuucuacacccaccccuccuucccccucgacccccuccacuacauccgcaagcccgaccucaagaagaagcgcggccgcccccccaagaugcgcgaggccauggccgagaugcccuucaugcacucccucuccuucccccucuccuccaccggcuucuaccccuccuacggcaugcccuacucccccuccccccucaccgccgcccccaucggccucggcuacuacggccgcuacccccccacccucuacccccccccccccucccccuccuucaccaccccccuccccccccccuccuacaugcacgccggccaccuccuccucaaccccgccaaguaccacaagaagaagcacaagcuccuccgccaggaggccuuccucaccaccucccgcaccccccuccucuccauguccaccuaccccuccgucccccccgagauggccuacggcuggauggucgagcacaagcaccgccaccgccacaagcaccgcgagcaccgcuccuccgagcagccccaggucuccauggacaccggcuccucccgcuccguccucgagucccucaagcgcuaccgcuucggcaaggacgccgucggcgagcgcuacaagcacaaggagaagcaccgcugccacauguccugcccccaccucucccccuccaagucccucaucaaccgcgaggagcaguggguccaccgcgagcccuccgaguccuccccccucgcccucggccuccagaccccccuccagaucgacugcuccgaguccucccccucccucucccucggcggcuucacccccaacuccgagcccgccuccuccgacgagcacaccaaccucuucaccuccgccaucggcuccugccgcgucuccaaccccaacuccuccggccgcaagaagcucaccgacucccccggccucuucuccgcccaggacaccucccucaaccgccuccaccgcaaggagucccuccccuccaacgagcgcgccguccagacccucgccggcucccagcccaccuccgacaagcccucccagcgccccuccgaguccaccaacugcucccccacccgcaagcgcuccuccuccgaguccaccuccuccaccgucaacggcguccccucccgcuccccccgccucgucgccuccggcgacgacuccgucgacucccuccuccagcgcaugguccagaacgaggaccaggagcccauggagaaguccaucgacgccgucaucgccaccgccuccgccccccccuccuccucccccggccgcucccacuccaaggaccgcacccucggcaagcccgacucccuccucguccccgccgucaccuccgacuccugcaacaacuccaucucccuccucuccgagaagcucaccuccuccugcuccccccaccacaucaagcgcuccgucgucgaggccaugcagcgccaggcccgcaagaugugcaacuacgacaagauccucgccaccaagaagaaccucgaccacgucaacaagauccucaaggccaagaagcuccagcgccaggcccgcaccggcaacaacuucgucaagcgccgccccggccgcccccgcaagugcccccuccaggccgucgucuccaugcaggccuuccaggccgcccaguucgucaaccccgagcucaaccgcgacgaggagggcgccgcccuccaccucucccccgacaccgucaccgacgucaucgaggccgucguccaguccgucaaccucaaccccgagcacaagaagggccucaagcgcaagggcuggcuccucgaggagcagacccgcaagaagcagaagccccuccccgaggaggaggagcaggagaacaacaaguccuucaacgaggcccccgucgagauccccucccccuccgagacccccgccaagcccuccgagcccgaguccacccuccagcccguccucucccucaucccccgcgagaagaagcccccccgcccccccaagaagaaguaccagaaggccggccucuacuccgacgucuacaagaccaccgaccccaagucccgccucauccagcucaagaaggagaagcucgaguacacccccggcgagcacgaguacggccucuuccccgcccccauccacgucggcaaguaccuccgccagaagcgcaucgacuuccagcuccccuacgacauccucuggcaguggaagcacaaccagcucuacaagaagcccgacgucccccucuacaagaagauccgcuccaacgucuacgucgacgucaagccccucuccggcuacgaggccaccaccugcaacugcaagaagcccgacgacgacacccgcaagggcugcgucgacgacugccucaaccgcaugaucuucgccgagugcucccccaacaccugccccugcggcgagcagugcugcaaccagcgcauccagcgccacgaguggguccagugccucgagcgcuuccgcgccgaggagaagggcuggggcauccgcaccaaggagccccucaaggccggccaguucaucaucgaguaccucggcgaggucgucuccgagcaggaguuccgcaaccgcaugaucgagcaguaccacaaccacuccgaccacuacugccucaaccucgacuccggcauggucaucgacuccuaccgcaugggcaacgaggcccgcuucaucaaccacuccugcgaccccaacugcgagaugcagaagugguccgucaacggcgucuaccgcaucggccucuacgcccucaaggacaugcccgccggcaccgagcucaccuacgacuacaacuuccacuccuucaacgucgagaagcagcagcucugcaagugcggcuucgagaagugccgcggcaucaucggcggcaagucccagcgcgucaacggccucaccuccuccaagaacucccagcccauggccacccacaagaaguccggccgcuccaaggagaagcgcaaguccaagcacaagcucaagaagcgccgcggccaccucuccgaggagcccuccgagaacaucaacacccccacccgccucaccccccagcuccagaugaagcccauguccaaccgcgagcgcaacuucguccucaagcaccacgucuuccucguccgcaacugggagaagauccgccagaagcaggaggaggucaagcacaccuccgacaacauccacuccgccucccucuacacccgcuggaacggcaucugccgcgacgacggcaacaucaaguccgacgucuucaugacccaguucuccgcccuccagaccgcccgcuccguccgcacccgccgccucgccgccgccgaggagaacaucgaggucgcccgcgccgcccgccucgcccagaucuucaaggagaucugcgacggcaucaucuccuacaaggacuccucccgccaggcccucgccgccccccuccucaaccucccccccaagaagaagaacgccgacuacuacgagaagaucuccgacccccucgaccucaucaccaucgagaagcagauccucaccggcuacuacaagaccgucgaggccuucgacgccgacaugcucaaggucuuccgcaacgccgagaaguacuacggccgcaagucccccgucggccgcgacgucugccgccuccgcaaggccuacuacaacgcccgccacgaggccuccgcccagaucgacgagaucgucggcgagaccgccuccgaggccgacuccuccgagaccuccgucuccgagaaggagaacggccacgagaaggacgacgacgucauccgcugcaucugcggccucuacaaggacgagggccucaugauccagugcgacaagugcauggucuggcagcacugcgacugcaugggcgucaacuccgacgucgagcacuaccucugcgagcagugcgacccccgccccgucgaccgcgagguccccaugaucccccgcccccacuacgcccagcccggcugcgucuacuucaucugccuccuccgcgacgaccuccuccuccgccagggcgacugcgucuaccucaugcgcgacucccgccgcacccccgacggccaccccguccgccaguccuaccgccuccucucccacaucaaccgcgacaagcucgacaucuuccgcaucgagaagcucuggaagaacgagaaggaggagcgcuucgccuucggccaccacuacuuccgcccccacgagacccaccacucccccucccgccgcuucuaccacaacgagcucuuccgcgucccccucuacgagaucaucccccucgaggccgucgucggcaccugcugcguccucgaccucuacaccuacugcaagggccgccccaagggcgucaaggagcaggacgucuacaucugcgacuaccgccucgacaaguccgcccaccucuucuacaagauccaccgcaaccgcuaccccgucugcaccaagcccuacgccuucgaccacuuccccaagaagcucacccccaagaaggacuucuccccccacuacguccccgacaacuacaagcgcaacggcggccgcuccuccuggaaguccgagcgcuccaagcccccccucaaggaccucggccaggaggacgacgcccucccccucaucgaggagguccucgccucccaggagcaggccgccaacgagauccccucccucgaggagcccgagcgcgagggcgccaccgccaacgucuccgagggcgagaagaagaccgaggaguccucccaggagccccaguccaccugcacccccgaggagcgccgccacaaccagcgcgagcgccucaaccagauccuccucaaccuccucgagaagauccccggcaagaacgccaucgacgucaccuaccuccucgaggagggcuccggccgcaagcuccgccgccgcacccucuucauccccgagaacuccuuccgcaaguga

SEQ ID NO: 40013 - RNA, 1605 nt, Artificial Sequence
  derived and/or modified sequence opt2 from ASH2L__Homo_sapiens__NP_001098684
auggacacccaggccggcuccgucgacgaggagaacggccgccagcucggcgaggucgagcuccagugcggcaucugcaccaagugguucaccgccgacaccuucggcaucgacaccuccuccugccuccccuucaugaccaacuacuccuuccacugcaacgucugccaccacuccggcaacaccuacuuccuccgcaagcaggccaaccucaaggagaugugccucuccgcccucgccaaccucaccuggcagucccgcacccaggacgagcaccccaagaccauguucuccaaggacaaggacaucauccccuucaucgacaaguacugggagugcaugaccacccgccagcgccccggcaagaugaccuggcccaacaacaucgucaagaccauguccaaggagcgcgacgucuuccucgucaaggagcaccccgaccccggcuccaaggaccccgaggaggacuaccccaaguucggccuccucgaccaggaccucuccaacaucggccccgccuacgacaaccagaagcaguccuccgccgucuccaccuccggcaaccucaacggcggcaucgccgccggcuccuccggcaagggccgcggcgccaagcgcaagcagcaggacggcggcaccaccggcaccaccaagaaggcccgcuccgacccccucuucuccgcccagcgccuccccccccacggcuacccccucgagcaccccuucaacaaggacggcuaccgcuacauccucgccgagcccgacccccacgcccccgaccccgagaagcucgagcucgacugcugggccggcaagcccauccccggcgaccucuaccgcgccugccucuacgagcgcguccuccucgcccuccacgaccgcgccccccagcucaagaucuccgacgaccgccucaccgucgucggcgagaagggcuacuccaugguccgcgccucccacggcguccgcaagggcgccugguacuucgagaucaccgucgacgagaugccccccgacaccgccgcccgccucggcuggucccagccccucggcaaccuccaggccccccucggcuacgacaaguucuccuacuccuggcgcuccaagaagggcaccaaguuccaccaguccaucggcaagcacuacuccuccggcuacggccagggcgacguccucggcuucuacaucaaccuccccgaggacaccgagaccgccaagucccuccccgacaccuacaaggacaaggcccucaucaaguucaaguccuaccucuacuucgaggagaaggacuucgucgacaaggccgagaagucccucaagcagaccccccacuccgagaucaucuucuacaagaacggcgucaaccagggcgucgccuacaaggacaucuucgagggcgucuacuuccccgccaucucccucuacaaguccugcaccgucuccaucaacuucggccccugcuucaaguacccccccaaggaccucaccuaccgccccauguccgacaugggcuggggcgccgucgucgagcacacccucgccgacguccucuaccacgucgagaccgaggucgacggccgccgcuccccccccugggagcccuga

SEQ ID NO: 40014 - RNA, 1587 nt, Artificial Sequence
  derived and/or modified sequence opt2 from ASIC1__Homo_sapiens__NP_001086
auggagcucaaggccgaggaggaggaggucggcggcguccagcccgucuccauccaggccuucgccuccuccuccacccuccacggccucgcccacaucuucuccuacgagcgccucucccucaagcgcgcccucugggcccucugcuuccucggcucccucgccguccuccucugcgucugcaccgagcgcguccaguacuacuuccacuaccaccacgucaccaagcucgacgaggucgccgccucccagcucaccuuccccgccgucacccucugcaaccucaacgaguuccgcuucucccaggucuccaagaacgaccucuaccacgccggcgagcuccucgcccuccucaacaaccgcuacgagauccccgacacccagauggccgacgagaagcagcucgagauccuccaggacaaggccaacuuccgcuccuucaagcccaagcccuucaacaugcgcgaguucuacgaccgcgccggccacgacauccgcgacaugcuccucuccugccacuuccgcggcgaggucugcuccgccgaggacuucaaggucgucuucacccgcuacggcaagugcuacaccuucaacuccggccgcgacggccgcccccgccucaagaccaugaagggcggcaccggcaacggccucgagaucaugcucgacauccagcaggacgaguaccuccccgucuggggcgagaccgacgagaccuccuucgaggccggcaucaagguccagauccacucccaggacgagccccccuucaucgaccagcucggcuucggcgucgcccccggcuuccagaccuucgucgccugccaggagcagcgccucaucuaccuccccccccccuggggcaccugcaaggccgucaccauggacuccgaccucgacuucuucgacuccuacuccaucaccgccugccgcaucgacugcgagacccgcuaccucgucgagaacugcaacugccgcaugguccacaugcccggcgacgcccccuacugcacccccgagcaguacaaggagugcgccgaccccgcccucgacuuccucgucgagaaggaccaggaguacugcgucugcgagaugcccugcaaccucacccgcuacggcaaggagcucuccauggucaagauccccuccaaggccuccgccaaguaccucgccaagaaguucaacaaguccgagcaguacaucggcgagaacauccucguccucgacaucuucuucgagguccucaacuacgagaccaucgagcagaagaaggccuacgagaucgccggccuccucggcgacaucggcggccagaugggccucuucaucggcgccuccauccucaccguccucgagcucuucgacuacgccuacgaggucaucaagcacaagcucugccgccgcggcaagugccagaaggaggccaagcgcuccuccgccgacaagggcgucgcccucucccucgacgacgucaagcgccacaaccccugcgagucccuccgcggccaccccgccggcaugaccuacgccgccaacauccucccccaccaccccgcccgcggcaccuucgaggacuucaccugcuga

SEQ ID NO: 40015 - RNA, 1539 nt, Artificial Sequence
  derived and/or modified sequence opt2 from ASIC2__Homo_sapiens__NP_001085
auggaccucaaggagucccccuccgagggcucccuccagcccuccuccauccagaucuucgccaacaccuccacccuccacggcauccgccacaucuucgucuacggcccccucaccauccgccgcguccucugggccgucgccuucgucggcucccucggccuccuccucgucgaguccuccgagcgcgucuccuacuacuucuccuaccagcacgucaccaaggucgacgaggucgucgcccagucccucgucuuccccgccgucacccucugcaaccucaacggcuuccgcuucucccgccucaccaccaacgaccucuaccacgccggcgagcuccucgcccuccucgacgucaaccuccagauccccgacccccaccucgccgaccccuccguccucgaggcccuccgccagaaggccaacuucaagcacuacaagcccaagcaguucuccaugcucgaguuccuccaccgcgucggccacgaccucaaggacaugaugcucuacugcaaguucaagggccaggagugcggccaccaggacuucaccaccgucuucaccaaguacggcaagugcuacauguucaacuccggcgaggacggcaagccccuccucaccaccgucaagggcggcaccggcaacggccucgagaucaugcucgacauccagcaggacgaguaccuccccaucuggggcgagaccgaggagaccaccuucgaggccggcgucaagguccagauccacucccaguccgagccccccuucauccaggagcucggcuucggcgucgcccccggcuuccagaccuucgucgccacccaggagcagcgccucaccuaccuccccccccccuggggcgagugccgcuccuccgagaugggccucgacuucuuccccgucuacuccaucaccgccugccgcaucgacugcgagacccgcuacaucgucgagaacugcaacugccgcaugguccacaugcccggcgacgcccccuucugcacccccgagcagcacaaggagugcgccgagcccgcccucggccuccucgccgagaaggacuccaacuacugccucugccgcacccccugcaaccucacccgcuacaacaaggagcucuccauggucaagauccccuccaagaccuccgccaaguaccucgagaagaaguucaacaaguccgagaaguacaucuccgagaacauccucguccucgacaucuucuucgaggcccucaacuacgagaccaucgagcagaagaaggccuacgaggucgccgcccuccucggcgacaucggcggccagaugggccucuucaucggcgccuccauccucaccauccucgagcucuucgacuacaucuacgagcucaucaaggagaagcuccucgaccuccucggcaaggaggaggacgagggcucccacgacgagaacgucuccaccugcgacaccaugcccaaccacuccgagaccaucucccacaccgucaacgucccccuccagaccacccucggcacccucgaggagaucgccugcuga

SEQ ID NO: 40016 - RNA, 1596 nt, Artificial Sequence
  derived and/or modified sequence opt2 from ASIC3__Homo_sapiens__NP_004760
augaagcccaccuccggccccgaggaggcccgccgccccgccuccgacauccgcgucuucgccuccaacugcuccaugcacggccucggccacgucuucggccccggcucccucucccuccgccgcggcaugugggccgccgccgucguccucuccgucgccaccuuccucuaccaggucgccgagcgcguccgcuacuaccgcgaguuccaccaccagaccgcccucgacgagcgcgagucccaccgccucaucuuccccgccgucacccucugcaacaucaacccccuccgccgcucccgccucacccccaacgaccuccacugggccggcuccgcccuccucggccucgaccccgccgagcacgccgccuuccuccgcgcccucggccgcccccccgccccccccggcuucaugcccucccccaccuucgacauggcccagcucuacgcccgcgccggccacucccucgacgacaugcuccucgacugccgcuuccgcggccagcccugcggccccgagaacuucaccaccaucuucacccgcaugggcaagugcuacaccuucaacuccggcgccgacggcgccgagcuccucaccaccacccgcggcggcaugggcaacggccucgacaucaugcucgacguccagcaggaggaguaccuccccgucuggcgcgacaacgaggagacccccuucgaggucggcauccgcguccagauccacucccaggaggagccccccaucaucgaccagcucggccucggcgucucccccggcuaccagaccuucgucuccugccagcagcagcagcucuccuuccuccccccccccuggggcgacugcuccuccgccucccucaaccccaacuacgagcccgagcccuccgacccccucggcucccccucccccucccccuccccccccuacacccucaugggcugccgccucgccugcgagacccgcuacgucgcccgcaagugcggcugccgcauggucuacaugcccggcgacguccccgucugcuccccccagcaguacaagaacugcgcccaccccgccaucgacgccaugcuccgcaaggacuccugcgccugccccaaccccugcgccuccacccgcuacgccaaggagcucuccaugguccgcauccccucccgcgccgccgcccgcuuccucgcccgcaagcucaaccgcuccgaggccuacaucgccgagaacguccucgcccucgacaucuucuucgaggcccucaacuacgagaccgucgagcagaagaaggccuacgagauguccgagcuccucggcgacaucggcggccagaugggccucuucaucggcgccucccuccucaccauccucgagauccucgacuaccucugcgaggucuuccgcgacaagguccucggcuacuucuggaaccgccagcacucccagcgccacuccuccaccaaccuccuccaggagggccucggcucccaccgcacccaggucccccaccucucccucggcccccgcccccccaccccccccugcgccgucaccaagacccucuccgccucccaccgcaccugcuaccucgucacccagcucuga

SEQ ID NO: 40017 - RNA, 1944 nt, Artificial Sequence
  derived and/or modified sequence opt2 from ASIC4__Homo_sapiens__NP_878267
augcucuccggcgccgccggcgccgcccgccgcggcggcgccgcccucgcccccucccucacccgcucccucgccggcacccacgccggcgccgacuccugcgccggcgccgacaagggcucccacaaggagaccaucgaggagcgcgacaagcgccagcagcgccagcagcgccagcgccagcaccagggcugcggcgccgccggcuccggcuccgacucccccaccuccggcccccaccccguccccguccucuucccccucgcccucucccucgaggagcagccccuccccccccucccccucggccgcgcccccggccuccucgcccgcgagggccagggccgcgaggcccucgccucccccuccucccgcggccagaugcccaucgagaucgucugcaagaucaaguucgccgaggaggacgccaagcccaaggagaaggaggccggcgacgagcagucccuccucggcgccgucgcccccggcgccgccccccgcgaccucgccaccuucgccuccaccuccacccuccacggccucggccgcgccugcggccccggcccccacggccuccgccgcacccucugggcccucgcccuccucaccucccucgccgccuuccucuaccaggccgccggccucgcccgcggcuaccucacccgcccccaccucgucgccauggaccccgccgcccccgcccccgucgccggcuuccccgccgucacccucugcaacaucaaccgcuuccgccacuccgcccucuccgacgccgacaucuuccaccucgccaaccucaccggccucccccccaaggaccgcgacggccaccgcgccgccggccuccgcuaccccgagcccgacauggucgacauccucaaccgcaccggccaccagcucgccgacaugcucaaguccugcaacuucuccggccaccacugcuccgccuccaacuucuccgucgucuacacccgcuacggcaagugcuacaccuucaacgccgacccccgcuccucccuccccucccgcgccggcggcaugggcuccggccucgagaucaugcucgacauccagcaggaggaguaccuccccaucuggcgcgagaccaacgagaccuccuucgaggccggcauccgcguccagauccacucccaggaggagccccccuacauccaccagcucggcuucggcgucucccccggcuuccagaccuucgucuccugccaggagcagcgccucaccuaccucccccagcccuggggcaacugccgcgccgaguccgagcuccgcgagcccgagcuccagggcuacuccgccuacuccgucuccgccugccgccuccgcugcgagaaggaggccguccuccagcgcugccacugccgcaugguccacaugcccgacucccucggcggcggccccgagggccccugcuucugccccacccccugcaaccucacccgcuacggcaaggagaucuccaugguccgcauccccaaccgcggcuccgcccgcuaccucgcccgcaaguacaaccgcaacgagaccuacauccgcgagaacuuccucguccucgacgucuucuucgaggcccucaccuccgaggccauggagcagcgcgccgccuacggccucuccgcccuccucggcgaccucggcggccagaugggccucuucaucggcgccuccauccucacccuccucgagauccucgacuacaucuacgaggucuccugggaccgccucaagcgcgucuggcgccgccccaagaccccccuccgcaccuccaccggcggcaucuccacccucggccuccaggagcucaaggagcagucccccugccccucccgcggccgcgucgagggcggcggcgucuccucccuccuccccaaccaccaccacccccacggcccccccggcggccucuucgaggacuucgccugcuga

SEQ ID NO: 40018 - RNA, 1518 nt, Artificial Sequence
  derived and/or modified sequence opt2 from ASIC5__Homo_sapiens__NP_059115
auggagcagaccgagaaguccaaggucuacgccgagaacggccuccucgagaagaucaagcucugccucuccaagaagccccuccccucccccaccgagcgcaagaaguucgaccacgacuucgccaucuccaccuccuuccacggcauccacaacaucguccagaaccgcuccaagauccgccgcguccucuggcucgucgucguccucggcuccgucucccucgucaccuggcagaucuacauccgccuccucaacuacuucaccuggcccaccaccaccuccaucgagguccaguacgucgagaagauggaguuccccgccgucaccuucugcaaccucaaccgcuuccagaccgacgccgucgccaaguucggcgucaucuucuuccucuggcacaucgucuccaagguccuccaccuccaggagaucaccgccaacuccaccggcucccgcgaggccaccgacuucgccgccucccaccagaacuucuccaucgucgaguucauccgcaacaagggcuucuaccucaacaacuccacccuccucgacugcgaguucuucggcaagcccugcucccccaaggacuucgcccacgucuucaccgaguacggcaacugcuucaccuucaaccacggcgagacccuccaggccaagcgcaaggucuccgucuccggccgcggccucucccuccucuucaacgucaaccaggaggccuucaccgacaaccccgcccucggcuucgucgacgccggcaucaucuucgucauccacucccccaagaaggucccccaguucgacggccucggccuccucucccccgucggcaugcacgcccgcgucaccauccgccaggucaagaccguccaccaggaguaccccuggggcgagugcaaccccaacaucaagcuccagaacuucuccuccuacuccaccuccggcugccucaaggagugcaaggcccagcacaucaagaagcagugcggcugcguccccuuccuccuccccggcuacggcaucgagugcgaccuccagaaguacuucuccugcgucucccccguccucgaccacaucgaguucaaggaccucugcaccgucggcacccacaacuccuccugccccgucuccugcgaggagaucgaguaccccgccaccaucuccuacuccuccuuccccucccagaaggcccucaaguaccucuccaagaagcucaaccagucccgcaaguacauccgcgagaaccucgucaagaucgagaucaacuacuccgaccucaacuacaagaucacccagcagcagaaggccgucuccgucuccgagcuccucgccgaccucggcggccagcucggccucuucugcggcgccucccucaucaccaucaucgagaucaucgaguaccucuucaccaacuucuacuggaucugcaucuucuuccuccucaagaucuccgagaugacccaguggaccccccccccccagaaccaccucggcaacaagaaccgcaucgaggagugcuga

SEQ ID NO: 40019 - RNA, 411 nt, Artificial Sequence
  derived and/or modified sequence opt2 from ASIP__Homo_sapiens__XP_005260469
augccccccggcauggacgucacccgccuccuccucgccacccuccucgucuuccucugcuucuucaccgccaacucccaccucccccccgaggagaagcuccgcgacgaccgcucccuccgcuccaacuccuccgucaaccuccucgacguccccuccgucuccaucgucgcccucaacaagaaguccaagcagaucggccgcaaggccgccgagaagaagcgcuccuccaagaaggaggccuccaugaagaaggucguccgcccccgcaccccccucuccgcccccugcgucgccacccgcaacuccugcaagccccccgcccccgccugcugcgaccccugcgccuccugccagugccgcuucuuccgcuccgccugcuccugccgcguccucucccucaacugcuga

SEQ ID NO: 40020 - RNA, 1395 nt, Artificial Sequence
  derived and/or modified sequence opt2 from ASL__Homo_sapiens__NP_000039
auggccuccgaguccggcaagcucuggggcggccgcuucgucggcgccgucgaccccaucauggagaaguucaacgccuccaucgccuacgaccgccaccucugggaggucgacguccagggcuccaaggccuacucccgcggccucgagaaggccggccuccucaccaaggccgagauggaccagauccuccacggccucgacaaggucgccgaggagugggcccagggcaccuucaagcucaacuccaacgacgaggacauccacaccgccaacgagcgccgccucaaggagcucaucggcgccaccgccggcaagcuccacaccggccgcucccgcaacgaccaggucgucaccgaccuccgccucuggaugcgccagaccugcuccacccucuccggccuccucugggagcucauccgcaccauggucgaccgcgccgaggccgagcgcgacguccucuuccccggcuacacccaccuccagcgcgcccagcccauccgcuggucccacuggauccucucccacgccgucgcccucacccgcgacuccgagcgccuccucgagguccgcaagcgcaucaacguccucccccucggcuccggcgccaucgccggcaacccccucggcgucgaccgcgagcuccuccgcgccgagcucaacuucggcgccaucacccucaacuccauggacgccaccuccgagcgcgacuucgucgccgaguuccucuucugggccucccucugcaugacccaccucucccgcauggccgaggaccucauccucuacugcaccaaggaguucuccuucguccagcucuccgacgccuacuccaccggcuccucccucaugccccagaagaagaaccccgacucccucgagcucauccgcuccaaggccggccgcgucuucggccgcugcgccggccuccucaugacccucaagggccuccccuccaccuacaacaaggaccuccaggaggacaaggaggccgucuucgaggucuccgacaccauguccgccguccuccaggucgccaccggcgucaucuccacccuccagauccaccaggagaacaugggccaggcccucucccccgacaugcucgccaccgaccucgccuacuaccucguccgcaagggcaugcccuuccgccaggcccacgaggccuccggcaaggccgucuucauggccgagaccaagggcgucgcccucaaccagcucucccuccaggagcuccagaccaucuccccccucuucuccggcgacgucaucugcgucugggacuacggccacuccgucgagcaguacggcgcccucggcggcaccgcccgcuccuccgucgacuggcagauccgccagguccgcgcccuccuccaggcccagcaggccuga

SEQ ID NO: 40021 - RNA, 897 nt, Artificial Sequence
  derived and/or modified sequence opt2 from ASMT__Homo_sapiens__NP_001164510
augggcuccuccgaggaccaggccuaccgccuccucaacgacuacgccaacggcuucauggucucccagguccucuucgccgccugcgagcucggcgucuucgaccuccucgccgaggcccccggcccccucgacgucgccgccgucgccgccggcguccgcgccuccgcccacggcaccgagcuccuccucgacaucugcgucucccucaagcuccucaaggucgagacccgcggcggcaaggccuucuaccgcaacaccgagcucuccuccgacuaccucaccaccgucucccccaccucccagugcuccaugcucaaguacaugggccgcaccuccuaccgcugcuggggccaccucgccgacgccguccgcgagggccgcaaccaguaccucgagaccuucggcguccccgccgaggagcucuucaccgccaucuaccgcuccgagggcgagcgccuccaguucaugcaggcccuccaggaggucugguccgucaacggccgcuccguccucaccgccuucgaccucuccgucuucccccucaugugcgaccucggcggcgacuucuucaaggacccccuccccgaggccgaccucuacauccucgcccgcguccuccacgacugggccgacggcaagugcucccaccuccucgagcgcaucuaccacaccugcaagcccggcggcggcauccucgucaucgagucccuccucgacgaggaccgccgcggcccccuccucacccagcucuacucccucaacaugcucguccagaccgagggccaggagcgcacccccacccacuaccacaugcuccucuccuccgccggcuuccgcgacuuccaguucaagaagaccggcgccaucuacgacgccauccucgcccgcaaguga

SEQ ID NO: 40022 - RNA, 1818 nt, Artificial Sequence
  derived and/or modified sequence opt2 from ASMTL__Homo_sapiens__NP_001166945
augguccucugccccgucaucggcaagcuccuccacaagcgcgucguccucgccuccgccuccccccgccgccaggagauccucuccaacgccggccuccgcuucgaggucguccccuccaaguucaaggagaagcucgacaaggccuccuucgccacccccuacggcuacgccauggagaccgccaagcagaaggcccucgaggucgccaaccgccucuaccagaccgucggcggccucauccucgagaagcccgucgacaagcaggacgccuaccgcaugcucucccgccucuccggccgcgagcacuccgucuucaccggcgucgccaucguccacugcuccuccaaggaccaccagcucgacacccgcgucuccgaguucuacgaggagaccaaggucaaguucuccgagcucuccgaggagcuccucugggaguacguccacuccggcgagcccauggacaaggccggcggcuacggcauccaggcccucggcggcaugcucgucgaguccguccacggcgacuuccucaacgucgucggcuucccccucaaccacuucugcaagcagcucgucaagcucuacuaccccccccgccccgaggaccuccgccgcuccgucaagcacgacuccauccccgccgccgacaccuucgaggaccucuccgacgucgagggcggcggcuccgagcccacccagcgcgacgccggcucccgcgacgagaaggccgaggccggcgaggccggccaggccaccgccgaggccgagugccaccgcacccgcgagacccucccccccuuccccacccgccuccucgagcucaucgagggcuucaugcucuccaagggccuccucaccgccugcaagcucaaggucuucgaccuccucaaggacgaggccccccagaaggccgccgacaucgccuccaaggucgacgccuccgccugcggcauggagcgccuccucgacaucugcgccgccaugggccuccucgagaagaccgagcagggcuacuccaacaccgagaccgccaacgucuaccucgccuccgacggcgaguacucccuccacggcuucaucaugcacaacaacgaccucaccuggaaccucuucaccuaccucgaguucgccauccgcgagggcaccaaccagcaccaccgcgcccucggcaagaaggccgaggaccucuuccaggacgccuacuaccagucccccgagacccgccuccgcuucaugcgcgccaugcacggcaugaccaagcucaccgccugccaggucgccaccgccuucaaccucucccgcuucuccuccgccugcgacgucggcggcugcaccggcgcccucgcccgcgagcucgcccgcgaguacccccgcaugcaggucaccgucuucgaccuccccgacaucaucgagcucgccgcccacuuccagccccccggcccccaggccguccagauccacuucgccgccggcgacuucuuccgcgacccccuccccuccgccgagcucuacguccucugccgcauccuccacgacuggcccgacgacaagguccacaagcuccucucccgcgucgccgaguccugcaagcccggcgccggccuccuccucgucgagacccuccucgacgaggagaagcgcgucgcccagcgcgcccucaugcagucccucaacaugcucguccagaccgagggcaaggagcgcucccucggcgaguaccagugccuccucgagcuccacggcuuccaccagguccaggucguccaccucggcggcguccucgacgccauccucgccaccaaggucgcccccuga

SEQ ID NO: 40023 - RNA, 1047 nt, Artificial Sequence
  derived and/or modified sequence opt2 from ASNA1__Homo_sapiens__NP_004308
auggccgccggcgucgccggcuggggcgucgaggccgaggaguucgaggacgcccccgacgucgagccccucgagcccacccucuccaacaucaucgagcagcgcucccucaaguggaucuucgucggcggcaagggcggcgucggcaagaccaccugcuccugcucccucgccguccagcucuccaagggccgcgaguccguccucaucaucuccaccgaccccgcccacaacaucuccgacgccuucgaccagaaguucuccaagguccccaccaaggucaagggcuacgacaaccucuucgccauggagaucgaccccucccucggcgucgccgagcuccccgacgaguucuucgaggaggacaacaugcucuccaugggcaagaagaugaugcaggaggccauguccgccuuccccggcaucgacgaggccauguccuacgccgaggucaugcgccucgucaagggcaugaacuucuccgucgucgucuucgacaccgcccccaccggccacacccuccgccuccucaacuuccccaccaucgucgagcgcggccucggccgccucaugcagaucaagaaccagaucucccccuucaucucccagaugugcaacaugcucggccucggcgacaugaacgccgaccagcucgccuccaagcucgaggagacccuccccgucauccgcuccgucuccgagcaguucaaggaccccgagcagaccaccuucaucugcgucugcaucgccgaguuccucucccucuacgagaccgagcgccucauccaggagcucgccaagugcaagaucgacacccacaacaucaucgucaaccagcucgucuuccccgaccccgagaagcccugcaagaugugcgaggcccgccacaagauccaggccaaguaccucgaccagauggaggaccucuacgaggacuuccacaucgucaagcucccccuccucccccacgagguccgcggcgccgacaaggucaacaccuucuccgcccuccuccucgagcccuacaagccccccuccgcccaguga

SEQ ID NO: 40024 - RNA, 1623 nt, Artificial Sequence
  derived and/or modified sequence opt2 from ASNS__Homo_sapiens__NP_001171546
augaagaucgcccaccgcggccccgacgccuuccgcuucgagaacgucaacggcuacaccaacugcugcuucggcuuccaccgccucgccgucgucgacccccucuucggcaugcagcccauccgcgucaagaaguaccccuaccucuggcucugcuacaacggcgagaucuacaaccacaagaagaugcagcagcacuucgaguucgaguaccagaccaaggucgacggcgagaucauccuccaccucuacgacaagggcggcaucgagcagaccaucugcaugcucgacggcgucuucgccuucguccuccucgacaccgccaacaagaaggucuuccucggccgcgacaccuacggcguccgcccccucuucaaggccaugaccgaggacggcuuccucgccgucugcuccgaggccaagggccucgucacccucaagcacuccgccacccccuuccucaaggucgagcccuuccuccccggccacuacgagguccucgaccucaagcccaacggcaaggucgccuccgucgagauggucaaguaccaccacugccgcgacgucccccuccacgcccucuacgacaacgucgagaagcucuuccccggcuucgagaucgagaccgucaagaacaaccuccgcauccucuucaacaacgccgucaagaagcgccucaugaccgaccgccgcaucggcugccuccucuccggcggccucgacuccucccucgucgccgccacccuccucaagcagcucaaggaggcccagguccaguacccccuccagaccuucgccaucggcauggaggacucccccgaccuccucgccgcccgcaaggucgccgaccacaucggcuccgagcacuacgagguccucuucaacuccgaggagggcauccaggcccucgacgaggucaucuucucccucgagaccuacgacaucaccaccguccgcgccuccgucggcauguaccucaucuccaaguacauccgcaagaacaccgacuccgucgucaucuucuccggcgagggcuccgacgagcucacccagggcuacaucuacuuccacaaggcccccucccccgagaaggccgaggaggaguccgagcgccuccuccgcgagcucuaccucuucgacguccuccgcgccgaccgcaccaccgccgcccacggccucgagcuccgcguccccuuccucgaccaccgcuucuccuccuacuaccucucccucccccccgagaugcgcauccccaagaacggcaucgagaagcaccuccuccgcgagaccuucgaggacuccaaccucauccccaaggagauccucuggcgccccaaggaggccuucuccgacggcaucaccuccgucaagaacuccugguucaagauccuccaggaguacgucgagcaccaggucgacgacgccaugauggccaacgccgcccagaaguuccccuucaacacccccaagaccaaggagggcuacuacuaccgccaggucuucgagcgccacuaccccggccgcgccgacuggcucucccacuacuggaugcccaaguggaucaacgccaccgaccccuccgcccgcacccucacccacuacaaguccgccgucaaggccuga

SEQ ID NO: 40025 - RNA, 942 nt, Artificial Sequence
  derived and/or modified sequence opt2 from ASPA__Homo_sapiens__XP_006721590
augaccuccugccacaucgccgaggagcacauccagaaggucgccaucuucggcggcacccacggcaacgagcucaccggcgucuuccucgucaagcacuggcucgagaacggcgccgagauccagcgcaccggccucgaggucaagcccuucaucaccaacccccgcgccgucaagaagugcacccgcuacaucgacugcgaccucaaccgcaucuucgaccucgagaaccucggcaagaagauguccgaggaccuccccuacgagguccgccgcgcccaggagaucaaccaccucuucggccccaaggacuccgaggacuccuacgacaucaucuucgaccuccacaacaccaccuccaacaugggcugcacccucauccucgaggacucccgcaacaacuuccucauccagauguuccacuacaucaagaccucccucgccccccuccccugcuacgucuaccucaucgagcaccccucccucaaguacgccaccacccgcuccaucgccaaguaccccgucggcaucgaggucggcccccagccccagggcguccuccgcgccgacauccucgaccagaugcgcaagaugaucaagcacgcccucgacuucauccaccacuucaacgagggcaaggaguucccccccugcgccaucgaggucuacaagaucaucgagaaggucgacuacccccgcgacgagaacggcgagaucgccgccaucauccaccccaaccuccaggaccaggacuggaagccccuccaccccggcgaccccauguuccucacccucgacggcaagaccaucccccucggcggcgacugcaccgucuaccccgucuucgucaacgaggccgccuacuacgagaagaaggaggccuucgccaagaccaccaagcucacccucaacgccaaguccauccgcugcugccuccacuga

SEQ ID NO: 40026 - RNA, 1722 nt, Artificial Sequence
  derived and/or modified sequence opt2 from ASPG__Homo_sapiens__NP_001073933
auggcccgcgccgucggccccgagcgccgccuccucgccgucuacaccggcggcaccaucggcaugcgcuccgagcucggcguccucguccccggcaccggccucgccgccauccuccgcacccuccccauguuccacgacgaggagcacgcccgcgcccgcggccucuccgaggacacccucguccucccccccgccucccgcaaccagcgcauccucuacaccguccucgagugccagccccucuucgacuccuccgacaugaccaucgccgagugggucugccucgcccagaccaucaagcgccacuacgagcaguaccacggcuucgucgucauccacggcaccgacaccauggccuucgccgccuccaugcucuccuucaugcucgagaaccuccagaagaccgucauccucaccggcgcccagguccccauccacgcccucugguccgacggccgcgagaaccuccucggcgcccuccucauggccggccaguacgucauccccgaggucugccucuucuuccagaaccagcucuuccgcggcaaccgcgccaccaaggucgacgcccgccgcuucgccgccuucugcucccccaaccuccucccccucgccaccgucggcgccgacaucaccaucaaccgcgagcucguccgcaaggucgacggcaaggccggccucgucguccacuccuccauggagcaggacgucggccuccuccgccucuaccccggcauccccgccgcccucguccgcgccuuccuccagcccccccucaagggcgucgucauggagaccuucggcuccggcaacggccccaccaagcccgaccuccuccaggagcuccgcgucgccaccgagcgcggccucgucaucgucaacugcacccacugccuccagggcgccgucaccaccgacuacgccgccggcauggccauggccggcgccggcgucaucuccggcuucgacaugaccuccgaggccgcccucgccaagcucuccuacguccucggccagcccggccucucccucgacguccgcaaggagcuccucaccaaggaccuccgcggcgagaugaccccccccuccgucgaggagcgccgccccucccuccagggcaacacccucggcggcggcgucuccuggcuccucucccucuccggcucccaggaggccgacgcccuccgcaacgcccucguccccucccucgccugcgccgccgcccacgccggcgacgucgaggcccuccaggcccucgucgagcucggcuccgaccucggccucgucgacuucaacggccagaccccccuccacgccgccgcccgcggcggccacaccgaggccgucaccaugcuccuccagcgcggcgucgacgucaacacccgcgacaccgacggcuucuccccccuccuccucgccguccgcggccgccaccccggcgucaucggccuccuccgcgaggccggcgccucccucuccacccaggagcucgaggaggccggcaccgagcucugccgccucgccuaccgcgccgaccucgagggccuccaggucugguggcaggccggcgccgaccucggccagcccggcuacgacggccacuccgcccuccacgucgccgaggccgccggcaaccucgccgucgucgccuuccuccagucccucgagggcgccgucggcgcccaggcccccugccccgagguccuccccggcgucuga

SEQ ID NO: 40027 - RNA, 2190 nt, Artificial Sequence
  derived and/or modified sequence opt2 from ASPH__Homo_sapiens__NP_001158222
auggccgaggacaaggagaccaagcacggcggccacaagaacggccgcaagggcggccucuccggcaccuccuucuucaccugguucauggucaucgcccuccucggcgucuggaccuccgucgccgucgucugguucgaccucgucgacuacgaggagguccucggcaagcucggcaucuacgacgccgacggcgacggcgacuucgacgucgacgacgccaagguccuccucggccucaaggagcgcuccaccuccgagcccgccgucccccccgaggaggccgagccccacaccgagcccgaggagcagguccccgucgaggccgagccccagaacaucgaggacgaggccaaggagcagauccagucccuccuccacgagaugguccacgccgagcacgucgagggcgaggaccuccagcaggaggacggccccaccggcgagccccagcaggaggacgacgaguuccucauggccaccgacgucgacgaccgcuucgagacccucgagcccgaggucucccacgaggagaccgagcacuccuaccacgucgaggagaccgucucccaggacugcaaccaggacauggaggagaugauguccgagcaggagaaccccgacuccuccgagcccgucgucgaggacgagcgccuccaccacgacaccgacgacgucaccuaccaggucuacgaggagcaggccgucuacgagccccucgagaacgagggcaucgagaucaccgaggucaccgccccccccgaggacaaccccgucgaggacucccaggucaucgucgaggaggucuccaucuuccccgucgaggagcagcaggaggucccccccgagaccaaccgcaagaccgacgaccccgagcagaaggccaaggucaagaagaagaagcccaagcuccucaacaaguucgacaagaccaucaaggccgagcucgacgccgccgagaagcuccgcaagcgcggcaagaucgaggaggccgucaacgccuucaaggagcucguccgcaaguacccccaguccccccgcgcccgcuacggcaaggcccagugcgaggacgaccucgccgagaagcgccgcuccaacgagguccuccgcggcgccaucgagaccuaccaggaggucgccucccuccccgacguccccgccgaccuccucaagcucucccucaagcgccgcuccgaccgccagcaguuccucggccacaugcgcggcucccuccucacccuccagcgccucguccagcucuuccccaacgacaccucccucaagaacgaccucggcgucggcuaccuccucaucggcgacaacgacaacgccaagaaggucuacgaggagguccucuccgucacccccaacgacggcuucgccaagguccacuacggcuucauccucaaggcccagaacaagaucgccgaguccauccccuaccucaaggagggcaucgaguccggcgaccccggcaccgacgacggccgcuucuacuuccaccucggcgacgccaugcagcgcgucggcaacaaggaggccuacaagugguacgagcucggccacaagcgcggccacuucgccuccgucuggcagcgcucccucuacaacgucaacggccucaaggcccagcccugguggacccccaaggagaccggcuacaccgagcucgucaagucccucgagcgcaacuggaagcucauccgcgacgagggccucgccgucauggacaaggccaagggccucuuccuccccgaggacgagaaccuccgcgagaagggcgacuggucccaguucacccucuggcagcagggccgccgcaacgagaacgccugcaagggcgcccccaagaccugcacccuccucgagaaguuccccgagaccaccggcugccgccgcggccagaucaaguacuccaucaugcaccccggcacccacgucuggccccacaccggccccaccaacugccgccuccgcaugcaccucggccucgucauccccaaggagggcugcaagauccgcugcgccaacgagaccaagaccugggaggagggcaagguccucaucuucgacgacuccuucgagcacgaggucuggcaggacgccuccuccuuccgccucaucuucaucgucgacgucuggcaccccgagcucaccccccagcagcgccgcucccuccccgccaucuga

SEQ ID NO: 40028 - RNA, 5679 nt, Artificial Sequence
  derived and/or modified sequence opt2 from ASPM__Homo_sapiens__NP_001193775
auggccaaccgccgcgucggccgcggcugcugggaggucucccccaccgagcgccgcccccccgccggccuccgcggccccgccgccgaggaggaggccuccuccccccccguccucucccucucccacuucugccgcucccccuuccucugcuucggcgacguccuccucggcgccucccgcacccucucccucgcccucgacaaccccaacgaggaggucgccgaggucaagaucucccacuuccccgccgccgaccucggcuucuccgucucccagcgcugcuucguccuccagcccaaggagaagaucgucaucuccgucaacuggaccccccucaaggagggccgcguccgcgagaucaugaccuuccucgucaacgacguccucaagcaccaggccauccuccucggcaacgccgaggagcagaagaagaagaagcgcucccucugggacaccaucaagaagaagaagaucuccgccuccaccucccacaaccgccgcgucuccaacauccagaacgucaacaagaccuucuccgucucccagaaggucgaccgcguccgcuccccccuccaggccugcgagaaccucgccaugaacgagggcggcccccccaccgagaacaacucccucauccucgaggagaacaagauccccaucucccccaucucccccgccuucaacgagugccacggcgccaccugccucccccucuccguccgccgcuccaccaccuacuccucccuccacgccuccgagaaccgcgagcuccucaacguccacuccgccaacgucuccaaggucuccuucaacgagaaggccgucaccgagaccuccuucaacuccgucaacgucaacggccagcgcggcgagaacuccaagcucucccucacccccaacugcuccuccacccucaacaucacccagucccagauccacuuccucucccccgacuccuucgucaacaacucccacggcgccaacaacgagcucgagcucgucaccugccucuccuccgacauguucaugaaggacaacucccagcccguccaccucgaguccaccaucgcccacgagaucuaccagaagauccucucccccgacuccuucaucaaggacaacuacggccucaaccaggaccucgaguccgaguccgucaaccccauccucucccccaaccaguuccucaaggacaacauggccuacaugugcaccucccagcagaccugcaaggucccccucuccaacgagaacucccaggucccccagucccccgaggacuggcgcaaguccgaggucuccccccgcauccccgagugccagggcuccaagucccccaaggccaucuucgaggagcucgucgagaugaaguccaacuacuacuccuucaucaagcagaacaaccccaaguucuccgccguccaggacaucuccucccacucccacaacaagcagcccaagcgccgccccauccucuccgccaccgucaccaagcgcaaggccaccugcacccgcgagaaccagaccgagaucaacaagcccaaggccaagcgcugccucaacuccgccgucggcgagcacgagaaggucaucaacaaccagaaggagaaggaggacuuccacuccuaccuccccaucaucgaccccauccucuccaaguccaaguccuacaagaacgaggucacccccuccuccaccaccgccuccgucgcccgcaagcgcaaguccgacggcuccauggaggacgccaacguccgcgucgccaucaccgagcacaccgagguccgcgagaucaagcgcauccacuucucccccuccgagcccaagaccuccgccgucaagaagaccaagaacgucaccacccccaucuccaagcgcaucuccaaccgcgagaagcucaaccucaagaagaagaccgaccucuccaucuuccgcacccccaucuccaagaccaacaagcgcaccaagcccaucaucgccgucgcccaguccucccucaccuucaucaagccccucaagaccgacaucccccgccaccccaugcccuucgccgccaagaacauguucuacgacgagcgcuggaaggagaagcaggagcagggcuucaccugguggcucaacuucauccucacccccgacgacuucaccgucaagaccaacaucuccgaggucaacgccgccacccuccuccucggcaucgagaaccagcacaagaucuccgucccccgcgcccccaccaaggaggagaugucccuccgcgccuacaccgcccgcugccgccucaaccgccuccgccgcgccgccugccgccucuucaccuccgagaagauggucaaggccaucaagaagcucgagaucgagaucgaggcccgccgccucaucguccgcaaggaccgccaccucuggaaggacgucggcgagcgccagaagguccucaacuggcuccucuccuacaacccccucuggcuccgcaucggccucgagaccaccuacggcgagcucaucucccucgaggacaacuccgacgucaccggccucgccauguucauccucaaccgccuccucuggaaccccgacaucgccgccgaguaccgccaccccaccgucccccaccucuaccgcgacggccacgaggaggcccucuccaaguucacccucaagaagcuccuccuccucgucugcuuccucgacuacgccaagaucucccgccucaucgaccacgaccccugccucuucugcaaggacgccgaguucaaggccuccaaggagauccuccucgccuucucccgcgacuuccucuccggcgagggcgaccucucccgccaccucggccuccucggccuccccgucaaccacguccagacccccuucgacgaguucgacuucgccgucaccaaccucgccgucgaccuccagugcggcguccgccucguccgcaccauggagcuccucacccagaacugggaccucuccaagaagcuccgcauccccgccaucucccgccuccagaagaugcacaacgucgacaucguccuccagguccucaagucccgcggcaucgagcucuccgacgagcacggcaacaccauccucuccaaggacaucgucgaccgccaccgcgagaagacccuccgccuccucuggaagaucgccuucgccuuccaggucgacaucucccucaaccucgaccagcucaaggaggagaucgccuuccucaagcacaccaaguccaucaagaagaccaucucccuccucuccugccacuccgacgaccucaucaacaagaagaagggcaagcgcgacuccggcuccuucgagcaguacuccgagaacaucaagcuccucauggacugggucaacgccgucugcgccuucuacaacaagaaggucgagaacuucaccgucuccuucuccgacggccgcguccucugcuaccucauccaccacuaccaccccugcuacguccccuucgacgccaucugccagcgcaccacccagaccgucgagugcacccagaccggcuccgucguccucaacuccuccuccgaguccgacgacuccucccucgacaugucccucaaggccuucgaccacgagaacaccuccgagcucuacaaggagcuccucgagaacgagaagaagaacuuccaccucguccgcuccgccguccgcgaccucggcggcauccccgccaugaucaaccacuccgacauguccaacaccauccccgacgagaaggucgucaucaccuaccucuccuuccucugcgcccgccuccucgaccuccgcaaggagauccgcgccgcccgccucauccagaccaccuggcgcaaguacaagcucaagaccgaccucaagcgccaccaggagcgcgagaaggccgcccgcaucauccagcucgccgucaucaacuuccucgccaagcagcgccuccgcaagcgcgucaacgccgcccucgucauccagaaguacuggcgccgcguccucgcccagcgcaagcuccucaugcucaagaaggagaagcucgagaagguccagaacaaggccgccucccucauccaggccauguggcgccgcuaccgcgccaagaaguaccucugcaaggucaaggccgccugcaagauccaggccugguaccgcugcuggcgcgcccacaaggaguaccucgccauccucaaggccgucaagaucauccagggcugcuucuacaccaagcucgagcgcacccgcuuccucaacguccgcgccuccgccaucaucauccagcgcaaguggcgcgccauccuccccgccaagaucgcccacgagcacuuccucaugaucaagcgccaccgcgccgccugccucauccaggcccacuaccgcggcuacaagggccgccaggucuuccuccgccagaaguccgccgcccucaucauccagaaguacauccgcgcccgcgaggccggcaagcacgagcgcaucaaguacaucgaguucaagaaguccaccgucauccuccaggcccucguccgcggcuggcucguccgcaagcgcuuccucgagcagcgcgccaagauccgccuccuccacuucaccgccgccgccuacuaccaccucaacgccguccgcauccagcgcgccuacaagcucuaccucgccgucaagaacgccaacaagcaggucaacuccgucaucugcauccagcgcugguuccgcgcccgccuccaggagaagcgcuucauccagaaguaccacuccaucaagaagaucgagcacgagggccaggagugccucucccagcgcaaccgcgccgccuccgucauccagaaggccguccgccacuuccuccuccgcaagaagcaggagaaguucaccuccggcaucaucaagauccaggcccucuggcgcggcuacuccuggcgcaagaagaacgacugcaccaagaucaaggccauccgccucucccuccaggucgucaaccgcgagauccgcgaggagaacaagcucuacaagcgcaccgcccucgcccuccacuaccuccucaccuacaagcaccucuccgccauccucgaggcccucaagcaccucgaggucgucacccgccucuccccccucugcugcgagaacauggcccaguccggcgccaucuccaagaucuucguccucauccgcuccugcaaccgcuccauccccugcauggaggucauccgcuacgccguccagguccuccucaacgucuccaaguacgagaagaccaccuccgccgucuacgacgucgagaacugcaucgacauccuccucgagcuccuccagaucuaccgcgagaagcccggcaacaaggucgccgacaagggcggcuccaucuucaccaagaccugcugccuccucgccauccuccucaagaccaccaaccgcgccuccgacguccgcucccgcuccaaggucgucgaccgcaucuacucccucuacaagcucaccgcccacaagcacaagaugaacaccgagcgcauccucuacaagcagaagaagaacuccuccaucuccauccccuucauccccgagacccccguccgcacccgcaucgucucccgccucaagcccgacuggguccuccgccgcgacaacauggaggagaucaccaacccccuccaggccauccagauggucauggacacccucggcauccccuacuga

SEQ ID NO: 40029 - RNA, 729 nt, Artificial Sequence
  derived and/or modified sequence opt2 from ASPN__Homo_sapiens__NP_001180264
augaaggaguacguccuccuccucuuccucgcccucugcuccgccaagcccuucuucucccccucccacaucgcccucaagaacaugaugcucaaggacauggaggacaccgacgacgacgacgacgacgacgacgacgacgacgacgacgaggacaacucccucuuccccacccgcgagccccgcucccacuucuuccccuucgaccucuuccccaugugccccuucggcugccagugcuacucccgcgucguccacugcuccgaccucggccucaccuccguccccaccaacauccccuucgacacccgcaugcucgaccuccagaacaacaagaucaaggagaucaaggagaacgacuucaagggccucaccucccucuacggccucauccucaacaacaacaagcucaccaagauccaccccaaggccuuccucaccaccaagaagcuccgccgccucuaccucucccacaaccagcucuccgagaucccccucaaccuccccaagucccucgccgagcuccgcauccacgagaacaaggucaagaagauccagaaggacaccuucaagggcaugaacgcccuccacguccucgagauguccgccaacccccucgacaacaacggcaucgagcccggcgccuucgagggcgucaccgucuuccacauccgcaucgccgaggccaagcucaccuccguccccaaggacaaccuccccuccuucuga

SEQ ID NO: 40030 - RNA, 1032 nt, Artificial Sequence
  derived and/or modified sequence opt2 from ASPRV1__Homo_sapiens__NP_690005
augggcucccccggcgccucccucggcaucaagaaggcccuccaguccgagcaggccaccgcccuccccgccuccgcccccgccgucucccagcccaccgcccccgcccccuccugccuccccaaggccggccaggucauccccacccuccuccgcgaggcccccuucuccuccgucaucgcccccacccuccucugcggcuuccucuuccucgccugggucgccgccgagguccccgaggaguccucccgcauggccggcuccggcgcccgcuccgaggagggccgccgccagcacgccuucguccccgagcccuucgacggcgccaacgucguccccaaccucuggcuccacuccuucgaggucaucaacgaccucaaccacugggaccacaucaccaagcuccgcuuccucaaggagucccuccgcggcgaggcccucggcgucuacaaccgccucuccccccaggaccagggcgacuacggcaccgucaaggaggcccuccucaaggccuucggcguccccggcgccgcccccucccaccuccccaaggagaucgucuucgccaacuccaugggcaagggcuacuaccucaagggcaagaucggcaagguccccguccgcuuccucgucgacuccggcgcccaggucuccgucguccaccccaaccucugggaggaggucaccgacggcgaccucgacacccuccagcccuucgagaacgucgucaaggucgccaacggcgccgagaugaagauccucggcgucugggacaccgccgucucccucggcaagcucaagcucaaggcccaguuccucgucgccaacgccuccgccgaggaggccaucaucggcaccgacguccuccaggaccacaacgccauccucgacuucgagcaccgcaccugcacccucaagggcaagaaguuccgccuccuccccgucggcggcucccucgaggacgaguucgaccucgagcucaucgaggaggaccccuccuccgaggagggccgccaggagcucucccacuga

SEQ ID NO: 40031 - RNA, 1944 nt, Artificial Sequence
  derived and/or modified sequence opt2 from ASPSCR1__Homo_sapiens__NP_001238817
auggccgcccccgccggcggcggcggcuccgccgucuccguccucgcccccaacggccgccgccacaccgucaaggucacccccuccaccguccuccuccagguccucgaggacaccugccgccgccaggacuucaaccccugcgaguacgaccucaaguuccagcgcuccguccucgaccucucccuccaguggcgcuucgccaaccuccccaacaacgccaagcucgagaugguccccgccucccgcucccgcgagggccccgagaacaugguccgcaucgcccuccagcucgacgacggcucccgccuccaggacuccuucugcuccggccagacccucugggagcuccucucccacuucccccagauccgcgagugccuccagcaccccggcggcgccacccccgucugcgucuacacccgcgacgaggucaccggcgaggccgcccuccgcggcaccacccuccagucccucggccucaccggcggcuccgccaccauccgcuucgucaugaagugcuacgaccccgucggcaagacccccggcucccucggcuccuccgccuccgccggccaggccgccgccuccgccccccucccccucgaguccggcgagcucucccgcggcgaccucucccgccccgaggacgccgacaccuccggccccugcugcgagcacacccaggagaagcaguccacccgcgcccccgccgccgcccccuucguccccuucuccggcggcggccagcgccucggcggcccccccggccccacccgcccccucaccuccuccuccgccaagcuccccaagucccucuccucccccggcggccccuccaagcccaagaaguccaaguccggccaggacccccagcaggagcaggagcaggagcgcgagcgcgacccccagcaggagcaggagcgcgagcgccccgucgaccgcgagcccgucgaccgcgagcccgucgucugccaccccgaccucgaggagcgccuccaggccuggcccgccgagcuccccgacgaguucuucgagcucaccgucgacgacguccgccgccgccucgcccagcucaaguccgagcgcaagcgccucgaggaggccccccucgucaccaaggccuuccgcgaggcccagaucaaggagaagcucgagcgcuaccccaaggucgcccuccgcguccucuuccccgaccgcuacguccuccagggcuucuuccgccccuccgagaccgucggcgaccuccgcgacuucguccgcucccaccucggcaaccccgagcucuccuucuaccucuucaucaccccccccaagaccguccucgacgaccacacccagacccucuuccagccccagcucggcgaccgcgucgcccccuucacccucggccccucccucaagcgcugccucggccccgagcagcgcacccgccuccccgucgucggcgacggcggcgacgucgacuccggccgccuccucuucuggggccccucccgcggccgcgccucccccuccaccggccagccccccugccaccccgucugccgccccuccuccccccccuccccccgccccuccuccggcgaccccucccgcgucaaggccggccacaagcacgucggcaccggccgcgccaaccucuuccccgccgcccucguccaccucggcgccgaggagcccgccggcgucuaccucgagcccggccuccucgagcacgccaucucccccuccgccgccgacguccucgucgcccgcuacaugucccgcgccgccggcucccccuccccccuccccgcccccgaccccgcccccaaguccgagcccgccgccgaggagggcgcccucgucccccccgagcccauccccggcaccgcccagcccgucaagcgcucccucggcaagguccccaaguggcucaagcuccccgccuccaagcgcuga

SEQ ID NO: 40032 - RNA, 927 nt, Artificial Sequence
  derived and/or modified sequence opt2 from ASRGL1__Homo_sapiens__NP_001077395
augaaccccaucgucgucguccacggcggcggcgccggccccaucuccaaggaccgcaaggagcgcguccaccagggcaugguccgcgccgccaccgucggcuacggcauccuccgcgagggcggcuccgccgucgacgccgucgagggcgccgucgucgcccucgaggacgaccccgaguucaacgccggcugcggcuccguccucaacaccaacggcgaggucgagauggacgccuccaucauggacggcaaggaccucuccgccggcgccgucuccgccguccagugcaucgccaaccccaucaagcucgcccgccucgucauggagaagaccccccacugcuuccucaccgaccagggcgccgcccaguucgccgccgccaugggcguccccgagauccccggcgagaagcucgucaccgagcgcaacaagaagcgccucgagaaggagaagcacgagaagggcgcccagaagaccgacugccagaagaaccucggcaccgucggcgccgucgcccucgacugcaagggcaacgucgccuacgccaccuccaccggcggcaucgucaacaagauggucggccgcgucggcgacucccccugccucggcgccggcggcuacgccgacaacgacaucggcgccgucuccaccaccggccacggcgaguccauccucaaggucaaccucgcccgccucacccucuuccacaucgagcagggcaagaccgucgaggaggccgccgaccucucccucggcuacaugaagucccgcgucaagggccucggcggccucaucgucgucuccaagaccggcgacugggucgccaaguggaccuccaccuccaugcccugggccgccgccaaggacggcaagcuccacuucggcaucgaccccgacgacaccaccaucaccgaccuccccuga

SEQ ID NO: 40033 - RNA, 1239 nt, Artificial Sequence
  derived and/or modified sequence opt2 from ASS1__Homo_sapiens__XP_005272257
auguccuccaagggcuccgucguccucgccuacuccggcggccucgacaccuccugcauccucgucuggcucaaggagcagggcuacgacgucaucgccuaccucgccaacaucggccagaaggaggacuucgaggaggcccgcaagaaggcccucaagcucggcgccaagaaggucuucaucgaggacgucucccgcgaguucgucgaggaguucaucuggcccgccauccaguccuccgcccucuacgaggaccgcuaccuccucggcaccucccucgcccgccccugcaucgcccgcaagcaggucgagaucgcccagcgcgagggcgccaaguacgucucccacggcgccaccggcaagggcaacgaccagguccgcuucgagcucuccugcuacucccucgccccccagaucaaggucaucgcccccuggcgcaugcccgaguucuacaaccgcuucaagggccgcaacgaccucauggaguacgccaagcagcacggcauccccauccccgucacccccaagaaccccugguccauggacgagaaccucaugcacaucuccuacgaggccggcauccucgagaaccccaagaaccaggccccccccggccucuacaccaagacccaggaccccgccaaggcccccaacacccccgacauccucgagaucgaguucaagaagggcguccccgucaaggucaccaacgucaaggacggcaccacccaccagaccucccucgagcucuucauguaccucaacgaggucgccggcaagcacggcgucggccgcaucgacaucgucgagaaccgcuucaucggcaugaagucccgcggcaucuacgagacccccgccggcaccauccucuaccacgcccaccucgacaucgaggccuucaccauggaccgcgagguccgcaagaucaagcagggccucggccucaaguucgccgagcucgucuacaccggcuucuggcacucccccgagugcgaguucguccgccacugcaucgccaagucccaggagcgcgucgagggcaagguccaggucuccguccucaagggccaggucuacauccucggccgcgaguccccccucucccucuacaacgaggagcucgucuccaugaacguccagggcgacuacgagcccaccgacgccaccggcuucaucaacaucaacucccuccgccucaaggaguaccaccgccuccaguccaaggucaccgccaaguga

SEQ ID NO: 40034 - RNA, 1128 nt, Artificial Sequence
  derived and/or modified sequence opt2 from ASTN2__Homo_sapiens__NP_001171663
augcccuucaucaccuaccucuccggccuccucaccgcccagaugcucuccgacgaccagcucaucuccggcgucgagauccgcugcgaggagaagggccgcugccccuccaccugccaccucugccgccgccccggcaaggagcagcucucccccacccccguccuccucgagaucaaccgcgucgucccccucuacacccucauccaggacaacggcaccaaggaggccuucaaguccgcccucauguccuccuacuggugcuccggcaagggcgacgucaucgacgacuggugccgcugcgaccucuccgccuucgacgccaacggccuccccaacugcuccccccuccuccagcccguccuccgccucucccccaccgucgagcccuccuccaccgucgucucccucgagugggucgacguccagcccgccaucggcaccaaggucuccgacuacauccuccagcacaagaaggucgacgaguacaccgacaccgaccucuacaccggcgaguuccucuccuucgccgacgaccuccucuccggccucggcaccuccugcgucgccgccggccgcucccacggcgagguccccgaggucuccaucuacuccgucaucuucaagugccucgagcccgacggccucuacaaguucacccucuacgccgucgacacccgcggccgccacuccgagcucuccaccgucacccuccgcaccgccugcccccucgucgacgacaacaaggccgaggagaucgccgacaagaucuacaaccucuacaacggcuacaccuccggcaaggagcagcagauggccuacaacacccucauggaggucuccgccuccaugcucuuccgcguccagcaccacuacaacucccacuacgagaaguucggcgacuucgucuggcgcuccgaggacgagcucggcccccgcaaggcccaccucauccuccgccgccucgagcgcgucuccucccacugcuccucccuccuccgcuccgccuacauccagucccgcgucgagaccguccccuaccucuucugccgcuccgaggagguccgccccgccggcauggucugguacuccauccucaaggacaccaagaucaccuacaucaucuga

SEQ ID NO: 40035 - RNA, 2121 nt, Artificial Sequence
  derived and/or modified sequence opt2 from ASUN__Homo_sapiens__NP_060634
augaagaucuucuccgagucccacaagaccgucuucgucgucgaccacugccccuacauggccgaguccugccgccagcacgucgaguucgacaugcucgucaagaaccgcacccagggcaucaucccccucgcccccaucuccaagucccucuggaccugcuccgucgaguccuccauggaguacugccgcaucauguacgacaucuuccccuucaagaagcucgucaacuucaucgucuccgacuccggcgcccacguccucaacuccuggacccaggaggaccagaaccuccaggagcucauggccgcccucgccgccgucggcccccccaacccccgcgccgaccccgagugcugcuccauccuccacggccucgucgccgccgucgagacccucugcaagaucaccgaguaccagcacgaggcccgcacccuccucauggagaacgccgagcgcgucggcaaccgcggccgcaucaucugcaucaccaacgccaaguccgacucccacguccgcaugcucgaggacugcguccaggagaccauccacgagcacaacaagcucgccgccaacuccgaccaccucaugcagauccagaagugcgagcucguccucauccacaccuaccccgucggcgaggacucccucgucuccgaccgcuccaagaaggagcucucccccguccucaccuccgagguccacuccguccgcgccggccgccaccucgccaccaagcucaacauccucguccagcagcacuucgaccucgccuccaccaccaucaccaacauccccaugaaggaggagcagcacgccaacaccuccgccaacuacgacgucgagcuccuccaccacaaggacgcccacgucgacuuccucaaguccggcgacucccaccucggcggcggcucccgcgagggcuccuucaaggagaccaucacccucaaguggugcaccccccgcaccaacaacaucgagcuccacuacugcaccggcgccuaccgcaucucccccgucgacgucaacucccgccccuccuccugccucaccaacuuccuccucaacggccgcuccguccuccucgagcagccccgcaaguccggcuccaaggucaucucccacaugcucuccucccacggcggcgagaucuuccuccacguccucuccuccucccgcuccauccucgaggacccccccuccaucuccgagggcugcggcggccgcgucaccgacuaccgcaucaccgacuucggcgaguucaugcgcgagaaccgccucacccccuuccucgacccccgcuacaagaucgacggcucccucgaggucccccucgagcgcgccaaggaccagcucgagaagcacacccgcuacuggcccaugaucaucucccagaccaccaucuucaacaugcaggccgucgucccccucgccuccgucaucgucaaggagucccucaccgaggaggacguccucaacugccagaagaccaucuacaaccucgucgacauggagcgcaagaacgacccccuccccaucuccaccgucggcacccgcggcaagggccccaagcgcgacgagcaguaccgcaucauguggaacgagcucgagacccucguccgcgcccacaucaacaacuccgagaagcaccagcgcguccucgagugccucauggccugccgcuccaagccccccgaggaggaggagcgcaagaagcgcggccgcaagcgcgaggacaaggaggacaaguccgagaaggccgucaaggacuacgagcaggagaaguccuggcaggacuccgagcgccucaagggcauccucgagcgcggcaaggaggagcucgccgaggccgagaucaucaaggacucccccgacucccccgagccccccaacaagaagccccucgucgagauggacgagaccccccaggucgagaaguccaagggccccgucucccuccucucccucugguccaaccgcaucaacaccgccaacucccgcaagcaccaggaguucgccggccgccucaacuccgucaacaaccgcgccgagcucuaccagcaccucaaggaggagaacggcauggagaccaccgagaacggcaaggccucccgccaguga

SEQ ID NO: 40036 - RNA, 258 nt, Artificial Sequence
  derived and/or modified sequence opt2 from ASXL1__Homo_sapiens__NP_001158075
augaaggacaagcagaagaagaagaaggagcgcaccugggccgaggccgcccgccucguccucgagaacuacuccgacgcccccaugacccccaagcagauccuccaggucaucgaggccgagggccucaaggagaugcgcuccggcaccuccccccucgccugccucaacgccaugcuccacuccaacucccgcggcggcgagggccucuucuacaagcuccccggccgcaucucccucuucacccucaaggucuga

SEQ ID NO: 40037 - RNA, 4308 nt, Artificial Sequence
  derived and/or modified sequence opt2 from ASXL2__Homo_sapiens__NP_060733
augcgcgagaagggccgccgcaagaagggccgcaccugggccgaggccgccaagaccguccucgagaaguaccccaacacccccaugucccacaaggagauccuccaggucauccagcgcgagggccucaaggagauccgcuccggcaccuccccccucgccugccucaacgccaugcuccacaccaacucccgcggcgaggagggcaucuucuacaagguccccggccgcaugggcgucuacacccucaagaaggacguccccgacggcgucaaggagcucuccgagggcuccgaggaguccuccgacggccaguccgacucccaguccuccgagaacuccuccuccuccuccgacggcggcuccaacaaggagggcaagaagucccgcuggaagcgcaaggucuccuccuccuccccccaguccggcugccccucccccaccauccccgccggcaaggucaucucccccucccagaagcacuccaagaaggcccucaagcaggcccucaagcagcagcagcagaagaagcagcagcagcagugccgccccuccaucuccaucuccuccaaccagcaccucucccucaagaccgucaaggccgccuccgacuccguccccgccaagcccgccaccugggagggcaagcaguccgacggccagaccggcuccccccagaacuccaacuccuccuucuccuccuccgucaaggucgagaacacccuccucggccucggcaagaaguccuuccagcgcuccgagcgccuccacacccgccagaugaagcgcaccaagugcgccgacaucgacgucgagacccccgacuccauccucgucaacaccaaccuccgcgcccucaucaacaagcacaccuucuccguccuccccggcgacugccagcagcgccuccuccuccuccuccccgaggucgaccgccaggucggccccgacggccucaugaagcucaacggcuccgcccucaacaacgaguucuucaccuccgccgcccagggcuggaaggagcgccucuccgagggcgaguucacccccgagaugcagguccgcauccgccaggagaucgagaaggagaagaaggucgagcccuggaaggagcaguucuucgaguccuacuacggccaguccuccggccucucccucgaggacuccaagaagcucaccgccucccccuccgaccccaaggucaagaagacccccgccgagcagcccaaguccaugcccgucuccgaggccucccucauccgcaucguccccgucgucucccaguccgagugcaaggaggaggcccuccagauguccucccccggccgcaaggaggagugcgagucccagggcgagguccagcccaacuucuccaccuccuccgagccccuccucuccuccgcccucaacacccacgagcucuccuccauccuccccaucaagugccccaaggacgaggaccuccucgagcagaagcccgucaccuccgccgagcaggaguccgagaagaaccaccucaccaccgccuccaacuacaacaaguccgagucccaggagucccucgucaccucccccuccaagcccaagucccccggcgucgagaagcccaucgucaagcccaccgccggcgccggcccccaggagaccaacaugaaggagccccucgccacccucgucgaccagucccccgagucccucaagcgcaaguccucccucacccaggaggaggcccccgucuccugggagaagcgcccccgcgucaccgagaaccgccagcaccagcagcccuuccaggucuccccccagcccuuccucaaccgcggcgaccgcauccagguccgcaagguccccccccucaagauccccgucucccgcaucucccccaugcccuuccaccccucccaggucuccccccgcgcccgcuuccccgucuccaucaccucccccaaccgcaccggcgcccgcacccucgccgacaucaaggccaaggcccagcucgucaaggcccagcgcgccgccgccgccgccgccgccgccgccgccgccgccgccuccgucggcggcaccauccccggccccggccccggcggcggccagggccccggcgagggcggcgagggccagaccgcccgcggcggcucccccggcuccgaccgcgucuccgagaccggcaagggccccacccucgagcucgccggcaccggcucccgcggcggcacccgcgagcuccuccccugcggccccgagacccagccccaguccgagaccaagaccacccccucccaggcccagccccacuccgucuccggcgcccagcuccagcagaccccccccgucccccccacccccgccgucuccggcgccugcaccuccguccccucccccgcccacaucgagaagcucgacaacgagaagcucaaccccacccgcgccaccgccaccgucgccuccgucucccacccccagggccccuccuccugccgccaggagaaggcccccucccccaccggccccgcccucaucuccggcgccucccccguccacugcgccgccgacggcaccgucgagcucaaggccggccccuccaagaacauccccaaccccuccgccuccuccaagaccgacgccuccguccccgucgccgucacccccuccccccucaccucccuccucaccaccgccacccucgagaagcuccccgucccccaggucuccgccaccaccgcccccgccggcuccgccccccccuccuccacccuccccgccgccuccucccucaagacccccggcaccucccucaacaugaacggccccacccuccgccccaccuccuccauccccgccaacaacccccucgucacccagcuccuccagggcaaggacguccccauggagcagauccuccccaagccccucaccaaggucgagaugaagaccgucccccucaccgccaaggaggagcgcggcaugggcgcccucaucgccaccaacaccaccgagaacuccacccgcgaggaggucaacgagcgccagucccaccccgccacccagcagcagcucggcaagacccuccaguccaagcagcucccccaggucccccgcccccuccagcucuucuccgccaaggagcuccgcgacuccuccaucgacacccaccaguaccacgagggccucuccaaggccacccaggaccagauccuccagacccucauccagcgcguccgccgccagaaccuccucuccgucgucccccccucccaguucaacuucgcccacuccggcuuccagcucgaggacaucuccaccucccagcgcuucaugcucggcuucgccggccgccgcaccuccaagcccgccauggccggccacuaccuccucaacaucuccaccuacggccgcggcuccgaguccuuccgccgcacccacuccgucaaccccgaggaccgcuucugccucuccucccccaccgaggcccucaagaugggcuacaccgacugcaagaacgccaccggcgaguccuccuccuccaaggaggacgacaccgacgaggaguccaccggcgacgagcaggaguccgucaccgucaaggaggagccccaggucucccaguccgccggcaagggcgacaccuccuccggcccccacucccgcgagacccucuccaccuccgacugccucgccuccaagaacgucaaggccgagaucccccucaacgagcagaccacccucuccaaggagaacuaccucuucacccgcggccagaccuucgacgagaagacccucgcccgcgaccucauccaggccgcccagaagcagauggcccacgccguccgcggcaaggccauccgcuccucccccgagcucuucuccuccaccguccucccccuccccgccgacucccccacccaccagccccuccuccuccccccccuccagacccccaagcucuacggcucccccacccagaucggccccuccuaccgcggcaugaucaacgucuccaccuccuccgacauggaccacaacuccgccguccccggcucccaggucuccuccaacgucggcgacgucauguccuucuccgucaccgucaccaccauccccgccucccaggccaugaaccccuccucccacggccagaccauccccguccaggccuucuccgaggagaacuccaucgagggcacccccuccaagugcuacugccgccucaaggccaugaucaugugcaagggcugcggcgccuucugccacgacgacugcaucggccccuccaagcucugcgucuccugccucgucguccgcuga

SEQ ID NO: 40038 - RNA, 6747 nt, Artificial Sequence
  derived and/or modified sequence opt2 from ASXL3__Homo_sapiens__NP_085135
augaaggacaagcgcaagaagaaggaccgcaccugggccgaggccgcccgccucgcccucgagaagcaccccaacucccccaugaccgccaagcagauccucgaggucauccagaaggagggccucaaggagaccuccggcaccuccccccucgccugccucaacgccaugcuccacaccaacacccgcaucggcgacggcaccuucuucaagauccccggcaaguccggccucuacgcccucaagaaggaggaguccuccugccccgccgacggcacccucgaccucgucugcgaguccgagcucgacggcaccgacauggccgaggccaacgcccacggcgaggagaacggcgucugcuccaagcaggucaccgacgaggccuccuccacccgcgacuccucccucaccaacaccgccguccaguccaagcucgucuccuccuuccagcagcacaccaagaaggcccucaagcaggcccuccgccagcagcagaagcgccgcaacggcgucuccaugauggucaacaagaccgucccccgcgucguccucaccccccucaaggucuccgacgagcaguccgacucccccuccggcuccgaguccaagaacggcgaggccgacuccuccgacaaggagaugaagcacggccagaagucccccaccggcaagcagaccucccagcaccucaagcgccucaagaaguccggccucggccaccucaaguggaccaaggccgaggacaucgacaucgagacccccggcuccauccucgucaacaccaaccuccgcgcccucaucaacaagcacaccuucgccucccucccccagcacuuccagcaguaccuccuccuccuccuccccgaggucgaccgccagaugggcuccgacggcauccuccgccucuccaccuccgcccucaacaacgaguucuucgccuacgccgcccagggcuggaagcagcgccucgccgagggcgaguucacccccgagaugcagcuccgcauccgccaggagaucgagaaggagaagaagaccgagcccuggaaggagaaguucuucgagcgcuucuacggcgagaagcucggcaugucccgcgaggaguccgucaagcucaccaccggccccaacaacgccggcgcccaguccuccuccuccugcggcaccuccggccuccccgucuccgcccagaccgcccucgccgagcagcagcccaaguccaugaagucccccgccucccccgagcccggcuucugcgccacccucugccccauggucgagaucccccccaaggacaucauggccgagcucgaguccgaggacauccucauccccgaggaguccgucauccaggaggagaucgccgaggaggucgagaccuccaucugcgagugccaggacgagaaccacaagaccauccccgaguucuccgaggaggccgagucccucaccaacucccacgaggagccccagaucgccccccccgaggacaaccucgaguccugcgucaugaugaacgacguccucgagacccucccccacaucgaggucaagaucgagggcaaguccgaguccccccaggaggagaugaccgucgucaucgaccagcucgaggucugcgacucccucauccccuccaccuccuccaugacccacgucuccgacaccgagcacaaggaguccgagaccgccgucgagaccuccacccccaagaucaagaccggcuccuccucccucgagggccaguuccccaacgagggcaucgccaucgacauggagcuccaguccgaccccgaggagcagcucuccgagaacgccugcaucuccgagaccuccuucuccuccgagucccccgagggcgccugcaccucccuccccucccccggcggcgagacccaguccaccuccgaggaguccugcacccccgccucccucgagaccaccuucugcuccgaggucuccuccaccgagaacaccgacaaguacaaccagcgcaacuccaccgacgagaacuuccacgccucccucauguccgagaucucccccaucuccaccucccccgagaucuccgaggccucccucauguccaaccucccccucaccuccgaggccucccccgucuccaaccucccccucaccuccgagaccucccccauguccgaccucccccucaccuccgagaccuccuccgucuccuccaugcuccucaccuccgagaccaccuucgucuccucccucccccuccccuccgagaccucccccaucuccaacuccuccaucaacgagcgcauggcccaccagcagcgcaagucccccuccgucuccgaggagccccucuccccccagaaggacgaguccuccgccaccgccaagccccucggcgagaaccucaccucccagcagaagaaccucuccaacacccccgagcccaucaucauguccuccuccuccaucgcccccgaggccuuccccuccgaggaccuccacaacaagacccucucccagcagaccugcaagucccacgucgacaccgagaagcccuaccccgccuccauccccgagcucgccuccaccgagaugaucaaggucaagaaccacuccguccuccagcgcaccgagaagaagguccuccccuccccccucgagcucuccgucuucuccgagggcaccgacaacaagggcaacgagcuccccuccgccaagcuccaggacaagcaguacaucuccuccgucgacaaggcccccuucuccgagggcucccgcaacaagacccacaagcagggcuccacccagucccgccucgagaccucccacaccuccaaguccuccgagcccuccaagucccccgacggcauccgcaacgagucccgcgacuccgagaucuccaagcgcaagaccgccgagcagcacuccuucggcaucugcaaggagaagcgcgcccgcaucgaggacgaccaguccacccgcaacaucuccuccuccuccccccccgagaaggagcagcccccccgcgaggagccccgcguccccccccucaagauccagcucuccaagaucggcccccccuucaucaucaagucccagcccgucuccaagcccgagucccgcgccuccaccuccaccuccgucuccggcggccgcaacaccggcgcccgcacccucgccgacaucaaggcccgcgcccagcaggcccgcgcccagcgcgaggccgccgccgccgccgccgucgccgccgccgccuccaucgucuccggcgccaugggcucccccggcgagggcggcaagacccgcacccucgcccacaucaaggagcagaccaaggccaagcucuucgccaagcaccaggcccgcgcccaccucuuccagaccuccaaggagacccgccucccccccccccucuccuccaaggagggcccccccaaccucgaggucuccuccacccccgagaccaagauggagggcuccaccggcgucaucaucgucaaccccaacugccgcucccccuccaacaaguccgcccaccuccgcgagaccaccaccguccuccagcagucccucaaccccuccaagcuccccgagaccgccaccgaccucuccguccacuccuccgacgagaacauccccgucucccaccucuccgagaagaucgucuccuccaccuccuccgagaacuccuccguccccaugcucuucaacaagaacuccguccccgucuccgucugcuccaccgccaucuccggcgccaucaaggagcaccccuucgucuccuccgucgacaaguccuccguccucauguccgucgacuccgccaacaccaccaucuccgccugcaacaucuccaugcucaagaccauccagggcaccgacacccccugcaucgccaucauccccaagugcaucgaguccacccccaucuccgccaccaccgagggcuccuccaucuccuccuccauggacgacaagcagcuccucaucuccuccuccuccgccuccaaccucgucuccacccaguacaccuccguccccacccccuccaucggcaacaaccuccccaaccucuccaccuccuccguccucaucccccccaugggcaucaacaaccgcuuccccuccgagaagaucgccauccccggcuccgaggagcaggccaccgucuccaugggcaccaccguccgcgccgcccucuccugcuccgacuccgucgccgucaccgacucccucgucgcccaccccaccgucgccauguucaccggcaacaugcucaccaucaacuccuacgacuccccccccaagcucuccgccgagucccucgacaagaacuccggcccccgcaaccgcgccgacaacuccggcaagccccagcagccccccggcggcuucgcccccgccgccaucaaccgcuccauccccugcaaggucaucgucgaccacuccaccacccucaccuccucccucucccucaccgucuccgucgaguccuccgaggccucccucgaccuccagggccgccccguccgcaccgaggccuccguccagcccgucgccugcccccaggucuccgucaucucccgccccgagcccgucgccaacgagggcaucgaccacuccuccaccuucaucgccgccuccgccgccaagcaggacuccaagacccuccccgccaccugcaccucccuccgcgagcucccccucguccccgacaagcucaacgagcccaccgcccccucccacaacuucgccgagcaggcccgcggccccgcccccuucaaguccgaggccgacaccaccugcuccaaccaguacaaccccuccaaccgcaucugcuggaacgacgacggcaugcgcuccaccggccagccccucgucacccacuccggcuccuccaagcagaaggaguaccucgagcaguccugccccaaggccaucaagaccgagcacgccaacuaccucaacgucuccgagcuccacccccgcaaccucgucaccaacgucgcccuccccgucaaguccgagcuccacgaggccgacaagggcuuccgcauggacaccgaggacuuccccggccccgagcuccccccccccgccgccgagggcgccuccuccguccagcagacccagaacaugaaggccuccaccuccucccccauggaggaggccaucucccucgccaccgacgcccucaagcgcguccccggcgccggcuccuccggcugccgccucuccuccgucgaggccaacaacccccucgucacccagcuccuccagggcaaccucccccucgagaagguccucccccagccccgccucggcgccaagcucgagaucaaccgccucccccucccccuccagaccaccuccgucggcaagaccgcccccgagcgcaacgucgagaucccccccuccucccccaaccccgacggcaagggcuaccucgccggcacccucgccccccuccagaugcgcaagcgcgagaaccaccccaagaagcgcgucgcccgcaccgucggcgagcacacccaggucaagugcgagcccggcaagcuccucgucgagcccgacgucaagggcguccccugcgucaucuccuccggcaucucccagcucggccacucccagcccuucaagcaggaguggcucaacaagcacuccaugcagaaccgcaucguccacucccccgaggucaagcagcagaagcgccuccuccccuccugcuccuuccagcagaaccucuuccacgucgacaagaacggcggcuuccacaccgacgccggcaccucccaccgccagcaguucuaccagaugcccgucgccgcccgcggccccauccccaccgccgcccuccuccaggccuccuccaagacccccgucggcugcaacgccuucgccuucaaccgccaccucgagcagaagggccucggcgaggucucccucuccuccgccccccaccagcuccgccucgccaacaugcucucccccaacaugcccaugaaggagggcgacgaggucggcggcaccgcccacaccaugcccaacaaggcccucguccaccccccccccccccccccccccccccccccccccccccucgcccucccccccccccccccccccccccccccccucccccccccccuccccaacgccgagguccccuccgaccagaagcagccccccgucaccauggagaccaccaagcgccucuccuggccccaguccaccggcaucugcuccaacaucaaguccgagccccucuccuucgaggagggccucuccuccuccugcgagcucggcaugaagcaggucuccuacgaccagaacgagaugaaggagcagcucaaggccuucgcccucaaguccgccgacuucuccuccuaccuccucuccgagccccagaagcccuucacccagcucgccgcccagaagaugcagguccagcagcagcagcagcucugcggcaacuaccccaccauccacuucggcuccaccuccuucaagcgcgccgccuccgccaucgagaaguccaucggcauccucggcuccggcuccaaccccgccaccggccucuccggccagaacgcccagaugcccguccagaacuucgccgacuccuccaacgccgacgagcucgagcucaagugcuccugccgccucaaggccaugaucgucugcaagggcugcggcgccuucugccacgacgacugcaucggccccuccaagcucugcgucgccugccucgucguccgcuga

SEQ ID NO: 40039 - RNA, 1428 nt, Artificial Sequence
  derived and/or modified sequence opt2 from ASZ1__Homo_sapiens__NP_570124
auggccgccuccgcccuccgcggccuccccgucgccggcggcggcgaguccuccgaguccgaggacgacggcugggagaucggcuaccucgaccgcaccucccagaagcucaagcgccuccuccccaucgaggagaagaaggagaaguucaagaaggccaugaccaucggcgacgucucccucguccaggagcuccucgacuccggcaucuccgucgacuccaacuuccaguacggcuggaccccccucauguacgccgccuccgucgccaacgccgagcucguccgcguccuccucgaccgcggcgccaacgccuccuucgagaaggacaagcaguccauccucaucaccgccugcuccgcccacggcuccgaggagcagauccucaagugcgucgagcuccuccucucccgcaacgccgaccccaacgucgccugccgccgccucaugacccccaucauguacgccgcccgcgacggccacacccaggucgucgcccuccucgucgcccacggcgccgaggucaacacccaggacgagaacggcuacaccgcccucaccugggccgcccgccagggccacaagaacaucguccucaagcuccucgagcucggcgccaacaagaugcuccagaccaaggacggcaagaugcccuccgagaucgccaagcgcaacaagcaccacgagaucuucaaccuccucuccuucacccucaacccccucgagggcaagcuccagcagcucaccaaggaggacaccaucugcaagauccucaccaccgacuccgaccgcgagaaggaccacaucuucuccuccuacaccgccuucggcgaccucgaggucuuccuccacggccucggccucgagcacaugaccgaccuccucaaggagcgcgacaucacccuccgccaccuccucaccaugcgcgaggacgaguucaccaagaacggcaucaccuccaaggaccagcagaagauccucgccgcccucaaggagcuccaggucgaggagauccaguucggcgagcucuccgaggagaccaagcucgagaucuccggcgacgaguuccucaacuuccuccucaagcucaacaagcagugcggccaccucaucaccgccguccagaacgucaucaccgagcuccccgucaacucccagaagaucacccucgagugggccuccccccagaacuucaccuccgucugcgaggagcucgucaacaacgucgaggaccucuccgagaaggucugcaagcucaaggaccucauccagaagcuccagaacgagcgcgagaacgaccccacccacauccagcuccgcgaggaggucuccaccuggaacucccgcauccucaagcgcaccgccaucaccaucugcggcuucggcuuccuccucuucaucugcaagcucaccuuccagcgcaaguga

SEQ ID NO: 40040 - RNA, 4173 nt, Artificial Sequence
  derived and/or modified sequence opt2 from ATAD2__Homo_sapiens__NP_054828
auggucguccuccgcuccucccucgagcuccacaaccacuccgccgccuccgccaccggcucccucgaccucuccuccgacuuccucucccucgagcacaucggccgccgccgccuccgcuccgccggcgccgcccagaagaagcccgccgccaccaccgccaaggccggcgacggcuccuccgucaaggaggucgagaccuaccaccgcacccgcgcccuccgcucccuccgcaaggacgcccagaacuccuccgacuccuccuucgagaagaacgucgagaucaccgagcagcucgccaacggccgccacuucacccgccagcucgcccgccagcaggccgacaagaagaaggaggagcaccgcgaggacaaggucauccccgucacccgcucccuccgcgcccgcaacaucguccaguccaccgagcaccuccacgaggacaacggcgacgucgagguccgccgcuccugccgcauccgcucccgcuacuccggcgucaaccaguccaugcucuucgacaagcucaucaccaacaccgccgaggccguccuccagaagauggacgacaugaagaagaugcgccgccagcgcaugcgcgagcucgaggaccucggcgucuucaacgagaccgaggaguccaaccucaacauguacacccgcggcaagcagaaggacauccagcgcaccgacgaggagaccaccgacaaccaggagggcuccgucgaguccuccgaggagggcgaggaccaggagcacgaggacgacggcgaggacgaggacgacgaggacgacgacgacgacgacgacgacgacgacgacgacgacgacgaggacgacgaggacgaggaggacggcgaggaggagaaccagaagcgcuacuaccuccgccagcgcaaggccaccgucuacuaccaggccccccucgagaagccccgccaccagcgcaagcccaacaucuucuacuccggccccgccucccccgcccgcccccgcuaccgccucuccuccgccggcccccgcucccccuacugcaagcgcaugaaccgccgccgccacgccauccacuccuccgacuccaccuccuccuccuccuccgaggacgagcagcacuucgagcgccgccgcaagcgcucccgcaaccgcgccaucaaccgcugccucccccucaacuuccgcaaggacgagcucaagggcaucuacaaggaccgcaugaagaucggcgccucccucgccgacgucgaccccaugcagcucgacuccuccguccgcuucgacuccgucggcggccucuccaaccacaucgccgcccucaaggagauggucgucuucccccuccucuaccccgaggucuucgagaaguucaagauccagcccccccgcggcugccucuucuacggcccccccggcaccggcaagacccucgucgcccgcgcccucgccaacgagugcucccagggcgacaagcgcgucgccuucuucaugcgcaagggcgccgacugccucuccaagugggucggcgaguccgagcgccagcuccgccuccucuucgaccaggccuaccagaugcgccccuccaucaucuucuucgacgagaucgacggccucgcccccguccgcuccucccgccaggaccagauccacuccuccaucgucuccacccuccucgcccucauggacggccucgacucccgcggcgagaucgucgucaucggcgccaccaaccgccucgacuccaucgaccccgcccuccgccgccccggccgcuucgaccgcgaguuccucuucucccuccccgacaaggaggcccgcaaggagauccucaagauccacacccgcgacuggaaccccaagccccucgacaccuuccucgaggagcucgccgagaacugcgucggcuacugcggcgccgacaucaaguccaucugcgccgaggccgcccucugcgcccuccgccgccgcuacccccagaucuacaccaccuccgagaagcuccagcucgaccucuccuccaucaacaucuccgccaaggacuucgaggucgccaugcagaagaugauccccgccucccagcgcgccgucaccucccccggccaggcccucuccaccgucgucaagccccuccuccagaacaccgucgacaagauccucgaggcccuccagcgcgucuucccccacgccgaguuccgcaccaacaagacccucgacuccgacaucuccugcccccuccucgaguccgaccucgccuacuccgacgacgacguccccuccgucuacgagaacggccucucccagaaguccucccacaaggccaaggacaacuucaacuuccuccaccucaaccgcaacgccugcuaccagcccauguccuuccgcccccgcauccucaucgucggcgagcccggcuucggccagggcucccaccucgcccccgccgucauccacgcccucgagaaguucaccgucuacacccucgacauccccguccucuucggcgucuccaccaccucccccgaggagaccugcgcccaggucauccgcgaggccaagcgcaccgcccccuccaucgucuacgucccccacauccacgucuggugggagaucgucggccccacccucaaggccaccuucaccacccuccuccagaacauccccuccuucgcccccguccuccuccucgccaccuccgacaagccccacuccgcccuccccgaggagguccaggagcucuucauccgcgacuacggcgagaucuucaacguccagcuccccgacaaggaggagcgcaccaaguucuucgaggaccucauccucaagcaggccgccaagccccccaucuccaagaagaaggccguccuccaggcccucgagguccuccccgucgcccccccccccgagccccgcucccucaccgccgaggaggucaagcgccucgaggagcaggaggaggacaccuuccgcgagcuccgcaucuuccuccgcaacgucacccaccgccucgccaucgacaagcgcuuccgcgucuucaccaagcccgucgaccccgacgagguccccgacuacgucaccgucaucaagcagcccauggaccucuccuccgucaucuccaagaucgaccuccacaaguaccucaccgucaaggacuaccuccgcgacaucgaccucaucugcuccaacgcccucgaguacaaccccgaccgcgaccccggcgaccgccucauccgccaccgcgccugcgcccuccgcgacaccgccuacgccaucaucaaggaggagcucgacgaggacuucgagcagcucugcgaggagauccaggagucccgcaagaagcgcggcugcuccuccuccaaguacgcccccuccuacuaccacgucaugcccaagcagaacuccacccucgucggcgacaagcgcuccgaccccgagcagaacgagaagcucaagacccccuccacccccgucgccugcuccacccccgcccagcucaagcgcaagauccgcaagaaguccaacugguaccucggcaccaucaagaagcgccgcaagaucucccaggccaaggacgacucccagaacgccaucgaccacaagaucgaguccgacaccgaggagacccaggacaccuccgucgaccacaacgagaccggcaacaccggcgaguccuccgucgaggagaacgagaagcagcagaacgccuccgaguccaagcucgagcuccgcaacaacuccaacaccugcaacaucgagaacgagcucgaggacucccgcaagaccaccgccugcaccgagcuccgcgacaagaucgccugcaacggcgacgccuccuccucccagaucauccacaucuccgacgagaacgagggcaaggagaugugcguccuccgcaugacccgcgcccgccgcucccaggucgagcagcagcagcucaucaccgucgagaaggcccucgccauccucucccagcccacccccucccucgucgucgaccacgagcgccucaagaaccuccucaagaccgucgucaagaagucccagaacuacaacaucuuccagcucgagaaccucuacgccgucaucucccagugcaucuaccgccaccgcaaggaccacgacaagaccucccucauccagaagauggagcaggaggucgagaacuucuccugcucccgcuga

SEQ ID NO: 40041 - RNA, 1443 nt, Artificial Sequence
  derived and/or modified sequence opt2 from ATAD3B__Homo_sapiens__XP_011540545
augcgccgcgccaccgucgagcgcgagauggagcuccgccacaagaacgagaugcuccgcgucgagaccgaggcccgcgcccgcgccaaggccgagcgcgagaacgccgacaucauccgcgagcagauccgccucaaggccuccgagcaccgccagaccguccucgaguccauccgcaccgccggcacccucuucggcgagggcuuccgcgccuucgucaccgaccgcgacaaggucaccgccaccgucgccggccucacccuccucgccgucggcgucuacuccgccaagaacgccaccgccgucaccggccgcuucaucgaggcccgccucggcaagcccucccucguccgcgagaccucccgcaucaccguccucgaggcccuccgccaccccauccaggucucccgccgccuccucucccgcccccaggacguccucgagggcgucguccucucccccucccucgaggcccgcguccgcgacaucgccaucgccacccgcaacaccaagaagaaccgcggccucuaccgccacauccuccucuacggcccccccggcaccggcaagacccucuucgccaagaagcucgcccuccacuccggcauggacuacgccaucaugaccggcggcgacgucgcccccaugggccgcgagggcgucaccgccaugcacaagcucuucgacugggccaacaccucccgccgcggccuccuccucuucauggacgaggccgacgccuuccuccgcaagcgcgccaccgaggagaucuccaaggaccuccgcgccacccucaacgccuuccucuaccacaugggccagcacuccaacaaguucaugcucguccucgccuccaaccuccccgagcaguucgacugcgccaucaacucccgcaucgacgucaugguccacuucgaccucccccagcaggaggagcgcgagcgccucguccgccuccacuucgacaacugcguccucaagcccgccaccgagggcaagcgccgccucaagcucgcccaguucgacuacggccgcaagugcuccgaggucgcccgccucaccgagggcauguccggccgcgagaucgcccagcucgccgucuccuggcaggccaccgccuacgccuccaaggacggcguccucaccgaggccaugauggacgccugcguccaggacgccguccagcaguaccgccagaagaugcgcuggcucaaggccgagggccccggccgcggcgucgagcacccccucuccggcguccagggcgagacccucaccuccuggucccucgccaccgaccccuccuaccccugccucgccggccccugcaccuuccgcaucugcuccuggaugggcaccggccucugccccggcccccucuccccccgcauguccugcggcggcggccgccccuucugcccccccggccacccccuccucuga

SEQ ID NO: 40042 - RNA, 1290 nt, Artificial Sequence
  derived and/or modified sequence opt2 from ATAD3C__Homo_sapiens__XP_011539310
augcagcgcgcccaccgccgcgccgaccccuccgagcuccagugccucgaggccauguccaaggacgcccucaaccucgcccagaugcaggagcagacccuccagcucgagcagcaguccaagcucaagcagcucgucaacgaggaccuccgcaagcaggaggaguccguccagaagcaccaccagaccuuccucgaguccauccgcgccgccggcacccucuucggcgagggcuuccgcgccuucgucaccgaccgcgacaaggucaccgccaccgucgccggccucacccuccucgccgucggcgucuacuccgccaagaacgccaccgccgucaccggccgcuacaucgaggcccgccucggcaagcccucccucguccgcgagaccucccgcaucaccguccucgaggcccuccgccaccccauccagcaggucucccgccgccuccucucccgcccccaggacguccucgagggcgucguccucucccccucccucgaggcccgcguccgcgacaucgccaucaugacccgcaacaucaagaagaaccgcggccucuaccgccacauccuccucuacggcccccccggcaccggcaagacccucuucgccaagaagcucgcccuccacuccggcauggacuacgccaucaugaccggcggcgacgucgcccccaugggccgcgagggcgucaccgccaugcacaagcucuucgacugggccaacaccucccgccgcggccuccuccucuucgucgacgaggccgacgccuuccuccgcaagcgcgccaccgagaagaucuccgaggaccuccgcgccacccucaacgccuuccucuaccgcaccggccagcacuccaacaaguucaugcucauccucgccuccugccaccccgagcaguucgacugggccaucaacgccugcaucgacgucaugguccacuucgaccuccccggccaggaggagcgcgcccgccucguccgcauguaccucaacgaguacguccucaagcccgccaccgagggcaagcgccgccucaagcucgcccaguucgacuacggccgcaagugccucgagaucgcccgccucaccgagggcauguccugccgcaagaucgcccagcucgccgucuccuggcaggccaccgccuacgccuccaaggacggcguccucaccgaggccaugauggacgccugcguccaggacuucguccagcagcaccagcagaugaugcgcuggcucaagggcgagcgccccggccccgaggacgagcagcccuccuccuga

SEQ ID NO: 40043 - RNA, 5535 nt, Artificial Sequence
  derived and/or modified sequence opt2 from ATAD5__Homo_sapiens__NP_079133
auggucggcguccucgccauggccgccgccgccgcccccccccccgucaaggacugcgagaucgagcccugcaagaagcgcaagaaggacgacgacaccuccaccugcaagaccaucaccaaguaccucuccccccucggcaagacccgcgaccgcgucuucgccccccccaagcccuccaacauccucgacuacuuccgcaagaccucccccaccaacgagaagacccagcucggcaaggagugcaagaucaagucccccgaguccguccccgucgacuccaacaaggacugcaccaccccccucgagauguucuccaacgucgaguucaagaagaagcgcaagcgcgucaaccucucccaccagcucaacaacaucaagaccgagaacgaggcccccaucgagaucuccuccgacgacuccaaggaggacuacucccucaacaacgacuucgucgaguccuccaccuccguccuccgcuacaagaagcaggucgagguccucgccgagaacauccaggacaccaagucccagcccaacaccaugaccucccuccagaacuccaagaaggucaaccccaagcagggcaccaccaagaacgacuucaagaagcuccgcaagcgcaagugccgcgacgucgucgaccucuccgagucccucccccucgccgaggagcucaaccuccucaagaaggacggcaaggacaccaagcagauggagaacaccaccucccacgccaacucccgcgacaacgucaccgaggccgcccagcucaacgacuccaucaucaccgucuccuacgaggaguuccucaagucccacaaggagaacaaggucgaggagauccccgacuccaccauguccaucugcguccccuccgagaccgucgacgagaucgucaaguccggcuacaucuccgaguccgagaacuccgagaucucccagcagguccgcuucaagaccgucaccguccucgcccagguccaccccaucccccccaagaagaccggcaagaucccccgcaucuuccucaagcagaagcaguucgagauggagaacucccucuccgaccccgagaacgagcagaccguccagaagcgcaaguccaacgucgucauccaggaggaggagcucgagcucgccguccucgaggccggcuccuccgaggccgucaagcccaagugcacccucgaggagcgccagcaguucaugaaggccuuccgccagcccgccuccgacgcccucaagaacggcgucaagaaguccuccgacaagcagaaggaccucaacgagaagugccucuacgaggucggccgcgacgacaacuccaagaagaucauggagaacuccggcauccagauggucuccaagaacggcaaccuccagcuccacaccgacaagggcuccuuccucaaggagaagaacaagaagcucaagaagaagaacaagaagacccucgacaccggcgccauccccggcaagaaccgcgagggcaacacccagaagaaggagaccaccuucuuccucaaggagaagcaguaccagaaccgcaugucccuccgccagcgcaagaccgaguucuucaaguccuccacccucuucaacaacgagucccucgucuacgaggacaucgccaacgacgaccuccucaaggucuccucccucugcaacaacaacaagcucucccgcaagaccuccauccccgucaaggacaucaagcucacccaguccaaggccgaguccgaggccucccuccucaacgucuccacccccaaguccacccgccgcuccggccgcaucuccuccacccccaccaccgagaccauccgcggcaucgacuccgacgacguccaggacaacucccagcucaaggccuccacccagaaggccgccaaccucuccgagaagcacucccucuacaccgccgagcucaucaccguccccuucgacuccgagucccccauccgcaugaaguucacccgcaucuccacccccaagaaguccaagaagaaguccaacaagcgcuccgagaaguccgaggccaccgacggcggcuucaccucccagauccgcaaggccuccaacaccuccaagaacaucuccaaggccaagcagcucaucgagaaggccaaggcccuccacaucucccgcuccaaggucaccgaggagaucgccaucccccuccgccgcuccucccgccaccagacccuccccgagcgcaagaagcucuccgagaccgaggacuccgucaucaucaucgacuccucccccaccgcccucaagcaccccgagaagaaccagaagaagcuccagugccucaacgacguccucggcaagaagcucaacaccuccaccaagaacguccccggcaagaugaaggucgccccccucuuccucguccgcaaggcccagaaggccgccgaccccguccccuccuucgacgaguccucccaggacaccuccgagaagucccaggacugcgacguccagugcaaggccaagcgcgacuuccucauguccggccuccccgaccuccucaagcgccagaucgccaagaaggccgccgcccucgacgucuacaacgccgucuccaccuccuuccagcgcgucguccacguccagcagaaggacgacggcugcugccucuggcaccucaagccccccuccugcccccuccucaccaaguucaaggagcucaacaccaaggucaucgaccucuccaagugcggcaucgcccucggcgaguucuccacccucaacuccaagcucaaguccggcaacuccgccgccgucuucaugcgcacccgcaaggaguucaccgaggagguccgcaaccuccuccucgaggagauccgcugguccaaccccgaguucucccucaagaaguacuucccccuccuccucaagaagcagaucgagcaccagguccucuccuccgagugccacuccaagcaggagcucgaggccgacgucucccacaaggagaccaagcgcaagcucgucgaggccgagaacuccaaguccaagcgcaagaagcccaacgaguacuccaagaaccucgagaagaccaaccgcaaguccgaggagcucuccaagcgcaacaacuccuccggcaucaagcucgacuccuccaaggacuccggcaccgaggacaugcucuggaccgagaaguaccagccccagaccgccuccgagcucaucggcaacgagcucgccaucaagaagcuccacuccuggcucaaggacuggaagcgccgcgccgagcucgaggagcgccagaaccucaagggcaagcgcgacgagaagcacgaggacuucuccggcggcaucgacuucaagggcuccuccgacgacgaggaggagucccgccucugcaacaccguccucaucaccggccccaccggcgucggcaagaccgccgccgucuacgccugcgcccaggagcucggcuucaagaucuucgaggucaacgccuccucccagcgcuccggccgccagauccucucccagcucaaggaggccacccagucccaccaggucgacaagcagggcgucaacucccagaagcccugcuucuucaacuccuacuacaucggcaagucccccaagaagaucuccucccccaagaaggucgucaccuccccccgcaagguccccccccccucccccaaguccuccggccccaagcgcgcccucccccccaagacccucgccaacuacuucaaggucucccccaagcccaagaacaacgaggagaucggcaugcuccucgagaacaacaagggcaucaagaacuccuucgagcagaagcagaucacccagaccaaguccaccaacgccaccaacuccaacgucaaggacgucggcgccgaggagcccucccgcaagaacgccaccucccucauccucuucgaggaggucgacgucaucuucgacgaggacgccggcuuccucaacgccaucaagaccuucauggccaccaccaagcgccccgucauccucaccaccuccgaccccaccuucucccucauguucgacggcugcuucgaggagaucaaguucuccacccccucccuccucaacgucgccuccuaccuccagaugaucugccucaccgagaacuuccgcaccgacgucaaggacuucgucacccuccucaccgccaacaccugcgacauccgcaaguccauccucuaccuccaguucuggauccgcuccggcggcggcguccucgaggagcgcccccucacccucuaccgcggcaacucccgcaacguccagcucgucugcuccgagcacggccucgacaacaagaucuaccccaagaacaccaagaagaagcgcgucgaccuccccaagugcgacuccggcugcgccgagacccucuucggccucaagaacaucuucucccccuccgaggaccucuucuccuuccucaagcacaagaucaccaugaaggaggaguggcacaaguucauccagcuccucaccgaguuccagaugcgcaacgucgacuuccucuacuccaaccucgaguucauccucccccuccccgucgacaccauccccgagaccaagaacuucugcggccccuccgucaccgucgacgccuccgccgccaccaaguccaugaacugccucgcccgcaagcacuccgagcgcgagcagccccucaagaagucccagaagaagaagcagaagaagacccucgucauccucgacgacuccgaccucuucgacaccgaccucgacuuccccgaccaguccaucucccucuccuccgucuccuccuccuccaacgccgaggaguccaagaccggcgacgaggaguccaaggcccgcgacaagggcaacaaccccgagaccaagaaguccauccccugcccccccaagaccaccgccggcaagaagugcuccgcccucgucucccacugccucaacucccucuccgaguucauggacaacauguccuuccucgacgcccuccucaccgacguccgcgagcagaacaaguacggccgcaacgacuucuccuggaccaacggcaaggucaccuccggccucugcgacgaguucucccucgaguccaacgacggcuggaccucccaguccuccggcgagcucaaggccgccgccgaggcccucuccuucaccaagugcuccuccgccaucuccaaggcccucgagacccucaacuccugcaagaagcucggccgcgaccccaccaacgaccucaccuucuacgucucccagaagcgcaacaacgucuacuucucccaguccgccgccaaccucgacaacgccuggaagcgcaucuccgucaucaaguccgucuucuccucccgcucccuccucuacgucggcaaccgccaggccuccaucaucgaguaccuccccacccuccgcaacaucugcaagaccgagaagcucaaggagcagggcaaguccaagcgccgcuuccuccacuacuucgagggcauccaccucgacauccccaaggagaccgucaacacccucgccgccgacuuccccuga

SEQ ID NO: 40044 - RNA, 1230 nt, Artificial Sequence
  derived and/or modified sequence opt2 from ATAT1__Homo_sapiens__NP_001026892
auguggcucaccuggcccuucugcuuccucaccaucacccuccgcgaggagggcgucugccaccucgaguccgucgaccuccagcagcagaucaugaccaucaucgacgagcucggcaaggccuccgccaaggcccagaaccucuccgcccccaucaccuccgccucccgcaugcaguccaaccgccacgucgucuacauccucaaggacuccuccgcccgccccgccggcaagggcgccaucaucggcuucaucaaggucggcuacaagaagcucuucguccucgacgaccgcgaggcccacaacgaggucgagccccucugcauccucgacuucuacauccacgaguccguccagcgccacggccacggccgcgagcucuuccaguacaugcuccagaaggagcgcgucgagccccaccagcucgccaucgaccgccccucccagaagcuccucaaguuccucaacaagcacuacaaccucgagaccaccgucccccaggucaacaacuucgucaucuucgagggcuucuucgcccaccagcaccgcccccccgcccccucccuccgcgccacccgccacucccgcgccgccgccgucgaccccacccccgccgcccccgcccgcaagcucccccccaagcgcgccgagggcgacaucaagcccuacuccuccuccgaccgcgaguuccucaaggucgccgucgagccccccuggccccucaaccgcgccccccgccgcgccaccccccccgcccacccccccccccgcuccuccucccucggcaacucccccgagcgcggcccccuccgccccuucguccccgagcaggagcuccuccgcucccuccgccucugccccccccaccccaccgcccgccuccuccucgccgccgaccccggcggcucccccgcccagcgccgccgcacccgcggcaccccccccggccucgucgcccaguccugcugcuacucccgccacggcggcgucaacuccuccucccccaacaccggcaaccaggacuccaagcagggcgagcaggagaccaagaaccgcuccgccuccgaggagcaggcccucucccaggacggcuccggcgagaagcccaugcacaccgcccccccccaggcccccgccccccccgcccaguccuggaccgucggcggcgacauccucaacgcccgcuucauccgcaaccuccaggagcgccgcuccacccgccccugguga

SEQ ID NO: 40045 - RNA, 1116 nt, Artificial Sequence
  derived and/or modified sequence opt2 from ATCAY__Homo_sapiens__NP_149053
augggcaccaccgaggccacccuccgcauggagaacgucgacgucaaggaggaguggcaggacgaggaccucccccgcccccuccccgaggagaccggcgucgagcuccucggcucccccgucgaggacaccuccuccccccccaacacccucaacuucaacggcgcccaccgcaagcgcaagacccucgucgcccccgagaucaacaucucccucgaccaguccgagggcucccuccucuccgacgacuuccucgacacccccgacgaccucgacaucaacgucgacgacaucgagacccccgacgagaccgacucccucgaguuccucggcaacggcaacgagcucgagugggaggacgacacccccgucgccaccgccaagaacaugcccggcgacuccgccgaccucuucggcgacggcaccaccgaggacggcuccgccgccaacggccgccucuggcgcaccgucaucaucggcgagcaggagcaccgcaucgaccuccacaugauccgccccuacaugaaggucgucacccacggcggcuacuacggcgagggccucaacgccaucaucgucuucgccgccugcuuccuccccgacuccucccuccccgacuaccacuacaucauggagaaccucuuccucuacgucaucuccucccucgagcuccucgucgccgaggacuacaugaucgucuaccucaacggcgccaccccccgccgccgcaugcccggcaucggcuggcucaagaagugcuaccagaugaucgaccgccgccuccgcaagaaccucaagucccucaucaucguccaccccuccugguucauccgcaccguccucgccaucucccgccccuucaucuccgucaaguucaucaacaagauccaguacguccacucccucgaggaccucgagcagcucauccccauggagcacguccagauccccgacugcguccuccaguacgaggaggagcgccucaaggcccgccgcgaguccgcccgcccccagcccgaguucguccucccccgcuccgaggagaagcccgaggucgcccccgucgagaaccgcuccgcccucgucuccgaggaccaggagaccuccauguccuga

SEQ ID NO: 40046 - RNA, 1557 nt, Artificial Sequence
  derived and/or modified sequence opt2 from ATE1__Homo_sapiens__NP_001001976
auggccuucugggccggcggcucccccuccgucgucgacuacuuccccuccgaggacuucuaccgcugcggcuacugcaagaacgaguccggcucccgcuccaacggcaugugggcccacuccaugaccguccaggacuaccaggaccucaucgaccgcggcuggcgccgcuccggcaaguacgucuacaagcccgucaugaaccagaccugcugcccccaguacaccauccgcugccgcccccuccaguuccagcccuccaagucccacaagaagguccucaagaagaugcucaaguuccucgccaagggcgagguccccaagggcuccugcgaggacgagcccauggacuccaccauggacgacgccgucgccggcgacuucgcccucaucaacaagcucgacauccagugcgaccucaagacccucuccgacgacaucaaggagucccucgaguccgagggcaagaacuccaagaaggaggagccccaggagcuccuccagucccaggacuucgucggcgagaagcucggcuccggcgagcccucccacuccgucaagguccacaccguccccaagcccggcaagggcgccgaccucuccaagccccccugccgcaaggccaaggagauccgcaaggagcgcaagcgccucaagcucaugcagcagaaccccgccggcgagcucgagggcuuccaggcccagggccacccccccucccucuucccccccaaggccaaguccaaccagcccaagucccucgaggaccucaucuucgagucccuccccgagaacgccucccacaagcucgagguccgcgucguccgcuccuccccccccuccucccaguucaaggccacccuccucgaguccuaccaggucuacaagcgcuaccagauggucauccacaagaacccccccgacacccccaccgagucccaguucacccgcuuccucugcuccuccccccucgaggccgagaccccccccaacggccccgacugcggcuacggcuccuuccaccagcaguacuggcucgacggcaagaucaucgccgucggcgucaucgacauccuccccaacugcgucuccuccgucuaccucuacuacgaccccgacuacuccuuccucucccucggcgucuacuccgcccuccgcgagaucgccuucacccgccagcuccacgagaagaccucccagcucuccuacuacuacaugggcuucuacauccacuccugccccaagaugaaguacaagggccaguaccgccccuccgaccuccucugccccgagaccuacgucuggguccccaucgagcagugccuccccucccucgagaacuccaaguacugccgcuucaaccaggaccccgaggccgucgacgaggaccgcuccaccgagcccgaccgccuccaggucuuccacaagcgcgccaucaugcccuacggcgucuacaagaagcagcagaaggaccccuccgaggaggccgccguccuccaguacgccucccucgucggccagaagugcuccgagcgcaugcuccucuuccgcaacuga

SEQ ID NO: 40047 - RNA, 816 nt, Artificial Sequence
  derived and/or modified sequence opt2 from ATF1__Homo_sapiens__XP_011536689
auggaggacucccacaaguccaccaccuccgagaccgccccccagcccggcuccgccguccagggcgcccacaucucccacaucgcccagcaggucuccucccucuccgaguccgaggagucccaggacuccuccgacuccaucggcuccucccagaaggcccacggcauccucgcccgccgccccuccuaccgcaagauccucaaggaccucuccuccgaggacacccgcggccgcaagggcgacggcgagaacuccggcgucuccgccgccgucaccuccauguccguccccacccccaucuaccagaccuccuccggccaguacaucgccaucgcccccaacggcgcccuccagcucgccucccccggcaccgacggcguccagggccuccagacccucaccaugaccaacuccggcuccacccagcagggcaccaccauccuccaguacgcccagaccuccgacggccagcagauccucguccccuccaaccaggucgucguccagaccgccuccggcgacaugcagaccuaccagauccgcaccacccccuccgccaccucccucccccagaccgucgucaugaccucccccgucacccucaccucccagaccaccaagaccgacgacccccagcucaagcgcgagauccgccucaugaagaaccgcgaggccgcccgcgagugccgccgcaagaagaaggaguacgucaagugccucgagaaccgcgucgccguccucgagaaccagaacaagacccucaucgaggagcucaagacccucaaggaccucuacuccaacaaguccgucuga

SEQ ID NO: 40048 - RNA, 1518 nt, Artificial Sequence
  derived and/or modified sequence opt2 from ATF2__Homo_sapiens__NP_001243019
augaaguucaagcuccacgucaacuccgcccgccaguacaaggaccucuggaacauguccgacgacaagcccuuccucugcaccgcccccggcugcggccagcgcuucaccaacgaggaccaccucgccguccacaagcacaagcacgagaugacccucaaguucggccccgcccgcaacgacuccgucaucgucgccgaccagacccccacccccacccgcuuccucaagaacugcgaggaggucggccucuucaacgagcucgccucccccuucgagaacgaguucaagaaggccuccgaggacgacaucaagaagaugccccucgaccucuccccccucgccacccccaucauccgcuccaagaucgaggagcccuccgucgucgagaccacccaccaggacuccccccucccccaccccgaguccaccaccuccgacgagaaggaggucccccucgcccagaccgcccagcccaccuccgccaucguccgccccgccucccuccagguccccaacguccuccucaccuccuccgacuccuccgucaucauccagcaggccguccccucccccaccuccuccaccgucaucacccaggcccccuccuccaaccgccccaucguccccguccccggccccuucccccuccuccuccaccuccccaacggccagaccaugcccgucgccauccccgccuccaucaccuccuccaacguccacguccccgccgccgucccccucguccgccccgucaccaugguccccuccguccccggcauccccggccccuccuccccccagcccguccaguccgaggccaagaugcgccucaaggccgcccucacccagcagcacccccccgucaccaacggcgacaccgucaagggccacggcuccggccucguccgcacccaguccgaggagucccgcccccagucccuccagcagcccgccaccuccaccaccgagacccccgccucccccgcccacaccaccccccagacccaguccaccuccggccgccgccgccgcgccgccaacgaggaccccgacgagaagcgccgcaaguuccucgagcgcaaccgcgccgccgccucccgcugccgccagaagcgcaaggucuggguccagucccucgagaagaaggccgaggaccucuccucccucaacggccagcuccaguccgaggucacccuccuccgcaacgaggucgcccagcucaagcagcuccuccucgcccacaaggacugccccgucaccgccaugcagaagaaguccggcuaccacaccgccgacaaggacgacuccuccgaggacaucuccguccccuccuccccccacaccgaggccauccagcacuccuccgucuccaccuccaacggcgucuccuccaccuccaaggccgaggccgucgccaccuccguccucacccagauggccgaccaguccaccgagcccgcccucucccagaucgucauggcccccuccucccagucccagcccuccggcuccuga

SEQ ID NO: 40049 - RNA, 408 nt, Artificial Sequence
  derived and/or modified sequence opt2 from ATF3__Homo_sapiens__NP_001035709
augaugcuccagcaccccggccaggucuccgccuccgaggucuccgccuccgccaucguccccugccucuccccccccggcucccucgucuucgaggacuucgccaaccucacccccuucgucaaggaggagcuccgcuucgccauccagaacaagcaccucugccaccgcauguccuccgcccucgaguccgucaccgucuccgaccgcccccucggcgucuccaucaccaaggccgaggucgcccccgaggaggacgagcgcaagaagcgccgccgcgagcgcaacaagaucgccgccgccaagugccgcaacaagaagaaggagaagaccgagugccuccagaagcucccccgccccuucuggguccagaagaccugcaucugggccgucgacuccugcaaguga

SEQ ID NO: 40050 - RNA, 1056 nt, Artificial Sequence
  derived and/or modified sequence opt2 from ATF4__Homo_sapiens__NP_001666
augaccgagauguccuuccucuccuccgagguccucgucggcgaccucaugucccccuucgaccaguccggccucggcgccgaggagucccucggccuccucgacgacuaccucgaggucgccaagcacuucaagccccacggcuucuccuccgacaaggccaaggccggcuccuccgaguggcucgccgucgacggccucgucucccccuccaacaacuccaaggaggacgccuucuccggcaccgacuggaugcucgagaagauggaccucaaggaguucgaccucgacgcccuccucggcaucgacgaccucgagaccaugcccgacgaccuccucaccacccucgacgacaccugcgaccucuucgccccccucguccaggagaccaacaagcagcccccccagaccgucaaccccaucggccaccuccccgagucccucaccaagcccgaccaggucgcccccuucaccuuccuccagccccucccccucucccccggcguccucuccuccacccccgaccacuccuucucccucgagcucggcuccgaggucgacaucaccgagggcgaccgcaagcccgacuacaccgccuacgucgccaugaucccccagugcaucaaggaggaggacacccccuccgacaacgacuccggcaucugcaugucccccgaguccuaccucggcuccccccagcacucccccuccacccgcggcucccccaaccgcucccuccccucccccggcguccucugcggcuccgcccgccccaagcccuacgacccccccggcgagaagauggucgccgccaaggucaagggcgagaagcucgacaagaagcucaagaagauggagcagaacaagaccgccgccacccgcuaccgccagaagaagcgcgccgagcaggaggcccucaccggcgagugcaaggagcucgagaagaagaacgaggcccucaaggagcgcgccgacucccucgccaaggagauccaguaccucaaggaccucaucgaggagguccgcaaggcccgcggcaagaagcgcguccccuga

SEQ ID NO: 40051 - RNA, 849 nt, Artificial Sequence
  derived and/or modified sequence opt2 from ATF5__Homo_sapiens__NP_001277675
augucccuccucgccacccucggccucgagcucgaccgcgcccuccuccccgccuccggccucggcuggcucgucgacuacggcaagcucccccccgcccccgccccccucgcccccuacgagguccucggcggcgcccucgagggcggccuccccgucggcggcgagccccucgccggcgacggcuucuccgacuggaugaccgagcgcgucgacuucaccgcccuccucccccucgagcccccccucccccccggcacccucccccagcccucccccaccccccccgaccucgaggccauggccucccuccucaagaaggagcucgagcagauggaggacuucuuccucgacgcccccccccuccccccccccuccccccccccccuccccccccccccccucccccccgcccccucccucccccucucccuccccuccuucgaccucccccagccccccguccucgacacccucgaccuccucgccaucuacugccgcaacgaggccggccaggaggaggucggcaugcccccccucccccccccccagcagccccccccccccucccccccccagcccucccgccucgcccccuacccccaccccgccaccacccgcggcgaccgcaagcagaagaagcgcgaccagaacaaguccgccgcccuccgcuaccgccagcgcaagcgcgccgagggcgaggcccucgagggcgagugccagggccucgaggcccgcaaccgcgagcucaaggagcgcgccgaguccgucgagcgcgagauccaguacgucaaggaccuccucaucgaggucuacaaggcccgcucccagcgcacccgcuccugcuga

SEQ ID NO: 40052 - RNA, 2103 nt, Artificial Sequence
  derived and/or modified sequence opt2 from ATF6B__Homo_sapiens__NP_001129625
auggccgagcucaugcuccucuccgagaucgccgaccccacccgcuucuucaccgacaaccuccucucccccgaggacugggacuccacccucuacuccggccucgacgaggucgccgaggagcagacccagcucuuccgcugccccgagcaggacguccccuucgacggcuccucccucgacgucggcauggacgucucccccuccgagccccccugggagcuccuccccaucuuccccgaccuccaggucaaguccgagcccuccucccccugcuccuccuccucccucuccuccgaguccucccgccucuccaccgagcccuccuccgaggcccucggcgucggcgagguccuccacgucaagaccgagucccucgcccccccccucugccuccucggcgacgaccccaccuccuccuucgagaccguccagaucaacgucauccccaccuccgacgacuccuccgacguccagaccaagaucgagcccgucucccccugcuccuccgucaacuccgaggccucccuccucuccgccgacuccuccucccaggccuucaucggcgaggagguccucgaggucaagaccgagucccucucccccuccggcugccuccucugggacguccccgcccccucccucggcgccguccagaucuccaugggccccucccucgacggcuccuccggcaaggcccuccccacccgcaagcccccccuccagcccaagcccgucguccucaccaccguccccaugcccucccgcgccgucccccccuccaccaccguccuccuccagucccucguccagcccccccccgucucccccgucguccucauccagggcgccauccgcguccagcccgagggccccgcccccucccucccccgccccgagcgcaaguccaucguccccgcccccaugcccggcaacuccugcccccccgaggucgacgccaagcuccucaagcgccagcagcgcaugaucaagaaccgcgaguccgccugccagucccgccgcaagaagaaggaguaccuccagggccucgaggcccgccuccaggccguccucgccgacaaccagcagcuccgccgcgagaacgccgcccuccgccgccgccucgaggcccuccucgccgagaacuccgagcucaagcucggcuccggcaaccgcaaggucgucugcaucauggucuuccuccucuucaucgccuucaacuucggccccgucuccaucuccgagccccccuccgcccccaucuccccccgcaugaacaagggcgagccccagccccgccgccaccuccucggcuucuccgagcaggagcccguccagggcgucgagccccuccagggcuccucccagggccccaaggagccccagcccucccccaccgaccagcccuccuucuccaaccucaccgccuuccccggcggcgccaaggagcuccuccuccgcgaccucgaccagcucuuccucuccuccgacugccgccacuucaaccgcaccgagucccuccgccucgccgacgagcucuccggcuggguccagcgccaccagcgcggccgccgcaagaucccccagcgcgcccaggagcgccagaagucccagccccgcaagaaguccccccccgucaaggccguccccauccagccccccggcccccccgagcgcgacuccgucggccagcuccagcucuaccgccaccccgaccgcucccagcccgccuuccucgacgccaucgaccgccgcgaggacaccuucuacgucgucuccuuccgccgcgaccaccuccuccuccccgccaucucccacaacaagaccucccgccccaagaugucccucgucaugcccgccauggcccccaacgagacccucuccggccgcggcgcccccggcgacuacgaggagaugaugcagaucgagugcgaggucauggacacccgcgucauccacaucaagaccuccaccgucccccccucccuccgcaagcagcccucccccacccccggcaacgccaccggcggcccccuccccgucuccgccgccucccaggcccaccaggccucccaccagccccucuaccucaaccaccccuga

SEQ ID NO: 40053 - RNA, 2013 nt, Artificial Sequence
  derived and/or modified sequence opt2 from ATF6__Homo_sapiens__NP_031374
augggcgagcccgccggcgucgccggcaccauggagucccccuucucccccggccucuuccaccgccucgacgaggacugggacuccgcccucuucgccgagcucggcuacuucaccgacaccgacgagcuccagcucgaggccgccaacgagaccuacgagaacaacuucgacaaccucgacuucgaccucgaccucaugcccugggaguccgacaucugggacaucaacaaccagaucugcaccgucaaggacaucaaggccgagccccagccccucucccccgccuccuccuccuacuccgucuccuccccccgcuccgucgacuccuacuccuccacccagcacguccccgaggagcucgaccucuccuccuccucccagauguccccccucucccucuacggcgagaacuccaacucccucuccuccgccgagccccucaaggaggacaagcccgucaccggcccccgcaacaagaccgagaacggccucacccccaagaagaagauccaggucaacuccaagcccuccauccagcccaagccccuccuccuccccgccgcccccaagacccagaccaacuccuccguccccgccaagaccaucaucauccagaccguccccacccucaugccccucgccaagcagcagcccaucaucucccuccagcccgcccccaccaagggccagaccguccuccucucccagcccaccgucguccagcuccaggcccccggcguccuccccuccgcccagcccguccucgccgucgccggcggcgucacccagcuccccaaccacgucgucaacgucguccccgcccccuccgccaacucccccgucaacggcaagcucuccgucaccaagcccguccuccaguccaccaugcgcaacgucggcuccgacaucgccguccuccgccgccagcagcgcaugaucaagaaccgcgaguccgccugccagucccgcaagaagaagaaggaguacaugcucggccucgaggcccgccucaaggccgcccucuccgagaacgagcagcucaagaaggagaacggcacccucaagcgccagcucgacgaggucgucuccgagaaccagcgccucaagguccccucccccaagcgccgcgucgucugcgucaugaucguccucgccuucaucauccucaacuacggccccauguccaugcucgagcaggacucccgccgcaugaaccccuccgucucccccgccaaccagcgccgccaccuccucggcuucuccgccaaggaggcccaggacaccuccgacggcaucauccagaagaacuccuaccgcuacgaccacuccgucuccaacgacaaggcccucaugguccucaccgaggagccccuccucuacaucccccccccccccugccagccccucaucaacaccaccgagucccuccgccucaaccacgagcuccgcggcuggguccaccgccacgaggucgagcgcaccaagucccgccgcaugaccaacaaccagcagaagacccgcauccuccagggcgcccucgagcagggcuccaacucccagcucauggccguccaguacaccgagaccaccuccuccaucucccgcaacuccggcuccgagcuccaggucuacuacgccuccccccgcuccuaccaggacuucuucgaggccauccgccgccgcggcgacaccuucuacgucgucuccuuccgccgcgaccaccuccuccuccccgccaccacccacaacaagaccacccgccccaagauguccaucguccuccccgccaucaacaucaacgagaacgucaucaacggccaggacuacgaggucaugaugcagaucgacugccaggucauggacacccgcauccuccacaucaaguccuccuccgucccccccuaccuccgcgaccagcagcgcaaccagaccaacaccuucuucggcuccccccccgccgccaccgaggccacccacgucgucuccaccauccccgagucccuccaguga

SEQ ID NO: 40054 - RNA, 1389 nt, Artificial Sequence
  derived and/or modified sequence opt2 from ATF7__Homo_sapiens__NP_001123532
augggcgacgaccgccccuucgucugcaacgcccccggcugcggccagcgcuucaccaacgaggaccaccucgccguccacaagcacaagcacgagaugacccucaaguucggccccgcccgcaccgacuccgucaucaucgccgaccagacccccacccccacccgcuuccucaagaacugcgaggaggucggccucuucaacgagcucgccuccuccuucgagcacgaguucaagaaggccgccgacgaggacgagaagaaggccgccgccggcccccucgacaugucccuccccuccacccccgacaucaagaucaaggaggaggagcccgucgaggaggucacccccaagcccguccucaucuccacccccacccccaccaucguccgccccggcucccucccccuccaccucggcuacgacccccuccaccccacccuccccucccccaccuccgucaucacccaggccccccccuccaaccgccagaugggcucccccaccggcucccucccccucgucaugcaccucgccaacggccagaccaugcccguccuccccggcccccccguccagaugcccuccgucaucucccucgcccgccccgucuccaugguccccaacauccccggcauccccggcccccccgucaacuccuccggcuccaucucccccuccggccaccccauccccuccgaggccaagaugcgccucaaggccacccucacccaccaggucuccuccaucaacggcggcugcggcauggucgucggcaccgccuccaccauggucaccgcccgccccgagcagucccagauccucauccagcaccccgacgcccccucccccgcccagccccaggucucccccgcccagcccacccccuccaccggcggccgccgccgccgcaccgucgacgaggaccccgacgagcgccgccagcgcuuccucgagcgcaaccgcgccgccgccucccgcugccgccagaagcgcaagcucugggucuccucccucgagaagaaggccgaggagcucaccucccagaacauccagcucuccaacgaggucacccuccuccgcaacgaggucgcccagcucaagcagcuccuccucgcccacaaggacugccccgucaccgcccuccagaagaagacccagggcuaccucgagucccccaaggaguccuccgagcccaccggcucccccgcccccgucauccagcacuccuccgccaccgcccccuccaacggccucuccguccgcuccgccgccgaggccgucgccaccuccguccucacccagauggccucccagcgcaccgagcucuccaugcccauccagucccacgucaucaugaccccccagucccaguccgccggccgcuga

SEQ ID NO: 40055 - RNA, 3318 nt, Artificial Sequence
  derived and/or modified sequence opt2 from ATF7IP__Homo_sapiens__NP_001273444
auggacucccucgaggagccccagaagaaggucuucaaggcccgcaagaccaugcgcgucuccgaccgccagcagcucgaggccgucuacaaggucaaggaggagcuccucaagaccgacgucaagcuccucaacggcaaccacgagaacggcgaccucgaccccaccuccccccucgagaacauggacuacaucaaggacaaggaggaggucaacggcaucgaggagaucugcuucgaccccgagggcuccaaggccgaguggaaggagacccccugcauccucuccgucaacgucaagaacaagcaggacgacgaccucaacugcgagccccucuccccccacaacaucacccccgagcccgucuccaagcuccccgccgagcccgucuccggcgaccccgcccccggcgaccucgacgccggcgaccccgccuccggcguccucgccuccggcgacuccaccuccggcgaccccaccuccuccgagcccuccuccuccgacgccgccuccggcgacgccaccuccggcgacgcccccuccggcgacgucucccccggcgacgccaccuccggcgacgccaccgccgacgaccucuccuccggcgaccccaccuccuccgaccccauccccggcgagcccguccccgucgagcccaucuccggcgacugcgccgccgacgacaucgccuccuccgagaucaccuccgucgaccucgccuccggcgcccccgccuccaccgaccccgccuccgacgaccucgccuccggcgaccucuccuccuccgagcucgccuccgacgaccucgccaccggcgagcucgccuccgacgagcucaccuccgaguccaccuucgaccgcaccuucgagcccaaguccguccccgucugcgagcccguccccgagaucgacaacaucgagcccuccuccaacaaggacgacgacuuccucgagaagaacggcgccgacgagaagcucgagcagauccaguccaaggacucccucgacgagaagaacaaggccgacaacaacaucgacgccaacgaggagacccucgagaccgacgacaccaccaucugcuccgaccgcccccccgagaacgagaagaaggucgaggaggacaucaucaccgagcucgcccucggcgaggacgccaucuccuccuccauggagaucgaccagggcgagaagaacgaggacgagaccuccgccgaccucgucgagaccaucaacgagaacgucaucgaggacaacaaguccgagaacauccucgagaacaccgacuccauggagaccgacgagaucauccccauccucgagaagcucgcccccuccgaggacgagcucaccugcuucuccaagaccucccuccuccccaucgacgagaccaaccccgaccucgaggagaagauggaguccuccuucggcucccccuccaagcaggaguccuccgagucccuccccaaggaggccuuccucguccucuccgacgaggaggacaucuccggcgagaaggacgaguccgaggucaucucccagaacgagaccugcucccccgaggucgaguccaacgagaaggacaacaagcccgaggaggaggagcaggucauccacgaggacgacgagcgccccuccgagaagaacgaguucucccgccgcaagcgcuccaaguccgaggacauggacaacguccaguccaagcgccgccgcuacauggaggaggaguacgaggccgaguuccaggucaagaucaccgccaagggcgacaucaaccagaagcuccagaaggucauccaguggcuccucgaggagaagcucugcgcccuccagugcgccgucuucgacaagacccucgccgagcucaagacccgcgucgagaagaucgagugcaacaagcgccacaagaccguccucaccgagcuccaggccaagaucgcccgccucaccaagcgcuucgaggccgccaaggaggaccucaagaagcgccacgagcacccccccaacccccccgucucccccggcaagaccgucaacgacgucaacuccaacaacaacauguccuaccgcaacgccggcaccguccgccagaugcucgaguccaagcgcaacgucuccgaguccgccccccccuccuuccagacccccgucaacaccgucuccuccaccaaccucgucaccccccccgccgucgucuccucccagcccaagcuccagacccccgucaccuccggcucccucaccgccaccuccguccuccccgcccccaacaccgccaccgucgucgccaccacccagguccccuccggcaacccccagcccaccaucucccuccagccccuccccgucauccuccacguccccgucgccgucuccucccagccccagcuccuccagucccaccccggcacccucgucaccaaccagcccuccggcaacgucgaguucaucuccguccaguccccccccaccgucuccggccucaccaagaaccccgucucccuccccucccuccccaaccccaccaagcccaacaacguccccuccguccccucccccuccauccagcgcaaccccaccgccuccgccgccccccucggcaccacccucgccguccaggccguccccaccgcccacuccaucguccaggccacccgcaccucccuccccaccgucggccccuccggccucuacucccccuccaccaaccgcggccccauccagaugaagauccccaucuccgccuucuccaccuccuccgccgccgagcagaacuccaacaccaccccccgcaucgagaaccagaccaacaagaccaucgacgccuccgucuccaagaaggccgccgacuccaccucccagugcggcaaggccaccggcuccgacuccuccggcgucaucgaccucaccauggacgacgaggaguccggcgccucccaggaccccaagaagcucaaccacacccccgucuccaccauguccuccucccagcccgucucccgcccccuccagcccauccagcccgcccccccccuccagcccuccggcguccccaccuccggccccucccagaccaccauccaccuccuccccaccgcccccaccaccgucaacgucacccaccgccccgucacccaggucaccacccgccuccccgucccccgcgcccccgccaaccaccaggucgucuacaccacccuccccgccccccccgcccaggccccccuccgcggcaccgucaugcaggcccccgccguccgccaggucaacccccagaacuccaagcgcuucuuccucuacauggccccccgcuacauguga

SEQ ID NO: 40056 - RNA, 663 nt, Artificial Sequence
  derived and/or modified sequence opt2 from ATG10__Homo_sapiens__XP_005248667
auggaggaggacgaguucaucggcgagaagaccuuccagcgcuacugcgccgaguucaucaagcacucccagcagaucggcgacuccugggaguggcgccccuccaaggacugcuccgacggcuacaugugcaagauccacuuccagaucaagaacggcuccgucaugucccaccucggcgccuccacccacggccagaccugccuccccauggaggaggccuucgagcucccccucgacgacugcgaggucaucgagaccgccgccgccuccgaggucaucaaguacgaguaccacguccucuacuccugcuccuaccagguccccguccucuacuuccgcgccuccuuccucgacggccgcccccucacccucaaggacaucugggagggcguccacgagugcuacaagaugcgccuccuccagggccccugggacaccaucacccagcaggagcaccccauccucggccagcccuucuucguccuccaccccugcaagaccaacgaguucaugacccccguccucaagaacucccagaagaucaacaagaacgucaacuacaucaccuccuggcucuccaucgucggccccgucgucggccucaaccucccccucuccuacgccaaggccaccucccaggacgagcgcaacguccccuga

SEQ ID NO: 40057 - RNA, 225 nt, Artificial Sequence
  derived and/or modified sequence opt2 from ATG12__Homo_sapiens__NP_001264712
auggccgaggagccccaguccguccuccagcuccccaccuccaucgccgccggcggcgagggccucaccgacgucucccccgagaccaccacccccgagccccccuccuccgccgccgucucccccggcaccgaggagcccgccggcgacaccaagaagaagaucuaccucugcgaguccguccucugcuccuucccccgcccccgcuccuggaacucccucuga

SEQ ID NO: 40058 - RNA, 1767 nt, Artificial Sequence
  derived and/or modified sequence opt2 from ATG16L1__Homo_sapiens__NP_060444
auguccuccggccuccgcgccgccgacuucccccgcuggaagcgccacaucuccgagcagcuccgccgccgcgaccgccuccagcgccaggccuucgaggagaucauccuccaguacaacaagcuccucgagaaguccgaccuccacuccguccucgcccagaagcuccaggccgagaagcacgacguccccaaccgccacgagaucucccccggccacgacggcaccuggaacgacaaccagcuccaggagauggcccagcuccgcaucaagcaccaggaggagcucaccgagcuccacaagaagcgcggcgagcucgcccagcucgucaucgaccucaacaaccagaugcagcgcaaggaccgcgagaugcagaugaacgaggccaagaucgccgagugccuccagaccaucuccgaccucgagaccgagugccucgaccuccgcaccaagcucugcgaccucgagcgcgccaaccagacccucaaggacgaguacgacgcccuccagaucaccuucaccgcccucgagggcaagcuccgcaagaccaccgaggagaaccaggagcucgucacccgcuggauggccgagaaggcccaggaggccaaccgccucaacgccgagaacgagaaggacucccgccgccgccaggcccgccuccagaaggagcucgccgaggccgccaaggagccccuccccgucgagcaggacgacgacaucgaggucaucgucgacgagaccuccgaccacaccgaggagaccucccccguccgcgccaucucccgcgccgccacccgccgcuccgucuccuccuuccccgucccccaggacaacgucgacacccaccccggcuccggcaaggagguccgcguccccgccaccgcccucugcgucuucgacgcccacgacggcgaggucaacgccguccaguucucccccggcucccgccuccucgccaccggcggcauggaccgccgcgucaagcucugggaggucuucggcgagaagugcgaguucaagggcucccucuccggcuccaacgccggcaucaccuccaucgaguucgacuccgccggcuccuaccuccucgccgccuccaacgacuucgccucccgcaucuggaccgucgacgacuaccgccuccgccacacccucaccggccacuccggcaagguccucuccgccaaguuccuccucgacaacgcccgcaucgucuccggcucccacgaccgcacccucaagcucugggaccuccgcuccaaggucugcaucaagaccgucuucgccggcuccuccugcaacgacaucgucugcaccgagcagugcgucauguccggccacuucgacaagaagauccgcuucugggacauccgcuccgaguccaucguccgcgagauggagcuccucggcaagaucaccgcccucgaccucaaccccgagcgcaccgagcuccucuccugcucccgcgacgaccuccucaaggucaucgaccuccgcaccaacgccaucaagcagaccuucuccgcccccggcuucaagugcggcuccgacuggacccgcgucgucuucucccccgacggcuccuacgucgccgccggcuccgccgagggcucccucuacaucugguccguccucaccggcaaggucgagaagguccucuccaagcagcacuccuccuccaucaacgccgucgccuggucccccuccggcucccacgucgucuccgucgacaagggcugcaaggccguccucugggcccaguacuga

SEQ ID NO: 40059 - RNA, 6237 nt, Artificial Sequence
  derived and/or modified sequence opt2 from ATG2B__Homo_sapiens__NP_060506
augcccuggcccuucuccgaguccaucaagaagcgcgccugccgcuaccuccuccagcgcuaccucggccacuuccuccaggagaagcucucccucgagcagcucucccucgaccucuaccagggcaccggcucccucgcccaggucccccucgacaaguggugccucaacgagauccucgaguccgccgacgccccccucgaggucaccgagggcuucauccaguccaucucccucuccguccccuggggcucccuccuccaggacaacugcgcccucgagguccgcggccucgagauggucuuccgcccccgcccccgccccgccaccggcuccgagcccauguacugguccuccuucaugaccuccuccaugcagcucgccaaggagugccucucccagaagcucaccgacgagcagggcgagggcucccagcccuucgagggccucgagaaguucgccgagaccaucgagaccguccuccgccgcgucaaggucaccuucaucgacaccguccuccgcaucgagcacguccccgagaacuccaagaccggcaccgcccucgagauccgcaucgagcgcaccgucuacugcgacgagaccgccgacgaguccuccggcaucaacguccaccagcccaccgccuucgcccacaagcuccuccagcucuccggcgucucccucuucugggacgaguucuccgccuccgccaaguccucccccgucugcuccaccgcccccgucgagaccgagcccaagcucucccccuccuggaaccccaagaucaucuacgagccccacccccagcucacccgcaaccuccccgagaucgcccccuccgaccccguccagaucggccgccucaucggccgccucgagcucucccucacccucaagcagaacgagguccuccccggcgccaagcucgacgucgacggccagaucgacuccauccaccuccuccucuccccccgccagguccaccuccuccucgacaugcucgccgccaucgccggccccgagaacuccuccaagaucggccucgccaacaaggaccgcaagaaccgccccaugcagcaggaggacgaguaccgcauccagauggagcucaaccgcuacuaccuccgcaaggacucccucuccgucggcgucuccuccgagcaguccuucuacgagaccgagaccgcccgcacccccuccucccgcgaggaggaggucuucuucuccauggccgacauggacaugucccacucccucuccucccuccccccccucggcgacccccccaacauggaccucgagcucucccucaccuccaccuacaccaacacccccgccggcuccccccucuccgccaccguccuccagcccaccuggggcgaguuccucgaccaccacaaggagcagcccguccgcggcuccaccuuccccuccaaccucguccaccccaccccccuccagaagaccucccuccccucccgcuccgucuccgucgacgagucccgccccgagcucaucuuccgccucgccgucggcaccuucuccaucuccguccuccacaucgacccccucuccccccccgagaccucccagaaccucaacccccucacccccauggccgucgccuucuucaccugcaucgagaagaucgaccccgcccgcuucuccaccgaggacuucaaguccuuccgcgccgucuucgccgaggccugcucccacgaccaccuccgcuucaucggcaccggcaucaaggucuccuacgagcagcgccagcgcuccgccucccgcuacuucuccaccgacauguccaucggccagauggaguuccucgagugccucuuccccaccgacuuccacuccguccccccccacuacaccgagcuccucaccuuccacuccaaggaggagaccggcucccacucccccgucugccuccagcuccacuacaagcacuccgagaaccgcggcccccagggcaaccaggcccgccucuccuccgucccccacaaggccgagcuccagaucaagcucaaccccgucugcugcgagcucgacaucuccaucgucgaccgccucaacucccuccuccagccccagaagcucgccaccgucgagaugauggccucccacauguacaccuccuacaacaagcacaucucccuccacaaggccuucaccgaggucuuccucgacgacucccacucccccgccaacugccgcaucuccguccaggucgccacccccgcccucaaccucuccguccgcuuccccauccccgaccuccgcuccgaccaggagcgcggccccugguucaagaagucccuccagaaggagauccucuaccucgccuucaccgaccucgaguucaagaccgaguucaucggcggcuccacccccgagcagaucaagcucgagcucaccuuccgcgagcucaucggcuccuuccaggaggagaagggcgaccccuccaucaaguucuuccacgucuccuccggcgucgacggcgacaccaccuccuccgacgacuucgacuggccccgcaucguccucaagaucaacccccccgccaugcacuccauccucgagcgcaucgccgccgaggaggaggaggagaacgacggccacuaccaggaggaggaggagggcggcgcccacucccucaaggacgucugcgaccuccgccgccccgcccccucccccuucuccucccgccgcgucauguucgagaacgagcagauggucaugcccggcgaccccgucgagaugaccgaguuccaggacaaggccaucuccaacucccacuacguccucgagcucacccuccccaacaucuacgucacccuccccaacaaguccuucuacgagaagcucuacaaccgcaucuucaacgaccuccuccucugggagcccaccgcccccucccccgucgagaccuucgagaacaucuccuacggcaucggccucuccgucgccucccagcucaucaacaccuucaacaaggacuccuucuccgccuucaaguccgccguccacuacgacgaggaguccggcuccgaggaggagacccuccaguacuucuccaccgucgaccccaacuaccgcucccgccgcaagaagaagcucgacucccagaacaagaacucccaguccuuccucuccguccuccucaacaucaaccacggccucaucgccgucuucaccgacgucaagcaggacaacggcgaccuccucgagaacaagcacggcgaguucuggcucgaguucaacuccggcucccucuucugcgucaccaaguacgagggcuucgacgacaagcacuacaucugccuccacuccuccuccuucucccucuaccacaagggcaucgucaacggcgucauccuccccaccgagacccgccuccccuccuccacccgcccccacuggcucgagcccaccaucuacuccuccgaggaggacggccucuccaagaccuccuccgacggcgucggcggcgacucccucaacaugcucuccgucgccgucaagauccucuccgacaaguccgaguccaacaccaaggaguuccucaucgccgucggccucaagggcgccacccuccagcaccgcaugcuccccuccggccucuccuggcacgagcagauccucuacuuccucaacaucgccgacgagcccguccucggcuacaacccccccaccuccuucaccaccuuccacguccaccucugguccugcgcccucgacuaccgcccccucuaccuccccauccgcucccuccucaccgucgagaccuucuccgucuccuccuccgucgcccucgacaaguccuccuccacccuccgcaucauccucgacgaggccgcccuccaccucuccgacaagugcaacaccgucaccaucaaccucucccgcgacuacguccgcgucauggacaugggccuccucgagcucaccaucaccgccgucaaguccgacuccgacggcgagcagaccgagccccgcuucgagcuccacugcuccuccgacgucguccacauccgcaccugcuccgacuccugcgccgcccucaugaaccucauccaguacaucgccuccuacggcgaccuccagacccccaacaaggccgacaugaagcccggcgccuuccagcgccgcuccaaggucgacuccuccggccgcuccuccucccgcggccccguccuccccgaggccgaccagcagaugcuccgcgaccucauguccgacgccauggaggagaucgacaugcagcagggcaccuccuccgucaagccccaggccaacggcguccucgacgagaagucccagauccaggagcccugcugcuccgaccucuuccucuuccccgacgaguccggcaacgucucccaggaguccggccccaccuacgccuccuucucccaccacuucaucuccgacgccaugaccggcguccccaccgagaacgacgacuucugcauccucuucgcccccaaggccgccaugcaggagaaggaggaggagcccgucaucaagaucauggucgacgacgccaucgucauccgcgacaacuacuucucccuccccgucaacaagaccgacaccuccaaggccccccuccacuuccccauccccgucauccgcuacgucgucaaggaggucucccucgucuggcaccucuacggcggcaaggacuucggcaccgucccccccaccucccccgccaaguccuacaucuccccccacuccucccccucccacacccccacccgccacggccgcaacaccgucugcggcggcaagggccgcaaccacgacuuccucauggagauccagcucuccaaggucaaguuccagcacgaggucuacccccccugcaagcccgacugcgacuccucccucuccgagcaccccgucucccgccaggucuucaucguccaggaccucgagauccgcgaccgccucgccaccucccagaugaacaaguuccucuaccucuacugcuccaaggagaugccccgcaaggcccacuccaacaugcucaccgucaaggcccuccacgucugccccgaguccggccgcuccccccaggagugcugccuccgcgucucccucaugccccuccgccucaacaucgaccaggacgcccucuucuuccucaaggacuucuucaccucccucuccgccgaggucgagcuccagaugacccccgaccccgaggucaagaagucccccggcgccgacgucaccugcucccucccccgccaccucuccaccuccaaggagcccaaccucgucaucuccuucuccggccccaagcagcccucccagaacgacuccgccaacuccgucgaggucgucaacggcauggaggagaagaacuucuccgccgaggaggccuccuuccgcgaccagcccgucuucuuccgcgaguuccgcuucaccuccgagguccccauccgccucgacuaccacggcaagcacgucuccauggaccagggcacccucgccggcauccucaucggccucgcccagcucaacugcuccgagcucaagcucaagcgccucuccuaccgccacggccuccucggcgucgacaagcucuucuccuacgccaucaccgaguggcucaacgacaucaagaagaaccagcuccccggcauccucggcggcgucggccccaugcacucccucguccagcucguccagggccucaaggaccucgucuggcuccccaucgagcaguaccgcaaggacggccgcaucguccgcggcuuccagcgcggcgccgccuccuucggcaccuccaccgccauggccgcccucgagcucaccaaccgcaugguccagaccauccaggccgccgccgagaccgccuacgacauggucucccccggcacccucuccaucgagcccaagaagaccaagcgcuucccccaccaccgccucgcccaccagcccgucgaccuccgcgagggcgucgccaaggccuacuccgucgucaaggagggcaucaccgacaccgcccagaccaucuacgagaccgccgcccgcgagcacgagucccgcggcgucaccggcgccgucggcgagguccuccgccagaucccccccgccgucgucaagccccucaucgucgccaccgaggccaccuccaacguccucggcggcaugcgcaaccagauccgccccgacguccgccaggacgagucccagaaguggcgccacggcgacgacuga

SEQ ID NO: 40060 - RNA, 945 nt, Artificial Sequence
  derived and/or modified sequence opt2 from ATG3__Homo_sapiens__NP_071933
augcagaacgucaucaacaccgucaagggcaaggcccucgaggucgccgaguaccucacccccguccucaaggaguccaaguucaaggagaccggcgucaucacccccgaggaguucgucgccgccggcgaccaccucguccaccacugccccaccuggcagugggccaccggcgaggagcucaaggucaaggccuaccuccccaccggcaagcaguuccucgucaccaagaacguccccugcuacaagcgcugcaagcagauggaguacuccgacgagcucgaggccaucaucgaggaggacgacggcgacggcggcugggucgacaccuaccacaacaccggcaucaccggcaucaccgaggccgucaaggagaucacccucgagaacaaggacaacauccgccuccaggacugcuccgcccucugcgaggaggaggaggacgaggacgagggcgaggccgccgacauggaggaguacgaggaguccggccuccucgagaccgacgaggccacccucgacacccgcaagaucgucgaggccugcaaggccaagaccgacgccggcggcgaggacgccauccuccagacccgcaccuacgaccucuacaucaccuacgacaaguacuaccagaccccccgccucuggcucuucggcuacgacgagcagcgccagccccucaccgucgagcacauguacgaggacaucucccaggaccacgucaagaagaccgucaccaucgagaaccacccccaccucccccccccccccaugugcuccguccaccccugccgccacgccgaggucaugaagaagaucaucgagaccgucgccgagggcggcggcgagcucggcguccacauguaccuccucaucuuccucaaguucguccaggccgucauccccaccaucgaguacgacuacacccgccacuucaccauguga

SEQ ID NO: 40061 - RNA, 1197 nt, Artificial Sequence
  derived and/or modified sequence opt2 from ATG4A__Homo_sapiens__NP_443168
auggaguccguccucuccaaguacgaggaccagaucaccaucuucaccgacuaccucgaggaguaccccgacaccgacgagcucgucuggauccucggcaagcagcaccuccucaagaccgagaaguccaagcuccucuccgacaucuccgcccgccucugguucaccuaccgccgcaaguucucccccaucggcggcaccggccccuccuccgacgccggcuggggcugcaugcuccgcugcggccagaugaugcucgcccaggcccucaucugccgccaccucggccgcgacugguccugggagaagcagaaggagcagcccaaggaguaccagcgcauccuccagugcuuccucgaccgcaaggacugcugcuacuccauccaccagauggcccagaugggcgucggcgagggcaaguccaucggcgagugguucggccccaacaccgucgcccagguccucaagaagcucgcccucuucgacgaguggaacucccucgccgucuacgucuccauggacaacaccgucgucaucgaggacaucaagaagaugugccgcguccucccccucuccgccgacaccgccggcgaccgcccccccgacucccucaccgccuccaaccaguccaagggcaccuccgccuacugcuccgccuggaagccccuccuccucaucgucccccuccgccucggcaucaaccagaucaaccccgucuacgucgacgccuucaaggagugcuucaagaugccccagucccucggcgcccucggcggcaagcccaacaacgccuacuacuucaucggcuuccucggcgacgagcucaucuuccucgacccccacaccacccagaccuucgucgacaccgaggagaacggcaccgucaacgaccagaccuuccacugccuccaguccccccagcgcaugaacauccucaaccucgaccccuccgucgcccucggcuucuucugcaaggaggagaaggacuucgacaacuggugcucccucguccagaaggagauccucaaggagaaccuccgcauguucgagcucguccagaagcaccccucccacuggccccccuucgucccccccgccaagcccgaggucaccaccaccggcgccgaguucaucgacuccaccgagcagcucgaggaguucgaccucgaggaggacuucgagauccucuccgucuga

SEQ ID NO: 40062 - RNA, 1182 nt, Artificial Sequence
  derived and/or modified sequence opt2 from ATG4B__Homo_sapiens__NP_037457
auggacgccgccacccucaccuacgacacccuccgcuucgccgaguucgaggacuuccccgagaccuccgagcccgucuggauccucggccgcaaguacuccaucuucaccgagaaggacgagauccucuccgacgucgccucccgccucugguucaccuaccgcaagaacuuccccgccaucggcggcaccggccccaccuccgacaccggcuggggcugcaugcuccgcugcggccagaugaucuucgcccaggcccucgucugccgccaccucggccgcgacuggcgcuggacccagcgcaagcgccagcccgacuccuacuucuccguccucaacgccuucaucgaccgcaaggacuccuacuacuccauccaccagaucgcccagaugggcgucggcgagggcaaguccaucggccagugguacggccccaacaccgucgcccagguccucaagaagcucgccgucuucgacaccugguccucccucgccguccacaucgccauggacaacaccgucgucauggaggagauccgccgccucugccgcaccuccguccccugcgccggcgccaccgccuuccccgccgacuccgaccgccacugcaacggcuuccccgccggcgccgaggucaccaaccgccccucccccuggcgcccccucguccuccucaucccccuccgccucggccucaccgacaucaacgaggccuacgucgagacccucaagcacugcuucaugaugccccagucccucggcgucaucggcggcaagcccaacuccgcccacuacuucaucggcuacgucggcgaggagcucaucuaccucgacccccacaccacccagcccgccgucgagcccaccgacggcugcuucauccccgacgaguccuuccacugccagcacccccccugccgcauguccaucgccgagcucgaccccuccaucgccgucggcuucuucugcaagaccgaggacgacuucaacgacuggugccagcaggucaagaagcucucccuccucggcggcgcccuccccauguucgagcucgucgagcuccagcccucccaccucgccugccccgacguccucaaccucucccucgacuccuccgacgucgagcgccucgagcgcuucuucgacuccgaggacgaggacuucgagauccucucccucuga

SEQ ID NO: 40063 - RNA, 1272 nt, Artificial Sequence
  derived and/or modified sequence opt2 from ATG4C__Homo_sapiens__XP_011540615
auggaggccaccggcaccgacgaggucgacaagcucaagaccaaguucaucuccgccuggaacaacaugaaguacuccuggguccucaagaccaagaccuacuucucccgcaacucccccguccuccuccucggcaagugcuaccacuucaaguacgaggacgaggacaagacccuccccgccgaguccggcugcaccaucgaggaccacgucaucgccggcaacgucgaggaguuccgcaaggacuucaucucccgcaucuggcucaccuaccgcgaggaguucccccagaucgagggcuccgcccucaccaccgacugcggcuggggcugcacccuccgcaccggccagaugcuccucgcccagggccucauccuccacuuccucggccgcgccuggaccuggcccgacgcccucaacaucgagaacuccgacuccgaguccuggaccucccacaccgucaagaaguucaccgccuccuucgaggccucccucuccggcgagcgcgaguucaagacccccaccaucucccucaaggagaccaucggcaaguacuccgacgaccacgagaugcgcaacgaggucuaccaccgcaagaucaucuccugguucggcgacuccccccucgcccucuucggccuccaccagcucaucgaguacggcaagaaguccggcaagaaggccggcgacugguacggccccgccgucgucgcccacauccuccgcaaggccgucgaggaggcccgccaccccgaccuccagggcaucaccaucuacgucgcccaggacugcaccgucuacaacuccgacgucaucgacaagcaguccgccuccaugaccuccgacaacgccgacgacaaggccgucaucauccucguccccguccgccucggcggcgagcgcaccaacaccgacuaccucgaguucgucaagggcauccucucccucgaguacugcgucggcaucaucggcggcaagcccaagcaguccuacuacuucgccggcuuccaggacgacucccucaucuacauggacccccacuacugccaguccuucgucgacgucuccaucaaggacuucccccucgagaccuuccacugccccucccccaagaagauguccuuccgcaagauggaccccuccugcaccaucggcuucuacugccgcaacguccaggacuucaagcgcgccuccgaggagaucaccaagaaccagaucaugaucaaggccgccaucaucaacauccacguccaggacuucauguggaccuga

SEQ ID NO: 40064 - RNA, 828 nt, Artificial Sequence
  derived and/or modified sequence opt2 from ATG5__Homo_sapiens__NP_001273035
augaccgacgacaaggacguccuccgcgacgucugguucggccgcauccccaccugcuucacccucuaccaggacgagaucaccgagcgcgaggccgagcccuacuaccuccuccucccccgcgucuccuaccucacccucgucaccgacaaggucaagaagcacuuccagaaggucaugcgccaggaggacaucuccgagaucugguucgaguacgagggcaccccccucaaguggcacuaccccaucggccuccucuucgaccuccucgccuccuccuccgcccuccccuggaacaucaccguccacuucaaguccuuccccgagaaggaccuccuccacugccccuccaaggacgccaucgaggcccacuucauguccugcaugaaggaggccgacgcccucaagcacaagucccaggucaucaacgagaugcagaagaaggaccacaagcagcucuggaugggccuccagaacgaccgcuucgaccaguucugggccaucaaccgcaagcucauggaguaccccgccgaggagaacggcuuccgcuacauccccuuccgcaucuaccagaccaccaccgagcgccccuucauccagaagcucuuccgccccgucgccgccgacggccagcuccacacccucggcgaccuccucaaggaggucugccccuccgccaucgaccccgaggacggcgagaagaagaaccaggucaugauccacggcaucgagcccaugcucgagaccccccuccaguggcucuccgagcaccucuccuaccccgacaacuuccuccacaucuccaucaucccccagcccaccgacuga

SEQ ID NO: 40065 - RNA, 2031 nt, Artificial Sequence
  derived and/or modified sequence opt2 from ATG7__Homo_sapiens__NP_001129503
auggccgccgccaccggcgaccccggccucuccaagcuccaguucgcccccuucuccuccgcccucgacgucggcuucuggcacgagcucacccagaagaagcucaacgaguaccgccucgacgaggcccccaaggacaucaagggcuacuacuacaacggcgacuccgccggccuccccgcccgccucacccucgaguucuccgccuucgacauguccgcccccacccccgcccgcugcugccccgccaucggcacccucuacaacaccaacacccucgaguccuucaagaccgccgacaagaagcuccuccucgagcaggccgccaacgagaucugggaguccaucaaguccggcaccgcccucgagaaccccguccuccucaacaaguuccuccuccucaccuucgccgaccucaagaaguaccacuucuacuacugguucugcuaccccgcccucugccuccccgagucccucccccucauccagggccccgucggccucgaccagcgcuucucccucaagcagaucgaggcccucgagugcgccuacgacaaccucugccagaccgagggcgucaccgcccuccccuacuuccucaucaaguacgacgagaacaugguccucgucucccuccucaagcacuacuccgacuucuuccagggccagcgcaccaagaucaccaucggcgucuacgaccccugcaaccucgcccaguaccccggcuggccccuccgcaacuuccucguccucgccgcccaccgcugguccuccuccuuccaguccgucgaggucgucugcuuccgcgaccgcaccaugcagggcgcccgcgacgucgcccacuccaucaucuucgaggucaagcuccccgagauggccuucucccccgacugccccaaggccgucggcugggagaagaaccagaagggcggcaugggcccccgcauggucaaccucuccgagugcauggaccccaagcgccucgccgaguccuccgucgaccucaaccucaagcucaugugcuggcgccucguccccacccucgaccucgacaaggucgucuccgucaagugccuccuccucggcgccggcacccucggcugcaacgucgcccgcacccucaugggcuggggcguccgccacaucaccuucgucgacaacgccaagaucuccuacuccaaccccguccgccagccccucuacgaguucgaggacugccucggcggcggcaagcccaaggcccucgccgccgccgaccgccuccagaagaucuuccccggcgucaacgcccgcggcuucaacauguccauccccaugcccggccaccccgucaacuucuccuccgucacccucgagcaggcccgccgcgacgucgagcagcucgagcagcucaucgagucccacgacgucgucuuccuccucauggacacccgcgagucccgcuggcuccccgccgucaucgccgccuccaagcgcaagcucgucaucaacgccgcccucggcuucgacaccuucgucgucaugcgccacggccucaagaagcccaagcagcagggcgccggcgaccucugccccaaccaccccgucgccuccgccgaccuccucggcuccucccucuucgccaacauccccggcuacaagcucggcugcuacuucugcaacgacgucgucgcccccggcgacuccacccgcgaccgcacccucgaccagcagugcaccgucucccgccccggccucgccgucaucgccggcgcccucgccgucgagcucauggucuccguccuccagcaccccgagggcggcuacgccaucgccuccuccuccgacgaccgcaugaacgagccccccaccucccucggccucgucccccaccagguccucgaccaguacgagcgcgagggcuucaacuuccucgccaaggucuucaacuccucccacuccuuccucgaggaccucaccggccucacccuccuccaccaggagacccaggccgccgagaucugggacauguccgacgacgagaccaucuga

SEQ ID NO: 40066 - RNA, 2520 nt, Artificial Sequence
  derived and/or modified sequence opt2 from ATG9A__Homo_sapiens__NP_001070666
auggcccaguucgacaccgaguaccagcgccucgaggccuccuacuccgacuccccccccggcgaggaggaccuccucguccacgucgccgagggcuccaagucccccuggcaccacaucgagaaccucgaccucuucuucucccgcgucuacaaccuccaccagaagaacggcuucaccugcaugcucaucggcgagaucuucgagcucaugcaguuccucuucgucgucgccuucaccaccuuccucgucuccugcgucgacuacgacauccucuucgccaacaagauggucaaccacucccuccaccccaccgagcccgucaaggucacccuccccgacgccuuccuccccgcccaggucugcuccgcccgcauccaggagaacggcucccucaucaccauccucgucaucgccggcgucuucuggauccaccgccucaucaaguucaucuacaacaucugcugcuacugggagauccacuccuucuaccuccacgcccuccgcauccccauguccgcccuccccuacugcaccuggcaggagguccaggcccgcaucguccagacccagaaggagcaccagaucugcauccacaagcgcgagcucaccgagcucgacaucuaccaccgcauccuccgcuuccagaacuacauggucgcccucgucaacaagucccuccucccccuccgcuuccgccuccccggccucggcgaggccgucuucuucacccgcggccucaaguacaacuucgagcucauccucuucuggggccccggcucccucuuccucaacgaguggucccucaaggccgaguacaagcgcggcggccagcgccucgagcucgcccagcgccucuccaaccgcauccucuggaucggcaucgccaacuuccuccucugcccccucauccucaucuggcagauccucuacgccuucuucuccuacgccgagguccucaagcgcgagcccggcgcccucggcgcccgcugcuggucccucuacggccgcugcuaccuccgccacuucaacgagcucgagcacgagcuccagucccgccucaaccgcggcuacaagcccgccuccaaguacaugaacugcuuccucuccccccuccucacccuccucgccaagaacggcgccuucuucgccggcuccauccucgccguccucaucgcccucaccaucuacgacgaggacguccucgccgucgagcacguccucaccaccgucacccuccucggcgucaccgucaccgucugccgcuccuucauccccgaccagcacauggucuucugccccgagcagcuccuccgcgucauccucgcccacauccacuacaugcccgaccacuggcagggcaacgcccaccgcucccagacccgcgacgaguucgcccagcucuuccaguacaaggccgucuucauccucgaggagcuccucucccccaucgucaccccccucauccucaucuucugccuccgcccccgcgcccucgagaucaucgacuucuuccgcaacuucaccgucgaggucgucggcgucggcgacaccugcuccuucgcccagauggacguccgccagcacggccacccccaguggcucuccgccggccagaccgaggccuccgucuaccagcaggccgaggacggcaagaccgagcucucccucaugcacuucgccaucaccaaccccggcuggcagcccccccgcgaguccaccgccuuccucggcuuccucaaggagcagguccagcgcgacggcgccgccgccucccucgcccagggcggccuccuccccgagaacgcccucuucaccuccauccagucccuccaguccgaguccgagccccucucccucaucgccaacgucgucgccggcuccuccugccgcggccccccccucccccgcgaccuccagggcucccgccaccgcgccgaggucgccuccgcccuccgcuccuucuccccccuccagcccggccaggcccccaccggccgcgcccacuccaccaugaccggcuccggcgucgacgcccgcaccgccuccuccggcuccuccgucugggagggccagcuccagucccucguccucuccgaguacgccuccaccgagaugucccuccacgcccucuacaugcaccagcuccacaagcagcaggcccaggccgagcccgagcgccacgucuggcaccgccgcgaguccgacgaguccggcgaguccgcccccgacgagggcggcgagggcgcccgcgccccccaguccaucccccgcuccgccuccuaccccugcgccgccccccgccccggcgcccccgagaccaccgcccuccacggcggcuuccagcgccgcuacggcggcaucaccgaccccggcaccgucccccgcguccccucccacuucucccgccucccccucggcggcugggccgaggacggccaguccgccucccgccaccccgagcccguccccgaggagggcuccgaggacgagcuccccccccagguccacaaggucuga

SEQ ID NO: 40067 - RNA, 1779 nt, Artificial Sequence
  derived and/or modified sequence opt2 from ATIC__Homo_sapiens__NP_004035
auggcccccggccagcucgcccucuucuccgucuccgacaagaccggccucgucgaguucgcccgcaaccucaccgcccucggccucaaccucgucgccuccggcggcaccgccaaggcccuccgcgacgccggccucgccguccgcgacgucuccgagcucaccggcuuccccgagaugcucggcggccgcgucaagacccuccaccccgccguccacgccggcauccucgcccgcaacauccccgaggacaacgccgacauggcccgccucgacuucaaccucauccgcgucgucgccugcaaccucuaccccuucgucaagaccgucgccucccccggcgucaccgucgaggaggccgucgagcagaucgacaucggcggcgucacccuccuccgcgccgccgccaagaaccacgcccgcgucaccgucgucugcgagcccgaggacuacgucgucgucuccaccgagaugcaguccuccgaguccaaggacaccucccucgagacccgccgccagcucgcccucaaggccuucacccacaccgcccaguacgacgaggccaucuccgacuacuuccgcaagcaguacuccaagggcgucucccagaugccccuccgcuacggcaugaacccccaccagacccccgcccagcucuacacccuccagcccaagcuccccaucaccguccucaacggcgcccccggcuucaucaaccucugcgacgcccucaacgccuggcagcucgucaaggagcucaaggaggcccucggcauccccgccgccgccuccuucaagcacgucucccccgccggcgccgccgucggcaucccccucuccgaggacgaggccaaggucugcauggucuacgaccucuacaagacccucacccccaucuccgccgccuacgcccgcgcccgcggcgccgaccgcauguccuccuucggcgacuucgucgcccucuccgacgucugcgacguccccaccgccaagaucaucucccgcgaggucuccgacggcaucaucgcccccggcuacgaggaggaggcccucaccauccucuccaagaagaagaacggcaacuacugcguccuccagauggaccaguccuacaagcccgacgagaacgagguccgcacccucuucggccuccaccucucccagaagcgcaacaacggcgucgucgacaagucccucuucuccaacgucgucaccaagaacaaggaccuccccgaguccgcccuccgcgaccucaucgucgccaccaucgccgucaaguacacccaguccaacuccgucugcuacgccaagaacggccaggucaucggcaucggcgccggccagcagucccgcauccacugcacccgccucgccggcgacaaggccaacuacugguggcuccgccaccacccccagguccucuccaugaaguucaagaccggcgucaagcgcgccgagaucuccaacgccaucgaccaguacgucaccggcaccaucggcgaggacgaggaccucaucaaguggaaggcccucuucgaggagguccccgagcuccucaccgaggccgagaagaaggagugggucgagaagcucaccgaggucuccaucuccuccgacgccuucuuccccuuccgcgacaacgucgaccgcgccaagcgcuccggcgucgccuacaucgccgcccccuccggcuccgccgccgacaaggucgucaucgaggccugcgacgagcucggcaucauccucgcccacaccaaccuccgccucuuccaccacuga

SEQ ID NO: 40068 - RNA, 1662 nt, Artificial Sequence
  derived and/or modified sequence opt2 from ATL1__Homo_sapiens__NP_001121185
auggccaagaaccgccgcgaccgcaacuccuggggcggcuucuccgagaagaccuacgagugguccuccgaggaggaggagcccgucaagaaggccggccccguccagguccucaucgucaaggacgaccacuccuucgagcucgacgagaccgcccucaaccgcauccuccucuccgaggccguccgcgacaaggaggucgucgccgucuccgucgccggcgccuuccgcaagggcaaguccuuccucauggacuucaugcuccgcuacauguacaaccaggaguccgucgacugggucggcgacuacaacgagccccucaccggcuucuccuggcgcggcggcuccgagcgcgagaccaccggcauccagaucugguccgagaucuuccucaucaacaagcccgacggcaagaaggucgccguccuccucauggacacccagggcaccuucgacucccaguccacccuccgcgacuccgccaccgucuucgcccucuccaccaugaucuccuccauccaggucuacaaccucucccagaacguccaggaggacgaccuccagcaccuccagcucuucaccgaguacggccgccucgccauggaggagaccuuccucaagcccuuccagucccucaucuuccucguccgcgacugguccuuccccuacgaguucuccuacggcgccgacggcggcgccaaguuccucgagaagcgccucaaggucuccggcaaccagcacgaggagcuccagaacguccgcaagcacauccacuccugcuucaccaacaucuccugcuuccuccucccccaccccggccucaaggucgccaccaaccccaacuucgacggcaagcucaaggagaucgacgacgaguucaucaagaaccucaagauccucauccccuggcuccucucccccgagucccucgacaucaaggagaucaacggcaacaagaucaccugccgcggccucgucgaguacuucaaggccuacaucaagaucuaccagggcgaggagcucccccaccccaaguccaugcuccaggccaccgccgaggccaacaaccucgccgccgucgccaccgccaaggacaccuacaacaagaagauggaggagaucugcggcggcgacaagcccuuccucgcccccaacgaccuccagaccaagcaccuccagcucaaggaggaguccgucaagcucuuccgcggcgucaagaagaugggcggcgaggaguucucccgccgcuaccuccagcagcucgaguccgagaucgacgagcucuacauccaguacaucaagcacaacgacuccaagaacaucuuccacgccgcccgcacccccgccacccucuucgucgucaucuucaucaccuacgucaucgccggcgucaccggcuucaucggccucgacaucaucgccucccucugcaacaugaucaugggccucacccucaucacccucugcaccugggccuacauccgcuacuccggcgaguaccgcgagcucggcgccgucaucgaccaggucgccgccgcccucugggaccaggcccucuacaagcucuacuccgccgccgccacccaccgccaccucuaccaccaggccuuccccacccccaaguccgaguccaccgagcaguccgagaagaagaagauguga

SEQ ID NO: 40069 - RNA, 1752 nt, Artificial Sequence
  derived and/or modified sequence opt2 from ATL2__Homo_sapiens__NP_001129145
auggccgagggcgacgaggccgcccgcggccagcagccccaccagggccucuggcgccgccgccgcaccuccgaccccuccgccgccgucaaccacgucuccuccaccaccucccucggcgagaacuacgaggacgacgaccucgucaacuccgacgaggucaugaagaagcccugccccguccagaucguccucgcccacgaggacgaccacaacuucgagcucgacgaggaggcccucgagcagauccuccuccaggagcacauccgcgaccucaacaucgucgucgucuccgucgccggcgccuuccgcaagggcaaguccuuccuccucgacuucaugcuccgcuacauguacaacaaggacucccaguccuggaucggcggcaacaacgagccccucaccggcuucaccuggcgcggcggcugcgagcgcgagaccaccggcauccaggucuggaacgaggucuucgucaucgaccgccccaacggcaccaaggucgccguccuccucauggacacccagggcgccuucgacucccaguccaccaucaaggacugcgccaccgucuucgcccucuccaccaugaccuccuccguccaggucuacaaccucucccagaacauccaggaggacgaccuccagcaccuccagcucuucaccgaguacggccgccucgccauggaggagaucuaccagaagcccuuccagacccucauguuccucauccgcgacugguccuaccccuacgagcacuccuacggccucgagggcggcaagcaguuccucgagaagcgccuccaggucaagcagaaccagcacgaggagcuccagaacguccgcaagcacauccacaacugcuucuccaaccucggcugcuuccuccucccccaccccggccucaaggucgccaccaaccccuccuucgacggccgccucaaggacaucgacgaggacuucaagcgcgagcuccgcaaccucgucccccuccuccucgcccccgagaaccucgucgagaaggagaucuccggcuccaaggucaccugccgcgaccucgucgaguacuucaaggccuacaucaagaucuaccagggcgaggagcucccccaccccaaguccaugcuccaggccaccgccgaggccaacaaccucgccgccgucgccggcgcccgcgacaccuacugcaaguccauggagcaggucugcggcggcgacaagcccuacaucgcccccuccgaccucgagcgcaagcaccucgaccucaaggaggucgccaucaagcaguuccgcuccgucaagaagaugggcggcgacgaguucugccgccgcuaccaggaccagcucgaggccgagaucgaggagaccuacgccaacuucaucaagcacaacgacggcaagaacaucuucuacgccgcccgcacccccgccacccucuucgccgucauguucgccauguacaucaucuccggccucaccggcuucaucggccucaacuccaucgccguccucugcaaccucgucaugggccucgcccucaucuuccucugcaccugggccuacgucaaguacuccggcgaguuccgcgagaucggcaccgucaucgaccagaucgccgagacccucugggagcagguccucaagccccucggcgacaaccucauggaggagaacauccgccaguccgucaccaacuccaucaaggccggccucaccgaccaggucucccaccacgcccgccucaagaccgacuga

SEQ ID NO: 40070 - RNA, 1572 nt, Artificial Sequence
  derived and/or modified sequence opt2 from ATL3__Homo_sapiens__NP_001276977
auggaguccuccaagcccggccccguccaggucguccucguccagaaggaccagcacuccuucgagcucgacgagaaggcccucgccuccauccuccuccaggaccacauccgcgaccucgacgucgucgucgucuccgucgccggcgccuuccgcaagggcaaguccuucauccucgacuucaugcuccgcuaccucuacucccagaaggaguccggccacuccaacuggcucggcgaccccgaggagccccucaccggcuucuccuggcgcggcggcuccgaccccgagaccaccggcauccagaucugguccgaggucuucaccgucgagaagcccggcggcaagaaggucgccgucguccucauggacacccagggcgccuucgacucccaguccaccgucaaggacugcgccaccaucuucgcccucuccaccaugaccuccuccguccagaucuacaaccucucccagaacauccaggaggacgaccuccagcagcuccagcucuucaccgaguacggccgccucgccauggacgagaucuuccagaagcccuuccagacccucauguuccucguccgcgacugguccuuccccuacgaguacuccuacggccuccagggcggcauggccuuccucgacaagcgccuccaggucaaggagcaccagcacgaggagauccagaacguccgcaaccacauccacuccugcuucuccgacgucaccugcuuccuccucccccaccccggccuccaggucgccaccucccccgacuucgacggcaagcucaaggacaucgccggcgaguucaaggagcagcuccaggcccucauccccuacguccucaaccccuccaagcucauggagaaggagaucaacggcuccaaggucaccugccgcggccuccucgaguacuucaaggccuacaucaagaucuaccagggcgaggaccucccccaccccaaguccaugcuccaggccaccgccgaggccaacaaccucgccgccgccgccuccgccaaggacaucuacuacaacaacauggaggaggucugcggcggcgagaagcccuaccucucccccgacauccucgaggagaagcacugcgaguucaagcagcucgcccucgaccacuucaagaagaccaagaagaugggcggcaaggacuucuccuuccgcuaccagcaggagcucgaggaggagaucaaggagcucuacgagaacuucugcaagcacaacggcuccaagaacgucuucuccaccuuccgcacccccgccguccucuucaccggcaucgucgcccucuacaucgccuccggccucaccggcuucaucggccucgaggucgucgcccagcucuucaacugcauggucggccuccuccucaucgcccuccucaccuggggcuacauccgcuacuccggccaguaccgcgagcucggcggcgccaucgacuucggcgccgccuacguccucgagcaggccuccucccacaucggcaacuccacccaggccaccguccgcgacgccgucgucggccgccccuccauggacaagaaggcccaguga

SEQ ID NO: 40071 - RNA, 9171 nt, Artificial Sequence
  derived and/or modified sequence opt2 from ATM__Homo_sapiens__XP_006718906
augucccucguccucaacgaccuccucaucugcugccgccagcucgagcacgaccgcgccaccgagcgcaagaaggaggucgagaaguucaagcgccucauccgcgaccccgagaccaucaagcaccucgaccgccacuccgacuccaagcagggcaaguaccucaacugggacgccgucuuccgcuuccuccagaaguacauccagaaggagaccgagugccuccgcaucgccaagcccaacgucuccgccuccacccaggccucccgccagaagaagaugcaggagaucuccucccucgucaaguacuucaucaagugcgccaaccgccgcgccccccgccucaagugccaggagcuccucaacuacaucauggacaccgucaaggacuccuccaacggcgccaucuacggcgccgacugcuccaacauccuccucaaggacauccucuccguccgcaaguacuggugcgagaucucccagcagcaguggcucgagcucuucuccgucuacuuccgccucuaccucaagcccucccaggacguccaccgcguccucgucgcccgcaucauccacgccgucaccaagggcugcugcucccagaccgacggccucaacuccaaguuccucgacuucuucuccaaggccauccagugcgcccgccaggagaaguccuccuccggccucaaccacauccucgccgcccucaccaucuuccucaagacccucgccgucaacuuccgcauccgcgucugcgagcucggcgacgagauccuccccacccuccucuacaucuggacccagcaccgccucaacgacucccucaaggaggucaucaucgagcucuuccagcuccagaucuacauccaccaccccaagggcgccaagacccaggagaagggcgccuacgaguccaccaaguggcgcuccauccucuacaaccucuacgaccuccucgucaacgagaucucccacaucggcucccgcggcaaguacuccuccggcuuccgcaacaucgccgucaaggagaaccucaucgagcucauggccgacaucugccaccaggucuucaacgaggacacccgcucccucgagaucucccaguccuacaccaccacccagcgcgaguccuccgacuacuccguccccugcaagcgcaagaagaucgagcucggcugggaggucaucaaggaccaccuccagaagucccagaacgacuucgaccucguccccuggcuccagaucgccacccagcucaucuccaaguaccccgccucccuccccaacugcgagcucuccccccuccucaugauccucucccagcuccucccccagcagcgccacggcgagcgcacccccuacguccuccgcugccucaccgaggucgcccucugccaggacaagcgcuccaaccucgaguccucccagaaguccgaccuccucaagcucuggaacaagaucuggugcaucaccuuccgcggcaucuccuccgagcagauccaggccgagaacuucggccuccucggcgccaucauccagggcucccucgucgaggucgaccgcgaguucuggaagcucuucaccggcuccgccugccgccccuccugccccgccgucugcugccucacccucgcccucaccaccuccaucguccccggcaccgucaagaugggcaucgagcagaacaugugcgaggucaaccgcuccuucucccucaaggaguccaucaugaaguggcuccucuucuaccagcucgagggcgaccucgagaacuccaccgaggucccccccauccuccacuccaacuucccccaccucguccucgagaagauccucgucucccucaccaugaagaacugcaaggccgccaugaacuucuuccaguccguccccgagugcgagcaccaccagaaggacaaggaggagcucuccuucuccgaggucgaggagcucuuccuccagaccaccuucgacaagauggacuuccucaccaucguccgcgagugcggcaucgagaagcaccaguccuccaucggcuucuccguccaccagaaccucaaggagucccucgaccgcugccuccucggccucuccgagcagcuccucaacaacuacuccuccgagaucaccaacuccgagacccucguccgcugcucccgccuccucgucggcguccucggcugcuacugcuacaugggcgucaucgccgaggaggaggccuacaaguccgagcucuuccagaaggccaagucccucaugcagugcgccggcgaguccaucacccucuucaagaacaagaccaacgaggaguuccgcaucggcucccuccgcaacaugaugcagcucugcacccgcugccucuccaacugcaccaagaagucccccaacaagaucgccuccggcuucuuccuccgccuccucaccuccaagcucaugaacgacaucgccgacaucugcaagucccucgccuccuucaucaagaagcccuucgaccgcggcgaggucgaguccauggaggacgacaccaacggcaaccucauggaggucgaggaccaguccuccaugaaccucuucaacgacuaccccgacuccuccgucuccgacgccaacgagcccggcgagucccaguccaccaucggcgccaucaacccccucgccgaggaguaccucuccaagcaggaccuccucuuccucgacaugcucaaguuccucugccucugcgucaccaccgcccagaccaacaccgucuccuuccgcgccgccgacauccgccgcaagcuccucaugcucaucgacuccuccacccucgagcccaccaagucccuccaccuccacauguaccucaugcuccucaaggagcuccccggcgaggaguacccccuccccauggaggacguccucgagcuccucaagccccucuccaacgucugcucccucuaccgccgcgaccaggacgucugcaagaccauccucaaccacguccuccacgucgucaagaaccucggccaguccaacauggacuccgagaacacccgcgacgcccagggccaguuccucaccgucaucggcgccuucuggcaccucaccaaggagcgcaaguacaucuucuccguccgcauggcccucgucaacugccucaagacccuccucgaggccgaccccuacuccaagugggccauccucaacgucaugggcaaggacuuccccgucaacgaggucuucacccaguuccucgccgacaaccaccaccagguccgcaugcucgccgccgaguccaucaaccgccucuuccaggacaccaagggcgacuccucccgccuccucaaggcccucccccucaagcuccagcagaccgccuucgagaacgccuaccucaaggcccaggagggcaugcgcgagaugucccacuccgccgagaaccccgagacccucgacgagaucuacaaccgcaaguccguccuccucacccucaucgccgucguccucuccugcucccccaucugcgagaagcaggcccucuucgcccucugcaaguccgucaaggagaacggccucgagccccaccucgucaagaagguccucgagaaggucuccgagaccuucggcuaccgccgccucgaggacuucauggccucccaccucgacuaccucguccucgaguggcucaaccuccaggacaccgaguacaaccucuccuccuuccccuucauccuccucaacuacaccaacaucgaggacuucuaccgcuccugcuacaagguccucaucccccaccucgucauccgcucccacuucgacgaggucaaguccaucgccaaccagauccaggaggacuggaagucccuccucaccgacugcuuccccaagauccucgucaacauccuccccuacuucgccuacgagggcacccgcgacuccggcauggcccagcagcgcgagaccgccaccaaggucuacgacaugcucaaguccgagaaccuccucggcaagcagaucgaccaccucuucaucuccaaccuccccgagaucgucgucgagcuccucaugacccuccacgagcccgccaacuccuccgccucccaguccaccgaccucugcgacuucuccggcgaccucgaccccgcccccaaccccccccacuuccccucccacgucaucaaggccaccuucgccuacaucuccaacugccacaagaccaagcucaaguccauccucgagauccucuccaagucccccgacuccuaccagaagauccuccucgccaucugcgagcaggccgccgagaccaacaacgucuacaagaagcaccgcauccucaagaucuaccaccucuucgucucccuccuccucaaggacaucaaguccggccucggcggcgccugggccuucguccuccgcgacgucaucuacacccucauccacuacaucaaccagcgccccuccugcaucauggacgucucccuccgcuccuucucccucugcugcgaccuccucucccaggucugccagaccgccgucaccuacugcaaggacgcccucgagaaccaccuccacgucaucgucggcacccucaucccccucgucuacgagcaggucgagguccagaagcagguccucgaccuccucaaguaccucgucaucgacaacaaggacaacgagaaccucuacaucaccaucaagcuccucgaccccuuccccgaccacgucgucuucaaggaccuccgcaucacccagcagaagaucaaguacucccgcggccccuucucccuccucgaggagaucaaccacuuccucuccgucuccgucuacgacgcccucccccucacccgccucgagggccucaaggaccuccgccgccagcucgagcuccacaaggaccagauggucgacaucaugcgcgccucccaggacaacccccaggacggcaucauggucaagcucgucgucaaccuccuccagcucuccaagauggccaucaaccacaccggcgagaaggagguccucgaggccgucggcuccugccucggcgaggucggccccaucgacuucuccaccaucgccauccagcacuccaaggacgccuccuacaccaaggcccucaagcucuucgaggacaaggagcuccaguggaccuucaucaugcucaccuaccucaacaacacccucgucgaggacugcgucaagguccgcuccgccgccgucaccugccucaagaacauccucgccaccaagaccggccacuccuucugggagaucuacaagaugaccaccgaccccaugcucgccuaccuccagcccuuccgcaccucccgcaagaaguuccucgaggucccccgcuucgacaaggagaaccccuucgagggccucgacgacaucaaccucuggaucccccucuccgagaaccacgacaucuggaucaagacccucaccugcgccuuccucgacuccggcggcaccaagugcgagauccuccagcuccucaagcccaugugcgaggucaagaccgacuucugccagaccguccuccccuaccucauccacgacauccuccuccaggacaccaacgaguccuggcgcaaccuccucuccacccacguccagggcuucuucaccuccugccuccgccacuucucccagaccucccgcuccaccacccccgccaaccucgacuccgaguccgagcacuucuuccgcugcugccucgacaagaagucccagcgcaccaugcucgccgucgucgacuacaugcgccgccagaagcgccccuccuccggcaccaucuucaacgacgccuucuggcucgaccucaacuaccucgaggucgccaaggucgcccaguccugcgccgcccacuucaccgcccuccucuacgccgagaucuacgccgacaagaaguccauggacgaccaggagaagcgcucccucgccuucgaggagggcucccaguccaccaccaucuccucccucuccgagaaguccaaggaggagaccggcaucucccuccaggaccuccuccucgagaucuaccgcuccaucggcgagcccgacucccucuacggcugcggcggcggcaagaugcuccagcccaucacccgccuccgcaccuacgagcacgaggccauguggggcaaggcccucgucaccuacgaccucgagaccgccauccccuccuccacccgccaggccggcaucauccaggcccuccagaaccucggccucugccacauccucuccgucuaccucaagggccucgacuacgagaacaaggacuggugccccgagcucgaggagcuccacuaccaggccgccuggcgcaacaugcagugggaccacugcaccuccgucuccaaggaggucgagggcaccuccuaccacgagucccucuacaacgcccuccagucccuccgcgaccgcgaguucuccaccuucuacgagucccucaaguacgcccgcgucaaggaggucgaggagaugugcaagcgcucccucgaguccgucuacucccucuaccccacccucucccgccuccaggccaucggcgagcucgaguccaucggcgagcucuucucccgcuccgucacccaccgccagcucuccgaggucuacaucaaguggcagaagcacucccagcuccucaaggacuccgacuucuccuuccaggagcccaucauggcccuccgcaccgucauccucgagauccucauggagaaggagauggacaacucccagcgcgagugcaucaaggacauccucaccaagcaccucgucgagcucuccauccucgcccgcaccuucaagaacacccagcuccccgagcgcgccaucuuccagaucaagcaguacaacuccgucuccugcggcgucuccgaguggcagcucgaggaggcccaggucuucugggccaagaaggagcagucccucgcccucuccauccucaagcagaugaucaagaagcucgacgccuccugcgccgccaacaaccccucccucaagcucaccuacaccgagugccuccgcgucugcggcaacuggcucgccgagaccugccucgagaaccccgccgucaucaugcagaccuaccucgagaaggccgucgaggucgccggcaacuacgacggcgaguccuccgacgagcuccgcaacggcaagaugaaggccuuccucucccucgcccgcuucuccgacacccaguaccagcgcaucgagaacuacaugaaguccuccgaguucgagaacaagcaggcccuccucaagcgcgccaaggaggaggucggccuccuccgcgagcacaagauccagaccaaccgcuacaccgucaagguccagcgcgagcucgagcucgacgagcucgcccuccgcgcccucaaggaggaccgcaagcgcuuccucugcaaggccgucgagaacuacaucaacugccuccucuccggcgaggagcacgacaugugggucuuccgccucugcucccucuggcucgagaacuccggcgucuccgaggucaacggcaugaugaagcgcgacggcaugaagauccccaccuacaaguuccucccccucauguaccagcucgccgcccgcaugggcaccaagaugaugggcggccucggcuuccacgagguccucaacaaccucaucucccgcaucuccauggaccacccccaccacacccucuucaucauccucgcccucgccaacgccaaccgcgacgaguuccucaccaagcccgaggucgcccgccgcucccgcaucaccaagaacguccccaagcaguccucccagcucgacgaggaccgcaccgaggccgccaaccgcaucaucugcaccauccgcucccgccgcccccagaugguccgcuccgucgaggcccucugcgacgccuacaucauccucgccaaccucgacgccacccaguggaagacccagcgcaagggcaucaacauccccgccgaccagcccaucaccaagcucaagaaccucgaggacgucgucguccccaccauggagaucaaggucgaccacaccggcgaguacggcaaccucgucaccauccaguccuucaaggccgaguuccgccucgccggcggcgucaaccuccccaagaucaucgacugcgucggcuccgacggcaaggagcgccgccagcucgucaagggccgcgacgaccuccgccaggacgccgucaugcagcaggucuuccagaugugcaacacccuccuccagcgcaacaccgagacccgcaagcgcaagcucaccaucugcaccuacaaggucgucccccucucccagcgcuccggcguccucgaguggugcaccggcaccguccccaucggcgaguuccucgucaacaacgaggacggcgcccacaagcgcuaccgccccaacgacuucuccgccuuccagugccagaagaagaugauggagguccagaagaaguccuucgaggagaaguacgaggucuucauggacgucugccagaacuuccagcccgucuuccgcuacuucugcauggagaaguuccucgaccccgccaucugguucgagaagcgccucgccuacacccgcuccgucgccaccuccuccaucgucggcuacauccucggccucggcgaccgccacguccagaacauccucaucaacgagcaguccgccgagcucguccacaucgaccucggcgucgccuucgagcagggcaagauccuccccacccccgagaccguccccuuccgccucacccgcgacaucgucgacggcaugggcaucaccggcgucgagggcgucuuccgccgcugcugcgagaagaccauggaggucaugcgcaacucccaggagacccuccucaccaucgucgagguccuccucuacgacccccucuucgacuggaccaugaacccccucaaggcccucuaccuccagcagcgccccgaggacgagaccgagcuccaccccacccucaacgccgacgaccaggagugcaagcgcaaccucuccgacaucgaccaguccuucaacaaggucgccgagcgcguccucaugcgccuccaggagaagcucaagggcgucgaggagggcaccguccucuccgucggcggccaggucaaccuccucauccagcaggccaucgaccccaagaaccucucccgccucuuccccggcuggaaggccugggucuga

SEQ ID NO: 40072 - RNA, 3573 nt, Artificial Sequence
  derived and/or modified sequence opt2 from ATN1__Homo_sapiens__NP_001007027
augaagacccgccagaacaaggacuccauguccaugcgcuccggccgcaagaaggaggcccccggcccccgcgaggagcuccgcucccgcggccgcgccucccccggcggcgucuccaccuccuccuccgacggcaaggccgagaagucccgccagaccgccaagaaggcccgcgucgaggaggccuccacccccaaggucaacaagcagggccgcuccgaggagaucuccgaguccgaguccgaggagaccaacgcccccaagaagaccaagaccgagcaggagcucccccgcccccagucccccuccgaccucgacucccucgacggccgcucccucaacgacgacggcuccuccgacccccgcgacaucgaccaggacaaccgcuccaccucccccuccaucuacucccccggcuccgucgagaacgacuccgacuccuccuccggccucucccagggccccgcccgccccuaccacccccccccccucuucccccccuccccccagccccccgacuccaccccccgccagcccgaggccuccuucgagccccaccccuccgucacccccaccggcuaccacgcccccauggagccccccaccucccgcauguuccaggccccccccggcgccccccccccccacccccagcucuaccccggcggcaccggcggcguccucuccggcccccccaugggccccaagggcggcggcgccgccuccuccgucggcggccccaacggcggcaagcagcaccccccccccaccacccccaucuccgucuccuccuccggcgccuccggcgccccccccaccaagccccccaccacccccgucggcggcggcaaccuccccuccgcccccccccccgccaacuucccccacgucacccccaaccucccccccccccccgcccuccgcccccucaacaacgccuccgccuccccccccggccucggcgcccagccccuccccggccaccuccccuccccccacgccaugggccagggcaugggcggccucccccccggccccgagaagggccccacccucgcccccuccccccacucccucccccccgccuccuccuccgcccccgccccccccaugcgcuuccccuacuccuccuccuccuccuccuccgccgccgccuccuccuccuccuccuccuccuccuccuccgccucccccuuccccgccucccaggcccuccccuccuacccccacuccuuccccccccccaccucccucuccgucuccaaccagccccccaaguacacccagcccucccuccccucccaggccgucuggucccagggcccccccccccccccccccuacggccgccuccucgccaacuccaacgcccaccccggccccuucccccccuccaccggcgcccaguccaccgcccacccccccgucuccacccaccaccaccaccaccagcagcagcagcagcagcagcagcagcagcagcagcagcagcagcagcagcagcagcaccacggcaacuccggcccccccccccccggcgccuucccccacccccucgagggcggcuccucccaccacgcccaccccuacgccaugucccccucccucggcucccuccgccccuacccccccggccccgcccaccucccccccccccacucccaggucuccuacucccaggccggccccaacggcccccccgucuccuccuccuccaacuccuccuccuccaccucccagggcuccuaccccugcucccaccccucccccucccagggcccccagggcgcccccuaccccuucccccccguccccaccgucaccaccuccuccgccacccucuccaccgucaucgccaccgucgccuccucccccgccggcuacaagaccgccuccccccccggccccccccccuacggcaagcgcgcccccucccccggcgccuacaagaccgccaccccccccggcuacaagcccggcuccccccccuccuuccgcaccggcaccccccccggcuaccgcggcaccuccccccccgccggccccggcaccuucaagcccggcucccccaccgucggccccggcccccucccccccgccggccccuccggccuccccucccucccccccccccccgccgcccccgccuccggccccccccucuccgccacccagaucaagcaggagcccgccgaggaguacgagacccccgagucccccgucccccccgcccgcucccccucccccccccccaaggucgucgacguccccucccacgccucccaguccgcccgcuucaacaagcaccucgaccgcggcuucaacuccugcgcccgcuccgaccucuacuucgucccccucgagggcuccaagcucgccaagaagcgcgccgaccucgucgagaagguccgccgcgaggccgagcagcgcgcccgcgaggagaaggagcgcgagcgcgagcgcgagcgcgagaaggagcgcgagcgcgagaaggagcgcgagcucgagcgcuccgucaagcucgcccaggagggccgcgcccccgucgagugccccucccucggccccgucccccaccgcccccccuucgagcccggcuccgccgucgccaccgucccccccuaccucggccccgacacccccgcccuccgcacccucuccgaguacgcccgcccccacgucaugucccccggcaaccgcaaccaccccuucuacgucccccucggcgccgucgaccccggccuccucggcuacaacguccccgcccucuacuccuccgaccccgccgcccgcgagcgcgagcgcgaggcccgcgagcgcgaccuccgcgaccgccucaagcccggcuucgaggucaagcccuccgagcucgagccccuccacggcguccccggccccggccucgaccccuucccccgccacggcggccucgcccuccagcccggcccccccggccuccaccccuuccccuuccaccccucccucggcccccucgagcgcgagcgccucgcccucgccgccggccccgcccuccgccccgacauguccuacgccgagcgccucgccgccgagcgccagcacgccgagcgcgucgccgcccucggcaacgacccccucgcccgccuccagaugcucaacgucaccccccaccaccaccagcacucccacauccacucccaccuccaccuccaccagcaggacgccauccacgccgccuccgccuccguccacccccucaucgacccccucgccuccggcucccaccucacccgcauccccuaccccgccggcacccuccccaacccccuccucccccacccccuccacgagaacgagguccuccgccaccagcucuucgccgcccccuaccgcgaccuccccgccucccucuccgcccccauguccgccgcccaccagcuccaggccaugcacgcccaguccgccgagcuccagcgccucgcccucgagcagcagcaguggcuccacgcccaccacccccuccacuccgucccccuccccgcccaggaggacuacuacucccaccucaagaaggaguccgacaagccccucuga

SEQ ID NO: 40073 - RNA, 1065 nt, Artificial Sequence
  derived and/or modified sequence opt2 from ATOH1__Homo_sapiens__NP_005163
augucccgccuccuccacgccgaggagugggccgaggucaaggagcucggcgaccaccaccgccagccccagccccaccaccucccccagccccccccccccccccagccccccgccacccuccaggcccgcgagcaccccgucuacccccccgagcucucccuccucgacuccaccgacccccgcgccuggcucgcccccacccuccagggcaucugcaccgcccgcgccgcccaguaccuccuccacucccccgagcucggcgccuccgaggccgccgccccccgcgacgaggucgacggccgcggcgagcucguccgccgcuccuccggcggcgccuccuccuccaagucccccggccccgucaagguccgcgagcagcucugcaagcucaagggcggcgucgucgucgacgagcucggcugcucccgccagcgcgcccccuccuccaagcaggucaacggcguccagaagcagcgccgccucgccgccaacgcccgcgagcgccgccgcaugcacggccucaaccacgccuucgaccagcuccgcaacgucauccccuccuucaacaacgacaagaagcucuccaaguacgagacccuccagauggcccagaucuacaucaacgcccucuccgagcuccuccagacccccuccggcggcgagcagcccccccccccccccgccuccugcaaguccgaccaccaccaccuccgcaccgccgccuccuacgagggcggcgccggcaacgccaccgccgccggcgcccagcaggccuccggcggcucccagcgccccaccccccccggcuccugccgcacccgcuucuccgcccccgccuccgccggcggcuacuccguccagcucgacgcccuccacuucuccaccuucgaggacuccgcccucaccgccaugauggcccagaagaaccucucccccucccuccccggcuccauccuccagcccguccaggaggagaacuccaagaccuccccccgcucccaccgcuccgacggcgaguucuccccccacucccacuacuccgacuccgacgaggccuccuga

SEQ ID NO: 40074 - RNA, 459 nt, Artificial Sequence
  derived and/or modified sequence opt2 from ATOH7__Homo_sapiens__NP_660161
augaaguccugcaagcccuccggcccccccgccggcgcccgcgucgccccccccugcgccggcggcaccgagugcgccggcaccugcgccggcgccggccgccucgaguccgccgcccgccgccgccucgccgccaacgcccgcgagcgccgccgcaugcagggccucaacaccgccuucgaccgccuccgccgcgucgucccccaguggggccaggacaagaagcucuccaaguacgagacccuccagauggcccucuccuacaucauggcccucacccgcauccucgccgaggccgagcgcuucggcuccgagcgcgacugggucggccuccacugcgagcacuucggccgcgaccacuaccuccccuuccccggcgccaagcuccccggcgaguccgagcucuacucccagcgccucuucggcuuccagcccgagcccuuccagauggccaccuga

SEQ ID NO: 40075 - RNA, 207 nt, Artificial Sequence
  derived and/or modified sequence opt2 from ATOX1__Homo_sapiens__NP_004036
augcccaagcacgaguucuccgucgacaugaccugcggcggcugcgccgaggccgucucccgcguccucaacaagcucggcggcgucaaguacgacaucgaccuccccaacaagaaggucugcaucgaguccgagcacuccauggacacccuccucgccacccucaagaagaccggcaagaccgucuccuaccucggccucgaguga

SEQ ID NO: 40076 - RNA, 4500 nt, Artificial Sequence
  derived and/or modified sequence opt2 from ATP10A__Homo_sapiens__NP_077816
auggagcgcgagcccgccggcaccgaggagcccggcccccccggccgccgccgccgccgcgagggccgcacccgcaccguccgcuccaaccuccuccccccccccggcgccgaggaccccgccgccggcgccgccaagggcgagcgccgccgccgccgcggcugcgcccagcaccucgccgacaaccgccucaagaccaccaaguacacccuccucuccuuccuccccaagaaccucuucgagcaguuccaccgccccgccaacgucuacuucgucuucaucgcccuccucaacuucguccccgccgucaacgccuuccagcccggccucgcccucgcccccguccucuucauccucgccaucaccgccuuccgcgaccucugggaggacuacucccgccaccgcuccgaccacaagaucaaccaccucggcugccucgucuucucccgcgaggagaagaaguacgucaaccgcuucuggaaggagauccacgucggcgacuucguccgccuccgcugcaacgagaucuuccccgccgacauccuccuccucuccuccuccgaccccgacggccucugccacaucgagaccgccaaccucgacggcgagaccaaccucaagcgccgccaggucguccgcggcuucuccgagcucgucuccgaguucaacccccucaccuucaccuccgucaucgagugcgagaagcccaacaacgaccucucccgcuuccgcggcugcaucauccacgacaacggcaagaaggccggccucuacaaggagaaccuccuccuccgcggcugcacccuccgcaacaccgacgccgucgucggcaucgucaucuacgccggccacgagaccaaggcccuccucaacaacuccggcccccgcuacaagcgcuccaagcucgagcgccagaugaacugcgacguccucuggugcguccuccuccucgucugcaugucccucuucuccgccgucggccacggccucuggaucuggcgcuaccaggagaagaagucccucuucuacguccccaaguccgacggcuccucccucucccccgucaccgccgccgucuacuccuuccucaccaugaucaucguccuccagguccucauccccaucucccucuacgucuccaucgagaucgucaaggccugccaggucuacuucaucaaccaggacaugcagcucuacgacgaggagaccgacucccagcuccagugccgcgcccucaacaucaccgaggaccucggccagauccaguacaucuucuccgacaagaccggcacccucaccgagaacaagauggucuuccgccgcugcaccgucuccggcgucgaguacucccacgacgccaacgcccagcgccucgcccgcuaccaggaggccgacuccgaggaggaggaggucgucccccgcggcggcuccgucucccagcgcggcuccaucggcucccaccaguccguccgcgucguccaccgcacccaguccaccaagucccaccgccgcaccggcucccgcgccgaggccaagcgcgccuccaugcucuccaagcacaccgccuucuccucccccauggagaaggacaucacccccgaccccaagcuccucgagaaggucuccgagugcgacaagucccucgccgucgcccgccaccaggagcaccuccucgcccaccucucccccgagcucuccgacgucuucgacuucuucaucgcccucaccaucugcaacaccgucgucgucaccucccccgaccagccccgcaccaagguccgcguccgcuucgagcucaagucccccgucaagaccaucgaggacuuccuccgccgcuucacccccuccugccucaccuccggcugcuccuccaucggcucccucgccgccaacaaguccucccacaagcucggcuccuccuuccccuccacccccuccuccgacggcaugcuccuccgccucgaggagcgccucggccagcccaccuccgccaucgccuccaacggcuacuccucccaggccgacaacugggccuccgagcucgcccaggagcaggaguccgagcgcgagcuccgcuacgaggccgagucccccgacgaggccgcccucgucuacgccgcccgcgccuacaacugcguccucgucgagcgccuccacgaccaggucuccgucgagcucccccaccucggccgccucaccuucgagcuccuccacacccucggcuucgacuccguccgcaagcgcauguccgucgucauccgccacccccucaccgacgagaucaacgucuacaccaagggcgccgacuccgucgucauggaccuccuccagcccugcuccuccgucgacgcccgcggccgccaccagaagaagauccgcuccaagacccagaacuaccucaacgucuacgccgccgagggccuccgcacccucugcaucgccaagcgcguccucuccaaggaggaguacgccugcuggcuccagucccaccucgaggccgaguccucccucgagaacuccgaggagcuccucuuccaguccgccauccgccucgagaccaaccuccaccuccucggcgccaccggcaucgaggaccgccuccaggacggcguccccgagaccaucuccaagcuccgccaggccggccuccagaucuggguccucaccggcgacaagcaggagaccgccgucaacaucgccuacgccugcaagcuccucgaccacgacgaggaggucaucacccucaacgccaccucccaggaggccugcgccgcccuccucgaccagugccucugcuacguccagucccgcggccuccagcgcgcccccgagaagaccaagggcaaggucuccaugcgcuucuccucccucugcccccccuccaccuccaccgccuccggccgccgccccucccucgucaucgacggccgcucccucgccuacgcccucgagaagaaccucgaggacaaguuccucuuccucgccaagcagugccgcuccguccucugcugccgcuccaccccccuccagaaguccauggucgucaagcucguccgcuccaagcucaaggccaugacccucgccaucggcgacggcgccaacgacgucuccaugauccaggucgccgacgucggcgucggcaucuccggccaggagggcaugcaggccgucauggccuccgacuucgccguccccaaguuccgcuaccucgagcgccuccucauccuccacggccacuggugcuacucccgccucgccaacaugguccucuacuucuucuacaagaacaccauguucgucggccuccucuucugguuccaguucuucugcggcuucuccgccuccaccaugaucgaccagugguaccucaucuucuucaaccuccucuucuccucccuccccccccucgucaccggcguccucgaccgcgacguccccgccaacguccuccucaccaacccccagcucuacaaguccggccagaacauggaggaguaccgcccccgcaccuucugguucaacauggccgacgccgccuuccagucccucgucugcuucuccauccccuaccucgccuacuacgacuccaacgucgaccucuucaccuggggcacccccaucgucaccaucgcccuccucaccuuccuccuccaccucggcaucgagaccaagaccuggaccuggcucaacuggaucaccugcggcuucuccguccuccucuucuucaccgucgcccucaucuacaacgccuccugcgccaccugcuacccccccuccaaccccuacuggaccaugcaggcccuccucggcgaccccgucuucuaccucaccugccucaugacccccgucgccgcccuccucccccgccucuucuuccgcucccuccagggccgcgucuuccccacccagcuccagcucgcccgccagcucacccgcaaguccccccgccgcugcuccgcccccaaggagaccuucgcccagggccgccuccccaaggacuccggcaccgagcacuccuccggccgcaccgucaagaccuccgucccccucucccagcccuccuggcacacccagcagcccgucugcucccucgaggccuccggcgagcccuccaccgucgacauguccaugcccguccgcgagcacacccuccucgagggccucuccgcccccgcccccauguccuccgcccccggcgaggccguccuccgcucccccggcggcugccccgaggaguccaagguccgcgccgccuccaccggccgcgucaccccccucuccucccucuucucccuccccaccuucucccuccucaacuggaucuccuccuggucccucgucucccgccucggcuccguccuccaguucucccgcaccgagcagcucgccgacggccaggccggccgcggccuccccguccagccccacuccggccgcuccggccuccagggccccgaccaccgccuccucaucggcgccuccucccgccgcucccaguga

SEQ ID NO: 40077 - RNA, 4386 nt, Artificial Sequence
  derived and/or modified sequence opt2 from ATP10B__Homo_sapiens__NP_079429
auggcccucuccgucgacuccuccuggcaccgcuggcaguggcgcguccgcgacggcuucccccacugccccuccgagaccaccccccuccucucccccgagaagggccgccaguccuacaaccucacccagcagcgcgucgucuuccccaacaacuccaucuuccaccaggacugggaggaggucucccgccgcuaccccggcaaccgcaccugcaccaccaaguacacccucuucaccuuccucccccgcaaccucuucgagcaguuccaccgcugggccaaccucuacuuccucuuccucgucauccucaacuggaugcccuccauggaggucuuccaccgcgagaucaccaugcucccccucgccaucguccucuucgucaucaugaucaaggacggcauggaggacuucaagcgccaccgcuucgacaaggccaucaacugcuccaacauccgcaucuacgagcgcaaggagcagaccuacguccagaagugcuggaaggacguccgcgucggcgacuucauccagaugaagugcaacgagaucguccccgccgacauccuccuccucuucuccuccgaccccaacggcaucugccaccucgagaccgccucccucgacggcgagaccaaccucaagcagcgcugcgucgucaagggcuucucccagcaggagguccaguucgagcccgagcucuuccacaacaccaucgucugcgagaagcccaacaaccaccucaacaaguucaagggcuacauggagcaccccgaccagacccgcaccggcuucggcugcgagucccuccuccuccgcggcugcaccauccgcaacaccgagauggccgucggcaucgucaucuacgccggccacgagaccaaggccaugcucaacaacuccggcccccgcuacaagcgcuccaagaucgagcgccgcaugaacaucgacaucuucuucugcaucggcauccucauccucaugugccucaucggcgccgucggccacuccaucuggaacggcaccuucgaggagcacccccccuucgacguccccgacgccaacggcuccuuccuccccuccgcccucggcggcuucuacauguuccucaccaugaucauccuccuccagguccucauccccaucucccucuacgucuccaucgagcucgucaagcucggccaggucuucuuccucuccaacgaccucgaccucuacgacgaggagaccgaccucuccauccagugccgcgcccucaacaucgccgaggaccucggccagauccaguacaucuucuccgacaagaccggcacccucaccgagaacaagauggucuuccgccgcugcaccaucaugggcuccgaguacucccaccaggagaacgccaagcgccucgagacccccaaggagcucgacuccgacggcgaggaguggacccaguaccagugccucuccuucuccgcccgcugggcccaggaccccgccaccaugcgcucccagaagggcgcccagccccuccgccgcucccaguccgcccgcguccccauccagggccacuaccgccagcgcuccaugggccaccgcgaguccucccagccccccgucgccuucuccuccuccaucgagaaggacgucacccccgacaagaaccuccucaccaagguccgcgacgccgcccucuggcucgagacccucuccgacucccgccccgccaaggccucccucuccaccaccuccuccaucgccgacuucuuccucgcccucaccaucugcaacuccgucauggucuccaccaccaccgagccccgccagcgcgucaccaucaagcccuccuccaaggcccucggcaccucccucgagaagauccagcagcucuuccagaagcucaagcuccucucccucucccaguccuucuccuccaccgcccccuccgacaccgaccucggcgagucccucggcgccaacgucgccaccaccgacuccgacgagcgcgacgacgccuccgucugcuccggcggcgacuccaccgacgacggcggcuaccgcuccuccaugugggaccagggcgacauccucgaguccggcuccggcaccucccucgaggaggcccucgaggcccccgccaccgaccucgcccgccccgaguucugcuacgaggccgagucccccgacgaggccgcccucguccacgccgcccacgccuacuccuucacccucgucucccgcacccccgagcaggucaccguccgccucccccagggcaccugccucaccuucucccuccucugcacccucggcuucgacuccguccgcaagcgcauguccgucgucguccgccacccccucaccggcgagaucgucgucuacaccaagggcgccgacuccgucaucauggaccuccucgaggaccccgccugcguccccgacaucaacauggagaagaagcuccgcaagauccgcgcccgcacccagaagcaccucgaccucuacgcccgcgacggccuccgcacccucugcaucgccaagaaggucgucuccgaggaggacuuccgccgcugggccuccuuccgccgcgaggccgaggccucccucgacaaccgcgacgagcuccucauggagaccgcccagcaccucgagaaccagcucacccuccucggcgccaccggcaucgaggaccgccuccaggagggcguccccgacaccaucgccacccuccgcgaggccggcauccagcucuggguccucaccggcgacaagcaggagaccgccgucaacaucgcccacuccugccgccuccucaaccagaccgacaccgucuacaccaucaacaccgagaaccaggagaccugcgaguccauccucaacugcgcccucgaggagcucaagcaguuccgcgagcuccagaagcccgaccgcaagcucuucggcuuccgccuccccuccaagacccccuccaucaccuccgaggccgucguccccgaggccggccucgucaucgacggcaagacccucaacgccaucuuccagggcaagcucgagaagaaguuccucgagcucacccaguacugccgcuccguccucugcugccgcuccaccccccuccagaaguccaugaucgucaagcucguccgcgacaagcuccgcgucaugacccucuccaucggcgacggcgccaacgacgucuccaugauccaggccgccgacaucggcaucggcaucuccggccaggagggcaugcaggccgucauguccuccgacuucgccaucacccgcuucaagcaccucaagaagcuccuccucguccacggccacuggugcuacucccgccucgcccgcauggucgucuacuaccucuacaagaacgucugcuacgucaaccuccucuucugguaccaguucuucugcggcuucuccuccuccaccaugaucgacuacuggcagaugaucuucuucaaccucuucuucaccucccuccccccccucgucuucggcguccucgacaaggacaucuccgccgagacccuccucgcccuccccgagcucuacaaguccggccagaacuccgagugcuacaaccucuccaccuucuggaucuccauggucgacgccuucuaccagucccucaucugcuucuucauccccuaccucgccuacaagggcuccgacaucgacgucuucaccuucggcacccccaucaacaccaucucccucaccaccauccuccuccaccaggccauggagaugaagaccuggaccaucuuccacggcgucguccuccucggcuccuuccucauguacuuccucgucucccuccucuacaacgccaccugcgucaucugcaacucccccaccaaccccuacugggucauggagggccagcucuccaaccccaccuucuaccucgucugcuuccucacccccgucgucgcccuccucccccgcuacuucuuccucucccuccagggcaccugcggcaagucccucaucuccaaggcccagaagaucgacaagcucccccccgacaagcgcaaccucgagauccaguccuggcgcucccgccagcgccccgcccccguccccgaggucgcccgccccacccaccaccccgucuccuccaucaccggccaggacuucuccgccuccacccccaaguccuccaacccccccaagcgcaagcacgucgaggaguccguccuccacgagcagcgcugcggcaccgagugcaugcgcgacgacuccugcuccggcgacuccuccgcccagcucuccuccggcgagcaccuccucggccccaaccgcaucauggccuacucccgcggccagaccgacaugugccgcugcuccaagcgcuccucccaccgccgcucccaguccucccucaccaucuga

SEQ ID NO: 40078 - RNA, 4281 nt, Artificial Sequence
  derived and/or modified sequence opt2 from ATP10D__Homo_sapiens__NP_065186
augaccgaggcccuccagugggcccgcuaccacuggcgccgccucauccgcggcgccacccgcgacgacgacuccggccccuacaacuacuccucccuccucgccugcggccgcaaguccucccagacccccaagcucuccggccgccaccgcaucgucgucccccacauccagcccuucaaggacgaguacgagaaguucuccggcgccuacgucaacaaccgcauccgcaccaccaaguacacccuccucaacuucgucccccgcaaccucuucgagcaguuccaccgcgccgccaaccucuacuuccucuuccucgucguccucaacugggucccccucgucgaggccuuccagaaggagaucaccaugcucccccucgucgucguccucaccaucaucgccaucaaggacggccucgaggacuaccgcaaguacaagaucgacaagcagaucaacaaccucaucaccaaggucuacucccgcaaggagaagaaguacaucgaccgcugcuggaaggacgucaccgucggcgacuucauccgccucuccugcaacgaggucauccccgccgacaugguccuccucuucuccaccgaccccgacggcaucugccacaucgagaccuccggccucgacggcgaguccaaccucaagcagcgccaggucguccgcggcuacgccgagcaggacuccgaggucgaccccgagaaguucuccucccgcaucgagugcgagucccccaacaacgaccucucccgcuuccgcggcuuccucgagcacuccaacaaggagcgcgucggccucuccaaggagaaccuccuccuccgcggcugcaccauccgcaacaccgaggccgucgucggcaucgucgucuacgccggccacgagaccaaggccaugcucaacaacuccggcccccgcuacaagcgcuccaagcucgagcgccgcgccaacaccgacguccucuggugcgucaugcuccucgucaucaugugccucaccggcgccgucggccacggcaucuggcucucccgcuacgagaagaugcacuucuucaacguccccgagcccgacggccacaucaucuccccccuccucgccggcuucuacauguucuggaccaugaucauccuccuccagguccucauccccaucucccucuacgucuccaucgagaucgucaagcucggccagaucuacuucauccaguccgacgucgacuucuacaacgagaagauggacuccaucguccagugccgcgcccucaacaucgccgaggaccucggccagauccaguaccucuucuccgacaagaccggcacccucaccgagaacaagauggucuuccgccgcugcuccgucgccggcuucgacuacugccacgaggagaacgcccgccgccucgaguccuaccaggaggccgucuccgaggacgaggacuucaucgacaccgucuccggcucccucuccaacauggccaagccccgcgcccccuccugccgcaccguccacaacggcccccucggcaacaagcccuccaaccaccucgccggcuccuccuucacccucggcuccggcgagggcgccuccgaggucccccacucccgccaggccgccuucuccucccccaucgagaccgacgucguccccgacacccgccuccucgacaaguucucccagaucaccccccgccucuucaugccccucgacgagaccauccagaacccccccauggagacccucuacaucaucgacuucuucaucgcccucgccaucugcaacaccgucgucgucuccgcccccaaccagccccgccagaagauccgccaccccucccucggcggccuccccaucaagucccucgaggagaucaagucccucuuccagcgcugguccguccgccgcuccuccucccccucccucaacuccggcaaggagcccuccuccggcguccccaacgccuucgucucccgccucccccucuucucccgcaugaagcccgccucccccgucgaggaggaggucucccaggucugcgaguccccccagugcuccuccuccuccgccugcugcaccgagaccgagaagcagcacggcgacgccggccuccucaacggcaaggccgagucccuccccggccagccccucgccugcaaccucugcuacgaggccgagucccccgacgaggccgcccucgucuacgccgcccgcgccuaccagugcacccuccgcucccgcacccccgagcaggucauggucgacuucgccgcccucggcccccucaccuuccagcuccuccacauccuccccuucgacuccguccgcaagcgcauguccgucgucguccgccacccccucuccaaccaggucgucgucuacaccaagggcgccgacuccgucaucauggagcuccucuccgucgccucccccgacggcgccucccucgagaagcagcagaugaucguccgcgagaagacccagaagcaccucgacgacuacgccaagcagggccuccgcacccucugcaucgccaagaaggucauguccgacaccgaguacgccgaguggcuccgcaaccacuuccucgccgagaccuccaucgacaaccgcgaggagcuccuccucgaguccgccaugcgccucgagaacaagcucacccuccucggcgccaccggcaucgaggaccgccuccaggagggcguccccgaguccaucgaggcccuccacaaggccggcaucaagaucuggaugcucaccggcgacaagcaggagaccgccgucaacaucgccuacgccugcaagcuccucgagcccgacgacaagcucuucauccucaacacccaguccaaggacgccugcggcaugcucauguccaccauccucaaggagcuccagaagaagacccaggcccuccccgagcaggucucccucuccgaggaccuccuccagccccccgucccccgcgacuccggccuccgcgccggccucaucaucaccggcaagacccucgaguucgcccuccaggagucccuccagaagcaguuccucgagcucaccuccuggugccaggccgucgucugcugccgcgccaccccccuccagaaguccgaggucgucaagcucguccgcucccaccuccaggucaugacccucgccaucggcgacggcgccaacgacgucuccaugauccaggucgccgacaucggcaucggcgucuccggccaggagggcaugcaggccgucauggccuccgacuucgccgucucccaguucaagcaccucuccaagcuccuccucguccacggccacuggugcuacacccgccucuccaacaugauccucuacuucuucuacaagaacgucgccuacgucaaccuccucuucugguaccaguucuucugcggcuucuccggcaccuccaugaccgacuacuggguccucaucuucuucaaccuccucuucaccuccgccccccccgucaucuacggcguccucgagaaggacgucuccgccgagacccucaugcagcuccccgagcucuaccgcuccggccagaaguccgaggccuaccucccccacaccuucuggaucacccuccucgacgccuucuaccagucccucgucugcuucuucguccccuacuucaccuaccagggcuccgacaccgacaucuucgccuucggcaacccccucaacaccgccgcccucuucaucguccuccuccaccucgucaucgaguccaagucccucaccuggauccaccuccucgucaucaucggcuccauccucuccuacuuccucuucgccaucgucuucggcgccaugugcgucaccugcaacccccccuccaaccccuacuggaucaugcaggagcacaugcucgaccccgucuucuaccucgucugcauccucaccaccuccaucgcccuccucccccgcuucgucuaccgcguccuccagggcucccucuuccccucccccauccuccgcgccaagcacuucgaccgccucacccccgaggagcgcaccaaggcccucaagaaguggcgcggcgccggcaagaugaaccaggucaccuccaaguacgccaaccaguccgccggcaaguccggccgccgccccaugcccggccccuccgccgucuucgccaugaaguccgccuccuccugcgccaucgagcagggcaaccucucccucugcgagaccgcccucgaccagggcuacuccgagaccaaggccuucgagauggccggccccuccaagggcaaggaguccuga

SEQ ID NO: 40079 - RNA, 3405 nt, Artificial Sequence
  derived and/or modified sequence opt2 from ATP11A__Homo_sapiens__NP_056020
auggacugcucccucguccgcacccucguccaccgcuacugcgccggcgaggagaacugggucgacucccgcaccaucuacgucggccaccgcgagcccccccccggcgccgaggccuacaucccccagcgcuaccccgacaaccgcaucgucuccuccaaguacaccuucuggaacuucauccccaagaaccucuucgagcaguuccgccgcgucgccaacuucuacuuccucaucaucuuccucguccagcucaucaucgacacccccaccucccccgucaccuccggccucccccucuucuucgucaucaccgucaccgccaucaagcagggcuacgaggacuggcuccgccacaaggccgacaacgccaugaaccagugccccguccacuucauccagcacggcaagcucguccgcaagcagucccgcaagcuccgcgucggcgacaucgucauggucaaggaggacgagaccuuccccugcgaccucaucuuccucuccuccaaccgcggcgacggcaccugccacgucaccaccgccucccucgacggcgaguccucccacaagacccacuacgccguccaggacaccaagggcuuccacaccgaggaggacaucggcggccuccacgccaccaucgagugcgagcagccccagcccgaccucuacaaguucgucggccgcaucaacgucuacuccgaccucaacgaccccgucguccgcccccucggcuccgagaaccuccuccuccgcggcgccacccucaagaacaccgagaagaucuucggcgucgccaucuacaccggcauggagaccaagauggcccucaacuaccaguccaagucccagaagcgcuccgccgucgagaaguccaugaacgccuuccucaucgucuaccucugcauccucaucuccaaggcccucaucaacaccguccucaaguacauguggcaguccgagcccuuccgcgacgagcccugguacaaccagaagaccgaguccgagcgccagcgcaaccucuuccucaaggccuucaccgacuuccucgccuucaugguccucuucaacuacaucauccccgucuccauguacgucaccgucgagaugcagaaguuccucggcuccuacuucaucaccugggacgaggacauguucgacgaggagaccggcgagggcccccucgucaacaccuccgaccucaacgaggagcucggccaggucgaguacaucuucaccgacaagaccggcacccucaccgagaacaacauggaguucaaggagugcugcaucgagggccacgucuacgucccccacgucaucugcaacggccagguccuccccgaguccuccggcaucgacaugaucgacuccucccccuccgucaacggccgcgagcgcgaggagcucuucuuccgcgcccucugccucugccacaccguccaggucaaggacgacgacuccgucgacggcccccgcaagucccccgacggcggcaaguccugcgucuacaucuccuccucccccgacgaggucgcccucgucgagggcguccagcgccucggcuucaccuaccuccgccucaaggacaacuacauggagauccucaaccgcgagaaccacaucgagcgcuucgagcuccucgagauccucuccuucgacuccguccgccgccgcauguccgucaucgucaaguccgccaccggcgagaucuaccucuucugcaagggcgccgacuccuccaucuucccccgcgucaucgagggcaaggucgaccagauccgcgcccgcgucgagcgcaacgccgucgagggccuccgcacccucugcgucgccuacaagcgccucauccaggaggaguacgagggcaucugcaagcuccuccaggccgccaaggucgcccuccaggaccgcgagaagaagcucgccgaggccuacgagcagaucgagaaggaccucacccuccucggcgccaccgccgucgaggaccgccuccaggagaaggccgccgacaccaucgaggcccuccagaaggccggcaucaaggucuggguccucaccggcgacaagauggagaccgccgccgccaccugcuacgccugcaagcucuuccgccgcaacacccagcuccucgagcucaccaccaagcgcaucgaggagcagucccuccacgacguccucuucgagcucuccaagaccguccuccgccacuccggcucccucacccgcgacaaccucuccggccucuccgccgacaugcaggacuacggccucaucaucgacggcgccgcccucucccucaucaugaagccccgcgaggacggcuccuccggcaacuaccgcgagcucuuccucgagaucugccgcuccugcuccgccguccucugcugccgcauggccccccuccagaaggcccagaucgucaagcucaucaaguucuccaaggagcaccccaucacccucgccaucggcgacggcgccaacgacgucuccaugauccucgaggcccacgucggcaucggcgucaucggcaaggagggccgccaggccgcccgcaacuccgacuacgccauccccaaguucaagcaccucaagaagaugcuccucguccacggccacuucuacuacauccgcaucuccgagcucguccaguacuucuucuacaagaacgucugcuucaucuucccccaguuccucuaccaguucuucugcggcuucucccagcagacccucuacgacaccgccuaccucacccucuacaacaucuccuucaccucccuccccauccuccucuacucccucauggagcagcacgucggcaucgacguccucaagcgcgaccccacccucuaccgcgacgucgccaagaacgcccuccuccgcuggcgcgucuucaucuacuggacccuccucggccucuucgacgcccucgucuucuucuucggcgccuacuucgucuucgagaacaccaccgucaccuccaacggccagaucuucggcaacuggaccuucggcacccucgucuucaccgucauggucuucaccgucacccucaagcucgcccucgacacccacuacuggaccuggaucaaccacuucgucaucuggggcucccuccucuucuacgucgucuucucccuccucuggggcggcgucaucuggcccuuccucaacuaccagcgcauguacuacgucuucauccagaugcucuccuccggccccgccuggcucgccaucguccuccucgucaccaucucccuccuccccgacguccucaagaagguccucugccgccagcucuggcccaccgccaccgagcgcguccagaccaagucccagugccucuccgucgagcaguccaccaucuucaugcucucccagaccuccuccucccucuccuucuga

SEQ ID NO: 40080 - RNA, 366 nt, Artificial Sequence
  derived and/or modified sequence opt2 from ATP11AUN__Homo_sapiens__NP_997323
augaacucccccgaggcccgccucugcgucgcccagugccgcgacuccuaccccggcugccagccccucaaggacacccgcgccugggccuccucccucaagauggaccccgccggccucgagggcggcccccgcgacgagucccgcgacgagccccccauccgcgcccaggccgccuccugggaccagccccagggcugccucaccuacaagggccgccgcuccgccuccggcacccagaagcagcuccagcuccccgacacccucuccucccuccucugcuggcgcggcgccaucauggucuacaucaaggucaccguccagaccgacgacuccaacaagcuccucucccuccucuaccgcuga

SEQ ID NO: 40081 - RNA, 3534 nt, Artificial Sequence
  derived and/or modified sequence opt2 from ATP11B__Homo_sapiens__NP_055431
auguggcgcuggauccgccagcagcucggcuucgaccccccccaccaguccgacacccgcaccaucuacgucgccaaccgcuucccccagaacggccucuacaccccccagaaguucaucgacaaccgcaucaucuccuccaaguacaccgucuggaacuucguccccaagaaccucuucgagcaguuccgccgcgucgccaacuucuacuuccucaucaucuuccucguccagcucaugaucgacacccccaccucccccgucaccuccggccucccccucuucuucgucaucaccgucaccgccaucaagcagggcuacgaggacuggcuccgccacaacuccgacaacgaggucaacggcgcccccgucuacgucguccgcuccggcggccucgucaagacccgcuccaagaacauccgcgucggcgacaucguccgcaucgccaaggacgagaucuuccccgccgaccucguccuccucuccuccgaccgccucgacggcuccugccacgucaccaccgccucccucgacggcgagaccaaccucaagacccacgucgccguccccgagaccgcccuccuccagaccgucgccaaccucgacacccucgucgccgucaucgagugccagcagcccgaggccgaccucuaccgcuucaugggccgcaugaucaucacccagcagauggaggagaucguccgcccccucggccccgagucccuccuccuccgcggcgcccgccucaagaacaccaaggagaucuucggcgucgccgucuacaccggcauggagaccaagauggcccucaacuacaaguccaagucccagaagcgcuccgccgucgagaaguccaugaacaccuuccucaucaucuaccucgucauccucaucuccgaggccgucaucuccaccauccucaaguacaccuggcaggccgaggagaagugggacgagcccugguacaaccagaagaccgagcaccagcgcaacuccuccaagauccuccgcuucaucuccgacuuccucgccuuccucguccucuacaacuucaucauccccaucucccucuacgucaccgucgagaugcagaaguuccucggcuccuucuucaucggcugggaccucgaccucuaccacgaggaguccgaccagaaggcccaggucaacaccuccgaccucaacgaggagcucggccaggucgaguacgucuucaccgacaagaccggcacccucaccgagaacgagaugcaguuccgcgagugcuccaucaacggcaugaaguaccaggagaucaacggccgccucguccccgagggccccacccccgacuccuccgagggcaaccucuccuaccucuccucccucucccaccucaacaaccucucccaccucaccaccuccuccuccuuccgcaccucccccgagaacgagaccgagcucaucaaggagcacgaccucuucuucaaggccgucucccucugccacaccguccagaucuccaacguccagaccgacugcaccggcgacggccccuggcaguccaaccucgcccccucccagcucgaguacuacgccuccucccccgacgagaaggcccucgucgaggccgccgcccgcaucggcaucgucuucaucggcaacuccgaggagaccauggaggucaagacccucggcaagcucgagcgcuacaagcuccuccacauccucgaguucgacuccgaccgccgccgcauguccgucaucguccaggcccccuccggcgagaagcuccucuucgccaagggcgccgaguccuccauccuccccaagugcaucggcggcgagaucgagaagacccgcauccacgucgacgaguucgcccucaagggccuccgcacccucugcaucgccuaccgcaaguucaccuccaaggaguacgaggagaucgacaagcgcaucuucgaggcccgcaccgcccuccagcagcgcgaggagaagcucgccgccgucuuccaguucaucgagaaggaccucauccuccucggcgccaccgccgucgaggaccgccuccaggacaagguccgcgagaccaucgaggcccuccgcauggccggcaucaaggucuggguccucaccggcgacaagcacgagaccgccgucuccgucucccucuccugcggccacuuccaccgcaccaugaacauccucgagcucaucaaccagaaguccgacuccgagugcgccgagcagcuccgccagcucgcccgccgcaucaccgaggaccacgucauccagcacggccucgucgucgacggcaccucccucucccucgcccuccgcgagcacgagaagcucuucauggaggucugccgcaacugcuccgccguccucugcugccgcauggccccccuccagaaggccaaggucauccgccucaucaagaucucccccgagaagcccaucacccucgccgucggcgacggcgccaacgacgucuccaugauccaggaggcccacgucggcaucggcaucaugggcaaggagggccgccaggccgcccgcaacuccgacuacgccaucgcccgcuucaaguuccucuccaagcuccucuucguccacggccacuucuacuacauccgcaucgccacccucguccaguacuucuucuacaagaacgucugcuucaucaccccccaguuccucuaccaguucuacugccucuucucccagcagacccucuacgacuccgucuaccucacccucuacaacaucugcuucaccucccuccccauccucaucuacucccuccucgagcagcacgucgacccccacguccuccagaacaagcccacccucuaccgcgacaucuccaagaaccgccuccucuccaucaagaccuuccucuacuggaccauccucggcuucucccacgccuucaucuucuucuucggcuccuaccuccucaucggcaaggacaccucccuccucggcaacggccagauguucggcaacuggaccuucggcacccucgucuucaccgucauggucaucaccgucaccgucaagauggcccucgagacccacuucuggaccuggaucaaccaccucgucaccuggggcuccaucaucuucuacuucgucuucucccucuucuacggcggcauccucuggcccuuccucggcucccagaacauguacuucgucuucauccagcuccucuccuccggcuccgccugguucgccaucauccucauggucgucaccugccucuuccucgacaucaucaagaaggucuucgaccgccaccuccaccccaccuccaccgagaaggcccagcucaccgagaccaacgccggcaucaagugccucgacuccaugugcugcuuccccgagggcgaggccgccugcgccuccgucggccgcaugcucgagcgcgucaucggccgcugcucccccacccacaucucccgcuccugguccgccuccgaccccuucuacaccaacgaccgcuccauccucacccucuccaccauggacuccuccaccugcuga

SEQ ID NO: 40082 - RNA, 3138 nt, Artificial Sequence
  derived and/or modified sequence opt2 from ATP12A__Homo_sapiens__NP_001172014
augcaccagaagacccccgagaucuacuccgucgagcucuccggcaccaaggacaucgucaagaccgacaagggcgacggcaaggagaaguaccgcggccucaagaacaacugccucgagcucaagaagaagaaccacaaggaggaguuccagaaggagcuccaccucgacgaccacaagcucuccaaccgcgagcucgaggagaaguacggcaccgacaucaucaugggccucuccuccacccgcgccgccgagcuccucgcccgcgacggccccaacucccucaccccccccaagcagacccccgagaucgucaaguuccucaagcagauggucggcggcuucuccauccuccucugggucggcgccuuccucugcuggaucgccuacggcauccaguacuccuccgacaaguccgccucccucaacaacgucuaccucggcugcguccucggccucgucgucauccucaccggcaucuucgccuacuaccaggaggccaaguccaccaacaucauguccuccuucaacaagaugaucccccagcaggcccucgucauccgcgacuccgagaagaagaccauccccuccgagcagcucgucgucggcgacaucgucgaggucaagggcggcgaccagauccccgccgacauccgcguccucuccucccagggcugccgcgucgacaacuccucccucaccggcgaguccgagccccagccccgcuccuccgaguucacccacgagaacccccucgagaccaagaacaucugcuucuacuccaccaccugccucgaggccuccaccucccccgucggcaccgucaccggcauggucaucaacaccggcgaccgcaccaucaucggccacaucgccucccucgccuccggcgucggcaacgagaagacccccaucgccaucgagaucgagcacuucguccacaucgucgccggcgucgccgucuccaucggcauccucuucuucaucaucgccgucucccucaaguaccagguccucgacuccaucaucuuccucaucggcaucaucgucgccaacguccccgagggccuccucgccaccgucaccgucacccucucccucaccgccaagcgcauggccaagaagaacugccucgucaagaaccucgaggccgucgagacccucggcuccaccuccaucaucugcuccgacaagaccggcacccucacccagaaccgcaugaccgucgcccaccucugguucgacaaccagaucuucgucgccgacaccuccgaggaccacuccaaccaggucuucgaccaguccucccgcaccugggccucccucuccaagaucaucacccucugcaaccgcgccgaguucaagcccggccaggagaacguccccaucaugaagaaggccgucaucggcgacgccuccgagaccgcccuccucaaguucuccgaggucauccucggcgacgucauggagauccgcaagcgcaaccgcaaggucgccgagauccccuucaacuccaccaacaaguuccagcucuccauccacgagauggacgacccccacggcaagcgcuuccucauggucaugaagggcgcccccgagcgcauccucgagaagugcuccaccaucaugaucaacggcgaggagcacccccucgacaaguccaccgccaagaccuuccacaccgccuacauggagcucggcggccucggcgagcgcguccucggcuucugccaccucuaccuccccgccgacgaguuccccgagaccuacuccuucgacaucgacgccaugaacuuccccaccuccaaccucugcuucgucggccuccucuccaugaucgaccccccccgcuccaccguccccgacgccgucaccaagugccgcuccgccggcaucaaggucaucauggucaccggcgaccaccccaucaccgccaaggccaucgccaaguccgucggcaucaucuccgccaacuccgagaccgucgaggacaucgcccaccgccucaacaucgccgucgagcaggucaacaagcgcgacgccaaggccgccgucgucaccggcauggagcucaaggacauguccuccgagcagcucgacgagauccucgccaacuaccaggagaucgucuucgcccgcaccuccccccagcagaagcucaucaucgucgagggcugccagcgccaggacgccgucgucgccgucaccggcgacggcgucaacgacucccccgcccucaagaaggccgacaucggcaucgccaugggcaucgccggcuccgacgccgccaagaacgccgccgacaugguccuccucgacgacaacuucgccuccaucgucaccggcgucgaggagggccgccucaucuucgacaaccucaagaagaccaucgccuacucccucaccaagaacaucgccgagcucugccccuuccucaucuacaucaucgucggccucccccuccccaucggcaccaucaccauccucuucaucgaccucggcaccgacaucauccccuccaucgcccucgccuacgagaaggccgaguccgacaucaugaaccgcaagccccgccacaagaacaaggaccgccucgucaaccagccccucgccgucuacuccuaccuccacaucggccucaugcaggcccucggcgccuuccucgucuacuucaccgucuacgcccaggagggcuuccucccccgcacccucaucaaccuccgcgucgagugggagaaggacuacgucaacgaccucaaggacuccuacggccaggaguggacccgcuaccagcgcgaguaccucgaguggaccggcuacaccgccuucuucgucggcauccucguccagcagaucgccgaccucaucauccgcaagacccgccgcaacuccaucuuccagcagggccucuuccgcaacaaggucaucugggucggcaucaccucccagaucaucaucggccucauccucuccuacggccucggcuccgucaccgcccucuccuucaccaugcuccgcgcccaguacugguucgucgccgucccccacgccauccucaucugggucuacgacgagguccgcaagcucuucauccgccucuaccccggcuccuggugggacaagaacauguacuacuga

SEQ ID NO: 40083 - RNA, 3681 nt, Artificial Sequence
  derived and/or modified sequence opt2 from ATP13A3__Homo_sapiens__NP_078800
auggaccgcgaggagcgcaagaccaucaaccagggccaggaggacgagauggagaucuacggcuacaaccucucccgcuggaagcucgccaucgucucccucggcgucaucugcuccggcggcuuccuccuccuccuccucuacuggaugcccgaguggcgcgucaaggccaccugcguccgcgccgccaucaaggacugcgaggucguccuccuccgcaccaccgacgaguucaagaugugguucugcgccaagauccgcguccucucccucgagaccuaccccgucuccucccccaaguccauguccaacaagcucuccaacggccacgccgucugccucaucgagaaccccaccgaggagaaccgccaccgcaucuccaaguacucccagaccgagucccagcagauccgcuacuucacccaccacuccgucaaguacuucuggaacgacaccauccacaacuucgacuuccucaagggccucgacgagggcgucuccugcaccuccaucuacgagaagcacuccgccggccucaccaagggcaugcacgccuaccgcaagcuccucuacggcgucaacgagaucgccgucaagguccccuccgucuucaagcuccucaucaaggagguccucaaccccuucuacaucuuccagcucuucuccgucauccucugguccaccgacgaguacuacuacuacgcccucgccaucgucgucauguccaucgucuccaucgucuccucccucuacuccauccgcaagcaguacgucaugcuccacgacauggucgccacccacuccaccguccgcgucuccgucugccgcgucaacgaggagaucgaggagaucuucuccaccgaccucguccccggcgacgucauggucaucccccucaacggcaccaucaugcccugcgacgccguccucaucaacggcaccugcaucgucaacgaguccaugcucaccggcgaguccguccccgucaccaagaccaaccuccccaaccccuccgucgacgucaagggcaucggcgacgagcucuacaaccccgagacccacaagcgccacacccucuucugcggcaccaccgucauccagacccgcuucuacaccggcgagcucgucaaggccaucgucguccgcaccggcuucuccaccuccaagggccagcucguccgcuccauccucuaccccaagcccaccgacuucaagcucuaccgcgacgccuaccucuuccuccucugccucgucgccgucgccggcaucggcuucaucuacaccaucaucaacuccauccucaacgagguccaggucggcgucaucaucaucgagucccucgacaucaucaccaucaccgucccccccgcccuccccgccgccaugaccgccggcaucgucuacgcccagcgccgccucaagaagaucggcaucuucugcaucuccccccagcgcaucaacaucugcggccagcucaaccucgucugcuucgacaagaccggcacccucaccgaggacggccucgaccucuggggcauccagcgcgucgagaacgcccgcuuccucucccccgaggagaacgucugcaacgagaugcucgucaagucccaguucgucgccugcauggccaccugccacucccucaccaagaucgagggcguccucuccggcgacccccucgaccucaagauguucgaggccaucggcuggauccucgaggaggccaccgaggaggagaccgcccuccacaaccgcaucaugcccaccgucguccgcccccccaagcagcuccuccccgaguccacccccgccggcaaccaggagauggagcucuucgagcuccccgccaccuacgagaucggcaucguccgccaguuccccuucuccuccgcccuccagcgcauguccgucgucgcccgcguccucggcgaccgcaagauggacgccuacaugaagggcgcccccgaggccaucgccggccucugcaagcccgagaccguccccgucgacuuccagaacguccucgaggacuucaccaagcagggcuuccgcgucaucgcccucgcccaccgcaagcucgaguccaagcucaccuggcacaagguccagaacaucucccgcgacgccaucgagaacaacauggacuucaugggccucaucaucaugcagaacaagcucaagcaggagacccccgccguccucgaggaccuccacaaggccaacauccgcaccgucauggucaccggcgacuccaugcucaccgccgucuccgucgcccgcgacugcggcaugauccucccccaggacaaggucaucaucgccgaggcccucccccccaaggacggcaaggucgccaagaucaacuggcacuacgccgacucccucacccagugcucccaccccuccgccaucgaccccgaggccauccccgucaagcucguccacgacucccucgaggaccuccagaugacccgcuaccacuucgccaugaacggcaaguccuucuccgucauccucgagcacuuccaggaccucguccccaagcucaugcuccacggcaccgucuucgcccgcauggcccccgaccagaagacccagcucaucgaggcccuccagaacgucgacuacuucgucggcaugugcggcgacggcgccaacgacugcggcgcccucaagcgcgcccacggcggcaucucccucuccgagcucgaggccuccgucgccucccccuucaccuccaagacccccuccaucuccugcguccccaaccucauccgcgagggccgcgccgcccucaucaccuccuucugcgucuucaaguucauggcccucuacuccaucauccaguacuucuccgucacccuccucuacuccauccucuccaaccucggcgacuuccaguuccucuucaucgaccucgccaucauccucgucgucgucuucaccaugucccucaaccccgccuggaaggagcucgucgcccagcgcccccccuccggccucaucuccggcgcccuccucuucuccguccucucccagaucaucaucugcaucggcuuccagucccucggcuucuucugggucaagcagcagcccugguacgaggucuggcaccccaaguccgacgccugcaacaccaccggcuccggcuucuggaacuccucccacgucgacaacgagaccgagcucgacgagcacaacauccagaacuacgagaacaccaccgucuucuucaucuccuccuuccaguaccucaucgucgccaucgccuucuccaagggcaagcccuuccgccagcccugcuacaagaacuacuucuucgucuucuccgucaucuuccucuacaucuucauccucuucaucaugcucuaccccgucgccuccgucgaccagguccuccagaucgucugcguccccuaccaguggcgcgucaccaugcucaucaucguccucgucaacgccuucgucuccaucaccgucgaggaguccgucgaccgcuggggcaagugcugccuccccugggcccucggcugccgcaagaagacccccaaggccaaguacauguaccucgcccaggagcuccucgucgaccccgaguggccccccaagccccagaccaccaccgaggccaaggcccucgucaaggagaacggcuccugccagaucaucaccaucaccuga

SEQ ID NO: 40084 - RNA, 3591 nt, Artificial Sequence
  derived and/or modified sequence opt2 from ATP13A4__Homo_sapiens__NP_115655
augggccacuucgagaagggccagcacgcccuccucaacgagggcgaggagaacgagauggagaucuucggcuaccgcacccagggcugccgcaagucccucugccucgccggcuccaucuucuccuucggcauccucccccucgucuucuacuggcgccccgccuggcacgucugggcccacugcguccccugcucccuccaggaggccgacaccguccuccuccgcaccaccgacgaguuccagaucuacuccuggaagaaggucaucuggaucuaccucuccgcccucaacuccgccuucggccucacccccgaccacccccucaugaccgacgaggaguacaucaucaaccgcgccauccgcaagcccgaccucaagguccgcugcaucaagguccagaagauccgcuacgucuggaacuaccucgagggccaguuccagaagaucggcucccucgaggacuggcucuccuccgccaagauccaccagaaguucggcuccggccucacccgcgaggagcaggagauccgccgccucaucugcggccccaacaccaucgacgucgaggucacccccaucuggaagcuccucaucaaggagguccucaaccccuucuacaucuuccagcucuucuccgucugccucugguucuccgaggacuacaaggaguacgccuucgccaucaucaucauguccaucaucuccaucucccucaccgucuacgaccuccgcgagcaguccgucaagcuccaccaccucgucgagucccacaacuccaucaccgucuccgucugcggccgcaaggccggcguccaggagcucgagucccgcguccucguccccggcgaccuccucauccucaccggcaacaagguccucaugcccugcgacgccguccucaucgagggcuccugcgucgucgacgagggcaugcucaccggcgaguccauccccgucaccaagaccccccuccccaagauggacuccuccguccccuggaagacccaguccgaggccgacuacaagcgccacguccucuucugcggcaccgaggucauccaggccaaggccgccugcuccggcaccguccgcgccgucguccuccagaccggcuucaacaccgccaagggcgaccucguccgcuccauccucuaccccaagcccgucaacuuccagcucuaccgcgacgccauccgcuuccuccucugccucgucggcaccgccaccaucggcaugaucuacacccucugcgucuacguccucuccggcgagccccccgaggaggucguccgcaaggcccucgacgucaucaccaucgccgucccccccgcccuccccgccgcccucaccaccggcaucaucuacgcccagcgccgccucaagaagcgcggcaucuucugcaucuccccccagcgcaucaacgucugcggccagcucaaccucgucugcuucgacaagaccggcacccucacccgcgacggccucgaccucuggggcgucgucuccugcgaccgcaacggcuuccaggagguccacuccuucgccuccggccaggcccuccccuggggcccccucugcgccgccauggccuccugccacucccucauccuccucgacggcaccauccagggcgacccccucgaccucaagauguucgaggccaccaccugggagauggccuucuccggcgacgacuuccacaucaagggcguccccgcccacgccauggucgucaagcccugccgcaccgccucccagguccccgucgagggcaucgccauccuccaccaguuccccuucuccuccgcccuccagcgcaugaccgucaucguccaggagaugggcggcgaccgccucgccuucaugaagggcgcccccgagcgcgucgccuccuucugccagcccgagaccguccccaccuccuucgucuccgagcuccagaucuacaccacccagggcuuccgcgucaucgcccucgccuacaagaagcucgagaacgaccaccacgccaccacccucacccgcgagaccgucgaguccgaccucaucuuccucggccuccucauccucgagaaccgccucaaggaggagaccaagcccguccucgaggagcucaucuccgcccgcauccgcaccgucaugaucaccggcgacaaccuccagaccgccaucaccgucgcccgcaaguccggcauggucuccgagucccagaaggucauccucaucgaggccaacgagaccaccggcuccuccuccgccuccaucuccuggacccucgucgaggagaagaagcacaucauguacggcaaccaggacaacuacaucaacauccgcgacgaggucuccgacaagggccgcgagggcuccuaccacuucgcccucaccggcaaguccuuccacgucaucucccagcacuucuccucccuccuccccaagauccucaucaacggcaccaucuucgcccgcaugucccccggccagaaguccucccucgucgaggaguuccagaagcucgacuacuucgucggcaugugcggcgacggcgccaacgacugcggcgcccucaagauggcccacgucggcaucucccucuccgagcaggaggccuccgucgccucccccuucaccuccaagacccccaacaucgagugcgucccccaccucaucaaggagggccgcgccgcccucgucaccuccuucugcauguucaaguacauggcccucuacuccaugauccaguacgucggcguccuccuccucuacugggagaccaacucccucuccaacuaccaguuccucuuccaggaccucgccaucaccacccucaucggcgucaccaugaaccucaacggcgccuaccccaagcucguccccuuccgccccgccggccgccucaucucccccccccuccuccucuccgucaucuucaacauccuccucucccucgccaugcacaucgccggcuucauccucguccagcgccagcccugguacuccgucgagauccacuccgccugcaccguccagaacgaguccaucuccgagcucaccaugucccccaccgcccccgagaagauggaguccaacuccaccuucaccuccuucgagaacaccaccgucugguuccucggcaccaucaacugcaucaccgucgcccucgucuucuccaagggcaagcccuuccgccagcccaccuacaccaacuacaucuucguccucguccucaucauccagcucggcgucugccucuucauccucuucgccgacauccccgagcucuaccgccgccucgaccuccucugcacccccguccucuggcgcgccuccaucgucaucaugcucucccucaacuucaucgucucccucgucgccgaggaggccgucaucgagaaccgcgcccucuggaugaugaucaagcgcugcuucggcuaccaguccaagucccaguaccgcaucuggcagcgcgaccucgccaacgaccccuccuggcccccccucaaccagaccucccacuccgacaugcccgagugcggccgcggcgucuccuacuccaaccccgucuucgaguccaacgaggagcagcucuga

SEQ ID NO: 40085 - RNA, 3063 nt, Artificial Sequence
  derived and/or modified sequence opt2 from ATP1A2__Homo_sapiens__NP_000693
augggccgcggcgccggccgcgaguacucccccgccgccaccaccgccgagaacggcggcggcaagaagaagcagaaggagaaggagcucgacgagcucaagaaggaggucgccauggacgaccacaagcucucccucgacgagcucggccgcaaguaccaggucgaccucuccaagggccucaccaaccagcgcgcccaggacguccucgcccgcgacggccccaacgcccucacccccccccccaccacccccgagugggucaaguucugccgccagcucuucggcggcuucuccauccuccucuggaucggcgccauccucugcuuccucgccuacggcauccaggccgccauggaggacgagcccuccaacgacaaccucuaccucggcgucguccucgccgccgucgucaucgucaccggcugcuucuccuacuaccaggaggccaaguccuccaagaucauggacuccuucaagaacauggucccccagcaggcccucgucauccgcgagggcgagaagaugcagaucaacgccgaggaggucgucgucggcgaccucgucgaggucaagggcggcgaccgcguccccgccgaccuccgcaucaucuccucccacggcugcaaggucgacaacuccucccucaccggcgaguccgagccccagacccgcucccccgaguucacccacgagaacccccucgagacccgcaacaucugcuucuucuccaccaacugcgucgagggcaccgcccgcggcaucgucaucgccaccggcgaccgcaccgucaugggccgcaucgccacccucgccuccggccucgaggucggccgcacccccaucgccauggagaucgagcacuucauccagcucaucaccggcgucgccgucuuccucggcgucuccuucuucguccucucccucauccucggcuacuccuggcucgaggccgucaucuuccucaucggcaucaucgucgccaacguccccgagggccuccucgccaccgucaccgucugccucacccucaccgccaagcgcauggcccgcaagaacugccucgucaagaaccucgaggccgucgagacccucggcuccaccuccaccaucugcuccgacaagaccggcacccucacccagaaccgcaugaccgucgcccacaugugguucgacaaccagauccacgaggccgacaccaccgaggaccaguccggcgccaccuucgacaagcgcucccccaccuggaccgcccucucccgcaucgccggccucugcaaccgcgccgucuucaaggccggccaggagaacaucuccgucuccaagcgcgacaccgccggcgacgccuccgaguccgcccuccucaagugcaucgagcucuccugcggcuccguccgcaagaugcgcgaccgcaaccccaaggucgccgagauccccuucaacuccaccaacaaguaccagcucuccauccacgagcgcgaggacuccccccagucccacguccucgucaugaagggcgcccccgagcgcauccucgaccgcugcuccaccauccucguccagggcaaggagaucccccucgacaaggagaugcaggacgccuuccagaacgccuacauggagcucggcggccucggcgagcgcguccucggcuucugccagcucaaccuccccuccggcaaguucccccgcggcuucaaguucgacaccgacgagcucaacuuccccaccgagaagcucugcuucgucggccucauguccaugaucgaccccccccgcgccgccguccccgacgccgucggcaagugccgcuccgccggcaucaaggucaucauggucaccggcgaccaccccaucaccgccaaggccaucgccaagggcgucggcaucaucuccgagggcaacgagaccgucgaggacaucgccgcccgccucaacauccccaugucccaggucaacccccgcgaggccaaggccugcgucguccacggcuccgaccucaaggacaugaccuccgagcagcucgacgagauccucaagaaccacaccgagaucgucuucgcccgcaccuccccccagcagaagcucaucaucgucgagggcugccagcgccagggcgccaucgucgccgucaccggcgacggcgucaacgacucccccgcccucaagaaggccgacaucggcaucgccaugggcaucuccggcuccgacgucuccaagcaggccgccgacaugauccuccucgacgacaacuucgccuccaucgucaccggcgucgaggagggccgccucaucuucgacaaccucaagaaguccaucgccuacacccucaccuccaacauccccgagaucacccccuuccuccucuucaucaucgccaacaucccccucccccucggcaccgucaccauccucugcaucgaccucggcaccgacaugguccccgccaucucccucgccuacgaggccgccgaguccgacaucaugaagcgccagccccgcaacucccagaccgacaagcucgucaacgagcgccucaucuccauggccuacggccagaucggcaugauccaggcccucggcggcuucuucaccuacuucgucauccucgccgagaacggcuuccuccccucccgccuccucggcauccgccucgacugggacgaccgcaccaugaacgaccucgaggacuccuacggccaggaguggaccuacgagcagcgcaaggucgucgaguucaccugccacaccgccuucuucgccuccaucgucgucguccagugggccgaccucaucaucugcaagacccgccgcaacuccgucuuccagcagggcaugaagaacaagauccucaucuucggccuccucgaggagaccgcccucgccgccuuccucuccuacugccccggcaugggcgucgcccuccgcauguacccccucaaggucaccuggugguucugcgccuuccccuacucccuccucaucuucaucuacgacgagguccgcaagcucauccuccgccgcuaccccggcggcugggucgagaaggagaccuacuacuga

SEQ ID NO: 40086 - RNA, 3075 nt, Artificial Sequence
  derived and/or modified sequence opt2 from ATP1A3__Homo_sapiens__NP_001243142
augggcggcugggaggaggagcgcaaccgccgcgccaccgacaagaaggacgacaaggacucccccaagaagaacaagggcaaggagcgccgcgaccucgacgaccucaagaaggaggucgccaugaccgagcacaagauguccgucgaggaggucugccgcaaguacaacaccgacugcguccagggccucacccacuccaaggcccaggagauccucgcccgcgacggccccaacgcccucacccccccccccaccacccccgagugggucaaguucugccgccagcucuucggcggcuucuccauccuccucuggaucggcgccauccucugcuuccucgccuacggcauccaggccggcaccgaggacgaccccuccggcgacaaccucuaccucggcaucguccucgccgccgucgucaucaucaccggcugcuucuccuacuaccaggaggccaaguccuccaagaucauggaguccuucaagaacauggucccccagcaggcccucgucauccgcgagggcgagaagaugcaggucaacgccgaggaggucgucgucggcgaccucgucgagaucaagggcggcgaccgcguccccgccgaccuccgcaucaucuccgcccacggcugcaaggucgacaacuccucccucaccggcgaguccgagccccagacccgcucccccgacugcacccacgacaacccccucgagacccgcaacaucaccuucuucuccaccaacugcgucgagggcaccgcccgcggcgucgucgucgccaccggcgaccgcaccgucaugggccgcaucgccacccucgccuccggccucgaggucggcaagacccccaucgccaucgagaucgagcacuucauccagcucaucaccggcgucgccgucuuccucggcgucuccuucuucauccucucccucauccucggcuacaccuggcucgaggccgucaucuuccucaucggcaucaucgucgccaacguccccgagggccuccucgccaccgucaccgucugccucacccucaccgccaagcgcauggcccgcaagaacugccucgucaagaaccucgaggccgucgagacccucggcuccaccuccaccaucugcuccgacaagaccggcacccucacccagaaccgcaugaccgucgcccacaugugguucgacaaccagauccacgaggccgacaccaccgaggaccaguccggcaccuccuucgacaaguccucccacaccugggucgcccucucccacaucgccggccucugcaaccgcgccgucuucaagggcggccaggacaacauccccguccucaagcgcgacgucgccggcgacgccuccgaguccgcccuccucaagugcaucgagcucuccuccggcuccgucaagcucaugcgcgagcgcaacaagaaggucgccgagauccccuucaacuccaccaacaaguaccagcucuccauccacgagaccgaggaccccaacgacaaccgcuaccuccucgucaugaagggcgcccccgagcgcauccucgaccgcugcuccaccauccuccuccagggcaaggagcagccccucgacgaggagaugaaggaggccuuccagaacgccuaccucgagcucggcggccucggcgagcgcguccucggcuucugccacuacuaccuccccgaggagcaguuccccaagggcuucgccuucgacugcgacgacgucaacuucaccaccgacaaccucugcuucgucggccucauguccaugaucgaccccccccgcgccgccguccccgacgccgucggcaagugccgcuccgccggcaucaaggucaucauggucaccggcgaccaccccaucaccgccaaggccaucgccaagggcgucggcaucaucuccgagggcaacgagaccgucgaggacaucgccgcccgccucaacauccccgucucccaggucaacccccgcgacgccaaggccugcgucauccacggcaccgaccucaaggacuucaccuccgagcagaucgacgagauccuccagaaccacaccgagaucgucuucgcccgcaccuccccccagcagaagcucaucaucgucgagggcugccagcgccagggcgccaucgucgccgucaccggcgacggcgucaacgacucccccgcccucaagaaggccgacaucggcgucgccaugggcaucgccggcuccgacgucuccaagcaggccgccgacaugauccuccucgacgacaacuucgccuccaucgucaccggcgucgaggagggccgccucaucuucgacaaccucaagaaguccaucgccuacacccucaccuccaacauccccgagaucacccccuuccuccucuucaucauggccaacaucccccucccccucggcaccaucaccauccucugcaucgaccucggcaccgacaugguccccgccaucucccucgccuacgaggccgccgaguccgacaucaugaagcgccagccccgcaacccccgcaccgacaagcucgucaacgagcgccucaucuccauggccuacggccagaucggcaugauccaggcccucggcggcuucuucuccuacuucgucauccucgccgagaacggcuuccuccccggcaaccucgucggcauccgccucaacugggacgaccgcaccgucaacgaccucgaggacuccuacggccagcaguggaccuacgagcagcgcaaggucgucgaguucaccugccacaccgccuucuucgucuccaucgucgucguccagugggccgaccucaucaucugcaagacccgccgcaacuccgucuuccagcagggcaugaagaacaagauccucaucuucggccucuucgaggagaccgcccucgccgccuuccucuccuacugccccggcauggacgucgcccuccgcauguacccccucaagcccuccuggugguucugcgccuuccccuacuccuuccucaucuucgucuacgacgagauccgcaagcucauccuccgccgcaaccccggcggcugggucgagaaggagaccuacuacuga

SEQ ID NO: 40087 - RNA, 498 nt, Artificial Sequence
  derived and/or modified sequence opt2 from ATP1A4__Homo_sapiens__NP_001001734
augauccaggcccucgccggcuucuucaccuacuucgucauccucgccgagaacggcuuccgccccgucgaccuccucggcauccgccuccacugggaggacaaguaccucaacgaccucgaggacuccuacggccagcaguggaccuacgagcagcgcaaggucgucgaguucaccugccagaccgccuucuucgucaccaucgucgucguccagugggccgaccucaucaucuccaagacccgccgcaacucccucuuccagcagggcaugcgcaacaagguccucaucuucggcauccucgaggagacccuccucgccgccuuccucuccuacacccccggcauggacgucgcccuccgcauguacccccucaagaucaccugguggcucugcgccauccccuacuccauccucaucuucgucuacgacgagauccgcaagcuccucauccgccagcaccccgacggcugggucgagcgcgagaccuacuacuga

SEQ ID NO: 40088 - RNA, 912 nt, Artificial Sequence
  derived and/or modified sequence opt2 from ATP1B1__Homo_sapiens__NP_001668
auggcccgcggcaaggccaaggaggagggcuccuggaagaaguucaucuggaacuccgagaagaaggaguuccucggccgcaccggcggcuccugguucaagauccuccucuucuacgucaucuucuacggcugccucgccggcaucuucaucggcaccauccaggucaugcuccucaccaucuccgaguucaagcccaccuaccaggaccgcgucgccccccccggccucacccagaucccccagauccagaagaccgagaucuccuuccgccccaacgaccccaaguccuacgaggccuacguccucaacaucguccgcuuccucgagaaguacaaggacuccgcccagcgcgacgacaugaucuucgaggacugcggcgacguccccuccgagcccaaggagcgcggcgacuucaaccacgagcgcggcgagcgcaaggucugccgcuucaagcucgaguggcucggcaacugcuccggccucaacgacgagaccuacggcuacaaggagggcaagcccugcaucaucaucaagcucaaccgcguccucggcuucaagcccaagccccccaagaacgagucccucgagaccuaccccgucaugaaguacaaccccaacguccuccccguccagugcaccggcaagcgcgacgaggacaaggacaaggucggcaacgucgaguacuucggccucggcaacucccccggcuucccccuccaguacuaccccuacuacggcaagcuccuccagcccaaguaccuccagccccuccucgccguccaguucaccaaccucaccauggacaccgagauccgcaucgagugcaaggccuacggcgagaacaucggcuacuccgagaaggaccgcuuccagggccgcuucgacgucaagaucgaggucaaguccuga

SEQ ID NO: 40089 - RNA, 873 nt, Artificial Sequence
  derived and/or modified sequence opt2 from ATP1B2__Homo_sapiens__NP_001669
auggucauccagaaggagaagaaguccugcggccaggucgucgaggaguggaaggaguucgucuggaacccccgcacccaccaguucaugggccgcaccggcaccuccugggccuucauccuccucuucuaccucgucuucuacggcuuccucaccgccauguucacccucaccaugugggucaugcuccagaccgucuccgaccacacccccaaguaccaggaccgccucgccacccccggccucaugauccgccccaagaccgagaaccucgacgucaucgucaacgucuccgacaccgaguccugggaccagcacguccagaagcucaacaaguuccucgagcccuacaacgacuccauccaggcccagaagaacgacgucugccgccccggccgcuacuacgagcagcccgacaacggcguccucaacuaccccaagcgcgccugccaguucaaccgcacccagcucggcaacugcuccggcaucggcgacuccacccacuacggcuacuccaccggccagcccugcgucuucaucaagaugaaccgcgucaucaacuucuacgccggcgccaaccaguccaugaacgucaccugcgccggcaagcgcgacgaggacgccgagaaccucggcaacuucgucauguuccccgccaacggcaacaucgaccucauguacuuccccuacuacggcaagaaguuccacgucaacuacacccagccccucgucgccgucaaguuccucaacgucacccccaacgucgaggucaacgucgagugccgcaucaacgccgccaacaucgccaccgacgacgagcgcgacaaguucgccggccgcgucgccuucaagcuccgcaucaacaagaccuga

SEQ ID NO: 40090 - RNA, 2610 nt, Artificial Sequence
  derived and/or modified sequence opt2 from ATP2A1__Homo_sapiens__NP_001273004
augggcaaggucuaccgcgccgaccgcaaguccguccagcgcaucaaggcccgcgacaucguccccggcgacaucgucgaggucgccgucggcgacaagguccccgccgacauccgcauccucgccaucaaguccaccacccuccgcgucgaccaguccauccucaccggcgaguccgucuccgucaucaagcacaccgagcccguccccgacccccgcgccgucaaccaggacaagaagaacaugcucuucuccggcaccaacaucgccgccggcaaggcccucggcaucgucgccaccaccggcgucggcaccgagaucggcaagauccgcgaccagauggccgccaccgagcaggacaagaccccccuccagcagaagcucgacgaguucggcgagcagcucuccaaggucaucucccucaucugcgucgccgucuggcucaucaacaucggccacuucaacgaccccguccacggcggcuccugguuccgcggcgccaucuacuacuucaagaucgccgucgcccucgccgucgccgccauccccgagggccuccccgccgucaucaccaccugccucgcccucggcacccgccgcauggccaagaagaacgccaucguccgcucccuccccuccgucgagacccucggcugcaccuccgucaucugcuccgacaagaccggcacccucaccaccaaccagauguccgucugcaagauguucaucaucgacaaggucgacggcgacaucugccuccucaacgaguucuccaucaccggcuccaccuacgcccccgagggcgagguccucaagaacgacaagcccguccgccccggccaguacgacggccucgucgagcucgccaccaucugcgcccucugcaacgacuccucccucgacuucaacgaggccaagggcgucuacgagaaggucggcgaggccaccgagaccgcccucaccacccucgucgagaagaugaacgucuucaacaccgacguccgcucccucuccaaggucgagcgcgccaacgccugcaacuccgucauccgccagcucaugaagaaggaguucacccucgaguucucccgcgaccgcaaguccauguccgucuacugcucccccgccaaguccucccgcgccgccgucggcaacaagauguucgucaagggcgcccccgagggcgucaucgaccgcugcaacuacguccgcgucggcaccacccgcgucccccucaccggccccgucaaggagaagaucauggccgucaucaaggaguggggcaccggccgcgacacccuccgcugccucgcccucgccacccgcgacaccccccccaagcgcgaggagaugguccucgacgacuccgcccgcuuccucgaguacgagaccgaccucaccuucgucggcgucgucggcaugcucgaccccccccgcaaggaggucaccggcuccauccagcucugccgcgacgccggcauccgcgucaucaugaucaccggcgacaacaagggcaccgccaucgccaucugccgccgcaucggcaucuucggcgagaacgaggaggucgccgaccgcgccuacaccggccgcgaguucgacgaccucccccucgccgagcagcgcgaggccugccgccgcgccugcugcuucgcccgcgucgagcccucccacaaguccaagaucgucgaguaccuccaguccuacgacgagaucaccgccaugaccggcgacggcgucaacgacgcccccgcccucaagaaggccgagaucggcaucgccaugggcuccggcaccgccgucgccaagaccgccuccgagaugguccucgccgacgacaacuucuccaccaucgucgccgccgucgaggagggccgcgccaucuacaacaacaugaagcaguucauccgcuaccucaucuccuccaacgucggcgaggucgucugcaucuuccucaccgccgcccucggccuccccgaggcccucauccccguccagcuccucugggucaaccucgucaccgacggccuccccgccaccgcccucggcuucaacccccccgaccucgacaucauggaccgccccccccgcucccccaaggagccccucaucuccggcuggcucuucuuccgcuacauggccaucggcggcuacgucggcgccgccaccgucggcgccgccgccuggugguuccucuacgccgaggacggcccccacgucaacuacucccagcucacccacuucaugcagugcaccgaggacaacacccacuucgagggcaucgacugcgaggucuucgaggcccccgagcccaugaccauggcccucuccguccucgucaccaucgagaugugcaacgcccucaacucccucuccgagaaccagucccuccuccgcaugccccccugggucaacaucuggcuccucggcuccaucugccucuccaugucccuccacuuccucauccucuacgucgacccccuccccaugaucuucaagcuccgcgcccucgaccucacccaguggcucaugguccucaagaucucccuccccgucaucggccucgacgagauccucaaguucgucgcccgcaacuaccucgagggcuga

SEQ ID NO: 40091 - RNA, 2994 nt, Artificial Sequence
  derived and/or modified sequence opt2 from ATP2A2__Homo_sapiens__NP_001672
auggagaacgcccacaccaagaccgucgaggagguccucggccacuucggcgucaacgaguccaccggccucucccucgagcaggucaagaagcucaaggagcgcuggggcuccaacgagcuccccgccgaggagggcaagacccuccucgagcucgucaucgagcaguucgaggaccuccucguccgcauccuccuccucgccgccugcaucuccuucguccucgccugguucgaggagggcgaggagaccaucaccgccuucgucgagcccuucgucauccuccucauccucgucgccaacgccaucgucggcgucuggcaggagcgcaacgccgagaacgccaucgaggcccucaaggaguacgagcccgagaugggcaaggucuaccgccaggaccgcaaguccguccagcgcaucaaggccaaggacaucguccccggcgacaucgucgagaucgccgucggcgacaagguccccgccgacauccgccucaccuccaucaaguccaccacccuccgcgucgaccaguccauccucaccggcgaguccgucuccgucaucaagcacaccgaccccguccccgacccccgcgccgucaaccaggacaagaagaacaugcucuucuccggcaccaacaucgccgccggcaaggccaugggcgucgucgucgccaccggcgucaacaccgagaucggcaagauccgcgacgagauggucgccaccgagcaggagcgcaccccccuccagcagaagcucgacgaguucggcgagcagcucuccaaggucaucucccucaucugcaucgccgucuggaucaucaacaucggccacuucaacgaccccguccacggcggcuccuggauccgcggcgccaucuacuacuucaagaucgccgucgcccucgccgucgccgccauccccgagggccuccccgccgucaucaccaccugccucgcccucggcacccgccgcauggccaagaagaacgccaucguccgcucccuccccuccgucgagacccucggcugcaccuccgucaucugcuccgacaagaccggcacccucaccaccaaccagauguccgucugccgcauguucauccucgaccgcgucgagggcgacaccugcucccucaacgaguucaccaucaccggcuccaccuacgcccccaucggcgagguccacaaggacgacaagcccgucaacugccaccaguacgacggccucgucgagcucgccaccaucugcgcccucugcaacgacuccgcccucgacuacaacgaggccaagggcgucuacgagaaggucggcgaggccaccgagaccgcccucaccugccucgucgagaagaugaacgucuucgacaccgagcucaagggccucuccaagaucgagcgcgccaacgccugcaacuccgucaucaagcagcucaugaagaaggaguucacccucgaguucucccgcgaccgcaaguccauguccgucuacugcacccccaacaagcccucccgcaccuccauguccaagauguucgucaagggcgcccccgagggcgucaucgaccgcugcacccacauccgcgucggcuccaccaagguccccaugaccuccggcgucaagcagaagaucauguccgucauccgcgaguggggcuccggcuccgacacccuccgcugccucgcccucgccacccacgacaacccccuccgccgcgaggagaugcaccucgaggacuccgccaacuucaucaaguacgagaccaaccucaccuucgucggcugcgucggcaugcucgaccccccccgcaucgaggucgccuccuccgucaagcucugccgccaggccggcauccgcgucaucaugaucaccggcgacaacaagggcaccgccgucgccaucugccgccgcaucggcaucuucggccaggacgaggacgucaccuccaaggccuucaccggccgcgaguucgacgagcucaaccccuccgcccagcgcgacgccugccucaacgcccgcugcuucgcccgcgucgagcccucccacaaguccaagaucgucgaguuccuccaguccuucgacgagaucaccgccaugaccggcgacggcgucaacgacgcccccgcccucaagaaggccgagaucggcaucgccaugggcuccggcaccgccgucgccaagaccgccuccgagaugguccucgccgacgacaacuucuccaccaucgucgccgccgucgaggagggccgcgccaucuacaacaacaugaagcaguucauccgcuaccucaucuccuccaacgucggcgaggucgucugcaucuuccucaccgccgcccucggcuuccccgaggcccucauccccguccagcuccucugggucaaccucgucaccgacggccuccccgccaccgcccucggcuucaacccccccgaccucgacaucaugaacaagcccccccgcaaccccaaggagccccucaucuccggcuggcucuucuuccgcuaccucgccaucggcugcuacgucggcgccgccaccgucggcgccgccgccuggugguucaucgccgccgacggcggcccccgcgucuccuucuaccagcucucccacuuccuccagugcaaggaggacaaccccgacuucgagggcgucgacugcgccaucuucgagucccccuaccccaugaccauggcccucuccguccucgucaccaucgagaugugcaacgcccucaacucccucuccgagaaccagucccuccuccgcaugccccccugggagaacaucuggcucgucggcuccaucugccucuccaugucccuccacuuccucauccucuacgucgagccccucccccucaucuuccagaucaccccccucaacgucacccaguggcucaugguccucaagaucucccuccccgucauccucauggacgagacccucaaguucgucgcccgcaacuaccucgagcccgccauccucgaguga

SEQ ID NO: 40092 - RNA, 3159 nt, Artificial Sequence
  derived and/or modified sequence opt2 from ATP2A3__Homo_sapiens__NP_777613
auggaggccgcccaccuccuccccgccgccgacguccuccgccacuucuccgucaccgccgagggcggccucucccccgcccaggucaccggcgcccgcgagcgcuacggccccaacgagcuccccuccgaggagggcaagucccucugggagcucguccucgagcaguucgaggaccuccucguccgcauccuccuccucgccgcccucgucuccuucguccucgccugguucgaggagggcgaggagaccaccaccgccuucgucgagccccucgucaucaugcucauccucgucgccaacgccaucgucggcgucuggcaggagcgcaacgccgaguccgccaucgaggcccucaaggaguacgagcccgagaugggcaaggucauccgcuccgaccgcaagggcguccagcgcauccgcgcccgcgacaucguccccggcgacaucgucgaggucgccgucggcgacaagguccccgccgaccuccgccucaucgagaucaaguccaccacccuccgcgucgaccaguccauccucaccggcgaguccgucuccgucaccaagcacaccgaggccauccccgacccccgcgccgucaaccaggacaagaagaacaugcucuucuccggcaccaacaucaccuccggcaaggccgucggcgucgccgucgccaccggccuccacaccgagcucggcaagauccgcucccagauggccgccgucgagcccgagcgcaccccccuccagcgcaagcucgacgaguucggccgccagcucucccacgccaucuccgucaucugcgucgccgucugggucaucaacaucggccacuucgccgaccccgcccacggcggcuccuggcuccgcggcgccgucuacuacuucaagaucgccgucgcccucgccgucgccgccauccccgagggccuccccgccgucaucaccaccugccucgcccucggcacccgccgcauggcccgcaagaacgccaucguccgcucccuccccuccgucgagacccucggcugcaccuccgucaucugcuccgacaagaccggcacccucaccaccaaccagauguccgucugccgcauguucgucgucgccgaggccgacgccggcuccugccuccuccacgaguucaccaucuccggcaccaccuacacccccgagggcgagguccgccagggcgaccagcccguccgcugcggccaguucgacggccucgucgagcucgccaccaucugcgcccucugcaacgacuccgcccucgacuacaacgaggccaagggcgucuacgagaaggucggcgaggccaccgagaccgcccucaccugccucgucgagaagaugaacgucuucgacaccgaccuccaggcccucucccgcgucgagcgcgccggcgccugcaacaccgucaucaagcagcucaugcgcaaggaguucacccucgaguucucccgcgaccgcaaguccauguccgucuacugcacccccacccgcccccaccccaccggccagggcuccaagauguucgucaagggcgcccccgaguccgucaucgagcgcugcuccuccguccgcgucggcucccgcaccgccccccucacccccaccucccgcgagcagauccucgccaagauccgcgacuggggcuccggcuccgacacccuccgcugccucgcccucgccacccgcgacgcccccccccgcaaggaggacauggagcucgacgacugcuccaaguucguccaguacgagaccgaccucaccuucgucggcugcgucggcaugcucgaccccccccgccccgaggucgccgccugcaucacccgcugcuaccaggccggcauccgcgucgucaugaucaccggcgacaacaagggcaccgccgucgccaucugccgccgccucggcaucuucggcgacaccgaggacgucgccggcaaggccuacaccggccgcgaguucgacgaccucucccccgagcagcagcgccaggccugccgcaccgcccgcugcuucgcccgcgucgagcccgcccacaagucccgcaucgucgagaaccuccaguccuucaacgagaucaccgccaugaccggcgacggcgucaacgacgcccccgcccucaagaaggccgagaucggcaucgccaugggcuccggcaccgccgucgccaaguccgccgccgagaugguccucuccgacgacaacuucgccuccaucgucgccgccgucgaggagggccgcgccaucuacuccaacaugaagcaguucauccgcuaccucaucuccuccaacgucggcgaggucgucugcaucuuccucaccgccauccucggccuccccgaggcccucauccccguccagcuccucugggucaaccucgucaccgacggccuccccgccaccgcccucggcuucaacccccccgaccucgacaucauggagaagcucccccgcuccccccgcgaggcccucaucuccggcuggcucuucuuccgcuaccucgccaucggcgucuacgucggccucgccaccgucgccgccgccaccuggugguucgucuacgacgccgagggcccccacaucaacuucuaccagcuccgcaacuuccucaagugcuccgaggacaacccccucuucgccggcaucgacugcgaggucuucgagucccgcuuccccaccaccauggcccucuccguccucgucaccaucgagaugugcaacgcccucaacuccgucuccgagaaccagucccuccuccgcaugccccccuggaugaaccccuggcuccucgucgccgucgccauguccauggcccuccacuuccucauccuccucguccccccccucccccucaucuuccaggucaccccccucuccggccgccagugggucgucguccuccagaucucccuccccgucauccuccucgacgaggcccucaaguaccucucccgcaaccacaugcacgccugccucuaccccggccuccuccgcaccgucucccaggccuggucccgccagccccucaccaccuccuggacccccgaccacaccggccucgccucccucggccagggccacuccaucgucucccucuccgagcuccuccgcgagggcggcucccgcgaggagaugucccagaaguga

SEQ ID NO: 40093 - RNA, 3663 nt, Artificial Sequence
  derived and/or modified sequence opt2 from ATP2B1__Homo_sapiens__XP_011536710
augggcgacauggccaacaacuccgucgccuacuccggcgucaagaacucccucaaggaggccaaccacgacggcgacuucggcaucacccucgccgagcuccgcgcccucauggagcuccgcuccaccgacgcccuccgcaagauccaggaguccuacggcgacgucuacggcaucugcaccaagcucaagaccucccccaacgagggccucuccggcaaccccgccgaccucgagcgccgcgaggccgucuucggcaagaacuucaucccccccaagaagcccaagaccuuccuccagcucgucugggaggcccuccaggacgucacccucaucauccucgagaucgccgccaucgucucccucggccucuccuucuaccagccccccgagggcgacaacgcccucugcggcgaggucuccgucggcgaggaggagggcgagggcgagaccggcuggaucgagggcgccgccauccuccucuccgucgucugcgucguccucgucaccgccuucaacgacugguccaaggagaagcaguuccgcggccuccagucccgcaucgagcaggagcagaaguucaccgucauccgcggcggccaggucauccagauccccgucgccgacaucaccgucggcgacaucgcccaggucaaguacggcgaccuccuccccgccgacggcauccucauccagggcaacgaccucaagaucgacgaguccucccucaccggcgaguccgaccacgucaagaagucccucgacaaggacccccuccuccucuccggcacccacgucauggagggcuccggccgcauggucgucaccgccgucggcgucaacucccagaccggcaucaucuucacccuccucggcgccggcggcgaggaggaggagaagaaggacgagaagaagaaggagaagaagaacaagaagcaggacggcgccaucgagaaccgcaacaaggccaaggcccaggacggcgccgccauggagaugcagccccucaaguccgaggagggcggcgacggcgacgagaaggacaagaagaaggccaaccuccccaagaaggagaaguccguccuccagggcaagcucaccaagcucgccguccagaucggcaaggccggccuccucauguccgccaucaccgucaucauccucguccucuacuucgucaucgacaccuucuggguccagaagcgccccuggcucgccgagugcacccccaucuacauccaguacuucgucaaguucuucaucaucggcgucaccguccucgucgucgccguccccgagggccucccccucgccgucaccaucucccucgccuacuccgucaagaagaugaugaaggacaacaaccucguccgccaccucgacgccugcgagaccaugggcaacgccaccgccaucugcuccgacaagaccggcacccucaccaugaaccgcaugaccgucguccaggccuacaucaacgagaagcacuacaagaagguccccgagcccgaggccaucccccccaacauccucuccuaccucgucaccggcaucuccgucaacugcgccuacaccuccaagauccucccccccgagaaggagggcggccucccccgccacgucggcaacaagaccgagugcgcccuccucggccuccuccucgaccucaagcgcgacuaccaggacguccgcaacgagauccccgaggaggcccucuacaaggucuacaccuucaacuccguccgcaaguccauguccaccguccucaagaacuccgacggcuccuaccgcaucuucuccaagggcgccuccgagaucauccucaagaagugcuucaagauccucuccgccaacggcgaggccaaggucuuccgcccccgcgaccgcgacgacaucgucaagaccgucaucgagcccauggccuccgagggccuccgcaccaucugccucgccuuccgcgacuuccccgccggcgagcccgagcccgagugggacaacgagaacgacaucgucaccggccucaccugcaucgccgucgucggcaucgaggaccccguccgccccgagguccccgacgccaucaagaagugccagcgcgccggcaucaccguccgcauggucaccggcgacaacaucaacaccgcccgcgccaucgccaccaagugcggcauccuccaccccggcgaggacuuccucugccucgagggcaaggacuucaaccgccgcauccgcaacgagaagggcgagaucgagcaggagcgcaucgacaagaucuggcccaagcuccgcguccucgcccgcuccucccccaccgacaagcacacccucgucaagggcaucaucgacuccaccgucuccgaccagcgccaggucgucgccgucaccggcgacggcaccaacgacggccccgcccucaagaaggccgacgucggcuucgccaugggcaucgccggcaccgacgucgccaaggaggccuccgacaucauccucaccgacgacaacuucaccuccaucgucaaggccgucauguggggccgcaacgucuacgacuccaucuccaaguuccuccaguuccagcucaccgucaacgucgucgccgucaucgucgccuucaccggcgccugcaucacccaggacuccccccucaaggccguccagaugcucugggucaaccucaucauggacacccucgccucccucgcccucgccaccgagccccccaccgagucccuccuccuccgcaagcccuacggccgcaacaagccccucaucucccgcaccaugaugaagaacauccucggccacgccuucuaccagcucgucgucgucuucacccuccucuucgccggcgagaaguucuucgacaucgacuccggccgcaacgccccccuccacgccccccccuccgagcacuacaccaucgucuucaacaccuucguccucaugcagcucuucaacgagaucaacgcccgcaagauccacggcgagcgcaacgucuucgagggcaucuucaacaacgccaucuucugcaccaucguccucggcaccuucgucguccagaucaucaucguccaguucggcggcaagcccuucuccugcuccgagcucuccaucgagcaguggcucugguccaucuuccucggcaugggcacccuccucuggggccagcucaucuccaccauccccaccucccgccucaaguuccucaaggaggccggccacggcacccagaaggaggagauccccgaggaggagcucgccgaggacgucgaggagaucgaccacgccgagcgcgagcuccgccgcggccagauccucugguuccgcggccucaaccgcauccagacccagauccgcgucgucaacgccuuccgcuccucccucuacgagggccucgagaagcccgagucccgcuccuccauccacaacuucaugacccaccccgaguuccgcaucgaggacuccgagccccacaucccccucaucgacgacaccgacgccgaggacgacgcccccaccaagcgcaacuccucccccccccccucccccaacaagaacaacaacgccgucgacuccggcauccaccucaccaucgagaugaacaaguccgccaccuccuccucccccggcuccccccuccacucccucgagaccucccucuga

SEQ ID NO: 40094 - RNA, 3732 nt, Artificial Sequence
  derived and/or modified sequence opt2 from ATP2B2__Homo_sapiens__NP_001001331
augggcgacaugaccaacuccgacuucuacuccaagaaccagcgcaacgaguccucccacggcggcgaguucggcugcaccauggaggagcuccgcucccucauggagcuccgcggcaccgaggccgucgucaagaucaaggagaccuacggcgacaccgaggccaucugccgccgccucaagaccucccccgucgagggccuccccggcaccgcccccgaccucgagaagcgcaagcagaucuucggccagaacuucaucccccccaagaagcccaagaccuuccuccagcucgucugggaggcccuccaggacgucacccucaucauccucgagaucgccgccaucaucucccucggccucuccuucuaccacccccccggcgagggcaacgagggcugcgccaccgcccagggcggcgccgaggacgagggcgaggccgaggccggcuggaucgagggcgccgccauccuccucuccgucaucugcgucguccucgucaccgccuucaacgacugguccaaggagaagcaguuccgcggccuccagucccgcaucgagcaggagcagaaguucaccgucguccgcgccggccaggucguccagauccccgucgccgagaucgucgucggcgacaucgcccaggucaaguacggcgaccuccuccccgccgacggccucuucauccagggcaacgaccucaagaucgacgaguccucccucaccggcgaguccgaccagguccgcaaguccgucgacaaggaccccaugcuccucuccggcacccacgucauggagggcuccggccgcaugcucgucaccgccgucggcgucaacucccagaccggcaucaucuucacccuccucggcgccggcggcgaggaggaggagaagaaggacaagaagggcgucaagaagggcgacggccuccagcuccccgccgccgacggcgccgccgccuccaacgccgccgacuccgccaacgccucccucgucaacggcaagaugcaggacggcaacgucgacgccucccaguccaaggccaagcagcaggacggcgccgccgccauggagaugcagccccucaaguccgccgagggcggcgacgccgacgaccgcaagaaggccuccaugcacaagaaggagaaguccguccuccagggcaagcucaccaagcucgccguccagaucggcaaggccggccucgucauguccgccaucaccgucaucauccucguccucuacuucaccgucgacaccuucgucgucaacaagaagcccuggcuccccgagugcacccccgucuacguccaguacuucgucaaguucuucaucaucggcgucaccguccucgucgucgccguccccgagggccucccccucgccgucaccaucucccucgccuacuccgucaagaagaugaugaaggacaacaaccucguccgccaccucgacgccugcgagaccaugggcaacgccaccgccaucugcuccgacaagaccggcacccucaccaccaaccgcaugaccgucguccaggccuacgucggcgacguccacuacaaggagauccccgaccccuccuccaucaacaccaagaccauggagcuccucaucaacgccaucgccaucaacuccgccuacaccaccaagauccucccccccgagaaggagggcgcccucccccgccaggucggcaacaagaccgagugcggccuccucggcuucguccucgaccucaagcaggacuacgagcccguccgcucccagaugcccgaggagaagcucuacaaggucuacaccuucaacuccguccgcaaguccauguccaccgucaucaagcuccccgacgaguccuuccgcauguacuccaagggcgccuccgagaucguccucaagaagugcugcaagauccucaacggcgccggcgagccccgcgucuuccgcccccgcgaccgcgacgagauggucaagaaggucaucgagcccauggccugcgacggccuccgcaccaucugcgucgccuaccgcgacuuccccuccucccccgagcccgacugggacaacgagaacgacauccucaacgagcucaccugcaucugcgucgucggcaucgaggaccccguccgccccgagguccccgaggccauccgcaagugccagcgcgccggcaucaccguccgcauggucaccggcgacaacaucaacaccgcccgcgccaucgccaucaagugcggcaucauccaccccggcgaggacuuccucugccucgagggcaaggaguucaaccgccgcauccgcaacgagaagggcgagaucgagcaggagcgcaucgacaagaucuggcccaagcuccgcguccucgcccgcuccucccccaccgacaagcacacccucgucaagggcaucaucgacuccacccacaccgagcagcgccaggucgucgccgucaccggcgacggcaccaacgacggccccgcccucaagaaggccgacgucggcuucgccaugggcaucgccggcaccgacgucgccaaggaggccuccgacaucauccucaccgacgacaacuucuccuccaucgucaaggccgucauguggggccgcaacgucuacgacuccaucuccaaguuccuccaguuccagcucaccgucaacgucgucgccgucaucgucgccuucaccggcgccugcaucacccaggacuccccccucaaggccguccagaugcucugggucaaccucaucauggacaccuucgccucccucgcccucgccaccgagccccccaccgagacccuccuccuccgcaagcccuacggccgcaacaagccccucaucucccgcaccaugaugaagaacauccucggccacgccgucuaccagcucgcccucaucuucacccuccucuucgucggcgagaagauguuccagaucgacuccggccgcaacgccccccuccacuccccccccuccgagcacuacaccaucaucuucaacaccuucgucaugaugcagcucuucaacgagaucaacgcccgcaagauccacggcgagcgcaacgucuucgacggcaucuuccgcaaccccaucuucugcaccaucguccucggcaccuucgccauccagaucgucaucguccaguucggcggcaagcccuucuccugcuccccccuccagcucgaccaguggauguggugcaucuucaucggccucggcgagcucgucuggggccaggucaucgccaccauccccaccucccgccucaaguuccucaaggaggccggccgccucacccagaaggaggagauccccgaggaggagcucaacgaggacgucgaggagaucgaccacgccgagcgcgagcuccgccgcggccagauccucugguuccgcggccucaaccgcauccagacccagauccgcgucgucaaggccuuccgcuccucccucuacgagggccucgagaagcccgagucccgcaccuccauccacaacuucauggcccaccccgaguuccgcaucgaggacucccagccccacaucccccucaucgacgacaccgaccucgaggaggacgccgcccucaagcagaacuccuccccccccuccucccucaacaagaacaacuccgccaucgacuccggcaucaaccucaccaccgacaccuccaaguccgccaccuccuccucccccggcucccccauccacucccucgagaccucccucuga

SEQ ID NO: 40095 - RNA, 3663 nt, Artificial Sequence
  derived and/or modified sequence opt2 from ATP2B3__Homo_sapiens__XP_005274747
augggcgacauggccaacuccuccaucgaguuccaccccaagccccagcagcagcgcgacgucccccaggccggcggcuucggcugcacccucgccgagcuccgcacccucauggagcuccgcggcgccgaggcccuccagaagaucgaggaggccuacggcgacgucuccggccucugccgccgccucaagaccucccccaccgagggccucgccgacaacaccaacgaccucgagaagcgccgccagaucuacggccagaacuucaucccccccaagcagcccaagaccuuccuccagcucgucugggaggcccuccaggacgucacccucaucauccucgaggucgccgccaucgucucccucggccucuccuucuacgccccccccggcgaggaguccgaggccugcggcaacgucuccggcggcgccgaggacgagggcgaggccgaggccggcuggaucgagggcgccgccauccuccucuccgucaucugcgucguccucgucaccgccuucaacgacugguccaaggagaagcaguuccgcggccuccagucccgcaucgagcaggagcagaaguucaccgucauccgcaacggccagcuccuccagguccccgucgccgcccucgucgucggcgacaucgcccaggucaaguacggcgaccuccuccccgccgacggcguccucauccaggccaacgaccucaagaucgacgaguccucccucaccggcgaguccgaccacguccgcaaguccgccgacaaggaccccaugcuccucuccggcacccacgucauggagggcuccggccgcauggucgucaccgccgucggcgucaacucccagaccggcaucaucuucacccuccucggcgccggcggcgaggaggaggagaagaaggacaagaagggcaagcagcaggacggcgccauggaguccucccagaccaaggccaagaagcaggacggcgccgucgccauggagaugcagccccucaaguccgccgagggcggcgagauggaggagcgcgagaagaagaaggccaacgcccccaagaaggagaaguccguccuccagggcaagcucaccaagcucgccguccagaucggcaaggccggccucgucauguccgccaucaccgucaucauccucguccucuacuucgucaucgagaccuucgucgucgagggccgcaccuggcucgccgagugcacccccgucuacguccaguacuucgucaaguucuucaucaucggcgucaccguccucgucgucgccguccccgagggccucccccucgccgucaccaucucccucgccuacuccgucaagaagaugaugaaggacaacaaccucguccgccaccucgacgccugcgagaccaugggcaacgccaccgccaucugcuccgacaagaccggcacccucaccaccaaccgcaugaccgucguccaguccuaccucggcgacacccacuacaaggagauccccgcccccuccgcccucacccccaagauccucgaccuccucguccacgccaucuccaucaacuccgccuacaccaccaagauccucccccccgagaaggagggcgcccucccccgccaggucggcaacaagaccgagugcgcccuccucggcuucguccucgaccucaagcgcgacuuccagcccguccgcgagcagauccccgaggacaagcucuacaaggucuacaccuucaacuccguccgcaaguccauguccaccgucauccgcaugcccgacggcggcuuccgccucuucuccaagggcgccuccgagauccuccucaagaagugcaccaacauccucaacuccaacggcgagcuccgcggcuuccgcccccgcgaccgcgacgacaugguccgcaagaucaucgagcccauggccugcgacggccuccgcaccaucugcaucgccuaccgcgacuucuccgccggccaggagcccgacugggacaacgagaacgaggucgucggcgaccucaccugcaucgccgucgucggcaucgaggaccccguccgccccgagguccccgaggccauccgcaagugccagcgcgccggcaucaccguccgcauggucaccggcgacaacaucaacaccgcccgcgccaucgccgccaagugcggcaucauccagcccggcgaggacuuccucugccucgagggcaaggaguucaaccgccgcauccgcaacgagaagggcgagaucgagcaggagcgccucgacaaggucuggcccaagcuccgcguccucgcccgcuccucccccaccgacaagcacacccucgucaagggcaucaucgacuccaccaccggcgagcagcgccaggucgucgccgucaccggcgacggcaccaacgacggccccgcccucaagaaggccgacgucggcuucgccaugggcaucgccggcaccgacgucgccaaggaggccuccgacaucauccucaccgacgacaacuucaccuccaucgucaaggccgucauguggggccgcaacgucuacgacuccaucuccaaguuccuccaguuccagcucaccgucaacgucgucgccgucaucgucgccuucaccggcgccugcaucacccaggacuccccccucaaggccguccagaugcucugggucaaccucaucauggacaccuucgccucccucgcccucgccaccgagccccccaccgagucccuccuccuccgcaagcccuacggccgcgacaagccccucaucucccgcaccaugaugaagaacauccucggccacgccgucuaccagcucgccaucaucuucacccuccucuucgucggcgagcucuucuucgacaucgacuccggccgcaacgccccccuccacuccccccccuccgagcacuacaccaucaucuucaacaccuucgucaugaugcagcucuucaacgagaucaacgcccgcaagauccacggcgagcgcaacgucuucgacggcaucuucuccaaccccaucuucugcaccaucguccucggcaccuucggcauccagaucgucaucguccaguucggcggcaagcccuucuccugcuccccccucuccaccgagcaguggcucuggugccucuucgucggcgucggcgagcucgucuggggccaggucaucgccaccauccccaccucccagcucaagugccucaaggaggccggccacggccccggcaaggacgagaugaccgacgaggagcucgccgagggcgaggaggagaucgaccacgccgagcgcgagcuccgccgcggccagauccucugguuccgcggccucaaccgcauccagacccagauccgcgucgucaaggccuuccgcuccucccucuacgagggccucgagaagcccgaguccaagaccuccauccacaacuucauggccacccccgaguuccucaucaacgacuacacccacaacaucccccucaucgacgacaccgacgucgacgagaacgaggagcgccuccgcgccccccccccccccucccccaaccagaacaacaacgccaucgacuccggcaucuaccucaccacccacgucaccaaguccgccaccuccuccgucuucuccuccucccccggcuccccccuccacuccgucgagaccucccucuga

SEQ ID NO: 40096 - RNA, 3513 nt, Artificial Sequence
  derived and/or modified sequence opt2 from ATP2B4__Homo_sapiens__NP_001001396
augaccaaccccuccgaccgcguccuccccgccaacuccauggccgagucccgcgagggcgacuucggcugcaccgucauggagcuccgcaagcucauggagcuccgcucccgcgacgcccucacccagaucaacguccacuacggcggcguccagaaccucugcucccgccucaagaccucccccgucgagggccucuccggcaaccccgccgaccucgagaagcgccgccaggucuucggccacaacgucaucccccccaagaagcccaagaccuuccucgagcucgucugggaggcccuccaggacgucacccucaucauccucgagaucgccgccaucaucucccucguccucuccuucuaccgccccgccggcgaggagaacgagcucugcggccaggucgccaccacccccgaggacgagaacgaggcccaggccggcuggaucgagggcgccgccauccucuucuccgucaucaucgucguccucgucaccgccuucaacgacugguccaaggagaagcaguuccgcggccuccagugccgcaucgagcaggagcagaaguucuccaucauccgcaacggccagcucauccagcuccccgucgccgagaucgucgucggcgacaucgcccaggucaaguacggcgaccuccuccccgccgacggcauccucauccagggcaacgaccucaagaucgacgaguccucccucaccggcgaguccgaccacgucaagaagucccucgacaaggaccccaugcuccucuccggcacccacgucauggagggcuccggccgcauggucgucaccgccgucggcgucaacucccagaccggcaucauccucacccuccucggcgucaacgaggacgacgagggcgagaagaagaagaagggcaagaagcagggcguccccgagaaccgcaacaaggccaagacccaggacggcgucgcccucgagauccagccccucaacucccaggagggcaucgacaacgaggagaaggacaagaaggccgucaagguccccaagaaggagaaguccguccuccagggcaagcucacccgccucgccguccagaucggcaaggccggccuccucauguccgcccucaccgucuucauccucauccucuacuucgucaucgacaacuucgucaucaaccgccgccccuggcuccccgagugcacccccaucuacauccaguacuucgucaaguucuucaucaucggcaucaccguccucgucgucgccguccccgagggccucccccucgccgucaccaucucccucgccuacuccgucaagaagaugaugaaggacaacaaccucguccgccaccucgacgccugcgagaccaugggcaacgccaccgccaucugcuccgacaagaccggcacccucaccaugaaccgcaugaccgucguccaggccuacaucggcggcauccacuaccgccagauccccucccccgacgucuuccuccccaagguccucgaccucaucgucaacggcaucuccaucaacuccgccuacaccuccaagauccucccccccgagaaggagggcggccucccccgccaggucggcaacaagaccgagugcgcccuccucggcuucgucaccgaccucaagcaggacuaccaggccguccgcaacgagguccccgaggagaagcucuacaaggucuacaccuucaacuccguccgcaaguccauguccaccgucauccgcaaccccaacggcggcuuccgcauguacuccaagggcgccuccgagaucauccuccgcaagugcaaccgcauccucgaccgcaagggcgaggccguccccuucaagaacaaggaccgcgacgacaugguccgcaccgucaucgagcccauggccugcgacggccuccgcaccaucugcaucgccuaccgcgacuucgacgacaccgagcccuccugggacaacgagaacgagauccucaccgagcucaccugcaucgccgucgucggcaucgaggaccccguccgccccgagguccccgacgccaucgccaagugcaagcaggccggcaucaccguccgcauggucaccggcgacaacaucaacaccgcccgcgccaucgccaccaagugcggcauccucacccccggcgacgacuuccucugccucgagggcaaggaguucaaccgccucauccgcaacgagaagggcgaggucgagcaggagaagcucgacaagaucuggcccaagcuccgcguccucgcccgcuccucccccaccgacaagcacacccucgucaagggcaucaucgacuccaccgucggcgagcaccgccaggucgucgccgucaccggcgacggcaccaacgacggccccgcccucaagaaggccgacgucggcuucgccaugggcaucgccggcaccgacgucgccaaggaggccuccgacaucauccucaccgacgacaacuucaccuccaucgucaaggccgucauguggggccgcaacgucuacgacuccaucuccaaguuccuccaguuccagcucaccgucaacgucgucgccgucaucgucgccuucaccggcgccugcaucacccaggacuccccccucaaggccguccagaugcucugggucaaccucaucauggacaccuucgccucccucgcccucgccaccgagccccccaccgagucccuccucaagcgccgccccuacggccgcaacaagccccucaucucccgcaccaugaugaagaacauccucggccacgccuucuaccagcucaucgucaucuucauccucgucuucgccggcgagaaguucuucgacaucgacuccggccgcaaggccccccuccacuccccccccucccagcacuacaccaucgucuucaacaccuucguccucaugcagcucuucaacgagaucaacucccgcaagauccacggcgagaagaacgucuucuccggcaucuaccgcaacaucaucuucugcuccgucguccucggcaccuucaucugccagaucuucaucgucgaguucggcggcaagcccuucuccugcaccucccucucccucucccaguggcucuggugccucuucaucggcaucggcgagcuccucuggggccaguucaucuccgccauccccacccgcucccucaaguuccucaaggaggccggccacggcaccaccaaggaggagaucaccaaggacgccgagggccucgacgagaucgaccacgccgagauggagcuccgccgcggccagauccucugguuccgcggccucaaccgcauccagacccagaucgacgucaucaacaccuuccagaccggcgccuccuucaagggcguccuccgccgccagaacaugggccagcaccucgacgucaagcucguccccuccuccuccuacgucgccgucgcccccgucaaguccucccccaccaccuccguccccgccgucuccuccccccccaugggcaaccaguccggccaguccguccccuga

SEQ ID NO: 40097 - RNA, 2850 nt, Artificial Sequence
  derived and/or modified sequence opt2 from ATP2C1__Homo_sapiens__NP_001001486
augaaggucgcccgcuuccagaagauccccaacggcgagaacgagaccaugauccccguccucaccuccaagaaggccuccgagcuccccgucuccgaggucgccuccauccuccaggccgaccuccagaacggccucaacaagugcgaggucucccaccgccgcgccuuccacggcuggaacgaguucgacaucuccgaggacgagccccucuggaagaaguacaucucccaguucaagaacccccucaucaugcuccuccucgccuccgccgucaucuccguccucaugcaccaguucgacgacgccgucuccaucaccgucgccauccucaucgucgucaccgucgccuucguccaggaguaccgcuccgagaagucccucgaggagcucuccaagcucgucccccccgagugccacugcguccgcgagggcaagcucgagcacacccucgcccgcgaccucguccccggcgacaccgucugccucuccgucggcgaccgcguccccgccgaccuccgccucuucgaggccgucgaccucuccaucgacgaguccucccucaccggcgagaccacccccugcuccaaggucaccgccccccagcccgccgccaccaacggcgaccucgccucccgcuccaacaucgccuucaugggcacccucguccgcugcggcaaggccaagggcgucgucaucggcaccggcgagaacuccgaguucggcgaggucuucaagaugaugcaggccgaggaggcccccaagaccccccuccagaaguccauggaccuccucggcaagcagcucuccuucuacuccuucggcaucaucggcaucaucaugcucgucggcuggcuccucggcaaggacauccucgagauguucaccaucuccgucucccucgccgucgccgccauccccgagggccuccccaucgucgucaccgucacccucgcccucggcgucaugcgcauggucaagaagcgcgccaucgucaagaagcuccccaucgucgagacccucggcugcugcaacgucaucugcuccgacaagaccggcacccucaccaagaacgagaugaccgucacccacaucuucaccuccgacggccuccacgccgaggucaccggcgucggcuacaaccaguucggcgaggucaucgucgacggcgacgucguccacggcuucuacaaccccgccgucucccgcaucgucgaggccggcugcgucugcaacgacgccgucauccgcaacaacacccucaugggcaagcccaccgagggcgcccucaucgcccucgccaugaagaugggccucgacggccuccagcaggacuacauccgcaaggccgaguaccccuucuccuccgagcagaaguggauggccgucaagugcguccaccgcacccagcaggaccgccccgagaucugcuucaugaagggcgccuacgagcaggucaucaaguacugcaccaccuaccaguccaagggccagacccucacccucacccagcagcagcgcgacgucuaccagcaggagaaggcccgcaugggcuccgccggccuccgcguccucgcccucgccuccggccccgagcucggccagcucaccuuccucggccucgucggcaucaucgaccccccccgcaccggcgucaaggaggccgucaccacccucaucgccuccggcgucuccaucaagaugaucaccggcgacucccaggagaccgccgucgccaucgccucccgccucggccucuacuccaagaccucccaguccgucuccggcgaggagaucgacgccauggacguccagcagcucucccagaucguccccaaggucgccgucuucuaccgcgccuccccccgccacaagaugaagaucaucaagucccuccagaagaacggcuccgucgucgccaugaccggcgacggcgucaacgacgccgucgcccucaaggccgccgacaucggcgucgccaugggccagaccggcaccgacgucugcaaggaggccgccgacaugauccucgucgacgacgacuuccagaccaucauguccgccaucgaggagggcaagggcaucuacaacaacaucaagaacuucguccgcuuccagcucuccaccuccaucgccgcccucacccucaucucccucgccacccucaugaacuuccccaacccccucaacgccaugcagauccucuggaucaacaucaucauggacggcccccccgcccagucccucggcgucgagcccgucgacaaggacgucauccgcaagcccccccgcaacuggaaggacuccauccucaccaagaaccucauccucaagauccucgucuccuccaucaucaucgucugcggcacccucuucgucuucuggcgcgagcuccgcgacaacgucaucaccccccgcgacaccaccaugaccuucaccugcuucgucuucuucgacauguucaacgcccucuccucccgcucccagaccaaguccgucuucgagaucggccucugcuccaaccgcauguucugcuacgccguccucggcuccaucaugggccagcuccucgucaucuacuuccccccccuccagaaggucuuccagaccgagucccucuccauccucgaccuccucuuccuccucggccucaccuccuccgucugcaucgucgccgagaucaucaagaaggucgagcgcucccgcgagaagauccagaagcacgucuccuccaccuccuccuccuuccucgaggucuggcucugggagcgcuccggccagcagcucgucgagauccacccccaccucgagaccggccucccccucaccgaggacgucuccugcgucuga

SEQ ID NO: 40098 - RNA, 2928 nt, Artificial Sequence
  derived and/or modified sequence opt2 from ATP2C2__Homo_sapiens__NP_001273456
auggucgagggccgcgucuccgaguuccucaagaagcucggcuucuccggcggcggccgccaguaccaggcccucgagaaggacgaggaggaggcccucaucgacgagcaguccgagcucaaggccaucgagaaggagaagaaggucaccgcccucccccccaaggaggccugcaagugccagaaggaggaccucgcccgcgccuucugcgucgaccuccacaccggccucuccgaguucuccgucacccagcgccgccucgcccacggcuggaacgaguucgucgccgacaacuccgagcccgucuggaagaaguaccucgaccaguucaagaacccccucauccuccuccuccucggcuccgcccucgucuccguccucaccaaggaguacgaggacgccgucuccaucgccaccgccguccucgucgucgucaccgucgccuucauccaggaguaccgcuccgagaagucccucgaggagcucaccaagcucgucccccccgagugcaacugccuccgcgagggcaagcuccagcaccuccucgcccgcgagcucguccccggcgacgucgucucccucuccaucggcgaccgcauccccgccgacauccgccucaccgaggucaccgaccuccucgucgacgaguccuccuucaccggcgaggccgagcccugcuccaagaccgacuccccccucaccggcggcggcgaccucaccacccucuccaacaucgucuucaugggcacccucguccaguacggccgcggccagggcgucgucaucggcaccggcgaguccucccaguucggcgaggucuucaagaugaugcaggccgaggagacccccaagaccccccuccagaaguccauggaccgccucggcaagcagcucacccucuucuccuucggcaucaucggccucaucaugcucaucggcuggucccagggcaagcagcuccucuccauguucaccaucggcgucucccucgccgucgccgccauccccgagggccuccccaucgucgucauggucacccucguccucggcguccuccgcauggccaagaagcgcgucaucgucaagaagcuccccaucgucgagacccucggcugcugcuccguccucugcuccgacaagaccggcacccucaccgccaacgagaugaccgucacccagcucgucaccuccgacggccuccgcgccgaggucuccggcgucggcuacgacggccagggcaccgucugccuccuccccuccaaggaggucaucaaggaguucuccaacgucuccgucggcaagcucgucgaggccggcugcgucgccaacaacgccgucauccgcaagaacgccgucaugggccagcccaccgagggcgcccucauggcccucgccaugaagauggaccucuccgacaucaagaacuccuacauccgcaagaaggagauccccuucuccuccgagcagaaguggauggccgucaagugcucccucaagaccgaggaccaggaggacaucuacuucaugaagggcgcccucgaggaggucauccgcuacugcaccauguacaacaacggcggcaucccccucccccucaccccccagcagcgcuccuucugccuccaggaggagaagcgcaugggcucccucggccuccgcguccucgcccucgccuccggccccgagcucggccgccucaccuuccucggccucgucggcaucaucgaccccccccgcgucggcgucaaggaggccguccagguccucuccgaguccggcgucuccgucaagaugaucaccggcgacgcccucgagaccgcccucgccaucggccgcaacaucggccucugcaacggcaagcuccaggccauguccggcgaggaggucgacuccgucgagaagggcgagcucgccgaccgcgucggcaaggucuccgucuucuuccgcaccucccccaagcacaagcucaagaucaucaaggcccuccaggaguccggcgccaucgucgccaugaccggcgacggcgucaacgacgccgucgcccucaaguccgccgacaucggcaucgccaugggccagaccggcaccgacgucuccaaggaggccgccaacaugauccucgucgacgacgacuucuccgccaucaugaacgccgucgaggagggcaagggcaucuucuacaacaucaagaacuucguccgcuuccagcucuccaccuccaucuccgcccucucccucaucacccucuccaccgucuucaaccuccccuccccccucaacgccaugcagauccucuggaucaacaucaucauggacggcccccccgcccagcgcuccucccagaagaccgaggucugcugcaccgccguccgccucggcgucgagggccgcggcgaguccaccugggccggccgcgccggccucggcgucgagcccgucgacaaggacgccuuccgccagcccccccgcuccguccgcgacaccauccucucccgcgcccucauccucaagauccucauguccgccgccaucaucaucuccggcacccucuucaucuucuggaaggagaugcccgaggaccgcgccuccaccccccgcaccaccaccaugaccuucaccugcuucgucuucuucgaccucuucaacgcccucaccugccgcucccagaccaagcucaucuucgagaucggcuuccuccgcaaccacauguuccucuacuccguccucggcuccauccucggccagcucgccgucaucuacauccccccccuccagcgcgucuuccagaccgagaaccucggcgcccucgaccuccucuuccucaccggccucgccuccuccgucuucauccucuccgagcuccucaagcucugcgagaaguacugcugcucccccaagcgcguccagaugcaccccgaggacgucuga

SEQ ID NO: 40099 - RNA, 3108 nt, Artificial Sequence
  derived and/or modified sequence opt2 from ATP4A__Homo_sapiens__NP_000695
augggcaaggccgagaacuacgagcucuacuccgucgagcucggccccggccccggcggcgacauggccgccaagauguccaagaagaagaaggccggcggcggcggcggcaagcgcaaggagaagcucgagaacaugaagaaggagauggagaucaacgaccaccagcucuccgucgccgagcucgagcagaaguaccagaccuccgccaccaagggccucuccgccucccucgccgccgagcuccuccuccgcgacggccccaacgcccuccgccccccccgcggcacccccgaguacgucaaguucgcccgccagcucgccggcggccuccagugccucaugugggucgccgccgccaucugccucaucgccuucgccauccaggccuccgagggcgaccucaccaccgacgacaaccucuaccucgccaucgcccucaucgccgucgucgucgucaccggcugcuucggcuacuaccaggaguucaaguccaccaacaucaucgccuccuucaagaaccucgucccccagcaggccaccgucauccgcgacggcgacaaguuccagaucaacgccgaccagcucgucgucggcgaccucgucgagaugaagggcggcgaccgcguccccgccgacauccgcauccucgccgcccagggcugcaaggucgacaacuccucccucaccggcgaguccgagccccagacccgcucccccgagugcacccacgaguccccccucgagacccgcaacaucgccuucuucuccaccaugugccucgagggcaccguccagggccucgucgucaacaccggcgaccgcaccaucaucggccgcaucgccucccucgccuccggcgucgagaacgagaagacccccaucgccaucgagaucgagcacuucgucgacaucaucgccggccucgccauccucuucggcgccaccuucuucaucgucgccaugugcaucggcuacaccuuccuccgcgccauggucuucuucauggccaucgucgucgccuacguccccgagggccuccucgccaccgucaccgucugccucucccucaccgccaagcgccucgccuccaagaacugcgucgucaagaaccucgaggccgucgagacccucggcuccaccuccgucaucugcuccgacaagaccggcacccucacccagaaccgcaugaccgucucccaccucugguucgacaaccacauccacaccgccgacaccaccgaggaccaguccggccagaccuucgaccaguccuccgagaccuggcgcgcccucugccgcguccucacccucugcaaccgcgccgccuucaaguccggccaggacgccguccccguccccaagcgcaucgucaucggcgacgccuccgagaccgcccuccucaaguucuccgagcucacccucggcaacgccaugggcuaccgcgaccgcuuccccaaggucugcgagauccccuucaacuccaccaacaaguuccagcucuccauccacacccucgaggacccccgcgacccccgccaccuccucgucaugaagggcgcccccgagcgcguccucgagcgcugcuccuccauccucaucaagggccaggagcucccccucgacgagcaguggcgcgaggccuuccagaccgccuaccucucccucggcggccucggcgagcgcguccucggcuucugccagcucuaccucaacgagaaggacuacccccccggcuacgccuucgacgucgaggccaugaacuuccccuccuccggccucugcuucgccggccucgucuccaugaucgaccccccccgcgccaccguccccgacgccguccucaagugccgcaccgccggcauccgcgucaucauggucaccggcgaccaccccaucaccgccaaggccaucgccgccuccgucggcaucaucuccgagggcuccgagaccgucgaggacaucgccgcccgccuccgcguccccgucgaccaggucaaccgcaaggacgcccgcgccugcgucaucaacggcaugcagcucaaggacauggaccccuccgagcucgucgaggcccuccgcacccaccccgagauggucuucgcccgcaccuccccccagcagaagcucgucaucgucgaguccugccagcgccucggcgccaucgucgccgucaccggcgacggcgucaacgacucccccgcccucaagaaggccgacaucggcgucgccaugggcaucgccggcuccgacgccgccaagaacgccgccgacaugauccuccucgacgacaacuucgccuccaucgucaccggcgucgagcagggccgccucaucuucgacaaccucaagaaguccaucgccuacacccucaccaagaacauccccgagcucacccccuaccucaucuacaucaccgucuccgucccccucccccucggcugcaucaccauccucuucaucgagcucugcaccgacaucuuccccuccgucucccucgccuacgagaaggccgaguccgacaucaugcaccuccgcccccgcaaccccaagcgcgaccgccucgucaacgagccccucgccgccuacuccuacuuccagaucggcgccauccaguccuucgccggcuucaccgacuacuucaccgccauggcccaggagggcugguucccccuccucugcgucggccuccgcgcccagugggaggaccaccaccuccaggaccuccaggacuccuacggccaggaguggaccuucggccagcgccucuaccagcaguacaccugcuacaccgucuucuucaucuccaucgaggucugccagaucgccgacguccucauccgcaagacccgccgccucuccgccuuccagcagggcuucuuccgcaacaagauccucgucaucgccaucgucuuccaggucugcaucggcugcuuccucugcuacugccccggcaugcccaacaucuucaacuucaugcccauccgcuuccagugguggcucgucccccuccccuacggcauccucaucuucgucuacgacgagauccgcaagcucggcguccgcugcugccccggcuccuggugggaccaggagcucuacuacuga

SEQ ID NO: 40100 - RNA, 876 nt, Artificial Sequence
  derived and/or modified sequence opt2 from ATP4B__Homo_sapiens__NP_000696
auggccgcccuccaggagaagaagaccugcggccagcgcauggaggaguuccagcgcuacugcuggaaccccgacaccggccagaugcucggccgcacccucucccgcugggucuggaucucccucuacuacgucgccuucuacgucgucaugaccggccucuucgcccucugccucuacguccucaugcagaccgucgaccccuacacccccgacuaccaggaccagcuccgcucccccggcgucacccuccgccccgacgucuacggcgagaagggccucgagaucgucuacaacgucuccgacaaccgcaccugggccgaccucacccagacccuccacgccuuccucgccggcuacucccccgccgcccaggaggacuccaucaacugcaccuccgagcaguacuucuuccaggaguccuuccgcgcccccaaccacaccaaguucuccugcaaguucaccgccgacaugcuccagaacugcuccggccucgccgaccccaacuucggcuucgaggagggcaagcccugcuucaucaucaagaugaaccgcaucgucaaguuccuccccuccaacggcuccgccccccgcgucgacugcgccuuccucgaccagccccgcgagcucggccagccccuccaggucaaguacuacccccccaacggcaccuucucccuccacuacuuccccuacuacggcaagaaggcccagccccacuacuccaacccccucgucgccgccaagcuccucaacaucccccgcaacgccgaggucgccaucgucugcaaggucauggccgagcacgucaccuucaacaacccccacgaccccuacgagggcaaggucgaguucaagcucaagaucgagaaguga

SEQ ID NO: 40101 - RNA, 1662 nt, Artificial Sequence
  derived and/or modified sequence opt2 from ATP5A1__Homo_sapiens__NP_001001937
augcucuccguccgcgucgccgccgccgucguccgcgcccucccccgccgcgccggccucgucucccgcaacgcccucggcuccuccuucaucgccgcccgcaacuuccacgccuccaacacccaccuccagaagaccggcaccgccgagauguccuccauccucgaggagcgcauccucggcgccgacaccuccgucgaccucgaggagaccggccgcguccucuccaucggcgacggcaucgcccgcguccacggccuccgcaacguccaggccgaggagauggucgaguucuccuccggccucaagggcaugucccucaaccucgagcccgacaacgucggcgucgucgucuucggcaacgacaagcucaucaaggagggcgacaucgucaagcgcaccggcgccaucgucgacguccccgucggcgaggagcuccucggccgcgucgucgacgcccucggcaacgccaucgacggcaagggccccaucggcuccaagacccgccgccgcgucggccucaaggcccccggcaucaucccccgcaucuccguccgcgagcccaugcagaccggcaucaaggccgucgacucccucguccccaucggccgcggccagcgcgagcucaucaucggcgaccgccagaccggcaagaccuccaucgccaucgacaccaucaucaaccagaagcgcuucaacgacggcuccgacgagaagaagaagcucuacugcaucuacgucgccaucggccagaagcgcuccaccgucgcccagcucgucaagcgccucaccgacgccgacgccaugaaguacaccaucgucgucuccgccaccgccuccgacgccgccccccuccaguaccucgcccccuacuccggcugcuccaugggcgaguacuuccgcgacaacggcaagcacgcccucaucaucuacgacgaccucuccaagcaggccgucgccuaccgccagaugucccuccuccuccgccgcccccccggccgcgaggccuaccccggcgacgucuucuaccuccacucccgccuccucgagcgcgccgccaagaugaacgacgccuucggcggcggcucccucaccgcccuccccgucaucgagacccaggccggcgacgucuccgccuacauccccaccaacgucaucuccaucaccgacggccagaucuuccucgagaccgagcucuucuacaagggcauccgccccgccaucaacgucggccucuccgucucccgcgucggcuccgccgcccagacccgcgccaugaagcaggucgccggcaccaugaagcucgagcucgcccaguaccgcgaggucgccgccuucgcccaguucggcuccgaccucgacgccgccacccagcagcuccucucccgcggcguccgccucaccgagcuccucaagcagggccaguacucccccauggccaucgaggagcaggucgccgucaucuacgccggcguccgcggcuaccucgacaagcucgagcccuccaagaucaccaaguucgagaacgccuuccucucccacgucgucucccagcaccaggcccuccucggcaccauccgcgccgacggcaagaucuccgagcaguccgacgccaagcucaaggagaucgucaccaacuuccucgccggcuucgaggccuga

SEQ ID NO: 40102 - RNA, 1590 nt, Artificial Sequence
  derived and/or modified sequence opt2 from ATP5B__Homo_sapiens__NP_001677
augcucggcuucgucggccgcgucgccgccgcccccgccuccggcgcccuccgccgccucacccccuccgccucccucccccccgcccagcuccuccuccgcgccgcccccaccgccguccaccccguccgcgacuacgccgcccagaccucccccucccccaaggccggcgccgccaccggccgcaucgucgccgucaucggcgccgucgucgacguccaguucgacgagggccucccccccauccucaacgcccucgagguccagggccgcgagacccgccucguccucgaggucgcccagcaccucggcgaguccaccguccgcaccaucgccauggacggcaccgagggccucguccgcggccagaagguccucgacuccggcgcccccaucaagauccccgucggccccgagacccucggccgcaucaugaacgucaucggcgagcccaucgacgagcgcggccccaucaagaccaagcaguucgcccccauccacgccgaggcccccgaguucauggagauguccgucgagcaggagauccucgucaccggcaucaaggucgucgaccuccucgcccccuacgccaagggcggcaagaucggccucuucggcggcgccggcgucggcaagaccguccucaucauggagcucaucaacaacgucgccaaggcccacggcggcuacuccgucuucgccggcgucggcgagcgcacccgcgagggcaacgaccucuaccacgagaugaucgaguccggcgucaucaaccucaaggacgccaccuccaaggucgcccucgucuacggccagaugaacgagccccccggcgcccgcgcccgcgucgcccucaccggccucaccgucgccgaguacuuccgcgaccaggagggccaggacguccuccucuucaucgacaacaucuuccgcuucacccaggccggcuccgaggucuccgcccuccucggccgcauccccuccgccgucggcuaccagcccacccucgccaccgacaugggcaccaugcaggagcgcaucaccaccaccaagaagggcuccaucaccuccguccaggccaucuacguccccgccgacgaccucaccgaccccgcccccgccaccaccuucgcccaccucgacgccaccaccguccucucccgcgccaucgccgagcucggcaucuaccccgccgucgacccccucgacuccaccucccgcaucauggaccccaacaucgucggcuccgagcacuacgacgucgcccgcggcguccagaagauccuccaggacuacaagucccuccaggacaucaucgccauccucggcauggacgagcucuccgaggaggacaagcucaccgucucccgcgcccgcaagauccagcgcuuccucucccagcccuuccaggucgccgaggucuucaccggccacaugggcaagcucgucccccucaaggagaccaucaagggcuuccagcagauccucgccggcgaguacgaccaccuccccgagcaggccuucuacauggucggccccaucgaggaggccgucgccaaggccgacaagcucgccgaggagcacuccuccuga

SEQ ID NO: 40103 - RNA, 897 nt, Artificial Sequence
  derived and/or modified sequence opt2 from ATP5C1__Homo_sapiens__NP_001001973
auguucucccgcgccggcgucgccggccucuccgccuggacccuccagccccaguggauccagguccgcaacauggccacccucaaggacaucacccgccgccucaaguccaucaagaacauccagaagaucaccaaguccaugaagauggucgccgccgccaaguacgcccgcgccgagcgcgagcucaagcccgcccgcaucuacggccucggcucccucgcccucuacgagaaggccgacaucaagggccccgaggacaagaagaagcaccuccucaucggcgucuccuccgaccgcggccucugcggcgccauccacuccuccaucgccaagcagaugaaguccgaggucgccacccucaccgccgccggcaaggaggucaugcucgucggcaucggcgacaagauccgcggcauccucuaccgcacccacuccgaccaguuccucgucgccuucaaggaggucggccgcaagccccccaccuucggcgacgccuccgucaucgcccucgagcuccucaacuccggcuacgaguucgacgagggcuccaucaucuucaacaaguuccgcuccgucaucuccuacaagaccgaggagaagcccaucuucucccucaacaccgucgccuccgccgacuccauguccaucuacgacgacaucgacgccgacguccuccagaacuaccaggaguacaaccucgccaacaucaucuacuacucccucaaggaguccaccaccuccgagcaguccgcccgcaugaccgccauggacaacgccuccaagaacgccuccgagaugaucgacaagcucacccucaccuucaaccgcacccgccaggccgucaucaccaaggagcucaucgagaucaucuccggcgccgccgcccucgacuga

SEQ ID NO: 40104 - RNA, 507 nt, Artificial Sequence
  derived and/or modified sequence opt2 from ATP5D__Homo_sapiens__NP_001001975
augcuccccgccgcccuccuccgccgccccggccucggccgccucguccgccacgcccgcgccuacgccgaggccgccgccgcccccgccgccgccuccggccccaaccagauguccuucaccuucgccucccccacccaggucuucuucaacggcgccaacguccgccaggucgacguccccacccucaccggcgccuucggcauccucgccgcccacguccccacccuccagguccuccgccccggccucgucgucguccacgccgaggacggcaccaccuccaaguacuucgucuccuccggcuccaucgccgucaacgccgacuccuccguccagcuccucgccgaggaggccgucacccucgacaugcucgaccucggcgccgccaaggccaaccucgagaaggcccaggccgagcucgucggcaccgccgacgaggccacccgcgccgagauccagauccgcaucgaggccaacgaggcccucgucaaggcccucgaguga

SEQ ID NO: 40105 - RNA, 156 nt, Artificial Sequence
  derived and/or modified sequence opt2 from ATP5E__Homo_sapiens__NP_008817
auggucgccuacuggcgccaggccggccucuccuacauccgcuacucccagaucugcgccaaggccguccgcgacgcccucaagaccgaguucaaggccaacgccgagaagaccuccggcuccaacgucaagaucgucaaggucaagaaggaguga

SEQ ID NO: 40106 - RNA, 411 nt, Artificial Sequence
  derived and/or modified sequence opt2 from ATP5G1__Homo_sapiens__NP_005166
augcagaccgccggcgcccucuucaucucccccgcccucauccgcugcugcacccgcggccucauccgccccgucuccgccuccuuccucaacucccccgucaacuccuccaagcagcccuccuacuccaacuucccccuccaggucgcccgccgcgaguuccagaccuccgucgucucccgcgacaucgacaccgccgccaaguucaucggcgccggcgccgccaccgucggcgucgccggcuccggcgccggcaucggcaccgucuucggcucccucaucaucggcuacgcccgcaaccccucccucaagcagcagcucuucuccuacgccauccucggcuucgcccucuccgaggccaugggccucuucugccucauggucgccuuccucauccucuucgccauguga

SEQ ID NO: 40107 - RNA, 474 nt, Artificial Sequence
  derived and/or modified sequence opt2 from ATP5G2__Homo_sapiens__NP_001002031
augcccgagcucauccucucccccgccaccgccccccacccccucaagauguucgccugcuccaaguucgucuccacccccucccucgucaaguccaccucccagcuccucucccgcccccucuccgccgucguccucaagcgccccgagauccucaccgacgagucccucuccucccucgccgucuccugcccccucaccucccucgucuccucccgcuccuuccagaccuccgccaucucccgcgacaucgacaccgccgccaaguucaucggcgccggcgccgccaccgucggcgucgccggcuccggcgccggcaucggcaccgucuucggcucccucaucaucggcuacgcccgcaaccccucccucaagcagcagcucuucuccuacgccauccucggcuucgcccucuccgaggccaugggccucuucugccucauggucgccuuccucauccucuucgccauguga

SEQ ID NO: 40108 - RNA, 429 nt, Artificial Sequence
  derived and/or modified sequence opt2 from ATP5G3__Homo_sapiens__NP_001002258
auguucgccugcgccaagcucgccugcacccccucccucauccgcgccggcucccgcgucgccuaccgccccaucuccgccuccguccucucccgccccgaggccucccgcaccggcgagggcuccaccgucuucaacggcgcccagaacggcgucucccagcucauccagcgcgaguuccagaccuccgccaucucccgcgacaucgacaccgccgccaaguucaucggcgccggcgccgccaccgucggcgucgccggcuccggcgccggcaucggcaccgucuucggcucccucaucaucggcuacgcccgcaaccccucccucaagcagcagcucuucuccuacgccauccucggcuucgcccucuccgaggccaugggccucuucugccucauggucgccuuccucauccucuucgccauguga

SEQ ID NO: 40109 - RNA, 414 nt, Artificial Sequence
  derived and/or modified sequence opt2 from ATP5H__Homo_sapiens__NP_001003785
auggccggccgcaagcucgcccucaagaccaucgacugggucgccuucgccgagaucaucccccagaaccagaaggccaucgccuccucccucaaguccuggaacgagacccucaccucccgccucgccgcccuccccgagaacccccccgccaucgacugggccuacuacaaggccaacgucgccaaggccggccucgucgacgacuucgagaagaaggucaaguccugcgccgagugggucucccucuccaaggcccgcaucgucgaguacgagaaggagauggagaagaugaagaaccucauccccuucgaccagaugaccaucgaggaccucaacgaggccuuccccgagaccaagcucgacaagaagaaguaccccuacuggccccaccagcccaucgagaaccucuga

SEQ ID NO: 40110 - RNA, 267 nt, Artificial Sequence
  derived and/or modified sequence opt2 from ATP5J2__Homo_sapiens__NP_001003713
auggccuccgucguccccgucaaggacaagaagcuccucgaggucaagcucggcgagcuccccuccuggauccucaugcgcgacuucucccccuccggcaucuucggcgccuuccagcgcggcuacuaccgcuacuacaacaaguacaucaacgucaagaagggcuccaucuccggcaucaccaugguccucgccugcuacguccucuucuccuacuccuucuccuacaagcaccucaagcacgagcgccuccgcaaguaccacuga

SEQ ID NO: 40111 - RNA, 327 nt, Artificial Sequence
  derived and/or modified sequence opt2 from ATP5J__Homo_sapiens__NP_001003696
augauccuccagcgccucuuccgcuucuccuccgucauccgcuccgccgucuccguccaccuccgccgcaacaucggcgucaccgccgucgccuucaacaaggagcucgaccccauccagaagcucuucgucgacaagauccgcgaguacaaguccaagcgccagaccuccggcggccccgucgacgccuccuccgaguaccagcaggagcucgagcgcgagcucuucaagcucaagcagauguucggcaacgccgacaugaacaccuuccccaccuucaaguucgaggaccccaaguucgaggucaucgagaagccccaggccuga

SEQ ID NO: 40112 - RNA, 312 nt, Artificial Sequence
  derived and/or modified sequence opt2 from ATP5L__Homo_sapiens__NP_006467
auggcccaguucguccgcaaccucgucgagaagacccccgcccucgucaacgccgccgucaccuacuccaagccccgccucgccaccuucugguacuacgccaaggucgagcucgucccccccacccccgccgagaucccccgcgccauccagucccucaagaagaucgucaacuccgcccagaccggcuccuucaagcagcucaccgucaaggaggccguccucaacggccucgucgccaccgagguccucaugugguucuacgucggcgagaucaucggcaagcgcggcaucaucggcuacgacgucuga

SEQ ID NO: 40113 - RNA, 642 nt, Artificial Sequence
  derived and/or modified sequence opt2 from ATP5O__Homo_sapiens__NP_001688
auggccgcccccgccgucuccggccucucccgccagguccgcugcuucuccaccuccgucguccgccccuucgccaagcucguccgcccccccguccaggucuacggcaucgagggccgcuacgccaccgcccucuacuccgccgccuccaagcagaacaagcucgagcaggucgagaaggagcuccuccgcgucgcccagauccucaaggagcccaaggucgccgccuccguccucaaccccuacgucaagcgcuccaucaaggucaagucccucaacgacaucaccgccaaggagcgcuucuccccccucaccaccaaccucaucaaccuccucgccgagaacggccgccucuccaacacccagggcgucgucuccgccuucuccaccaugauguccguccaccgcggcgagguccccugcaccgucaccuccgccuccccccucgaggaggccacccucuccgagcucaagaccguccucaaguccuuccucucccagggccagguccucaagcucgaggccaagaccgaccccuccauccucggcggcaugaucguccgcaucggcgagaaguacgucgacauguccgucaagaccaagauccagaagcucggccgcgccaugcgcgagaucgucuga

SEQ ID NO: 40114 - RNA, 1413 nt, Artificial Sequence
  derived and/or modified sequence opt2 from ATP6AP1__Homo_sapiens__NP_001174
augauggccgccauggccaccgcccgcguccgcaugggcccccgcugcgcccaggcccucuggcgcaugcccuggcuccccgucuuccucucccucgccgccgccgccgccgccgccgccgccgagcagcaggucccccucguccucugguccuccgaccgcgaccucugggcccccgccgccgacacccacgagggccacaucaccuccgaccuccagcucuccaccuaccucgaccccgcccucgagcucggcccccgcaacguccuccucuuccuccaggacaagcucuccaucgaggacuucaccgccuacggcggcgucuucggcaacaagcaggacuccgccuucuccaaccucgagaacgcccucgaccucgcccccuccucccucguccuccccgccgucgacugguacgccgucuccacccucaccaccuaccuccaggagaagcucggcgccuccccccuccacgucgaccucgccacccuccgcgagcucaagcucaacgccucccuccccgcccuccuccucauccgccuccccuacaccgccuccuccggccucauggccccccgcgagguccucaccggcaacgacgaggucaucggccagguccucuccacccucaaguccgaggacguccccuacaccgccgcccucaccgccguccgccccucccgcgucgcccgcgacgucgccgucgucgccggcggccucggccgccagcuccuccagaagcagcccgucucccccgucauccacccccccgucuccuacaacgacaccgccccccgcauccucuucugggcccagaacuucuccgucgccuacaaggaccagugggaggaccucaccccccucaccuucggcguccaggagcucaaccucaccggcuccuucuggaacgacuccuucgcccgccucucccucaccuacgagcgccucuucggcaccaccgucaccuucaaguucauccucgccaaccgccucuaccccgucuccgcccgccacugguucaccauggagcgccucgagguccacuccaacggcuccgucgccuacuucaacgccucccaggucaccggccccuccaucuacuccuuccacugcgaguacgucuccucccucuccaagaagggcucccuccucgucgcccgcacccagcccucccccuggcagaugaugcuccaggacuuccagauccaggccuucaacgucaugggcgagcaguucuccuacgccuccgacugcgccuccuucuucucccccggcaucuggaugggccuccucaccucccucuucaugcucuucaucuucaccuacggccuccacaugauccucucccucaagaccauggaccgcuucgacgaccacaagggccccaccaucucccucacccagaucgucuga

SEQ ID NO: 40115 - RNA, 675 nt, Artificial Sequence
  derived and/or modified sequence opt2 from ATP6AP1L__Homo_sapiens__XP_011542025
augcgccucuggaaggcccgcguccucaagcucguccucaagaccgccaaggacucccgccucggccucaacuccaaguggcucucccucaagcucggcgacgccggcaacccccgcucccucgccauccgcuucauccucaccaacuacaacaagcucuccauccaguccugguucucccuccgccgcgucgagaucaucuccaacaacuccauccaggccgucuucaaccccaccggcgucuacgcccccuccggcuacuccuaccgcugccagcgcgucggcucccuccagcaggaccaggcccuccuccuccccuccgacaccgacgacggcuccucccucugggaggucaccuucaucgacuuccagauccagggcuucgccaucaagggcggccgcuucaccaaggcccaggacugcgccuccuccuucucccccgccuuccucaucggccucgccaugucccucauccuccuccucguccucgccuacgcccuccacaugcucaucuaccuccgcuaccucgaccagcaguacgaccucaucgccucccccgcccacuucucccagcucaaggcccgcgacaccgccgaggagaaggagcuccuccgcucccagggcgccgagugcuacaagcuccgcucccagcagaucuccaagaucuacgucuga

SEQ ID NO: 40116 - RNA, 1053 nt, Artificial Sequence
  derived and/or modified sequence opt2 from ATP6AP2__Homo_sapiens__NP_005756
auggccgucuucgucguccuccucgcccucgucgccggcguccucggcaacgaguucuccauccucaagucccccggcuccgucgucuuccgcaacggcaacuggcccauccccggcgagcgcauccccgacgucgccgcccucuccaugggcuucuccgucaaggaggaccucuccuggcccggccucgccgucggcaaccucuuccaccgcccccgcgccaccgucauggucauggucaagggcgucaacaagcucgcccucccccccggcuccgucaucuccuacccccucgagaacgccguccccuucucccucgacuccgucgccaacuccauccacucccucuucuccgaggagacccccgucguccuccagcucgcccccuccgaggagcgcgucuacauggucggcaaggccaacuccgucuucgaggaccucuccgucacccuccgccagcuccgcaaccgccucuuccaggagaacuccguccucuccucccucccccucaacucccucucccgcaacaacgaggucgaccuccucuuccucuccgagcuccagguccuccacgacaucuccucccuccucucccgccacaagcaccucgccaaggaccacucccccgaccucuacucccucgagcucgccggccucgacgagaucggcaagcgcuacggcgaggacuccgagcaguuccgcgacgccuccaagauccucgucgacgcccuccagaaguucgccgacgacauguacucccucuacggcggcaacgccgucgucgagcucgucaccgucaaguccuucgacaccucccucauccgcaagacccgcaccauccucgaggccaagcaggccaagaaccccgccucccccuacaaccucgccuacaaguacaacuucgaguacuccgucgucuucaacaugguccucuggaucaugaucgcccucgcccucgccgucaucaucaccuccuacaacaucuggaacauggaccccggcuacgacuccaucaucuaccgcaugaccaaccagaagauccgcauggacuga

SEQ ID NO: 40117 - RNA, 2517 nt, Artificial Sequence
  derived and/or modified sequence opt2 from ATP6V0A1__Homo_sapiens__NP_001123492
augggcgagcucuuccgcuccgaggagaugacccucgcccagcucuuccuccaguccgaggccgccuacugcugcgucuccgagcucggcgagcucggcaagguccaguuccgcgaccucaaccccgacgucaacgucuuccagcgcaaguucgucaacgagguccgccgcugcgaggagauggaccgcaagcuccgcuucgucgagaaggagauccgcaaggccaacauccccaucauggacaccggcgagaaccccgagguccccuucccccgcgacaugaucgaccucgaggccaacuucgagaagaucgagaacgagcucaaggagaucaacaccaaccaggaggcccucaagcgcaacuuccucgagcucaccgagcucaaguucauccuccgcaagacccagcaguucuucgacgaggccgagcuccaccaccagcagauggccgaccccgaccuccucgaggaguccuccucccuccucgagcccuccgagaugggccgcggcaccccccuccgccucggcuucgucgccggcgucaucaaccgcgagcgcauccccaccuucgagcgcaugcucuggcgcgucugccgcggcaacgucuuccuccgccaggccgagaucgagaacccccucgaggaccccgucaccggcgacuacguccacaaguccgucuucaucaucuucuuccagggcgaccagcucaagaaccgcgucaagaagaucugcgagggcuuccgcgccucccucuaccccugccccgagaccccccaggagcgcaaggagauggccuccggcgucaacacccgcaucgacgaccuccagaugguccucaaccagaccgaggaccaccgccagcgcguccuccaggccgccgccaagaacauccgcgucugguucaucaagguccgcaagaugaaggccaucuaccacacccucaaccucugcaacaucgacgucacccagaagugccucaucgccgaggucuggugccccgucaccgaccucgacuccauccaguucgcccuccgccgcggcaccgagcacuccggcuccaccguccccuccauccucaaccgcaugcagaccaaccagaccccccccaccuacaacaagaccaacaaguucaccuacggcuuccagaacaucgucgacgccuacggcaucggcaccuaccgcgagaucaaccccgcccccuacaccaucaucaccuuccccuuccucuucgccgucauguucggcgacuucggccacggcauccucaugacccucuucgccgucuggaugguccuccgcgagucccgcauccucucccagaagaacgagaacgagauguucuccaccgucuucuccggccgcuacaucauccuccucaugggcgucuucuccauguacaccggccucaucuacaacgacugcuucuccaagucccucaacaucuucggcuccuccugguccguccgccccauguucaccuacaacuggaccgaggagacccuccgcggcaaccccguccuccagcucaaccccgcccuccccggcgucuucggcggccccuaccccuucggcaucgaccccaucuggaacaucgccaccaacaagcucaccuuccucaacuccuucaagaugaagauguccgucauccucggcaucauccacaugcucuucggcgucucccucucccucuucaaccacaucuacuucaagaagccccucaacaucuacuucggcuucauccccgagaucaucuucaugaccucccucuucggcuaccucgucauccucaucuucuacaaguggaccgccuacgacgcccacaccuccgagaacgcccccucccuccucauccacuucaucaacauguuccucuucuccuaccccgaguccggcuacuccaugcucuacuccggccagaagggcauccagugcuuccucgucgucgucgcccuccucugcguccccuggaugcuccucuucaagccccucguccuccgccgccaguaccuccgccgcaagcaccucggcacccucaacuucggcggcauccgcgucggcaacggccccaccgaggaggacgccgagaucauccagcacgaccagcucuccacccacuccgaggacgccgacgaguucgacuucggcgacaccaugguccaccaggccauccacaccaucgaguacugccucggcugcaucuccaacaccgccuccuaccuccgccucugggcccucucccucgcccacgcccagcucuccgagguccucuggaccauggucauccacaucggccucuccgucaagucccucgccggcggccucguccucuucuucuucuucaccgccuucgccacccucaccgucgccauccuccucaucauggagggccucuccgccuuccuccacgcccuccgccuccacugggucgaguuccagaacaaguucuacuccggcaccggcuucaaguuccuccccuucuccuucgagcacauccgcgagggcaaguucgaggaguga

SEQ ID NO: 40118 - RNA, 2571 nt, Artificial Sequence
  derived and/or modified sequence opt2 from ATP6V0A2__Homo_sapiens__NP_036595
augggcucccucuuccgcuccgagaccaugugccucgcccagcucuuccuccaguccggcaccgccuacgagugccucuccgcccucggcgagaagggccucguccaguuccgcgaccucaaccagaacgucuccuccuuccagcgcaaguucgucggcgaggucaagcgcugcgaggagcucgagcgcauccucgucuaccucguccaggagaucaaccgcgccgacaucccccuccccgagggcgaggccuccccccccgcccccccccucaagcagguccucgagaugcaggagcagcuccagaagcucgaggucgagcuccgcgaggucaccaagaacaaggagaagcuccgcaagaaccuccucgagcucaucgaguacacccacaugcuccgcgucaccaagaccuucgucaagcgcaacgucgaguucgagcccaccuacgaggaguuccccucccucgaguccgacucccuccucgacuacuccugcaugcagcgccucggcgccaagcucggcuucgucuccggccucaucaaccagggcaaggucgaggccuucgagaagaugcucuggcgcgucugcaagggcuacaccaucgucuccuacgccgagcucgacgagucccucgaggaccccgagaccggcgaggucaucaagugguacgucuuccucaucuccuucuggggcgagcagaucggccacaaggucaagaagaucugcgacugcuaccacugccacgucuaccccuaccccaacaccgccgaggagcgccgcgagauccaggagggccucaacacccgcauccaggaccucuacaccguccuccacaagaccgaggacuaccuccgccagguccucugcaaggccgccgaguccgucuacucccgcgucauccaggucaagaagaugaaggccaucuaccacaugcucaacaugugcuccuucgacgucaccaacaagugccucaucgccgaggucuggugccccgaggccgaccuccaggaccuccgccgcgcccucgaggagggcucccgcgaguccggcgccaccauccccuccuucaugaacaucauccccaccaaggagaccccccccacccgcauccgcaccaacaaguucaccgagggcuuccagaacaucgucgacgccuacggcgucggcuccuaccgcgaggucaaccccgcccucuucaccaucaucaccuuccccuuccucuucgccgucauguucggcgacuucggccacggcuucgucauguuccucuucgcccuccuccucguccucaacgagaaccacccccgccucaaccagucccaggagaucaugcgcauguucuucaacggccgcuacauccuccuccucaugggccucuucuccgucuacaccggccucaucuacaacgacugcuucuccaaguccgucaaccucuucggcuccggcuggaacgucuccgccauguacuccuccucccacccccccgccgagcacaagaagaugguccucuggaacgacuccgucguccgccacaacuccauccuccagcucgaccccuccauccccggcgucuuccgcggccccuacccccucggcaucgaccccaucuggaaccucgccaccaaccgccucaccuuccucaacuccuucaagaugaagauguccgucauccucggcaucauccacaugaccuucggcgucauccucggcaucuucaaccaccuccacuuccgcaagaaguucaacaucuaccucgucuccauccccgagcuccucuucaugcucugcaucuucggcuaccucaucuucaugaucuucuacaaguggcucgucuucuccgccgagaccucccgcgucgcccccuccauccucaucgaguucaucaacauguuccucuuccccgccuccaagaccuccggccucuacaccggccaggaguacguccagcgcguccuccucgucgucaccgcccucuccguccccguccucuuccucggcaagccccucuuccuccucuggcuccacaacggccgcuccugcuucggcgucaaccgcuccggcuacacccucauccgcaaggacuccgaggaggaggucucccuccucggcucccaggacaucgaggagggcaaccaccaggucgaggacggcugccgcgagauggccugcgaggaguucaacuucggcgagauccucaugacccaggucauccacuccaucgaguacugccucggcugcaucuccaacaccgccuccuaccuccgccucugggcccucucccucgcccacgcccagcucuccgacguccucugggccaugcucaugcgcgucggccuccgcgucgacaccaccuacggcguccuccuccuccuccccgucaucgcccucuucgccguccucaccaucuucauccuccucaucauggagggccucuccgccuuccuccacgccauccgccuccacugggucgaguuccagaacaaguucuacgucggcgccggcaccaaguucguccccuucuccuucucccuccucuccuccaaguucaacaacgacgacuccgucgccuga

SEQ ID NO: 40119 - RNA, 2523 nt, Artificial Sequence
  derived and/or modified sequence opt2 from ATP6V0A4__Homo_sapiens__XP_005250451
auggucuccgucuuccgcuccgaggagaugugccucucccagcucuuccuccaggucgaggccgccuacugcugcgucgccgagcucggcgagcucggccucguccaguucaaggaccucaacaugaacgucaacuccuuccagcgcaaguucgucaacgagguccgccgcugcgagucccucgagcgcauccuccgcuuccucgaggacgagaugcagaacgagaucgucguccagcuccucgagaaguccccccucaccccccucccccgcgagaugaucacccucgagaccguccucgagaagcucgagggcgagcuccaggaggccaaccagaaccagcaggcccucaagcaguccuuccucgagcucaccgagcucaaguaccuccucaagaagacccaggacuucuucgagaccgagaccaaccucgccgacgacuucuucaccgaggacaccuccggccuccucgagcucaaggccguccccgccuacaugaccggcaagcucggcuucaucgccggcgucaucaaccgcgagcgcauggccuccuucgagcgccuccucuggcgcaucugccgcggcaacgucuaccucaaguucuccgagauggacgccccccucgaggaccccgucaccaaggaggagauccagaagaacaucuucaucaucuucuaccagggcgagcagcuccgccagaagaucaagaagaucugcgacggcuuccgcgccaccgucuaccccugccccgagcccgccgucgagcgccgcgagaugcucgaguccgucaacguccgccucgaggaccucaucaccgucaucacccagaccgagucccaccgccagcgccuccuccaggaggccgccgccaacuggcacuccuggcucaucaagguccagaagaugaaggccgucuaccacauccucaacaugugcaacaucgacgucacccagcagugcgucaucgccgagaucugguuccccgucgccgacgccacccgcaucaagcgcgcccucgagcagggcauggagcucuccggcuccuccauggcccccaucaugaccaccguccaguccaagaccgccccccccaccuucaaccgcaccaacaaguucaccgccggcuuccagaacaucgucgacgccuacggcgucggcuccuaccgcgagaucaaccccgcccccuacaccaucaucaccuuccccuuccucuucgccgucauguucggcgacugcggccacggcaccgucaugcuccucgccgcccucuggaugauccucaacgagcgccgccuccucucccagaagaccgacaacgagaucuggaacaccuucuuccacggccgcuaccucauccuccucaugggcaucuucuccaucuacaccggccucaucuacaacgacugcuucuccaagucccucaacaucuucggcuccuccugguccguccagcccauguuccgcaacggcaccuggaacacccacgucauggaggagucccucuaccuccagcucgaccccgccauccccggcgucuacuucggcaaccccuaccccuucggcaucgaccccaucuggaaccucgccuccaacaagcucaccuuccucaacuccuacaagaugaagauguccgucauccucggcaucguccagauggucuucggcgucauccucucccucuucaaccacaucuacuuccgccgcacccucaacaucauccuccaguucauccccgagaugaucuucauccucugccucuucggcuaccucgucuucaugaucaucuucaaguggugcugcuucgacguccacgucucccagcacgcccccuccauccucauccacuucaucaacauguuccucuucaacuacuccgacuccuccaacgccccccucuacaagcaccagcaggagguccaguccuucuucgucgucauggcccucaucuccguccccuggaugcuccucaucaagcccuucauccuccgcgccucccaccgcaagucccagcuccaggccucccgcauccaggaggacgccaccgagaacaucgagggcgacuccuccucccccuccucccgcuccggccagcgcaccuccgccgacacccacggcgcccucgacgaccacggcgaggaguucaacuucggcgacgucuucguccaccaggccauccacaccaucgaguacugccucggcugcaucuccaacaccgccuccuaccuccgccucugggcccucucccucgcccacgcccagcucuccgagguccucuggaccauggucaugaacuccggccuccagacccgcggcuggggcggcaucgucggcgucuucaucaucuucgccgucuucgccguccucaccgucgccauccuccucaucauggagggccucuccgccuuccuccacgcccuccgccuccacugggucgaguuccagaacaaguucuacgucggcgacggcuacaaguucucccccuucuccuucaagcacauccucgacggcaccgccgaggaguga

SEQ ID NO: 40120 - RNA, 468 nt, Artificial Sequence
  derived and/or modified sequence opt2 from ATP6V0C__Homo_sapiens__NP_001185498
auguccgaguccaaguccggccccgaguacgccuccuucuucgccgucaugggcgccuccgccgccauggucuucuccgcccucggcgccgccuacggcaccgccaaguccggcaccggcaucgccgccauguccgucaugcgccccgagcagaucaugaaguccaucauccccgucgucauggccggcaucaucgccaucuacggccucgucgucgccguccucaucgccaacucccucaacgacgacaucucccucuacaaguccuuccuccagcucggcgccggccucuccgucggccucuccggccucgccgccggcuucgccaucggcaucgucggcgacgccggcguccgcggcaccgcccagcagccccgccucuucgucggcaugauccucauccucaucuucgccgagguccucggccucuacggccucaucgucgcccucauccucuccaccaaguga

SEQ ID NO: 40121 - RNA, 1056 nt, Artificial Sequence
  derived and/or modified sequence opt2 from ATP6V0D1__Homo_sapiens__NP_004682
auguccuucuuccccgagcucuacuucaacgucgacaacggcuaccucgagggccucguccgcggccucaaggccggcguccucucccaggccgacuaccucaaccucguccagugcgagacccucgaggaccucaagcuccaccuccaguccaccgacuacggcaacuuccucgccaacgaggccuccccccucaccgucuccgucaucgacgaccgccucaaggagaagauggucgucgaguuccgccacaugcgcaaccacgccuacgagccccucgccuccuuccucgacuucaucaccuacuccuacaugaucgacaacgucauccuccucaucaccggcacccuccaccagcgcuccaucgccgagcucguccccaagugccacccccucggcuccuucgagcagauggaggccgucaacaucgcccagacccccgccgagcucuacaacgccauccucgucgacaccccccucgccgccuucuuccaggacugcaucuccgagcaggaccucgacgagaugaacaucgagaucauccgcaacacccucuacaaggccuaccucgaguccuucuacaaguucugcacccuccucggcggcaccaccgccgacgccaugugccccauccucgaguucgaggccgaccgccgcgccuucaucaucaccaucaacuccuucggcaccgagcucuccaaggaggaccgcgccaagcucuucccccacugcggccgccucuaccccgagggccucgcccagcucgcccgcgccgacgacuacgagcaggucaagaacgucgccgacuacuaccccgaguacaagcuccucuucgagggcgccggcuccaaccccggcgacaagacccucgaggaccgcuucuucgagcacgaggucaagcucaacaagcucgccuuccucaaccaguuccacuucggcgucuucuacgccuucgucaagcucaaggagcaggagugccgcaacaucgucuggaucgccgagugcaucgcccagcgccaccgcgccaagaucgacaacuacauccccaucuucuga

SEQ ID NO: 40122 - RNA, 246 nt, Artificial Sequence
  derived and/or modified sequence opt2 from ATP6V0E1__Homo_sapiens__NP_003936
auggccuaccacggccucaccgucccccucaucgucauguccgucuucuggggcuucgucggcuuccucguccccugguucauccccaagggccccaaccgcggcgucaucaucaccaugcucgucaccugcuccgucugcugcuaccucuucuggcucaucgccauccucgcccagcucaacccccucuucggcccccagcucaagaacgagaccaucugguaccucaaguaccacuggcccuga

SEQ ID NO: 40123 - RNA, 642 nt, Artificial Sequence
  derived and/or modified sequence opt2 from ATP6V0E2__Homo_sapiens__NP_001094062
augcgcguccgcggccccgcccgccucaucgccuccggcgcccgccuccuccuccgcaugcucuccgcccuccccggcuggggccccgcccaccuccagcgcccccuccucggccccgccuccugccucggcauccuccgccccgccaugaccgcccacuccuucgcccuccccgucaucaucuucaccaccuucuggggccucgucggcaucgccggccccugguucguccccaagggccccaaccgcggcgucaucaucaccaugcucgucgccaccgccgucugcugcuaccuccucugccccgcccucggcaugaccgucgccccccucucccucaccacccccuccuccggccccucccccacccagcucugccucgucaccuccucccuccuccucgccccccgcgaccccgacccccagggccuccccggcuccuggaaguccucccaguccucccagcccgcccgcgcccucggcucccccggccacuccuccggccgcggcgacguccuccuccaguacccccacugcuccggcgucugcccccucucccagggcgacgccgccggcgagcucgucugggucggcuccuucccccuccagaccggccagaugcccggccucucccccuccuga

SEQ ID NO: 40124 - RNA, 1542 nt, Artificial Sequence
  derived and/or modified sequence opt2 from ATP6V1B1__Homo_sapiens__NP_001683
auggccauggagaucgacucccgccccggcggccuccccggcuccuccugcaaccucggcgccgcccgcgagcacaugcaggccgucacccgcaacuacaucacccacccccgcgucaccuaccgcaccgucugcuccgucaacggcccccucgucguccucgaccgcgucaaguucgcccaguacgccgagaucguccacuucacccuccccgacggcacccagcgcuccggccagguccucgaggucgccggcaccaaggccaucguccaggucuucgagggcaccuccggcaucgacgcccgcaagaccaccugcgaguucaccggcgacauccuccgcacccccgucuccgaggacaugcucggccgcgucuucaacggcuccggcaagcccaucgacaagggccccgucgucauggccgaggacuuccucgacaucaacggccagcccaucaacccccacucccgcaucuaccccgaggagaugauccagaccggcaucucccccaucgacgucaugaacuccaucgcccgcggccagaagauccccaucuucuccgccgccggccucccccacaacgagaucgccgcccagaucugccgccaggccggccucgucaagaaguccaaggccguccucgacuaccacgacgacaacuucgccaucgucuucgccgccaugggcgucaacauggagaccgcccgcuucuucaaguccgacuucgagcagaacggcaccaugggcaacgucugccucuuccucaaccucgccaacgaccccaccaucgagcgcaucaucaccccccgccucgcccucaccaccgccgaguuccucgccuaccagugcgagaagcacguccucgucauccucaccgacauguccuccuacgccgaggcccuccgcgaggucuccgccgcccgcgaggagguccccggccgccgcggcuuccccggcuacauguacaccgaccucgccaccaucuacgagcgcgccggccgcgucgagggccgcggcggcuccaucacccagauccccauccucaccaugcccaacgacgacaucacccaccccauccccgaccucaccggcuucaucaccgagggccagaucuacgucgaccgccagcuccacaaccgccagaucuacccccccaucaacguccuccccucccucucccgccucaugaaguccgccaucggcgagggcaugacccgcaaggaccacggcgacgucuccaaccagcucuacgccugcuacgccaucggcaaggacguccaggccaugaaggccgucgucggcgaggaggcccucaccuccgaggaccuccucuaccucgaguuccuccagaaguucgagaagaacuucaucaaccagggccccuacgagaaccgcuccgucuucgagucccucgaccucggcuggaagcuccuccgcaucuuccccaaggagaugcucaagcgcaucccccaggccgucaucgacgaguucuacucccgcgagggcgcccuccaggaccucgcccccgacaccgcccucuga

SEQ ID NO: 40125 - RNA, 1536 nt, Artificial Sequence
  derived and/or modified sequence opt2 from ATP6V1B2__Homo_sapiens__NP_001684
auggcccuccgcgccaugcgcggcaucgucaacggcgccgcccccgagcuccccguccccaccggcggccccgccgucggcgcccgcgagcaggcccucgccgucucccgcaacuaccucucccagccccgccucaccuacaagaccgucuccggcgucaacggcccccucgucauccucgaccacgucaaguucccccgcuacgccgagaucguccaccucacccuccccgacggcaccaagcgcuccggccagguccucgaggucuccggcuccaaggccgucguccaggucuucgagggcaccuccggcaucgacgccaagaagaccuccugcgaguucaccggcgacauccuccgcacccccgucuccgaggacaugcucggccgcgucuucaacggcuccggcaagcccaucgaccgcggccccgucguccucgccgaggacuuccucgacaucaugggccagcccaucaacccccagugccgcaucuaccccgaggagaugauccagaccggcaucuccgccaucgacggcaugaacuccaucgcccgcggccagaagauccccaucuucuccgccgccggccucccccacaacgagaucgccgcccagaucugccgccaggccggccucgucaagaaguccaaggacgucgucgacuacuccgaggagaacuucgccaucgucuucgccgccaugggcgucaacauggagaccgcccgcuucuucaaguccgacuucgaggagaacggcuccauggacaacgucugccucuuccucaaccucgccaacgaccccaccaucgagcgcaucaucaccccccgccucgcccucaccaccgccgaguuccucgccuaccagugcgagaagcacguccucgucauccucaccgacauguccuccuacgccgaggcccuccgcgaggucuccgccgcccgcgaggagguccccggccgccgcggcuuccccggcuacauguacaccgaccucgccaccaucuacgagcgcgccggccgcgucgagggccgcaacggcuccaucacccagauccccauccucaccaugcccaacgacgacaucacccaccccauccccgaccucaccggcuacaucaccgagggccagaucuacgucgaccgccagcuccacaaccgccagaucuacccccccaucaacguccuccccucccucucccgccucaugaaguccgccaucggcgagggcaugacccgcaaggaccacgccgacgucuccaaccagcucuacgccugcuacgccaucggcaaggacguccaggccaugaaggccgucgucggcgaggaggcccucaccuccgacgaccuccucuaccucgaguuccuccagaaguucgagcgcaacuucaucgcccagggccccuacgagaaccgcaccgucuucgagacccucgacaucggcuggcagcuccuccgcaucuuccccaaggagaugcucaagcgcaucccccaguccacccucuccgaguucuacccccgcgacuccgccaagcacuga

SEQ ID NO: 40126 - RNA, 1149 nt, Artificial Sequence
  derived and/or modified sequence opt2 from ATP6V1C1__Homo_sapiens__NP_001686
augaccgaguucuggcucaucuccgcccccggcgagaagaccugccagcagaccugggagaagcuccacgccgccaccuccaagaacaacaaccucgccgucaccuccaaguucaacauccccgaccucaaggucggcacccucgacguccucgucggccucuccgacgagcucgccaagcucgacgccuucgucgagggcgucgucaagaaggucgcccaguacauggccgacguccucgaggacuccaaggacaagguccaggagaaccuccucgccaacggcgucgaccucgucaccuacaucacccgcuuccagugggacauggccaaguaccccaucaagcagucccucaagaacaucuccgagaucaucgccaagggcgucacccagaucgacaacgaccucaagucccgcgccuccgccuacaacaaccucaagggcaaccuccagaaccucgagcgcaagaacgccggcucccuccucacccgcucccucgccgagaucgucaagaaggacgacuucguccucgacuccgaguaccucgucacccuccucgucgucguccccaagcucaaccacaacgacuggaucaagcaguacgagacccucgccgagauggucgucccccgcuccuccaacguccucuccgaggaccaggacuccuaccucugcaacgucacccucuuccgcaaggccgucgacgacuuccgccacaaggcccgcgagaacaaguucaucguccgcgacuuccaguacaacgaggaggagaugaaggccgacaaggaggagaugaaccgccucuccaccgacaagaagaagcaguucggcccccucguccgcuggcucaaggucaacuucuccgaggccuucaucgccuggauccacgucaaggcccuccgcgucuucgucgaguccguccuccgcuacggccuccccgucaacuuccaggccaugcuccuccagcccaacaagaagacccucaagaagcuccgcgagguccuccacgagcucuacaagcaccucgacuccuccgccgccgccaucaucgacgcccccauggacauccccggccucaaccucucccagcaggaguacuaccccuacgucuacuacaagaucgacugcaaccuccucgaguucaaguga

SEQ ID NO: 40127 - RNA, 744 nt, Artificial Sequence
  derived and/or modified sequence opt2 from ATP6V1D__Homo_sapiens__NP_057078
auguccggcaaggaccgcaucgagaucuuccccucccgcauggcccagaccaucaugaaggcccgccucaagggcgcccagaccggccgcaaccuccucaagaagaaguccgacgcccucacccuccgcuuccgccagauccucaagaagaucaucgagaccaagaugcucaugggcgaggucaugcgcgaggccgccuucucccucgccgaggccaaguucaccgccggcgacuucuccaccaccgucauccagaacgucaacaaggcccaggucaagauccgcgccaagaaggacaacgucgccggcgucacccuccccgucuucgagcacuaccacgagggcaccgacuccuacgagcucaccggccucgcccgcggcggcgagcagcucgccaagcucaagcgcaacuacgccaaggccgucgagcuccucgucgagcucgccucccuccagaccuccuucgucacccucgacgaggccaucaagaucaccaaccgccgcgucaacgccaucgagcacgucaucaucccccgcaucgagcgcacccucgccuacaucaucaccgagcucgacgagcgcgagcgcgaggaguucuaccgccucaagaagauccaggagaagaagaagauccucaaggagaaguccgagaaggaccucgagcagcgccgcgccgccggcgagguccucgagcccgccaaccuccucgccgaggagaaggacgaggaccuccucuucgaguga

SEQ ID NO: 40128 - RNA, 615 nt, Artificial Sequence
  derived and/or modified sequence opt2 from ATP6V1E1__Homo_sapiens__NP_001034455
auggcccucuccgacgccgacguccagaagcaggccgaggaggaguucaacaucgagaagggccgccucguccagacccagcgccucaagaucauggaguacuacgagaagaaggagaagcagaucgagcagcagaagaagauccagauguccaaccucaugaaccaggcccgccucaagguccuccgcgcccgcgacgaccucaucaccgaccuccucaacgaggccaagcagcgccucuccaaggucgucaaggacaccacccgcuaccagguccuccucgacggccucguccuccagggccucuaccagcuccucgagccccgcaugaucguccgcugccgcaagcaggacuucccccucgucaaggccgccguccagaaggccauccccauguacaagaucgccaccaagaacgacgucgacguccagaucgaccaggaguccuaccuccccgaggacaucgccggcggcgucgagaucuacaacggcgaccgcaagaucaaggucuccaacacccucgagucccgccucgaccucaucgcccagcagaugaugcccgagguccgcggcgcccucuucggcgccaacgccaaccgcaaguuccucgacuga

SEQ ID NO: 40129 - RNA, 444 nt, Artificial Sequence
  derived and/or modified sequence opt2 from ATP6V1F__Homo_sapiens__NP_001185838
auggccggccgcggcaagcucaucgccgucaucggcgacgaggacaccgucaccggcuuccuccucggcggcaucggcgagcucaacaagaaccgccaccccaacuuccucgucgucgagaaggacaccaccaucaacgagaucgaggacaccuuccgcucccucggcucccuccccggcuccgucgucgaggccaaccccaaccagcgcgaccccccccucugggacgagaucgacucccgccaguuccucaaccgcgacgacaucggcaucauccucaucaaccaguacaucgccgagaugguccgccacgcccucgacgcccaccagcaguccauccccgccguccucgagauccccuccaaggagcaccccuacgacgccgccaaggacuccauccuccgccgcgcccgcggcauguucaccgccgaggaccuccgcuga

SEQ ID NO: 40130 - RNA, 357 nt, Artificial Sequence
  derived and/or modified sequence opt2 from ATP6V1G1__Homo_sapiens__NP_004879
auggccucccagucccagggcauccagcagcuccuccaggccgagaagcgcgccgccgagaaggucuccgaggcccgcaagcgcaagaaccgccgccucaagcaggccaaggaggaggcccaggccgagaucgagcaguaccgccuccagcgcgagaaggaguucaaggccaaggaggccgccgcccucggcucccgcggcuccugcuccaccgaggucgagaaggagacccaggagaagaugaccauccuccagaccuacuuccgccagaaccgcgacgagguccucgacaaccuccucgccuucgucugcgacauccgccccgagauccacgagaacuaccgcaucaacggcuga

SEQ ID NO: 40131 - RNA, 237 nt, Artificial Sequence
  derived and/or modified sequence opt2 from ATP6V1G2__Homo_sapiens__NP_001191007
auggccucccagucccagggcauccagcagcuccuccaggccgagaagcgcgccgccgagaaggucgccgacgcccgcaagcgcaaggcccgccgccucaagcaggccacccgccgccagguccagggcaugcaguccucccagcagcgcaaccgcgagcgcguccucgcccagcuccucggcauggucugcgacguccgcccccagguccaccccaacuaccgcaucuccgccuga

SEQ ID NO: 40132 - RNA, 357 nt, Artificial Sequence
  derived and/or modified sequence opt2 from ATP6V1G3__Homo_sapiens__XP_006725021
augaccucccagucccagggcauccaccagcuccuccaggccgagaagcgcgccaaggacaagcucgaggaggccaagaagcgcaagggcaagcgccucaagcaggccaaggaggaggccauggucgagaucgaccaguaccgcaugcagcgcgacaaggaguuccgccucaagcaguccaagaucaugggcucccagaacaaccucuccgacgagaucgaggagcagacccucggcaagauccaggagcucaacggccacuacaacaaguacauggaguccgucaugaaccagcuccucuccauggucugcgacaugaagcccgagauccacgucaacuaccgcgccaccaacuga

SEQ ID NO: 40133 - RNA, 4503 nt, Artificial Sequence
  derived and/or modified sequence opt2 from ATP7A__Homo_sapiens__NP_000043
auggaccccuccaugggcgucaacuccgucaccaucuccgucgagggcaugaccugcaacuccugcgucuggaccaucgagcagcagaucggcaaggucaacggcguccaccacaucaaggucucccucgaggagaagaacgccaccaucaucuacgaccccaagcuccagacccccaagacccuccaggaggccaucgacgacaugggcuucgacgccgucauccacaaccccgacccccuccccguccucaccgacacccucuuccucaccgucaccgccucccucacccuccccugggaccacauccaguccacccuccucaagaccaagggcgucaccgacaucaagaucuacccccagaagcgcaccgucgccgucaccaucauccccuccaucgucaacgccaaccagaucaaggagcucguccccgagcucucccucgacaccggcacccucgagaagaaguccggcgccugcgaggaccacuccauggcccaggccggcgaggucguccucaagaugaaggucgagggcaugaccugccacuccugcaccuccaccaucgagggcaagaucggcaagcuccagggcguccagcgcaucaaggucucccucgacaaccaggaggccaccaucgucuaccagccccaccucaucuccgucgaggagaugaagaagcagaucgaggccaugggcuuccccgccuucgucaagaagcagcccaaguaccucaagcucggcgccaucgacgucgagcgccucaagaacacccccgucaaguccuccgagggcucccagcagcgcucccccuccuacaccaacgacuccaccgccaccuucaucaucgacggcaugcacugcaaguccugcgucuccaacaucgaguccacccucuccgcccuccaguacgucuccuccaucgucgucucccucgagaaccgcuccgccaucgucaaguacaacgccuccuccgucacccccgagucccuccgcaaggccaucgaggccgucucccccggccucuaccgcgucuccaucaccuccgaggucgaguccaccuccaacucccccuccuccuccucccuccagaagaucccccucaacgucgucucccagccccucacccaggagaccgucaucaacaucgacggcaugaccugcaacuccugcguccaguccaucgagggcgucaucuccaagaagcccggcgucaaguccauccgcgucucccucgccaacuccaacggcaccgucgaguacgacccccuccucaccucccccgagacccuccgcggcgccaucgaggacaugggcuucgacgccacccucuccgacaccaacgagccccucgucgucaucgcccagcccuccuccgagaugccccuccucaccuccaccaacgaguucuacaccaagggcaugacccccguccaggacaaggaggagggcaagaacuccuccaagugcuacauccaggucaccggcaugaccugcgccuccugcgucgccaacaucgagcgcaaccuccgccgcgaggagggcaucuacuccauccucgucgcccucauggccggcaaggccgagguccgcuacaaccccgccgucauccagccccccaugaucgccgaguucauccgcgagcucggcuucggcgccaccgucaucgagaacgccgacgagggcgacggcguccucgagcucgucguccgcggcaugaccugcgccuccugcguccacaagaucgaguccucccucaccaagcaccgcggcauccucuacugcuccgucgcccucgccaccaacaaggcccacaucaaguacgaccccgagaucaucggcccccgcgacaucauccacaccaucgagucccucggcuucgaggccucccucgucaagaaggaccgcuccgccucccaccucgaccacaagcgcgagauccgccaguggcgccgcuccuuccucgucucccucuucuucugcauccccgucaugggccucaugaucuacaugauggucauggaccaccacuucgccacccuccaccacaaccagaacauguccaaggaggagaugaucaaccuccacuccuccauguuccucgagcgccagauccuccccggccucuccgucaugaaccuccucuccuuccuccucugcguccccguccaguucuucggcggcugguacuucuacauccaggccuacaaggcccucaagcacaagaccgccaacauggacguccucaucguccucgccaccaccaucgccuucgccuacucccucaucauccuccucgucgccauguacgagcgcgccaaggucaaccccaucaccuucuucgacaccccccccaugcucuucgucuucaucgcccucggccgcuggcucgagcacaucgccaagggcaagaccuccgaggcccucgccaagcucaucucccuccaggccaccgaggccaccaucgucacccucgacuccgacaacauccuccucuccgaggagcaggucgacgucgagcucguccagcgcggcgacaucaucaaggucguccccggcggcaaguuccccgucgacggccgcgucaucgagggccacuccauggucgacgagucccucaucaccggcgaggccaugcccgucgccaagaagcccggcuccaccgucaucgccggcuccaucaaccagaacggcucccuccucaucugcgccacccacgucggcgccgacaccacccucucccagaucgucaagcucgucgaggaggcccagaccuccaaggcccccauccagcaguucgccgacaagcucuccggcuacuucguccccuucaucgucuucgucuccaucgccacccuccucgucuggaucgucaucggcuuccucaacuucgagaucgucgagaccuacuuccccggcuacaaccgcuccaucucccgcaccgagaccaucauccgcuucgccuuccaggccuccaucaccguccucugcaucgccugccccugcucccucggccucgccacccccaccgccgucauggucggcaccggcgucggcgcccagaacggcauccucaucaagggcggcgagccccucgagauggcccacaaggucaaggucgucgucuucgacaagaccggcaccaucacccacggcacccccgucgucaaccaggucaagguccucaccgaguccaaccgcaucucccaccacaagauccucgccaucgucggcaccgccgaguccaacuccgagcacccccucggcaccgccaucaccaaguacugcaagcaggagcucgacaccgagacccucggcaccugcaucgacuuccaggucguccccggcugcggcaucuccugcaaggucaccaacaucgagggccuccuccacaagaacaacuggaacaucgaggacaacaacaucaagaacgccucccucguccagaucgacgccuccaacgagcaguccuccaccuccuccuccaugaucaucgacgcccagaucuccaacgcccucaacgcccagcaguacaagguccucaucggcaaccgcgaguggaugauccgcaacggccucgucaucaacaacgacgucaacgacuucaugaccgagcacgagcgcaagggccgcaccgccguccucgucgccgucgacgacgagcucugcggccucaucgccaucgccgacaccgucaagcccgaggccgagcucgccauccacauccucaaguccaugggccucgaggucguccucaugaccggcgacaacuccaagaccgcccgcuccaucgccucccaggucggcaucaccaaggucuucgccgagguccuccccucccacaaggucgccaaggucaagcagcuccaggaggagggcaagcgcgucgccauggucggcgacggcaucaacgacucccccgcccucgccauggccaacgucggcaucgccaucggcaccggcaccgacgucgccaucgaggccgccgacgucguccucauccgcaacgaccuccucgacgucgucgccuccaucgaccucucccgcaagaccgucaagcgcauccgcaucaacuucgucuucgcccucaucuacaaccucgucggcauccccaucgccgccggcgucuucaugcccaucggccucguccuccagcccuggaugggcuccgccgccauggccgccuccuccgucuccgucguccucuccucccucuuccucaagcucuaccgcaagcccaccuacgaguccuacgagcuccccgcccgcucccagaucggccagaagucccccuccgagaucuccguccacgucggcaucgacgacaccucccgcaacucccccaagcucggccuccucgaccgcaucgucaacuacucccgcgccuccaucaacucccuccucuccgacaagcgcucccucaacuccgucgucaccuccgagcccgacaagcacucccuccucgucggcgacuuccgcgaggacgacgacaccgcccucuga

SEQ ID NO: 40134 - RNA, 3777 nt, Artificial Sequence
  derived and/or modified sequence opt2 from ATP7B__Homo_sapiens__NP_001005918
augcccgagcaggagcgccagaucaccgcccgcgagggcgccucccgcaagauccucuccaagcucucccuccccacccgcgccugggagcccgccaugaagaaguccuucgccuucgacaacgucggcuacgagggcggccucgacggccucggccccuccucccaggucgccaccuccaccguccgcauccucggcaugaccugccaguccugcgucaaguccaucgaggaccgcaucuccaaccucaagggcaucaucuccaugaaggucucccucgagcagggcuccgccaccgucaaguacguccccuccgucgucugccuccagcaggucugccaccagaucggcgacaugggcuucgaggccuccaucgccgagggcaaggccgccuccuggcccucccgcucccuccccgcccaggaggccgucgucaagcuccgcgucgagggcaugaccugccaguccugcgucuccuccaucgagggcaagguccgcaagcuccagggcgucguccgcgucaaggucucccucuccaaccaggaggccgucaucaccuaccagcccuaccucauccagcccgaggaccuccgcgaccacgucaacgacaugggcuucgaggccgccaucaaguccaaggucgccccccucucccucggccccaucgacaucgagcgccuccaguccaccaaccccaagcgcccccucuccuccgccaaccagaacuucaacaacuccgagacccucggccaccagggcucccacgucgucacccuccagcuccgcaucgacggcaugcacugcaaguccugcguccucaacaucgaggagaacaucggccagcuccucggcguccaguccauccaggucucccucgagaacaagaccgcccaggucaaguacgaccccuccugcaccucccccgucgcccuccagcgcgccaucgaggcccucccccccggcaacuucaaggucucccuccccgacggcgccgagggcuccggcaccgaccaccgcuccuccuccucccacucccccggcucccccccccgcaaccagguccagggcaccugcuccaccacccucaucgccaucgccggcaugaccugcgccuccugcguccacuccaucgagggcaugaucucccagcucgagggcguccagcagaucuccgucucccucgccgagggcaccgccaccguccucuacaaccccuccgucaucucccccgaggagcuccgcgccgccaucgaggacaugggcuucgaggccuccgucgucuccgaguccugcuccaccaacccccucggcaaccacuccgccggcaacuccaugguccagaccaccgacggcacccccaccuccguccaggaggucgccccccacaccggccgccuccccgccaaccacgcccccgacauccucgccaaguccccccaguccacccgcgccgucgccccccagaagugcuuccuccagaucaagggcaugaccugcgccuccugcgucuccaacaucgagcgcaaccuccagaaggaggccggcguccucuccguccucgucgcccucauggccggcaaggccgagaucaaguacgaccccgaggucauccagccccucgagaucgcccaguucauccaggaccucggcuucgaggccgccgucauggaggacuacgccggcuccgacggcaacaucgagcucaccaucaccggcaugaccugcgccuccugcguccacaacaucgaguccaagcucacccgcaccaacggcaucaccuacgccuccgucgcccucgccaccuccaaggcccucgucaaguucgaccccgagaucaucggcccccgcgacaucaucaagaucaucgaguccaagaccuccgaggcccucgccaagcucaugucccuccaggccaccgaggccaccgucgucacccucggcgaggacaaccucaucauccgcgaggagcagguccccauggagcucguccagcgcggcgacaucgucaaggucguccccggcggcaaguuccccgucgacggcaagguccucgagggcaacaccauggccgacgagucccucaucaccggcgaggccaugcccgucaccaagaagcccggcuccaccgucaucgccggcuccaucaacgcccacggcuccguccucaucaaggccacccacgucggcaacgacaccacccucgcccagaucgucaagcucgucgaggaggcccagauguccaagaaccccaacaagcacaucucccagaccgaggucaucauccgcuucgccuuccagaccuccaucaccguccucugcaucgccugccccugcucccucggccucgccacccccaccgccgucauggucggcaccggcgucgccgcccagaacggcauccucaucaagggcggcaagccccucgagauggcccacaagaucaagaccgucauguucgacaagaccggcaccaucacccacggcgucccccgcgucaugcgcguccuccuccucggcgacgucgccacccucccccuccgcaagguccucgccgucgucggcaccgccgaggccuccuccgagcacccccucggcgucgccgucaccaaguacugcaaggaggagcucggcaccgagacccucggcuacugcaccgacuuccaggccguccccggcugcggcaucggcugcaaggucuccaacgucgagggcauccucgcccacuccgagcgcccccucuccgcccccgccucccaccucaacgaggccggcucccuccccgccgagaaggacgccgucccccagaccuucuccguccucaucggcaaccgcgaguggcuccgccgcaacggccucaccaucuccuccgacgucuccgacgccaugaccgaccacgagaugaagggccagaccgccauccucgucgccaucgacggcguccucugcggcaugaucgccaucgccgacgccgucaagcaggaggccgcccucgccguccacacccuccaguccaugggcgucgacgucguccucaucaccggcgacaaccgcaagaccgcccgcgccaucgccacccaggucggcaucaacaaggucuucgccgagguccuccccucccacaaggucgccaagguccaggagcuccagaacaagggcaagaaggucgccauggucggcgacggcgucaacgacucccccgcccucgcccaggccgacaugggcgucgccaucggcaccggcaccgacgucgccaucgaggccgccgacgucguccucauccgcaacgaccuccucgacgucgucgccuccauccaccucuccaagcgcaccguccgccgcauccgcaucaaccucguccucgcccucaucuacaaccucgucggcauccccaucgccgccggcgucuucaugcccaucggcaucguccuccagcccuggaugggcuccgccgccauggccgccuccuccgucuccgucguccucuccucccuccagcucaagugcuacaagaagcccgaccucgagcgcuacgaggcccaggcccacggccacaugaagccccucaccgccucccaggucuccguccacaucggcauggacgaccgcuggcgcgacuccccccgcgccacccccugggaccaggucuccuacgucucccaggucucccucuccucccucaccuccgacaagcccucccgccacuccgccgccgccgacgacgacggcgacaaguggucccuccuccucaacggccgcgacgaggagcaguacaucuga

SEQ ID NO: 40135 - RNA, 3450 nt, Artificial Sequence
  derived and/or modified sequence opt2 from ATP8A1__Homo_sapiens__NP_001098999
augcccaccaugcgccgcaccgucuccgagauccgcucccgcgccgagggcuacgagaagaccgacgacgucuccgagaagaccucccucgccgaccaggaggagguccgcaccaucuucaucaaccagccccagcucaccaaguucugcaacaaccacgucuccaccgccaaguacaacaucaucaccuuccucccccgcuuccucuacucccaguuccgccgcgccgccaacuccuucuuccucuucaucgcccuccuccagcagauccccgacgucucccccaccggccgcuacaccacccucgucccccuccucuucauccucgccgucgccgccaucaaggagaucaucgaggacaucaagcgccacaaggccgacaacgccgucaacaagaagcagacccagguccuccgcaacggcgccugggagaucguccacugggagaaggucaacgucggcgacaucgucaucaucaagggcaaggaguacauccccgccgacaccguccuccucuccuccuccgagccccaggccaugugcuacaucgagaccuccaaccucgacggcgagaccaaccucaagauccgccagggccuccccgccaccuccgacaucaaggacgucgacucccucaugcgcaucuccggccgcaucgagugcgagucccccaaccgccaccucuacgacuucgucggcaacauccgccucgacggccacggcaccgucccccucggcgccgaccagauccuccuccgcggcgcccagcuccgcaacacccaguggguccacggcaucgucgucuacaccggccacgacaccaagcucaugcagaacuccaccucccccccccucaagcucuccaacgucgagcgcaucaccaacguccagauccucauccucuucugcauccucaucgccaugucccucgucugcuccgucggcuccgccaucuggaaccgccgccacuccggcaaggacugguaccucaaccucaacuacggcggcgccuccaacuucggccucaacuuccucaccuucaucauccucuucaacaaccucauccccaucucccuccucgucacccucgaggucgucaaguucacccaggccuacuucaucaacugggaccucgacaugcacuacgagcccaccgacaccgccgccauggcccgcaccuccaaccucaacgaggagcucggccaggucaaguacaucuucuccgacaagaccggcacccucaccugcaacgucaugcaguucaagaagugcaccaucgccggcgucgccuacggccagaacucccaguucggcgacgagaagaccuucuccgacuccucccuccucgagaaccuccagaacaaccaccccaccgcccccaucaucugcgaguuccucaccaugauggccgucugccacaccgccguccccgagcgcgagggcgacaagaucaucuaccaggccgccucccccgacgagggcgcccucguccgcgccgccaagcagcucaacuucgucuucaccggccgcacccccgacuccgucaucaucgacucccucggccaggaggagcgcuacgagcuccucaacguccucgaguucaccuccgcccgcaagcgcauguccgucaucguccgcacccccuccggcaagcuccgccucuacugcaagggcgccgacaccgucaucuacgaccgccucgccgagaccuccaaguacaaggagaucacccucaagcaccucgagcaguucgccaccgagggccuccgcacccucugcuucgccgucgccgagaucuccgaguccgacuuccaggaguggcgcgccgucuaccagcgcgccuccaccuccguccagaaccgccuccucaagcucgaggaguccuacgagcucaucgagaagaaccuccagcuccucggcgccaccgccaucgaggacaagcuccaggaccagguccccgagaccaucgagacccucaugaaggccgacaucaagaucuggauccucaccggcgacaagcaggagaccgccaucaacaucggccacuccugcaagcuccucaagaagaacaugggcaugaucgucaucaacgagggcucccucgacggcacccgcgagacccucucccgccacugcaccacccucggcgacgcccuccgcaaggagaacgacuucgcccucaucaucgacggcaagacccucaaguacgcccucaccuucggcguccgccaguacuuccucgaccucgcccucuccugcaaggccgucaucugcugccgcgucuccccccuccagaaguccgaggucgucgagauggucaagaagcaggucaaggucgucacccucgccaucggcgacggcgccaacgacgucuccaugauccagaccgcccacgucggcgucggcaucuccggcaacgagggccuccaggccgccaacuccuccgacuacuccaucgcccaguucaaguaccucaagaaccuccucaugauccacggcgccuggaacuacaaccgcgucuccaagugcauccucuacugcuucuacaagaacaucguccucuacaucaucgagaucugguucgccuucgucaacggcuucuccggccagauccucuucgagcgcuggugcaucggccucuacaacgucauguucaccgccaugcccccccucacccucggcaucuucgagcgcuccugccgcaaggagaacaugcucaaguaccccgagcucuacaagaccucccagaacgcccucgacuucaacaccaaggucuucuggguccacugccucaacggccucuuccacuccgucauccucuucugguucccccucaaggcccuccaguacggcaccgccuucggcaacggcaagaccuccgacuaccuccuccucggcaacuucgucuacaccuucgucgucaucaccgucugccucaaggccggccucgagaccuccuacuggaccugguucucccacaucgccaucuggggcuccaucgcccucugggucgucuucuucggcaucuacuccucccucuggcccgccauccccauggcccccgacauguccggcgaggccgccaugcucuucuccuccggcgucuucuggaugggccuccucuucauccccgucgccucccuccuccucgacgucgucuacaaggucaucaagcgcaccgccuucaagacccucgucgacgagguccaggagcucgaggccaagucccaggaccccggcgccgucguccucggcaagucccucaccgagcgcgcccagcuccucaagaacgucuucaagaagaaccacgucaaccucuaccgcuccgagucccuccagcagaaccuccuccacggcuacgccuucucccaggacgagaacggcaucgucucccaguccgaggucauccgcgccuacgacaccaccaagcagcgccccgacgagugguga

SEQ ID NO: 40136 - RNA, 3567 nt, Artificial Sequence
  derived and/or modified sequence opt2 from ATP8A2__Homo_sapiens__NP_057613
augcucaacggcgccggccucgacaaggcccucaagaugucccucccccgccgcucccgcauccgcuccuccgucggccccguccgcuccucccucggcuacaagaaggccgaggacgagaugucccgcgccaccuccgucggcgaccagcucgaggcccccgcccgcaccaucuaccucaaccagccccaccucaacaaguuccgcgacaaccagaucuccaccgccaaguacuccguccucaccuuccucccccgcuuccucuacgagcagauccgccgcgccgccaacgccuucuuccucuucaucgcccuccuccagcagauccccgacgucucccccaccggccgcuacaccacccucgucccccucaucaucauccucaccaucgccggcaucaaggagaucgucgaggacuucaagcgccacaaggccgacaacgccgucaacaagaagaagaccaucguccuccgcaacggcauguggcacaccaucauguggaaggaggucgccgucggcgacaucgucaaggucgucaacggccaguaccuccccgccgacgucguccuccucuccuccuccgagccccaggccaugugcuacgucgagaccgccaaccucgacggcgagaccaaccucaagauccgccagggccucucccacaccgccgacaugcagacccgcgagguccucaugaagcucuccggcaccaucgagugcgagggccccaaccgccaccucuacgacuucaccggcaaccucaaccucgacggcaagucccucgucgcccucggccccgaccagauccuccuccgcggcacccagcuccgcaacacccagugggucuucggcaucgucgucuacaccggccacgacaccaagcucaugcagaacuccaccaaggccccccucaagcgcuccaacgucgagaaggucaccaacguccagauccucguccucuucggcauccuccucgucauggcccucgucuccuccgccggcgcccucuacuggaaccgcucccacggcgagaagaacugguacaucaagaagauggacaccaccuccgacaacuucggcuacaaccuccucaccuucaucauccucuacaacaaccucauccccaucucccuccucgucacccucgaggucgucaaguacacccaggcccucuucaucaacugggacaccgacauguacuacaucggcaacgacacccccgccauggcccgcaccuccaaccucaacgaggagcucggccaggucaaguaccucuucuccgacaagaccggcacccucaccugcaacaucaugaacuucaagaagugcuccaucgccggcgucaccuacggccacuuccccgagcucgcccgcgagcccuccuccgacgacuucugccgcaugcccccccccugcuccgacuccugcgacuucgacgacccccgccuccucaagaacaucgaggaccgccaccccaccgcccccugcauccaggaguuccucacccuccucgccgucugccacaccgucguccccgagaaggacggcgacaacaucaucuaccaggccuccucccccgacgaggccgcccucgucaagggcgccaagaagcucggcuucgucuucaccgcccgcacccccuucuccgucaucaucgaggccaugggccaggagcagaccuucggcauccucaacguccucgaguucuccuccgaccgcaagcgcauguccgucaucguccgcacccccuccggccgccuccgccucuacugcaagggcgccgacaacgucaucuucgagcgccucuccaaggacuccaaguacauggaggagacccucugccaccucgaguacuucgccaccgagggccuccgcacccucugcgucgccuacgccgaccucuccgagaacgaguacgaggaguggcucaaggucuaccaggaggccuccaccauccucaaggaccgcgcccagcgccucgaggagugcuacgagaucaucgagaagaaccuccuccuccucggcgccaccgccaucgaggaccgccuccaggccggcguccccgagaccaucgccacccuccucaaggccgagaucaagaucuggguccucaccggcgacaagcaggagaccgccaucaacaucggcuacuccugccgccucgucucccagaacauggcccucauccuccucaaggaggacucccucgacgccacccgcgccgccaucacccagcacugcaccgaccucggcaaccuccucggcaaggagaacgacgucgcccucaucaucgacggccacacccucaaguacgcccucuccuucgagguccgccgcuccuuccucgaccucgcccucuccugcaaggccgucaucugcugccgcgucuccccccuccagaaguccgagaucgucgacgucgucaagaagcgcgucaaggccaucacccucgccaucggcgacggcgccaacgacgucggcaugauccagaccgcccacgucggcgucggcaucuccggcaacgagggcaugcaggccaccaacaacuccgacuacgccaucgcccaguucuccuaccucgagaagcuccuccucguccacggcgccugguccuacaaccgcgucaccaagugcauccucuacugcuucuacaagaacgucguccucuacaucaucgagcucugguucgccuucgucaacggcuucuccggccagauccucuucgagcgcuggugcaucggccucuacaacgucaucuucaccgcccucccccccuucacccucggcaucuucgagcgcuccugcacccaggaguccaugcuccgcuucccccagcucuacaagaucacccagaacggcgagggcuucaacaccaaggucuucuggggccacugcaucaacgcccucguccacucccucauccucuucugguuccccaugaaggcccucgagcacgacaccguccucaccuccggccacgccaccgacuaccucuucgucggcaacaucgucuacaccuacgucgucgucaccgucugccucaaggccggccucgagaccaccgccuggaccaaguucucccaccucgccgucuggggcuccaugcucaccuggcucgucuucuucggcaucuacuccaccaucuggcccaccauccccaucgcccccgacaugcgcggccaggccaccaugguccucuccuccgcccacuucuggcucggccucuuccucguccccaccgccugccucaucgaggacgucgccuggcgcgccgccaagcacaccugcaagaagacccuccucgaggagguccaggagcucgagaccaagucccgcguccucggcaaggccguccuccgcgacuccaacggcaagcgccucaacgagcgcgaccgccucaucaagcgccucggccgcaagaccccccccacccucuuccgcggcuccucccuccagcagggcgucccccacggcuacgccuucucccaggaggagcacggcgccgucucccaggaggaggucauccgcgccuacgacaccaccaagaagaagucccgcaagaaguga

SEQ ID NO: 40137 - RNA, 3756 nt, Artificial Sequence
  derived and/or modified sequence opt2 from ATP8B1__Homo_sapiens__XP_011524324
auguccaccgagcgcgacuccgagaccaccuucgacgaggacucccagcccaacgacgaggucguccccuacuccgacgacgagaccgaggacgagcucgacgaccagggcuccgccgucgagcccgagcagaaccgcgucaaccgcgaggccgaggagaaccgcgagcccuuccgcaaggagugcaccuggcaggucaaggccaacgaccgcaaguaccacgagcagccccacuucaugaacaccaaguuccucugcaucaaggaguccaaguacgccaacaacgccaucaagaccuacaaguacaacgccuucaccuucauccccaugaaccucuucgagcaguucaagcgcgccgccaaccucuacuuccucgcccuccucauccuccaggccgucccccagaucuccacccucgccugguacaccacccucgucccccuccucgucguccucggcgucaccgccaucaaggaccucgucgacgacgucgcccgccacaagauggacaaggagaucaacaaccgcaccugcgaggucaucaaggacggccgcuucaaggucgccaaguggaaggagauccaggucggcgacgucauccgccucaagaagaacgacuucguccccgccgacauccuccuccucuccuccuccgagcccaacucccucugcuacgucgagaccgccgagcucgacggcgagaccaaccucaaguucaagaugucccucgagaucaccgaccaguaccuccagcgcgaggacacccucgccaccuucgacggcuucaucgagugcgaggagcccaacaaccgccucgacaaguucaccggcacccucuucuggcgcaacaccuccuucccccucgacgccgacaagauccuccuccgcggcugcgucauccgcaacaccgacuucugccacggccucgucaucuucgccggcgccgacaccaagaucaugaagaacuccggcaagacccgcuucaagcgcaccaagaucgacuaccucaugaacuacauggucuacaccaucuucgucguccucauccuccucuccgccggccucgccaucggccacgccuacugggaggcccaggucggcaacuccuccugguaccucuacgacggcgaggacgacacccccuccuaccgcggcuuccucaucuucuggggcuacaucaucguccucaacaccaugguccccaucucccucuacgucuccgucgaggucauccgccucggccagucccacuucaucaacugggaccuccagauguacuacgccgagaaggacacccccgccaaggcccgcaccaccacccucaacgagcagcucggccagauccacuacaucuucuccgacaagaccggcacccucacccagaacaucaugaccuucaagaagugcugcaucaacggccagaucuacggcgaccaccgcgacgccucccagcacaaccacaacaagaucgagcaggucgacuucuccuggaacaccuacgccgacggcaagcucgccuucuacgaccacuaccucaucgagcagauccaguccggcaaggagcccgagguccgccaguucuucuuccuccucgccgucugccacaccgucauggucgaccgcaccgacggccagcucaacuaccaggccgccucccccgacgagggcgcccucgucaacgccgcccgcaacuucggcuucgccuuccucgcccgcacccagaacaccaucaccaucuccgagcucggcaccgagcgcaccuacaacguccucgccauccucgacuucaacuccgaccgcaagcgcauguccaucaucguccgcacccccgagggcaacaucaagcucuacugcaagggcgccgacaccgucaucuacgagcgccuccaccgcaugaaccccaccaagcaggagacccaggacgcccucgacaucuucgccaacgagacccuccgcacccucugccucugcuacaaggagaucgaggagaaggaguucaccgaguggaacaagaaguucauggccgccuccgucgccuccaccaaccgcgacgaggcccucgacaaggucuacgaggagaucgagaaggaccucauccuccucggcgccaccgccaucgaggacaagcuccaggacggcguccccgagaccaucuccaagcucgccaaggccgacaucaagaucuggguccucaccggcgacaagaaggagaccgccgagaacaucggcuucgccugcgagcuccucaccgaggacaccaccaucugcuacggcgaggacaucaacucccuccuccacgcccgcauggagaaccagcgcaaccgcggcggcgucuacgccaaguucgccccccccguccaggaguccuucuucccccccggcggcaaccgcgcccucaucaucaccggcuccuggcucaacgagauccuccucgagaagaagaccaagcgcaacaagauccucaagcucaaguucccccgcaccgaggaggagcgccgcaugcgcacccaguccaagcgccgccucgaggccaagaaggagcagcgccagaagaacuucgucgaccucgccugcgagugcuccgccgucaucugcugccgcgucacccccaagcagaaggccauggucgucgaccucgucaagcgcuacaagaaggccaucacccucgccaucggcgacggcgccaacgacgucaacaugaucaagaccgcccacaucggcgucggcaucuccggccaggagggcaugcaggccgucauguccuccgacuacuccuucgcccaguuccgcuaccuccagcgccuccuccucguccacggccgcugguccuacauccgcaugugcaaguuccuccgcuacuucuucuacaagaacuucgccuucacccucguccacuucugguacuccuucuucaacggcuacuccgcccagaccgccuacgaggacugguucaucacccucuacaacguccucuacaccucccuccccguccuccucaugggccuccucgaccaggacgucuccgacaagcucucccuccgcuuccccggccucuacaucgucggccagcgcgaccuccucuucaacuacaagcgcuucuucgucucccuccuccacggcguccucaccuccaugauccucuucuucaucccccucggcgccuaccuccagaccgucggccaggacggcgaggcccccuccgacuaccaguccuucgccgucaccaucgccuccgcccucgucaucaccgucaacuuccagaucggccucgacaccuccuacuggaccuucgucaacgccuucuccaucuucggcuccaucgcccucuacuucggcaucauguucgacuuccacuccgccggcauccacguccucuuccccuccgccuuccaguucaccggcaccgccuccaacgcccuccgccagcccuacaucuggcucaccaucauccucgccgucgccgucugccuccuccccgucgucgccauccgcuuccucuccaugaccaucuggcccuccgaguccgacaagauccagaagcaccgcaagcgccucaaggccgaggagcaguggcagcgccgccagcaggucuuccgccgcggcgucuccacccgccgcuccgccuacgccuucucccaccagcgcggcuacgccgaccucaucuccuccggccgcuccauccgcaagaagcgcuccccccucgacgccaucgucgccgacggcaccgccgaguaccgccgcaccggcgacuccuga

SEQ ID NO: 40138 - RNA, 3792 nt, Artificial Sequence
  derived and/or modified sequence opt2 from ATP8B3__Homo_sapiens__NP_001171473
augggcgacucccccggccgcggcgcccccgagcgccgccacaaggcccagcccggccgcgcccgcaaguacgaguggcgccccgagggccccaccuccaugggcucccucggccagcgcgaggaccuccaggacgaggaccgcaacuccgccuucaccuggaagguccaggccaacaaccgcgccuacaacggccaguucaaggagaaggucauccucugcuggcagcgcaagaaguacaagaccaacgucauccgcaccgccaaguacaacuucuacuccuuccucccccucaaccucuacgagcaguuccaccgcgucuccaaccucuucuuccucaucaucaucauccuccaguccauccccgacaucuccacccuccccugguucucccucuccacccccauggucugccuccucuucauccgcgccacccgcgaccucgucgacgacaugggccgccacaaguccgaccgcgccaucaacaaccgccccugccagauccucaugggcaaguccuucaagcagaagaaguggcaggaccucugcgucggcgacgucgucugccuccgcaaggacaacaucguccccgccgacaugcuccuccucgccuccaccgagcccuccucccucugcuacgucgagaccgucgacaucgacggcgagaccaaccucaaguuccgccaggcccucauggucacccacaaggagcucgccaccaucaagaagauggccuccuuccagggcaccgucaccugcgaggcccccaacucccgcaugcaccacuucgucggcugccucgaguggaacgacaagaaguacucccucgacaucggcaaccuccuccuccgcggcugccgcauccgcaacaccgacaccugcuacggccucgucaucuacgccgacggcuacauguucgucggcuucgacaccaagaucaugaagaacugcggcaagauccaccucaagcgcaccaagcucgaccuccucaugaacaagcucgucgucgucaucuucaucuccgucguccucgucugccucguccucgccuucggcuucggcuucuccgucaaggaguucaaggaccaccacuacuaccucuccggcguccacggcuccuccgucgccgccgaguccuucuucgucuucugguccuuccucauccuccucuccgucaccauccccauguccauguucauccucuccgaguucaucuaccucggcaacuccgucuucaucgacugggacguccagauguacuacaagccccaggacguccccgccaaggcccgcuccaccucccucaacgaccaccucggccaggucgaguacaucuucuccgacaagaccggcacccucacccagaacauccucaccuucaacaagugcugcaucuccggccgcgucuacggccccgacuccgaggccaccacccgccccaaggagaaccccuaccucuggaacaaguucgccgacggcaagcuccucuuccacaacgccgcccuccuccaccucguccgcaccaacggcgacgaggccguccgcgaguucuggcgccuccucgccaucugccacaccgucaugguccgcgaguccccccgcgagcgccccgaccagcuccucuaccaggccgccucccccgacgagggcgcccucgucaccgccgcccgcaacuucggcuacgucuuccucucccgcacccaggacaccgucaccaucauggagcucggcgaggagcgcgucuaccagguccucgccaucauggacuucaacuccacccgcaagcgcauguccguccucguccgcaagcccgagggcgccaucugccucuacaccaagggcgccgacaccgucaucuucgagcgccuccaccgccgcggcgccauggaguucgccaccgaggaggcccucgccgccuucgcccaggagacccuccgcacccucugccucgccuaccgcgaggucgccgaggacaucuacgaggacuggcagcagcgccaccaggaggccucccuccuccuccagaaccgcgcccaggcccuccagcaggucuacaacgagauggagcaggaccuccgccuccucggcgccaccgccaucgaggaccgccuccaggacggcguccccgagaccaucaagugccucaagaaguccaacaucaagaucuggguccucaccggcgacaagcaggagaccgccgucaacaucggcuucgccugcgagcuccucuccgagaacaugcucauccucgaggagaaggagaucucccgcauccucgagaccuacugggagaacuccaacaaccuccucacccgcgagucccucucccaggucaagcucgcccucgucaucaacggcgacuuccucgacaagcuccucgucucccuccgcaaggagccccgcgcccucgcccagaacgucaacauggacgaggccuggcaggagcucggccagucccgccgcgacuuccucuacgcccgccgccucucccuccucugccgccgcuucggccucccccucgccgccccccccgcccaggacucccgcgcccgccgcuccuccgagguccuccaggagcgcgccuucgucgaccucgccuccaagugccaggccgucaucugcugccgcgucacccccaagcagaaggcccucaucgucgcccucgucaagaaguaccaccaggucgucacccucgccaucggcgacggcgccaacgacaucaacaugaucaagaccgccgacgucggcgucggccucgccggccaggagggcaugcaggccguccagaacuccgacuucguccucggccaguucugcuuccuccagcgccuccuccucguccacggccgcugguccuacguccgcaucugcaaguuccuccgcuacuucuucuacaaguccauggccuccaugaugguccaggucugguucgccugcuacaacggcuucaccggccagccccucuacgagggcugguuccucgcccucuucaaccuccucuacuccacccuccccguccucuacaucggccucuucgagcaggacgucuccgccgagcagucccucgagaagcccgagcucuacgucgucggccagaaggacgagcucuucaacuacugggucuucguccaggccaucgcccacggcgucaccaccucccucgucaacuucuucaugacccucuggaucucccgcgacaccgccggccccgccuccuucuccgaccaccaguccuucgccgucgucgucgcccucuccugccuccucuccaucaccauggaggucauccucaucaucaaguacuggaccgcccucugcgucgccaccauccuccucucccucggcuucuacgccaucaugaccaccaccacccaguccuucuggcucuuccgcgucucccccaccaccuuccccuuccucuacgccgaccucuccgucauguccucccccuccauccuccucgucguccuccucuccgucuccaucaacaccuuccccguccucgcccuccgcgucaucuuccccgcccucaaggagcuccgcgccaaggaggagaaggucgaggagggccccuccgaggagaucuucaccauggagccccucccccacguccaccgcgagucccgcgcccgccgcuccuccuacgccuucucccaccgcgagggcuacgccaaccucaucacccagggcaccauccuccgccgcggccccggcgucuccuccgacaucgccuccgagucccucgaccccuccgacgaggaggccgccuccucccccaaggagucccaguga

SEQ ID NO: 40139 - RNA, 3579 nt, Artificial Sequence
  derived and/or modified sequence opt2 from ATP8B4__Homo_sapiens__NP_079113
auguucugcuccgagaagaagcuccgcgaggucgagcgcaucgucaaggccaacgaccgcgaguacaacgagaaguuccaguacgccgacaaccgcauccacaccuccaaguacaacauccucaccuuccuccccaucaaccucuucgagcaguuccagcgcgucgccaacgccuacuuccucugccuccucauccuccagcucauccccgagaucuccucccucaccugguucaccaccaucgucccccucguccucgucaucaccaugaccgccgucaaggacgccaccgacgacuacuuccgccacaaguccgacaaccaggucaacaaccgccaguccgagguccucaucaacuccaagcuccagaacgagaaguggaugaacgucaaggucggcgacaucaucaagcucgagaacaaccaguucgucgccgccgaccuccuccuccucuccuccuccgagccccacggccucugcuacgucgagaccgccgagcucgacggcgagaccaaccucaagguccgccacgcccucuccgucaccuccgagcucggcgccgacaucucccgccucgccggcuucgacggcaucgucgucugcgagguccccaacaacaagcucgacaaguucaugggcauccucuccuggaaggacuccaagcacucccucaacaacgagaagaucauccuccgcggcugcauccuccgcaacaccuccuggugcuucggcauggucaucuucgccggccccgacaccaagcucaugcagaacuccggcaagaccaaguucaagcgcaccuccaucgaccgccucaugaacacccucguccucuggaucuucggcuuccucaucugccucggcaucauccucgccaucggcaacuccaucugggagucccagaccggcgaccaguuccgcaccuuccucuucuggaacgagggcgagaaguccuccgucuucuccggcuuccucaccuucugguccuacaucaucauccucaacaccgucguccccaucucccucuacgucuccgucgaggucauccgccucggccacuccuacuucaucaacugggaccgcaagauguacuacucccgcaaggccauccccgccgucgcccgcaccaccacccucaacgaggagcucggccagaucgaguacaucuucuccgacaagaccggcacccucacccagaacaucaugaccuucaagcgcugcuccaucaacggccgcaucuacggcgagguccacgacgaccucgaccagaagaccgagaucacccaggagaaggagcccgucgacuucuccgucaagucccaggccgaccgcgaguuccaguucuucgaccaccaccucauggaguccaucaagaugggcgaccccaagguccacgaguuccuccgccuccucgcccucugccacaccgucauguccgaggagaacuccgccggcgagcucaucuaccagguccagucccccgacgagggcgcccucgucaccgccgcccgcaacuucggcuucaucuucaagucccgcacccccgagaccaucaccaucgaggagcucggcacccucgucaccuaccagcuccucgccuuccucgacuucaacaacacccgcaagcgcauguccgucaucguccgcaaccccgagggccagaucaagcucuacuccaagggcgccgacaccauccucuucgagaagcuccaccccuccaacgagguccuccucucccucaccuccgaccaccucuccgaguucgccggcgagggccuccgcacccucgccaucgccuaccgcgaccucgacgacaaguacuucaaggaguggcacaagaugcucgaggacgccaacgccgccaccgaggagcgcgacgagcgcaucgccggccucuacgaggagaucgagcgcgaccucaugcuccucggcgccaccgccgucgaggacaagcuccaggagggcgucaucgagaccgucaccucccucucccucgccaacaucaagaucuggguccucaccggcgacaagcaggagaccgccaucaacaucggcuacgccugcaacaugcucaccgacgacaugaacgacgucuucgucaucgccggcaacaacgccgucgagguccgcgaggagcuccgcaaggccaagcagaaccucuucggccagaaccgcaacuucuccaacggccacgucgucugcgagaagaagcagcagcucgagcucgacuccaucgucgaggagaccaucaccggcgacuacgcccucaucaucaacggccacucccucgcccacgcccucgaguccgacgucaagaacgaccuccucgagcucgccugcaugugcaagaccgucaucugcugccgcgucaccccccuccagaaggcccaggucgucgagcucgucaagaaguaccgcaacgccgucacccucgccaucggcgacggcgccaacgacgucuccaugaucaaguccgcccacaucggcgucggcaucuccggccaggagggccuccaggccguccucgccuccgacuacuccuucgcccaguuccgcuaccuccagcgccuccuccucguccacggccgcugguccuacuuccgcaugugcaaguuccucugcuacuucuucuacaagaacuucgccuucacccucguccacuucugguucggcuucuucugcggcuucuccgcccagaccgucuacgaccagugguucaucacccucuucaacaucgucuacaccucccuccccguccucgccaugggcaucuucgaccaggacgucuccgaccagaacuccgucgacugcccccagcucuacaagcccggccagcucaaccuccucuucaacaagcgcaaguucuucaucugcguccuccacggcaucuacaccucccucguccucuucuucauccccuacggcgccuucuacaacgucgccggcgaggacggccagcacaucgccgacuaccaguccuucgccgucaccauggccaccucccucgucaucgucgucuccguccagaucgcccucgacaccuccuacuggaccuucaucaaccacgucuucaucuggggcuccaucgccaucuacuucuccauccucuucaccaugcacuccaacggcaucuucggcaucuuccccaaccaguuccccuucgucggcaacgcccgccacucccucacccagaagugcaucuggcucgucauccuccucaccaccgucgccuccgucaugcccgucgucgccuuccgcuuccucaaggucgaccucuaccccacccucuccgaccagauccgccgcuggcagaaggcccagaagaaggcccgcccccccuccucccgccgcccccgcacccgccgcuccuccucccgccgcuccggcuacgccuucgcccaccaggagggcuacggcgagcucaucaccuccggcaagaacaugcgcgccaagaaccccccccccaccuccggccucgagaagacccacuacaacuccaccuccuggaucgagaaccucugcaagaagaccaccgacaccgucuccuccuucucccaggacaagaccgucaagcucuga

SEQ ID NO: 40140 - RNA, 3444 nt, Artificial Sequence
  derived and/or modified sequence opt2 from ATP9B__Homo_sapiens__NP_940933
auggccgaccagaucccccucuaccccguccgcuccgccgccgccgccgccgccaaccgcaagcgcgccgccuacuacuccgccgccggcccccgccccggcgccgaccgccacucccgcuaccagcucgaggacgaguccgcccaccucgacgagaugccccucaugauguccgaggagggcuucgagaacgaggaguccgacuaccacacccucccccgcgcccgcaucaugcagcgcaagcgcggccucgagugguucgucugcgacggcuggaaguuccucugcaccuccugcugcggcuggcucaucaacaucugccgccgcaagaaggagcucaaggcccgcaccgucuggcucggcugccccgagaagugcgaggagaagcacccccgcaacuccaucaagaaccagaaguacaacgucuucaccuucauccccggcguccucuacgagcaguucaaguucuuccucaaccucuacuuccucgucaucuccugcucccaguucguccccgcccucaagaucggcuaccucuacaccuacugggccccccucggcuucguccucgccgucaccaugacccgcgaggccaucgacgaguuccgccgcuuccagcgcgacaaggaggucaacucccagcucuacuccaagcucaccguccgcggcaagguccaggucaaguccuccgacauccaggucggcgaccucaucaucgucgagaagaaccagcgcauccccuccgacauggucuuccuccgcaccuccgagaaggccggcuccugcuucauccgcaccgaccagcucgacggcgagaccgacuggaagcucaaggucgccgucuccugcacccagcagcuccccgcccucggcgaccucuucuccaucuccgccuacgucuacgcccagaagccccagauggacauccacuccuucgagggcaccuucacccgcgaggacuccgacccccccauccacgagucccucuccaucgagaacacccucugggccuccaccaucgucgccuccggcaccgucaucggcgucgucaucuacaccggcaaggagacccgcuccgucaugaacaccuccaaccccaagaacaaggucggccuccucgaccucgagcucaaccgccucaccaaggcccucuuccucgcccucgucgcccucuccaucgucauggucacccuccagggcuucgucggccccugguaccgcaaccucuuccgcuuccuccuccucuucuccuacaucauccccaucucccuccgcgucaaccucgacaugggcaaggccgucuacggcuggaugaugaugaaggacgagaacauccccggcaccgucguccgcaccuccaccauccccgaggagcucggccgccucgucuaccuccucaccgacaagaccggcacccucacccagaacgagaugaucuucaagcgccuccaccucggcaccgucuccuacggcgccgacaccauggacgagauccagucccacguccgcgacuccuacucccagaugcagucccaggccggcggcaacaacaccggcuccaccccccuccgcaaggcccaguccuccgcccccaagguccgcaaguccgucuccucccgcauccacgaggccgucaaggccaucguccucugccacaacgucacccccgucuacgagucccgcgccggcgucaccgaggagaccgaguucgccgaggccgaccaggacuucuccgacgagaaccgcaccuaccaggccuccucccccgacgaggucgcccucguccaguggaccgaguccgucggccucacccucgucucccgcgaccucaccuccaugcagcucaagacccccuccggccagguccucuccuucugcauccuccagcucuuccccuucaccuccgaguccaagcgcaugggcgucaucguccgcgacgaguccaccgccgagaucaccuucuacaugaagggcgccgacgucgccaugucccccaucguccaguacaacgacuggcucgaggaggagugcggcaacauggcccgcgagggccuccgcacccucgucgucgccaagaaggcccucaccgaggagcaguaccaggacuucgagucccgcuacacccaggccaagcucuccaugcacgaccgcucccucaaggucgccgccgucgucgagucccucgagcgcgagauggagcuccucugccucaccggcgucgaggaccagcuccaggccgacguccgccccacccucgagaugcuccgcaacgccggcaucaagaucuggaugcucaccggcgacaagcucgagaccgccaccugcaucgccaaguccucccaccucgucucccgcacccaggacauccacaucuuccgccaggucaccucccgcggcgaggcccaccucgagcucaacgccuuccgccgcaagcacgacugcgcccucgucaucuccggcgacucccucgaggucugccucaaguacuacgagcacgaguucgucgagcucgccugccagugccccgccgucgucugcugccgcugcucccccacccagaaggcccgcaucgucacccuccuccagcagcacaccggccgccgcaccugcgccaucggcgacggcggcaacgacgucuccaugauccaggccgccgacugcggcaucggcaucgagggcaaggagggcaagcaggccucccucgccgccgacuucuccaucacccaguuccgccacaucggccgccuccucaugguccacggccgcaacuccuacaagcgcuccgccgcccucggccaguucgucaugcaccgcggccucaucaucuccaccaugcaggccgucuucuccuccgucuucuacuucgccuccgucccccucuaccagggcuuccucauggucggcuacgccaccaucuacaccauguuccccgucuucucccucguccucgaccaggacgucaagcccgagauggccaugcucuaccccgagcucuacaaggaccucaccaagggccgcucccucuccuucaagaccuuccucaucuggguccucaucuccaucuaccagggcggcauccucauguacggcgcccucguccucuucgaguccgaguucguccacgucgucgccaucuccuucaccgcccucauccucaccgagcuccucauggucgcccucaccguccgcaccuggcacuggcucauggucgucgccgaguuccucucccucggcugcuacgucuccucccucgccuuccucaacgaguacuucggcaucggccgcgucuccuucggcgccuuccucgacgucgccuucaucaccaccgucaccuuccucuggaaggucuccgccaucaccgucgucuccugccucccccucuacguccucaaguaccuccgccgcaagcucuccccccccuccuacugcaagcucgccuccuga

SEQ ID NO: 40141 - RNA, 870 nt, Artificial Sequence
  derived and/or modified sequence opt2 from ATPAF2__Homo_sapiens__NP_663729
auguggcgcuccugccuccgccuccgcgacggcggccgccgccuccucaaccgccccgccggcggccccuccgccuccaugucccccggccccaccauccccucccccgcccgcgccuacgccccccccaccgagcgcaagcgcuucuaccagaacgucuccaucacccagggcgagggcggcuucgagaucaaccucgaccaccgcaagcucaagaccccccaggccaagcucuucaccguccccuccgaggcccucgccaucgccgucgccaccgagugggacucccagcaggacaccaucaaguacuacaccaugcaccucaccacccucugcaacaccucccucgacaaccccacccagcgcaacaaggaccagcucauccgcgccgccgucaaguuccucgacaccgacaccaucugcuaccgcgucgaggagcccgagacccucgucgagcuccagcgcaacgagugggaccccaucaucgagugggccgagaagcgcuacggcgucgagaucuccuccuccaccuccaucaugggccccuccauccccgccaagacccgcgagguccucgucucccaccucgccuccuacaacaccugggcccuccagggcaucgaguucgucgccgcccagcucaaguccaugguccucacccucggccucaucgaccuccgccucaccgucgagcaggccguccuccucucccgccucgaggaggaguaccagauccagaaguggggcaacaucgagugggcccacgacuacgagcuccaggagcuccgcgcccgcaccgccgccggcacccucuucauccaccucugcuccgaguccaccaccgucaagcacaagcuccucaaggaguga

SEQ ID NO: 40142 - RNA, 690 nt, Artificial Sequence
  derived and/or modified sequence opt2 from ATRAID__Homo_sapiens__NP_001164266
auggccccccacgaccccggcucccucaccacccucguccccugggccgccgcccuccuccucgcccucggcgucgagcgcgcccucgcccuccccgagaucugcacccagugccccggcuccguccagaaccucuccaaggucgccuucuacugcaagaccacccgcgagcucaugcuccacgcccgcugcugccucaaccagaagggcaccauccucggccucgaccuccagaacugcucccucgaggaccccggccccaacuuccaccaggcccacaccaccgucaucaucgaccuccaggccaacccccucaagggcgaccucgccaacaccuuccgcggcuucacccagcuccagacccucauccucccccagcacgucaacugccccggcggcaucaacgccuggaacaccaucaccuccuacaucgacaaccagaucugccagggccagaagaaccucugcaacaacaccggcgaccccgagaugugccccgagaacggcuccugcguccccgacggccccggccuccuccagugcgucugcgccgacggcuuccacggcuacaagugcaugcgccagggcuccuucucccuccucauguucuucggcauccucggcgccaccacccucuccgucuccauccuccucugggccacccagcgccgcaaggccaagaccuccuga

SEQ ID NO: 40143 - RNA, 7935 nt, Artificial Sequence
  derived and/or modified sequence opt2 from ATR__Homo_sapiens__NP_001175
augggcgagcacggccucgagcucgccuccaugauccccgcccuccgcgagcucggcuccgccacccccgaggaguacaacaccgucguccagaagccccgccagauccucugccaguucaucgaccgcauccucaccgacgucaacgucgucgccgucgagcucgucaagaagaccgacucccagcccaccuccgucaugcuccucgacuucauccagcacaucaugaaguccuccccccucauguucgucaacgucuccggcucccacgaggccaagggcuccugcaucgaguucuccaacuggaucaucacccgccuccuccgcaucgccgccacccccuccugccaccuccuccacaagaagaucugcgaggucaucugcucccuccucuuccucuucaaguccaagucccccgccaucuucggcguccucaccaaggagcuccuccagcucuucgaggaccucgucuaccuccaccgccgcaacgucaugggccacgccgucgaguggcccgucgucaugucccgcuuccucucccagcucgacgagcacaugggcuaccuccaguccgccccccuccagcucauguccaugcagaaccucgaguucaucgaggucacccuccucaugguccucacccgcaucaucgccaucgucuucuuccgccgccaggagcuccuccucuggcagaucggcugcguccuccucgaguacggcucccccaagaucaagucccucgccaucuccuuccucaccgagcucuuccagcucggcggccuccccgcccagcccgccuccaccuucuucuccuccuuccucgagcuccucaagcaccucgucgagauggacaccgaccagcucaagcucuacgaggagccccucuccaagcucaucaagacccucuuccccuucgaggccgaggccuaccgcaacaucgagcccgucuaccucaacaugcuccucgagaagcucugcgucauguucgaggacggcguccucaugcgccucaaguccgaccuccucaaggccgcccucugccaccuccuccaguacuuccucaaguucguccccgccggcuacgaguccgcccuccagguccgcaaggucuacguccgcaacaucugcaaggcccuccucgacguccucggcaucgaggucgacgccgaguaccuccucggcccccucuacgccgcccucaagauggaguccauggagaucaucgaggagauccagugccagacccagcaggagaaccucuccuccaacuccgacggcaucucccccaagcgccgccgccucuccuccucccucaaccccuccaagcgcgcccccaagcagaccgaggagaucaagcacgucgacaugaaccagaaguccauccucugguccgcccucaagcagaaggccgagucccuccagaucucccucgaguacuccggccucaagaaccccgucaucgagaugcucgagggcaucgccgucguccuccagcucaccgcccucugcaccguccacugcucccaccagaacaugaacugccgcaccuucaaggacugccagcacaaguccaagaagaagcccuccgucgucaucaccuggaugucccucgacuucuacaccaagguccucaaguccugccgcucccuccucgaguccguccagaagcucgaccucgaggccaccaucgacaaggucgucaagaucuacgacgcccucaucuacaugcaggucaacuccuccuucgaggaccacauccucgaggaccucugcggcaugcucucccuccccuggaucuacucccacuccgacgacggcugccucaagcucaccaccuucgccgccaaccuccucacccucuccugccgcaucuccgacuccuacuccccccaggcccagucccgcugcgucuuccuccucacccucuucccccgccgcaucuuccucgaguggcgcaccgccgucuacaacugggcccuccaguccucccacgaggucauccgcgccuccugcgucuccggcuucuucauccuccuccagcagcagaacuccugcaaccgcguccccaagauccucaucgacaaggucaaggacgacuccgacaucgucaagaaggaguucgccuccauccucggccagcucgucugcacccuccacggcauguucuaccucaccuccucccucaccgagcccuucuccgagcacggccacgucgaccucuucugccgcaaccucaaggccaccucccagcacgagugcuccuccucccagcucaaggccuccgucugcaagcccuuccucuuccuccucaagaagaagauccccucccccgucaagcucgccuucaucgacaaccuccaccaccucugcaagcaccucgacuuccgcgaggacgagaccgacgucaaggccguccucggcacccuccucaaccucauggaggaccccgacaaggacguccgcgucgccuucuccggcaacaucaagcacauccucgagucccucgacuccgaggacggcuucaucaaggagcucuucguccuccgcaugaaggaggccuacacccacgcccagaucucccgcaacaacgagcucaaggacacccucauccucaccaccggcgacaucggccgcgccgccaagggcgaccucguccccuucgcccuccuccaccuccuccacugccuccucuccaaguccgccuccgucuccggcgccgccuacaccgagauccgcgcccucgucgccgccaaguccgucaagcuccaguccuucuucucccaguacaagaagcccaucugccaguuccucgucgagucccuccacuccucccagaugaccgcccuccccaacacccccugccagaacgccgacguccgcaagcaggacgucgcccaccagcgcgagauggcccucaacacccucuccgagaucgccaacgucuucgacuuccccgaccucaaccgcuuccucacccgcacccuccagguccuccuccccgaccucgccgccaaggccucccccgccgccuccgcccucauccgcacccucggcaagcagcucaacgucaaccgccgcgagauccucaucaacaacuucaaguacaucuucucccaccucgucugcuccugcuccaaggacgagcucgagcgcgcccuccacuaccucaagaacgagaccgagaucgagcucggcucccuccuccgccaggacuuccagggccuccacaacgagcuccuccuccgcaucggcgagcacuaccagcaggucuucaacggccucuccauccucgccuccuucgccuccuccgacgaccccuaccagggcccccgcgacaucaucucccccgagcucauggccgacuaccuccagcccaagcuccucggcauccucgccuucuucaacaugcagcuccucuccuccuccgucggcaucgaggacaagaagauggcccucaacucccucaugucccucaugaagcucaugggccccaagcacgucuccuccguccgcgucaagaugaugaccacccuccgcaccggccuccgcuucaaggacgacuuccccgagcucugcugccgcgccugggacugcuucguccgcugccucgaccacgccugccucggcucccuccucucccacgucaucgucgcccuccucccccucauccacauccagcccaaggagaccgccgccaucuuccacuaccucaucaucgagaaccgcgacgccguccaggacuuccuccacgagaucuacuuccuccccgaccaccccgagcucaagaagaucaaggccguccuccaggaguaccgcaaggagaccuccgaguccaccgaccuccagaccacccuccagcucuccaugaaggccauccagcacgagaacgucgacguccgcauccacgcccucaccucccucaaggagacccucuacaagaaccaggagaagcucaucaaguacgccaccgacuccgagaccgucgagcccaucaucucccagcucgucaccguccuccucaagggcugccaggacgccaacucccaggcccgccuccucugcggcgagugccucggcgagcucggcgccaucgaccccggccgccucgacuucuccaccaccgagacccagggcaaggacuucaccuucgucaccggcgucgaggacuccuccuucgccuacggccuccucauggagcucacccgcgccuaccucgccuacgccgacaacucccgcgcccaggacuccgccgccuacgccauccaggagcuccucuccaucuacgacugccgcgagauggagaccaacggccccggccaccagcucuggcgccgcuuccccgagcacguccgcgagauccucgagccccaccucaacacccgcuacaaguccucccagaaguccaccgacugguccggcgucaagaagcccaucuaccucuccaagcucggcuccaacuucgccgagugguccgccuccugggccggcuaccucaucaccaagguccgccacgaccucgccuccaagaucuucaccugcugcuccaucaugaugaagcacgacuucaaggucaccaucuaccuccucccccacauccucgucuacguccuccucggcugcaaccaggaggaccagcaggaggucuacgccgagaucauggccguccucaagcacgacgaccagcacaccaucaacacccaggacaucgccuccgaccucugccagcucuccacccagaccgucuucuccaugcucgaccaccucacccagugggcccgccacaaguuccaggcccucaaggccgagaagugcccccacuccaaguccaaccgcaacaaggucgacuccauggucuccaccgucgacuacgaggacuaccaguccgucacccgcuuccucgaccucaucccccaggacacccucgccgucgccuccuuccgcuccaaggccuacacccgcgccgucaugcacuucgaguccuucaucaccgagaagaagcagaacauccaggagcaccucggcuuccuccagaagcucuacgccgccaugcacgagcccgacggcgucgccggcgucuccgccauccgcaaggccgagcccucccucaaggagcagauccucgagcacgagucccucggccuccuccgcgacgccaccgccugcuacgaccgcgccauccagcucgagcccgaccagaucauccacuaccacggcgucgucaaguccaugcucggccucggccagcucuccaccgucaucacccaggucaacggcguccacgccaaccgcuccgaguggaccgacgagcucaacaccuaccgcgucgaggccgccuggaagcucucccagugggaccucgucgagaacuaccucgccgccgacggcaaguccaccaccugguccguccgccucggccagcuccuccucuccgccaagaagcgcgacaucaccgccuucuacgacucccucaagcucguccgcgccgagcagaucgucccccucuccgccgccuccuucgagcgcggcuccuaccagcgcggcuacgaguacaucguccgccuccacaugcucugcgagcucgagcacuccaucaagccccucuuccagcacucccccggcgacuccucccaggaggacucccucaacugggucgcccgccucgagaugacccagaacuccuaccgcgccaaggagcccauccucgcccuccgccgcgcccuccucucccucaacaagcgccccgacuacaacgagauggucggcgagugcuggcuccaguccgcccgcgucgcccgcaaggccggccaccaccagaccgccuacaacgcccuccucaacgccggcgagucccgccucgccgagcucuacgucgagcgcgccaaguggcucugguccaagggcgacguccaccaggcccucaucguccuccagaagggcgucgagcucugcuuccccgagaacgagaccccccccgagggcaagaacaugcucauccacggccgcgccaugcuccucgucggccgcuucauggaggagaccgccaacuucgaguccaacgccaucaugaagaaguacaaggacgucaccgccugccuccccgagugggaggacggccacuucuaccucgccaaguacuacgacaagcucaugcccauggucaccgacaacaagauggagaagcagggcgaccucauccgcuacaucguccuccacuucggccgcucccuccaguacggcaaccaguucaucuaccaguccaugccccgcaugcucacccucuggcucgacuacggcaccaaggccuacgagugggagaaggccggccgcuccgaccgcguccagaugcgcaacgaccucggcaagaucaacaaggucaucaccgagcacaccaacuaccucgcccccuaccaguuccucaccgccuucucccagcucaucucccgcaucugccacucccacgacgaggucuucgucguccucauggagaucaucgccaaggucuuccucgccuacccccagcaggccauguggaugaugaccgccgucuccaaguccuccuaccccaugcgcgucaaccgcugcaaggagauccucaacaaggccauccacaugaagaagucccucgagaaguucgucggcgacgccacccgccucaccgacaagcuccucgagcucugcaacaagcccgucgacggcuccuccuccacccucuccauguccacccacuucaagaugcucaagaagcucgucgaggaggccaccuucuccgagauccucaucccccuccaguccgucaugauccccacccuccccuccauccucggcacccacgccaaccacgccucccacgagcccuuccccggccacugggccuacaucgccggcuucgacgacauggucgagauccucgccucccuccagaagcccaagaagaucucccucaagggcuccgacggcaaguucuacaucaugaugugcaagcccaaggacgaccuccgcaaggacugccgccucauggaguucaacucccucaucaacaagugccuccgcaaggacgccgagucccgccgccgcgagcuccacauccgcaccuacgccgucaucccccucaacgacgagugcggcaucaucgagugggucaacaacaccgccggccuccgccccauccucaccaagcucuacaaggagaagggcgucuacaugaccggcaaggagcuccgccagugcaugcuccccaaguccgccgcccucuccgagaagcucaaggucuuccgcgaguuccuccucccccgccacccccccaucuuccacgagugguuccuccgcaccuuccccgaccccaccuccugguacuccucccgcuccgccuacugccgcuccaccgccgucauguccauggucggcuacauccucggccucggcgaccgccacggcgagaacauccucuucgacucccucaccggcgagugcguccacgucgacuucaacugccucuucaacaagggcgagaccuucgagguccccgagaucguccccuuccgccucacccacaacauggucaacggcaugggccccaugggcaccgagggccucuuccgccgcgccugcgaggucaccaugcgccucaugcgcgaccagcgcgagccccucauguccguccucaagaccuuccuccacgacccccucgucgagugguccaagcccgucaagggccacuccaaggccccccucaacgagaccggcgaggucgucaacgagaaggccaagacccacguccucgacaucgagcagcgccuccagggcgucaucaagacccgcaaccgcgucaccggccucccccucuccaucgagggccacguccacuaccucauccaggaggccaccgacgagaaccuccucugccagauguaccucggcuggacccccuacauguga

SEQ ID NO: 40144 - RNA, 2097 nt, Artificial Sequence
  derived and/or modified sequence opt2 from ATRIP__Homo_sapiens__NP_001257952
auguccaagaaccccuccggcaagaaccgcgagaccguccccaucaaggacaacuucgagcucgagguccuccaggcccaguacaaggagcucaaggagaagaugaaggucauggaggaggagguccucaucaagaacggcgagaucaagauccuccgcgacucccuccaccagaccgaguccguccucgaggagcagcgccgcucccacuuccuccucgagcaggagaagacccaggcccucuccgacaaggagaaggaguucuccaagaagcuccagucccuccaguccgagcuccaguucaaggacgccgagaugaacgagcuccgcaccaagcuccagaccuccgagcgcgccaacaagcucgccgcccccuccgucucccacgucuccccccgcaagaaccccuccgucgucaucaagcccgaggccugcuccccccaguucggcaagaccuccuuccccaccaaggaguccuucuccgccaacaugucccucccccaccccugccagaccgaguccggcuacaagccccucgucggccgcgaggacuccaagccccacucccuccgcggcgacuccaucaagcaggaggaggcccagaaguccuucgucgacuccuggcgccagcgcuccaacacccagggcuccauccucaucaaccuccuccucaagcagccccucauccccggcuccucccucucccucugccaccuccucuccuccuccuccgagucccccgccggcaccccccuccagccccccggcuucggcuccacccucgccggcauguccggccuccgcaccaccggcuccuacgacggcuccuucucccucuccgcccuccgcgaggcccagaaccucgccuucaccggccucaaccucgucgcccgcaacgagugcucccgcgacggcgaccccgccgagggcggccgccgcgccuucccccucugccagcuccccggcgccguccacuuccucccccucguccaguucuucaucggccuccacugccaggcccuccaggaccucgccgccgccaagcgcuccggcgcccccggcgacucccccacccacuccuccugcgucuccuccggcgucgagaccaaccccgaggacuccgucugcauccucgagggcuucuccgucaccgcccucuccauccuccagcaccucgucugccacuccggcgccgucgucucccuccuccucuccggcgucggcgccgacuccgccgccggcgagggcaaccgcucccucguccaccgccucuccgacggcgacaugaccuccgcccuccgcggcgucgccgacgaccagggccagcacccccuccucaagaugcuccuccaccuccucgccuucuccuccgccgccaccggccaccuccaggccuccguccucacccagugccucaagguccucgucaagcucgccgagaacaccuccugcgacuuccucccccgcuuccagugcgucuuccagguccuccccaagugccucucccccgagaccccccuccccuccguccuccucgccgucgagcuccucucccuccucgccgaccacgaccagcucgccccccagcucugcucccacuccgagggcugccuccuccuccuccucuacauguacaucaccucccgccccgaccgcgucgcccucgagacccaguggcuccagcucgagcaggaggucgucuggcuccucgccaagcucggcguccaguccccccucccccccgucaccggcuccaacugccagugcaacgucgaggucguccgcgcccucaccgucaugcuccaccgccaguggcucaccguccgccgcgccggcggccccccccgcaccgaccagcagcgccgcaccguccgcugccuccgcgacaccguccuccuccuccacggccucucccagaaggacaagcucuucaugaugcacugcgucgagguccuccaccaguucgaccaggucaugcccggcgucuccaugcucauccgcggccuccccgacgucaccgacugcgaggaggccgcccucgacgaccucugcgccgccgagaccgacgucgaggaccccgaggucgagugcggcuga

SEQ ID NO: 40145 - RNA, 4290 nt, Artificial Sequence
  derived and/or modified sequence opt2 from ATRN__Homo_sapiens__NP_647537
auggucgccgccgccgccgccaccgaggcccgccuccgccgccgcaccgccgccaccgccgcccucgccggccgcuccggcggcccccacugggacugggacgucacccgcgccggccgccccggccucggcgccggccuccgccucccccgccuccucucccccccccuccgcccccgccuccuccuccuccuccuccuccucucccccccccuccuccuccuccuccuccccugcgaggccgaggccgccgccgccgccgccgccgucuccggcuccgccgccgccgaggccaaggagugcgaccgccccugcgucaacggcggccgcugcaaccccggcaccggccagugcgucugccccgccggcugggucggcgagcagugccagcacugcggcggccgcuuccgccucaccggcuccuccggcuucgucaccgacggccccggcaacuacaaguacaagaccaagugcaccuggcucaucgagggccagcccaaccgcaucaugcgccuccgcuucaaccacuucgccaccgagugcuccugggaccaccucuacgucuacgacggcgacuccaucuacgccccccucgucgccgccuucuccggccucaucguccccgagcgcgacggcaacgagaccguccccgaggucgucgccaccuccggcuacgcccuccuccacuucuucuccgacgccgccuacaaccucaccggcuucaacaucaccuacuccuucgacaugugccccaacaacugcuccggccgcggcgagugcaagaucuccaacuccuccgacaccgucgagugcgagugcuccgagaacuggaagggcgaggccugcgacaucccccacugcaccgacaacugcggcuucccccaccgcggcaucugcaacuccuccgacguccgcggcugcuccugcuucuccgacuggcagggccccggcugcuccguccccguccccgccaaccaguccuucuggacccgcgaggaguacuccaaccucaagcucccccgcgccucccacaaggccgucgucaacggcaacaucaugugggucgucggcggcuacauguucaaccacuccgacuacaacaugguccucgccuacgaccucgccucccgcgaguggcucccccucaaccgcuccgucaacaacgucgucguccgcuacggccacucccucgcccucuacaaggacaagaucuacauguacggcggcaagaucgacuccaccggcaacgucaccaacgagcuccgcgucuuccacauccacaacgaguccuggguccuccucacccccaaggccaaggagcaguacgccgucgucggccacuccgcccacaucgucacccucaagaacggccgcgucgucaugcucgucaucuucggccacugcccccucuacggcuacaucuccaacguccaggaguacgaccucgacaagaacaccugguccauccuccacacccagggcgcccucguccagggcggcuacggccacuccuccgucuacgaccaccgcacccgcgcccucuacguccacggcggcuacaaggccuucuccgccaacaaguaccgccucgccgacgaccucuaccgcuacgacgucgacacccagauguggaccauccucaaggacucccgcuucuuccgcuaccuccacaccgccgucaucgucuccggcaccaugcucgucuucggcggcaacacccacaacgacaccuccaugucccacggcgccaagugcuucuccuccgacuucauggccuacgacaucgccugcgaccgcugguccguccucccccgccccgaccuccaccacgacgucaaccgcuucggccacuccgccguccuccacaacuccaccauguacgucuucggcggcuucaacucccuccuccucuccgacauccucgucuucaccuccgagcagugcgacgcccaccgcuccgaggccgccugccucgccgccggccccggcauccgcugcgucuggaacaccggcuccucccagugcaucuccugggcccucgccaccgacgagcaggaggagaagcucaaguccgagugcuucuccaagcgcacccucgaccacgaccgcugcgaccagcacaccgacugcuacuccugcaccgccaacaccaacgacugccacuggugcaacgaccacugcgucccccgcaaccacuccugcuccgagggccagaucuccaucuuccgcuacgagaacugccccaaggacaaccccauguacuacugcaacaagaagaccuccugccgcuccugcgcccucgaccagaacugccagugggagccccgcaaccaggagugcaucgcccuccccgagaacaucugcggcaucggcuggcaccucgucggcaacuccugccucaagaucaccaccgccaaggagaacuacgacaacgccaagcucuucugccgcaaccacaacgcccuccucgccucccucaccacccagaagaaggucgaguucguccucaagcagcuccgcaucaugcaguccucccaguccauguccaagcucacccucacccccugggucggccuccgcaagaucaacgucuccuacuggugcugggaggacaugucccccuucaccaacucccuccuccaguggaugcccuccgagcccuccgacgccggcuucugcggcauccucuccgagcccuccacccgcggccucaaggccgccaccugcaucaacccccucaacggcuccgucugcgagcgccccgccaaccacuccgccaagcagugccgcacccccugcgcccuccgcaccgccugcggcgacugcaccuccggcuccuccgagugcauguggugcuccaacaugaagcagugcgucgacuccaacgccuacgucgccuccuuccccuucggccagugcauggagugguacaccauguccaccugcccccccgagaacugcuccggcuacugcaccugcucccacugccucgagcagcccggcugcggcuggugcaccgaccccuccaacaccggcaagggcaagugcaucgagggcuccuacaagggccccgucaagaugcccucccaggcccccaccggcaacuucuacccccagccccuccucaacuccuccaugugccucgaggacucccgcuacaacugguccuucauccacugccccgccugccagugcaacggccacuccaagugcaucaaccaguccaucugcgagaagugcgagaaccucaccaccggcaagcacugcgagaccugcaucuccggcuucuacggcgaccccaccaacggcggcaagugccagcccugcaagugcaacggccacgccucccucugcaacaccaacaccggcaagugcuucugcaccaccaagggcgucaagggcgacgagugccagcucugcgaggucgagaaccgcuaccagggcaacccccuccgcggcaccugcuacuacacccuccucaucgacuaccaguucaccuucucccucucccaggaggacgaccgcuacuacaccgccaucaacuucgucgccacccccgacgagcagaaccgcgaccucgacauguucaucaacgccuccaagaacuucaaccucaacaucaccugggccgccuccuucuccgccggcacccaggccggcgaggagaugcccgucgucuccaagaccaacaucaaggaguacaaggacuccuucuccaacgagaaguucgacuuccgcaaccaccccaacaucaccuucuucgucuacgucuccaacuucaccuggcccaucaagauccagaucgccuucucccagcacuccaacuucauggaccucguccaguucuucgucaccuucuucuccugcuuccucucccuccuccucgucgccgccgucgucuggaagaucaagcaguccugcugggccucccgccgccgcgagcagcuccuccgcgagaugcagcagauggccucccgccccuucgccuccgucaacgucgcccucgagaccgacgaggagccccccgaccucaucggcggcuccaucaagaccguccccaagcccaucgcccucgagcccugcuucggcaacaaggccgccguccucuccgucuucguccgccucccccgcggccucggcggcauccccccccccggccaguccggccucgccgucgccuccgcccucgucgacaucucccagcagaugcccaucgucuacaaggagaaguccggcgccguccgcaaccgcaagcagcagccccccgcccagcccggcaccugcaucuga

SEQ ID NO: 40146 - RNA, 4140 nt, Artificial Sequence
  derived and/or modified sequence opt2 from ATRNL1__Homo_sapiens__NP_997186
auggagaccggcggccgcgcccgcaccggcaccccccagcccgccgcccccggcgucuggcgcgcccgccccgccggcggcggcggcggcggcgccuccuccuggcuccucgacggcaacuccuggcuccucugcuacggcuuccucuaccucgcccucuacgcccaggucucccaguccaagcccugcgagcgcaccggcuccugcuucuccggccgcugcgucaacuccaccugccucugcgaccccggcugggucggcgaccagugccagcacugccagggccgcuucaagcucaccgagcccuccggcuaccucaccgacggccccaucaacuacaaguacaagaccaagugcaccuggcucaucgagggcuaccccaacgccguccuccgccuccgcuucaaccacuucgccaccgagugcuccugggaccacauguacgucuacgacggcgacuccaucuacgccccccucaucgccguccucuccggccucaucguccccgagauccgcggcaacgagaccguccccgaggucgucaccaccuccggcuacgcccuccuccacuucuucuccgacgccgccuacaaccucaccggcuucaacaucuucuacuccaucaacuccugccccaacaacugcuccggccacggcaagugcaccaccuccgucuccguccccucccaggucuacugcgagugcgacaaguacuggaagggcgaggccugcgacauccccuacugcaaggccaacugcggcucccccgaccacggcuacugcgaccucaccggcgagaagcucugcgucugcaacgacuccuggcagggccccgacugcucccucaacguccccuccaccgaguccuacuggauccuccccaacgucaagcccuucucccccuccgucggccgcgccucccacaaggccguccuccacggcaaguucaugugggucaucggcggcuacaccuucaacuacuccuccuuccagaugguccucaacuacaaccucgaguccuccaucuggaacgucggcacccccucccgcggcccccuccagcgcuacggccacucccucgcccucuaccaggagaacaucuucauguacggcggccgcaucgagaccaacgacggcaacgucaccgacgagcucugggucuucaacauccacucccaguccugguccaccaagacccccaccguccucggccacggccagcaguacgccgucgagggccacuccgcccacaucauggagcucgacucccgcgacgucgucaugaucaucaucuucggcuacuccgccaucuacggcuacaccuccuccauccaggaguaccacaucuccuccaacaccuggcucguccccgagaccaagggcgccaucguccagggcggcuacggccacaccuccgucuacgacgagaucaccaaguccaucuacguccacggcggcuacaaggcccuccccggcaacaaguacggccucgucgacgaccucuacaaguacgaggucaacaccaagaccuggaccauccucaaggaguccggcuucgcccgcuaccuccacuccgccguccucaucaacggcgccaugcucaucuucggcggcaacacccacaacgacaccucccucuccaacggcgccaagugcuucuccgccgacuuccucgccuacgacaucgccugcgacgaguggaagauccuccccaagcccaaccuccaccgcgacgucaaccgcuucggccacuccgccgucgucaucaacggcuccauguacaucuucggcggcuucuccuccguccuccucaacgacauccucgucuacaagccccccaacugcaaggccuuccgcgacgaggagcucugcaagaacgccggccccggcaucaagugcgucuggaacaagaaccacugcgaguccugggaguccggcaacaccaacaacauccuccgcgccaagugcccccccaagaccgccgccuccgacgaccgcugcuaccgcuacgccgacugcgccuccugcaccgccaacaccaacggcugccaguggugcgacgacaagaagugcaucuccgccaacuccaacugcuccauguccgucaagaacuacaccaagugccacguccgcaacgagcagaucugcaacaagcucaccuccugcaaguccugcucccucaaccucaacugccagugggaccagcgccagcaggagugccaggcccuccccgcccaccucugcggcgagggcuggucccacaucggcgacgccugccuccgcgucaacuccucccgcgagaacuacgacaacgccaagcucuacugcuacaaccucuccggcaaccucgccucccucaccaccuccaaggaggucgaguucguccucgacgagauccagaaguacacccagcagaaggucucccccugggucggccuccgcaagaucaacaucuccuacuggggcugggaggacaugucccccuucaccaacaccacccuccaguggcuccccggcgagcccaacgacuccggcuucugcgccuaccucgagcgcgccgccgucgccggccucaaggccaaccccugcaccuccauggccaacggccucgucugcgagaagcccgucgucucccccaaccagaacgcccgccccugcaagaagcccugcucccuccgcaccuccugcuccaacugcaccuccaacggcauggagugcauguggugcuccuccaccaagcgcugcgucgacuccaacgccuacaucaucuccuuccccuacggccagugccucgaguggcagaccgccaccugcuccccccagaacugcuccggccuccgcaccugcggccagugccucgagcagcccggcugcggcuggugcaacgaccccuccaacaccggccgcggccacugcaucgagggcuccucccgcggccccaugaagcucaucggcaugcaccacuccgagaugguccucgacaccaaccucugccccaaggagaagaacuacgagugguccuucauccagugccccgccugccagugcaacggccacuccaccugcaucaacaacaacgucugcgagcagugcaagaaccucaccaccggcaagcagugccaggacugcaugcccggcuacuacggcgaccccaccaacggcggccagugcaccgccugcaccugcuccggccacgccaacaucugccaccuccacaccggcaagugcuucugcaccaccaagggcaucaagggcgaccagugccagcucugcgacuccgagaaccgcuacgucggcaacccccuccgcggcaccugcuacuacucccuccucaucgacuaccaguucaccuucucccuccuccaggaggacgaccgccaccacaccgccaucaacuucaucgccaaccccgagcaguccaacaagaaccucgacaucuccaucaacgccuccaacaacuucaaccucaacaucaccugguccgucggcuccaccgccggcaccaucuccggcgaggagaccuccaucgucuccaagaacaacaucaaggaguaccgcgacuccuucuccuacgagaaguucaacuuccgcuccaaccccaacaucaccuucuacgucuacgucuccaacuucuccuggcccaucaagauccagaucgccuucucccagcacaacaccaucauggaccucguccaguucuucgucaccuucuucuccugcuuccucucccuccuccucgucgccgccgucgucuggaagaucaagcagaccugcugggccucccgccgccgcgagcagcuccuccgcgagcgccagcagauggccucccgccccuucgccuccgucgacgucgcccucgaggucggcgccgagcagaccgaguuccuccgcggcccccucgagggcgcccccaagcccaucgccaucgagcccugcgccggcaaccgcgccgccguccucaccgucuuccucugccucccccgcggcuccuccggcgcccccccccccggccaguccggccucgccaucgccuccgcccucaucgacaucucccagcagaaggccuccgacuccaaggacaagaccuccggcguccgcaaccgcaagcaccucuccacccgccagggcaccugcgucuga

SEQ ID NO: 40147 - RNA, 7479 nt, Artificial Sequence
  derived and/or modified sequence opt2 from ATRX__Homo_sapiens__NP_000480
augaccgccgagcccauguccgaguccaagcucaacacccucguccagaagcuccacgacuuccucgcccacuccuccgaggaguccgaggagaccuccucccccccccgccucgccaugaaccagaacaccgacaagaucuccggcuccggcuccaacuccgacaugauggagaacuccaaggaggagggcaccuccuccuccgagaaguccaaguccuccggcuccucccgcuccaagcgcaagcccuccaucgucaccaaguacgucgaguccgacgacgagaagccccucgacgacgagaccgucaacgaggacgccuccaacgagaacuccgagaacgacaucaccaugcagucccuccccaagggcaccgucaucguccagcccgagcccguccucaacgaggacaaggacgacuucaagggccccgaguuccgcucccgcuccaagaugaagaccgagaaccucaagaagcgcggcgaggacggccuccacggcaucgucuccugcaccgccugcggccagcaggucaaccacuuccagaaggacuccaucuaccgccaccccucccuccagguccucaucugcaagaacugcuucaaguacuacauguccgacgacaucucccgcgacuccgacggcauggacgagcagugccgcuggugcgccgagggcggcaaccucaucugcugcgacuucugccacaacgccuucugcaagaagugcauccuccgcaaccucggccgcaaggagcucuccaccaucauggacgagaacaaccagugguacugcuacaucugccaccccgagccccuccucgaccucgucaccgccugcaacuccgucuucgagaaccucgagcagcuccuccagcagaacaagaagaagaucaaggucgacuccgagaaguccaacaaggucuacgagcacaccucccgcuucucccccaagaagaccuccuccaacugcaacggcgaggagaagaagcucgacgacuccugcuccggcuccgucaccuacuccuacuccgcccucaucguccccaaggagaugaucaagaaggccaagaagcucaucgagaccaccgccaacaugaacuccuccuacgucaaguuccucaagcaggccaccgacaacuccgagaucuccuccgccaccaagcuccgccagcucaaggccuucaaguccguccucgccgacaucaagaaggcccaccucgcccucgaggaggaccucaacuccgaguuccgcgccauggacgccgucaacaaggagaagaacaccaaggagcacaaggucaucgacgccaaguucgagaccaaggcccgcaagggcgagaagcccugcgcccucgagaagaaggacaucuccaaguccgaggccaagcucucccgcaagcaggucgacuccgagcacaugcaccagaacguccccaccgaggagcagcgcaccaacaaguccaccggcggcgagcacaagaaguccgaccgcaaggaggagccccaguacgagcccgccaacaccuccgaggaccucgacauggacaucgucuccguccccuccuccguccccgaggacaucuucgagaaccucgagaccgccauggagguccaguccuccgucgaccaccagggcgacggcuccuccggcaccgagcaggaggucgaguccuccuccgucaagcucaacaucuccuccaaggacaaccgcggcggcaucaaguccaagaccaccgccaaggucaccaaggagcucuacgucaagcucacccccgucucccucuccaacucccccaucaagggcgccgacugccaggaggucccccaggacaaggacggcuacaaguccugcggccucaaccccaagcucgagaagugcggccucggccaggagaacuccgacaacgagcaccucgucgagaacgaggucucccuccuccucgaggaguccgaccuccgccgcuccccccgcgucaagaccaccccccuccgccgccccaccgagaccaaccccgucaccuccaacuccgacgaggagugcaacgagaccgucaaggagaagcagaagcucuccguccccguccgcaagaaggacaagcgcaacuccuccgacuccgccaucgacaaccccaagcccaacaagcuccccaaguccaagcaguccgagaccgucgaccagaacuccgacuccgacgagaugcucgccauccucaaggaggucucccgcaugucccacuccuccuccuccgacaccgacaucaacgagauccacaccaaccacaagacccucuacgaccucaagacccaggccggcaaggacgacaagggcaagcgcaagcgcaaguccuccaccuccggcuccgacuucgacaccaagaagggcaaguccgccaaguccuccaucaucuccaagaagaagcgccagacccaguccgaguccuccaacuacgacuccgagcucgagaaggagaucaaguccauguccaagaucggcgccgcccgcaccaccaagaagcgcauccccaacaccaaggacuucgacuccuccgaggacgagaagcacuccaagaagggcauggacaaccagggccacaagaaccucaagaccucccaggagggcuccuccgacgacgccgagcgcaagcaggagcgcgagaccuucuccuccgccgagggcaccgucgacaaggacaccaccaucauggagcuccgcgaccgccuccccaagaagcagcaggccuccgccuccaccgacggcgucgacaagcucuccggcaaggaggaguccuucaccucccucgagguccgcaaggucgccgagaccaaggagaaguccaagcaccucaagaccaagaccugcaagaagguccaggacggccucuccgacaucgccgagaaguuccucaagaaggaccaguccgacgagaccuccgaggacgacaagaagcaguccaagaagggcaccgaggagaagaagaagcccuccgacuucaagaagaaggucaucaagauggagcagcaguacgaguccuccuccgacggcaccgagaagcuccccgagcgcgaggagaucugccacuuccccaagggcaucaagcagaucaagaacggcaccaccgacggcgagaagaaguccaagaagauccgcgacaagaccuccaagaagaaggacgagcucuccgacuacgccgagaaguccaccggcaagggcgacuccugcgacuccuccgaggacaagaaguccaagaacggcgccuacggccgcgagaagaagcgcugcaagcuccucggcaaguccucccgcaagcgccaggacugcuccuccuccgacaccgagaaguacuccaugaaggaggacggcugcaacuccuccgacaagcgccucaagcgcaucgagcuccgcgagcgccgcaaccucuccuccaagcgcaacaccaaggagauccaguccggcuccuccuccuccgacgccgaggaguccuccgaggacaacaagaagaagaagcagcgcaccuccuccaagaagaaggccgucaucgucaaggagaagaagcgcaacucccuccgcaccuccaccaagcgcaagcaggccgacaucaccuccuccuccuccuccgacaucgaggacgacgaccagaacuccaucggcgagggcuccuccgacgagcagaagaucaagcccgucaccgagaaccucguccucuccucccacaccggcuucugccaguccuccggcgacgaggcccucuccaaguccguccccgucaccgucgacgacgacgacgacgacaacgaccccgagaaccgcaucgccaagaagaugcuccucgaggagaucaaggccaaccucuccuccgacgaggacggcuccuccgacgacgagcccgaggagggcaagaagcgcaccggcaagcagaacgaggagaaccccggcgacgaggaggccaagaaccaggucaacuccgaguccgacuccgacuccgaggaguccaagaagccccgcuaccgccaccgccuccuccgccacaagcucaccgucuccgacggcgaguccggcgaggagaagaagaccaagcccaaggagcacaaggaggucaagggccgcaaccgccgcaaggucuccuccgaggacuccgaggacuccgacuuccaggaguccggcgucuccgaggaggucuccgaguccgaggacgagcagcgcccccgcacccgcuccgccaagaaggccgagcucgaggagaaccagcgcuccuacaagcagaagaagaagcgccgccgcaucaagguccaggaggacuccuccuccgagaacaaguccaacuccgaggaggaggaggaggagaaggaggaggaggaggaggaggaggaggaggaggaggaggaggaggaggacgagaacgacgacuccaagucccccggcaagggccgcaagaagauccgcaagauccucaaggacgacaagcuccgcaccgagacccagaacgcccucaaggaggaggaggagcgccgcaagcgcaucgccgagcgcgagcgcgagcgcgagaagcuccgcgaggucaucgagaucgaggacgccucccccaccaagugccccaucaccaccaagcucguccucgacgaggacgaggagaccaaggagccccucguccagguccaccgcaacauggucaucaagcucaagccccaccaggucgacggcguccaguucaugugggacugcugcugcgaguccgucaagaagaccaagaagucccccggcuccggcugcauccucgcccacugcaugggccucggcaagacccuccaggucgucuccuuccuccacaccguccuccucugcgacaagcucgacuucuccaccgcccucgucgucugcccccucaacaccgcccucaacuggaugaacgaguucgagaaguggcaggagggccucaaggacgacgagaagcucgaggucuccgagcucgccaccgucaagcgcccccaggagcgcuccuacaugcuccagcgcuggcaggaggacggcggcgucaugaucaucggcuacgagauguaccgcaaccucgcccagggccgcaacgucaagucccgcaagcucaaggagaucuucaacaaggcccucgucgaccccggccccgacuucgucgucugcgacgagggccacauccucaagaacgaggccuccgccgucuccaaggccaugaacuccauccgcucccgccgccgcaucauccucaccggcaccccccuccagaacaaccucaucgaguaccacugcauggucaacuucaucaaggagaaccuccucggcuccaucaaggaguuccgcaaccgcuucaucaaccccauccagaacggccagugcgccgacuccaccauggucgacguccgcgucaugaagaagcgcgcccacauccucuacgagaugcucgccggcugcguccagcgcaaggacuacaccgcccucaccaaguuccucccccccaagcacgaguacguccucgccguccgcaugaccuccauccagugcaagcucuaccaguacuaccucgaccaccucaccggcgucggcaacaacuccgagggcggccgcggcaaggccggcgccaagcucuuccaggacuuccagaugcucucccgcaucuggacccaccccuggugccuccagcucgacuacaucuccaaggagaacaagggcuacuucgacgaggacuccauggacgaguucaucgccuccgacuccgacgagaccuccaugucccucuccuccgacgacuacaccaagaagaagaagaagggcaagaagggcaagaaggacuccuccuccuccggcuccggcuccgacaacgacgucgaggucaucaaggucuggaacucccgcucccgcggcggcggcgagggcaacgucgacgagaccggcaacaaccccuccgucucccucaagcucgaggaguccaaggccaccuccuccuccaaccccuccucccccgcccccgacugguacaaggacuucgucaccgacgccgacgccgagguccucgagcacuccggcaagaugguccuccucuucgagauccuccgcauggccgaggagaucggcgacaagguccucgucuucucccagucccucaucucccucgaccucaucgaggacuuccucgagcucgccucccgcgagaagaccgaggacaaggacaagccccucaucuacaagggcgagggcaaguggcuccgcaacaucgacuacuaccgccucgacggcuccaccaccgcccagucccgcaagaagugggccgaggaguucaacgacgagaccaacguccgcggccgccucuucaucaucuccaccaaggccggcucccucggcaucaaccucgucgccgccaaccgcgucaucaucuucgacgccuccuggaaccccuccuacgacauccaguccaucuuccgcgucuaccgcuucggccagaccaagcccgucuacgucuaccgcuuccucgcccagggcaccauggaggacaagaucuacgaccgccaggucaccaagcagucccucuccuuccgcgucgucgaccagcagcaggucgagcgccacuucaccaugaacgagcucaccgagcucuacaccuucgagcccgaccuccucgacgaccccaacuccgagaagaagaagaagcgcgacacccccaugcuccccaaggacaccauccucgccgagcuccuccagauccacaaggagcacaucgucggcuaccacgagcacgacucccuccucgaccacaaggaggaggaggagcucaccgaggaggagcgcaaggccgccugggccgaguacgaggccgagaagaagggccucaccaugcgcuucaacauccccaccggcaccaaccucccccccgucuccuucaacucccagacccccuacauccccuucaaccucggcgcccucuccgccauguccaaccagcagcucgaggaccucaucaaccagggccgcgagaaggucgucgaggccaccaacuccgucaccgccguccgcauccagccccucgaggacaucaucuccgccgucuggaaggagaacaugaaccucuccgaggcccagguccaggcccucgcccucucccgccaggccucccaggagcucgacgucaagcgccgcgaggccaucuacaacgacguccucaccaagcagcagaugcucaucuccugcguccagcgcauccucaugaaccgccgccuccagcagcaguacaaccagcagcagcagcagcagaugaccuaccagcaggccacccucggccaccucaugaugcccaagccccccaaccucaucaugaaccccuccaacuaccagcagaucgacaugcgcggcauguaccagcccgucgccggcggcaugcagccccccccccuccagcgcgcccccccccccaugcgcuccaagaaccccggccccucccagggcaaguccauguga

SEQ ID NO: 40148 - RNA, 1236 nt, Artificial Sequence
  derived and/or modified sequence opt2 from ATXN10__Homo_sapiens__NP_001161093
auggccgccccccgccccccccccgcccgccucuccggcgucaugguccccgcccccauccaggaccucgaggcccuccgcgcccucaccgcccucuucaaggagcagcgcaaccgcaaccucgacaccaucggcgucgccgucgaccucauccuccucuuccgcgagcuccgcgucgagcaggagucccuccucaccgccuuccgcugcggccuccaguuccucggcaacaucgccucccgcaacgaggacucccaguccaucgucuggguccacgccuuccccgagcucuuccucuccugccucaaccaccccgacaagaagaucgucgccuacuccuccaugauccucuucaccucccucaaccacgagcgcaugaaggagcucgaggagaaccucaacaucgccaucgacgucaucgacgccuaccagaagcaccccgaguccgaguggcccuuccucaucaucaccgaccucuuccucaagucccccgagcucguccaggccauguuccccaagcucaacaaccaggagcgcgucacccuccucgaccucaugaucgccaagaucaccuccgacgagccccucaccaaggacgacauccccgucuuccuccgccacgccgagcucaucgccuccaccuucgucgaccagugcaagaccguccucaagcucgccuccgaggagccccccgacgacgaggaggcccucgccaccauccgccuccucgacguccucugcgagaugaccgucaacaccgagcuccucggcuaccuccaggucuuccccggccuccucgagcgcgucaucgaccuccuccgcgucauccacgucgccggcaaggagaccaccaacaucuucuccaacugcggcugcguccgcgccgagggcgacaucuccaacgucgccaacggcuucaagucccaccucauccgccucaucggcaaccucugcuacaagaacaaggacaaccaggacaaggucaacgagcucgacggcaucccccucauccucgacaacugcaacaucuccgacuccaaccccuuccucacccagugggucaucuacgccauccgcaaccucaccgaggacaacucccagaaccaggaccucaucgccaagauggaggagcagggccucgccgacgccucccuccucaagaaggucggcuucgaggucgagaagaagggcgagaagcucauccucaaguccacccgcgacacccccaagcccuga

SEQ ID NO: 40149 - RNA, 2448 nt, Artificial Sequence
  derived and/or modified sequence opt2 from ATXN1__Homo_sapiens__NP_001121636
augaaguccaaccaggagcgcuccaacgagugccucccccccaagaagcgcgagauccccgccaccucccgcuccuccgaggagaaggcccccacccuccccuccgacaaccaccgcgucgagggcaccgccuggcuccccggcaaccccggcggccgcggccacggcggcggccgccacggccccgccggcaccuccgucgagcucggccuccagcagggcaucggccuccacaaggcccucuccaccggccucgacuacuccccccccuccgccccccgcuccguccccgucgccaccacccuccccgccgccuacgccaccccccagcccggcacccccgucucccccguccaguacgcccaccucccccacaccuuccaguucaucggcuccucccaguacuccggcaccuacgccuccuucauccccucccagcucaucccccccaccgccaaccccgucaccuccgccgucgccuccgccgccggcgccaccacccccucccagcgcucccagcucgaggccuacuccacccuccucgccaacaugggcucccucucccagacccccggccacaaggccgagcagcagcagcagcagcagcagcagcagcagcagcagcaccagcaccagcagcagcagcagcagcagcagcagcagcagcagcagcagcaccucucccgcgcccccggccucaucacccccggcucccccccccccgcccagcagaaccaguacguccacaucuccuccuccccccagaacaccggccgcaccgccuccccccccgccauccccguccaccuccacccccaccagaccaugaucccccacacccucacccucggcccccccucccaggucgucaugcaguacgccgacuccggcucccacuucgucccccgcgaggccaccaagaaggccgaguccucccgccuccagcaggccauccaggccaaggagguccucaacggcgagauggagaagucccgccgcuacggcgcccccuccuccgccgaccucggccucggcaaggccggcggcaaguccgucccccaccccuacgagucccgccacgucgucguccaccccucccccuccgacuacuccucccgcgaccccuccggcguccgcgccuccgucaugguccuccccaacuccaacacccccgccgccgaccucgagguccagcaggccacccaccgcgaggccucccccuccacccucaacgacaaguccggccuccaccucggcaagcccggccaccgcuccuacgcccucuccccccacaccgucauccagaccacccacuccgccuccgagccccuccccgucggccuccccgccaccgccuucuacgccggcacccagccccccgucaucggcuaccucuccggccagcagcaggccaucaccuacgccggcucccucccccagcaccucgucauccccggcacccagccccuccucauccccgucggcuccaccgacauggaggccuccggcgccgcccccgccaucgucaccuccuccccccaguucgccgccgucccccacaccuucgucaccaccgcccuccccaaguccgagaacuucaaccccgaggcccucgucacccaggccgccuaccccgccaugguccaggcccagauccaccuccccgucguccaguccgucgccucccccgccgccgccccccccacccucccccccuacuucaugaagggcuccaucauccagcucgccaacggcgagcucaagaaggucgaggaccucaagaccgaggacuucauccaguccgccgagaucuccaacgaccucaagaucgacuccuccaccgucgagcgcaucgaggacucccacucccccggcgucgccgucauccaguucgccgucggcgagcaccgcgcccaggucuccgucgagguccucgucgaguaccccuucuucgucuucggccagggcugguccuccugcugccccgagcgcaccucccagcucuucgaccuccccugcuccaagcucuccgucggcgacgucugcaucucccucacccucaagaaccucaagaacggcuccgucaagaagggccagcccgucgaccccgccuccguccuccucaagcacuccaaggccgacggccucgccggcucccgccaccgcuacgccgagcaggagaacggcaucaaccagggcuccgcccagaugcucuccgagaacggcgagcucaaguuccccgagaagaugggccuccccgccgcccccuuccucaccaagaucgagcccuccaagcccgccgccacccgcaagcgccgcugguccgcccccgagucccgcaagcucgagaaguccgaggacgagcccccccucacccuccccaagcccucccucaucccccaggaggucaagaucugcaucgagggccgcuccaacgucggcaaguga

SEQ ID NO: 40150 - RNA, 2070 nt, Artificial Sequence
  derived and/or modified sequence opt2 from ATXN1L__Homo_sapiens__NP_001131147
augaagcccguccacgagcgcucccaggagugccucccccccaagaagcgcgaccuccccgucaccuccgaggacaugggccgcaccaccuccugcuccaccaaccacacccccuccuccgacgccuccgaguggucccgcggcgucgucgucgccggccagucccaggccggcgcccgcgucucccucggcggcgacggcgccgaggccaucaccggccucaccgucgaccaguacggcaugcucuacaaggucgccgucccccccgccaccuucucccccaccggccuccccuccgucgucaacauguccccccucccccccaccuucaacgucgccuccucccucauccagcaccccggcauccacuaccccccccuccacuacgcccagcuccccuccaccucccuccaguucaucggcucccccuacucccuccccuacgccgucccccccaacuuccuccccuccccccuccucucccccuccgccaaccucgccaccucccaccucccccacuucguccccuacgccucccuccucgccgagggcgccaccccccccccccaggcccccucccccgcccacuccuucaacaaggcccccuccgccaccucccccuccggccagcucccccaccacuccuccacccagccccucgaccucgcccccggccgcaugcccaucuacuaccagaugucccgccuccccgccggcuacacccuccacgagaccccccccgccggcgccucccccguccucaccccccaggagucccaguccgcccucgaggccgccgccgccaacggcggccagcgcccccgcgagcgcaaccucguccgccgcgaguccgaggcccucgacucccccaacuccaagggcgagggccagggccucguccccgucgucgagugcgucgucgacggccagcucuucuccggcucccagaccccccgcgucgaggucgccgcccccgcccaccgcggcacccccgacaccgaccucgagguccagcgcgucgucggcgcccucgccucccaggacuaccgcgucgucgccgcccagcgcaaggaggagcccuccccccucaaccucucccaccacacccccgaccaccagggcgagggccgcggcuccgcccgcaaccccgccgagcucgccgagaagucccaggcccgcggcuucuacccccagucccaccaggagcccgucaagcaccgcccccuccccaaggccauggucgucgccaacggcaaccucguccccaccggcaccgacuccggccuccuccccgucggcuccgagauccucgucgccuccucccucgacguccaggcccgcgccaccuuccccgacaaggagcccacccccccccccaucaccuccucccaccuccccucccacuucaugaagggcgccaucauccagcucgccaccggcgagcucaagcgcgucgaggaccuccagacccaggacuucguccgcuccgccgaggucuccggcggccucaagaucgacuccuccaccgucgucgacauccaggagucccaguggcccggcuucgucaugcuccacuucgucgucggcgagcagcaguccaaggucuccaucgaggucccccccgagcaccccuucuucgucuacggccagggcugguccuccugcucccccggccgcaccacccagcucuucucccuccccugccaccgccuccaggucggcgacgucugcaucuccaucucccuccagucccucaacuccaacuccgucucccaggccuccugcgccccccccucccagcucggccccccccgcgagcgccccgagcgcaccguccucggcucccgcgagcucugcgacuccgagggcaagucccagcccgccggcgagggcucccgcgucgucgagcccucccagcccgaguccggcgcccaggccugcuggcccgcccccuccuuccagcgcuacuccaugcagggcgaggaggcccgcgccgcccuccuccgccccuccuucaucccccaggaggucaagcucuccaucgagggccgcuccaacgccggcaaguga

SEQ ID NO: 40151 - RNA, 3942 nt, Artificial Sequence
  derived and/or modified sequence opt2 from ATXN2__Homo_sapiens__NP_002964
augcgcuccgccgccgccgccccccgcucccccgccgucgccaccgagucccgccgcuucgccgccgcccgcuggcccggcuggcgcucccuccagcgccccgcccgccgcuccggccgcggcggcggcggcgccgcccccggccccuaccccuccgccgccccccccccccccggccccggccccccccccucccgccaguccuccccccccuccgccuccgacugcuucggcuccaacggcaacggcggcggcgccuuccgccccggcucccgccgccuccucggccucggcggccccccccgccccuucgucguccuccuccucccccucgccucccccggcgccccccccgccgcccccacccgcgccuccccccucggcgcccgcgccucccccccccgcuccggcgucucccucgcccgccccgcccccggcugcccccgccccgccugcgagcccgucuacggcccccucaccaugucccucaagccccagcagcagcagcagcagcagcagcagcagcagcagcagcagcagcagcagcagcagcagcagcagcagcccccccccgccgccgccaacguccgcaagcccggcggcuccggccuccucgccucccccgccgccgcccccucccccuccuccuccuccgucuccuccuccuccgccaccgcccccuccuccgucgucgccgccaccuccggcggcggccgccccggccucggccgcggccgcaacuccaacaagggccucccccaguccaccaucuccuucgacggcaucuacgccaacaugcgcaugguccacauccucaccuccgucgucggcuccaagugcgagguccaggucaagaacggcggcaucuacgagggcgucuucaagaccuacucccccaagugcgaccucguccucgacgccgcccacgagaaguccaccgaguccuccuccggccccaagcgcgaggagaucauggaguccauccucuucaagugcuccgacuucgucgucguccaguucaaggacauggacuccuccuacgccaagcgcgacgccuucaccgacuccgccaucuccgccaaggucaacggcgagcacaaggagaaggaccucgagcccugggacgccggcgagcucaccgccaacgaggagcucgaggcccucgagaacgacgucuccaacggcugggaccccaacgacauguuccgcuacaacgaggagaacuacggcgucgucuccaccuacgacuccucccucuccuccuacaccgucccccucgagcgcgacaacuccgaggaguuccucaagcgcgaggcccgcgccaaccagcucgccgaggagaucgaguccuccgcccaguacaaggcccgcgucgcccucgagaacgacgaccgcuccgaggaggagaaguacaccgccguccagcgcaacuccuccgagcgcgagggccacuccaucaacacccgcgagaacaaguacaucccccccggccagcgcaaccgcgaggucaucuccuggggcuccggccgccagaacuccccccgcaugggccagcccggcuccggcuccaugcccucccgcuccaccucccacaccuccgacuucaaccccaacuccggcuccgaccagcgcgucgucaacggcggcguccccuggcccucccccugccccucccccuccucccgcccccccucccgcuaccaguccggccccaacucccuccccccccgcgccgccacccccacccgcccccccucccgcccccccucccgccccucccgcccccccucccaccccuccgcccacggcucccccgcccccgucuccaccaugcccaagcgcauguccuccgagggccccccccgcaugucccccaaggcccagcgccacccccgcaaccaccgcgucuccgccggccgcggcuccaucuccuccggccucgaguucgucucccacaacccccccuccgaggccgccaccccccccgucgcccgcaccucccccuccggcggcaccugguccuccgucgucuccggcgucccccgccucucccccaagacccaccgcccccgcuccccccgccagaacuccaucggcaacacccccuccggccccguccucgccuccccccaggccggcaucauccccaccgaggccgucgccaugcccauccccgccgccucccccacccccgccucccccgccuccaaccgcgccgucacccccuccuccgaggccaaggacucccgccuccaggaccagcgccagaacucccccgccggcaacaaggagaacaucaagcccaacgagaccucccccuccuucuccaaggccgagaacaagggcaucucccccgucgucuccgagcaccgcaagcagaucgacgaccucaagaaguucaagaacgacuuccgccuccagcccuccuccaccuccgaguccauggaccagcuccucaacaagaaccgcgagggcgagaagucccgcgaccucaucaaggacaagaucgagcccuccgccaaggacuccuucaucgagaacuccuccuccaacugcaccuccggcuccuccaagcccaacucccccuccaucucccccuccauccucuccaacaccgagcacaagcgcggccccgaggucaccucccagggcguccagaccuccucccccgccugcaagcaggagaaggacgacaaggaggagaagaaggacgccgccgagcagguccgcaaguccacccucaaccccaacgccaaggaguucaacccccgcuccuucucccagcccaagcccuccaccacccccaccuccccccgcccccaggcccagcccucccccuccauggucggccaccagcagcccacccccgucuacacccagcccgucugcuucgcccccaacaugauguaccccguccccgucucccccggcguccagccccucuaccccauccccaugacccccaugcccgucaaccaggccaagaccuaccgcgccguccccaacaugccccagcagcgccaggaccagcaccaccaguccgccaugaugcaccccgccuccgccgccggcccccccaucgccgccaccccccccgccuacuccacccaguacgucgccuacuccccccagcaguuccccaaccagccccucguccagcacgucccccacuaccagucccagcacccccacgucuacucccccgucauccagggcaacgcccgcaugauggccccccccacccacgcccagcccggccucgucuccuccuccgccacccaguacggcgcccacgagcagacccacgccauguacgccugccccaagcuccccuacaacaaggagaccucccccuccuucuacuucgccaucuccaccggcucccucgcccagcaguacgcccaccccaacgccacccuccacccccacaccccccacccccagcccuccgccacccccaccggccagcagcagucccagcacggcggcucccaccccgcccccucccccguccagcaccaccagcaccaggccgcccaggcccuccaccucgccuccccccagcagcaguccgccaucuaccacgccggccucgcccccaccccccccuccaugacccccgccuccaacacccaguccccccagaacuccuuccccgccgcccagcagaccgucuucaccauccaccccucccacguccagcccgccuacaccaaccccccccacauggcccacgucccccaggcccacguccaguccggcaugguccccucccaccccaccgcccacgcccccaugaugcucaugaccacccagccccccggcggcccccaggccgcccucgcccaguccgcccuccagcccauccccgucuccaccaccgcccacuuccccuacaugacccaccccuccguccaggcccaccaccagcagcagcucuga

SEQ ID NO: 40152 - RNA, 3228 nt, Artificial Sequence
  derived and/or modified sequence opt2 from ATXN2L__Homo_sapiens__NP_009176
augcucaagccccagccccuccagcagcccucccagccccagcagcccccccccacccagcaggccgucgcccgccgcccccccggcggcaccuccccccccaacggcggccuccccggcccccucgccaccuccgccgccccccccggcccccccgccgccgccucccccugccucggccccgucgccgccgccggcuccggccuccgccgcggcgccgagggcauccucgccccccagcccccccccccccagcagcaccaggagcgccccggcgccgccgccaucggcuccgcccgcggccaguccaccggcaagggccccccccagucccccgucuucgagggcgucuacaacaacucccgcaugcuccacuuccucaccgccgucgucggcuccaccugcgacgucaaggucaagaacggcaccaccuacgagggcaucuucaagacccucuccuccaaguucgagcucgccgucgacgccguccaccgcaaggccuccgagcccgccggcggcccccgccgcgaggacaucgucgacaccauggucuucaagcccuccgacgucaugcucguccacuuccgcaacgucgacuucaacuacgccaccaaggacaaguucaccgacuccgccaucgccaugaacuccaaggucaacggcgagcacaaggagaagguccuccagcgcugggagggcggcgacuccaacuccgacgacuacgaccucgaguccgacauguccaacggcugggaccccaacgagauguucaaguucaacgaggagaacuacggcgucaagaccaccuacgacuccucccucuccuccuacaccgucccccucgagaaggacaacuccgaggaguuccgccagcgcgagcuccgcgccgcccagcucgcccgcgagaucgaguccuccccccaguaccgccuccgcaucgccauggagaacgacgacggccgcaccgaggaggagaagcacuccgccguccagcgccagggcuccggccgcgagucccccucccucgccucccgcgagggcaaguacaucccccucccccagcgcguccgcgagggcccccgcggcggcguccgcugcuccuccucccgcggcggccgccccggccucuccucccuccccccccgcggcccccaccaccucgacaacuccucccccggccccggcuccgaggcccgcggcaucaacggcggccccucccgcaugucccccaaggcccagcgcccccuccgcggcgccaagacccucuccucccccuccaaccgccccuccggcgagaccuccgucccccccccccccgccgucggccgcauguaccccccccgcucccccaaguccgccgcccccgcccccaucuccgccuccugccccgagccccccaucggcuccgccguccccaccuccuccgccuccauccccgucaccuccuccgucuccgaccccggcgucggcuccaucucccccgccucccccaagaucucccucgcccccaccgacgucaaggagcucuccaccaaggagcccggccgcacccucgagccccaggagcucgcccgcaucgccggcaagguccccggccuccagaacgagcagaagcgcuuccagcucgaggagcuccgcaaguucggcgcccaguucaagcuccagcccuccuccucccccgagaacucccucgaccccuuccccccccgcauccucaaggaggagcccaagggcaaggagaaggaggucgacggccuccucaccuccgagcccaugggcucccccgucuccuccaagaccgaguccgucuccgacaaggaggacaagcccccccucgcccccuccggcggcaccgagggccccgagcagccccccccccccugccccucccagaccggcuccccccccgucggccucaucaagggcgaggacaaggacgagggccccgucgccgagcaggucaagaaguccacccucaaccccaacgccaaggaguucaaccccaccaagccccuccucuccgucaacaaguccaccuccacccccaccucccccggcccccgcacccacuccacccccuccauccccguccucaccgccggccaguccggccucuacuccccccaguacaucuccuacaucccccagauccacaugggccccgccguccaggccccccagauguaccccuaccccgucuccaacuccguccccggccagcagggcaaguaccgcggcgccaagggcucccuccccccccagcgcuccgaccagcaccagcccgccuccgccccccccaugaugcaggccgccgccgccgccggccccccccucgucgccgccacccccuacuccuccuacauccccuacaacccccagcaguuccccggccagcccgccaugaugcagcccauggcccacuaccccucccagcccgucuucgcccccaugcuccaguccaacccccgcaugcucaccuccggcucccacccccaggccaucgucuccuccuccaccccccaguaccccuccgccgagcagcccaccccccaggcccucuacgccaccguccaccaguccuacccccaccacgccacccagcuccacgcccaccagccccagcccgccaccacccccaccggcucccagccccagucccagcacgccgcccccucccccguccagcaccaggccggccaggccccccaccucggcuccggccagccccagcagaaccucuaccaccccggcgcccucaccggcaccccccccucccucccccccggccccuccgcccaguccccccaguccuccuucccccagcccgccgccgucuacgccauccaccaccagcagcucccccacggcuucaccaacauggcccacgucacccaggcccacguccagaccggcaucaccgccgccccccccccccaccccggcgccccccaccccccccaggucaugcuccuccaccccccccagucccacggcggccccccccagggcgccgucccccaguccggcguccccgcccucuccgccuccacccccucccccuaccccuacaucggccacccccagggcgagcagcccggccaggcccccggcuuccccggcggcgccgacgaccgcauccgcgaguucucccucgccggcggcaucuggcacggccgcgccgagggccuccaggucggccaggacgcccgcguccucggcggcgaguga

SEQ ID NO: 40153 - RNA, 1041 nt, Artificial Sequence
  derived and/or modified sequence opt2 from ATXN3__Homo_sapiens__NP_001121168
auggaguccaucuuccacgagaagcaggagggcucccucugcgcccagcacugccucaacaaccuccuccagggcgaguacuucucccccgucgagcucuccuccaucgcccaccagcucgacgaggaggagcgcaugcgcauggccgagggcggcgucaccuccgaggacuaccgcaccuuccuccaggucaucuccaacgcccucaaggucuggggccucgagcucauccucuucaacucccccgaguaccagcgccuccgcaucgaccccaucaacgagcgcuccuucaucugcaacuacaaggagcacugguucaccguccgcaagcucggcaagcagugguucaaccucaacucccuccucaccggccccgagcucaucuccgacaccuaccucgcccucuuccucgcccagcuccagcaggagggcuacuccaucuucgucgucaagggcgaccuccccgacugcgaggccgaccagcuccuccagaugauccgcguccagcagaugcaccgccccaagcucaucggcgaggagcucgcccagcucaaggagcagcgcguccacaagaccgaccucgagcgcguccucgaggccaacgacggcuccggcaugcucgacgaggacgaggaggaccuccagcgcgcccucgcccucucccgccaggagaucgacauggaggacgaggaggccgaccuccgccgcgccauccagcucuccaugcagggcuccucccgcaacaucucccaggacaugacccagaccuccggcaccaaccucaccuccgaggagcuccgcaagcgccgcgaggccuacuucgagaagcagcagcagaagcagcagcagcagcagcagcagcagcagcagggcgaccucuccggccaguccucccaccccugcgagcgccccgccaccuccuccggcgcccucggcuccgaccucggcgacgccauguccgaggaggacaugcuccaggccgccgucaccaugucccucgagaccguccgcaacgaccucaagaccgagggcaagaaguga

SEQ ID NO: 40154 - RNA, 2679 nt, Artificial Sequence
  derived and/or modified sequence opt2 from ATXN7__Homo_sapiens__NP_000324
auguccgagcgcgccgccgacgacguccgcggcgagccccgccgcgccgccgccgccgccggcggcgccgccgccgccgccgcccgccagcagcagcagcagcagcagcagcagcagcccccccccccccagccccagcgccagcagcacccccccccccccccccgccgcacccgccccgaggacggcggccccggcgccgccuccaccuccgccgccgccauggccaccgucggcgagcgccgcccccuccccucccccgaggucaugcucggccaguccuggaaccucugggucgaggccuccaagcuccccggcaaggacggcaccgagcucgacgaguccuucaaggaguucggcaagaaccgcgaggucaugggccucugccgcgaggacaugcccaucuucggcuucugccccgcccacgacgacuucuaccucgucgucugcaacgacugcaaccaggucgucaagccccaggccuuccagucccacuacgagcgccgccacuccuccuccuccaagcccccccucgccgucccccccaccuccgucuucuccuucuuccccucccucuccaaguccaagggcggcuccgccuccggcuccaaccgcuccuccuccggcggcguccucuccgccuccuccuccuccuccaagcuccucaagucccccaaggagaagcuccagcuccgcggcaacacccgccccaugcaccccauccagcagucccgcgucccccacggccgcaucaugacccccuccgucaaggucgagaagauccaccccaagauggacggcacccuccucaaguccgccgucggccccaccugccccgccaccgucuccucccucgucaagcccggccucaacugccccuccauccccaagcccacccuccccucccccggccagauccucaacggcaagggccuccccgccccccccacccucgagaagaagcccgaggacaacuccaacaaccgcaaguuccucaacaagcgccucuccgagcgcgaguucgaccccgacauccacugcggcgucaucgaccucgacaccaagaagcccugcacccgcucccucaccugcaagacccacucccucacccagcgccgcgccguccagggccgccgcaagcgcuucgacguccuccucgccgagcacaagaacaagacccgcgagaaggagcucauccgccaccccgacucccagcagcccccccagccccuccgcgacccccaccccgcccccccccgcaccucccaggagccccaccagaacccccacggcgucauccccuccgaguccaagcccuucgucgccuccaagcccaagccccacacccccucccucccccgcccccccggcugccccgcccagcagggcggcuccgcccccaucgaccccccccccguccacgaguccccccaccccccccuccccgccaccgagcccgccucccgccucuccuccgaggagggcgagggcgacgacaaggaggaguccgucgagaagcucgacugccacuacuccggccaccacccccagcccgccuccuucugcaccuucggcucccgccagaucggccgcggcuacuacgucuucgacucccgcuggaaccgccuccgcugcgcccucaaccucauggucgagaagcaccucaacgcccagcucuggaagaagaucccccccguccccuccaccaccucccccaucuccacccgcaucccccaccgcaccaacuccguccccaccucccagugcggcgucuccuaccucgccgccgccaccgucuccaccucccccguccuccucuccuccaccugcaucucccccaacuccaaguccguccccgcccacggcaccacccucaacgcccagcccgccgccuccggcgccauggaccccgucugcuccaugcagucccgccaggucuccuccuccuccuccucccccuccacccccuccggccucuccuccguccccuccucccccaugucccgcaagccccagaagcucaaguccuccaagucccuccgccccaaggaguccuccggcaacuccaccaacugccagaacgccuccuccuccaccuccggcggcuccggcaagaagcgcaagaacuccuccccccuccucguccacuccuccuccuccuccuccuccuccuccuccuccucccacuccauggaguccuuccgcaagaacugcgucgcccacuccggcccccccuaccccuccaccgucaccuccucccacuccaucggccucaacugcgucaccaacaaggccaacgccgucaacguccgccacgaccaguccggccgcggcccccccaccggcucccccgccgaguccaucaagcgcauguccgucauggucaacuccuccgacuccacccucucccucggccccuucauccaccaguccaacgagcuccccgucaacucccacggcuccuucucccacucccacaccccccucgacaagcucaucggcaagaagcgcaagugcucccccuccuccuccuccaucaacaacuccuccuccaagcccaccaaggucgccaagguccccgccgucaacaacguccacaugaagcacaccggcaccauccccggcgcccagggccucaugaacuccucccuccuccaccagcccaaggcccgccccuga

SEQ ID NO: 40155 - RNA, 294 nt, Artificial Sequence
  derived and/or modified sequence opt2 from ATXN7L3B__Homo_sapiens__NP_001129734
auggaggagaucucccucgccaaccucgacaccaacaagcucgaggccaucgcccaggagaucuacgucgaccucaucgaggacuccugccucggcuucugcuucgagguccaccgcgccgucaagugcggcuacuucuaccucgaguucgccgagaccggcuccgucaaggacuucggcauccagcccgucgaggacaagggcgccugccgccucccccucugcucccuccccggcgagcccggcaacggccccgaccagcagcuccagcgcuccccccccgaguuccaguga

SEQ ID NO: 40156 - RNA, 1020 nt, Artificial Sequence
  derived and/or modified sequence opt2 from AUH__Homo_sapiens__NP_001689
auggccgccgccgucgccgccgcccccggcgcccucggcucccuccacgccggcggcgcccgccucgucgccgccugcuccgccuggcucugccccggccuccgccuccccggcucccucgccggccgccgcgccggccccgccaucugggcccagggcuggguccccgccgccggcggccccgcccccaagcgcggcuacuccuccgagaugaagaccgaggacgagcuccgcguccgccaccucgaggaggagaaccgcggcaucgucguccucggcaucaaccgcgccuacggcaagaacucccucuccaagaaccucaucaagaugcucuccaaggccgucgacgcccucaaguccgacaagaagguccgcaccaucaucauccgcuccgagguccccggcaucuucugcgccggcgccgaccucaaggagcgcgccaagauguccuccuccgaggucggccccuucgucuccaagauccgcgccgucaucaacgacaucgccaaccuccccguccccaccaucgccgccaucgacggccucgcccucggcggcggccucgagcucgcccucgccugcgacauccgcgucgccgccuccuccgccaagaugggccucgucgagaccaagcucgccaucauccccggcggcggcggcacccagcgccucccccgcgccaucggcaugucccucgccaaggagcucaucuucuccgcccgcguccucgacggcaaggaggccaaggccgucggccucaucucccacguccucgagcagaaccaggagggcgacgccgccuaccgcaaggcccucgaccucgcccgcgaguuccucccccagggccccgucgccaugcgcgucgccaagcucgccaucaaccagggcauggaggucgaccucgucaccggccucgccaucgaggaggccugcuacgcccagaccauccccaccaaggaccgccucgagggccuccucgccuucaaggagaagcgccccccccgcuacaagggcgaguga

SEQ ID NO: 40157 - RNA, 1212 nt, Artificial Sequence
  derived and/or modified sequence opt2 from AURKA__Homo_sapiens__XP_006723935
auggaccgcuccaaggagaacugcaucuccggccccgucaaggccaccgcccccgucggcggccccaagcgcguccucgucacccagcaguuccccugccagaacccccuccccgucaacuccggccaggcccagcgcguccucugccccuccaacuccucccagcgcaucccccuccaggcccagaagcucgucuccucccacaagcccguccagaaccagaagcagaagcagcuccaggccaccuccgucccccaccccgucucccgcccccucaacaacacccagaaguccaagcagccccuccccuccgcccccgagaacaaccccgaggaggagcucgccuccaagcagaagaacgaggaguccaagaagcgccagugggcccucgaggacuucgagaucggccgcccccucggcaagggcaaguucggcaacgucuaccucgcccgcgagaagcaguccaaguucauccucgcccucaagguccucuucaaggcccagcucgagaaggccggcgucgagcaccagcuccgccgcgaggucgagauccagucccaccuccgccaccccaacauccuccgccucuacggcuacuuccacgacgccacccgcgucuaccucauccucgaguacgccccccucggcaccgucuaccgcgagcuccagaagcucuccaaguucgacgagcagcgcaccgccaccuacaucaccgagcucgccaacgcccucuccuacugccacuccaagcgcgucauccaccgcgacaucaagcccgagaaccuccuccucggcuccgccggcgagcucaagaucgccgacuucggcugguccguccacgcccccuccucccgccgcaccacccucugcggcacccucgacuaccucccccccgagaugaucgagggccgcaugcacgacgagaaggucgaccucuggucccucggcguccucugcuacgaguuccucgucggcaagccccccuucgaggccaacaccuaccaggagaccuacaagcgcaucucccgcgucgaguucaccuuccccgacuucgucaccgagggcgcccgcgaccucaucucccgccuccucaagcacaaccccucccagcgccccaugcuccgcgagguccucgagcaccccuggaucaccgccaacuccuccaagcccuccaacugccagaacaaggaguccgccuccaagcaguccuga

SEQ ID NO: 40158 - RNA, 1038 nt, Artificial Sequence
  derived and/or modified sequence opt2 from AURKB__Homo_sapiens__NP_001271455
auggcccagaaggagaacuccuaccccuggcccuacggccgccagaccgcccccuccggccucuccacccucccccagcgcguccuccgcaaggagcccgucacccccuccgcccucguccucaugucccgcuccaacguccagcccaccgccgcccccggccagaaggucauggagaacuccuccggcacccccgacauccucacccgccgccacuucaccaucgacgacuucgagaucggccgcccccucggcaagggcaaguucggcaacgucuaccucgcccgcgagaagaagucccacuucaucgucgcccucaagguccucuucaagucccagaucgagaaggagggcgucgagcaccagcuccgccgcgagaucgagauccaggcccaccuccaccaccccaacauccuccgccucuacaacuacuucuacgaccgccgccgcaucuaccucauccucgaguacgccccccgcggcgagcucuacaaggagcuccagaaguccugcaccuucgacgagcagcgcaccgccaccaucauggaggagcucgccgacgcccucauguacugccacggcaagaaggucauccaccgcgacaucaagcccgagaaccuccuccucggccucaagggcgagcucaagaucgccgacuucggcugguccguccacgcccccucccuccgccgcaagaccaugugcggcacccucgacuaccucccccccgagaugaucgagggccgcaugcacaacgagaaggucgaccucuggugcaucggcguccucugcuacgagcuccucgucggcaacccccccuucgaguccgccucccacaacgagaccuaccgccgcaucgucaaggucgaccucaaguuccccgccuccguccccaugggcgcccaggaccucaucuccaagcuccuccgccacaaccccuccgagcgccucccccucgcccaggucuccgcccaccccuggguccgcgccaacucccgccgcguccucccccccuccgcccuccaguccgucgccuga

SEQ ID NO: 40159 - RNA, 930 nt, Artificial Sequence
  derived and/or modified sequence opt2 from AURKC__Homo_sapiens__NP_001015878
auguccuccccccgcgccgucguccagcucggcaaggcccagcccgccggcgaggagcucgccaccgccaaccagaccgcccagcagcccuccucccccgccaugcgccgccucaccgucgacgacuucgagaucggccgcccccucggcaagggcaaguucggcaacgucuaccucgcccgccucaaggagucccacuucaucgucgcccucaagguccucuucaagucccagaucgagaaggagggccucgagcaccagcuccgccgcgagaucgagauccaggcccaccuccagcaccccaacauccuccgccucuacaacuacuuccacgacgcccgccgcgucuaccucauccucgaguacgccccccgcggcgagcucuacaaggagcuccagaaguccgagaagcucgacgagcagcgcaccgccaccaucaucgaggagcucgccgacgcccucaccuacugccacgacaagaaggucauccaccgcgacaucaagcccgagaaccuccuccucggcuuccgcggcgaggucaagaucgccgacuucggcugguccguccacacccccucccuccgccgcaagaccaugugcggcacccucgacuaccucccccccgagaugaucgagggccgcaccuacgacgagaaggucgaccucuggugcaucggcguccucugcuacgagcuccucgucggcuacccccccuucgaguccgccucccacuccgagaccuaccgccgcauccucaaggucgacguccgcuucccccucuccaugccccucggcgcccgcgaccucaucucccgccuccuccgcuaccagccccucgagcgccucccccucgcccagauccucaagcaccccuggguccaggcccacucccgccgcguccucccccccugcgcccagauggccuccuga

SEQ ID NO: 40160 - RNA, 3708 nt, Artificial Sequence
  derived and/or modified sequence opt2 from AUTS2__Homo_sapiens__NP_001120703
auggacggccccacccgcggccacggccuccgcaagaagcgccgcucccgcucccagcgcgaccgcgagcgccgcucccgcggcggccucggcgccggcgccgccggcggcggcggcgccggccgcacccgcgcccucucccucgccuccuccuccggcuccgacaaggaggacaacggcaagccccccuccuccgcccccucccgcccccgccccccccgccgcaagcgccgcgaguccaccuccgccgaggaggacaucaucgacggcuucgccaugaccuccuucgucaccuucgaggcccucgagaaggacgucgcccucaagccccaggagcgcgucgagaagcgccagaccccccucaccaagaagaagcgcgaggcccucaccaacggccucuccuuccacuccaagaagucccgccucucccacccccaccacuacuccuccgaccgcgagaacgaccgcaaccucugccagcaccucggcaagcgcaagaagaugcccaaggcccuccgccagcucaagcccggccagaacuccugccgcgacuccgacuccgaguccgccuccggcgaguccaagggcuuccaccgcuccuccucccgcgagcgccucuccgacuccuccgcccccuccucccucggcaccggcuacuucugcgacuccgacuccgaccaggaggagaaggccuccgacgccuccuccgagaagcucuucaacaccgucaucgucaacaaggaccccgagcucggcgucggcacccuccccgagcacgacucccaggacgccggccccaucguccccaagaucuccggccucgagcgcucccaggagaagucccaggacugcugcaaggagcccaucuucgagcccgucguccucaaggaccccugcccccaggucgcccagcccaucccccagccccagaccgagccccagcuccgcgcccccucccccgaccccgaccucguccagcgcaccgaggcccccccccagccccccccccucuccacccagcccccccagggcccccccgaggcccagcuccagcccgccccccagccccagguccagcgccccccccgcccccagucccccacccagcuccuccaccagaaccucccccccguccaggcccaccccuccgcccagucccucucccagccccucuccgccuacaacuccuccucccucucccucaacucccucuccuccucccgcuccuccacccccgccaagacccagcccgcccccccccacaucucccaccaccccuccgccucccccuucccccucucccuccccaaccacuccccccuccacuccuucacccccacccuccagccccccgcccacucccaccaccccaacauguucgccccccccaccgcccucccccccccccccccccucaccuccggcucccuccaggucgccggccaccccgccggcuccaccuacuccgagcaggacauccuccgccaggagcucaacacccgcuuccucgccucccaguccgccgaccgcggcgccucccucggccccccccccuaccuccgcaccgaguuccaccagcaccagcaccagcaccagcacacccaccagcacacccaccagcacaccuucacccccuucccccacgccaucccccccaccgccaucaugcccacccccgccccccccauguucgacaaguaccccaccaaggucgaccccuucuaccgccacucccucuuccacuccuacccccccgccgucuccggcaucccccccaugaucccccccaccggccccuucggcucccuccagggcgccuuccagcccaagcucaccgaccccuuccgccccaugcuccgcaagcccggcaaguggugcgccaugcacguccacaucgccuggcagaucuaccaccaccagcagaaggucaagaagcagaugcaguccgacccccacaagcucgacuucggccucaagcccgaguuccucucccgcccccccggccccucccucuucggcgccauccaccacccccacgaccucgcccgccccuccacccucuucuccgccgccggcgccgcccaccccaccggcacccccuucggcccccccccccaccacuccaacuuccucaaccccgccgcccaccucgagcccuucaaccgccccuccaccuucaccggccucgccgccgucggcggcaacgccuucggcggccucggcaaccccuccgucacccccaacuccauguucggccacaaggacggccccuccguccagaacuucuccaacccccacgagcccuggaaccgccuccaccgcaccccccccuccuuccccacccccccccccuggcucaagcccggcgagcucgagcgcuccgccuccgccgccgcccacgaccgcgaccgcgacgucgacaagcgcgacuccuccgucuccaaggacgacaaggagcgcgaguccgucgagaagcgccacuccucccaccccucccccgcccccguccuccccgucaacgcccucggccacacccgcuccuccaccgagcagauccgcgcccaccucaacaccgaggcccgcgagaaggacaagcccaaggagcgcgagcgcgaccacuccgagucccgcaaggaccucgccgccgacgagcacaaggccaaggagggccaccuccccgagaaggacggccacggccacgagggccgcgccgccggcgaggaggccaagcagcucgcccgcguccccucccccuacguccgcacccccgucgucgaguccgcccgccccaacuccaccuccucccgcgaggccgagccccgcaagggcgagcccgccuacgagaaccccaagaaguccuccgaggucaaggucaaggaggagcgcaaggaggaccacgaccucccccccgaggccccccagacccaccgcgccuccgagccccccccccccaacuccuccuccuccguccaccccggcccccucgccuccaugcccaugaccgucggcgucaccggcauccaccccaugaacuccaucuccucccucgaccgcacccgcaugaugacccccuucaugggcaucuccccccuccccggcggcgagcgcuuccccuaccccuccuuccacugggaccccauccgcgacccccuccgcgaccccuaccgcgagcucgacauccaccgccgcgacccccucggccgcgacuuccuccuccgcaacgacccccuccaccgccucuccaccccccgccucuacgaggccgaccgcuccuuccgcgaccgcgagccccacgacuacucccaccaccaccaccaccaccaccacccccucuccgucgacccccgccgcgagcacgagcgcggcggccaccucgacgagcgcgagcgccuccacaugcuccgcgaggacuacgagcacacccgccuccacuccguccaccccgccucccucgacggccaccucccccaccccucccucaucacccccggccuccccuccaugcacuacccccgcaucucccccaccgccggcaaccagaacggccuccucaacaagaccccccccaccgccgcccucuccgccccccccccccucaucuccacccucggcggccgccccgucuccccccgccgcaccaccccccucuccgccgagauccgcgagcgcccccccucccacacccucaaggacaucgaggcccgcuga

SEQ ID NO: 40161 - RNA, 1089 nt, Artificial Sequence
  derived and/or modified sequence opt2 from AVEN__Homo_sapiens__NP_065104
augcaggccgagcgcggcgcccgcggcggccgcggccgccgccccggccgcggccgccccggcggcgaccgccacuccgagcgccccggcgccgccgccgccgucgcccgcggcggcggcggcggcggcggcggcgacggcggcggccgccgcggccgcggccgcggccgcggcuuccgcggcgcccgcggcggccgcggcggcggcggcgccccccgcggcucccgccgcgagcccggcggcuggggcgccggcgccuccgcccccgucgaggacgacuccgacgccgagaccuacggcgaggagaacgacgagcagggcaacuacuccaagcgcaagaucgucuccaacugggaccgcuaccaggacaucgagaaggaggucaacaacgaguccggcgagucccagcgcggcaccgacuucuccguccuccucuccuccgccggcgacuccuucucccaguuccgcuucgccgaggagaaggagugggacuccgaggccuccugccccaagcagaacuccgccuucuacgucgacuccgagcuccucguccgcgcccuccaggagcucccccucugccuccgccucaacgucgccgccgagcucguccagggcaccgucccccucgaggucccccaggucaagcccaagcgcaccgacgacggcaagggccucggcaugcagcucaagggcccccucggccccggcggccgcggccccaucuucgagcucaaguccgucgccgccggcugccccguccuccucggcaaggacaaccccucccccggccccucccgcgacucccagaagcccaccuccccccuccaguccgccggcgaccaccucgaggaggagcucgaccuccuccucaaccucgacgcccccaucaaggagggcgacaacauccuccccgaccagaccucccaggaccucaaguccaaggaggacggcgaggucguccaggaggaggaggucugcgccaagcccuccgucaccgaggagaagaacauggagcccgagcagcccuccaccuccaagaacgucaccgaggaggagcucgaggacuggcucgacuccaugaucuccuga

SEQ ID NO: 40162 - RNA, 495 nt, Artificial Sequence
  derived and/or modified sequence opt2 from AVP__Homo_sapiens__NP_000481
augcccgacaccaugcuccccgccugcuuccucggccuccucgccuucuccuccgccugcuacuuccagaacugcccccgcggcggcaagcgcgccauguccgaccucgagcuccgccagugccuccccugcggccccggcggcaagggccgcugcuucggccccuccaucugcugcgccgacgagcucggcugcuucgucggcaccgccgaggcccuccgcugccaggaggagaacuaccuccccucccccugccaguccggccagaaggccugcggcuccggcggccgcugcgccgccuucggcgucugcugcaacgacgaguccugcgucaccgagcccgagugccgcgagggcuuccaccgccgcgcccgcgccuccgaccgcuccaacgccacccagcucgacggccccgccggcgcccuccuccuccgccucguccagcucgccggcgcccccgagcccuucgagcccgcccagcccgacgccuacuga

SEQ ID NO: 40163 - RNA, 444 nt, Artificial Sequence
  derived and/or modified sequence opt2 from AVPI1__Homo_sapiens__NP_068378
augggcacccccgccuccgucgucuccgagcccccccccuggcaggcccccaucgaggcccgcggccgcaagcaggccuccgccaacaucuuccaggacgccgagcuccuccagauccaggcccucuuccagcgcuccggcgaccagcucgccgaggagcgcgcccagaucaucugggagugcgccggcgaccaccgcgucgccgaggcccucaagcgccuccgccgcaagcgccccccccgccagaagccccucggccacucccuccaccacugcucccgccuccgcauccucgagccccacuccgcccucgccaacccccaguccgccaccgagaccgccuccuccgagcaguaccuccacucccgcaagaaguccgcccgcauccgccgcaacuggcgcaaguccggccccaccuccuaccuccaccagauccgccacuga

SEQ ID NO: 40164 - RNA, 1257 nt, Artificial Sequence
  derived and/or modified sequence opt2 from AVPR1A__Homo_sapiens__NP_000697
augcgccucuccgccggccccgacgccggccccuccggcaacuccucccccugguggccccucgccaccggcgccggcaacaccucccgcgaggccgaggcccucggcgagggcaacggccccccccgcgacguccgcaacgaggagcucgccaagcucgagaucgccguccucgccgucaccuucgccgucgccguccucggcaacuccuccguccuccucgcccuccaccgcaccccccgcaagaccucccgcaugcaccucuucauccgccaccucucccucgccgaccucgccgucgccuucuuccagguccucccccagaugugcugggacaucaccuaccgcuuccgcggccccgacuggcucugccgcgucgucaagcaccuccaggucuucggcauguucgccuccgccuacaugcucgucgucaugaccgccgaccgcuacaucgccgucugccacccccucaagacccuccagcagcccgcccgccgcucccgccucaugaucgccgccgccuggguccucuccuucguccucuccaccccccaguacuucgucuucuccaugaucgaggucaacaacgucaccaaggcccgcgacugcugggccaccuucauccagcccuggggcucccgcgccuacgucaccuggaugaccggcggcaucuucgucgcccccgucgucauccucggcaccugcuacggcuucaucugcuacaacaucuggugcaacguccgcggcaagaccgccucccgccaguccaagggcgccgagcaggccggcgucgccuuccagaagggcuuccuccucgcccccugcgucuccuccgucaaguccaucucccgcgccaagauccgcaccgucaagaugaccuucgucaucgucaccgccuacaucgucugcugggcccccuucuucaucauccagaugugguccgucugggaccccauguccgucuggaccgaguccgagaaccccaccaucaccaucaccgcccuccucggcucccucaacuccugcugcaaccccuggaucuacauguucuucuccggccaccuccuccaggacugcguccaguccuuccccugcugccagaacaugaaggagaaguucaacaaggaggacaccgacuccaugucccgccgccagaccuucuacuccaacaaccgcucccccaccaacuccaccggcauguggaaggacucccccaaguccuccaaguccaucaaguucauccccgucuccaccuga

SEQ ID NO: 40165 - RNA, 1275 nt, Artificial Sequence
  derived and/or modified sequence opt2 from AVPR1B__Homo_sapiens__NP_000698
auggacuccggcccccucugggacgccaaccccaccccccgcggcacccucuccgcccccaacgccaccacccccuggcucggccgcgacgaggagcucgccaaggucgagaucggcguccucgccaccguccucguccucgccaccggcggcaaccucgccguccuccucacccucggccagcucggccgcaagcgcucccgcaugcaccucuucguccuccaccucgcccucaccgaccucgccgucgcccucuuccagguccucccccagcuccucugggacaucaccuaccgcuuccagggccccgaccuccucugccgcgccgucaaguaccuccagguccucuccauguucgccuccaccuacaugcuccucgccaugacccucgaccgcuaccucgccgucugccacccccuccgcucccuccagcagcccggccaguccaccuaccuccucaucgccgcccccuggcuccucgccgccaucuucucccucccccaggucuucaucuucucccuccgcgaggucauccagggcuccggcguccucgacugcugggccgacuucggcuuccccuggggcccccgcgccuaccucaccuggaccacccucgccaucuucguccuccccgucaccaugcucaccgccugcuacucccucaucugccacgagaucugcaagaaccucaaggucaagacccaggccuggcgcgucggcggcggcggcuggcgcaccugggaccgccccucccccuccacccucgccgccaccacccgcggccuccccucccgcgucuccuccaucaacaccaucucccgcgccaagauccgcaccgucaagaugaccuucgucaucguccucgccuacaucgccugcugggcccccuucuucuccguccagaugugguccgucugggacaagaacgcccccgacgaggacuccaccaacgucgccuucaccaucuccaugcuccucggcaaccucaacuccugcugcaaccccuggaucuacaugggcuucaacucccaccuccucccccgcccccuccgccaccucgccugcugcggcggcccccagccccgcaugcgccgccgccucuccgacggcucccucuccucccgccacaccacccuccucacccgcuccuccugccccgccacccucucccucucccucucccucacccucuccggccgcccccgccccgaggaguccccccgcgaccucgagcucgccgacggcgagggcaccgccgagaccaucaucuucuga

SEQ ID NO: 40166 - RNA, 930 nt, Artificial Sequence
  derived and/or modified sequence opt2 from AVPR2__Homo_sapiens__NP_001139623
augcucauggccuccaccaccuccgccguccccggccaccccucccuccccucccuccccuccaacuccucccaggagcgcccccucgacacccgcgacccccuccucgcccgcgccgagcucgcccuccucuccaucgucuucgucgccgucgcccucuccaacggccucguccucgccgcccucgcccgccgcggccgccgcggccacugggcccccauccacgucuucaucggccaccucugccucgccgaccucgccgucgcccucuuccagguccucccccagcucgccuggaaggccaccgaccgcuuccgcggccccgacgcccucugccgcgccgucaaguaccuccagauggucggcauguacgccuccuccuacaugauccucgccaugacccucgaccgccaccgcgccaucugccgccccaugcucgccuaccgccacggcuccggcgcccacuggaaccgccccguccucgucgccugggccuucucccuccuccucucccucccccagcucuucaucuucgcccagcgcaacgucgagggcggcuccggcgucaccgacugcugggccugcuucgccgagcccuggggccgccgcaccuacgucaccuggaucgcccucauggucuucgucgcccccacccucggcaucgccgccugccagguccucaucuuccgcgagauccacgccucccucguccccggccccuccgagcgccccggcggccgccgccgcggccgccgcaccggcucccccggcgagggcgcccacgucuccgccgccgucgccaagaccguccgcaugacccucgucaucgucgucgucuacguccucugcugggcccccuucuuccucguccagcucugggccgccugggaccccgaggccccccucgagggcggcugcucccgcggcuga

SEQ ID NO: 40167 - RNA, 987 nt, Artificial Sequence
  derived and/or modified sequence opt2 from AWAT1__Homo_sapiens__NP_001013597
auggcccacuccaagcagcccucccacuuccagucccucaugcuccuccaguggccccucuccuaccucgccaucuucuggauccuccagccccucuucgucuaccuccucuucaccucccucuggccccuccccguccucuacuucgccuggcucuuccucgacuggaagacccccgagcgcggcggccgccgcuccgccuggguccgcaacuggugcgucuggacccacauccgcgacuacuuccccaucaccauccucaagaccaaggaccucucccccgagcacaacuaccucaugggcguccacccccacggccuccucaccuucggcgccuucugcaacuucugcaccgaggccaccggcuucuccaagaccuuccccggcaucaccccccaccucgccacccucuccugguucuucaagauccccuucguccgcgaguaccucauggccaagggcgucugcuccgucucccagcccgccaucaacuaccuccucucccacggcaccggcaaccucgucggcaucgucgucggcggcgucggcgaggcccuccaguccguccccaacaccaccacccucauccuccagaagcgcaagggcuucguccgcaccgcccuccagcacggcgcccaccucguccccaccuucaccuucggcgagaccgaggucuacgaccagguccucuuccacaaggacucccgcauguacaaguuccaguccugcuuccgccgcaucuucggcuucuacugcugcgucuucuacggccaguccuucugccagggcuccaccggccuccuccccuacucccgccccaucgucaccgucgucggcgagccccucccccucccccagaucgagaagcccucccaggagauggucgacaaguaccacgcccucuacauggacgcccuccacaagcucuucgaccagcacaagacccacuacggcugcuccgagacccagaagcucuucuuccucuga

SEQ ID NO: 40168 - RNA, 3039 nt, Artificial Sequence
  derived and/or modified sequence opt2 from AXDND1__Homo_sapiens__NP_653297
augucccuccccaagacccccuccaccccccucaacuccaccuccaccuccgaguccaagaagcucaaggucuccgucgccaaggagggcacccgcggccuccccgagcucaaggagaagaagaacauggucgaccgcuccaagcuccuccccaccucccuccagaacgaguucauccccaaggagguccuccucucccucaccuacgccgccaacgccggccccugccccgagaaccuccucccccccaagaagaucaagacccccaagggcacccucccccgccucgucgaccacgucuggcaccaccccguccgccgcaacaaguucaaguaccucaucgaccaccccgucucccucaccggcgccggccgcgacaucuccuuccucuacgacgucaccuacgccaagggccagacccgcgagaaggccgucugccccccccaccucgcccgcucccuccagucccacgacggcgucaucgucccccacaagcccaagacccucaccgacacccucauccccgaggaguuccacaucgucuccuccaccggcgucuccggccucgagugcuacgacgacaaguacaccacccuccucaccgacuccgagaaccgccuccuccucuuccccuccaugaagcccaacaagcgcgucgaggucgcccagcucaacgacgucauggacaccaugcucgagcgcgccggcgucgagaaccaggaguacaccggccccaccaagaugcacaagcuccuccacauccucaagaaggagcagaccaucuacaacaugaucuuccacgagcucauccgccaggucuccgucgacugcgccgaccgcggcgagcuccucuccaagguccgcgagcgcuacguccagaugcucgaccagaucgcccgccagaugaucgacuucuacaaggaccucgucacccagcgcgucauggaccagcgcauccucgaggagcucuacaacuucaagcacgucaucgaggagcucacccgcgagcucugccucguccgcgcccacgacgucaagcucaccaaggagaccgagaaggcccacaaggaccucgcccaggcccuccucaacgccgagaagaacgccaagaucgucgaggaguaccacgaccucuacacccuccagcgcgagcgcauggagaacgacaugaagaagcucgucgccgagcgcgacaucugguccuccgccaccuacgagcucgcccucaaggucaucgagcgcaaccgcgucauccucgcccgccgccucuaccucaacgagaagggcuggaacaaguacaccaagcacuucaucauccuccucuccaacaaggacaccgaggaccucgcccuccuccagaagcucacccagaaguggcgcaaccucgucaacaagcucaagcaggaggucgagcagauggaggaguccaccuccgagacccucaagaucgucaaggacggccucaucaaguggcaggaguucuucaacgagaaggacauccucucccccaacaagggcaacaucuucaacuccguccuccucgacuucaagcaguggcagaagauccucaacgagaagaaggaggaguucaccggcgacguccuccucuccaaguacgacacccucaagaucaucaagcaccuccaggagaacugggccgacaucggccucggcaucuucaaccgccacaagucccucgagggcgagaugcccuccgagcgccaguacauggaggagaucaucaagaacauccagaagcucuacaaggaguacgagauccgcaucaacggcgacaacggcuacuccaagauccuccccucccucaucuccucccucgacuucugcuccuucaagcucgagaaccucgaguuccccgacaccccccucgaggaguggcaggagaucgacgagaagaucaacgagaugaagucccaccucgacauccuccucaaccucaccggcaucgucccccagcacaucgacgucgacuccgucuccguccuccaggccuacaucuucaacaugauccagcaguggcuccucaagaucggcaacgagaucaacaacggcaacaucgagcuccagcaccacauggacgagcuccacaucuccaugauccaguggauggucaaccuccucauccucaugauccccaacuucaccgaccaggacugccuccucaagcucgaggaggaguccgccgagaagcacgacaucggcgucgcccgccucgagcucgacgccaucgagcucacccgcaagcucuaccaguacuccuccuaccucuccuccugcugcaagggcauggucaccgccauggcccucuccaaguccaccaacucccacaagaacgccaccgaggaccucuacgaggucgacaagcucaagaaggagugcuacgaguggaucaacaccugcuccugccuccucuccaacaucaagggccgcaagaucacccuccucaccuacgaggagaucgagcgccuccucgaggaggaggccgucaaggaguucaucgagcccgagaucgacgaguccuucaaggaggacgaggaggaguccaaggaggaccgcaagcuccaggaggagaacaaggagcgcgccgaggagcagcccuccaccuccaccgagaaggagaagcucauccgcuucaucggcgaggacgagaacguccacuccaagccccucuucgagaccgacguccucuccuccuggcgcgaguccgccaagcagggcacccucgcccagaaguaccucgaggccauggccgucaucgagcacaugcaggagaagcuccucgaggucgagaaccgcgcccgccaggccgaggagaaguucgaggacgccuacgagaagcuccaccacacccucaucaagaacaaggaccucgaggagcucgucaugaccucccgcaaggaguccaaggaggagaaggagaaccaggacgagcgcgaggucaaggaggaggaggagcagcaggaggaggaggagguccgcuccgccgagaacuccuccaagucccccaagaagggccacuga

SEQ ID NO: 40169 - RNA, 2589 nt, Artificial Sequence
  derived and/or modified sequence opt2 from AXIN1__Homo_sapiens__NP_003493
augaacauccaggagcagggcuucccccucgaccucggcgccuccuucaccgaggacgccccccgcccccccguccccggcgaggagggcgagcucgucuccaccgacccccgccccgccuccuacuccuucugcuccggcaagggcgucggcaucaagggcgagaccuccaccgccaccccccgccgcuccgaccucgaccucggcuacgagcccgagggcuccgccucccccaccccccccuaccucaagugggccgagucccuccacucccuccucgacgaccaggacggcaucucccucuuccgcaccuuccucaagcaggagggcugcgccgaccuccucgacuucugguucgccugcaccggcuuccgcaagcucgagcccugcgacuccaacgaggagaagcgccucaagcucgcccgcgccaucuaccgcaaguacauccucgacaacaacggcaucgucucccgccagaccaagcccgccaccaaguccuucaucaagggcugcaucaugaagcagcucaucgaccccgccauguucgaccaggcccagaccgagauccaggccaccauggaggagaacaccuaccccuccuuccucaaguccgacaucuaccucgaguacacccgcaccggcuccgagucccccaaggucugcuccgaccaguccuccggcuccggcaccggcaagggcaucuccggcuaccuccccacccucaacgaggacgaggaguggaagugcgaccaggacauggacgaggacgacggccgcgacgccgccccccccggccgccucccccagaagcuccuccucgagaccgccgccccccgcgucuccuccucccgccgcuacuccgagggccgcgaguuccgcuacggcuccuggcgcgagcccgucaaccccuacuacgucaacgccggcuacgcccucgcccccgccaccuccgccaacgacuccgagcagcagucccucuccuccgacgccgacacccucucccucaccgacuccuccgucgacggcaucccccccuaccgcauccgcaagcagcaccgccgcgagaugcaggaguccguccaggucaacggccgcgucccccucccccacaucccccgcaccuaccgcguccccaaggagguccgcgucgagccccagaaguucgccgaggagcucauccaccgccucgaggccguccagcgcacccgcgaggccgaggagaagcucgaggagcgccucaagcgcguccgcauggaggaggagggcgaggacggcgaccccuccuccggcccccccggccccugccacaagcucccccccgcccccgccuggcaccacuuccccccccgcugcgucgacaugggcugcgccggccuccgcgacgcccacgaggagaaccccgaguccauccucgacgagcacguccagcgcguccuccgcacccccggccgccagucccccggccccggccaccgcucccccgacuccggccacgucgccaagaugcccgucgcccucggcggcgccgccuccggccacggcaagcacguccccaaguccggcgccaagcucgacgccgccggccuccaccaccaccgccacguccaccaccacguccaccacuccaccgcccgccccaaggagcaggucgaggccgaggccacccgccgcgcccaguccuccuucgccuggggccucgagccccacucccacggcgcccgcucccgcggcuacuccgaguccgucggcgccgcccccaacgccuccgacggccucgcccacuccggcaaggucggcgucgccugcaagcgcaacgccaagaaggccgaguccggcaaguccgccuccaccgagguccccggcgccuccgaggacgccgagaagaaccagaagaucaugcaguggaucaucgagggcgagaaggagaucucccgccaccgccgcaccggccacggcuccuccggcacccgcaagccccagccccacgagaacucccgcccccucucccucgagcaccccugggccggcccccagcuccgcaccuccguccagcccucccaccucuucauccaggaccccaccaugcccccccaccccgcccccaacccccucacccagcucgaggaggcccgccgccgccucgaggaggaggagaagcgcgccucccgcgcccccuccaagcagcgcuacguccaggaggucaugcgccgcggccgcgccugcguccgccccgccugcgcccccguccuccacgucguccccgccgucuccgacauggagcucuccgagaccgagacccgcucccagcgcaaggucggcggcggcuccgcccagcccugcgacuccaucgucgucgccuacuacuucugcggcgagcccauccccuaccgcacccucguccgcggccgcgccgucacccucggccaguucaaggagcuccucaccaagaagggcuccuaccgcuacuacuucaagaaggucuccgacgaguucgacugcggcgucgucuucgaggagguccgcgaggacgaggccguccuccccgucuucgaggagaagaucaucggcaaggucgagaaggucgacuga

SEQ ID NO: 40170 - RNA, 2532 nt, Artificial Sequence
  derived and/or modified sequence opt2 from AXIN2__Homo_sapiens__XP_011523623
auguccuccgccaugcucgucaccugccuccccgaccccuccuccuccuuccgcgaggacgccccccgcccccccguccccggcgaggagggcgagaccccccccugccagcccggcgucggcaagggccaggucaccaagcccaugcccgucuccuccaacacccgccgcaacgaggacggccucggcgagcccgagggccgcgccucccccgacuccccccucacccgcuggaccaagucccuccacucccuccucggcgaccaggacggcgccuaccucuuccgcaccuuccucgagcgcgagaagugcgucgacacccucgacuucugguucgccugcaacggcuuccgccagaugaaccucaaggacaccaagacccuccgcgucgccaaggccaucuacaagcgcuacaucgagaacaacuccaucgucuccaagcagcucaagcccgccaccaagaccuacauccgcgacggcaucaagaagcagcagaucgacuccaucauguucgaccaggcccagaccgagauccaguccgucauggaggagaacgccuaccagauguuccucaccuccgacaucuaccucgaguacguccgcuccggcggcgagaacaccgccuacauguccaacggcggccucggcucccucaaggucgucugcggcuaccuccccacccucaacgaggaggaggaguggaccugcgccgacuucaagugcaagcucucccccaccgucgucggccucuccuccaagacccuccgcgccaccgccuccguccgcuccaccgagaccgucgacuccggcuaccgcuccuucaagcgcuccgaccccgucaaccccuaccacaucggcuccggcuacgucuucgcccccgccaccuccgccaacgacuccgagaucuccuccgacgcccucaccgacgacuccauguccaugaccgacuccuccgucgacggcaucccccccuaccgcgucggcuccaagaagcagcuccagcgcgagaugcaccgcuccgucaaggccaacggccaggucucccucccccacuucccccgcacccaccgccuccccaaggagaugacccccgucgagcccgccaccuucgccgccgagcucaucucccgccucgagaagcucaagcucgagcucgagucccgccacucccucgaggagcgccuccagcagauccgcgaggacgaggagcgcgagggcuccgagcucacccucaacucccgcgagggcgcccccacccagcacccccucucccuccuccccuccggcuccuacgaggaggacccccagaccauccucgacgaccaccucucccgcguccucaagacccccggcugccagucccccggcgucggccgcuacuccccccgcucccgcucccccgaccaccaccaccaccaccacucccaguaccacucccuccucccccccggcggcaagcucccccccgccgccgccucccccggcgccugcccccuccucggcggcaagggcuucgucaccaagcagaccaccaagcacguccaccaccacuacauccaccaccacgccguccccaagaccaaggaggagaucgaggccgaggccacccagcgcguccacugcuucugccccggcggcuccgaguacuacugcuacuccaagugcaagucccacuccaaggcccccgagaccaugcccuccgagcaguucggcggcucccgcggcuccacccuccccaagcgcaacggcaagggcaccgagcccggccucgcccuccccgcccgcgagggcggcgcccccggcggcgccggcgcccuccagcucccccgcgaggagggcgaccgcucccaggacgucuggcaguggaugcucgaguccgagcgccaguccaagcccaagccccacuccgcccaguccaccaagaaggccuacccccucgaguccgcccgcuccucccccggcgagcgcgccucccgccaccaccucuggggcggcaacuccggccacccccgcaccaccccccgcgcccaccucuucacccaggaccccgccaugcccccccucaccccccccaacacccucgcccagcucgaggaggccugccgccgccucgccgaggucuccaagccccccaagcagcgcugcugcgucgccucccagcagcgcgaccgcaaccacuccgccaccguccagaccggcgccacccccuucuccaaccccucccucgcccccgaggaccacaaggagcccaagaagcucgccggcguccacgcccuccaggccuccgagcucgucgucaccuacuucuucugcggcgaggagauccccuaccgccgcaugcucaaggcccagucccucacccucggccacuucaaggagcagcucuccaagaagggcaacuaccgcuacuacuucaagaaggccuccgacgaguucgccugcggcgccgucuucgaggagaucugggaggacgagaccguccuccccauguacgagggccgcauccucggcaaggucgagcgcaucgacuga

SEQ ID NO: 40171 - RNA, 2658 nt, Artificial Sequence
  derived and/or modified sequence opt2 from AXL__Homo_sapiens__NP_001690
auggccuggcgcugcccccgcaugggccgcgucccccucgccuggugccucgcccucugcggcugggccugcauggccccccgcggcacccaggccgaggagucccccuucgucggcaaccccggcaacaucaccggcgcccgcggccucaccggcacccuccgcugccagcuccagguccagggcgagccccccgagguccacuggcuccgcgacggccagauccucgagcucgccgacuccacccagacccaggucccccucggcgaggacgagcaggacgacuggaucgucgucucccagcuccgcaucaccucccuccagcucuccgacaccggccaguaccagugccucgucuuccucggccaccagaccuucgucucccagcccggcuacgucggccucgagggccuccccuacuuccucgaggagcccgaggaccgcaccgucgccgccaacacccccuucaaccucuccugccaggcccagggcccccccgagcccgucgaccuccucuggcuccaggacgccgucccccucgccaccgcccccggccacggcccccagcgcucccuccacguccccggccucaacaagaccuccuccuucuccugcgaggcccacaacgccaagggcgucaccaccucccgcaccgccaccaucaccguccucccccagcagccccgcaaccuccaccucgucucccgccagcccaccgagcucgaggucgccuggacccccggccucuccggcaucuacccccucacccacugcacccuccaggccguccucuccgacgacggcaugggcauccaggccggcgagcccgacccccccgaggagccccucaccucccaggccuccguccccccccaccagcuccgccucggcucccuccacccccacacccccuaccacauccgcgucgccugcaccuccucccagggccccuccuccuggacccacuggcuccccgucgagacccccgagggcgucccccucggcccccccgagaacaucuccgccacccgcaacggcucccaggccuucguccacuggcaggagccccgcgccccccuccagggcacccuccucggcuaccgccucgccuaccagggccaggacacccccgagguccucauggacaucggccuccgccaggaggucacccucgagcuccagggcgacggcuccgucuccaaccucaccgucugcgucgccgccuacaccgccgccggcgacggccccuggucccuccccgucccccucgaggccuggcgccccgucaaggagcccuccacccccgccuucuccuggcccuggugguacguccuccucggcgccgucgucgccgccgccugcguccucauccucgcccucuuccucguccaccgccgcaagaaggagacccgcuacggcgaggucuucgagcccaccgucgagcgcggcgagcucgucguccgcuaccgcguccgcaaguccuacucccgccgcaccaccgaggccacccucaacucccucggcaucuccgaggagcucaaggagaagcuccgcgacgucauggucgaccgccacaaggucgcccucggcaagacccucggcgagggcgaguucggcgccgucauggagggccagcucaaccaggacgacuccauccucaaggucgccgucaagaccaugaagaucgccaucugcacccgcuccgagcucgaggacuuccucuccgaggccgucugcaugaaggaguucgaccaccccaacgucaugcgccucaucggcgucugcuuccagggcuccgagcgcgaguccuuccccgcccccgucgucauccuccccuucaugaagcacggcgaccuccacuccuuccuccucuacucccgccucggcgaccagcccgucuaccuccccacccagaugcucgucaaguucauggccgacaucgccuccggcauggaguaccucuccaccaagcgcuucauccaccgcgaccucgccgcccgcaacugcaugcucaacgagaacauguccgucugcgucgccgacuucggccucuccaagaagaucuacaacggcgacuacuaccgccagggccgcaucgccaagaugcccgucaaguggaucgccaucgagucccucgccgaccgcgucuacaccuccaaguccgacgucugguccuucggcgucaccaugugggagaucgccacccgcggccagacccccuaccccggcgucgagaacuccgagaucuacgacuaccuccgccagggcaaccgccucaagcagcccgccgacugccucgacggccucuacgcccucaugucccgcugcugggagcucaacccccaggaccgccccuccuucaccgagcuccgcgaggaccucgagaacacccucaaggcccucccccccgcccaggagcccgacgagauccucuacgucaacauggacgagggcggcggcuaccccgagccccccggcgccgccggcggcgccgacccccccacccagcccgaccccaaggacuccugcuccugccucaccgccgccgagguccaccccgccggccgcuacguccucugccccuccaccacccccucccccgcccagcccgccgaccgcggcucccccgccgcccccggccaggaggacggcgccuga

SEQ ID NO: 40172 - RNA, 897 nt, Artificial Sequence
  derived and/or modified sequence opt2 from AZGP1__Homo_sapiens__NP_001176
augguccgcaugguccccguccuccucucccuccuccuccuccucggccccgccgucccccaggagaaccaggacggccgcuacucccucaccuacaucuacaccggccucuccaagcacgucgaggacguccccgccuuccaggcccucggcucccucaacgaccuccaguucuuccgcuacaacuccaaggaccgcaagucccagcccaugggccucuggcgccaggucgagggcauggaggacuggaagcaggacucccagcuccagaaggcccgcgaggacaucuucauggagacccucaaggacaucgucgaguacuacaacgacuccaacggcucccacguccuccagggccgcuucggcugcgagaucgagaacaaccgcuccuccggcgccuucuggaaguacuacuacgacggcaaggacuacaucgaguucaacaaggagauccccgccuggguccccuucgaccccgccgcccagaucaccaagcagaagugggaggccgagcccgucuacguccagcgcgccaaggccuaccucgaggaggagugccccgccacccuccgcaaguaccucaaguacuccaagaacauccucgaccgccaggacccccccuccgucgucgucaccucccaccaggcccccggcgagaagaagaagcucaagugccucgccuacgacuucuaccccggcaagaucgacguccacuggacccgcgccggcgagguccaggagcccgagcuccgcggcgacguccuccacaacggcaacggcaccuaccaguccugggucgucgucgccguccccccccaggacaccgcccccuacuccugccacguccagcacuccucccucgcccagccccucgucguccccugggaggccuccuga

SEQ ID NO: 40173 - RNA, 732 nt, Artificial Sequence
  derived and/or modified sequence opt2 from AZI2__Homo_sapiens__NP_001127904
auggacgcccucgucgaggacgacaucugcauccucaaccacgagaaggcccacaagcgcgacaccgucacccccgucuccaucuacuccggcgacgaguccgucgccucccacuucgcccucgucaccgccuacgaggacaucaagaagcgccucaaggacuccgagaaggagaacucccuccucaagaagcgcauccgcuuccucgaggagaagcucaucgcccgcuucgaggaggagaccuccuccgucggccgcgagcaggucaacaaggccuaccacgccuaccgcgaggucugcaucgaccgcgacaaccucaaguccaagcucgacaagaugaacaaggacaacuccgagucccucaagguccucaacgagcagcuccaguccaaggaggucgagcuccuccagcuccgcaccgaggucgagacccagcaggucaugcgcaaccucaacccccccuccuccaacugggaggucgagaagcucuccugcgaccucaagauccacggccucgagcaggagcucgagcucaugcgcaaggagugcuccgaccucaagaucgagcuccagaaggccaagcagaccgaccccuaccaggaggacaaccucaagucccgcgaccuccagaagcucuccaucucccgccaguccaucugcuccaccgccugguccgccgucgcccaguccugggacuccaugaacuucgaggacugcucccucuucgccuga

SEQ ID NO: 40174 - RNA, 1092 nt, Artificial Sequence
  derived and/or modified sequence opt2 from AZIN1__Homo_sapiens__NP_001288597
augaagggcuucaucgacgacgccaacuacuccgucggccuccucgacgagggcaccaaccucggcaacgucaucgacaacuacgucuacgagcacacccucaccggcaagaacgccuucuucgucggcgaccucggcaagaucgucaagaagcacucccaguggcagaacgucgucgcccagaucaagcccuucuacaccgucaagugcaacuccgcccccgccguccucgagauccucgccgcccucggcaccggcuucgccugcuccuccaagaacgagauggcccucguccaggagcucggcgucccccccgagaacaucaucuacaucucccccugcaagcaggucucccagaucaaguacgccgccaaggucggcgucaacauccucaccugcgacaacgagaucgagcucaagaagaucgcccgcaaccaccccaacgccaagguccuccuccacaucgccaccgaggacaacaucggcggcgaggagggcaacaugaaguucggcaccacccucaagaacugccgccaccuccucgagugcgccaaggagcucgacguccagaucaucggcgucaaguuccacgucuccuccgccugcaaggagucccaggucuacguccacgcccucuccgacgcccgcugcgucuucgacauggccggcgagaucggcuucaccaugaacaugcucgacaucggcggcggcuucaccggcaccgaguuccagcucgaggaggucaaccacgucaucuccccccuccucgacaucuacuuccccgagggcuccggcgucaagaucaucuccgagcccggcuccuacuacgucuccuccgccuucacccucgccgucaacaucaucgccaagaaggucgucgagaacgacaaguuccccuccggcgucgagaagaccggcuccgacgagcccgccuucauguacuacaugaacgacggcgucuacggcuccuucgccuccaagcucuccgaggaccucaacaccauccccgagguccacaagaaguacaaggaggacgagccccucuucaccuccucccucuggggccccuccugcgacgagcucuuccgcuga

SEQ ID NO: 40175 - RNA, 1443 nt, Artificial Sequence
  derived and/or modified sequence opt2 from AZIN2__Homo_sapiens__NP_001288754
auggccggcuaccucuccgaguccgacuucgucauggucgaggagggcuucuccacccgcgaccuccucaaggagcucacccucggcgccucccaggccaccaccgacgaggucgccgccuucuucgucgccgaccucggcgccaucguccgcaagcacuucugcuuccucaagugccucccccgcguccgccccuucuacgccgucaagugcaacuccucccccggcguccucaagguccucgcccagcucggccucggcuucuccugcgccaacaaggccgagauggagcucguccagcacaucggcauccccgccuccaagaucaucugcgccaaccccugcaagcagaucgcccagaucaaguacgccgccaagcacggcauccagcuccucuccuucgacaacgagauggagcucgccaaggucgucaagucccaccccuccgccaagaugguccucugcaucgccaccgacgacucccacucccucuccugccucucccucaaguucggcgucucccucaaguccugccgccaccuccucgagaacgccaagaagcaccacgucgaggucgucggcgucuccuuccacaucggcuccggcugccccgacccccaggccuacgcccaguccaucgccgacgcccgccucgucuucgagaugggcaccgagcucggccacaagaugcacguccucgaccucggcggcggcuuccccggcaccgagggcgccaagguccgcuucgaggagaucgccuccgucaucaacuccgcccucgaccucuacuuccccgagggcugcggcgucgacaucuucgccgagcucggccgcuacuacgucaccuccgccuucaccgucgccgucuccaucaucgccaagaaggagguccuccucgaccagcccggccgcgaggccccccucccccccccccacaucgccaccugcgccgccuccgagcccuccccccccgccgaggagaacggcuccaccuccaagaccaucgucuaccaccucgacgagggcgucuacggcaucuucaacuccguccucuucgacaacaucugccccacccccauccuccagaagaagcccuccaccgagcagccccucuacuccuccucccucuggggccccgccgucgacggcugcgacugcgucgccgagggccucuggcucccccagcuccacgucggcgacuggcucgucuucgacaacaugggcgccuacaccgucggcaugggcucccccuucuggggcacccaggccugccacaucaccuacgccaugucccgcgucgccugggaggcccuccgccgccagcucauggccgccgagcaggaggacgacgucgagggcgucugcaagccccucuccugcggcugggagaucaccgacacccucugcgucggccccgucuucacccccgccuccaucauguga

SEQ ID NO: 40176 - RNA, 756 nt, Artificial Sequence
  derived and/or modified sequence opt2 from AZU1__Homo_sapiens__NP_001691
augacccgccucaccguccucgcccuccucgccggccuccucgccuccucccgcgccggcuccuccccccuccucgacaucgucggcggccgcaaggcccgcccccgccaguuccccuuccucgccuccauccagaaccagggccgccacuucugcggcggcgcccucauccacgcccgcuucgucaugaccgccgccuccugcuuccagucccagaaccccggcgucuccaccgucguccucggcgccuacgaccuccgccgccgcgagcgccagucccgccagaccuucuccaucuccuccauguccgagaacggcuacgacccccagcagaaccucaacgaccucaugcuccuccagcucgaccgcgaggccaaccucaccuccuccgucaccauccucccccucccccuccagaacgccaccgucgaggccggcacccgcugccaggucgccggcuggggcucccagcgcuccggcggccgccucucccgcuucccccgcuucgucaacgucaccgucacccccgaggaccagugccgccccaacaacgucugcaccggcguccucacccgccgcggcggcaucugcaacggcgacggcggcaccccccucgucugcgagggccucgcccacggcgucgccuccuucucccucggccccugcggccgcggccccgacuucuucacccgcgucgcccucuuccgcgacuggaucgacggcguccucaacaaccccggccccggccccgccuga

SEQ ID NO: 40177 - RNA, 360 nt, Artificial Sequence
  derived and/or modified sequence opt2 from B2M__Homo_sapiens__NP_004039
augucccgcuccgucgcccucgccguccucgcccuccucucccucuccggccucgaggccauccagcgcacccccaagauccaggucuacucccgccaccccgccgagaacggcaaguccaacuuccucaacugcuacgucuccggcuuccaccccuccgacaucgaggucgaccuccucaagaacggcgagcgcaucgagaaggucgagcacuccgaccucuccuucuccaaggacugguccuucuaccuccucuacuacaccgaguucacccccaccgagaaggacgaguacgccugccgcgucaaccacgucacccucucccagcccaagaucgucaagugggaccgcgacauguga

SEQ ID NO: 40178 - RNA, 996 nt, Artificial Sequence
  derived and/or modified sequence opt2 from B3GALNT1__Homo_sapiens__XP_005247921
auggccuccgcccucuggaccguccuccccucccgcaugucccuccgcucccucaaguggucccuccuccuccucucccuccucuccuucuucgucaugugguaccucucccucccccacuacaacgucaucgagcgcgucaacuggauguacuucuacgaguacgagcccaucuaccgccaggacuuccacuucacccuccgcgagcacuccaacugcucccaccagaaccccuuccucgucauccucgucaccucccaccccuccgacgucaaggcccgccaggccauccgcgucaccuggggcgagaagaaguccugguggggcuacgagguccucaccuucuuccuccucggccaggaggccgagaaggaggacaagaugcucgcccucucccucgaggacgagcaccuccucuacggcgacaucauccgccaggacuuccucgacaccuacaacaaccucacccucaagaccaucauggccuuccgcugggucaccgaguucugccccaacgccaaguacgucaugaagaccgacaccgacgucuucaucaacaccggcaaccucgucaaguaccuccucaaccucaaccacuccgagaaguucuucaccggcuacccccucaucgacaacuacuccuaccgcggcuucuaccagaagacccacaucuccuaccaggaguaccccuucaaggucuucccccccuacugcuccggccucggcuacaucaugucccgcgaccucgucccccgcaucuacgagaugaugggccacgucaagcccaucaaguucgaggacgucuacgucggcaucugccucaaccuccucaaggucaacauccacauccccgaggacaccaaccucuucuuccucuaccgcauccaccucgacgucugccagcuccgccgcgucaucgccgcccacggcuucuccuccaaggagaucaucaccuucuggcaggucaugcuccgcaacaccaccugccacuacuga

SEQ ID NO: 40179 - RNA, 981 nt, Artificial Sequence
  derived and/or modified sequence opt2 from B3GALNT2__Homo_sapiens__NP_001264084
augcgcaacuggcucguccuccucugccccugcguccucggcgccgcccuccaccucuggcuccgccuccgcucccccccccccgccugcgccuccggcgccggccccgccggcggcgucucccuccuccucccccgccucgagugcaacggcgccgucuccgcccaccccaaccuccaccuccccggcucccgcgacucccccgccuccgccucccaggucgccggcaucaccgaccagcucgcccucuucccccaguggaaguccacccacuacgacgucgucgucggcguccucuccgcccgcaacaaccacgagcuccgcaacgucauccgcuccaccuggaugcgccaccuccuccagcaccccacccucucccagcgcguccucgucaaguucaucaucggcgcccacggcugcgagguccccgucgaggaccgcgaggaccccuacuccugcaagcuccucaacaucaccaaccccguccucaaccaggagaucgaggccuucucccucuccgaggacaccuccuccggccuccccgaggaccgcgucgucuccgucuccuuccgcguccucuaccccaucgucaucaccucccucggcgucuucuacgacgccaacgacgucggcuuccagcgcaacaucaccgucaagcucuaccaggccgagcaggaggaggcccucuucaucgcccgcuucuccccccccuccugcggcguccaggucaacaagcucugguacaagcccgucgagcaguucauccuccccgaguccuucgagggcaccaucgucugggagucccaggaccuccacggccucgucucccgcaaccuccacaaggucaccgucaacgacggcggcggcguccuccgcgucaucaccgccggcgagggcgcccucccccacgaguuccucgagggcgucgagggcgucgccggcggcuucaucuacaccauccagggcaaguucgccuccuga

SEQ ID NO: 40180 - RNA, 1269 nt, Artificial Sequence
  derived and/or modified sequence opt2 from B3GALT2__Homo_sapiens__NP_003774
augcuccaguggcgccgccgccacugcugcuucgccaagaugaccuggaacgccaagcgcucccucuuccgcacccaccucaucggcguccucucccucgucuuccucuucgccauguuccucuucuucaaccaccacgacuggcuccccggccgcgccggcuucaaggagaaccccgucaccuacaccuuccgcggcuuccgcuccaccaaguccgagaccaaccacuccucccuccgcaacaucuggaaggagaccgucccccagacccuccgcccccagaccgccaccaacuccaacaacaccgaccucuccccccagggcgucaccggccucgagaacacccucuccgccaacggcuccaucuacaacgagaagggcaccggccaccccaacuccuaccacuucaaguacaucaucaacgagcccgagaagugccaggagaagucccccuuccucauccuccucaucgccgccgagcccggccagaucgaggcccgccgcgccauccgccagaccuggggcaacgagucccucgcccccggcauccagaucacccgcaucuuccuccucggccucuccaucaagcucaacggcuaccuccagcgcgccauccucgaggagucccgccaguaccacgacaucauccagcaggaguaccucgacaccuacuacaaccucaccaucaagacccucaugggcaugaacugggucgccaccuacugcccccacauccccuacgucaugaagaccgacuccgacauguucgucaacaccgaguaccucaucaacaagcuccucaagcccgaccuccccccccgccacaacuacuucaccggcuaccucaugcgcggcuacgcccccaaccgcaacaaggacuccaagugguacaugccccccgaccucuaccccuccgagcgcuaccccgucuucugcuccggcaccggcuacgucuucuccggcgaccucgccgagaagaucuucaaggucucccucggcauccgccgccuccaccucgaggacgucuacgucggcaucugccucgccaagcuccgcaucgaccccguccccccccccaacgaguucgucuucaaccacuggcgcgucuccuacuccuccugcaaguacucccaccucaucaccucccaccaguuccagcccuccgagcucaucaaguacuggaaccaccuccagcagaacaagcacaacgccugcgccaacgccgccaaggagaaggccggccgcuaccgccaccgcaagcuccacuga

SEQ ID NO: 40181 - RNA, 1137 nt, Artificial Sequence
  derived and/or modified sequence opt2 from B3GALT4__Homo_sapiens__NP_003773
augcagcuccgccucuuccgccgccuccuccucgccgcccuccuccucgucaucgucuggacccucuucggccccuccggccucggcgaggagcuccucucccucucccucgccucccuccuccccgcccccgccucccccggccccccccucgcccucccccgccuccucauccccaaccaggaggccugcuccggccccggcgccccccccuuccuccucauccucgucugcaccgcccccgagaaccucaaccagcgcaacgccauccgcgccuccuggggcggccuccgcgaggcccgcggccuccgcguccagacccucuuccuccucggcgagcccaacgcccagcaccccgucuggggcucccagggcuccgaccucgccuccgaguccgccgcccagggcgacauccuccaggccgccuuccaggacuccuaccgcaaccucacccucaagacccucuccggccucaacugggccgagaagcacugccccauggcccgcuacguccucaagaccgacgacgacgucuacgucaacguccccgagcucgucuccgagcucguccuccgcggcggccgcuggggccagugggagcgcuccaccgagccccagcgcgaggccgagcaggagggcggccagguccuccacuccgaggaggucccccuccucuaccucggccgcguccacuggcgcgucaaccccucccgcacccccggcggccgccaccgcgucuccgaggagcaguggccccacaccuggggccccuucccccccuacgccuccggcaccggcuacguccucuccgccuccgccguccagcucauccucaaggucgccucccgcgccccccuccucccccucgaggacgucuucgucggcgucuccgcccgccgcggcggccucgcccccacccagugcgucaagcucgccggcgccacccacuacccccucgaccgcugcugcuacggcaaguuccuccucaccucccaccgccucgaccccuggaagaugcaggaggccuggaagcucgucggcggcuccgacggcgagcgcaccgcccccuucugcuccugguuccagggcguccucggcauccuccgcugccgcgccaucgccuggcuccaguccuga

SEQ ID NO: 40182 - RNA, 933 nt, Artificial Sequence
  derived and/or modified sequence opt2 from B3GALT5__Homo_sapiens__NP_149361
auggccuuccccaagaugcgccucauguacaucugccuccucguccucggcgcccucugccucuacuucuccauguacucccucaaccccuucaaggagcaguccuucgucuacaagaaggacggcaacuuccucaagcuccccgacaccgacugccgccagaccccccccuuccucguccuccucgucaccuccucccacaagcagcucgccgagcgcauggccauccgccagaccuggggcaaggagcgcauggucaagggcaagcagcucaagaccuucuuccuccucggcaccaccuccuccgccgccgagaccaaggaggucgaccaggagucccagcgccacggcgacaucauccagaaggacuuccucgacgucuacuacaaccucacccucaagaccaugaugggcaucgaguggguccaccgcuucugcccccaggccgccuucgucaugaagaccgacuccgacauguucaucaacgucgacuaccucaccgagcuccuccucaagaagaaccgcaccacccgcuucuucaccggcuuccucaagcucaacgaguuccccauccgccagcccuucuccaagugguucgucuccaaguccgaguaccccugggaccgcuacccccccuucugcuccggcaccggcuacgucuucuccggcgacgucgccucccaggucuacaacgucuccaaguccguccccuacaucaagcucgaggacgucuucgucggccucugccucgagcgccucaacauccgccucgaggagcuccacucccagcccaccuucuuccccggcggccuccgcuucuccgucugccucuuccgccgcaucgucgccugccacuucaucaagccccgcacccuccucgacuacuggcaggcccucgagaacucccgcggcgaggacugcccccccgucuga

SEQ ID NO: 40183 - RNA, 1497 nt, Artificial Sequence
  derived and/or modified sequence opt2 from B3GALTL__Homo_sapiens__NP_919299
augcgcccccccgccugcugguggcuccucgccccccccgcccuccucgcccuccucaccugcucccucgccuucggccucgccuccgaggacaccaagaaggaggucaagcagucccaggaccucgagaaguccggcaucucccgcaagaacgacaucgaccucaagggcaucgucuucgucauccagucccaguccaacuccuuccacgccaagcgcgccgagcagcucaagaaguccauccucaagcaggccgccgaccucacccaggagcuccccuccguccuccuccuccaccagcucgccaagcaggagggcgccuggaccauccucccccuccucccccacuucuccgucaccuacucccgcaacuccuccuggaucuucuucugcgaggaggagacccgcauccagauccccaagcuccucgagacccuccgccgcuacgaccccuccaaggagugguuccucggcaaggcccuccacgacgaggaggccaccaucauccaccacuacgccuucuccgagaaccccaccgucuucaaguaccccgacuucgccgccggcugggcccucuccaucccccucgucaacaagcucaccaagcgccucaaguccgagucccucaaguccgacuucaccaucgaccucaagcacgagaucgcccucuacaucugggacaagggcggcggccccccccucacccccguccccgaguucugcaccaacgacgucgacuucuacugcgccaccaccuuccacuccuuccucccccucugccgcaagcccgucaagaagaaggacaucuucgucgccgucaagaccugcaagaaguuccacggcgaccgcauccccaucgucaagcagaccugggagucccaggccucccucaucgaguacuacuccgacuacaccgagaacuccauccccaccgucgaccucggcauccccaacaccgaccgcggccacugcggcaagaccuucgccauccucgagcgcuuccucaaccgcucccaggacaagaccgccuggcucgucaucgucgacgacgacacccucaucuccaucucccgccuccagcaccuccucuccugcuacgacuccggcgagcccgucuuccucggcgagcgcuacggcuacggccucggcaccggcggcuacuccuacaucaccggcggcggcggcauggucuucucccgcgaggccguccgccgccuccucgccuccaagugccgcugcuacuccaacgacgcccccgacgacaugguccucggcaugugcuucuccggccucggcauccccgucacccacuccccccucuuccaccaggcccgccccgucgacuaccccaaggacuaccucucccaccagguccccaucuccuuccacaagcacuggaacaucgaccccgucaaggucuacuucaccuggcucgcccccuccgacgaggacaaggcccgccaggagacccagaagggcuuccgcgaggagcucuga

SEQ ID NO: 40184 - RNA, 1044 nt, Artificial Sequence
  derived and/or modified sequence opt2 from B3GAT1__Homo_sapiens__XP_011541055
augggcaacgaggagcccuggguccagcccgcccucgagaugcccaagcgccgcgacauccucgccaucguccucaucguccuccccuggacccuccucaucaccgucuggcaccaguccacccucgccccccuccucgccguccacaaggacgagggcuccgacccccgccgcgagaccccccccggcgccgacccccgcgaguacugcaccuccgaccgcgacaucgucgaggucguccgcaccgaguacgucuacacccgccccccccccugguccgacacccuccccaccauccacgucgucacccccaccuacucccgccccguccagaaggccgagcucacccgcauggccaacacccuccuccacguccccaaccuccacuggcucgucgucgaggacgccccccgccgcaccccccucaccgcccgccuccuccgcgacaccggccucaacuacacccaccuccacgucgagaccccccgcaacuacaagcuccgcggcgacgcccgcgacccccgcaucccccgcggcaccaugcagcgcaaccucgcccuccgcuggcuccgcgagaccuucccccgcaacuccucccagcccggcgucgucuacuucgccgacgacgacaacaccuacucccucgagcucuucgaggagaugcgcuccacccgccgcgucuccgucuggcccgucgccuucgucggcggccuccgcuacgaggccccccgcgucaacggcgccggcaaggucgucggcuggaagaccgucuucgacccccaccgccccuucgccaucgacauggccggcuucgccgucaaccuccgccucauccuccagcgcucccaggccuacuucaagcuccgcggcgucaagggcggcuaccaggaguccucccuccuccgcgagcucgucacccucaacgaccucgagcccaaggccgccaacugcaccaagauccucgucuggcacacccgcaccgagaagcccguccucgucaacgagggcaagaagggcuucaccgaccccuccgucgagaucuga

SEQ ID NO: 40185 - RNA, 972 nt, Artificial Sequence
  derived and/or modified sequence opt2 from B3GAT2__Homo_sapiens__NP_542780
augaaguccgcccucuucacccgcuucuucauccuccuccccuggauccucaucgucaucaucaugcucgacgucgacacccgccgccccguccccccccucaccccccgccccuacuucucccccuacgccgucggccgcggcggcgcccgccucccccuccgccgcggcggccccgcccacggcacccagaagcgcaaccagucccgcccccagccccagcccgagccccagcuccccaccaucuacgccaucacccccaccuacucccgccccguccagaaggccgagcucacccgccucgccaacaccuuccgccaggucgcccagcuccacuggauccucgucgaggacgccgccgcccgcuccgagcucgucucccgcuuccucgcccgcgccggccuccccuccacccaccuccacguccccaccccccgccgcuacaagcgccccggccucccccgcgccaccgagcagcgcaacgccggccucgccuggcuccgccagcgccaccagcaccagcgcgcccagcccggcguccucuucuucgccgacgacgacaacaccuacucccucgagcucuuccaggagaugcgcaccacccgcaaggucuccgucuggcccgucggccucgucggcggccgccgcuacgagcgcccccucgucgagaacggcaaggucgucggcugguacaccggcuggcgcgccgaccgccccuucgccaucgacauggccggcuucgccgucucccuccaggucauccucuccaaccccaaggccgucuucaagcgccgcggcucccagcccggcaugcaggaguccgacuuccucaagcagaucaccaccgucgaggagcucgagcccaaggccaacaacugcaccaagguccucgucuggcacacccgcaccgagaaggucaaccucgccaacgagcccaaguaccaccucgacaccgucaagaucgaggucuga

SEQ ID NO: 40186 - RNA, 948 nt, Artificial Sequence
  derived and/or modified sequence opt2 from B3GAT3__Homo_sapiens__NP_001275652
augaagcucaagcucaagaacgucuuccucgccuacuuccucgucuccaucgccggccuccucuacgcccucguccagcucggccagcccugcgacugccuccccccccuccgcgccgccgccgagcagcuccgccagaaggaccuccgcaucucccagcuccaggccgagcuccgccgccccccccccgcccccgcccagccccccgagcccgaggcccuccccaccaucuacgucgucacccccaccuacgcccgccucguccagaaggccgagcucguccgccucucccagacccucucccucgucccccgccuccacuggcuccucgucgaggacgccgagggccccaccccccucgucuccggccuccucgccgccuccggccuccucuucacccaccucgucguccucacccccaaggcccagcgccuccgcgagggcgagcccggcuggguccacccccgcggcgucgagcagcgcaacaaggcccucgacuggcuccgcggccgcggcggcgccgucggcggcgagaaggacccccccccccccggcacccagggcgucgucuacuucgccgacgacgacaacaccuacucccgcgagcucuucgaggagaugcgcuggacccgcggcgucuccgucuggcccgucggccucgucggcggccuccgcuucgagggcccccagguccaggacggccgcgucgucggcuuccacaccgccugggagcccucccgccccuuccccgucgacauggccggcuucgccgucgcccucccccuccuccucgacaagcccaacgcccaguucgacuccaccgccccccgcggccaccucgaguccucccuccucucccaccucgucgaccccaaggaccucgagccccgcgccgccaacugcacccgcaccgagucccgcugcgucacccaggccggcguccaguga

SEQ ID NO: 40187 - RNA, 1194 nt, Artificial Sequence
  derived and/or modified sequence opt2 from B3GNT2__Homo_sapiens__NP_001306004
auguccgucggccgccgccgcaucaagcuccucggcauccucaugauggccaacgucuucaucuacuucaucauggaggucuccaaguccuccucccaggagaagaacggcaagggcgaggucaucauccccaaggagaaguucuggaagaucuccaccccccccgaggccuacuggaaccgcgagcaggagaagcucaaccgccaguacaaccccauccucuccaugcucaccaaccagaccggcgaggccggccgccucuccaacaucucccaccucaacuacugcgagcccgaccuccgcgucaccuccgucgucaccggcuucaacaaccuccccgaccgcuucaaggacuuccuccucuaccuccgcugccgcaacuacucccuccucaucgaccagcccgacaagugcgccaagaagcccuuccuccuccucgccaucaagucccucaccccccacuucgcccgccgccaggccauccgcgaguccuggggccaggaguccaacgccggcaaccagaccgucguccgcgucuuccuccucggccagaccccccccgaggacaaccaccccgaccucuccgacaugcucaaguucgaguccgagaagcaccaggacauccucauguggaacuaccgcgacaccuucuucaaccucucccucaaggagguccucuuccuccgcugggucuccaccuccugccccgacaccgaguucgucuucaagggcgacgacgacgucuucgucaacacccaccacauccucaacuaccucaacucccucuccaagaccaaggccaaggaccucuucaucggcgacgucauccacaacgccggcccccaccgcgacaagaagcucaaguacuacauccccgaggucgucuacuccggccucuacccccccuacgccggcggcggcggcuuccucuacuccggccaccucgcccuccgccucuaccacaucaccgaccagguccaccucuaccccaucgacgacgucuacaccggcaugugccuccagaagcucggccucguccccgagaagcacaagggcuuccgcaccuucgacaucgaggagaagaacaagaacaacaucugcuccuacgucgaccucaugcucguccacucccgcaagccccaggagaugaucgacaucuggucccagcuccaguccgcccaccucaagugcuga

SEQ ID NO: 40188 - RNA, 1119 nt, Artificial Sequence
  derived and/or modified sequence opt2 from B3GNT3__Homo_sapiens__XP_011525929
augaaguaccuccgccaccgccgccccaacgccacccucauccucgccaucggcgccuucacccuccuccucuucucccuccucgucuccccccccaccugcaagguccaggagcagccccccgccauccccgaggcccucgccuggcccaccccccccacccgccccgcccccgcccccugccacgccaacaccuccauggucacccaccccgacuucgccacccagccccagcacguccagaacuuccuccucuaccgccacugccgccacuucccccuccuccaggacgucccccccuccaagugcgcccagcccgucuuccuccuccucgucaucaaguccucccccuccaacuacguccgccgcgagcuccuccgccgcaccuggggccgcgagcgcaagguccgcggccuccagcuccgccuccucuuccucgucggcaccgccuccaacccccacgaggcccgcaaggucaaccgccuccucgagcucgaggcccagacccacggcgacauccuccagugggacuuccacgacuccuucuucaaccucacccucaagcagguccucuuccuccaguggcaggagacccgcugcgccaacgccuccuucguccucaacggcgacgacgacgucuucgcccacaccgacaacauggucuucuaccuccaggaccacgaccccggccgccaccucuucgucggccagcucauccagaacgucggccccauccgcgccuucugguccaaguacuacguccccgaggucgucacccagaacgagcgcuacccccccuacugcggcggcggcggcuuccuccucucccgcuucaccgccgccgcccuccgccgcgccgcccacguccucgacaucuuccccaucgacgacgucuuccucggcaugugccucgagcucgagggccucaagcccgccucccacuccggcauccgcaccuccggcguccgcgcccccucccagcgccucuccuccuucgaccccugcuucuaccgcgaccuccuccucguccaccgcuuccuccccuacgagaugcuccucaugugggacgcccucaaccagcccaaccucaccugcggcaaccagacccagaucuacuga

SEQ ID NO: 40189 - RNA, 1137 nt, Artificial Sequence
  derived and/or modified sequence opt2 from B3GNT5__Homo_sapiens__XP_011511531
augcgcaugcucgucuccggccgccgcgucaagaaguggcagcucaucauccagcucuucgccaccugcuuccucgccucccucauguucuucugggagcccaucgacaaccacaucgucucccacaugaaguccuacuccuaccgcuaccucaucaacuccuacgacuucgucaacgacacccucucccucaagcacaccuccgccggcccccgcuaccaguaccucaucaaccacaaggagaagugccaggcccaggacguccuccuccuccucuucgucaagaccgcccccgagaacuacgaccgccgcuccggcauccgccgcaccuggggcaacgagaacuacguccgcucccagcucaacgccaacaucaagacccucuucgcccucggcacccccaacccccucgagggcgaggagcuccagcgcaagcucgccugggaggaccagcgcuacaacgacaucauccagcaggacuucgucgacuccuucuacaaccucacccucaagcuccucaugcaguucuccugggccaacaccuacugcccccacgccaaguuccucaugaccgccgacgacgacaucuucauccacaugcccaaccucaucgaguaccuccagucccucgagcagaucggcguccaggacuucuggaucggccgcguccaccgcggcgccccccccauccgcgacaaguccuccaaguacuacgucuccuacgagauguaccaguggcccgccuaccccgacuacaccgccggcgccgccuacgucaucuccggcgacgucgccgccaaggucuacgaggccucccagacccucaacuccucccucuacaucgacgacgucuucaugggccucugcgccaacaagaucggcaucgucccccaggaccacgucuucuucuccggcgagggcaagacccccuaccaccccugcaucuacgagaagaugaugaccucccacggccaccucgaggaccuccaggaccucuggaagaacgccaccgaccccaaggucaagaccaucuccaagggcuucuucggccagaucuacugccgccucaugaagaucauccuccucugcaagaucuccuacgucgacaccuaccccugccgcgccgccuucaucuga

SEQ ID NO: 40190 - RNA, 1155 nt, Artificial Sequence
  derived and/or modified sequence opt2 from B3GNT6__Homo_sapiens__NP_619651
auggccuuccccugccgccgcucccucaccgccaagacccucgccugccuccucgucggcgucuccuuccucgcccuccagcagugguuccuccaggccccccgcuccccccgcgaggagcgcuccccccaggaggagacccccgagggccccaccgacgcccccgccgccgacgagccccccuccgagcucguccccggcccccccugcgucgccaacgccuccgccaacgccaccgccgacuucgagcagcuccccgcccgcauccaggacuuccuccgcuaccgccacugccgccacuucccccuccucugggacgcccccgccaagugcgccggcggccgcggcgucuuccuccuccucgccgucaaguccgcccccgagcacuacgagcgccgcgagcucauccgccgcaccuggggccaggagcgcuccuacggcggccgccccguccgccgccucuuccuccucggcacccccggccccgaggacgaggcccgcgccgagcgccucgccgagcucgucgcccucgaggcccgcgagcacggcgacguccuccagugggccuucgccgacaccuuccucaaccucacccucaagcaccuccaccuccucgacuggcucgccgcccgcugcccccacgcccgcuuccuccucuccggcgacgacgacgucuucguccacaccgccaacgucguccgcuuccuccaggcccagccccccggccgccaccucuucuccggccagcucauggagggcuccguccccauccgcgacuccugguccaaguacuucguccccccccagcucuuccccggcuccgccuaccccgucuacugcuccggcggcggcuuccuccucuccggccccaccgcccgcgcccuccgcgccgccgcccgccacaccccccucuuccccaucgacgacgccuacaugggcaugugccucgagcgcgccggccucgcccccuccggccacgagggcauccgccccuucggcguccagcuccccggcgcccagcaguccuccuucgaccccugcauguaccgcgagcuccuccucguccaccgcuucgcccccuacgagaugcuccucauguggaaggcccuccacucccccgcccucuccugcgaccgcggccaccgcgucuccuga

SEQ ID NO: 40191 - RNA, 1194 nt, Artificial Sequence
  derived and/or modified sequence opt2 from B3GNT8__Homo_sapiens__NP_940942
augcgcugccccaagugccuccucugccucuccgcccuccucacccuccucggccucaaggucuacaucgaguggaccuccgagucccgccucuccaaggccuaccccuccccccgcggcaccccccccucccccacccccgccaaccccgagcccacccuccccgccaaccucuccacccgccucggccagaccaucccccuccccuucgccuacuggaaccagcagcaguggcgccucggcucccuccccuccggcgacuccaccgagaccggcggcugccaggccuggggcgccgccgccgccaccgagauccccgacuucgccuccuaccccaaggaccuccgccgcuuccuccucuccgccgccugccgcuccuucccccaguggcuccccggcggcggcggcucccaggucuccuccugcuccgacaccgacguccccuaccuccuccucgccgucaaguccgagcccggccgcuucgccgagcgccaggccguccgcgagaccuggggcucccccgcccccggcauccgccuccucuuccuccucggcucccccgucggcgaggccggccccgaccucgacucccucgucgccugggagucccgccgcuacuccgaccuccuccucugggacuuccucgacguccccuucaaccagacccucaaggaccuccuccuccucgccuggcucggccgccacugccccaccgucuccuucguccuccgcgcccaggacgacgccuucguccacacccccgcccuccucgcccaccuccgcgcccucccccccgccuccgcccgcucccucuaccucggcgaggucuucacccaggccaugccccuccgcaagcccggcggccccuucuacguccccgaguccuucuucgagggcggcuaccccgccuacgccuccggcggcggcuacgucaucgccggccgccucgcccccuggcuccuccgcgccgccgcccgcgucgcccccuuccccuucgaggacgucuacaccggccucugcauccgcgcccucggccucgucccccaggcccaccccggcuuccucaccgccuggcccgccgaccgcaccgccgaccacugcgccuuccgcaaccuccuccucguccgcccccucggcccccaggccuccauccgccucuggaagcagcuccaggacccccgccuccagugcuga

SEQ ID NO: 40192 - RNA, 1086 nt, Artificial Sequence
  derived and/or modified sequence opt2 from B3GNTL1__Homo_sapiens__XP_006722335
auguccggcgccggcgucggcggcgccuccgaggagucccaggccaugcaggcccacgucuccaucauccuccccguccacaacgccgagcccuggcucgacgagugccuccgcuccguccuccagcaggacuucgagggcaccauggagcucuccgucuucaacgacgccuccaaggacaaguccggcgccaucaucgagaaguggcgcgucaagcucgaggacuccggcguccacgucaucaucggcggccacgacucccccuccccccgcggcgucggcuacgccaagaaccaggccgucgcccaguccuccggcuccuaccucugcuuccucgacuccgacgacgucaugaugccccagcgcguccgccuccagcacgaggccgccguccagcaccccuccuccaucaucggcugccgcguccgccgcgacccccccaacuccaccgagcgcuacacccgcuggaucaaccagcucacccccgagcagcuccucacccaggucuucaccuccaacggccccaccgucaucaugcccaccugguucugcucccgcgccugguucucccacgucggccccuucaacgagggcggccagggcguccccgaggaccuccucuucuucuacgagcaccuccgcaagggcggcggcgucauccgcgucgaccagucccuccuccucuaccgccaccacccccaggccgccacccacugcguccucgagaccaccaucuggacccaccgcguccgcuuccucgaggagcaggcccucccccgcugggccgccuucaccaucuggaacgccggcaagcagggccgccgccucuaccgcucccucaccgccggcucccagcgcaaggucgucgccuucugcgacgucgacgagaacaagauccgcaagggcuucuacugccacgaggacucccaggagcgccccaagccccgcauccccauccuccacuuccgcgccgcccgcccccccuucgucaucugcgucaagcucgaccucaccggcggcgccuucgaggacaaccuccgcucccuccaccuccaggagggccaggacuuccuccacuucuccuga

SEQ ID NO: 40193 - RNA, 987 nt, Artificial Sequence
  derived and/or modified sequence opt2 from B4GALNT1__Homo_sapiens__NP_001263398
auguggcucggccgccgcgcccucugcgcccucguccuccuccucgccugcgccucccucggccuccucuacgccuccacccgcgacgcccccggccuccgccucccccucgcccccugggcccccccccaguccccccgccgccccgagcuccccgaccucgcccccgagccccgcuacgcccacauccccguccgcaucaaggagcaggucgucggccuccucgccuggaacaacugcuccugcgaguccuccggcggcggccucccccuccccuuccagaagcagguccgcgccaucgaccucaccaaggccuucgaccccgccgagcuccgcgccgccuccgccacccgcgagcaggaguuccaggccuuccucucccgcucccagucccccgccgaccagcuccucaucgcccccgccaacuccccccuccaguacccccuccagggcgucgagguccagccccuccgcuccauccucguccccggccucucccuccaggccgccuccggccaggaggucuaccaggucaaccucaccgccucccucggcaccugggacgucgccggcgaggucaccggcgucacccucaccggcgagggccaggccgaccucacccucgucucccccggccucgaccagcucaaccgccagcuccagcucgucaccuacuccucccgcuccuaccagaccaacaccgccgacaccggcgcccgccccggcuggcgcgacggccaggccggccagaccgagaagaaccagaagggcugguccggccagauggccgagggcaugggcggcaucugggccauggcccgcgccguccagccccacaacggcugcuucaacuggaccucccgcgcccgcggccgcaagggcgccuucguccaccucggccucgagcaggcccgcggcaagcccgagcccugggucugccuccccuuccgccccaccgucggcggcccccgcaagcgccucgucuga

SEQ ID NO: 40194 - RNA, 1521 nt, Artificial Sequence
  derived and/or modified sequence opt2 from B4GALNT2__Homo_sapiens__NP_001152859
augaccuccggcggcucccgcuuccucuggcuccucaagauccucgucaucauccucguccucggcaucgucggcuucauguucggcuccauguuccuccaggccgucuucuccucccccaagcccgagcuccccucccccgcccccggcguccagaagcucaagcuccuccccgaggagcgccuccgcaaccucuucuccuacgacggcaucuggcucuuccccaagaaccagugcaagugcgaggccaacaaggagcagggcggcuacaacuuccaggacgccuacggccaguccgaccuccccgccgucaaggcccgccgccaggccgaguucgagcacuuccagcgccgcgagggccucccccgcccccucccccuccucguccagcccaaccuccccuucggcuaccccguccacggcgucgaggucaugccccuccacaccguccccauccccggccuccaguucgagggccccgacgcccccgucuacgaggucacccucaccgccucccucggcacccucaacacccucgccgacguccccgacuccgucguccagggccgcggccagaagcagcucaucaucuccaccuccgaccgcaagcuccucaaguucauccuccagcacgucaccuacaccuccaccggcuaccagcaccagaaggucgacaucgucucccucgagucccgcuccuccgucgccaaguuccccgucaccauccgccaccccgucauccccaagcucuacgaccccggccccgagcgcaagcuccgcaaccucgucaccaucgccaccaagaccuuccuccgcccccacaagcucaugaucaugcuccgcuccauccgcgaguacuaccccgaccucaccgucaucgucgccgacgacucccagaagccccucgagaucaaggacaaccacgucgaguacuacaccaugcccuucggcaagggcugguucgccggccgcaaccucgccaucucccaggucaccaccaaguacguccucugggucgacgacgacuuccucuucaacgaggagaccaagaucgagguccucgucgacguccucgagaagaccgagcucgacgucgucggcggcuccguccucggcaacgucuuccaguucaagcuccuccucgagcaguccgagaacggcgccugccuccacaagcgcaugggcuucuuccagccccucgacggcuuccccuccugcgucgucaccuccggcgucgucaacuucuuccucgcccacaccgagcgccuccagcgcgucggcuucgacccccgccuccagcgcgucgcccacuccgaguucuucaucgacggccucggcacccuccucgucggcuccugccccgaggucaucaucggccaccagucccgcucccccgucgucgacuccgagcucgccgcccucgagaagaccuacaacaccuaccgcuccaacacccucacccgcguccaguucaagcucgcccuccacuacuucaagaaccaccuccagugcgccgccuga

SEQ ID NO: 40195 - RNA, 2997 nt, Artificial Sequence
  derived and/or modified sequence opt2 from B4GALNT3__Homo_sapiens__NP_775864
augggcuccccccgcgccgcccgccccccccuccuccuccgccccgucaagcuccuccgccgccgcuuccgccuccuccucgcccucgccgucgucuccgucggccucuggacccucuaccucgagcucgucgccuccgcccaggucggcggcaacccccucaaccgccgcuacggcuccuggcgcgagcucgccaaggcccucgccucccgcaacauccccgccgucgacccccaccuccaguucuaccacccccagcgccucucccucgaggaccacgacaucgaccagggcgucuccuccaacuccuccuaccucaaguggaacaagcccguccccuggcucuccgaguuccgcggccgcgccaaccuccacgucuucgaggacuggugcggcuccuccauccagcagcuccgccgcaaccuccacuucccccucuacccccacauccgcaccacccuccgcaagcucgccgucucccccaaguggaccaacuacggccuccgcaucuucggcuaccuccaccccuucaccgacggcaagauccaguucgccaucgccgccgacgacaacgccgaguucuggcucucccucgacgaccaggucuccggccuccagcuccucgccuccgucggcaagaccggcaaggaguggaccgcccccggcgaguucggcaaguuccgcucccagaucuccaagcccgucucccucuccgccucccaccgcuacuacuucgagguccuccacaagcagaacgaggagggcaccgaccacgucgaggucgccuggcgccgcaacgaccccggcgccaaguucaccaucaucgacucccucucccucucccucuucaccaacgagaccuuccuccagauggacgaggucggccacaucccccagaccgccgccucccacgucgacuccuccaacgcccucccccgcgacgagcagccccccgccgacaugcuccgccccgacccccgcgacacccucuaccgcgucccccucauccccaagucccaccuccgccacguccuccccgacugccccuacaagcccuccuaccucgucgacggccucccccuccagcgcuaccagggccuccgcuucguccaccucuccuucgucuaccccaacgacuacacccgccucucccacauggagacccacaacaagugcuucuaccaggagaacgccuacuaccaggaccgcuucuccuuccaggaguacaucaagaucgaccagcccgagaagcagggccucgagcagcccggcuucgaggagaaccuccucgaggagucccaguacggcgaggucgccgaggagacccccgccuccaacaaccagaacgcccgcaugcucgagggccgccagacccccgccuccacccucgagcaggacgccaccgacuaccgccuccgcucccuccgcaagcuccucgcccagccccgcgagggccuccucgcccccuucuccaagcgcaacuccaccgccuccuuccccggccgcaccucccacauccccguccagcagcccgagaagcgcaagcagaagcccucccccgagcccucccaggacuccccccacuccgacaaguggccccccggccaccccgucaagaaccucccccagaugcgcggcccccgcccccgccccgccggcgacuccccccgcaagacccaguggcucaaccaggucgaguccuacaucgccgagcagcgccgcggcgaccgcaugcgcccccaggcccccggccgcggcuggcacggcgaggaggaggucgucgccgccgccggccaggagggccaggucgagggcgaggaggagggcgaggaggaggaggaggaggaggacauguccgaggucuucgaguacguccccgucuucgaccccgucgucaacugggaccagaccuucuccgcccgcaaccucgacuuccaggcccuccgcaccgacuggaucgaccucuccugcaacaccuccggcaaccuccuccuccccgagcaggaggcccucgaggucacccgcgucuuccucaagaagcucaaccagcgcucccgcggccgcuaccagcuccagcgcaucgucaacgucgagaagcgccaggaccagcuccgcggcggccgcuaccuccucgagcucgagcuccucgagcagggccagcgcgucguccgccucuccgaguacgucuccgcccgcggcuggcagggcaucgaccccgccggcggcgaggaggucgaggcccgcaaccuccagggccucgucugggacccccacaaccgccgccgccagguccucaacacccgcgcccaggagcccaagcucugcuggccccagggcuucuccuggucccaccgcgccgucguccacuucgucguccccgucaagaaccaggcccgcuggguccagcaguucaucaaggacauggagaaccucuuccaggucaccggcgacccccacuucaacaucgucaucaccgacuacuccuccgaggacauggacgucgagauggcccucaagcgcuccaagcuccgcuccuaccaguacgucaagcucuccggcaacuucgagcgcuccgccggccuccaggccggcaucgaccucgucaaggacccccacuccaucaucuuccucugcgaccuccacauccacuuccccgccggcgucaucgacgccauccgcaagcacugcgucgagggcaagauggccuucgcccccauggucaugcgccuccacugcggcgccaccccccaguggcccgagggcuacugggaggucaacggcuucggccuccucggcaucuacaaguccgaccucgaccgcaucggcggcaugaacaccaaggaguuccgcgaccgcuggggcggcgaggacugggagcuccucgaccgcauccuccaggccggccucgacgucgagcgccucucccuccgcaacuucuuccaccacuuccacuccaagcgcggcauguggucccgccgccagaugaagacccucuga

SEQ ID NO: 40196 - RNA, 1197 nt, Artificial Sequence
  derived and/or modified sequence opt2 from B4GALT1__Homo_sapiens__NP_001488
augcgccuccgcgagccccuccucuccggcuccgccgccaugcccggcgccucccuccagcgcgccugccgccuccucgucgccgucugcgcccuccaccucggcgucacccucgucuacuaccucgccggccgcgaccucucccgccucccccagcucgucggcgucuccaccccccuccagggcggcuccaacuccgccgccgccaucggccaguccuccggcgagcuccgcaccggcggcgcccgccccccccccccccucggcgccuccucccagccccgccccggcggcgacuccucccccgucgucgacuccggccccggccccgccuccaaccucaccuccguccccgucccccacaccaccgcccucucccuccccgccugccccgaggaguccccccuccucgucggccccaugcucaucgaguucaacaugcccgucgaccucgagcucgucgccaagcagaaccccaacgucaagaugggcggccgcuacgccccccgcgacugcgucuccccccacaaggucgccaucaucauccccuuccgcaaccgccaggagcaccucaaguacuggcucuacuaccuccaccccguccuccagcgccagcagcucgacuacggcaucuacgucaucaaccaggccggcgacaccaucuucaaccgcgccaagcuccucaacgucggcuuccaggaggcccucaaggacuacgacuacaccugcuucgucuucuccgacgucgaccucauccccaugaacgaccacaacgccuaccgcugcuucucccagccccgccacaucuccgucgccauggacaaguucggcuucucccuccccuacguccaguacuucggcggcgucuccgcccucuccaagcagcaguuccucaccaucaacggcuuccccaacaacuacuggggcuggggcggcgaggacgacgacaucuucaaccgccucgucuuccgcggcauguccaucucccgccccaacgccgucgucggccgcugccgcaugauccgccacucccgcgacaagaagaacgagcccaacccccagcgcuucgaccgcaucgcccacaccaaggagaccaugcucuccgacggccucaacucccucaccuaccagguccucgacguccagcgcuacccccucuacacccagaucaccgucgacaucggcacccccuccuga

SEQ ID NO: 40197 - RNA, 1182 nt, Artificial Sequence
  derived and/or modified sequence opt2 from B4GALT3__Homo_sapiens__NP_003770
augcuccgccgccuccucgagcgccccugcacccucgcccuccucgucggcucccagcucgccgucaugauguaccucucccucggcggcuuccgcucccucuccgcccucuucggccgcgaccagggccccaccuucgacuacucccacccccgcgacgucuacuccaaccucucccaccuccccggcgcccccggcggcccccccgccccccagggccuccccuacugccccgagcgcuccccccuccucgucggccccgucuccgucuccuucucccccguccccucccucgccgagaucgucgagcgcaacccccgcgucgagcccggcggccgcuaccgccccgccggcugcgagccccgcucccgcaccgccaucaucgucccccaccgcgcccgcgagcaccaccuccgccuccuccucuaccaccuccaccccuuccuccagcgccagcagcucgccuacggcaucuacgucauccaccaggccggcaacggcaccuucaaccgcgccaagcuccucaacgucggcguccgcgaggcccuccgcgacgaggagugggacugccucuuccuccacgacgucgaccuccuccccgagaacgaccacaaccucuacgucugcgacccccgcggcccccgccacgucgccgucgccaugaacaaguucggcuacucccuccccuacccccaguacuucggcggcgucuccgcccucacccccgaccaguaccucaagaugaacggcuuccccaacgaguacuggggcuggggcggcgaggacgacgacaucgccacccgcguccgccucgccggcaugaagaucucccgcccccccaccuccgucggccacuacaagauggucaagcaccgcggcgacaagggcaacgaggagaacccccaccgcuucgaccuccucguccgcacccagaacuccuggacccaggacggcaugaacucccucaccuaccagcuccucgcccgcgagcucggcccccucuacaccaacaucaccgccgacaucggcaccgacccccgcggcccccgcgcccccuccggcccccgcuacccccccggcuccucccaggccuuccgccaggagaugcuccagcgccgcccccccgcccgccccggcccccucuccaccgccaaccacaccgcccuccgcggcucccacuga

SEQ ID NO: 40198 - RNA, 1035 nt, Artificial Sequence
  derived and/or modified sequence opt2 from B4GALT4__Homo_sapiens__NP_997708
augggcuucaaccucaccuuccaccucuccuacaaguuccgccuccuccuccuccucacccucugccucaccgucgucggcugggccaccuccaacuacuucgucggcgccauccaggagauccccaaggccaaggaguucauggccaacuuccacaagacccucauccucggcaagggcaagacccucaccaacgaggccuccaccaagaaggucgagcucgacaacugccccuccgucucccccuaccuccgcggccaguccaagcucaucuucaagcccgaccucacccucgaggagguccaggccgagaaccccaaggucucccgcggccgcuaccgcccccaggagugcaaggcccuccagcgcgucgccauccucgucccccaccgcaaccgcgagaagcaccucauguaccuccucgagcaccuccaccccuuccuccagcgccagcagcucgacuacggcaucuacgucauccaccaggccgagggcaagaaguucaaccgcgccaagcuccucaacgucggcuaccucgaggcccucaaggaggagaacugggacugcuucaucuuccacgacgucgaccucguccccgagaacgacuucaaccucuacaagugcgaggagcaccccaagcaccucgucgucggccgcaacuccaccggcuaccgccuccgcuacuccggcuacuucggcggcgucaccgcccucucccgcgagcaguucuucaaggucaacggcuucuccaacaacuacuggggcuggggcggcgaggacgacgaccuccgccuccgcgucgagcuccagcgcaugaagaucucccgcccccuccccgaggucggcaaguacaccauggucuuccacacccgcgacaagggcaacgaggucaacgccgagcgcaugaagcuccuccaccaggucucccgcgucuggcgcaccgacggccucuccuccugcuccuacaagcucgucuccgucgagcacaacccccucuacaucaacaucaccgucgacuucugguucggcgccuga

SEQ ID NO: 40199 - RNA, 1167 nt, Artificial Sequence
  derived and/or modified sequence opt2 from B4GALT5__Homo_sapiens__NP_004767
augcgcgcccgccgcggccuccuccgccucccccgccgcucccuccucgccgcccucuucuucuucucccucuccuccucccuccucuacuucgucuacgucgcccccggcaucgucaacaccuaccucuucaugaugcaggcccagggcauccucauccgcgacaacguccgcaccaucggcgcccaggucuacgagcagguccuccgcuccgccuacgccaagcgcaacuccuccgucaacgacuccgacuacccccucgaccucaaccacuccgagaccuuccuccagaccaccaccuuccuccccgaggacuucaccuacuucgccaaccacaccugccccgagcgccuccccuccaugaagggccccaucgacaucaacauguccgagaucggcauggacuacauccacgagcucuucuccaaggaccccaccaucaagcucggcggccacuggaagcccuccgacugcaugccccgcuggaaggucgccauccucauccccuuccgcaaccgccacgagcaccuccccguccucuuccgccaccuccuccccaugcuccagcgccagcgccuccaguucgccuucuacgucgucgagcaggucggcacccagcccuucaaccgcgccaugcucuucaacgucggcuuccaggaggccaugaaggaccucgacugggacugccucaucuuccacgacgucgaccacauccccgaguccgaccgcaacuacuacggcugcggccagaugccccgccacuucgccaccaagcucgacaaguacauguaccuccuccccuacaccgaguucuucggcggcgucuccggccucaccgucgagcaguuccgcaagaucaacggcuuccccaacgccuucuggggcuggggcggcgaggacgacgaccucuggaaccgcguccagaacgccggcuacuccgucucccgccccgagggcgacaccggcaaguacaaguccaucccccaccaccaccgcggcgagguccaguuccucggccgcuacgcccuccuccgcaaguccaaggagcgccagggccucgacggccucaacaaccucaacuacuucgccaacaucaccuacgacgcccucuacaagaacaucaccgucaaccucacccccgagcucgcccaggucaacgaguacuga

SEQ ID NO: 40200 - RNA, 1149 nt, Artificial Sequence
  derived and/or modified sequence opt2 from B4GALT6__Homo_sapiens__NP_004766
auguccguccuccgccgcaugaugcgcgucuccaaccgcucccuccucgccuucaucuucuucuucucccucuccuccuccugccucuacuucaucuacgucgcccccggcaucgccaacaccuaccucuucaugguccaggcccgcggcaucaugcuccgcgagaacgucaagaccaucggccacaugauccgccucuacaccaacaagaacuccacccucaacggcaccgacuaccccgagggcaacaacuccuccgacuaccucguccagaccaccaccuaccuccccgagaacuucaccuacucccccuaccuccccugccccgagaagcuccccuacaugcgcggcuuccucaacgucaacgucuccgaggucuccuucgacgagauccaccagcucuucuccaaggaccucgacaucgagcccggcggccacuggcgccccaaggacugcaagccccgcuggaaggucgccguccucauccccuuccgcaaccgccacgagcaccuccccaucuucuuccuccaccucauccccaugcuccagaagcagcgccucgaguucgccuucuacgucaucgagcagaccggcacccagcccuucaaccgcgccaugcucuucaacgucggcuucaaggaggccaugaaggacuccgucugggacugcgucaucuuccacgacgucgaccaccuccccgagaacgaccgcaacuacuacggcugcggcgagaugccccgccacuucgccgccaagcucgacaaguacauguacauccuccccuacaaggaguucuucggcggcgucuccggccucaccgucgagcaguuccgcaagaucaacggcuuccccaacgccuucuggggcuggggcggcgaggacgacgaccucuggaaccgcguccacuacgccggcuacaacgucacccgccccgagggcgaccucggcaaguacaaguccaucccccaccaccaccgcggcgagguccaguuccucggccgcuacaagcuccuccgcuacuccaaggagcgccaguacaucgacggccucaacaaccucaucuaccgccccaagauccucgucgaccgccucuacaccaacaucuccgucaaccucaugcccgagcucgcccccaucgaggacuacuga

SEQ ID NO: 40201 - RNA, 984 nt, Artificial Sequence
  derived and/or modified sequence opt2 from B4GALT7__Homo_sapiens__NP_009186
auguuccccucccgccgcaaggccgcccagcuccccugggaggacggccgcuccggccuccucuccggcggccucccccgcaagugcuccgucuuccaccucuucgucgccugccucucccucggcuucuucucccuccucuggcuccagcucuccugcuccggcgacgucgcccgcgccguccgcggccagggccaggagaccuccggccccccccgcgccugcccccccgagcccccccccgagcacugggaggaggacgccuccuggggcccccaccgccucgccguccucguccccuuccgcgagcgcuucgaggagcuccucgucuucgucccccacaugcgccgcuuccucucccgcaagaagauccgccaccacaucuacguccucaaccaggucgaccacuuccgcuucaaccgcgccgcccucaucaacgucggcuuccucgaguccuccaacuccaccgacuacaucgccaugcacgacgucgaccuccucccccucaacgaggagcucgacuacggcuuccccgaggccggccccuuccacgucgccucccccgagcuccacccccucuaccacuacaagaccuacgucggcggcauccuccuccucuccaagcagcacuaccgccucugcaacggcauguccaaccgcuucuggggcuggggccgcgaggacgacgaguucuaccgccgcaucaagggcgccggccuccagcucuuccgccccuccggcaucaccaccggcuacaagaccuuccgccaccuccacgaccccgccuggcgcaagcgcgaccagaagcgcaucgccgcccagaagcaggagcaguucaaggucgaccgcgagggcggccucaacaccgucaaguaccacgucgccucccgcaccgcccucuccgucggcggcgcccccugcaccguccucaacaucaugcucgacugcgacaagaccgccacccccuggugcaccuucuccuga

SEQ ID NO: 40202 - RNA, 1248 nt, Artificial Sequence
  derived and/or modified sequence opt2 from B4GAT1__Homo_sapiens__NP_006867
augcagauguccuacgccauccgcugcgccuucuaccagcuccuccucgccgcccucaugcucgucgccaugcuccagcuccucuaccucucccuccucuccggccuccacggccaggaggagcaggaccaguacuucgaguucuucccccccuccccccgcuccgucgaccaggucaaggcccagcuccgcaccgcccucgccuccggcggcguccucgacgccuccggcgacuaccgcgucuaccgcggccuccucaagaccaccauggaccccaacgacgucauccucgccacccacgccuccgucgacaaccuccuccaccucuccggccuccucgagcgcugggagggcccccucuccgucuccgucuucgccgccaccaaggaggaggcccagcucgccaccguccucgccuacgcccucuccucccacugccccgacaugcgcgcccgcgucgccaugcaccucgucugccccucccgcuacgaggccgccguccccgacccccgcgagcccggcgaguucgcccuccuccgcuccugccaggaggucuucgacaagcucgcccgcgucgcccagcccggcaucaacuacgcccucggcaccaacgucuccuaccccaacaaccuccuccgcaaccucgcccgcgagggcgccaacuacgcccucgucaucgacgucgacaugguccccuccgagggccucuggcgcggccuccgcgagaugcucgaccaguccaaccaguggggcggcaccgcccucgucguccccgccuucgagauccgccgcgcccgccgcaugcccaugaacaagaacgagcucguccagcucuaccaggucggcgagguccgccccuucuacuacggccucugcacccccugccaggcccccaccaacuacucccgcugggucaaccuccccgaggagucccuccuccgccccgccuacgucguccccuggcaggaccccugggagcccuucuacgucgccggcggcaagguccccaccuucgacgagcgcuuccgccaguacggcuucaaccgcaucucccaggccugcgagcuccacgucgccggcuucgacuucgagguccucaacgagggcuuccucguccacaagggcuucaaggaggcccucaaguuccacccccagaaggaggccgagaaccagcacaacaagauccucuaccgccaguucaagcaggagcucaaggccaaguaccccaacuccccccgccgcugcuga

SEQ ID NO: 40203 - RNA, 444 nt, Artificial Sequence
  derived and/or modified sequence opt2 from B9D1__Homo_sapiens__NP_001230404
augaugaccuccaccgccuccaccgcccucugcaccgcccgcaccggccccccccagcgcgucuggcgccgcggcucccaccgcucccacccccgcgccaagaugugcggcaagcacuggugcggcaccuccccccucauguccccccucaaggcccccacccccaccgccggccaccgcuccugcuccgccugcauggaccagaugugcuccggcaccaugugguucgaggccaugggccccugcaccugccccucccaccucgccggcaccaagggccccucccccugccucucccagaaccuccgccucaacugccgcucccuccaggccggcuccuggggcggcggccccuccacccagaccccccgcugguggcuccgcgucaaggccggcaagccccccuccggccucuccgucaaggacuccuccgucucccgcuga

SEQ ID NO: 40204 - RNA, 528 nt, Artificial Sequence
  derived and/or modified sequence opt2 from B9D2__Homo_sapiens__NP_085055
auggccgagguccacgucaucggccagaucaucggcgccuccggcuucuccgaguccucccucuucugcaaguggggcauccacaccggcgccgccuggaagcuccucuccggcguccgcgagggccagacccaggucgacaccccccagaucggcgacauggccuacuggucccaccccaucgaccuccacuucgccaccaagggccuccagggcuggccccgccuccacuuccaggucuggucccaggacuccuucggccgcugccagcucgccggcuacggcuucugccacguccccuccucccccggcacccaccagcucgccugccccaccuggcgcccccucggcuccuggcgcgagcagcucgcccgcgccuucgucggcggcggcccccagcuccuccacggcgacaccaucuacuccggcgccgaccgcuaccgccuccacaccgccgccggcggcaccguccaccucgagaucggccuccuccuccgcaacuucgaccgcuacggcgucgagugcuga

SEQ ID NO: 40205 - RNA, 165 nt, Artificial Sequence
  derived and/or modified sequence opt2 from BAALC__Homo_sapiens__NP_001019543
augggcugcggcggcucccgcgccgacgccaucgagccccgcuacuacgaguccuggacccgcgagaccgaguccaccuggcucaccuacaccgacuccgacgccccccccuccgccgccgcccccgacuccggccccgaggccggcggccuccacuccggcuga

SEQ ID NO: 40206 - RNA, 1257 nt, Artificial Sequence
  derived and/or modified sequence opt2 from BAAT__Homo_sapiens__NP_001692
augauccagcucaccgccacccccgucuccgcccucgucgacgagcccguccacauccgcgccaccggccucauccccuuccagauggucuccuuccaggccucccucgaggacgagaacggcgacauguucuacucccaggcccacuaccgcgccaacgaguucggcgaggucgaccucaaccacgccuccucccucggcggcgacuacaugggcguccaccccaugggccucuucuggucccucaagcccgagaagcuccucacccgccuccucaagcgcgacgucaugaaccgccccuuccagguccaggucaagcucuacgaccucgagcucaucgucaacaacaaggucgccuccgcccccaaggccucccucacccucgagcgcugguacgucgcccccggcgucacccgcaucaagguccgcgagggccgccuccgcggcgcccucuuccucccccccggcgagggccucuuccccggcgucaucgaccucuucggcggccucggcggccuccucgaguuccgcgccucccuccucgccucccgcggcuucgccucccucgcccucgccuaccacaacuacgaggaccucccccgcaagcccgaggucaccgaccucgaguacuucgaggaggccgccaacuuccuccuccgccaccccaaggucuucggcuccggcgucggcgucgucuccgucugccagggcguccagaucggccucuccauggccaucuaccucaagcaggucaccgccaccguccucaucaacggcaccaacuuccccuucggcaucccccaggucuaccacggccagauccaccagccccucccccacuccgcccagcucaucuccaccaacgcccucggccuccucgagcucuaccgcaccuucgagaccacccaggucggcgccucccaguaccucuuccccaucgaggaggcccagggccaguuccucuucaucgucggcgagggcgacaagaccaucaacuccaaggcccacgccgagcaggccaucggccagcucaagcgccacggcaagaacaacuggacccuccucuccuaccccggcgccggccaccucaucgagccccccuacuccccccucugcugcgccuccaccacccacgaccuccgccuccacuggggcggcgaggucaucccccacgccgccgcccaggagcacgccuggaaggagauccagcgcuuccuccgcaagcaccucauccccgacgucaccucccagcucuga

SEQ ID NO: 40207 - RNA, 990 nt, Artificial Sequence
  derived and/or modified sequence opt2 from BABAM1__Homo_sapiens__NP_001275685
auggaggucgccgagcccuccucccccaccgaggaggaggaggaggaggaggagcacuccgccgagccccgcccccgcacccgcuccaaccccgagggcgccgaggaccgcgccgucggcgcccaggccuccgucggcucccgcuccgagggcgagggcgaggccgccuccgccgacgacggcucccucaacaccuccggcgccggccccaaguccuggcagguccccccccccgcccccgagguccagauccgcaccccccgcgucaacugccccgagaaggucaucaucugccucgaccucuccgaggagaugucccuccccaagcucgaguccuucaacggcuccaagaccaacgcccucaacgucucccagaagaugaucgagauguucguccgcaccaagcacaagaucgacaagucccacgaguucgcccucgucgucgucaacgacgacaccgccuggcucuccggccucaccuccgacccccgcgagcucugcuccugccucuacgaccucgagaccgccuccugcuccaccuucaaccucgagggccucuucucccucauccagcagaagaccgagcuccccgucaccgagaacguccagaccauccccccccccuacgucguccgcaccauccucgucuacucccgcccccccugccagccccaguucucccucaccgagcccaugaagaagauguuccagugccccuacuucuucuucgacgucgucuacauccacaacggcaccgaggagaaggaggaggagauguccuggaaggacauguucgccuucaugggcucccucgacaccaagggcaccuccuacaaguacgaggucgcccucgccggccccgcccucgagcuccacaacugcauggccaagcuccucgcccacccccuccagcgccccugccagucccacgccuccuacucccuccucgaggaggaggacgaggccaucgaggucgaggccaccgucuga

SEQ ID NO: 40208 - RNA, 1131 nt, Artificial Sequence
  derived and/or modified sequence opt2 from BACE1__Homo_sapiens__NP_001193978
augguccccuucaucuaccuccaggcccacuucacccucugcuccggcugguccuccaccuaccgcgaccuccgcaagggcgucuacguccccuacacccagggcaagugggagggcgagcucggcaccgaccucgucuccaucccccacggccccaacgucaccguccgcgccaacaucgccgccaucaccgaguccgacaaguucuucaucaacggcuccaacugggagggcauccucggccucgccuacgccgagaucgcccgccucugcggcgccggcuucccccucaaccaguccgagguccucgccuccgucggcggcuccaugaucaucggcggcaucgaccacucccucuacaccggcucccucugguacacccccauccgccgcgagugguacuacgaggucaucaucguccgcgucgagaucaacggccaggaccucaagauggacugcaaggaguacaacuacgacaaguccaucgucgacuccggcaccaccaaccuccgccuccccaagaaggucuucgaggccgccgucaaguccaucaaggccgccuccuccaccgagaaguuccccgacggcuucuggcucggcgagcagcucgucugcuggcaggccggcaccacccccuggaacaucuuccccgucaucucccucuaccucaugggcgaggucaccaaccaguccuuccgcaucaccauccucccccagcaguaccuccgccccgucgaggacgucgccaccucccaggacgacugcuacaaguucgccaucucccaguccuccaccggcaccgucaugggcgccgucaucauggagggcuucuacgucgucuucgaccgcgcccgcaagcgcaucggcuucgccgucuccgccugccacguccacgacgaguuccgcaccgccgccgucgagggccccuucgucacccucgacauggaggacugcggcuacaacaucccccagaccgacgaguccacccucaugaccaucgccuacgucauggccgccaucugcgcccucuucaugcucccccucugccucauggucugccaguggcgcugccuccgcugccuccgccagcagcacgacgacuucgccgacgacaucucccuccucaaguga

SEQ ID NO: 40209 - RNA, 1557 nt, Artificial Sequence
  derived and/or modified sequence opt2 from BACE2__Homo_sapiens__NP_036237
augggcgcccucgcccgcgcccuccuccucccccuccucgcccaguggcuccuccgcgccgcccccgagcucgcccccgcccccuucacccucccccuccgcgucgccgccgccaccaaccgcgucgucgcccccacccccggccccggcacccccgccgagcgccacgccgacggccucgcccucgcccucgagcccgcccucgccucccccgccggcgccgccaacuuccucgccauggucgacaaccuccagggcgacuccggccgcggcuacuaccucgagaugcucaucggcacccccccccagaagcuccagauccucgucgacaccggcuccuccaacuucgccgucgccggcaccccccacuccuacaucgacaccuacuucgacaccgagcgcuccuccaccuaccgcuccaagggcuucgacgucaccgucaaguacacccagggcuccuggaccggcuucgucggcgaggaccucgucaccauccccaagggcuucaacaccuccuuccucgucaacaucgccaccaucuucgaguccgagaacuucuuccuccccggcaucaaguggaacggcauccucggccucgccuacgccacccucgccaagcccuccuccucccucgagaccuucuucgacucccucgucacccaggccaacauccccaacgucuucuccaugcagaugugcggcgccggccuccccgucgccggcuccggcaccaacggcggcucccucguccucggcggcaucgagcccucccucuacaagggcgacaucugguacacccccaucaaggaggagugguacuaccagaucgagauccucaagcucgagaucggcggccagucccucaaccucgacugccgcgaguacaacgccgacaaggccaucgucgacuccggcaccacccuccuccgccucccccagaaggucuucgacgccgucgucgaggccgucgcccgcgccucccucauccccgaguucuccgacggcuucuggaccggcucccagcucgccugcuggaccaacuccgagacccccugguccuacuuccccaagaucuccaucuaccuccgcgacgagaacuccucccgcuccuuccgcaucaccauccucccccagcucuacauccagcccaugaugggcgccggccucaacuacgagugcuaccgcuucggcaucucccccuccaccaacgcccucgucaucggcgccaccgucauggagggcuucuacgucaucuucgaccgcgcccagaagcgcgucggcuucgccgccucccccugcgccgagaucgccggcgccgccgucuccgagaucuccggccccuucuccaccgaggacgucgccuccaacugcguccccgcccagucccucuccgagcccauccucuggaucgucuccuacgcccucauguccgucugcggcgccauccuccucguccucaucguccuccuccuccuccccuuccgcugccagcgccgcccccgcgaccccgaggucgucaacgacgaguccucccucguccgccaccgcuggaaguga

SEQ ID NO: 40210 - RNA, 2211 nt, Artificial Sequence
  derived and/or modified sequence opt2 from BACH1__Homo_sapiens__NP_996749
augucccucuccgagaacuccgucuucgccuacgaguccuccguccacuccaccaacguccuccucucccucaacgaccagcgcaagaaggacguccucugcgacgucaccaucuucgucgagggccagcgcuuccgcgcccaccgcuccguccucgccgccugcuccuccuacuuccacucccgcaucgucggccaggccgacggcgagcucaacaucacccuccccgaggaggucaccgucaagggcuucgagccccucauccaguucgccuacaccgccaagcucauccucuccaaggagaacgucgacgaggucugcaagugcgucgaguuccucuccguccacaacaucgaggaguccugcuuccaguuccucaaguucaaguuccucgacuccaccgccgaccagcaggagugcccccgcaagaagugcuucuccucccacugccagaagaccgaccucaagcucucccuccucgaccagcgcgaccucgagaccgacgaggucgaggaguuccucgagaacaagaacguccagaccccccagugcaagcuccgccgcuaccagggcaacgccaaggccucccccccccuccaggacuccgccucccagaccuacgaguccaugugccucgagaaggacgccgcccucgcccuccccucccucugccccaaguaccgcaaguuccagaaggccuucggcaccgaccgcguccgcaccggcgaguccuccgucaaggacauccacgccuccguccagcccaacgagcgcuccgagaacgagugccucggcggcguccccgagugccgcgaccuccaggucaugcucaagugcgacgaguccaagcucgccauggagcccgaggagaccaagaaggaccccgccucccagugccccaccgagaaguccgaggucacccccuucccccacaacuccuccaucgacccccacggccucuacucccucucccuccuccacaccuacgaccaguacggcgaccucaacuucgccggcaugcagaacaccaccguccucaccgagaagccccucuccggcaccgacguccaggagaagaccuucggcgagucccaggaccucccccucaaguccgaccucggcacccgcgaggacuccuccgucgccuccuccgaccgcuccuccgucgagcgcgaggucgccgagcaccucgccaagggcuucugguccgacaucugcuccaccgacacccccugccagaugcagcucucccccgccgucgccaaggacggcuccgagcagaucucccagaagcgcuccgagugccccuggcucggcauccgcaucuccgagucccccgagcccggccagcgcaccuucaccacccucuccuccgucaacugccccuucaucuccacccucuccaccgagggcugcuccuccaaccucgagaucggcaacgacgacuacgucuccgagccccagcaggagcccugccccuacgccugcgucaucucccucggcgacgacuccgagaccgacaccgagggcgacuccgaguccugcuccgcccgcgagcaggagugcgaggucaagcuccccuucaacgcccagcgcaucaucucccucucccgcaacgacuuccagucccuccucaagaugcacaagcucacccccgagcagcucgacugcauccacgacauccgccgccgcuccaagaaccgcaucgccgcccagcgcugccgcaagcgcaagcucgacugcauccagaaccucgaguccgagaucgagaagcuccaguccgagaaggagucccuccucaaggagcgcgaccacauccucuccacccucggcgagaccaagcagaaccucaccggccucugccagaaggucugcaaggaggccgcccucucccaggagcagauccagauccucgccaaguacuccgccgccgacugcccccucuccuuccucaucuccgagaaggacaaguccacccccgacggcgagcucgcccuccccuccaucuucucccucuccgaccgcccccccgccguccucccccccugcgcccgcggcaacuccgagcccggcuacgcccgcggccaggagucccagcagauguccaccgccaccuccgagcaggccggccccgccgagcagugccgccaguccggcggcaucuccgacuucugccagcagaugaccgacaagugcaccaccgacgaguga

SEQ ID NO: 40211 - RNA, 2634 nt, Artificial Sequence
  derived and/or modified sequence opt2 from BACH2__Homo_sapiens__XP_005248815
augucccgccacaccggcaagcgccgcaagacccaggucgaggagaccucccagaucucccgcaacuggaacgucuucaaguccuggcagucccagggcgucaacggcauguccgucgacgagaagcccgacucccccauguacgucuacgaguccaccguccacugcaccaacauccuccucggccucaacgaccagcgcaagaaggacauccucugcgacgucacccucaucgucgagcgcaaggaguuccgcgcccaccgcgccguccucgccgccugcuccgaguacuucuggcaggcccucgucggccagaccaagaacgaccucgucgucucccuccccgaggaggucaccgcccgcggcuucggcccccuccuccaguucgccuacaccgccaagcuccuccucucccgcgagaacauccgcgaggucauccgcugcgccgaguuccuccgcaugcacaaccucgaggacuccugcuucuccuuccuccagacccagcuccucaacuccgaggacggccucuucgucugccgcaaggacgccgccugccagcgcccccacgaggacugcgagaacuccgccggcgaggaggaggacgaggaggaggagaccauggacuccgagaccgccaagauggccugcccccgcgaccagaugcuccccgagcccaucuccuucgaggccgccgccauccccgucgccgagaaggaggaggcccuccuccccgagcccgacguccccaccgacaccaaggaguccuccgagaaggacgcccucacccaguacccccgcuacaagaaguaccagcucgccugcaccaagaacgucuacaacgccuccucccacuccaccuccggcuucgccuccaccuuccgcgaggacaacuccuccaacucccucaagcccggccucgcccgcggccagaucaaguccgagccccccuccgaggagaacgaggaggaguccaucacccucugccucuccggcgacgagcccgacgccaaggaccgcgccggcgacgucgagauggaccgcaagcagcccucccccgcccccacccccaccgcccccgccggcgccgccugccucgagcgcucccgcuccgucgccucccccuccugccuccgcucccucuucuccaucaccaaguccgucgagcucuccggccuccccuccaccucccagcagcacuucgcccgcucccccgccugccccuucgacaagggcaucacccagggcgaccucaagaccgacuacacccccuucaccggcaacuacggccagccccacgucggccagaaggaggucuccaacuucaccaugggcuccccccuccgcggccccggccucgaggcccucugcaagcaggagggcgagcucgaccgccgcuccgucaucuucuccuccuccgccugcgaccaggucuccaccuccguccacuccuacuccggcgucuccucccucgacaaggaccucuccgagcccguccccaagggccucugggucggcgccggccagucccuccccuccucccaggccuacucccacggcggccucauggccgaccaccuccccggccgcaugcgccccaacaccuccugccccguccccaucaaggucugcccccgcucccccccccucgagacccgcacccgcaccuccuccuccugcuccuccuacuccuacgccgaggacggcuccggcggcucccccugcucccucccccucugcgaguucuccuccucccccugcucccagggcgcccgcuuccucgccaccgagcaccaggagcccggccucaugggcgacggcauguacaaccagguccgcccccagaucaagugcgagcaguccuacggcaccaacuccuccgacgaguccggcuccuucuccgaggccgacuccgaguccugccccguccaggaccgcggccaggaggucaagcuccccuuccccgucgaccagaucaccgaccucccccgcaacgacuuccagaugaugaucaagaugcacaagcucaccuccgagcagcucgaguucauccacgacguccgccgccgcuccaagaaccgcaucgccgcccagcgcugccgcaagcgcaagcucgacugcauccagaaccucgagugcgagauccgcaagcucgucugcgagaaggagaagcuccucuccgagcgcaaccagcucaaggccugcaugggcgagcuccucgacaacuucuccugccucucccaggaggucugccgcgacauccagucccccgagcagauccaggcccuccaccgcuacugccccguccuccgccccauggaccuccccaccgccuccuccaucaaccccgccccccucggcgccgagcagaacaucgccgccucccagugcgccgucggcgagaacguccccugcugccucgagcccggcgccgccccccccggcccccccugggcccccuccaacaccuccgagaacugcaccuccggccgccgccucgagggcaccgaccccggcaccuucuccgagcgcggccccccccucgagccccgcucccagaccgucaccgucgacuucugccaggagaugaccgacaagugcaccaccgacgagcagccccgcaaggacuacaccuga

SEQ ID NO: 40212 - RNA, 507 nt, Artificial Sequence
  derived and/or modified sequence opt2 from BAD__Homo_sapiens__NP_004313
auguuccagauccccgaguucgagcccuccgagcaggaggacuccuccuccgccgagcgcggccucggccccucccccgccggcgacggccccuccggcuccggcaagcaccaccgccaggcccccggccuccucugggacgccucccaccagcaggagcagcccaccuccuccucccaccacggcggcgccggcgccgucgagauccgcucccgccacuccuccuaccccgccggcaccgaggacgacgagggcaugggcgaggagcccucccccuuccgcggccgcucccgcuccgccccccccaaccucugggccgcccagcgcuacggccgcgagcuccgccgcauguccgacgaguucgucgacuccuucaagaagggccucccccgccccaaguccgccggcaccgccacccagaugcgccaguccuccuccuggacccgcgucuuccaguccuggugggaccgcaaccucggccgcggcuccuccgcccccucccaguga

SEQ ID NO: 40213 - RNA, 693 nt, Artificial Sequence
  derived and/or modified sequence opt2 from BAG1__Homo_sapiens__NP_001165886
augaaccgcucccaggaggucacccgcgacgaggaguccacccgcuccgaggaggucacccgcgaggagauggccgccgccggccucaccgucaccgucacccacuccaacgagaagcacgaccuccacgucaccucccagcagggcuccuccgagcccgucguccaggaccucgcccaggucgucgaggaggucaucggcgucccccaguccuuccagaagcucaucuucaagggcaagucccucaaggagauggagaccccccucuccgcccucggcauccaggacggcugccgcgucaugcucaucggcaagaagaacuccccccaggaggaggucgagcucaagaagcucaagcaccucgagaaguccgucgagaagaucgccgaccagcucgaggagcucaacaaggagcucaccggcauccagcagggcuuccuccccaaggaccuccaggccgaggcccucugcaagcucgaccgccgcgucaaggccaccaucgagcaguucaugaagauccucgaggagaucgacacccucauccuccccgagaacuucaaggacucccgccucaagcgcaagggccucgucaagaagguccaggccuuccucgccgagugcgacaccgucgagcagaacaucugccaggagaccgagcgccuccaguccaccaacuucgcccucgccgaguga

SEQ ID NO: 40214 - RNA, 1728 nt, Artificial Sequence
  derived and/or modified sequence opt2 from BAG3__Homo_sapiens__NP_004272
auguccgccgccacccacucccccaugaugcaggucgccuccggcaacggcgaccgcgacccccucccccccggcugggagaucaagaucgacccccagaccggcuggcccuucuucgucgaccacaacucccgcaccaccaccuggaacgacccccgcguccccuccgagggccccaaggagacccccuccuccgccaacggccccucccgcgagggcucccgccucccccccgcccgcgagggccaccccgucuacccccagcuccgccccggcuacauccccauccccguccuccacgagggcgccgagaaccgccagguccaccccuuccacgucuacccccagcccggcaugcagcgcuuccgcaccgaggccgccgccgccgccccccagcgcucccaguccccccuccgcggcaugcccgagaccacccagcccgacaagcagugcggccaggucgccgccgccgccgccgcccagccccccgccucccacggccccgagcgcucccagucccccgccgccuccgacugcuccuccuccuccuccuccgccucccuccccuccuccggccgcuccucccucggcucccaccagcucccccgcggcuacaucuccauccccgucauccacgagcagaacgucacccgccccgccgcccagcccuccuuccaccaggcccagaagacccacuaccccgcccagcagggcgaguaccagacccaccagcccgucuaccacaagauccagggcgacgacugggagccccgcccccuccgcgccgccucccccuuccgcuccuccguccagggcgccuccucccgcgagggcucccccgcccgcuccuccaccccccuccacucccccucccccauccgcguccacaccgucgucgaccgcccccagcagcccaugacccaccgcgagaccgcccccgucucccagcccgagaacaagcccgaguccaagcccggccccgucggccccgagcucccccccggccacauccccauccaggucauccgcaaggaggucgacuccaagcccgucucccagaagccccccccccccuccgagaaggucgaggucaaggucccccccgcccccguccccugccccccccccucccccggccccuccgccguccccuccucccccaaguccgucgccaccgaggagcgcgccgcccccuccaccgcccccgccgaggccaccccccccaagcccggcgaggccgaggccccccccaagcaccccggcguccucaaggucgaggccauccucgagaagguccagggccucgagcaggccgucgacaacuucgagggcaagaagaccgacaagaaguaccucaugaucgaggaguaccucaccaaggagcuccucgcccucgacuccgucgaccccgagggccgcgccgacguccgccaggcccgccgcgacggcguccgcaagguccagaccauccucgagaagcucgagcagaaggccaucgacguccccggccagguccaggucuacgagcuccagcccuccaaccucgaggccgaccagccccuccaggccaucauggagaugggcgccgucgccgccgacaagggcaagaagaacgccggcaacgccgaggacccccacaccgagacccagcagcccgaggccaccgccgccgccaccuccaaccccuccuccaugaccgacacccccggcaaccccgccgcccccuga

SEQ ID NO: 40215 - RNA, 1266 nt, Artificial Sequence
  derived and/or modified sequence opt2 from BAG4__Homo_sapiens__NP_001191807
auguccgcccuccgccgcuccggcuacggccccuccgacggccccuccuacggccgcuacuacggccccggcggcggcgacguccccguccaccccccccccccccucuacccccuccgccccgagcccccccagccccccaucuccuggcgcguccgcggcggcggccccgccgagaccaccuggcucggcgagggcggcggcggcgacggcuacuaccccuccggcggcgccuggcccgagcccggccgcgccggcggcucccaccagucccucaacuccuacaccaacggcgccuacggccccaccuacccccccggccccggcgccaacaccgccuccuacuccggcgccuacuacgcccccggcuacacccagaccuccuacuccaccgagguccccuccaccuaccgcuccuccggcaacucccccacccccgucucccgcuggaucuacccccagcaggacugccagaccgaggcccccccccuccgcggccagguccccggcuacccccccucccagaaccccggcaugacccucccccacuaccccuacggcgacggcaaccgcuccgucccccaguccggccccaccguccgcccccaggaggacgccugggccucccccggcgccuacggcaugggcggccgcuaccccuggcccuccuccgcccccuccgccccccccggcaaccucuacaugaccgaguccaccucccccuggcccuccuccggcuccccccaguccccccccuccccccccguccagcagcccaaggacuccuccuaccccuacucccaguccgaccaguccaugaaccgccacaacuuccccugcuccguccaccaguacgaguccuccggcaccgucaacaacgacgacuccgaccuccucgacucccagguccaguacuccgccgagccccagcucuacggcaacgccaccuccgaccaccccaacaaccaggaccaguccuccucccuccccgaggagugcguccccuccgacgaguccaccccccccuccaucaagaagaucauccacguccucgagaagguccaguaccucgagcaggaggucgaggaguucgucggcaagaagaccgacaaggccuacuggcuccucgaggagaugcucaccaaggagcuccucgagcucgacuccgucgagaccggcggccaggacuccguccgccaggcccgcaaggaggccgucugcaagauccaggccauccucgagaagcucgagaagaagggccucuga

SEQ ID NO: 40216 - RNA, 1467 nt, Artificial Sequence
  derived and/or modified sequence opt2 from BAG5__Homo_sapiens__NP_001015049
augcgcuuccacuggcuccccacccucuccgagcccuucgaccgcaaccaggagcucgagaccugcauccgcccccucuggacccccuccggcuccgccugcgagaccgagcacaacaaguccauggacaugggcaaccagcaccccuccaucucccgccuccaggagauccagaaggaggucaaguccgucgagcagcaggucaucggcuucuccggccucuccgacgacaagaacuacaagaagcucgagcgcauccucaccaagcagcucuucgagaucgacuccgucgacaccgagggcaagggcgacauccagcaggcccgcaagcgcgccgcccaggagaccgagcgccuccucaaggagcucgagcagaacgccaaccacccccaccgcaucgagauccagaacaucuucgaggaggcccagucccucguccgcgagaagaucguccccuucuacaacggcggcaacugcgucaccgacgaguucgaggagggcauccaggacaucauccuccgccucacccacgucaagaccggcggcaagaucucccuccgcaaggcccgcuaccacacccucaccaagaucugcgccguccaggagaucaucgaggacugcaugaagaagcagcccucccucccccucuccgaggacgcccaccccuccgucgccaagaucaacuucgucaugugcgaggucaacaaggcccgcggcguccucaucgcccuccucaugggcgucaacaacaacgagaccugccgccaccucuccugcguccucuccggccucaucgccgaccucgacgcccucgacgucugcggccgcaccgagauccgcaacuaccgccgcgaggucgucgaggacaucaacaagcuccucaaguaccucgaccucgaggaggaggccgacaccaccaaggccuucgaccuccgccagaaccacuccauccucaagaucgagaagguccucaagcgcaugcgcgagaucaagaacgagcuccuccaggcccagaaccccuccgagcucuaccucuccuccaagaccgagcuccagggccucaucggccagcucgacgaggucucccucgagaagaaccccugcauccgcgaggcccgccgccgcgccgucaucgagguccagacccucaucaccuacaucgaccucaaggaggcccucgagaagcgcaagcucuucgccugcgaggagcaccccucccacaaggccgucuggaacguccucggcaaccucuccgagauccagggcgagguccucuccuucgacggcaaccgcaccgacaagaacuacauccgccucgaggagcuccucaccaagcagcuccucgcccucgacgccgucgacccccagggcgaggagaagugcaaggccgcccgcaagcaggccguccgccucgcccagaacauccucuccuaccucgaccucaaguccgacgagugggaguacuga

SEQ ID NO: 40217 - RNA, 2712 nt, Artificial Sequence
  derived and/or modified sequence opt2 from BAG6__Homo_sapiens__NP_001186626
auggagcccaacgacuccaccuccaccgccgucgaggagcccgacucccucgagguccucgucaagacccucgacucccagacccgcaccuucaucgucggcgcccagaugaacgucaaggaguucaaggagcacaucgccgccuccgucuccauccccuccgagaagcagcgccucaucuaccagggccgcguccuccaggacgacaagaagcuccaggaguacaacgucggcggcaaggucauccaccucgucgagcgcgcccccccccagacccaccuccccuccggcgccuccuccggcaccggcuccgccuccgccacccacggcggcggcuccccccccggcacccgcggccccggcgccuccguccacgaccgcaacgccaacuccuacgucauggucggcaccuucaaccuccccuccgacggcuccgccgucgacguccacaucaacauggagcaggcccccauccaguccgagccccgcguccgccucgucauggcccagcacaugauccgcgacauccagacccuccucucccgcauggagugccgcggcggcccccagccccagcacucccagccccccccccagccccccgccgucacccccgagcccgucgcccucuccucccagaccuccgagcccgucgaguccgaggcccccccccgcgagcccauggaggccgaggaggucgaggagcgcgcccccgcccagaaccccgagcucacccccggccccgcccccgccggccccacccccgcccccgagaccaacgcccccaaccaccccucccccgccgaguacgucgagguccuccaggagcuccagcgccucgagucccgccuccagcccuuccuccagcgcuacuacgagguccucggcgccgccgccaccaccgacuacaacaacaaccacgagggccgcgaggaggaccagcgccucaucaaccucgucggcgagucccuccgccuccucggcaacaccuucgucgcccucuccgaccuccgcugcaaccucgccugcacccccccccgccaccuccacgucguccgccccaugucccacuacaccacccccaugguccuccagcaggccgccauccccauccagaucaacgucggcaccaccgucaccaugaccggcaacggcacccgccccccccccacccccaacgccgaggcccccccccccggccccggccaggccuccuccgucgcccccuccuccaccaacgucgaguccuccgccgagggcgcccccccccccggccccgcccccccccccgccaccucccacccccgcgucauccgcaucucccaccaguccgucgagcccgucgucaugaugcacaugaacauccaggacuccggcacccagcccggcggcguccccuccgcccccaccggcccccucggcccccccggccacggccagacccucggccagcagguccccggcuuccccaccgcccccacccgcgucgucaucgcccgccccacccccccccaggcccgccccucccaccccggcggcccccccgucuccggcacccucggcgccggccucggcaccaacgccucccucgcccagauggucuccggccucgucggccagcuccucaugcagcccguccucgucgcccagggcacccccggcucccccggcggccucggccucgagucccucucccccgaguucuucaccuccgucguccagggcguccucuccucccuccucggcucccucggcgcccgcgccggcuccuccgaguccaucgccgccuucauccagcgccucuccggcuccuccaacaucuucgagcccggcgccgacggcgcccucggcuucuucggcgcccuccucucccuccucugccagaacuucuccauggucgacgucgucaugcuccuccacggccacuuccagccccuccagcgccuccagccccagcuccgcuccuucuuccaccagcacuaccucggcggccaggagcccacccccuccaacauccgcauggccacccacacccucaucaccggccucgaggaguacguccgcgaguccuucucccucguccagguccagcccggcgucgacaucauccgcaccaaccucgaguuccuccaggagcaguucaacuccaucgccgcccacguccuccacugcaccgacuccggcuucggcgcccgccuccucgagcucugcaaccagggccucuucgagugccucgcccucaaccuccacugccucggcggccagcagauggagcucgccgccgucaucaacggccgcauccgccgcaugucccgcggcgucaaccccucccucgucuccuggcucaccaccaugaugggccuccgccuccaggucguccucgagcacaugcccgucggccccgacgccauccuccgcuacguccgccgcgucggcgaccccccccagccccuccccgaggagcccauggagguccagggcgccgagcgcgccucccccgagccccaggaguggguccccaucauccagcaggacauccagucccagcgcaaggucaagccccagcccccccucuccgacgccuaccucuccggcaugcccgccaagcgccgcaagcuccgcuccgacauccagaagcgccuccaggaggaccccaacuacuccccccagcgcuuccccaacgcccagcgcgccuucgccgacgaccccuga

SEQ ID NO: 40218 - RNA, 1536 nt, Artificial Sequence
  derived and/or modified sequence opt2 from BAIAP2L1__Homo_sapiens__NP_061330
augucccgcggccccgaggaggucaaccgccucaccgaguccaccuaccgcaacgucauggagcaguucaaccccggccuccgcaaccucaucaaccucggcaagaacuacgagaaggccgucaacgccaugauccucgccggcaaggccuacuacgacggcgucgccaagaucggcgagaucgccaccggcucccccgucuccaccgagcucggccacguccucaucgagaucuccuccacccacaagaagcucaacgagucccucgacgagaacuucaagaaguuccacaaggagaucauccacgagcucgagaagaagaucgagcucgacgucaaguacaugaacgccacccucaagcgcuaccagaccgagcacaagaacaagcucgagucccucgagaagucccaggccgagcucaagaagauccgccgcaagucccagggcucccgcaacgcccucaaguacgagcacaaggagaucgaguacgucgagaccgucaccucccgccaguccgagauccagaaguucaucgccgacggcugcaaggaggcccuccucgaggagaagcgccgcuucugcuuccucgucgacaagcacugcggcuucgccaaccacauccacuacuaccaccuccaguccgccgagcuccucaacuccaagcucccccgcuggcaggagaccugcgucgacgccaucaagguccccgagaagaucaugaacaugaucgaggagaucaagacccccgccuccacccccgucuccggcaccccccaggccucccccaugaucgagcgcuccaacgucguccgcaaggacuacgacacccucuccaagugcucccccaagaugccccccgcccccuccggccgcgccuacaccuccccccucaucgacauguucaacaaccccgccaccgccgcccccaacucccagcgcgucaacaacuccaccggcaccuccgaggaccccucccuccagcgcuccgucuccgucgccaccggccucaacaugaugaagaagcagaaggucaagaccaucuucccccacaccgccggcuccaacaagacccuccucuccuucgcccagggcgacgucaucacccuccucauccccgaggagaaggacggcuggcucuacggcgagcacgacgucuccaaggcccgcggcugguuccccuccuccuacaccaagcuccucgaggagaacgagaccgaggccgucaccguccccacccccucccccacccccguccgcuccaucuccaccgucaaccucuccgagaacuccuccgucgucauccccccccccgacuaccucgagugccucuccaugggcgccgccgccgaccgccgcgccgacuccgcccgcaccaccuccaccuucaaggcccccgccuccaagcccgagaccgccgcccccaacgacgccaacggcaccgccaagccccccuuccucuccggcgagaaccccuucgccaccgucaagcuccgccccaccgucaccaacgaccgcuccgcccccaucauccgcuga

SEQ ID NO: 40219 - RNA, 3351 nt, Artificial Sequence
  derived and/or modified sequence opt2 from BAIAP3__Homo_sapiens__NP_001186025
auguccacccuccucgacaucaaguccuccguccuccgccagguccaggucugccccuccuuccgccgccgcaccgagcaggaccccggcuccgccuccgccgacccccaggagcccgccaccggcgccuggaagcccggcgacggcgucgaguucuucgcccacaugcgccucaugcucaagaagggcgagggccgccagggccuccccugccucgaggucccccuccgcuccggcucccccgccccccccgagcccgucgaccccucccucggccuccgcgcccucgcccccgaggaggucgagaugcucuacgaggaggcccucuacaccguccucuaccgcgccggcaccaugggccccgaccaggucgacgacgaggaggcccuccucuccuaccuccagcaggucuucggcaccucccucgaggagcacaccgaggccaucgagcgcguccgcaaggccaaggcccccaccuacgcccucaaggucuccgucaugcgcgccaagaaccuccucgccaaggaccccaacggcuucuccgaccccuacugcaugcucggcauccuccccgccuccgacgccacccgcgagccccgcgcccagaaggagcagcgcuucggcuuccgcaagggcuccaagcgcggcggcccccuccccgccaagugcauccaggucaccgaggucaaguccuccacccucaaccccgucuggaaggagcacuuccucuucgagaucgaggacgucuccaccgaccagcuccaccucgacaucugggaccacgacgacgacgucucccucgucgaggccugccgcaagcucaacgaggucaucggccucaagggcaugggccgcuacuucaagcagaucgucaaguccgcccgcgccaacggcaccgccggccccaccgaggaccacaccgacgacuuccucggcugccucaacauccccguccgccgcgacaccgccaugucccagcgcggccgcuccggcuuccucucccaccuccuccuccucucccaccuccuccgccucgagcacuccgccgaggagcccaacuccuccuccuggcgcggcgagcucuccacccccgccgccaccauccucugccuccacggcgcccaguccaaccucuccccccuccagcucgccguccuccacuggcaggucuccucccgccaccaccagaccugcacccucgacuacuccuaccuccucggccuccucgaggacaugcaggcccacugggaggaggcccccucccucccccaggagcaggaggagucccucgccgacucccucuccgccuucuccgaguucggccuccagcuccuccgccagcuccgcgacuacuuccccgccaccaacuccaccgccguccaccgccucgagcuccuccucaagugccucggcaagcuccagcucuuccagcccuccuucgagaucugccccuucgaguccgagcucaacauggacaucgccgccgcccucaagcgcggcaaccgcgagugguacgaccgcauccucaacgacaaguccccccgcgagcagcccggcccccagcgccuccccggccucgucguccucgccgacgccgucuacgacgaccuccaguucugcuacuccgucuacgccucccucuuccacuccauccucaacgucgacgucuucacccucaccuuccgccagcucgagcgccucgucgccgaggaggccuggguccucaccgaggagcucucccccaagaugacccucgaggucgccuccggccucuucgagcucuaccucacccucgccgaccuccagcgcuucugggacuccauccccggccgcgacucccgcucccucgcccucgccggcauccacgcccccuuccuccccgccgucaagcucugguuccagguccuccgcgaccaggccaaguggcgccuccagggcgccgucgacauggacacccucgagcccgucgacgccuccucccgccacuccuccuccgccgccaccgccggccucugccucucccacauccaggagcucuggguccgccucgccuggcccgaccccgcccaggcccagggccucggcacccagcucggccaggacgucugcgaggccacccucuucuacaccgagcuccuccgcaagaaggucgacacccagcccggcgccgccggcgaggccgucuccgaggcccucugcgucguccucaacaacgucgagcucguccgcaaggccgccggccaggcccucaagggccucgccuggcccgagggcgccaccggccccgagggcguccucccccgcccccuccucuccugcacccaggcccucgacgacgaccuccagcgcgaggcccacaccgucaccgcccaccucaccuccaagauggucggcgacauccgcaaguacguccagcacaucucccucucccccgacuccauccagaacgacgaggccgucgccccccucaugaaguaccucgacgagaagcucgcccuccucaacgccucccucgucaagggcaaccucucccgcguccucgaggcccucugggagcuccuccuccaggccauccuccaggcccucggcgccaaccgcgacgucuccgccgacuucuacucccgcuuccacuucacccucgaggcccucgucuccuucuuccacgccgagggccagggccucccccucgagucccuccgcgacggcuccuacaagcgccucaaggaggagcuccgccuccacaagugcuccacccgcgagugcaucgagcaguucuaccucgacaagcucaagcagcgcacccucgagcagaaccgcuucggccgccucuccguccgcugccacuacgaggccgccgagcagcgccucgccgucgagguccuccacgccgccgaccuccucccccucgacgccaacggccucuccgaccccuucgucaucgucgagcucggccccccccaccucuucccccucguccgcucccagcgcacccaggucaagacccgcacccuccaccccgucuacgacgagcucuucuacuucuccguccccgccgaggccugccgccgccgcgccgccugcguccucuucaccgucauggaccacgacuggcucuccaccaacgacuucgccggcgaggccgcccucggccucggcggcgucaccggcgucgcccgcccccaggucggcggcggcgcccgcgccggccagcccgucacccuccaccucugccgcccccgcgcccagguccgcuccgcccuccgccgccucgagggccgcaccuccaaggaggcccaggaguucgucaagaagcucaaggagcucgagaagugcauggaggccgaccccuga

SEQ ID NO: 40220 - RNA, 636 nt, Artificial Sequence
  derived and/or modified sequence opt2 from BAK1__Homo_sapiens__NP_001179
auggccuccggccagggccccggccccccccgccaggagugcggcgagcccgcccuccccuccgccuccgaggagcaggucgcccaggacaccgaggaggucuuccgcuccuacgucuucuaccgccaccagcaggagcaggaggccgagggcgucgccgcccccgccgaccccgagauggucacccucccccuccagcccuccuccaccaugggccaggucggccgccagcucgccaucaucggcgacgacaucaaccgccgcuacgacuccgaguuccagaccaugcuccagcaccuccagcccaccgccgagaacgccuacgaguacuucaccaagaucgccaccucccucuucgaguccggcaucaacuggggccgcgucgucgcccuccucggcuucggcuaccgccucgcccuccacgucuaccagcacggccucaccggcuuccucggccaggucacccgcuucgucgucgacuucaugcuccaccacugcaucgcccgcuggaucgcccagcgcggcggcugggucgccgcccucaaccucggcaacggccccauccucaacguccucgucguccucggcgucguccuccucggccaguucgucguccgccgcuucuucaaguccuga

SEQ ID NO: 40221 - RNA, 783 nt, Artificial Sequence
  derived and/or modified sequence opt2 from BAMBI__Homo_sapiens__NP_036474
auggaccgccacuccuccuacaucuucaucuggcuccagcucgagcucugcgccauggccguccuccucaccaagggcgagauccgcugcuacugcgacgccgcccacugcgucgccaccggcuacaugugcaaguccgagcucuccgccugcuucucccgccuccucgacccccagaacuccaacuccccccucacccacggcugccucgacucccucgccuccaccaccgacaucugccaggccaagcaggcccgcaaccacuccggcaccaccauccccacccucgagugcugccacgaggacaugugcaacuaccgcggccuccacgacguccucucccccccccgcggcgaggccuccggccagggcaaccgcuaccagcacgacggcucccgcaaccucaucaccaagguccaggagcucaccuccuccaaggagcucugguuccgcgccgccgucaucgccguccccaucgccggcggccucauccucguccuccucaucaugcucgcccuccgcaugcuccgcuccgagaacaagcgccuccaggaccagcgccagcagaugcucucccgccuccacuacuccuuccacggccaccacuccaagaagggccaggucgccaagcucgaccucgagugcaugguccccgucuccggccacgagaacugcugccucaccugcgacaagaugcgccaggccgaccucuccaacgacaagauccucucccucguccacuggggcauguacuccggccacggcaagcucgaguucgucuga

SEQ ID NO: 40222 - RNA, 270 nt, Artificial Sequence
  derived and/or modified sequence opt2 from BANF1__Homo_sapiens__NP_001137457
augaccaccucccagaagcaccgcgacuucgucgccgagcccaugggcgagaagcccgucggcucccucgccggcaucggcgagguccucggcaagaagcucgaggagcgcggcuucgacaaggccuacgucguccucggccaguuccucguccucaagaaggacgaggaccucuuccgcgaguggcucaaggacaccugcggcgccaacgccaagcagucccgcgacugcuucggcugccuccgcgaguggugcgacgccuuccucuga

SEQ ID NO: 40223 - RNA, 2268 nt, Artificial Sequence
  derived and/or modified sequence opt2 from BANK1__Homo_sapiens__NP_001077376
augaucuacgaggaggacgccgaggagugggcccucuaccucaccgaggucuuccuccacgucgucaagcgcgaggccauccuccucuaccgccucgagaacuucuccuuccgccaccucgagcuccucaaccucaccuccuacaagugcaagcuccucauccucuccaacucccuccuccgcgaccucacccccaagaagugccaguuccucgagaagauccuccacucccccaaguccgucgucacccuccucugcggcgucaaguccuccgaccagcucuacgagcuccucaacaucucccagucccgcugggagaucuccaccgagcaggagcccgaggacuacaucuccgucauccaguccaucaucuucaaggacuccgaggacuacuucgaggucaacauccccaccgaccuccgcgccaagcacuccggcgagaucuccgagcgcaaggagaucgaggagcucuccgaggccucccgcaacaccaucccccucgccgucguccuccccaccgagauccccugcgagaaccccggcgagaucuucaucauccuccgcgacgaggucaucggcgacaccgucgaggucgaguucaccuccuccaacaagcgcauccgcacccgccccgcccucuggaacaagaaggucuggugcaugaaggcccucgaguuccccgccggcuccguccacgucaacgucuacugcgacggcaucgucaaggccaccaccaagaucaaguacuaccccaccgccaaggccaaggagugccucuuccgcauggccgacuccggcgagucccucugccagaacuccaucgaggagcucgacggcguccucaccuccaucuucaagcacgagauccccuacuacgaguuccagucccuccagaccgagaucugcucccagaacaaguacacccacuucaaggagcuccccacccuccuccacugcgccgccaaguucggccucaagaaccucgccauccaccuccuccagugcuccggcgccaccugggccuccaagaugaagaacauggagggcuccgaccccgcccacaucgccgagcgccacggccacaaggagcucaagaagaucuucgaggacuucuccauccaggagaucgacaucaacaacgagcaggagaacgacuacgaggaggacaucgccuccuucuccaccuacauccccuccacccagaaccccgccuuccaccacgagucccgcaagaccuacggccaguccgccgacggcgccgaggccaacgagauggagggcgagggcaagcagaacggcuccggcauggagaccaagcacuccccccucgaggucggcuccgaguccuccgaggaccaguacgacgaccucuacgucuucauccccggcgccgaccccgagaacaacucccaggagccccucauguccucccgccccccccucccccccccccgccccgucgccaacgccuuccagcucgagcgcccccacuucacccuccccggcaccauggucgagggccagauggagcgcucccagaacuggggccaccccggcguccgccaggagaccggcgacgagcccaagggcgagaaggagaagaaggaggaggagaaggagcaggaggaggaggaggaccccuacaccuucgccgagaucgacgacuccgaguacgacaugauccucgccaaccucuccaucaagaagaagaccggcucccgcuccuucaucaucaaccgcccccccgcccccaccccccgccccaccuccaucccccccaaggaggagaccacccccuacaucgcccaggucuuccagcagaagaccgcccgccgccaguccgacgacgacaaguuccgcggccuccccaagaagcaggaccgcgcccgcaucgagucccccgccuucuccacccuccgcggcugccucaccgacggccaggaggagcucauccuccuccaggagaaggucaagaacggcaagauguccauggacgaggcccucgagaaguucaagcacuggcagaugggcaaguccggccucgagaugauccagcaggagaagcuccgccagcuccgcgacugcaucaucggcaagcgccccgaggaggagaacgucuacaacaagcucaccaucguccaccaccccggcggcaaggagaccgcccacaacgagaacaaguucuacaacguccacuucuccaacaagcuccccgcccgcccccaggucgagaaggaguucggcuucugcugcaagaaggaccacuga

SEQ ID NO: 40224 - RNA, 1518 nt, Artificial Sequence
  derived and/or modified sequence opt2 from BANP__Homo_sapiens__NP_001167010
augauguccgagcacgaccucgccgacgucguccagaucgccgucgaggaccucucccccgaccaccccgucguccucgagaaccacgucgucaccgacgaggacgagcccgcccucaagcgccagcgccucgagaucaacugccaggaccccuccaucaaguccuuccucuacuccaucaaccagaccaucugccuccgccucgacuccaucgaggccaagcuccaggcccucgaggccaccugcaagucccucgaggagaagcucgaccucgucaccaacaagcagcacucccccauccagguccccauggucgccggcuccccccucggcgccacccagaccugcaacaagguccgcugcgucgucccccagaccaccgucauccucaacaacgaccgccagaacgccaucgucgccaagauggaggacccccucuccaaccgcgcccccgacucccucgagaacgucaucuccaacgccguccccggccgccgccagaacaccaucgucgucaagguccccggccaggaggacucccaccacgaggacggcgaguccggcuccgaggccuccgacuccgucuccuccugcggccaggccggcucccaguccaucggcuccaacgucacccucaucacccucaacuccgaggaggacuaccccaacggcaccuggcucggcgacgagaacaaccccgagaugcgcguccgcugcgccaucauccccuccgacaugcuccacaucuccaccaacugccgcaccgccgagaagauggcccucacccuccucgacuaccucuuccaccgcgagguccaggccgucuccaaccucuccggccagggcaagcacggcaagaagcagcucgacccccucaccaucuacggcauccgcugccaccucuucuacaaguucggcaucaccgaguccgacugguaccgcaucaagcaguccaucgacuccaagugccgcaccgccuggcgccgcaagcagcgcggccagucccucgccgucaaguccuucucccgccgcacccccaacuccuccuccuacugccccuccgagcccaugauguccacccccccccccgccuccgagcucccccagccccagccccagccccaggcccuccacuacgcccucgccaacgcccagcagguccagauccaccagaucggcgaggacggccagguccaggucggccaccuccacaucgcccaggucccccagggcgagcagguccagaucacccaggacuccgagggcaaccuccagauccaccacgucggccaggacggccagguccuccagggcgcccagcucaucgccgucgccuccuccgaccccgccgccgccggcgucgacggcuccccccuccagggcuccgacauccagguccaguacguccagcucgcccccgucuccgaccacaccgccggcgcccagaccgccgaggcccuccagcccacccuccagcccgagaugcagcucgagcacggcgccauccagauccaguga

SEQ ID NO: 40225 - RNA, 2190 nt, Artificial Sequence
  derived and/or modified sequence opt2 from BAP1__Homo_sapiens__NP_004647
augaacaagggcuggcucgagcucgaguccgaccccggccucuucacccuccucgucgaggacuucggcgucaagggcguccaggucgaggagaucuacgaccuccaguccaagugccagggccccgucuacggcuucaucuuccucuucaaguggaucgaggagcgccgcucccgccgcaaggucuccacccucgucgacgacaccuccgucaucgacgacgacaucgucaacaacauguucuucgcccaccagcucauccccaacuccugcgccacccacgcccuccucuccguccuccucaacugcuccuccgucgaccucggccccacccucucccgcaugaaggacuucaccaagggcuucucccccgaguccaagggcuacgccaucggcaacgcccccgagcucgccaaggcccacaacucccacgcccgccccgagccccgccaccuccccgagaagcagaacggccucuccgccguccgcaccauggaggccuuccacuucgucuccuacguccccaucaccggccgccucuucgagcucgacggccucaaggucuaccccaucgaccacggccccuggggcgaggacgaggaguggaccgacaaggcccgccgcgucaucauggagcgcaucggccucgccaccgccggcgagcccuaccacgacauccgcuucaaccucauggccgucguccccgaccgccgcaucaaguacgaggcccgccuccacguccucaaggucaaccgccagaccguccucgaggcccuccagcagcucauccgcgucacccagcccgagcucauccagacccacaagucccaggagucccagcuccccgaggaguccaaguccgccuccaacaaguccccccucguccucgaggccaaccgcgcccccgccgccuccgagggcaaccacaccgacggcgccgaggaggccgccggcuccugcgcccaggcccccucccacuccccccccaacaagcccaagcucgucgucaagccccccggcuccucccucaacggcguccaccccaaccccacccccaucguccagcgccuccccgccuuccucgacaaccacaacuacgccaagucccccaugcaggaggaggaggaccucgccgccggcgucggccgcucccgcguccccguccgccccccccagcaguacuccgacgacgaggacgacuacgaggacgacgaggaggacgacguccagaacaccaacuccgcccuccgcuacaagggcaagggcaccggcaagcccggcgcccucuccggcuccgccgacggccagcucuccguccuccagcccaacaccaucaacguccucgccgagaagcucaaggagucccagaaggaccucuccaucccccucuccaucaagaccuccuccggcgccggcucccccgccgucgccguccccacccacucccagcccucccccacccccuccaacgaguccaccgacaccgccuccgagaucggcuccgccuucaacuccccccuccgcucccccauccgcuccgccaaccccacccgccccuccucccccgucaccucccacaucuccaagguccucuucggcgaggacgacucccuccuccgcgucgacugcauccgcuacaaccgcgccguccgcgaccucggccccgucaucuccaccggccuccuccaccucgccgaggacggcguccucuccccccucgcccucaccgagggcggcaagggcuccucccccuccauccgccccauccagggcucccagggcuccuccucccccgucgagaaggaggucgucgaggccaccgacucccgcgagaagaccggcaugguccgccccggcgagccccucuccggcgagaaguacucccccaaggagcuccucgcccuccucaagugcgucgaggccgagaucgccaacuacgaggccugccucaaggaggaggucgagaagcgcaagaaguucaagaucgacgaccagcgccgcacccacaacuacgacgaguucaucugcaccuucaucuccaugcucgcccaggagggcaugcucgccaaccucgucgagcagaacaucuccguccgccgccgccagggcgucuccaucggccgccuccacaagcagcgcaagcccgaccgccgcaagcgcucccgccccuacaaggccaagcgccaguga

SEQ ID NO: 40226 - RNA, 2334 nt, Artificial Sequence
  derived and/or modified sequence opt2 from BARD1__Homo_sapiens__NP_000456
augcccgacaaccgccagccccgcaaccgccagccccgcauccgcuccggcaacgagccccgcuccgcccccgccauggagcccgacggccgcggcgccugggcccacucccgcgccgcccucgaccgccucgagaagcuccuccgcugcucccgcugcaccaacauccuccgcgagcccgucugccucggcggcugcgagcacaucuucugcuccaacugcgucuccgacugcaucggcaccggcugccccgucugcuacacccccgccuggauccaggaccucaagaucaaccgccagcucgacuccaugauccagcucugcuccaagcuccgcaaccuccuccacgacaacgagcucuccgaccucaaggaggacaagccccgcaagucccucuucaacgacgccggcaacaagaagaacuccaucaagaugugguucuccccccgcuccaagaagguccgcuacgucgucuccaaggccuccguccagacccagcccgccaucaagaaggacgccuccgcccagcaggacuccuacgaguucgucucccccuccccccccgccgacgucuccgagcgcgccaagaaggccuccgcccgcuccggcaagaagcagaagaagaagacccucgccgagaucaaccagaaguggaaccucgaggccgagaaggaggacggcgaguucgacuccaaggaggaguccaagcagaagcucgucuccuucugcucccagcccuccgucaucuccuccccccagaucaacggcgagaucgaccuccucgccuccggcucccucaccgaguccgagugcuucggcucccucaccgaggucucccucccccucgccgagcagaucgagucccccgacaccaagucccgcaacgaggucgucacccccgagaaggucugcaagaacuaccucaccuccaagaagucccucccccucgagaacaacggcaagcgcggccaccacaaccgccucuccucccccaucuccaagcgcugccgcaccuccauccucuccaccuccggcgacuucgucaagcagaccguccccuccgagaacaucccccuccccgagugcuccuccccccccuccugcaagcgcaaggucggcggcaccuccggccgcaagaacuccaacauguccgacgaguucaucucccucucccccggcaccccccccuccacccucuccuccuccuccuaccgccgcgucauguccucccccuccgccaugaagcuccuccccaacauggccgucaagcgcaaccaccgcggcgagacccuccuccacaucgccuccaucaagggcgacauccccuccgucgaguaccuccuccagaacggcuccgaccccaacgucaaggaccacgccggcuggaccccccuccacgaggccugcaaccacggccaccucaaggucgucgagcuccuccuccagcacaaggcccucgucaacaccaccggcuaccagaacgacuccccccuccacgacgccgccaagaacggccacgucgacaucgucaagcuccuccucuccuacggcgccucccgcaacgccgucaacaucuucggccuccgccccgucgacuacaccgacgacgaguccaugaagucccuccuccuccuccccgagaagaacgaguccuccuccgccucccacugcuccgucaugaacaccggccagcgccgcgacggcccccucguccucaucggcuccggccucuccuccgagcagcagaagaugcucuccgagcucgccgucauccucaaggccaagaaguacaccgaguucgacuccaccgucacccacgucgucguccccggcgacgccguccaguccacccucaagugcaugcucggcauccucaacggcugcuggauccucaaguucgagugggucaaggccugccuccgccgcaaggucugcgagcaggaggagaaguacgagauccccgagggcccccgccgcucccgccucaaccgcgagcagcuccuccccaagcucuucgacggcugcuacuucuaccucuggggcaccuucaagcaccaccccaaggacaaccucaucaagcucgucaccgccggcggcggccagauccucucccgcaagcccaagcccgacuccgacgucacccagaccaucaacaccgucgccuaccacgcccgccccgacuccgaccagcgcuucugcacccaguacaucaucuacgaggaccucugcaacuaccaccccgagcgcguccgccagggcaaggucuggaaggcccccuccuccugguucaucgacugcgucauguccuucgagcuccucccccucgacuccuga

SEQ ID NO: 40227 - RNA, 984 nt, Artificial Sequence
  derived and/or modified sequence opt2 from BARHL1__Homo_sapiens__NP_064448
auggagggcuccaacggcuucggcaucgacuccauccucucccaccgcgccggcucccccgcccuccccaagggcgacccccuccucggcgacugccgcuccccccucgagcucuccccccgcuccgaguccuccuccgacugcuccucccccgccucccccggccgcgacugccucgagaccggcaccccccgccccggcggcgccuccggccccggccucgacucccaccuccagcccggccagcucuccgcccccgcccagucccgcaccgucaccuccuccuuccucauccgcgacauccucgccgacugcaagccccucgccgccugcgcccccuacuccuccuccggccagcccgccgcccccgagcccggcggccgccucgccgccaaggccgccgaggacuuccgcgacaagcucgacaaguccggcuccaacgccuccuccgacuccgaguacaaggucaaggaggagggcgaccgcgagaucuccuccucccgcgacuccccccccguccgccucaagaagccccgcaaggcccgcaccgccuucaccgaccaccagcucgcccagcucgagcgcuccuucgagcgccagaaguaccucuccguccaggaccgcauggagcucgccgccucccucaaccucaccgacacccaggucaagaccugguaccagaaccgccgcaccaaguggaagcgccagaccgccgucggccucgagcuccucgccgaggccggcaacuacuccgcccuccagcgcauguuccccucccccuacuucuacccccagucccucgucuccaaccucgaccccggcgccgcccucuaccucuaccgcggccccuccgcccccccccccgcccuccagcgcccccucgucccccgcauccucauccacggccuccagggcgccuccgagcccccccccccccuccccccccucgccggcguccucccccgcgccgcccagccccgcuga

SEQ ID NO: 40228 - RNA, 765 nt, Artificial Sequence
  derived and/or modified sequence opt2 from BARX1__Homo_sapiens__NP_067545
augcagcgccccggcgagcccggcgccgcccgcuucggcccccccgagggcugcgccgaccaccgcccccaccgcuaccgcuccuucaugaucgaggagauccucaccgagccccccggccccaagggcgccgcccccgccgccgccgccgccgccgccggcgagcuccucaaguucggcguccaggcccuccucgccgcccgccccuuccacucccaccucgccguccucaaggccgagcaggccgccgucuucaaguucccccucgccccccucggcugcuccggccucuccuccgcccuccucgccgccggccccggccuccccggcgccgccggcgccccccaccucccccucgagcuccagcuccgcggcaagcucgaggccgccggccccggcgagcccggcaccaaggccaagaagggccgccgcucccgcaccgucuucaccgagcuccagcucaugggccucgagaagcgcuucgagaagcagaaguaccucuccacccccgaccgcaucgaccucgccgagucccucggccucucccagcuccaggucaagaccugguaccagaaccgccgcaugaaguggaagaagaucguccuccagggcggcggccucgagucccccaccaagcccaagggccgccccaagaagaacuccauccccaccuccgagcagcucaccgagcaggagcgcgccaaggacgccgagaagcccgccgagguccccggcgagcccuccgaccgcucccgcgaggacuga

SEQ ID NO: 40229 - RNA, 840 nt, Artificial Sequence
  derived and/or modified sequence opt2 from BARX2__Homo_sapiens__NP_003649
augcacugccacgccgagcuccgccucuccucccccggccagcucaaggccgcccgccgccgcuacaagaccuucaugaucgacgagauccucuccaaggagaccugcgacuacuucgagaagcucucccucuacuccgucugccccucccucgucguccgccccaagccccuccacuccugcaccggcucccccucccuccgcgccuacccccuccucuccgucaucacccgccagcccaccgucaucucccaccucguccccgccacccccggcaucgcccaggcccucuccugccaccaggucaccgaggccgucuccgccgaggcccccggcggcgaggcccucgccuccuccgaguccgagaccgagcagcccaccccccgccagaagaagccccgccgcucccgcaccaucuucaccgagcuccagcucaugggccucgagaagaaguuccagaagcagaaguaccucuccacccccgaccgccucgaccucgcccagucccucggccucacccagcuccaggucaagaccugguaccagaaccgccgcaugaaguggaagaagaugguccucaagggcggccaggaggcccccaccaagcccaagggccgccccaagaagaacuccauccccaccuccgaggagaucgaggccgaggagaagaugaacucccaggcccagggccaggagcagcucgagcccucccagggccaggaggagcucugcgaggcccaggagcccaaggcccgcgacgucccccucgagauggccgagccccccgaccccccccaggagcuccccauccccuccuccgagccccccccccucuccuga

SEQ ID NO: 40230 - RNA, 684 nt, Artificial Sequence
  derived and/or modified sequence opt2 from BASP1__Homo_sapiens__NP_006308
augggcggcaagcucuccaagaagaagaagggcuacaacgucaacgacgagaaggccaaggagaaggacaagaaggccgagggcgccgccaccgaggaggagggcacccccaaggaguccgagccccaggccgccgccgagcccgccgaggccaaggagggcaaggagaagcccgaccaggacgccgagggcaaggccgaggagaaggagggcgagaaggacgccgccgccgccaaggaggaggcccccaaggccgagcccgagaagaccgagggcgccgccgaggccaaggccgagccccccaaggcccccgagcaggagcaggccgcccccggccccgccgccggcggcgaggcccccaaggccgccgaggccgccgccgcccccgccgaguccgccgcccccgccgccggcgaggagcccuccaaggaggagggcgagcccaagaagaccgaggcccccgccgcccccgccgcccaggagaccaaguccgacggcgcccccgccuccgacuccaagcccggcuccuccgaggccgcccccuccuccaaggagacccccgccgccaccgaggcccccuccuccacccccaaggcccagggccccgccgccuccgccgaggagcccaagcccgucgaggcccccgccgccaacuccgaccagaccgucaccgucaaggaguga

SEQ ID NO: 40231 - RNA, 825 nt, Artificial Sequence
  derived and/or modified sequence opt2 from BATF2__Homo_sapiens__NP_612465
augcaccucugcggcggcaacggccuccucacccagaccgaccccaaggagcagcagcgccagcucaagaagcagaagaaccgcgccgccgcccagcgcucccgccagaagcacaccgacaaggccgacgcccuccaccagcagcacgagucccucgagaaggacaaccucgcccuccgcaaggagauccagucccuccaggccgagcucgccugguggucccgcacccuccacguccacgagcgccucugccccauggacugcgccuccugcuccgcccccggccuccucggcugcugggaccaggccgagggccuccucggccccggcccccagggccagcacggcugccgcgagcagcucgagcucuuccagacccccggcuccugcuaccccgcccagccccucucccccggcccccagccccacgacucccccucccuccuccagugcccccuccccucccucucccucggccccgccgucgucgccgagccccccguccagcucucccccuccccccuccucuucgccucccacaccggcuccucccuccagggcuccuccuccaagcucuccgcccuccagcccucccucaccgcccagaccgcccccccccagccccucgagcucgagcaccccacccgcggcaagcucggcuccucccccgacaaccccuccuccgcccucggccucgcccgccuccagucccgcgagcacaagcccgcccucuccgccgccaccuggcagggccucgucgucgaccccuccccccacccccuccucgccuucccccuccucuccuccgcccagguccacuucuga

SEQ ID NO: 40232 - RNA, 378 nt, Artificial Sequence
  derived and/or modified sequence opt2 from BATF__Homo_sapiens__NP_006390
augccccacuccuccgacuccuccgacuccuccuucucccgcucccccccccccggcaagcaggacuccuccgacgacguccgccgcguccagcgccgcgagaagaaccgcaucgccgcccagaagucccgccagcgccagacccagaaggccgacacccuccaccucgaguccgaggaccucgagaagcagaacgccgcccuccgcaaggagaucaagcagcucaccgaggagcucaaguacuucaccuccguccucaacucccacgagccccucugcuccguccucgccgccuccacccccuccccccccgaggucgucuacuccgcccacgccuuccaccagccccacgucuccuccccccgcuuccagcccuga

SEQ ID NO: 40233 - RNA, 666 nt, Artificial Sequence
  derived and/or modified sequence opt2 from BAX__Homo_sapiens__NP_001278357
auggacggcuccggcgagcagccccgcggcggcggccccaccuccuccgagcagaucaugaagaccggcgcccuccuccuccagggcuucauccaggaccgcgccggccgcaugggcggcgaggcccccgagcucgcccucgaccccgucccccaggacgccuccaccaagaagcucuccgagugccucaagcgcaucggcgacgagcucgacuccaacauggagcuccagcgcaugaucgccgccgucgacaccgacuccccccgcgaggucuucuuccgcgucgccgccgacauguucuccgacggcaacuucaacuggggccgcgucgucgcccucuucuacuucgccuccaagcucguccucaaggcccucugcaccaagguccccgagcucauccgcaccaucaugggcuggacccucgacuuccuccgcgagcgccuccucggcuggauccaggaccagggcggcuggggccucccccucgccgagucccucaagcgccucaugucccucucccccggccgccccccccuccuccucugggacgcccacgucgccgaccgcgaccaccucugcggcggcuccgcccaccgccucacccaccaccucgaggaggacggccuccgcccccccgccgcccucgacugcgucuucccccccuga

SEQ ID NO: 40234 - RNA, 4671 nt, Artificial Sequence
  derived and/or modified sequence opt2 from BAZ1A__Homo_sapiens__NP_038476
augccccuccuccaccgcaagcccuucguccgccagaagccccccgccgaccuccgccccgacgaggaggucuucuacugcaaggucaccaacgagaucuuccgccacuacgacgacuucuucgagcgcaccauccucugcaacucccucgucugguccugcgccgucaccggccgccccggccucaccuaccaggaggcccucgaguccgagaagaaggcccgccagaaccuccaguccuuccccgagccccucaucauccccguccucuaccucaccucccucacccaccgcucccgccuccacgagaucugcgacgacaucuucgccuacgucaaggaccgcuacuucgucgaggagaccgucgaggucauccgcaacaacggcgcccgccuccagugccgcauccucgagguccucccccccucccaccagaacggcuucgccaacggccacgucaacuccgucgacggcgagaccaucaucaucuccgacuccgacgacuccgagacccaguccugcuccuuccagaacggcaagaagaaggacgccaucgacccccuccucuucaaguacaagguccagcccaccaagaaggagcuccacgaguccgccaucgucaaggccacccagaucucccgccgcaagcaccucuucucccgcgacaagcucaagcucuuccucaagcagcacugcgagccccaggacggcgucaucaagaucaaggccuccucccucuccaccuacaagaucgccgagcaggacuucuccuacuucuuccccgacgacccccccaccuucaucuucucccccgccaaccgccgccgcggccgcccccccaagcgcauccacaucucccaggaggacaacgucgccaacaagcagacccucgccuccuaccgcuccaaggccaccaaggagcgcgacaagcuccucaagcaggaggagaugaagucccucgccuucgagaaggccaagcucaagcgcgagaaggccgacgcccucgaggccaagaagaaggagaaggaggacaaggagaagaagcgcgaggagcucaagaagaucgucgaggaggagcgccucaagaagaaggaggagaaggagcgccucaaggucgagcgcgagaaggagcgcgagaagcuccgcgaggagaagcgcaaguacgucgaguaccucaagcagugguccaagccccgcgaggacauggagugcgacgaccucaaggagcuccccgagcccacccccgucaagacccgccucccccccgagaucuucggcgacgcccucaugguccucgaguuccucaacgccuucggcgagcucuucgaccuccaggacgaguuccccgacggcgucacccucgagguccucgaggaggcccucgucggcaacgacuccgagggcccccucugcgagcuccucuucuucuuccucaccgccaucuuccaggccaucgccgaggaggaggaggaggucgccaaggagcagcucaccgacgccgacaccaaggaccucaccgaggcccucgacgaggacgccgaccccaccaaguccgcccucuccgccgucgccucccucgccgccgccuggccccagcuccaccagggcugcucccucaagucccucgaccucgacuccugcacccucuccgagauccuccgccuccacauccucgccuccggcgccgacgucaccuccgccaacgccaaguaccgcuaccagaagcgcggcggcuucgacgccaccgacgacgccugcauggagcuccgccucuccaaccccucccucgucaagaagcucuccuccaccuccgucuacgaccucacccccggcgagaagaugaagauccuccacgcccucugcggcaagcuccucacccucgucuccacccgcgacuucaucgaggacuacgucgacauccuccgccaggccaagcaggaguuccgcgagcucaaggccgagcagcaccgcaaggagcgcgaggaggccgccgcccgcauccgcaagcgcaaggaggagaagcucaaggagcaggagcagaagaugaaggagaagcaggagaagcucaaggaggacgagcagcgcaacuccaccgccgacaucuccaucggcgaggaggagcgcgaggacuucgacaccuccaucgaguccaaggacaccgagcagaaggagcucgaccaggacauggucaccgaggacgaggacgaccccggcucccacaagcgcggccgccgcggcaagcgcggccagaacggcuucaaggaguucacccgccaggagcagaucaacugcgucacccgcgagccccucaccgccgacgaggaggaggcccucaagcaggagcaccagcgcaaggagaaggagcuccucgagaagauccaguccgccaucgccugcaccaacaucuucccccucggccgcgaccgcauguaccgccgcuacuggaucuuccccuccauccccggccucuucaucgaggaggacuacuccggccucaccgaggacaugcuccucccccgccccuccuccuuccagaacaacguccagucccaggacccccaggucuccaccaagaccggcgagccccucauguccgaguccaccuccaacaucgaccagggcccccgcgaccacuccguccagcuccccaagcccguccacaagcccaaccgcuggugcuucuacuccuccugcgagcagcucgaccagcucaucgaggcccucaacucccgcggccaccgcgaguccgcccucaaggagacccuccuccaggagaagucccgcaucugcgcccagcucgcccgcuucuccgaggagaaguuccacuucuccgacaagccccagcccgacuccaagcccaccuacucccgcggccgcuccuccaacgccuacgaccccucccagaugugcgccgagaagcagcucgagcuccgccuccgcgacuuccuccucgacaucgaggaccgcaucuaccagggcacccucggcgccaucaaggucaccgaccgccacaucuggcgcuccgcccucgaguccggccgcuacgagcuccucuccgaggagaacaaggagaacggcaucaucaagaccgucaacgaggacgucgaggagauggagaucgacgagcagaccaaggucaucgucaaggaccgccuccucggcaucaagaccgagacccccuccaccgucuccaccaacgccuccaccccccaguccgucuccuccgucguccacuaccucgccauggcccucuuccagaucgagcagggcaucgagcgccgcuuccucaaggccccccucgacgccuccgacuccggccgcuccuacaagaccguccucgaccgcuggcgcgagucccuccucuccuccgccucccucucccaggucuuccuccaccucuccacccucgaccgcuccgucaucugguccaaguccauccucaacgcccgcugcaagaucugccgcaagaagggcgacgccgagaacaugguccucugcgacggcugcgaccgcggccaccacaccuacugcguccgccccaagcucaagaccguccccgagggcgacugguucugccccgagugccgccccaagcagcgcucccgccgccucuccucccgccagcgccccucccucgaguccgacgaggacgucgaggacuccaugggcggcgaggacgacgaggucgacggcgacgaggaggagggccaguccgaggaggaggaguacgaggucgagcaggacgaggacgacucccaggaggaggaggaggucucccuccccaagcgcggccgcccccagguccgccuccccgucaagacccgcggcaagcucuccuccuccuucuccucccgcggccagcagcaggagcccggccgcuaccccucccgcucccagcaguccacccccaagaccaccgucuccuccaagaccggccgcucccuccgcaagaucaacuccgccccccccaccgagaccaagucccuccgcaucgccucccgcuccacccgccacucccacggcccccuccaggccgacgucuucgucgagcuccucuccccccgccgcaagcgccgcggccgcaaguccgccaacaacacccccgagaacucccccaacuuccccaacuuccgcgucaucgccaccaaguccuccgagcagucccgcuccgucaacaucgccuccaagcucucccuccaggaguccgaguccaagcgccgcugccgcaagcgccagucccccgagcccucccccgucacccucggccgccgcuccuccggccgccagggcggcguccacgagcucuccgccuucgagcagcucgucgucgagcucguccgccacgacgacuccuggcccuuccucaagcucgucuccaagauccagguccccgacuacuacgacaucaucaagaagcccaucgcccucaacaucauccgcgagaaggucaacaagugcgaguacaagcucgccuccgaguucaucgacgacaucgagcucauguucuccaacugcuucgaguacaacccccgcaacaccuccgaggccaaggccggcacccgccuccaggccuucuuccacauccaggcccagaagcucggccuccacgucacccccuccaacgucgaccaggucuccaccccccccgccgccaagaagucccgcaucuga

SEQ ID NO: 40235 - RNA, 4452 nt, Artificial Sequence
  derived and/or modified sequence opt2 from BAZ1B__Homo_sapiens__NP_115784
auggccccccuccucggccgcaagcccuucccccucgucaagccccuccccggcgaggagccccucuucaccaucccccacacccaggaggccuuccgcacccgcgaggaguacgaggcccgccucgagcgcuacuccgagcgcaucuggaccugcaaguccaccggcuccucccagcucacccacaaggaggccugggaggaggagcaggaggucgccgagcuccucaaggaggaguuccccgccugguacgagaagcucguccucgagaugguccaccacaacaccgccucccucgagaagcucgucgacaccgccuggcucgagaucaugaccaaguacgccgucggcgaggagugcgacuucgaggucggcaaggagaagaugcucaaggucaagaucgucaagauccacccccucgagaaggucgacgaggaggccaccgagaagaaguccgacggcgccugcgacucccccuccuccgacaaggagaacuccucccagaucgcccaggaccaccagaagaaggagaccgucgucaaggaggacgagggccgccgcgaguccaucaacgaccgcgcccgccgcuccccccgcaagcuccccaccucccucaagaagggcgagcgcaagugggccccccccaaguuccucccccacaaguacgacgucaagcuccagaacgaggacaagaucaucuccaacguccccgccgacucccucauccgcaccgagcgcccccccaacaaggagaucguccgcuacuucauccgccacaacgcccuccgcgccggcaccggcgagaacgcccccugggucgucgaggacgagcucgucaagaaguacucccuccccuccaaguucuccgacuuccuccucgaccccuacaaguacaugacccucaaccccuccaccaagcgcaagaacaccggcucccccgaccgcaagcccuccaagaaguccaagaccgacaacuccucccucuccuccccccucaaccccaagcucuggugccacguccaccucaagaagucccucuccggcuccccccucaaggucaagaacuccaagaacuccaagucccccgaggagcaccucgaggagaugaugaagaugaugucccccaacaagcuccacaccaacuuccacauccccaagaagggcccccccgccaagaagcccggcaagcacuccgacaagccccucaaggccaagggccgcuccaagggcauccucaacggccagaaguccaccggcaacuccaagucccccaagaagggccucaagacccccaagaccaagaugaagcagaugacccuccucgacauggccaagggcacccagaagaugacccgcgccccccgcaacuccggcggcaccccccgcaccuccuccaagccccacaagcaccucccccccgccgcccuccaccucaucgccuacuacaaggagaacaaggaccgcgaggacaagcgcuccgcccucuccugcgucaucuccaagaccgcccgccuccucuccuccgaggaccgcgcccgccuccccgaggagcuccgcucccucguccagaagcgcuacgagcuccucgagcacaagaagcgcugggccuccauguccgaggagcagcgcaaggaguaccucaagaagaagcgcgaggagcucaagaagaagcucaaggagaaggccaaggagcgccgcgagaaggagaugcucgagcgccucgagaagcagaagcgcuacgaggaccaggagcucaccggcaagaaccuccccgccuuccgccucgucgacacccccgagggccuccccaacacccucuucggcgacgucgccauggucgucgaguuccucuccugcuacuccggccuccuccuccccgacgcccaguaccccaucaccgccgucucccucauggaggcccucuccgccgacaagggcggcuuccucuaccucaaccgcguccucgucauccuccuccagacccuccuccaggacgagaucgccgaggacuacggcgagcucggcaugaagcucuccgagaucccccucacccuccacuccgucuccgagcucguccgccucugccuccgccgcuccgacguccaggaggaguccgagggcuccgacaccgacgacaacaaggacuccgccgccuucgaggacaacgagguccaggacgaguuccucgagaagcucgagaccuccgaguucuucgagcucaccuccgaggagaagcuccagauccucaccgcccucugccaccgcauccucaugaccuacuccguccaggaccacauggagacccgccagcagauguccgccgagcucuggaaggagcgccucgccguccucaaggaggagaacgacaagaagcgcgccgagaagcagaagcgcaaggagauggaggccaagaacaaggagaacggcaaggucgagaacggccucggcaagaccgaccgcaagaaggagaucgucaaguucgagccccaggucgacaccgaggccgaggacaugaucuccgccgucaagucccgccgccuccucgccauccaggccaagaaggagcgcgagauccaggagcgcgagaugaaggucaagcucgagcgccaggccgaggaggagcgcauccgcaagcacaaggccgccgccgagaaggccuuccaggagggcaucgccaaggccaagcucgucaugcgccgcacccccaucggcaccgaccgcaaccacaaccgcuacuggcucuucuccgacgagguccccggccucuucaucgagaagggcuggguccacgacuccaucgacuaccgcuucaaccaccacugcaaggaccacaccgucuccggcgacgaggacuacugcccccgcuccaagaaggccaaccucggcaagaacgccuccaugaacacccagcacggcaccgccaccgaggucgccgucgagaccaccacccccaagcagggccagaaccucugguuccucugcgacucccagaaggagcucgacgagcuccucaacugccuccacccccagggcauccgcgagucccagcucaaggagcgccucgagaagcgcuaccaggacaucauccacuccauccaccucgcccgcaagcccaaccucggccucaaguccugcgacggcaaccaggagcuccucaacuuccuccgcuccgaccucaucgaggucgccacccgccuccagaagggcggccucggcuacgucgaggagaccuccgaguucgaggcccgcgucaucucccucgagaagcucaaggacuucggcgagugcgucaucgcccuccaggccuccgucaucaagaaguuccuccagggcuucauggcccccaagcagaagcgccgcaagcuccaguccgaggacuccgccaagaccgaggaggucgacgaggagaagaagauggucgaggaggccaaggucgccuccgcccucgagaaguggaagaccgccauccgcgaggcccagaccuucucccgcaugcacguccuccucggcaugcucgacgccugcaucaagugggacauguccgccgagaacgcccgcugcaaggucugccgcaagaagggcgaggacgacaagcucauccucugcgacgagugcaacaaggccuuccaccucuucugccuccgccccgcccucuacgagguccccgacggcgaguggcagugccccgccugccagcccgccaccgcccgccgcaacucccgcggccgcaacuacaccgaggaguccgccuccgaggacuccgaggacgacgaguccgacgaggaggaggaggaggaggaggaggaggaggaggaggaggacuacgaggucgccggccuccgccuccgcccccgcaagaccauccgcggcaagcacuccgucaucccccccgccgcccgcuccggccgccgccccggcaagaagccccacuccacccgccgcucccagcccaaggccccccccgucgacgacgccgaggucgacgagcucguccuccagaccaagcgcuccucccgccgccagucccucgagcuccagaagugcgaggagauccuccacaagaucgucaaguaccgcuucuccuggcccuuccgcgagcccgucacccgcgacgaggccgaggacuacuacgacgucaucacccaccccauggacuuccagaccguccagaacaagugcuccugcggcuccuaccgcuccguccaggaguuccucaccgacaugaagcaggucuucaccaacgccgaggucuacaacugccgcggcucccacguccucuccugcauggucaagaccgagcagugccucgucgcccuccuccacaagcaccuccccggccaccccuacguccgccgcaagcgcaagaaguuccccgaccgccucgccgaggacgagggcgacuccgagcccgaggccgucggccagucccgcggccgccgccagaagaaguga

SEQ ID NO: 40236 - RNA, 5712 nt, Artificial Sequence
  derived and/or modified sequence opt2 from BAZ2A__Homo_sapiens__NP_001287834
auggaggccaacgaccacuucaacuucaccggccucccccccgcccccgccgccuccggccucaagcccucccccuccuccggcgagggccucuacaccaacggcucccccaugaacuucccccagcagggcaagucccucaacggcgacgucaacgucaacggccucuccaccgucucccacaccaccaccuccggcauccucaacuccgccccccacuccuccuccaccucccaccuccaccaccccuccgucgccuacgacugccucuggaacuacucccaguaccccuccgccaaccccggcuccaaccucaaggaccccccccuccucucccaguucuccggcggccaguacccccucaacggcauccucggcggcucccgccagcccuccucccccucccacaacaccaaccuccgcgccggcucccaggaguucugggccaacggcacccagucccccaugggccucaacuucgacucccaggagcucuacgacuccuuccccgaccagaacuucgaggucaugcccaacggcccccccuccuucuucaccuccccccagaccucccccaugcucggcuccuccauccagaccuucgcccccucccaggaggucggcuccggcauccaccccgacgaggccgccgagaaggagaugaccuccgucgucgccgagaacggcaccggccucgucggcucccucgagcucgaggaggagcagcccgagcucaagaugugcggcuacaacggcuccguccccuccgucgagucccuccaccaggaggucuccguccucguccccgaccccaccgucuccugccucgacgaccccucccaccuccccgaccagcucgaggacacccccauccucuccgaggacucccucgagcccuucaacucccucgcccccgagcccgucuccggcggccucuacggcaucgacgacaccgagcucaugggcgccgaggacaagcucccccucgaggacucccccgucaucuccgcccucgacugccccucccucaacaacgccaccgccuucucccuccucgccgacgacucccagaccuccaccuccaucuucgccucccccaccuccccccccguccucggcgaguccguccuccaggacaacuccuucgaccucaacaacggcuccgacgccgagcaggaggagauggagacccaguccuccgacuucccccccucccucacccagcccgcccccgaccaguccuccaccauccagcuccaccccgccaccucccccgccgucucccccaccaccucccccgccgucucccucgucgucucccccgccgccucccccgagaucucccccgaggucugccccgccgccuccaccgucgucucccccgccgucuucuccgucgucucccccgccuccuccgccguccuccccgccgucucccucgaggucccccucaccgccuccgucaccucccccaaggccucccccgucaccucccccgccgccgccuuccccaccgccucccccgccaacaaggacgucuccuccuuccucgagaccaccgccgacgucgaggagaucaccggcgagggccucaccgccuccggcuccggcgacgucaugcgccgccgcaucgccacccccgaggagguccgccucccccuccagcacggcuggcgccgcgagguccgcaucaagaagggcucccaccgcuggcagggcgagaccugguacuacggccccugcggcaagcgcaugaagcaguuccccgaggucaucaaguaccucucccgcaacgucguccacuccguccgccgcgagcacuucuccuucuccccccgcaugcccgucggcgacuucuucgaggagcgcgacacccccgagggccuccaguggguccagcucuccgccgaggagauccccucccgcauccaggccaucaccggcaagcgcggccgcccccgcaacaccgagaaggccaagaccaaggagguccccaaggucaagcgcggccgcggccgcccccccaaggucaagaucaccgagcuccucaacaagaccgacaaccgcccccucaagaagcucgaggcccaggagacccucaacgaggaggacaaggccaagaucgccaaguccaagaagaagaugcgccagaagguccagcgcggcgagugccagaccaccauccagggccaggcccgcaacaagcgcaagcaggagaccaagucccucaagcagaaggaggccaagaagaaguccaaggccgagaaggagaagggcaagaccaagcaggagaagcucaaggagaaggucaagcgcgagaagaaggagaaggucaagaugaaggagaaggaggaggucaccaaggccaagcccgccugcaaggccgacaagacccucgccacccagcgccgccucgaggagcgccagcgccagcagaugauccucgaggagaugaagaagcccaccgaggacaugugccucaccgaccaccagccccuccccgacuucucccgcguccccggccucacccuccccuccggcgccuucuccgacugccucaccaucgucgaguuccuccacuccuucggcaagguccucggcuucgaccccgccaaggacguccccucccucggcguccuccaggagggccuccucugccagggcgacucccucggcgagguccaggaccuccucguccgccuccucaaggccgcccuccacgaccccggcuuccccuccuacugccagucccucaagauccucggcgagaaggucuccgagaucccccucacccgcgacaacgucuccgagauccuccgcugcuuccucauggccuacggcgucgagcccgcccucugcgaccgccuccgcacccagcccuuccaggcccagcccccccagcagaaggccgccguccucgccuuccucguccacgagcucaacggcuccacccucaucaucaacgagaucgacaagacccucgaguccauguccuccuaccgcaagaacaaguggaucgucgagggccgccuccgccgccucaagaccguccucgccaagcgcaccggccgcuccgaggucgagauggagggccccgaggagugccucggccgccgccgcuccucccgcaucauggaggagaccuccggcauggaggaggaggaggaggaggaguccaucgccgccguccccggccgccgcggccgccgcgacggcgaggucgacgccaccgccuccuccauccccgagcucgagcgccagaucgagaagcucuccaagcgccagcucuucuuccgcaagaagcuccuccacuccucccagaugcuccgcgccgucucccucggccaggaccgcuaccgccgccgcuacuggguccuccccuaccucgccggcaucuucgucgagggcaccgagggcaaccucguccccgaggaggucaucaagaaggagaccgacucccucaaggucgccgcccacgccucccucaaccccgcccucuucuccaugaagauggagcucgccggcuccaacaccaccgccuccucccccgcccgcgcccgcggccgcccccgcaagaccaagcccggcuccaugcagccccgccaccucaagucccccguccgcggccaggacuccgagcagccccaggcccagcuccagcccgaggcccagcuccacgcccccgcccagccccagccccagcuccagcuccagcuccagucccacaagggcuuccucgagcaggagggcuccccccucucccucggccagucccagcacgaccucucccaguccgccuuccucuccuggcucucccagacccagucccacuccucccuccucuccuccuccguccucacccccgacuccucccccggcaagcucgaccccgcccccucccagccccccgaggagcccgagcccgacgaggccgaguccucccccgacccccaggcccucugguucaacaucuccgcccagaugcccugcaacgccgcccccacccccccccccgccgucuccgaggaccagcccacccccuccccccagcagcucgccuccuccaagcccaugaaccgccccuccgccgccaaccccugcucccccguccaguucuccuccaccccccucgccggccucgcccccaagcgccgcgccggcgaccccggcgagaugccccagucccccaccggccucggccagcccaagcgccgcggccgcccccccuccaaguucuucaagcagauggagcagcgcuaccucacccagcucaccgcccagcccgucccccccgagaugugcuccggcuggugguggauccgcgaccccgagaugcucgacgccaugcucaaggcccuccacccccgcggcauccgcgagaaggcccuccacaagcaccucaacaagcaccgcgacuuccuccaggaggucugccuccgccccuccgccgaccccaucuucgagccccgccagcuccccgccuuccaggagggcaucauguccuggucccccaaggagaagaccuacgagaccgaccucgccguccuccagugggucgaggagcucgagcagcgcgucaucauguccgaccuccagauccgcggcuggaccugccccucccccgacuccacccgcgaggaccucgccuacugcgagcaccucuccgacucccaggaggacaucaccuggcgcggccgcggccgcgagggccucgccccccagcgcaagaccaccaacccccucgaccucgccgucaugcgccucgccgcccucgagcagaacgucgagcgccgcuaccuccgcgagccccucuggcccacccacgaggucguccucgagaaggcccuccucuccacccccaacggcgcccccgagggcaccaccaccgagaucuccuacgagaucaccccccgcauccgcgucuggcgccagacccucgagcgcugccgcuccgccgcccaggucugccucugccucggccagcucgagcgcuccaucgccugggagaaguccgucaacaaggucaccugccucgucugccgcaagggcgacaacgacgaguuccuccuccucugcgacggcugcgaccgcggcugccacaucuacugccaccgccccaagauggaggccguccccgagggcgacugguucugcaccgucugccucgcccagcaggucgagggcgaguucacccagaagcccggcuuccccaagcgcggccagaagcgcaaguccggcuacucccucaacuucuccgagggcgacggccgccgccgccgcguccuccuccgcggccgcgagucccccgccgccggcccccgcuacuccgaggagggccucucccccuccaagcgccgccgccucuccaugcgcaaccaccacuccgaccucaccuucugcgagaucauccucauggagauggagucccacgacgccgccuggcccuuccucgagcccgucaacccccgccucgucuccggcuaccgccgcaucaucaagaaccccauggacuucuccaccaugcgcgagcgccuccuccgcggcggcuacaccuccuccgaggaguucgccgccgacgcccuccucgucuucgacaacugccagaccuucaacgaggacgacuccgaggucggcaaggccggccacaucaugcgccgcuucuucgagucccgcugggaggaguucuaccagggcaagcaggccaaccucuga

SEQ ID NO: 40237 - RNA, 6399 nt, Artificial Sequence
  derived and/or modified sequence opt2 from BAZ2B__Homo_sapiens__NP_001276904
auggaguccggcgagcgccuccccuccuccgccgccuccuccaccacccccaccuccuccuccacccccuccgucgccuccgucgucuccaagggcggccucuccaccggcgucgccucccucuccuccaccaucaaccccugcggccaccucuuccgcaccgccggcgaccagcccuucaaccucuccaccgucuccuccgccuuccccauggucucccaccccgucuucggccuccacuccgccuccuccggccacuccgaguucggcggccucggcacccucggcacccccaccgcccucgccgcccacccccagcucgccuccuuccccgagugguggcgcaccaccgacgcccacacccgcaccggcgccaccuucuuccccccccuccucggcauccccccccucuucgccccccccgcccagaaccacgacuccuccuccuuccacucccgcaccuccggcaaguccaaccgcaacggccccgagaagggcgucaacggcuccaucaacggcuccaacaccuccuccgucaucggcaucaacaccuccguccucuccaccaccgccuccuccuccaugggccagaccaaguccaccuccuccggcggcggcaaccgcaagugcaaccaggagcaguccaagaaccagccccucgacgcccgcgucgacaagaucaaggacaagaagccccgcaagaaggccauggaguccuccuccaacuccgacuccgacuccggcaccuccuccgacaccuccuccgagggcaucuccuccuccgacuccgacgaccucgaggaggacgaggaggaggaggaccaguccaucgaggaguccgaggacgacgacuccgacuccgaguccgaggcccagcacaaguccaacaaccagguccuccuccacggcaucuccgaccccaaggccgacggccagaaggccaccgagaaggcccaggagaagcgcauccaccagccccucccccucgccuccgagucccagacccacuccuuccagucccagcagaagcagccccagguccucucccagcagcuccccuucaucuuccaguccucccaggccaaggaggaguccgucaacaagcacaccuccgucauccaguccaccggccucgucuccaacgucaagccccucucccucgucaaccaggccaagaaggagaccuacaugaagcucaucguccccucccccgacguccucaaggccggcaacaagaacaccuccgaggaguccucccuccucaccuccgagcuccgcuccaagcgcgagcaguacaagcaggccuuccccucccagcucaagaagcaggaguccuccaagucccucaagaaggucaucgccgcccucuccaaccccaaggccaccuccuccucccccgcccaccccaagcagacccucgagaacaaccaccccaaccccuuccucaccaacgcccuccucggcaaccaccagcccaacggcgucauccaguccgucauccaggaggccccccucgcccucaccaccaagaccaagaugcaguccaagaucaacgagaacaucgccgccgccuccuccacccccuucuccucccccgucaaccucuccaccuccggccgccgcacccccggcaaccagacccccgucaugcccuccgccucccccauccuccacucccagggcaaggagaaggccgucuccaacaacgucaaccccgucaagacccagcaccacucccaccccgccaagucccucgucgagcaguuccgcggcaccgacuccgacauccccuccuccaaggacuccgaggacuccaacgaggacgaggaggaggacgacgaggaggaggacgaggaggacgacgaggacgacgaguccgacgacucccaguccgaguccgacuccaacuccgaguccgacaccgagggcuccgaggaggaggacgacgacgacaaggaccaggacgaguccgacuccgacaccgagggcgagaagaccuccaugaagcucaacaagaccaccuccuccgucaagucccccuccaugucccucaccggccacuccaccccccgcaaccuccacaucgccaaggcccccggcuccgcccccgccgcccucugcuccgagucccagucccccgccuuccucggcaccuccuccuccacccucaccuccuccccccacuccggcaccuccaagcgccgccgcgucaccgacgagcgcgagcuccgcaucccccucgaguacggcuggcagcgcgagacccgcauccgcaacuucggcggccgccuccagggcgaggucgccuacuacgcccccugcggcaagaagcuccgccaguaccccgaggucaucaagggcaugcaguggugccuccucaaggaggaggacgucaucccccgcauccgcgccauggagggccgccgcggccgcccccccaaccccgaccgccagcgcgcccgcgaggagucccgcaugcgccgccgcaagggccgcccccccaacgucggcaacgccgaguuccucgacaacgccgacgccaagcuccuccgcaagcuccaggcccaggagaucgcccgccaggccgcccagaucaagcuccuccgcaagcuccagaagcaggagcaggcccgcgucgccaaggaggccaagaagcagcaggccaucauggccgccgaggagaagcgcaagcagaaggagcagaucaagaucaugaagcagcaggagaagaucaagcgcauccagcagauccgcauggagaaggagcuccgcgcccagcagauccucgaggccaagaagaagaagaaggaggaggccgccaacgccaagcuccucgaggccgagaagcgcaucaaggagaaggagaugcgccgccagcaggccguccuccucaagcaccaggagcgcgagcgccgccgccagcacaugaugcucaugaaggccauggaggcccgcaagaaggccgaggagaaggagcgccucaagcaggagaagcgcgacgagaagcgccucaacaaggagcgcaagcucgagcagcgccgccucgagcucgagauggccaaggagcucaagaagcccaacgaggacaugugccucgccgaccagaagccccuccccgagcucccccgcauccccggccucguccucuccggcuccaccuucuccgacugccucauggucguccaguuccuccgcaacuucggcaagguccucggcuucgacgucaacaucgacguccccaaccucuccguccuccaggagggccuccucaacaucggcgacuccaugggcgagguccaggaccuccucguccgccuccucuccgccgccgucugcgaccccggccucaucaccggcuacaaggccaagaccgcccucggcgagcaccuccucaacgucggcgucaaccgcgacaacgucuccgagauccuccagaucuucauggaggcccacugcggccagaccgagcucaccgagucccucaagaccaaggccuuccaggcccacacccccgcccagaaggccuccguccucgccuuccucaucaacgagcucgccugcuccaaguccgucgucuccgagaucgacaagaacaucgacuacauguccaaccuccgccgcgacaagugggucgucgagggcaagcuccgcaagcuccgcaucauccacgccaagaagaccggcaagcgcgacaccuccggcggcaucgaccucggcgaggagcagcacccccucggcacccccacccccggccgcaagcgccgccgcaagggcggcgacuccgacuacgacgacgacgacgacgacgacuccgacgaccagggcgacgaggacgacgaggacgaggaggacaaggaggacaagaagggcaagaagaccgacaucugcgaggacgaggacgagggcgaccaggccgccuccgucgaggagcucgagaagcagaucgagaagcucuccaagcagcagucccaguaccgccgcaagcucuucgacgccucccacucccuccgcuccgucauguucggccaggaccgcuaccgccgccgcuacuggauccucccccagugcggcggcaucuucgucgagggcauggaguccggcgagggccucgaggagaucgccaaggagcgcgagaagcucaagaaggccgaguccguccagaucaaggaggagauguucgagaccuccggcgacucccucaacugcuccaacaccgaccacugcgagcagaaggaggaccucaaggagaaggacaacaccaaccucuuccuccagaagcccggcuccuucuccaagcucuccaagcuccucgaggucgccaagaugccccccgaguccgaggucaugacccccaagcccaacgccggcgccaacggcugcacccucuccuaccagaacuccggcaagcacucccucggcuccguccaguccaccgccacccaguccaacgucgagaaggccgacuccaacaaccucuucaacaccggcuccuccggccccggcaaguucuacuccccccuccccaacgaccagcuccucaagacccucaccgagaagaaccgccagugguucucccuccucccccgcacccccugcgacgacaccucccucacccacgccgacauguccaccgccucccucgucaccccccagucccagccccccuccaagucccccucccccacccccgccccccucggcuccuccgcccagaaccccgucggccucaaccccuucgcccucuccccccuccaggucaagggcggcgucuccaugaugggccuccaguucugcggcuggcccaccggcgucgucaccuccaacauccccuucaccuccuccguccccucccucggcuccggccucggccucuccgagggcaacggcaacuccuuccucaccuccaacgucgccuccuccaaguccgagucccccgucccccagaacgagaaggccaccuccgcccagcccgccgccgucgaggucgccaagcccgucgacuuccccucccccaagcccauccccgaggagaugcaguucggcugguggcgcaucaucgaccccgaggaccucaaggcccuccucaagguccuccaccuccgcggcauccgcgagaaggcccuccagaagcagauccagaagcaccucgacuacaucacccaggccugccucaagaacaaggacgucgccaucaucgagcucaacgagaacgaggagaaccaggucacccgcgacaucgucgagaacugguccgucgaggagcaggccauggagauggaccucuccguccuccagcaggucgaggaccucgagcgccgcgucgccuccgccucccuccaggucaagggcuggaugugccccgagcccgccuccgagcgcgaggaccucgucuacuucgagcacaaguccuucaccaagcucugcaaggagcacgacggcgaguucaccggcgaggacgaguccuccgcccacgcccucgagcgcaaguccgacaacccccucgacaucgccgucacccgccucgccgaccucgagcgcaacaucgagcgccgcaucgaggaggacaucgcccccggccuccgcgucuggcgccgcgcccucuccgaggcccgcuccgccgcccaggucgcccucugcauccagcagcuccagaaguccaucgccugggagaaguccaucaugaaggucuacugccagaucugccgcaagggcgacaacgaggagcuccuccuccucugcgacggcugcgacaagggcugccacaccuacugccaccgccccaagaucaccaccauccccgacggcgacugguucugccccgccugcaucgccaaggccuccggccagacccucaagaucaagaagcuccacgucaagggcaagaagaccaacgaguccaagaagggcaagaaggucacccucaccggcgacaccgaggacgaggacuccgccuccaccuccuccucccucaagcgcggcaacaaggaccucaagaagcgcaagauggaggagaacaccuccaucaaccucuccaagcaggaguccuucaccuccgucaagaagcccaagcgcgacgacuccaaggaccucgcccucugcuccaugauccucaccgagauggagacccacgaggacgccuggcccuuccuccuccccgucaaccucaagcucguccccggcuacaagaaggucaucaagaagcccauggacuucuccaccauccgcgagaagcucuccuccggccaguaccccaaccucgagaccuucgcccucgacguccgccucgucuucgacaacugcgagaccuucaacgaggacgacuccgacaucggccgcgccggccacaacaugcgcaaguacuucgagaagaaguggaccgacaccuucaaggucuccuga

SEQ ID NO: 40238 - RNA, 786 nt, Artificial Sequence
  derived and/or modified sequence opt2 from BBC3__Homo_sapiens__NP_001120712
augaaguucggcaugggcuccgcccaggccugccccugccaggucccccgcgccgccuccaccaccuggguccccugccagaucugcggcccccgcgagcgccacggcccccgcacccccggcggccagcuccccggcgcccgccgcggccccggcccccgccgccccgccccccuccccgcccgcccccccggcgcccucggcuccguccuccgcccccuccgcgcccgccccggcugccgcccccgccgcccccaccccgccgcccgcugccucccccuccgcccccaccgccccacccgccgccaccgccgccccggcggcuucccccucgccuggggcuccccccagcccgccccccgccccgcccccggccgcuccuccgcccucgcccucgccggcggcgccgcccccggcgucgcccgcgcccagcgccccggcggcuccggcggccgcucccaccccggcggccccggcuccccccgcggcggcggcaccgucggccccggcgaccgcggccccgccgccgccgacggcggccgcccccagcgcaccguccgcgccgccgagacccgcggcgccgccgccgcccccccccucacccucgagggccccguccagucccaccacggcacccccgcccucacccagggcccccaguccccccgcgacggcgcccagcucggcgccugcacccgccccgucgacguccgcgacuccggcggccgcccccuccccccccccgacacccucgccuccgccggcgacuuccucugcaccauguga

SEQ ID NO: 40239 - RNA, 312 nt, Artificial Sequence
  derived and/or modified sequence opt2 from BBIP1__Homo_sapiens__NP_001182233
augcucaaggccgccgccaagcgccccgagcucuccggccuccucaaguucaacaacuacggcauccucuccgaguccccccucaccucccagcgcaccaccuggcuccucuaccagucccccuccuucauccccggcuucgccuaccccucccgcugccucaagaccaucggcggcgucuacaagcaggcccgcaagaagcacuacauccagcagcuccgcuacggccgcuccgaggucaacguccccggcuccuccuccaaggcccgcgccaccgucugcggccgcuacaacgacaacggcgccgucuga

SEQ ID NO: 40240 - RNA, 1164 nt, Artificial Sequence
  derived and/or modified sequence opt2 from BBOX1__Homo_sapiens__XP_011518705
auggccugcaccauccagaaggccgaggcccucgacggcgcccaccucaugcagauccucugguacgacgaggaggagucccucuaccccgccgucuggcuccgcgacaacugccccugcuccgacugcuaccucgacuccgccaaggcccgcaagcuccucgucgaggcccucgacgucaacaucggcaucaagggccucaucuucgaccgcaagaaggucuacaucaccuggcccgacgagcacuacuccgaguuccaggccgacuggcucaagaagcgcugcuucuccaagcaggcccgcgccaagcuccagcgcgagcucuucuuccccgagugccaguacuggggcuccgagcuccagcuccccacccucgacuucgaggacguccuccgcuacgacgagcacgccuacaaguggcucuccacccucaagaaggucggcaucguccgccucaccggcgccuccgacaagcccggcgaggucuccaagcucggcaagcgcaugggcuuccucuaccucaccuucuacggccacaccuggcagguccaggacaagaucgacgccaacaacgucgccuacaccaccggcaagcucuccuuccacaccgacuaccccgcccuccaccacccccccggcguccagcuccuccacugcaucaagcagaccgucaccggcggcgacuccgagaucgucgacggcuucaacgucugccagaagcucaagaagaacaacccccaggccuuccagauccucuccuccaccuucgucgacuucaccgacaucggcgucgacuacugcgacuucuccguccaguccaagcacaagaucaucgagcucgacgacaagggccaggucguccgcaucaacuucaacaacgccacccgcgacaccaucuucgacguccccgucgagcgcguccagcccuucuacgccgcccucaaggaguucgucgaccucaugaacuccaaggaguccaaguucaccuucaagaugaaccccggcgacgucaucaccuucgacaacuggcgccuccuccacggccgccgcuccuacgaggccggcaccgagaucucccgccaccucgagggcgccuacgccgacugggacgucgucaugucccgccuccgcauccuccgccagcgcgucgagaacggcaacuga

SEQ ID NO: 40241 - RNA, 2172 nt, Artificial Sequence
  derived and/or modified sequence opt2 from BBS10__Homo_sapiens__NP_078961
augcucuccuccauggccgccgccggcuccgucaaggccgcccuccaggucgccgagguccucgaggccaucgucuccugcugcgucggccccgagggccgccagguccucugcaccaagcccaccggcgagguccuccucucccgcaacggcggccgccuccucgaggcccuccaccucgagcaccccaucgcccgcaugaucgucgacugcgucuccucccaccucaagaagaccggcgacggcgccaagaccuucaucaucuuccucugccaccuccuccgcggccuccacgccaucaccgaccgcgagaaggacccccucaugugcgagaacauccagacccacggccgccacuggaagaacugcucccgcuggaaguucaucucccaggcccuccucaccuuccagacccagauccucgacggcaucauggaccaguaccucucccgccacuuccucuccaucuucuccuccgccaaggagcgcacccucugccgcuccucccucgagcuccuccucgaggccuacuucugcggccgcgucggccgcaacaaccacaaguucaucucccagcucaugugcgacuacuucuucaagugcaugaccugcaaguccggcaucggcgucuucgagcucgucgacgaccacuucgucgagcucaacgucggcgucaccggccuccccgucuccgacucccgcaucaucgccggccucguccuccagaaggacuucuccgucuaccgccccgccgacggcgacaugcgcauggucaucgucaccgagaccauccagccccucuucuccaccuccggcuccgaguucauccucaacuccgaggcccaguuccagaccucccaguucuggaucauggagaagaccaaggccaucaugaagcaccuccacucccagaacgucaagcuccucaucuccuccgucaagcagcccgaccucgucuccuacuacgccggcgucaacggcaucuccgucgucgagugccucuccuccgaggaggucucccucauccgccgcaucaucggccucucccccuucguccccccccaggccuucucccagugcgagauccccaacaccgcccucgucaaguucugcaagccccucauccuccgcuccaagcgcuacguccaccucggccucaucuccaccugcgccuucaucccccacuccaucguccucugcggccccguccacggccucaucgagcagcacgaggacgcccuccacggcgcccucaagaugcuccgccagcucuucaaggaccucgaccucaacuacaugacccagaccaacgaccagaacggcaccuccucccucuucaucuacaagaacuccggcgaguccuaccaggcccccgaccccggcaacggcuccauccagcgccccuaccaggacaccgucgccgagaacaaggacgcccucgagaagacccagaccuaccucaagguccacuccaaccucgucauccccgacgucgagcucgagaccuacauccccuacuccacccccacccucacccccaccgacaccuuccagaccgucgagacccucaccugccucucccucgagcgcaaccgccucaccgacuacuacgagccccuccucaagaacaacuccaccgccuacuccacccgcggcaaccgcaucgagaucuccuacgagaaccuccaggucaccaacaucacccgcaagggcuccaugcuccccgucuccugcaagcuccccaacaugggcaccucccaguccuaccucuccuccuccaugcccgccggcugcguccuccccgucggcggcaacuucgagauccuccuccacuacuaccuccucaacuacgccaagaagugccaccaguccgaggagaccauggucuccaugaucaucgccaacgcccuccucggcauccccaagguccucuacaaguccaagaccggcaaguacuccuucccccacaccuacauccgcgccguccacgcccuccagaccaaccagccccucgucuccucccagaccggccucgaguccgucaugggcaaguaccagcuccucaccuccguccuccagugccucaccaagauccucaccaucgacauggucaucaccgucaagcgccacccccagaagguccacaaccaggacuccgaggacgagcucuga

SEQ ID NO: 40242 - RNA, 2133 nt, Artificial Sequence
  derived and/or modified sequence opt2 from BBS12__Homo_sapiens__NP_689831
auggucauggccugccgcgucgucaacaagcgccgccacaugggccuccagcagcucuccuccuucgccgagaccggccgcaccuuccucggcccccucaaguccuccaaguucaucaucgacgaggagugccacgaguccguccucaucuccuccaccguccgccuccucgagucccucgaccucaccuccgccgucggccagcuccucaacgaggccguccaggcccagaacaacaccuaccgcaccggcaucuccacccuccucuuccucgucggcgccugguccuccgccgucgaggagugccuccaccucggcguccccaucuccaucaucgucuccgucauguccgagggccucaacuucugcuccgaggaggucgucucccuccacguccccguccacaacaucuucgacugcauggacuccaccaagaccuucucccagcucgagaccuucuccgucucccucugccccuuccuccagguccccuccgacaccgaccucaucgaggagcuccacggccucaaggacgucgccucccagacccucaccaucuccaaccucuccggccgcccccucaaguccuacgagcucuucaagccccagaccaaggucgaggccgacaacaacaccucccgcacccucaagaacucccuccucgccgacaccugcugccgccaguccauccucauccacucccgccacuucaaccgcaccgacaacaccgagggcgucuccaagcccgacggcuuccaggagcacgucaccgccacccacaagaccuaccgcugcaacgaccucgucgagcucgccgucggccucucccacggcgaccacuccuccaugaagcucgucgaggaggccguccagcuccaguaccagaacgccugcguccagcagggcaacugcaccaagcccuucauguucgacaucucccgcaucuucaccugcugccuccccggccuccccgagaccuccuccugcgucugccccggcuacaucaccgucgucuccgucuccaacaaccccgucaucaaggagcuccagaaccagcccguccgcaucguccucaucgagggcgaccucaccgagaacuaccgccaccucggcuucaacaaguccgccaacaucaagaccguccucgacuccaugcgccuccaggaggacuccuccgaggagcucugggccaaccacguccuccagguccucauccaguucaaggucaaccucguccucguccagggcaacgucuccgagcgccucaucgagaagugcaucaacuccaagcgccucgucaucggcuccgucaacggcuccgucaugcaggccuucgccgaggccgccggcgccguccaggucgccuacaucacccaggucaacgaggacugcgucggcgacggcgucugcgucaccuucuggcgcuccuccccccucgacgucgucgaccgcaacaaccgcaucgccauccuccucaagaccgagggcaucaaccucgucaccgccguccucaccaaccccgucaccgcccagaugcagaucaaggaggaccgcuucuggaccugcgccuaccgccucuacuacgcccucaaggaggagaaggucuuccucggcggcggcgccgucgaguuccucugccucuccugccuccacauccucgccgagcagucccucaagaaggagaaccacgccugcuccggcuggcuccacaacaccuccuccuggcucgccuccucccucgccaucuaccgccccaccguccucaaguuccucgccaacggcuggcagaaguaccucuccacccuccucuacaacaccgccaacuacuccuccgaguucgaggccuccaccuacauccagcaccaccuccagaacgccaccgacuccggcucccccuccuccuacauccucaacgaguacuccaagcucaacucccgcaucuucaacuccgacaucuccaacaagcucgagcagaucccccgcgucuacgacgucgucacccccaagaucgaggccuggcgccgcgcccucgaccucguccuccucguccuccagaccgacuccgagaucaucaccggccacggccacacccagaucaacucccaggagcucaccggcuuccucuuccucuga

SEQ ID NO: 40243 - RNA, 1782 nt, Artificial Sequence
  derived and/or modified sequence opt2 from BBS1__Homo_sapiens__NP_078925
auggccgccgccuccuccuccgacuccgacgccugcggcgccgaguccaacgaggccaacuccaaguggcucgacgcccacuacgaccccauggccaacauccacaccuucuccgccugccucgcccucgccgaccuccacggcgacggcgaguacaagcucgucgucggcgaccucggccccggcggccagcagccccgccucaagguccucaagggcccccucgucaugaccgaguccccccuccccgcccuccccgccgccgccgccaccuuccucauggagcagcacgagccccgcacccccgcccucgcccucgccuccggccccugcgucuacgucuacaagaaccuccgccccuacuucaaguucucccucccccagcucccccccaacccccucgagcaggaccucuggaaccaggccaaggaggaccgcaucgacccccucacccucaaggagaugcucgaguccauccgcgagaccgccgaggagccccucuccauccagucccuccgcuuccuccagcucgagcucuccgagauggaggccuucgucaaccagcacaaguccaacuccaucaagcgccagaccgucaucaccaccaugaccacccucaagaagaaccucgccgacgaggacgccgucuccugccucguccucggcaccgagaacaaggagcuccucguccucgaccccgaggccuucaccauccucgccaagaugucccuccccuccguccccgucuuccucgaggucuccggccaguucgacgucgaguuccgccucgccgccgccugccgcaacggcaacaucuacauccuccgccgcgacuccaagcaccccaaguacugcaucgagcucuccgcccagcccgucggccucauccgcguccacaagguccucgucgucggcuccacccaggacucccuccacggcuucacccacaagggcaagaagcucuggaccguccagaugcccgccgccauccucaccaugaaccuccucgagcagcacucccgcggccuccaggccgucauggccggccucgccaacggcgagguccgcaucuaccgcgacaaggcccuccucaacgucauccacacccccgacgccgucaccucccucugcuucggccgcuacggccgcgaggacaacacccucaucaugaccacccgcggcggcggccucaucaucaagauccucaagcgcaccgccgucuucgucgagggcggcuccgaggucggccccccccccgcccaggccaugaagcucaacgucccccgcaagacccgccucuacgucgaccagacccuccgcgagcgcgaggccggcaccgccaugcaccgcgccuuccagaccgaccucuaccuccuccgccuccgcgccgcccgcgccuaccuccaggcccucgaguccucccucuccccccucuccaccaccgcccgcgagccccucaagcuccacgccgucguccagggccucggccccaccuucaagcucacccuccaccuccagaacaccuccaccacccgccccguccucggccuccucgucugcuuccucuacaacgaggcccucuacucccucccccgcgccuucuucaaggucccccuccucguccccggccucaacuacccccucgagaccuucgucgagucccucuccaacaagggcaucuccgacaucaucaagguccucguccuccgcgagggccaguccgccccccuccucuccgcccacgucaacaugcccggcuccgagggccucgccgccgccuga

SEQ ID NO: 40244 - RNA, 2166 nt, Artificial Sequence
  derived and/or modified sequence opt2 from BBS2__Homo_sapiens__XP_005256137
augcuccuccccgucuucacccucaagcuccgccacaagaucuccccccgcauggucgccaucggccgcuacgacggcacccaccccugccucgccgccgccacccagaccggcaaggucuucauccacaacccccacacccgcaaccagcacgucuccgccucccgcgucuuccaguccccccucgaguccgacgucucccuccucuccaucaaccaggccgucuccugccucaccgccggcguccucaaccccgagcucggcuacgacgcccuccucgucggcacccagaccaaccuccucgccuacgacgucuacaacaacuccgaccucuucuaccgcgaggucgccgacggcgccaacgccaucguccucggcacccucggcgacaucuccuccccccucgccaucaucggcggcaacugcgcccuccagggcuucaaccacgagggcuccgaccucuucuggaccgucaccggcgacaacgucaacucccucgcccucugcgacuucgacggcgacggcaagaaggagcuccucgucggcuccgaggacuucgacauccgcgucuucaaggaggacgagaucgucgccgagaugaccgagaccgagaucgucaccucccucugccccauguacggcucccgcuucggcuacgcccucuccaacggcaccgucggcgucuacgacaagaccucccgcuacuggcgcaucaaguccaagaaccacgccauguccauccacgccuucgaccucaacuccgacggcgucaacgagcucaucaccggcugguccaacggcaaggucgacgcccgcuccgaccgcaccggcgaggucaucuucaaggacaacuucuccuccgccaucgccggcgucgucgagggcgacuaccgcauggacggccacauccagcucaucugcugcuccgucgacggcgagauccgcggcuaccuccccggcaccgccgagaugcgcggcaaccucauggacaccuccgccgagcaggaccucauccgcgagcucucccagaagaagcagaaccuccuccucgagcuccgcaacuacgaggagaacgccaaggccgagcucgccuccccccucaacgaggccgacggccaccgcggcaucauccccgccaacacccgccuccacaccacccucuccgucucccucggcaacgagacccagaccgcccacaccgagcuccgcaucuccaccuccaacgacaccaucauccgcgccguccucaucuucgccgagggcaucuucaccggcgagucccacgucguccaccccuccauccacaaccucuccuccuccaucugcauccccaucgucccccccaaggacguccccgucgaccuccaccucaaggccuucgucggcuaccgcuccuccacccaguuccacgucuucgaguccacccgccagcucccccgcuucuccauguacgcccucaccucccucgaccccgccuccgagcccaucuccuacgucaacuucaccaucgccgagcgcgcccagcgcgucgucgucuggcucggccagaacuuccuccuccccgaggacacccacauccagaacgcccccuuccaggucugcuucaccucccuccgcaacggcggccaccuccacaucaagaucaagcucuccggcgagaucaccaucaacaccgacgacaucgaccucgccggcgacaucauccaguccauggccuccuucuucgccaucgaggaccuccaggucgaggccgacuuccccgucuacuucgaggagcuccgcaagguccucgucaaggucgacgaguaccacuccguccaccagaagcucuccgccgacauggccgaccacuccaaccucauccgcucccuccucgucggcgccgaggacgcccgccucaugcgcgacaugaagaccaugaagucccgcuacauggagcucuacgaccucaaccgcgaccuccucaacggcuacaagauccgcugcaacaaccacaccgagcuccucggcaaccucaaggccgucaaccaggccauccagcgcgccggccgccuccgcgucggcaagcccaagaaccaggucaucaccgccugccgcgacgccauccgcuccaacaacaucaacacccucuucaagaucaugcgcgucggcaccgccuccuccuga

SEQ ID NO: 40245 - RNA, 1560 nt, Artificial Sequence
  derived and/or modified sequence opt2 from BBS4__Homo_sapiens__NP_149017
auggccgaggagcgcgucgccacccgcacccaguuccccgucuccaccgagucccagaagccccgccagaagaaggcccccgaguuccccauccucgagaagcagaacuggcucauccaccuccacuacauccgcaaggacuacgaggccugcaaggccgucaucaaggagcagcuccaggagacccagggccucugcgaguacgccaucuacguccaggcccucaucuuccgccucgagggcaacauccaggagucccucgagcucuuccagaccugcgccguccucuccccccaguccgccgacaaccucaagcaggucgcccgcucccucuuccuccucggcaagcacaaggccgccaucgaggucuacaacgaggccgccaagcucaaccagaaggacugggagaucucccacaaccucggcgucugcuacaucuaccucaagcaguucaacaaggcccaggaccagcuccacaacgcccucaaccucaaccgccacgaccucaccuacaucaugcucggcaagauccaccuccucgagggcgaccucgacaaggccaucgaggucuacaagaaggccgucgaguucucccccgagaacaccgagcuccucaccacccucggccuccucuaccuccagcucggcaucuaccagaaggccuucgagcaccucggcaacgcccucaccuacgaccccaccaacuacaaggccauccucgccgccggcuccaugaugcagacccacggcgacuucgacgucgcccucaccaaguaccgcgucgucgccugcgccguccccgagucccccccccucuggaacaacaucggcaugugcuucuucggcaagaagaaguacgucgccgccaucuccugccucaagcgcgccaacuaccucgcccccuucgacuggaagauccucuacaaccucggccucguccaccucaccaugcagcaguacgccuccgccuuccacuuccucuccgccgccaucaacuuccagcccaagaugggcgagcucuacaugcuccucgccgucgcccucaccaaccucgaggacaucgagaacgccaagcgcgccuacgccgaggccguccaccucgacaagugcaacccccucgucaaccucaacuacgccguccuccucuacaaccagggcgagaagaagaacgcccucgcccaguaccaggagauggagaagaaggucucccuccucaaggacaacuccucccucgaguucgacuccgagauggucgagauggcccagaagcucggcgccgcccuccaggucggcgaggcccucgucuggaccaagcccgucaaggaccccaaguccaagcaccagaccaccuccaccuccaagcccgccuccuuccagcagccccucggcuccaaccaggcccucggccaggccauguccuccgccgccgccuaccgcacccuccccuccggcgccggcggcaccucccaguucaccaagccccccucccucccccucgagcccgagcccgccgucgaguccucccccaccgagaccuccgagcagauccgcgagaaguga

SEQ ID NO: 40246 - RNA, 1026 nt, Artificial Sequence
  derived and/or modified sequence opt2 from BBS5__Homo_sapiens__NP_689597
auguccguccucgacgcccucugggaggaccgcgacguccgcuucgaccucuccgcccagcagaugaagacccgccccggcgagguccucaucgacugccucgacuccaucgaggacaccaagggcaacaacggcgaccgcggccgccuccucgucaccaaccuccgcauccucuggcacucccucgcccucucccgcgucaacgucuccgucggcuacaacugcauccucaacaucaccacccgcaccgccaacuccaagcuccgcggccagaccgaggcccucuacauccucaccaagugcaacuccacccgcuucgaguucaucuucaccaaccucguccccggcuccccccgccucuucaccuccgucauggccguccaccgcgccuacgagaccuccaagauguaccgcgacuucaagcuccgcuccgcccucauccagaacaagcagcuccgccuccucccccaggagcacgucuacgacaagaucaacggcgucuggaaccucuccuccgaccagggcaaccucggcaccuucuucaucaccaacguccgcaucgucuggcacgccaacaugaacgacuccuucaacgucuccauccccuaccuccagauccgcuccaucaagauccgcgacuccaaguucggccucgcccucgucaucgaguccucccagcaguccggcggcuacguccucggcuucaagaucgaccccgucgagaagcuccaggaguccgucaaggagaucaacucccuccacaaggucuacuccgccucccccaucuucggcgucgacuacgagauggaggagaagccccagccccucgaggcccucaccgucgagcagauccaggacgacgucgagaucgacuccgacggccacaccgacgccuucgucgccuacuucgccgacggcaacaagcagcaggaccgcgagcccgucuucuccgaggagcucggccucgccaucgagaagcucaaggacggcuucacccuccagggccucugggaggucauguccuga

SEQ ID NO: 40247 - RNA, 2019 nt, Artificial Sequence
  derived and/or modified sequence opt2 from BBS7__Homo_sapiens__NP_060660
auggaccucauccucaaccgcauggacuaccuccaggucggcgucaccucccagaagaccaugaagcucauccccgccucccgccaccgcgccacccagaaggucgucaucggcgaccacgacggcgucgucaugugcuucggcaugaagaagggcgaggccgccgccgucuucaagacccuccccggccccaagaucgcccgccucgagcucggcggcgucaucaacaccccccaggagaagaucuucaucgccgccgccuccgagauccgcggcuucaccaagcgcggcaagcaguuccucuccuucgagaccaaccucaccgaguccaucaaggccaugcacaucuccggcuccgaccucuuccucuccgccuccuacaucuacaaccacuacugcgacugcaaggaccagcacuacuaccucuccggcgacaagaucaacgacgucaucugccuccccgucgagcgccucucccgcaucacccccguccucgccugccaggaccgcguccuccgcguccuccagggcuccgacgucauguacgccgucgagguccccggcccccccaccguccucgcccuccacaacggcaacggcggcgacuccggcgaggaccuccucuucggcaccuccgacggcaagcucgcccucauccagaucaccaccuccaagcccguccgcaagugggagauccagaacgagaagaagcgcggcggcauccucugcaucgacuccuucgacaucgucggcgacggcgucaaggaccuccucgucggccgcgacgacggcauggucgaggucuacuccuucgacaacgccaacgagcccguccuccgcuucgaccagaugcucuccgaguccgucaccuccauccagggcggcugcgucggcaaggacuccuacgacgagaucgucgucuccaccuacuccggcugggucaccggccucaccaccgagcccauccacaaggaguccggccccggcgaggagcucaagaucaaccaggagaugcagaacaagaucuccucccuccgcaacgagcucgagcaccuccaguacaagguccuccaggagcgcgagaacuaccagcaguccucccaguccuccaaggccaaguccgccguccccuccuucggcaucaacgacaaguucacccucaacaaggacgacgccuccuacucccucauccucgagguccagaccgccaucgacaacguccucauccaguccgacguccccaucgaccuccucgacgucgacaagaacuccgccgucgucuccuucuccuccugcgacuccgaguccaacgacaacuuccuccucgccaccuaccgcugccaggccgacaccacccgccucgagcucaagauccgcuccaucgagggccaguacggcacccuccaggccuacgucaccccccgcauccagcccaagaccugccagguccgccaguaccacaucaagccccucucccuccaccagcgcacccacuucaucgaccacgaccgccccaugaacacccucacccucaccggccaguucuccuucgccgagguccacuccugggucgucuucugccuccccgagguccccgagaagccccccgccggcgagugcgucaccuucuacuuccagaacaccuuccucgacacccagcucgaguccaccuaccgcaagggcgagggcgucuucaaguccgacaacaucuccaccaucuccauccucaaggacguccucuccaaggaggccaccaagcgcaagaucaaccucaacaucuccuacgagaucaacgaggucuccgucaagcacacccucaagcucauccaccccaagcucgaguaccagcuccuccucgccaagaagguccagcucaucgacgcccucaaggagcuccagauccacgagggcaacaccaacuuccucauccccgaguaccacugcauccucgaggaggccgaccaccuccaggaggaguacaagaagcagcccgcccaccucgagcgccucuacggcuga

SEQ ID NO: 40248 - RNA, 2559 nt, Artificial Sequence
  derived and/or modified sequence opt2 from BBS9__Homo_sapiens__NP_001028776
augucccucuucaaggcccgcgacuggugguccaccauccucggcgacaaggaggaguucgaccagggcugccucugccucgccaacgucgacaacuccggcaacggccaggacaagaucaucgucggcuccuucaugggcuaccuccgcaucuucuccccccaccccgccaagaccggcgacggcgcccaggccgaggaccuccuccucgaggucgaccuccgcgaccccguccuccaggucgaggucggcaaguucgucuccggcaccgagaugcuccaccucgccguccuccacucccgcaagcucugcgucuacuccgucuccggcacccucggcaacgucgagcacggcaaccagugccagaugaagcucauguacgagcacaaccuccagcgcaccgccugcaacaugaccuacggcuccuucggcggcgucaagggccgcgaccucaucugcauccaguccauggacggcaugcucauggucuucgagcaggaguccuacgccuucggccgcuuccuccccggcuuccuccuccccggcccccucgccuacuccucccgcaccgacuccuuccucaccgucuccuccugccagcaggucgaguccuacaaguaccagguccucgccuucgccaccgacgccgacaagcgccaggagaccgagcagcagaagcucggcuccggcaagcgccucgucgucgacuggacccucaacaucggcgagcaggcccucgacaucugcaucgucuccuucaaccaguccgccuccuccgucuucguccucggcgagcgcaacuucuucugccucaaggacaacggccagauccgcuucaugaagaagcucgacuggucccccuccugcuuccuccccuacugcuccgucuccgagggcaccaucaacacccucaucggcaaccacaacaacaugcuccacaucuaccaggacgucacccucaagugggccacccagcucccccacauccccgucgccguccgcgucggcugccuccacgaccucaagggcgucaucgucacccucuccgacgacggccaccuccagugcuccuaccucggcaccgaccccucccucuuccaggcccccaacguccagucccgcgagcucaacuacgacgagcucgacgucgagaugaaggagcuccagaagaucaucaaggacgucaacaagucccagggcgucuggcccaugaccgagcgcgaggacgaccucaacgucuccgucgucgucucccccaacuucgacuccgucucccaggccaccgacgucgaggucggcaccgaccucguccccuccgucaccgucaaggucacccuccagaaccgcgucauccuccagaaggccaagcucuccgucuacguccagcccccccucgagcucaccugcgaccaguucaccuucgaguucaugaaccgcaaccccgacggcaucccccgcgucauccagugcaaguuccgccucccccucaagcucaucugccuccccggccagcccuccaagaccgccucccacaagaucaccaucgacaccaacaagucccccgucucccuccucucccucuuccccggcuucgccucccaguccgacgacgaccaggucaacgucaugggcuuccacuuccucggcggcgcccgcaucaccguccucgccuccaagaccucccagcgcuaccgcauccaguccgagcaguucgaggaccucuggcucaucaccaacgagcucauccuccgccuccaggaguacuucgagaagcagggcgucaaggacuucgccugcuccuucuccggcuccaucccccuccaggaguacuucgagcucaucgaccaccacuucgagcuccgcaucaacggcgagaagcucgaggagcuccucuccgagcgcgccguccaguuccgcgccauccagcgccgccuccucgcccgcuucaaggacaagacccccgccccccuccagcaccucgacacccuccucgacggcaccuacaagcaggucaucgcccucgccgacgccgucgaggagaaccagggcaaccucuuccaguccuucacccgccucaaguccgccacccaccucgucauccuccucaucgcccucuggcagaagcucuccgccgaccaggucgccauccucgaggccgccuuccucccccuccaggaggacacccaggagcucggcugggaggagaccgucgacgccgccaucucccaccuccucaagaccugccucuccaaguccuccaaggagcaggcccucaaccucaacucccagcucaacauccccaaggacaccucccagcucaagaagcacaucacccuccucugcgaccgccucuccaagggcggccgccucugccucuccaccgacgccgccgccccccagaccauggucaugcccggcggcugcaccaccauccccgaguccgaccucgaggagcgcuccgucgagcaggacuccaccgagcucuucaccaaccaccgccaccucaccgccgagaccccccgccccgaggucuccccccuccagggcgucuccgaguga

SEQ ID NO: 40249 - RNA, 2826 nt, Artificial Sequence
  derived and/or modified sequence opt2 from BBX__Homo_sapiens__NP_001136040
augaagggcuccaaccgcaacaaggaccacuccgccgagggcgagggcgucggcaagcgccccaagcgcaagugccuccaguggcacccccuccucgccaagaagcuccucgacuucuccgaggaggaggaggaggaggacgaggaggaggacaucgacaagguccagcuccucggcgccgacggccucgagcaggacgucggcgagaccgaggacgacgagucccccgagcagcgcgcccgccgccccaugaacgccuuccuccucuucugcaagcgccaccgcucccucguccgccaggagcacccccgccucgacaaccgcggcgccaccaagauccucgccgacuggugggccguccucgaccccaaggagaagcagaaguacaccgacauggccaaggaguacaaggacgccuucaugaaggccaaccccggcuacaaguggugccccaccaccaacaagcccgucaagucccccacccccaccgucaacccccgcaagaagcucugggccuuccccuccgacuccucccgcgaccuccccucccccaagaaggccaagaccgaggagaugccccagcucaacuucggcauggccgaccccacccagaugggcggccucuccaugcuccuccucgccggcgagcacgcccucggcacccccgaggucuccuccggcaccugccgccccgacgucuccgagucccccgagcuccgccagaaguccccccucuuccaguucgccgagaucuccuccuccaccucccacuccgacgccuccaccaagcagugccagaccuccgcccucuuccaguucgccgagaucuccuccaacaccucccagcucggcggcgccgagcccgucaagcgcugcggcaaguccgcccucuuccagcucgccgagaugugccucgccuccgagggcaugaagauggaggaguccaagcucaucaaggccaaggaguccgacggcggccgcaucaaggagcucgagaagggcaaggaggagaaggagaucaagauggagaagaccgacgagacccgccuccagaaggaggccgaguucgagaaguccgccaaggagaaccuccgcgacuccaaggagcuccgcaacuucgaggcccuccagaucgacgacaucauggccaucaagauggaggaccccaaggagauccgcaaggaggagcucgaggaggaccacaagugcucccacuuccccgacuucuccuacuccgccuccuccaagaucaucaucuccgacguccccucccgcaaggaccacaugugccacccccacggcaucaugaucaucgaggaccccgccgcccucaacaagcccgagaagcucaagaagaagaagaagaaguccaagauggaccgccacggcaacgacaaguccacccccaagaagaccugcaagaagcgccaguccuccgaguccgacaucgaguccgucaucuacaccaucgaggccgucgccaagggcgacuggggcaucgagaagcucggcgacaccccccgcaagaagguccgcaccuccuccuccggcaagggcuccauccucgacgccaagccccccaagaagaaggucaagucccgcgagaagaagauguccaaggagaaguccuccgacaccaccaaggagucccgcccccccgacuucaucuccaucuccgccuccaagaacaucuccggcgagacccccgagggcaucaaggccgagccccucacccccauggaggacgcccucccccccucccucuccggccaggccaagcccgaggacuccgacugccaccgcaagaucgagaccugcggcucccgcaaguccgagcgcuccugcaagggcgcccucuacaagacccucgucuccgagggcaugcucaccucccuccgcgccaacgucgaccgcggcaagcgcuccuccggcaagggcaacuccuccgaccacgagggcugcuggaacgaggaguccuggaccuucucccaguccggcaccuccggcuccaagaaguucaagaagaccaagcccaaggaggacugccuccucggcuccgccaagcucgacgaggaguucgagaagaaguucaacucccucccccaguacucccccgucaccuucgaccgcaagugcguccccgucccccgcaagaagaagaagaccggcaacgucuccuccgagcccaccaagaccuccaagggccccuuccagucccagaagaagaaccucuuccacaagaucgucuccaaguacaagcacaagaaggagaagcccaacguccccgagaagggcuccggcgacaagugguccaacaagcagcucuuccucgacgccauccaccccaccgaggccaucuucuccgaggaccgcaacaccauggagcccguccacaaggucaagaacauccccuccaucuucaacacccccgagcccaccaccacccaggagccccucgucggcucccagaagcgcaaggcccgcaagaccaagaucacccaccucguccgcaccgccgacggccgcgucucccccgccggcggcacccucgacgacaagcccaaggagcagcuccagcgcucccuccccaaggccaccgagaccgacugcaacgacaagugcucccacaacaccgaggucggcgagacccgcuccuccacccccgagaugcccgccgucuccgccuucuucucccucgccgcccucgccgaggucgccgccauggagaacguccaccgcggccagcgcuccaccccccucacccacgacggccagcccaaggagaugccccaggcccccguccucaucuccugcgccgaccaguga

SEQ ID NO: 40250 - RNA, 1767 nt, Artificial Sequence
  derived and/or modified sequence opt2 from BCAM__Homo_sapiens__NP_001013275
auggagccccccgacgcccccgcccaggcccgcggcgccccccgccuccuccuccucgccguccuccucgccgcccaccccgacgcccaggccgagguccgccucuccguccccccccucgucgaggucaugcgcggcaaguccgucauccucgacugcacccccaccggcacccacgaccacuacaugcucgagugguuccucaccgaccgcuccggcgcccgcccccgccucgccuccgccgagaugcagggcuccgagcuccaggucaccaugcacgacacccgcggccgcuccccccccuaccagcucgacucccagggccgccucguccucgccgaggcccaggucggcgacgagcgcgacuacgucugcgucguccgcgccggcgccgccggcaccgccgaggccaccgcccgccucaacgucuucgccaagcccgaggccaccgaggucucccccaacaagggcacccucuccgucauggaggacuccgcccaggagaucgccaccugcaacucccgcaacggcaaccccgcccccaagaucaccugguaccgcaacggccagcgccucgagguccccgucgagaugaaccccgagggcuacaugaccucccgcaccguccgcgaggccuccggccuccucucccucaccuccacccucuaccuccgccuccgcaaggacgaccgcgacgccuccuuccacugcgccgcccacuacucccuccccgagggccgccacggccgccucgacucccccaccuuccaccucacccuccacuaccccaccgagcacguccaguucugggucggcucccccuccacccccgccggcuggguccgcgagggcgacaccguccagcuccucugccgcggcgacggcucccccucccccgaguacacccucuuccgccuccaggacgagcaggaggagguccucaacgucaaccucgagggcaaccucacccucgagggcgucacccgcggccaguccggcaccuacggcugccgcgucgaggacuacgacgccgccgacgacguccagcucuccaagacccucgagcuccgcgucgccuaccucgacccccucgagcucuccgagggcaagguccucucccucccccucaacuccuccgccgucgucaacugcuccguccacggccuccccacccccgcccuccgcuggaccaaggacuccaccccccucggcgacggccccaugcucucccucuccuccaucaccuucgacuccaacggcaccuacgucugcgaggccucccuccccaccguccccguccucucccgcacccagaacuucacccuccucguccagggcucccccgagcucaagaccgccgagaucgagcccaaggccgacggcuccuggcgcgagggcgacgaggucacccucaucugcuccgcccgcggccaccccgaccccaagcucuccuggucccagcucggcggcucccccgccgagcccauccccggccgccagggcugggucuccuccucccucacccucaaggucaccuccgcccucucccgcgacggcaucuccugcgaggccuccaacccccacggcaacaagcgccacgucuuccacuucggcaccgucuccccccagaccucccaggccggcgucgccgucauggccgucgccgucuccgucggccuccuccuccucgucgucgccgucuucuacugcguccgccgcaagggcggccccugcugccgccagcgccgcgagaagggcgcccccuga

SEQ ID NO: 40251 - RNA, 2016 nt, Artificial Sequence
  derived and/or modified sequence opt2 from BCAN__Homo_sapiens__NP_940819
auggcccagcucuuccucccccuccucgccgcccucguccucgcccaggcccccgccgcccucgccgacguccucgagggcgacuccuccgaggaccgcgccuuccgcguccgcaucgccggcgacgccccccuccagggcguccucggcggcgcccucaccauccccugccacguccacuaccuccgccccccccccucccgccgcgccguccucggcuccccccgcgucaaguggaccuuccucucccgcggccgcgaggccgagguccucgucgcccgcggcguccgcgucaaggucaacgaggccuaccgcuuccgcgucgcccuccccgccuaccccgccucccucaccgacgucucccucgcccucuccgagcuccgccccaacgacuccggcaucuaccgcugcgagguccagcacggcaucgacgacuccuccgacgccgucgaggucaaggucaagggcgucgucuuccucuaccgcgagggcuccgcccgcuacgccuucuccuucuccggcgcccaggaggccugcgcccgcaucggcgcccacaucgccacccccgagcagcucuacgccgccuaccucggcggcuacgagcagugcgacgccggcuggcucuccgaccagaccguccgcuaccccauccagaccccccgcgaggccugcuacggcgacauggacggcuuccccggcguccgcaacuacggcgucgucgaccccgacgaccucuacgacgucuacugcuacgccgaggaccucaacggcgagcucuuccucggcgacccccccgagaagcucacccucgaggaggcccgcgccuacugccaggagcgcggcgccgagaucgccaccaccggccagcucuacgccgccugggacggcggccucgaccacugcucccccggcuggcucgccgacggcuccguccgcuaccccaucgucacccccucccagcgcugcggcggcggccuccccggcgucaagacccucuuccucuuccccaaccagaccggcuuccccaacaagcacucccgcuucaacgucuacugcuuccgcgacuccgcccagcccuccgccauccccgaggccuccaaccccgccuccaaccccgccuccgacggccucgaggccaucgucaccgucaccgagacccucgaggagcuccagcucccccaggaggccaccgaguccgagucccgcggcgccaucuacuccauccccaucauggaggacggcggcggcggcuccuccacccccgaggaccccgccgaggccccccgcacccuccucgaguucgagacccaguccauggucccccccaccggcuucuccgaggaggagggcaaggcccucgaggaggaggagaaguacgaggacgaggaggagaaggaggaggaggaggaggaggaggaggucgaggacgaggcccucugggccuggcccuccgagcucuccucccccggccccgaggccucccuccccaccgagcccgccgcccaggaggagucccucucccaggcccccgcccgcgccguccuccagcccggcgccuccccccuccccgacggcgaguccgaggccucccgccccccccgcguccacggcccccccaccgagacccuccccaccccccgcgagcgcaaccucgccucccccucccccuccacccucgucgaggcccgcgaggucggcgaggccaccggcggccccgagcucuccggcgucccccgcggcgaguccgaggagaccggcuccuccgagggcgcccccucccuccuccccgccacccgcgcccccgagggcacccgcgagcucgaggcccccuccgaggacaacuccggccgcaccgcccccgccggcaccuccguccaggcccagcccguccuccccaccgacuccgccucccgcggcggcgucgccgucguccccgccuccggcaacuccgcccagggcuccaccgcccucuccauccuccuccucuucuucccccuccagcucugggucaccuga

SEQ ID NO: 40252 - RNA, 1047 nt, Artificial Sequence
  derived and/or modified sequence opt2 from BCAP29__Homo_sapiens__NP_001008405
augacccuccagugggccgccgucgccaccuuccucuacgccgagaucggccucauccucaucuucugccuccccuucauccccccccagcgcuggcagaagaucuucuccuucaacgucuggggcaagaucgccaccuucuggaacaaggccuuccucaccaucaucauccuccucaucguccucuuccucgacgccguccgcgagguccgcaaguacuccuccguccacaccaucgagaaguccuccaccucccgccccgacgccuacgagcacacccagaugaagcucuuccgcucccagcgcaaccucuacaucuccggcuucucccucuucuucuggcucguccuccgccgccucgucacccucaucacccagcucgccaaggagcucuccaacaagggcguccucaagacccaggccgagaacaccaacaaggccgccaagaaguucauggaggagaacgagaagcucaagcgcauccucaagucccacggcaaggacgaggagugcguccucgaggccgagaacaagaagcucgucgaggaccaggagaagcucaagaccgagcuccgcaagaccuccgacgcccucuccaaggcccagaacgacgucauggagaugaagaugcaguccgagcgccucuccaaggaguacgaccagcuccucaaggagcacuccgagcuccagcacuccuccuucggcgaguuccucuccaagcgcucccacaagaacggcuccaucggcaagcagaccggcucccgcaagggcuccuuccgcaagcgccagcaggagaagaccgucaacuucaucaaggacaccugcaacauccucugccagaacgacaacuucgucaugcucgccucccgcaaguucaaguuccgcaagaugcacuacgaccgcuucgucaucuuccucaugccccacaucggcugcaucgucauggcccucuccaaguaccucaugauguuccagaucuacugcaaggucugcauccccgcccucaagaagaacaucuccaugcucaacaccaucuucaccuacuga

SEQ ID NO: 40253 - RNA, 942 nt, Artificial Sequence
  derived and/or modified sequence opt2 from BCAP31__Homo_sapiens__NP_001132929
augggcgccgaggccuccuccuccuggugccccggcaccgcccuccccgaggagcgccucuccgucaagcgcgccuccgagaucuccggcuuccucggccagggcuccuccggcgaggccgcccucgacguccucacccacguccucgagggcgccggcaacaagcucaccuccuccugcggcaagcccuccuccaaccgcaugucccuccaguggaccgccgucgccaccuuccucuacgccgaggucuucgucguccuccuccucugcauccccuucaucucccccaagcgcuggcagaagaucuucaagucccgccucgucgagcuccucgucuccuacggcaacaccuucuucgucguccucaucgucauccucguccuccucgucaucgacgccguccgcgagauccgcaaguacgacgacgucaccgagaaggucaaccuccagaacaaccccggcgccauggagcacuuccacaugaagcucuuccgcgcccagcgcaaccucuacaucgccggcuucucccuccuccucuccuuccuccuccgccgccucgucacccucaucucccagcaggccacccuccucgccuccaacgaggccuucaagaagcaggccgaguccgccuccgaggccgccaagaaguacauggaggagaacgaccagcucaagaagggcgccgccgucgacggcggcaagcucgacgucggcaacgccgaggucaagcucgaggaggagaaccgcucccucaaggccgaccuccagaagcucaaggacgagcucgccuccaccaagcagaagcucgagaaggccgagaaccagguccucgccaugcgcaagcaguccgagggccucaccaaggaguacgaccgccuccucgaggagcacgccaagcuccaggccgccgucgacggccccauggacaagaaggaggaguga

SEQ ID NO: 40254 - RNA, 2751 nt, Artificial Sequence
  derived and/or modified sequence opt2 from BCAR1__Homo_sapiens__NP_001164185
augcccgccaagcccuuccucuccuccguccuccucuccuggaagguccucgacuucuccggccccggcccccagggcaccggccagcccugcuccugcggccacugggccgagggccagggcggcccccccgagcccgccggcggccccaacguccucgccaaggcccucuacgacaacgucgccgagucccccgacgagcucuccuuccgcaagggcgacaucaugaccguccucgagcaggacacccagggccucgacggcugguggcucugcucccuccacggccgccagggcaucguccccggcaaccgccucaagauccucgucggcauguacgacaagaagcccgccggccccggccccggcccccccgccacccccgcccagccccagcccggccuccacgcccccgccccccccgccucccaguacacccccaugcuccccaacaccuaccagccccagcccgacuccgucuaccucguccccacccccuccaaggcccagcagggccucuaccagguccccggccccuccccccaguuccaguccccccccgccaagcagaccuccaccuucuccaagcagaccccccaccaccccuuccccucccccgccaccgaccucuaccaggucccccccggccccggcggccccgcccaggacaucuaccaggucccccccuccgccggcaugggccacgacaucuaccaggucccccccuccauggacacccgcuccugggagggcaccaagccccccgccaaggucgucguccccacccgcgucggccagggcuacgucuacgaggccgcccagcccgagcaggacgaguacgacaucccccgccaccuccucgcccccggcccccaggacaucuacgacgucccccccguccgcggccuccuccccucccaguacggccaggaggucuacgacaccccccccauggccgucaagggccccaacggccgcgacccccuccucgaggucuacgacgucccccccuccgucgagaagggccucccccccuccaaccaccacgccgucuacgacgucccccccuccgucuccaaggacguccccgacggcccccuccuccgcgaggagaccuacgacgucccccccgccuucgccaaggccaagcccuucgaccccgcccgcaccccccucguccucgccgcccccccccccgacuccccccccgccgaggacgucuacgacguccccccccccgcccccgaccucuacgacgucccccccggccuccgccgccccggccccggcacccucuacgacgucccccgcgagcgcguccucccccccgaggucgccgacggcggcgucgucgacuccggcgucuacgccguccccccccccgccgagcgcgaggcccccgccgagggcaagcgccucuccgccuccuccaccggcuccacccgcuccucccaguccgccuccucccucgaggucgccggccccggccgcgagccccucgagcucgaggucgccgucgaggcccucgcccgccuccagcagggcgucuccgccaccgucgcccaccuccucgaccucgccggcuccgccggcgccaccggcuccuggcgcucccccuccgagccccaggagccccucguccaggaccuccaggccgccgucgccgccguccaguccgccguccacgagcuccucgaguucgcccgcuccgccgucggcaacgccgcccacaccuccgaccgcgcccuccacgccaagcucucccgccagcuccagaagauggaggacguccaccagacccucgucgcccacggccaggcccucgacgccggccgcggcggcuccggcgccacccucgaggaccucgaccgccucgucgccugcucccgcgccguccccgaggacgccaagcagcucgccuccuuccuccacggcaacgccucccuccucuuccgccgcaccaaggccaccgcccccggccccgagggcggcggcacccuccaccccaaccccaccgacaagaccuccuccauccagucccgcccccuccccuccccccccaaguucaccucccaggacucccccgacggccaguacgagaacuccgagggcggcuggauggaggacuacgacuacguccaccuccagggcaaggaggaguucgagaagacccagaaggagcuccucgagaagggcuccaucacccgccagggcaagucccagcucgagcuccagcagcucaagcaguucgagcgccucgagcaggaggucucccgccccaucgaccacgaccucgccaacuggacccccgcccagccccucgcccccggccgcaccggcggccucggccccuccgaccgccagcuccuccucuucuaccucgagcagugcgaggccaaccucaccacccucaccaacgccgucgacgccuucuucaccgccgucgccaccaaccagccccccaagaucuucgucgcccacuccaaguucgucauccucuccgcccacaagcucgucuucaucggcgacacccucucccgccaggccaaggccgccgacguccgcucccaggucacccacuacuccaaccuccucugcgaccuccuccgcggcaucgucgccaccaccaaggccgccgcccuccaguaccccucccccuccgccgcccaggacauggucgagcgcgucaaggagcucggccacuccacccagcaguuccgccgcguccucggccagcucgccgccgccuga

SEQ ID NO: 40255 - RNA, 1755 nt, Artificial Sequence
  derived and/or modified sequence opt2 from BCAS1__Homo_sapiens__NP_003648
augggcaaccagauguccgucccccagcgcgucgaggaccaggagaacgagcccgaggccgagaccuaccaggacaacgccuccgcccucaacggcguccccgucgucgucuccacccacaccguccagcaccucgaggaggucgaccucggcaucuccgucaagaccgacaacgucgccaccuccucccccgagaccaccgagaucuccgccgucgccgacgccaacggcaagaaccucggcaaggaggccaagcccgaggcccccgccgccaagucccgcuucuuccucaugcucucccgccccguccccggccgcaccggcgaccaggccgccgacuccucccucggcuccgucaagcucgacgucuccuccaacaaggcccccgccaacaaggaccccuccgaguccuggacccuccccgucgccgccggccccggccaggacaccgacaagacccccggccacgcccccgcccaggacaagguccucuccgccgcccgcgaccccacccuccucccccccgagaccggcggcgccggcggcgaggcccccuccaagcccaaggacuccuccuucuucgacaaguucuucaagcucgacaagggccaggagaagguccccggcgacucccagcaggaggccaagcgcgccgagcaccaggacaaggucgacgagguccccggccucuccggccaguccgacgacguccccgccggcaaggacaucgucgacggcaaggagaaggagggccaggagcucggcaccgccgacugcuccguccccggcgaccccgagggccucgagaccgccaaggacgacucccaggccgccgccaucgccgagaacaacaacuccaucauguccuucuucaagacccucgucucccccaacaaggccgagaccaagaaggaccccgaggacaccggcgccgagaagucccccaccaccuccgccgaccucaaguccgacaaggccaacuucaccucccaggagacccagggcgccggcaagaacuccaagggcugcaaccccuccggccacacccaguccgucaccacccccgagcccgccaaggagggcaccaaggagaaguccggccccaccucccucccccucggcaagcucuucuggaagaaguccgucaaggaggacuccguccccaccggcgccgaggagaacgucgucugcgagucccccgucgagaucaucaaguccaaggaggucgaguccgcccuccagaccgucgaccucaacgagggcgacgccgcccccgagcccaccgaggccaagcucaagcgcgaggaguccaagccccgcaccucccucauggccuuccuccgccagauguccgucaagggcgacggcggcaucacccacuccgaggagaucaacggcaaggacuccuccugccagaccuccgacuccaccgagaagaccaucaccccccccgagcccgagcccaccggcgccccccagaagggcaaggagggcuccuccaaggacaagaaguccgccgccgagaugaacaagcagaaguccaacaagcaggaggccaaggagcccgcccagugcaccgagcaggccaccgucgacaccaacucccuccagaacggcgacaagcuccagaagcgccccgagaagcgccagcagucccucggcggcuucuucaagggccucggccccaagcgcaugcucgacgcccagguccagaccgaccccgucuccaucggccccgucggcaaguccaaguga

SEQ ID NO: 40256 - RNA, 2787 nt, Artificial Sequence
  derived and/or modified sequence opt2 from BCAS3__Homo_sapiens__NP_001092902
augaacgaggccauggccaccgacuccccccgccgccccucccgcugcaccggcggcgucgucguccgcccccaggccgucaccgagcaguccuacauggaguccgucgucaccuuccuccaggacgucgucccccaggccuacuccggcaccccccucaccgaggagaaggagaagaucgucuggguccgcuucgagaacgccgaccucaacgacaccucccgcaaccucgaguuccacgagauccacuccaccggcaacgagcccccccuccucaucaugaucggcuacuccgacggcaugcaggucugguccauccccaucuccggcgaggcccaggagcucuucuccguccgccacggccccauccgcgccgcccgcauccuccccgccccccaguucggcgcccagaagugcgacaacuucgccgagaagcgcccccuccucggcgucugcaaguccaucggcuccuccggcaccuccccccccuacugcugcgucgaccucuacucccuccgcaccggcgagauggucaaguccauccaguucaagacccccaucuacgaccuccacugcaacaagcgcauccucgucgucguccuccaggagaagaucgccgccuucgacuccugcaccuucaccaagaaguucuucgucaccuccugcuaccccugccccggccccaacaugaaccccaucgcccucggcucccgcuggcucgccuacgccgagaacaagcucauccgcugccaccagucccgcggcggcgccugcggcgacaacauccaguccuacaccgccaccgucaucuccgccgccaagacccucaaguccggccucaccauggucggcaaggucgucacccagcucaccggcacccuccccuccggcgucaccgaggacgacgucgccauccacuccaacucccgccgcuccccccucguccccggcaucaucaccgucaucgacaccgagaccgucggcgagggccagguccucgucuccgaggacuccgacuccgacggcaucgucgcccacuuccccgcccacgagaagcccgucugcugcauggccuucaacaccuccggcaugcuccucgucaccaccgacacccucggccacgacuuccacgucuuccagauccucacccaccccugguccuccucccagugcgccguccaccaccucuacacccuccaccgcggcgagaccgaggccaagguccaggacaucugcuucucccacgacugccgcugggucgucgucuccacccuccgcggcaccucccacgucuuccccaucaaccccuacggcggccagcccugcguccgcacccacauguccccccgcgucgucaaccgcaugucccgcuuccagaaguccgccggccucgaggagaucgagcaggagcucaccuccaagcagggcggccgcugcucccccguccccggccucuccuccucccccuccggcuccccccuccacggcaagcucaacucccaggacuccuacaacaacuucaccaacaacaaccccggcaacccccgccucuccccccuccccucccucauggucgucaugccccucgcccagaucaagcagcccaugacccucggcaccaucaccaagcgcaccggccccuaccucuucggcgccggcugcuucuccaucaaggcccccugcaaggucaagccccccccccagaucucccccuccaaguccaugggcggcgaguucugcgucgccgccaucuucggcaccucccgcuccugguucgccaacaacgccggccucaagcgcgagaaggaccaguccaagcaggucgucgucgagucccucuacaucaucuccugcuacggcacccucgucgagcacaugauggagccccgcccccucuccaccgcccccaagaucuccgacgacaccccccucgagaugaugaccuccccccgcgccuccuggacccucguccgcaccccccaguggaacgagcuccagccccccuucaacgccaaccacccccuccuccucgccgccgacgccguccaguacuaccaguuccuccucgccggccucgucccccccggcucccccggccccaucacccgccacggcuccuacgacucccucgccuccgaccacuccggccaggaggacgaggaguggcucucccaggucgagaucgucacccacaccggcccccaccgccgccucuggaugggcccccaguuccaguucaagaccauccaccccuccggccagaccaccgucaucuccuccuccuccuccguccuccagucccacggccccuccgacaccccccagccccuccucgacuucgacaccgacgaccucgaccucaacucccuccgcauccagcccguccgcuccgaccccgucuccaugcccggcuccucccgccccgucuccgaccgccgcggcgucuccaccgucaucgacgccgccuccggcaccuucgaccgcuccgucacccuccucgaggucugcggcuccuggcccgagggcuucggccuccgccacauguccuccauggagcacaccgaggagggccuccgcgagcgccucgccgacgccauggccgagucccccucccgcgacgucgucggcuccggcaccgagcuccagcgcgagggcuccaucgagacccucuccaacuccuccggcuccaccuccggcuccaucccccgcaacuucgacggcuaccgcuccccccuccccaccaacgagucccagccccucucccucuuccccaccggcuuccccuga

SEQ ID NO: 40257 - RNA, 477 nt, Artificial Sequence
  derived and/or modified sequence opt2 from BCAS4__Homo_sapiens__NP_001010974
augcagcgcaccggcggcggcgccccccgccccggccgcaaccacggccuccccggcucccuccgccagcccgaccccgucgcccuccucaugcuccucgucgacgccgaccagcccgagcccaugcgcuccggcgcccgcgagcucgcccucuuccucacccccgagcccggcgccgaggccaaggaggucgaggagaccaucgagggcaugcuccuccgccucgaggaguucugcucccucgccgaccucauccgcuccgacaccucccagauccucgaggagaacauccccguccucaaggccaagcucaccgagaugcgcggcaucuacgccaaggucgaccgccucgagaagucccccgcccccguccccgucaccuacgagcuccccacccucuaccgcaccgaggacuacuuccccgucgacgccggcgaggcccagcaccacccccgcaccugcccccgcccccucuga

SEQ ID NO: 40258 - RNA, 1050 nt, Artificial Sequence
  derived and/or modified sequence opt2 from BCAT1__Homo_sapiens__NP_001171562
augaaggacugcuccaacggcugcuccgccgagugcaccggcgagggcggcuccaaggaggucgucggcaccuucaaggccaaggaccucaucgucacccccgccaccauccucaaggagaagcccgaccccaacaaccucgucuucggcaccgucuucaccgaccacaugcucaccgucgagugguccuccgaguucggcugggagaagccccacaucaagccccuccagaaccucucccuccaccccggcuccuccgcccuccacuacgccgucgaggucuucgacaaggaggagcuccucgagugcauccagcagcucgucaagcucgaccaggaguggguccccuacuccaccuccgccucccucuacauccgccccaccuucaucggcaccgagcccucccucggcgucaagaagcccaccaaggcccuccucuucguccuccucucccccgucggccccuacuucuccuccggcaccuucaaccccgucucccucugggccaaccccaaguacguccgcgccuggaagggcggcaccggcgacugcaagaugggcggcaacuacggcuccucccucuucgcccagugcgaggccgucgacaacggcugccagcagguccucuggcucuacggcgaggaccaccagaucaccgaggucggcaccaugaaccucuuccucuacuggaucaacgaggacggcgaggaggagcucgccacccccccccucgacggcaucauccuccccggcgucacccgccgcugcauccucgaccucgcccaccaguggggcgaguucaaggucuccgagcgcuaccucaccauggacgaccucaccaccgcccucgagggcaaccgcguccgcgagauguucggcuccggcaccgccugcgucgucugccccgucuccgacauccucuacaagggcgagaccauccacauccccaccauggagaacggccccaagcucgccucccgcauccucuccaagcucaccgacauccaguacggccgcgaggaguccgacuggaccaucguccucuccuga

SEQ ID NO: 40259 - RNA, 903 nt, Artificial Sequence
  derived and/or modified sequence opt2 from BCAT2__Homo_sapiens__NP_001158245
auggccgccgccgcccucggccagcucuucgagggcaugaaggccuucaagggcaaggaccagcagguccgccucuuccgccccuggcucaacauggaccgcaugcuccgcuccgccaugcgccucugccuccccuccuucgacaagcucgagcuccucgagugcauccgccgccucaucgaggucgacaaggacuggguccccgacgccgccggcaccucccucuacguccgccccguccucaucggcaacgagcccucccucggcgucucccagcccacccgcgcccuccucuucgucauccucugccccgucggcgccuacuuccccggcggcuccgucacccccgucucccuccucgccgaccccgccuucauccgcgccugggucggcggcgucggcaacuacaagcucggcggcaacuacggccccaccguccucguccagcaggaggcccucaagcgcggcugcgagcagguccucuggcucuacggccccgaccaccagcucaccgaggucggcaccaugaacaucuucgucuacuggacccacgaggacggcguccucgagcucgucacccccccccucaacggcgucauccuccccggcgucguccgccagucccuccucgacauggcccagaccuggggcgaguuccgcgucgucgagcgcaccaucaccaugaagcagcuccuccgcgcccucgaggagggccgcguccgcgaggucuucggcuccggcaccgccugccaggucugccccguccaccgcauccucuacaaggaccgcaaccuccacauccccaccauggagaacggccccgagcucauccuccgcuuccagaaggagcucaaggagauccaguacggcauccgcgcccacgaguggauguuccccgucuga

SEQ ID NO: 40260 - RNA, 969 nt, Artificial Sequence
  derived and/or modified sequence opt2 from BCCIP__Homo_sapiens__NP_057651
auggccucccgcuccaagcgccgcgccgucgaguccggcgucccccagccccccgacccccccguccagcgcgacgaggaggaggagaaggaggucgagaacgaggacgaggacgacgacgacuccgacaaggagaaggacgaggaggacgaggucaucgacgaggaggucaacaucgaguucgaggccuacucccucuccgacaacgacuacgacggcaucaagaagcuccuccagcagcucuuccucaaggcccccgucaacaccgccgagcucaccgaccuccucauccagcagaaccacaucggcuccgucaucaagcagaccgacgucuccgaggacuccaacgacgacauggacgaggacgaggucuucggcuucaucucccuccucaaccucaccgagcgcaagggcacccagugcgucgagcagauccaggagcucguccuccgcuucugcgagaagaacugcgagaaguccauggucgagcagcucgacaaguuccucaacgacaccaccaagcccgucggccuccuccucuccgagcgcuucaucaacguccccccccagaucgcccuccccauguaccagcagcuccagaaggagcucgccggcgcccaccgcaccaacaagcccugcggcaagugcuacuucuaccuccucaucuccaagaccuucgucgaggccggcaagaacaacuccaagaagaagcccuccaacaagaagaaggccgcccucauguucgccaacgccgaggaggaguucuucuacgaggagcagggcaagcccgagguccucggcggccccgacacccgccgcggccucgagcccguccccauccagcacaacggcggcucccgcggccaggucaccgcccucgucucccucaaggccggccucauccagucccgcuccacccucuccgacuuccagggcaccuucaugaccgucggcaucgcccucuccuga

SEQ ID NO: 40261 - RNA, 879 nt, Artificial Sequence
  derived and/or modified sequence opt2 from BCDIN3D__Homo_sapiens__NP_859059
auggccguccccaccgagcucgacggcggcuccgucaaggagaccgccgccgaggaggagucccgcguccucgcccccggcgccgcccccuucggcaacuucccccacuacucccgcuuccacccccccgagcagcgccuccgccuccucccccccgagcuccuccgccagcucuuccccgagucccccgagaacggccccauccucggccucgacgucggcugcaacuccggcgaccucuccgucgcccucuacaagcacuuccucucccuccccgacggcgagaccugcuccgacgccucccgcgaguuccgccuccucugcugcgacaucgaccccguccucgucaagcgcgccgagaaggagugccccuuccccgacgcccucaccuucaucacccucgacuucaugaaccagcgcacccgcaagguccuccucuccuccuuccucucccaguucggccgcuccgucuucgacaucggcuucugcauguccaucaccauguggauccaccucaaccacggcgaccacggccucugggaguuccucgcccaccucuccucccucugccacuaccuccucgucgagccccagcccuggaagugcuaccgcgccgccgcccgccgccuccgcaagcucggccuccacgacuucgaccacuuccacucccucgccauccgcggcgacaugcccaaccagaucguccagauccucacccaggaccacggcauggagcucaucugcugcuucggcaacaccuccugggaccgcucccuccuccucuuccgcgccaagcagaccaucgagacccaccccauccccgagucccucaucgagaagggcaaggagaagaaccgccucuccuuccagaagcaguga

SEQ ID NO: 40262 - RNA, 1809 nt, Artificial Sequence
  derived and/or modified sequence opt2 from BCHE__Homo_sapiens__NP_000046
augcacuccaaggucaccaucaucugcauccgcuuccucuucugguuccuccuccucugcaugcucaucggcaagucccacaccgaggacgacaucaucaucgccaccaagaacggcaagguccgcggcaugaaccucaccgucuucggcggcaccgucaccgccuuccucggcauccccuacgcccagcccccccucggccgccuccgcuucaagaagccccagucccucaccaagugguccgacaucuggaacgccaccaaguacgccaacuccugcugccagaacaucgaccaguccuuccccggcuuccacggcuccgagauguggaaccccaacaccgaccucuccgaggacugccucuaccucaacgucuggauccccgcccccaagcccaagaacgccaccguccucaucuggaucuacggcggcggcuuccagaccggcaccuccucccuccacgucuacgacggcaaguuccucgcccgcgucgagcgcgucaucgucgucuccaugaacuaccgcgucggcgcccucggcuuccucgcccuccccggcaaccccgaggcccccggcaacaugggccucuucgaccagcagcucgcccuccaguggguccagaagaacaucgccgccuucggcggcaaccccaaguccgucacccucuucggcgaguccgccggcgccgccuccgucucccuccaccuccucucccccggcucccacucccucuucacccgcgccauccuccaguccggcuccuucaacgcccccugggccgucaccucccucuacgaggcccgcaaccgcacccucaaccucgccaagcucaccggcugcucccgcgagaacgagaccgagaucaucaagugccuccgcaacaaggacccccaggagauccuccucaacgaggccuucgucguccccuacggcaccccccucuccgucaacuucggccccaccgucgacggcgacuuccucaccgacaugcccgacauccuccucgagcucggccaguucaagaagacccagauccucgucggcgucaacaaggacgagggcaccgccuuccucgucuacggcgcccccggcuucuccaaggacaacaacuccaucaucacccgcaaggaguuccaggagggccucaagaucuucuuccccggcgucuccgaguucggcaaggaguccauccucuuccacuacaccgacugggucgacgaccagcgccccgagaacuaccgcgaggcccucggcgacgucgucggcgacuacaacuucaucugccccgcccucgaguucaccaagaaguucuccgaguggggcaacaacgccuucuucuacuacuucgagcaccgcuccuccaagcuccccuggcccgaguggaugggcgucaugcacggcuacgagaucgaguucgucuucggccucccccucgagcgccgcgacaacuacaccaaggccgaggagauccucucccgcuccaucgucaagcgcugggccaacuucgccaaguacggcaaccccaacgagacccagaacaacuccaccuccuggcccgucuucaaguccaccgagcagaaguaccucacccucaacaccgaguccacccgcaucaugaccaagcuccgcgcccagcagugccgcuucuggaccuccuucuuccccaagguccucgagaugaccggcaacaucgacgaggccgagugggaguggaaggccggcuuccaccgcuggaacaacuacaugauggacuggaagaaccaguucaacgacuacaccuccaagaaggaguccugcgucggccucuga

SEQ ID NO: 40263 - RNA, 1338 nt, Artificial Sequence
  derived and/or modified sequence opt2 from BCKDHA__Homo_sapiens__NP_000700
auggccgucgccaucgccgccgcccgcgucuggcgccucaaccgcggccucucccaggccgcccuccuccuccuccgccagcccggcgcccgcggccucgcccgcucccaccccccccgccagcagcagcaguucuccucccucgacgacaagccccaguuccccggcgccuccgccgaguucaucgacaagcucgaguucauccagcccaacgucaucuccggcauccccaucuaccgcgucauggaccgccagggccagaucaucaaccccuccgaggacccccaccuccccaaggagaagguccucaagcucuacaaguccaugacccuccucaacaccauggaccgcauccucuacgagucccagcgccagggccgcaucuccuucuacaugaccaacuacggcgaggagggcacccacgucggcuccgccgccgcccucgacaacaccgaccucgucuucggccaguaccgcgaggccggcguccucauguaccgcgacuacccccucgagcucuucauggcccagugcuacggcaacaucuccgaccucggcaagggccgccagaugcccguccacuacggcugcaaggagcgccacuucgucaccaucuccuccccccucgccacccagaucccccaggccgucggcgccgccuacgccgccaagcgcgccaacgccaaccgcgucgucaucugcuacuucggcgagggcgccgccuccgagggcgacgcccacgccggcuucaacuucgccgccacccucgagugccccaucaucuucuucugccgcaacaacggcuacgccaucuccacccccaccuccgagcaguaccgcggcgacggcaucgccgcccgcggccccggcuacggcaucauguccauccgcgucgacggcaacgacgucuucgccgucuacaacgccaccaaggaggcccgccgccgcgccgucgccgagaaccagcccuuccucaucgaggccaugaccuaccgcaucggccaccacuccaccuccgacgacuccuccgccuaccgcuccgucgacgaggucaacuacugggacaagcaggaccaccccaucucccgccuccgccacuaccuccucucccagggcuggugggacgaggagcaggagaaggccuggcgcaagcagucccgccgcaaggucauggaggccuucgagcaggccgagcgcaagcccaagcccaaccccaaccuccucuucuccgacgucuaccaggagaugcccgcccagcuccgcaagcagcaggagucccucgcccgccaccuccagaccuacggcgagcacuacccccucgaccacuucgacaaguga

SEQ ID NO: 40264 - RNA, 1179 nt, Artificial Sequence
  derived and/or modified sequence opt2 from BCKDHB__Homo_sapiens__NP_000047
auggccgucgucgccgccgccgccggcuggcuccuccgccuccgcgccgccggcgccgagggccacuggcgccgccuccccggcgccggccucgcccgcggcuuccuccaccccgccgccaccgucgaggacgccgcccagcgccgccaggucgcccacuucaccuuccagcccgaccccgagccccgcgaguacggccagacccagaagaugaaccucuuccaguccgucaccuccgcccucgacaacucccucgccaaggaccccaccgccgucaucuucggcgaggacgucgccuucggcggcgucuuccgcugcaccgucggccuccgcgacaaguacggcaaggaccgcgucuucaacaccccccucugcgagcagggcaucgucggcuucggcaucggcaucgccgucaccggcgccaccgccaucgccgagauccaguucgccgacuacaucuuccccgccuucgaccagaucgucaacgaggccgccaaguaccgcuaccgcuccggcgaccucuucaacugcggcucccucaccauccgcucccccuggggcugcgucggccacggcgcccucuaccacucccagucccccgaggccuucuucgcccacugccccggcaucaaggucgucaucccccgcucccccuuccaggccaagggccuccuccucuccugcaucgaggacaagaaccccugcaucuucuucgagcccaagauccucuaccgcgccgccgccgaggagguccccaucgagcccuacaacaucccccucucccaggccgaggucauccaggagggcuccgacgucacccucgucgccuggggcacccagguccacgucauccgcgaggucgccuccauggccaaggagaagcucggcgucuccugcgaggucaucgaccuccgcaccaucauccccugggacgucgacaccaucugcaaguccgucaucaagaccggccgccuccucaucucccacgaggccccccucaccggcggcuucgccuccgagaucuccuccaccguccaggaggagugcuuccucaaccucgaggcccccaucucccgcgucugcggcuacgacacccccuucccccacaucuucgagcccuucuacauccccgacaaguggaagugcuacgacgcccuccgcaagaugaucaacuacuga

SEQ ID NO: 40265 - RNA, 1098 nt, Artificial Sequence
  derived and/or modified sequence opt2 from BCKDK__Homo_sapiens__NP_001116429
augauccucgccuccguccuccgcuccggccccggcggcggccucccccuccgcccccuccucggccccgcccucgcccuccgcgcccgcuccaccuccgccaccgacacccaccacgucgagauggcccgcgagcgcuccaagaccgucaccuccuucuacaaccaguccgccaucgacgccgccgccgagaagcccuccguccgccucacccccaccaugaugcucuacgccggccgcucccaggacggcucccaccuccucaaguccgcccgcuaccuccagcaggagcuccccguccgcaucgcccaccgcaucaagggcuuccgcugccuccccuucaucaucggcugcaaccccaccauccuccacguccacgagcucuacauccgcgccuuccagaagcucaccgacuucccccccaucaaggaccaggccgacgaggcccaguacugccagcucguccgccagcuccucgacgaccacaaggacgucgucacccuccucgccgagggccuccgcgagucccgcaagcacaucgaggacgagaagcucguccgcuacuuccucgacaagacccucaccucccgccucggcauccgcaugcucgccacccaccaccucgcccuccacgaggacaagcccgacuucgucggcaucaucugcacccgccucucccccaagaagaucaucgagaagugggucgacuucgcccgccgccucugcgagcacaaguacggcaacgccccccgcguccgcaucaacggccacgucgccgcccgcuuccccuucauccccaugccccucgacuacauccuccccgagcuccucaagaacgccaugcgcgccaccauggagucccaccucgacacccccuacaacguccccgacgucgucaucaccaucgccaacaacgacgucgaccucaucauccgcaucuccgaccgcggcggcggcaucgcccacaaggaccucgaccgcgucauggacuaccacuucaccaccgccgaggccuccacccaggacccccgcaucuccccccucuucggccaccucgacaugcacuccggcgcccaguccggccccaugcacggcuga

SEQ ID NO: 40266 - RNA, 648 nt, Artificial Sequence
  derived and/or modified sequence opt2 from BCL10__Homo_sapiens__XP_011540701
auggcccucgagaaccuccgcgucuaccucugcgagaagaucaucgccgagcgccacuucgaccaccuccgcgccaagaagauccucucccgcgaggacaccgaggagaucuccugccgcaccuccucccgcaagcgcgccggcaagcuccucgacuaccuccaggagaaccccaagggccucgacacccucgucgaguccauccgccgcgagaagacccagaacuuccucauccagaagaucaccgacgagguccucaagcuccgcaacaucaagcucgagcaccucaagggccucaagugcuccuccugcgagcccuuccccgacggcgccaccaacaaccucucccgcuccaacuccgacgaguccaacuucuccgagaagcuccgcgccuccaccgucauguaccaccccgagggcgaguccuccaccacccccuucuucuccaccaacuccucccucaaccuccccguccucgaggucggccgcaccgagaacaccaucuucuccuccaccacccucccccgccccggcgaccccggcgcccccccccucccccccgaccuccagcucgaggaggagggcaccugcgccaacuccuccgagauguuccucccccuccgcucccgcaccgucucccgccaguga

SEQ ID NO: 40267 - RNA, 2322 nt, Artificial Sequence
  derived and/or modified sequence opt2 from BCL11A__Homo_sapiens__NP_060484
augucccgccgcaagcagggcaagccccagcaccucuccaagcgcgaguucucccccgagccccucgaggccauccucaccgacgacgagcccgaccacggcccccucggcgcccccgagggcgaccacgaccuccucaccugcggccagugccagaugaacuucccccucggcgacauccucaucuucaucgagcacaagcgcaagcagugcaacggcucccucugccucgagaaggccgucgacaagccccccucccccucccccaucgagaugaagaaggccuccaaccccgucgaggucggcauccaggucacccccgaggacgacgacugccucuccaccuccucccgcggcaucugccccaagcaggagcacaucgccgacaagcuccuccacuggcgcggccucuccuccccccgcuccgcccacggcgcccucauccccacccccggcauguccgccgaguacgccccccagggcaucugcaaggacgagcccuccuccuacaccugcaccaccugcaagcagcccuucaccuccgccugguuccuccuccagcacgcccagaacacccacggccuccgcaucuaccucgaguccgagcacggcuccccccucaccccccgcgucggcauccccuccggccucggcgccgagugccccucccagcccccccuccacggcauccacaucgccgacaacaaccccuucaaccuccuccgcauccccggcuccgucucccgcgaggccuccggccucgccgagggccgcuucccccccacccccccccucuucuccccccccccccgccaccaccucgacccccaccgcaucgagcgccucggcgccgaggagauggcccucgccacccaccaccccuccgccuucgaccgcguccuccgccucaaccccauggccauggagccccccgccauggacuucucccgccgccuccgcgagcucgccggcaacaccuccucccccccccucucccccggccgccccucccccaugcagcgccuccuccagcccuuccagcccggcuccaagccccccuuccucgccacccccccccuccccccccuccaguccgcccccccccccucccagccccccgucaaguccaaguccugcgaguucugcggcaagaccuucaaguuccaguccaaccucgucguccaccgccgcucccacaccggcgagaagcccuacaagugcaaccucugcgaccacgccugcacccaggccuccaagcucaagcgccacaugaagacccacaugcacaaguccucccccaugaccgucaaguccgacgacggccucuccaccgccuccucccccgagcccggcaccuccgaccucgucggcuccgccuccuccgcccucaaguccgucgucgccaaguucaaguccgagaacgaccccaaccucauccccgagaacggcgacgaggaggaggaggaggacgacgaggaggaggaggaggaggaggaggaggaggaggaggagcucaccgaguccgagcgcgucgacuacggcuucggccucucccucgaggccgcccgccaccacgagaacuccucccgcggcgccgucgucggcgucggcgacgagucccgcgcccuccccgacgucaugcagggcaugguccucuccuccaugcagcacuucuccgaggccuuccaccagguccucggcgagaagcacaagcgcggccaccucgccgaggccgagggccaccgcgacaccugcgacgaggacuccgucgccggcgaguccgaccgcaucgacgacggcaccgucaacggccgcggcugcucccccggcgaguccgccuccggcggccucuccaagaagcuccuccucggcucccccuccucccucucccccuucuccaagcgcaucaagcucgagaaggaguucgaccucccccccgccgccaugcccaacaccgagaacgucuacucccaguggcucgccggcuacgccgccucccgccagcucaaggaccccuuccucuccuucggcgacucccgccagucccccuucgccuccuccuccgagcacuccuccgagaacggcucccuccgcuucuccaccccccccggcgagcucgacggcggcaucuccggccgcuccggcaccggcuccggcggcuccaccccccacaucuccggccccggccccggccgccccuccuccaaggagggccgccgcuccgacaccugcuccucccacacccccauccgccgcuccacccagcgcgcccaggacgucuggcaguucuccgacggcuccucccgcgcccucaaguucuga

SEQ ID NO: 40268 - RNA, 2472 nt, Artificial Sequence
  derived and/or modified sequence opt2 from BCL11B__Homo_sapiens__NP_075049
augucccgccgcaagcagggcaacccccagcaccucucccagcgcgagcucaucacccccgaggccgaccacgucgaggccgccauccucgaggaggacgagggccucgagaucgaggagcccuccggccucggccucauggucggcggccccgaccccgaccuccucaccugcggccagugccagaugaacuucccccucggcgacauccucgucuucaucgagcacaagcgcaagcagugcggcggcucccucggcgccugcuacgacaaggcccucgacaaggacucccccccccccuccucccgcuccgagcuccgcaaggucuccgagcccgucgagaucggcauccaggucacccccgacgaggacgaccaccuccucucccccaccaagggcaucugccccaagcaggagaacaucgccggcaaggacgagcccuccuccuacaucugcaccaccugcaagcagcccuucaacuccgccugguuccuccuccagcacgcccagaacacccacggcuuccgcaucuaccucgagcccggccccgccuccuccucccucaccccccgccucaccaucccccccccccucggccccgaggccgucgcccaguccccccucaugaacuuccucggcgacuccaaccccuucaaccuccuccgcaugaccggccccauccuccgcgaccaccccggcuucggcgagggccgccuccccggcacccccccccucuucuccccccccccccgccaccaccucgacccccaccgccucuccgccgaggagaugggccucgucgcccagcaccccuccgccuucgaccgcgucaugcgccucaaccccauggccaucgacucccccgccauggacuucucccgccgccuccgcgagcucgccggcaacuccuccacccccccccccgucucccccggccgcggcaaccccaugcaccgccuccucaaccccuuccagcccucccccaagucccccuuccucuccacccccccccucccccccaugccccccggcggcaccccccccccccagccccccgccaaguccaaguccugcgaguucugcggcaagaccuucaaguuccaguccaaccucaucguccaccgccgcucccacaccggcgagaagcccuacaagugccagcucugcgaccacgccugcucccaggccuccaagcucaagcgccacaugaagacccacaugcacaaggccggcucccucgccggccgcuccgacgacggccucuccgccgccuccucccccgagcccggcaccuccgagcucgccggcgagggccucaaggccgccgacggcgacuuccgccaccacgaguccgaccccucccucggccacgagcccgaggaggaggacgaggaggaggaggaggaggaggaggagcuccuccucgagaacgagucccgccccgaguccuccuucuccauggacuccgagcucucccgcaaccgcgagaacggcggcggcggcguccccggcguccccggcgccggcggcggcgccgccaaggcccucgccgacgagaaggcccucguccucggcaaggucauggagaacgucggccucggcgcccucccccaguacggcgagcuccucgccgacaagcagaagcgcggcgccuuccucaagcgcgccgccggcggcggcgacgccggcgacgacgacgacgccggcggcugcggcgacgccggcgccggcggcgccgucaacggccgcggcggcggcuucgcccccggcaccgagcccuuccccggccucuucccccgcaagcccgccccccuccccucccccggccucaacuccgccgccaagcgcaucaaggucgagaaggaccucgagcucccccccgccgcccucauccccuccgagaacgucuacucccaguggcucgucggcuacgccgccucccgccacuucaugaaggaccccuuccucggcuucaccgacgcccgccagucccccuucgccaccuccuccgagcacuccuccgagaacggcucccuccgcuucuccaccccccccggcgaccuccucgacggcggccucuccggccgcuccggcaccgccuccggcggcuccaccccccaccucggcggccccggccccggccgccccuccuccaaggagggccgccgcuccgacaccugcgaguacugcggcaaggucuucaagaacugcuccaaccucaccguccaccgccgcucccacaccggcgagcgccccuacaagugcgagcucugcaacuacgccugcgcccaguccuccaagcucacccgccacaugaagacccacggccagaucggcaaggaggucuaccgcugcgacaucugccagaugcccuucuccgucuacuccacccucgagaagcacaugaagaaguggcacggcgagcaccuccucaccaacgacgucaagaucgagcaggccgagcgcuccuga

SEQ ID NO: 40269 - RNA, 492 nt, Artificial Sequence
  derived and/or modified sequence opt2 from BCL2A1__Homo_sapiens__NP_001108207
augaccgacugcgaguucggcuacaucuaccgccucgcccaggacuaccuccagugcguccuccagaucccccagcccggcuccggccccuccaagaccucccgcguccuccagaacgucgccuucuccguccagaaggaggucgagaagaaccucaaguccugccucgacaacgucaacgucgucuccgucgacaccgcccgcacccucuucaaccaggucauggagaaggaguucgaggacggcaucaucaacuggggccgcaucgucaccaucuucgccuucgagggcauccucaucaagaagcuccuccgccagcagaucgcccccgacgucgacaccuacaaggagaucuccuacuucgucgccgaguucaucaugaacaacaccggcgaguggauccgccagaacggcggcuggggcaaguggcacaaccacacccccaugcucgucgaguccgucgcccacaagaagcgcaagauggcccucuga

SEQ ID NO: 40270 - RNA, 720 nt, Artificial Sequence
  derived and/or modified sequence opt2 from BCL2__Homo_sapiens__NP_000624
auggcccacgccggccgcaccggcuacgacaaccgcgagaucgucaugaaguacauccacuacaagcucucccagcgcggcuacgagugggacgccggcgacgucggcgccgccccccccggcgccgcccccgcccccggcaucuucuccucccagcccggccacaccccccaccccgccgccucccgcgaccccgucgcccgcaccuccccccuccagacccccgccgcccccggcgccgccgccggccccgcccucucccccgucccccccgucguccaccucacccuccgccaggccggcgacgacuucucccgccgcuaccgccgcgacuucgccgagauguccucccagcuccaccucacccccuucaccgcccgcggccgcuucgccaccgucgucgaggagcucuuccgcgacggcgucaacuggggccgcaucgucgccuucuucgaguucggcggcgucaugugcgucgaguccgucaaccgcgagauguccccccucgucgacaacaucgcccucuggaugaccgaguaccucaaccgccaccuccacaccuggauccaggacaacggcggcugggacgccuucgucgagcucuacggccccuccaugcgcccccucuucgacuucuccuggcucucccucaagacccuccucucccucgcccucgucggcgccugcaucacccucggcgccuaccucggccacaaguga

SEQ ID NO: 40271 - RNA, 615 nt, Artificial Sequence
  derived and/or modified sequence opt2 from BCL2L10__Homo_sapiens__NP_065129
auggucgaccagcuccgcgagcgcaccaccauggccgacccccuccgcgagcgcaccgagcuccuccucgccgacuaccucggcuacugcgcccgcgagcccggcacccccgagcccgcccccuccacccccgaggccgccguccuccgcuccgccgccgcccgccuccgccagauccaccgcuccuucuucuccgccuaccucggcuaccccggcaaccgcuucgagcucgucgcccucauggccgacuccguccucuccgacucccccggccccaccuggggccgcgucgucacccucgucaccuucgccggcacccuccucgagcgcggcccccucgucaccgcccgcuggaagaaguggggcuuccagccccgccucaaggagcaggagggcgacgucgcccgcgacugccagcgccucgucgcccuccucuccucccgccucaugggccagcaccgcgccuggcuccaggcccagggcggcugggacggcuucugccacuucuuccgcacccccuucccccucgccuucuggcgcaagcagcucguccaggccuuccucuccugccuccucaccaccgccuucaucuaccucuggacccgccuccucuga

SEQ ID NO: 40272 - RNA, 258 nt, Artificial Sequence
  derived and/or modified sequence opt2 from BCL2L11__Homo_sapiens__NP_001191036
auggccaagcagcccuccgacgucuccuccgagugcgaccgcgagggccgccagcuccagcccgccgagcgccccccccagcuccgccccggcgcccccaccucccuccagaccgagccccaggccuccaugcgccaggccgagcccgccgacaugcgccccgagaucuggaucgcccaggagcuccgccgcaucggcgacgaguucaacgccuacuacgcccgccgccucgccaagcuccucgccuccuccaccuga

SEQ ID NO: 40273 - RNA, 1002 nt, Artificial Sequence
  derived and/or modified sequence opt2 from BCL2L12__Homo_sapiens__NP_001035758
augggccgccccgccggccucuuccccccccucugccccuuccucggcuuccgccccgaggccugcugggagcgccacaugcagaucgagcgcgcccccuccgucccccccuuccuccgcugggccggcuaccgccccggccccguccgccgccgcggcaaggucgagcucaucaaguucguccgcguccaguggcgccgcccccaggucgaguggcgccgccgccgcuggggccccggccccggcgccuccauggccggcuccgaggagcucggccuccgcgaggacacccuccgcguccucgccgccuuccuccgccgcggcgaggccgccggcucccccguccccaccccccccucccccgcccaggaggagcccaccgacuuccucucccgccuccgccgcugccuccccugcucccucggccgcggcgccgcccccuccgaguccccccgccccugcucccuccccauccgccccugcuacggccucgagcccggccccgccacccccgacuucuacgcccucgucgcccagcgccucgagcagcucguccaggagcagcucaaguccccccccucccccgagcuccagggcccccccuccaccgagaaggaggccauccuccgccgccucgucgcccuccucgaggaggaggccgaggucaucaaccagaagcucgccuccgaccccgcccuccgcuccaagcucguccgccucuccuccgacuccuucgcccgccucgucgagcucuucugcucccgcgacgacuccucccgccccucccgcgccugccccggcccccccccccccucccccgagccccucgcccgccucgcccucgccauggagcucucccgccgcgucgccggccucggcggcacccucgccggccucuccgucgagcacguccacuccuucacccccuggauccaggcccacggcggcugggagggcauccucgccgucucccccgucgaccucaaccucccccucgacuga

SEQ ID NO: 40274 - RNA, 1386 nt, Artificial Sequence
  derived and/or modified sequence opt2 from BCL2L13__Homo_sapiens__NP_001257656
auguccggcuccuccggccccgcccccacccccgccgucaccaaggcccgccgcggcgaccucacccuccagcacggcggcggcggccgccucggcccccgcgucggcgcccucaccgccgccggcggccccugccgcaagcagcuccccccccccccccucuccucccuccucggccagggccccggccccggcguccagcucgacaucgccucccagucccucgaccaggagauccuccucaaggucaagaccgagaucgaggaggagcucaagucccucgacaaggagaucuccgaggccuucaccuccaccggcuucgaccgccacaccucccccgucuucucccccgccaaccccgaguccuccauggaggacugccucgcccaccucggcgagaaggucucccaggagcucaaggagccccuccacaaggcccuccagaugcuccucucccagcccgucaccuaccaggccuuccgcgagugcacccucgagaccaccguccacgccuccggcuggaacaagggcaccgucuucucccucgaguccgaggaggaggaguaccccggcaucaccgccgaggacuccaacgacaucuacauccuccccuccgacaacuccggccaggucuccccccccgagucccccaccgucaccaccuccuggcaguccgagucccuccccgucucccucuccgccucccaguccuggcacaccgagucccuccccgucucccucggccccgaguccuggcagcagaucgccauggaccccgaggaggucaagucccucgacuccaacggcgccggcgagaaguccgagaacaacuccuccaacuccgacaucguccacgucgagaaggaggagguccccgagggcauggaggaggccgccgucgccuccgucguccuccccgcccgcgagcuccaggaggcccuccccgaggcccccgccccccuccucccccacaucaccgccaccucccuccucggcacccgcgagcccgacaccgaggucaucaccgucgagaaguccucccccgccaccucccucuucgucgagcucgacgaggaggaggucaaggccgccaccaccgagcccaccgaggucgaggaggucguccccgcccucgagcccaccgagacccuccucuccgagaaggagaucaacgcccgcgaggagucccucgucgaggagcucucccccgccuccgagaagaagcccgucccccccuccgagggcaagucccgccucucccccgccggcgagaugaagcccaugccccucuccgagggcaaguccauccuccucuucggcggcgccgccgccgucgccauccucgccgucgccaucggcgucgcccucgcccuccgcaagaaguga

SEQ ID NO: 40275 - RNA, 759 nt, Artificial Sequence
  derived and/or modified sequence opt2 from BCL2L14__Homo_sapiens__NP_110393
augugcuccaccuccggcugcgaccucgaggagaucccccucgacgacgacgaccucaacaccaucgaguucaagauccucgccuacuacacccgccaccacgucuucaaguccacccccgcccucuucucccccaagcuccuccgcacccgcucccucucccagcgcggccucggcaacugcuccgccaacgaguccuggaccgaggucuccuggcccugccgcaacucccaguccuccgagaaggccaucaaccucggcaagaagaaguccuccuggaaggccuucuucggcgucgucgagaaggaggacucccaguccacccccgccaaggucuccgcccagggccagcgcacccucgaguaccaggacucccacucccagcaguggucccgcugccucuccaacgucgagcagugccucgagcacgaggccgucgaccccaaggucaucuccaucgccaaccgcgucgccgagaucgucuacuccuggccccccccccaggccacccaggccggcggcuucaaguccaaggagaucuucgucaccgagggccucuccuuccagcuccagggccacguccccgucgccuccuccuccaagaaggacgaggaggagcagauccucgccaagaucgucgagcuccucaaguacuccggcgaccagcucgagcgcaaggacaccgccuucauccccaucccccucgucgacaccuccauccagggcuucccccaggacggccucauggccugcaucuga

SEQ ID NO: 40276 - RNA, 513 nt, Artificial Sequence
  derived and/or modified sequence opt2 from BCL2L1__Homo_sapiens__NP_001182
augucccaguccaaccgcgagcucgucgucgacuuccucuccuacaagcucucccagaagggcuacuccuggucccaguucuccgacgucgaggagaaccgcaccgaggcccccgagggcaccgaguccgagauggagacccccuccgccaucaacggcaaccccuccuggcaccucgccgacucccccgccgucaacggcgccaccggccacuccuccucccucgacgcccgcgaggucauccccauggccgccgucaagcaggcccuccgcgaggccggcgacgaguucgagcuccgcuaccgccgcgccuucuccgaccucaccucccagcuccacaucacccccggcaccgccuaccaguccuucgagcaggacaccuucgucgagcucuacggcaacaacgccgccgccgagucccgcaagggccaggagcgcuucaaccgcugguuccucaccggcaugaccgucgccggcgucguccuccucggcucccucuucucccgcaaguga

SEQ ID NO: 40277 - RNA, 582 nt, Artificial Sequence
  derived and/or modified sequence opt2 from BCL2L2__Homo_sapiens__NP_004041
auggccacccccgccuccgcccccgacacccgcgcccucgucgccgacuucgucggcuacaagcuccgccagaagggcuacgucugcggcgccggccccggcgagggccccgccgccgacccccuccaccaggccaugcgcgccgccggcgacgaguucgagacccgcuuccgccgcaccuucuccgaccucgccgcccagcuccacgucacccccggcuccgcccagcagcgcuucacccaggucuccgacgagcucuuccagggcggccccaacuggggccgccucgucgccuucuucgucuucggcgccgcccucugcgccgaguccgucaacaaggagauggagccccucgucggccagguccaggaguggauggucgccuaccucgagacccgccucgccgacuggauccacuccuccggcggcugggccgaguucaccgcccucuacggcgacggcgcccucgaggaggcccgccgccuccgcgagggcaacugggccuccguccgcaccguccucaccggcgccgucgcccucggcgcccucgucaccgucggcgccuucuucgccuccaaguga

SEQ ID NO: 40278 - RNA, 1002 nt, Artificial Sequence
  derived and/or modified sequence opt2 from BCL2L2-PABPN1__Homo_sapiens__NP_001186793
auggccacccccgccuccgcccccgacacccgcgcccucgucgccgacuucgucggcuacaagcuccgccagaagggcuacgucugcggcgccggccccggcgagggccccgccgccgacccccuccaccaggccaugcgcgccgccggcgacgaguucgagacccgcuuccgccgcaccuucuccgaccucgccgcccagcuccacgucacccccggcuccgcccagcagcgcuucacccaggucuccgacgagcucuuccagggcggccccaacuggggccgccucgucgccuucuucgucuucggcgccgcccucugcgccgaguccgucaacaaggagauggagccccucgucggccagguccaggaguggauggucgccuaccucgagacccgccucgccgacuggauccacuccuccggcggcugggagcucgaggccaucaaggcccgcguccgcgagauggaggaggaggccgagaagcucaaggagcuccagaacgaggucgagaagcagaugaacaugucccccccccccggcaacgccggccccgucaucauguccaucgaggagaagauggaggccgacgcccgcuccaucuacgucggcaacgucgacuacggcgccaccgccgaggagcucgaggcccacuuccacggcugcggcuccgucaaccgcgucaccauccucugcgacaaguucuccggccaccccaagggcuucgccuacaucgaguucuccgacaaggaguccguccgcaccucccucgcccucgacgagucccucuuccgcggccgccagaucaaggucauccccaagcgcaccaaccgccccggcaucuccaccaccgaccgcggcuucccccgcgcccgcuaccgcgcccgcaccaccaacuacaacuccucccgcucccgcuucuacuccggcuucaacucccgcccccgcggccgcgucuaccgcggccgcgcccgcgccaccuccugguacucccccuacuga

SEQ ID NO: 40279 - RNA, 1365 nt, Artificial Sequence
  derived and/or modified sequence opt2 from BCL3__Homo_sapiens__XP_011525499
augccccgcugccccgccggcgccauggacgagggccccgucgaccuccgcacccgccccaaggccgccggccuccccggcgccgcccucccccuccgcaagcgcccccuccgcgcccccucccccgagcccgccgccccccgcggcgccgccggccucgucgucccccucgacccccuccgcggcggcugcgaccuccccgccguccccggccccccccacggccucgcccgccccgaggcccucuacuaccccggcgcccuccucccccucuaccccacccgcgccaugggcucccccuucccccucgucaaccuccccaccccccucuaccccaugaugugccccauggagcacccccucuccgccgacaucgccauggccacccgcgccgacgaggacggcgacaccccccuccacaucgccgucguccagggcaaccuccccgccguccaccgccucgucaaccucuuccagcagggcggccgcgagcucgacaucuacaacaaccuccgccagaccccccuccaccucgccgucaucaccacccuccccuccgucguccgccuccucgucaccgccggcgccucccccauggcccucgaccgccacggccagaccgccgcccaccucgccugcgagcaccgcucccccaccugccuccgcgcccuccucgacuccgccgcccccggcacccucgaccucgaggcccgcaacuacgacggccucaccgcccuccacgucgccgucaacaccgagugccaggagaccguccagcuccuccucgagcgcggcgccgacaucgacgccgucgacaucaaguccggccgcuccccccucauccacgccgucgagaacaacucccucuccaugguccagcuccuccuccagcacggcgccaacgucaacgcccagauguacuccggcuccuccgcccuccacuccgccuccggccgcggccuccucccccucguccgcacccucguccgcuccggcgccgacuccucccucaagaacugccacaacgacaccccccucauggucgcccgcucccgccgcgucaucgacauccuccgcggcaaggccacccgccccgccuccaccucccagcccgaccccucccccgaccgcuccgccaacaccucccccgaguccuccucccgccucuccuccaacggccuccucuccgccucccccuccuccucccccucccagucccccccccgcgacccccccggcuuccccauggccccccccaacuucuuccuccccucccccuccccccccgccuuccuccccuucgccggcguccuccgcggccccggccgccccgucccccccucccccgcccccggcggcuccuga

SEQ ID NO: 40280 - RNA, 1443 nt, Artificial Sequence
  derived and/or modified sequence opt2 from BCL6B__Homo_sapiens__NP_862827
augggcucccccgccgcccccgagggcgcccucggcuacguccgcgaguucacccgccacuccuccgacguccucggcaaccucaacgagcuccgccuccgcggcauccucaccgacgucacccuccucgucggcggccagccccuccgcgcccacaaggccguccucaucgccugcuccggcuucuucuacuccaucuuccgcggccgcgccggcgucggcgucgacguccucucccuccccggcggccccgaggcccgcggcuucgccccccuccucgacuucauguacaccucccgccuccgccucucccccgccaccgcccccgccguccucgccgccgccaccuaccuccagauggagcacgucguccaggccugccaccgcuucauccaggccuccuacgagccccucggcaucucccuccgcccccucgaggccgagccccccaccccccccaccgcccccccccccggcuccccccgccgcuccgagggccaccccgacccccccaccgagucccgcuccugcucccagggcccccccucccccgccucccccgaccccaaggccugcaacuggaagaaguacaaguacaucguccucaacucccaggccucccaggccggcucccucgucggcgagcgcuccuccggccagcccugcccccaggcccgccuccccuccggcgacgaggccuccuccuccuccuccuccuccuccuccuccuccuccgaggagggccccauccccggcccccagucccgccucucccccaccgccgccaccguccaguucaagugcggcgcccccgccuccacccccuaccuccucaccucccaggcccaggacaccuccggcucccccuccgagcgcgcccgcccccuccccggcuccgaguucuucuccugccagaacugcgaggccgucgccggcugcuccuccggccucgacucccucguccccggcgacgaggacaagcccuacaagugccagcucugccgcuccuccuuccgcuacaagggcaaccucgccucccaccgcaccguccacaccggcgagaagcccuaccacugcuccaucugcggcgcccgcuucaaccgccccgccaaccucaagacccacucccgcauccacuccggcgagaagcccuacaagugcgagaccugcggcucccgcuucguccaggucgcccaccuccgcgcccacguccucauccacaccggcgagaagcccuaccccugccccaccugcggcacccgcuuccgccaccuccagacccucaagucccacguccgcauccacaccggcgagaagcccuaccacugcgaccccugcggccuccacuuccgccacaagucccagcuccgccuccaccuccgccagaagcacggcgccgccaccaacaccaagguccacuaccacauccucggcggccccuga

SEQ ID NO: 40281 - RNA, 2121 nt, Artificial Sequence
  derived and/or modified sequence opt2 from BCL6__Homo_sapiens__NP_001124317
auggccucccccgccgacuccugcauccaguucacccgccacgccuccgacguccuccucaaccucaaccgccuccgcucccgcgacauccucaccgacgucgucaucgucgucucccgcgagcaguuccgcgcccacaagaccguccucauggccugcuccggccucuucuacuccaucuucaccgaccagcucaagugcaaccucuccgucaucaaccucgaccccgagaucaaccccgagggcuucugcauccuccucgacuucauguacaccucccgccucaaccuccgcgagggcaacaucauggccgucauggccaccgccauguaccuccagauggagcacgucgucgacaccugccgcaaguucaucaaggccuccgaggccgagauggucuccgccaucaagcccccccgcgaggaguuccucaacucccgcaugcucaugccccaggacaucauggccuaccgcggccgcgaggucgucgagaacaaccucccccuccgcuccgcccccggcugcgagucccgcgccuucgcccccucccucuacuccggccucuccaccccccccgccuccuacuccauguacucccaccuccccgucuccucccuccucuucuccgacgaggaguuccgcgacguccgcaugcccgucgccaaccccuuccccaaggagcgcgcccuccccugcgacuccgcccgccccguccccggcgaguacucccgccccacccucgaggucucccccaacgucugccacuccaacaucuacucccccaaggagaccauccccgaggaggcccgcuccgacaugcacuacuccgucgccgagggccucaagcccgccgcccccuccgcccgcaacgcccccuacuuccccugcgacaaggccuccaaggaggaggagcgccccuccuccgaggacgagaucgcccuccacuucgagccccccaacgccccccucaaccgcaagggccucgucuccccccaguccccccagaaguccgacugccagcccaacucccccaccgaguccugcuccuccaagaacgccugcauccuccaggccuccggcuccccccccgccaagucccccaccgaccccaaggccugcaacuggaagaaguacaaguucaucguccucaacucccucaaccagaacgccaagcccgagggccccgagcaggccgagcucggccgccucuccccccgcgccuacaccgccccccccgccugccagccccccauggagcccgagaaccucgaccuccagucccccaccaagcucuccgccuccggcgaggacuccaccaucccccaggccucccgccucaacaacaucgucaaccgcuccaugaccggcuccccccgcuccuccuccgagucccacuccccccucuacaugcacccccccaagugcaccuccugcggcucccaguccccccagcacgccgagaugugccuccacaccgccggccccaccuuccccgaggagaugggcgagacccaguccgaguacuccgacuccuccugcgagaacggcgccuucuucugcaacgagugcgacugccgcuucuccgaggaggccucccucaagcgccacacccuccagacccacuccgacaagcccuacaagugcgaccgcugccaggccuccuuccgcuacaagggcaaccucgccucccacaagaccguccacaccggcgagaagcccuaccgcugcaacaucugcggcgcccaguucaaccgccccgccaaccucaagacccacacccgcauccacuccggcgagaagcccuacaagugcgagaccugcggcgcccgcuucguccaggucgcccaccuccgcgcccacguccucauccacaccggcgagaagcccuaccccugcgagaucugcggcacccgcuuccgccaccuccagacccucaagucccaccuccgcauccacaccggcgagaagcccuaccacugcgagaagugcaaccuccacuuccgccacaagucccagcuccgccuccaccuccgccagaagcacggcgccaucaccaacaccaagguccaguaccgcgucuccgccaccgaccucccccccgagcuccccaaggccugcuga

SEQ ID NO: 40282 - RNA, 633 nt, Artificial Sequence
  derived and/or modified sequence opt2 from BCL7A__Homo_sapiens__NP_001019979
auguccggccgcuccguccgcgccgagacccgcucccgcgccaaggacgacaucaagcgcgucauggccgccaucgagaagguccgcaagugggagaagaagugggucaccgucggcgacaccucccuccgcaucuacaaguggguccccgucaccgagcccaaggucgacgacaagaacaagaacaagaagaagggcaaggacgagaagugcggcuccgaggucaccacccccgagaacuccuccucccccggcaugauggacaugcacgacgacaacuccaaccaguccuccaucgccgacgccucccccaucaagcaggagaacuccuccaacuccucccccgcccccgagcccaacuccgccguccccuccgacggcaccgaggccaaggucgacgaggcccaggccgacggcaaggagcaccccggcgccgaggacgccuccgacgagcagaacucccaguccuccauggagcacuccaugaacuccuccgagaaggucgaccgccagcccuccggcgacuccggccucgccgccgagaccuccgccaucucccaggaccucgagggcgucccccccuccaagaagaugaagcucgaggccucccagcagaacuccgaggagauguga

SEQ ID NO: 40283 - RNA, 438 nt, Artificial Sequence
  derived and/or modified sequence opt2 from BCL7B__Homo_sapiens__NP_001184173
auguccggccgcuccguccgcgccgagacccgcucccgcgccaaggacgacaucaagaaggucauggccgccaucgagaagguccgcaagugggagaagaagugggucaccgucggcgacaccucccuccgcaucuucaaguggguccccgucaccgacuccaaggagaaggagaaguccaaguccaacuccuccgccgcccgcgagcccaacggcuuccccuccgacgccuccgccaacuccucccuccuccucgaguuccaggagcccucccuccccuccuccgaggucgccgacgagccccccacccucaccaaggaggagcccgucccccucgagacccaggucgucgaggaggaggaggacuccggcgcccccccccucaagcgcuucugcgucgaccagcccaccgucccccagaccgccuccgaguccuga

SEQ ID NO: 40284 - RNA, 729 nt, Artificial Sequence
  derived and/or modified sequence opt2 from BCL7C__Homo_sapiens__NP_001273455
auggccggccgcaccguccgcgccgagacccgcucccgcgccaaggacgacaucaagaaggucauggccaccaucgagaagguccgccgcugggagaagcgcugggucaccgucggcgacaccucccuccgcaucuucaaguggguccccgucgucgacccccaggaggaggagcgccgccgcgccggcggcggcgccgagcgcucccgcggccgcgagcgccgcggccgcggcgccuccccccgcggcggcggcccccucauccuccucgaccucaacgacgagaacuccaaccaguccuuccacuccgagggcucccuccagaagggcaccgagcccucccccggcggcaccccccagcccucccgccccgucucccccgccggcccccccgagggcguccccgaggaggcccagcccccccgccucggccaggagcgcgaccccggcggcaucaccgccggcuccaccgacgagccccccaugcucaccaaggaggagcccguccccgagcuccucgaggccgaggacuccggcguccgcaugacccgccgcgcccuccacgagaagggccucaagaccgagccccuccgccgccuccucccccgccgcggccuccgcaccaacguccgccccuccuccauggccguccccgacacccgcgcccccggcggcggcuccaaggccccccgcgccccccgcaccaucccccagggcaagggccgcuga

SEQ ID NO: 40285 - RNA, 4500 nt, Artificial Sequence
  derived and/or modified sequence opt2 from BCL9L__Homo_sapiens__NP_872363
augcgcauccucgccaacaagacccgccucccccacccccgccgccgcgaggcccccggcucccccccccucuccccccgcggccacugcccccccgcccccgccaagcccaugcaccccgagaacaagcucaccaaccacggcaagaccggcaacggcggcgcccagucccagcaccagaacgucaaccagggccccaccugcaacgucggcuccaagggcgucggcgccggcaaccacggcgccaaggccaaccagaucucccccuccaacuccucccucaagaacccccaggccggcgucccccccuucuccucccucaagggcaaggucaagcgcgaccgcuccgucuccgucgacuccggcgagcagcgcgaggccggcacccccucccucgacuccgaggccaaggaggucgccccccgcuccaagcgccgcugcguccucgagcgcaagcagcccuacuccggcgacgaguggugcuccggccccgacuccgaggaggacgacaagcccaucggcgccacccacaacugcaacgucgccgaccccgccauggccgccccccagcucggccccggccagaccacccagcucccccucuccgaguccuccguccccggcgccccccacggccccccccccggccuccgccccgacgcccccggcggcggcggcggcggcggcggcguccccggcaagccccccucccaguucgucuacgucuucaccacccaccucgccaacaccgccgccgaggccguccuccagggccgcgccgacuccauccucgccuaccaccagcagaacgucccccgcgccaagcucgaccaggcccccaaggucccccccacccccgagccccucccccucuccacccccuccgccggcaccccccagucccagccccccccccucccccccccccccccccccgcccccggcuccgccccccccgcccucccccccgagggcccccccgaggacuccucccaggaccucgcccccaacuccgucggcgccgccuccaccggcggcggcaccggcggcacccaccccaacacccccaccgccaccaccgccaacaacccccucccccccggcggcgaccccuccuccgcccccggccccgcccuccucggcgaggccgccgcccccggcaacggccagcgcucccucgucggcuccgagggccucuccaaggagcagcucgagcaccgcgagcgcucccuccagacccuccgcgacaucgagcgccuccuccuccgcuccggcgagaccgagcccuuccucaagggcccccccggcggcgccggcgagggcggcccccccgcccaggcccccccccccccccagcagccccccaccgccccccccuccggccucaagaaguacgaggagccccuccaguccaugaucucccagacccagucccucggcggccccccccucgagcacgagguccccggccacccccccggcggcgacaugggccagcagaugaacaugaugauccagcgccucggccaggacucccucacccccgagcaggucgccuggcgcaagcuccaggaggaguacuacgaggagaagcgccgcaaggaggagcagaucggccuccacggcucccgcccccuccaggacaugaugggcaugggcggcaugaugguccgcggcccccccccccccuaccacuccaagcccggcgaccaguggccccccggcaugggcgcccagcuccgcggccccauggacguccaggaccccaugcagcuccgcggcggcccccccuuccccggcccccgcuuccccggcaaccagauccagcgcguccccggcuucggcggcaugcaguccaugcccauggagguccccaugaacgccaugcagcgccccguccgccccggcaugggcuggaccgaggaccucccccccaugggcggccccuccaacuucgcccagaacaccaugcccuaccccggcggccagggcgaggccgagcgcuucaugaccccccgcguccgcgaggagcuccuccgccaccagcuccucgagaagcgcuccaugggcaugcagcgcccccucggcauggccggcuccggcaugggccaguccauggagauggagcgcaugaugcaggcccaccgccagauggaccccgccauguuccccggccagauggccggcggcgagggccucgccggcacccccaugggcauggaguucggcggcggccgcggccuccucuccccccccaugggccaguccggccuccgcgaggucgacccccccaugggccccggcaaccucaacaugaacaugaacgucaacaugaacaugaacaugaaccucaacguccagaugaccccccagcagcagaugcucaugucccagaagaugcgcggccccggcgaccucaugggcccccagggccucucccccgaggagauggcccgcguccgcgcccagaacuccuccggcgucaugggcggcccccagaagaugcucaugcccucccaguuccccaaccagggccagcagggcuucuccggcggccagggccccuaccaggccaugucccaggacaugggcaacacccaggacauguucucccccgaccaguccuccaugcccauguccaacgucggcaccacccgccucucccacaugccccucccccccgccuccaacccccccggcaccguccacuccgcccccaaccgcggccucggccgccgccccuccgaccucaccaucuccaucaaccagaugggcucccccggcaugggccaccucaagucccccacccucucccagguccacuccccccucgucaccucccccuccgccaaccucaaguccccccagacccccucccagauggucccccuccccuccgccaacccccccggcccccucaaguccccccagguccucggcuccucccucuccguccgcucccccaccggcucccccucccgccucaagucccccuccauggccguccccucccccggcugggucgccucccccaagaccgccaugcccucccccggcgucucccagaacaagcagcccccccucaacaugaacuccuccaccacccucuccaacauggagcagggcacccucccccccuccggcccccgcuccuccuccuccgccccccccgccaacccccccuccggccucaugaaccccucccuccccuucaccuccucccccgaccccacccccucccagaacccccucucccucaugaugacccagauguccaaguacgccaugcccuccuccaccccccucuaccacaacgccaucaagaccaucgccaccuccgacgacgagcuccuccccgaccgcccccuccuccccccccccccccccccccagggcuccggccccggcaucuccaacucccagcccucccagaugcaccucaacuccgccgccgcccagucccccaugggcaugaaccuccccggccagcagccccucucccacgagcccccccccgccaugcuccccucccccaccccccucggcuccaacaucccccuccaccccaacgcccagggcaccggcggccccccccagaacuccaugaugauggcccccggcggccccgacucccucaacgcccccugcggccccguccccuccuccucccagaugaugcccuuccccccccgccuccagcagccccacggcgccauggcccccaccggcggcggcggcggcggccccggccuccagcagcacuaccccuccggcauggcccucccccccgaggaccuccccaaccagccccccggccccaugcccccccagcagcaccucaugggcaaggccauggccggccgcaugggcgacgccuacccccccggcguccuccccggcgucgccuccguccucaacgaccccgagcucuccgaggucauccgccccacccccaccggcauccccgaguucgaccucucccgcaucauccccuccgagaagcccuccuccacccuccaguacuuccccaaguccgagaaccagccccccaaggcccagccccccaaccuccaccucaugaaccuccagaacaugauggccgagcagacccccucccgcccccccaaccuccccggccagcagggcguccagcgcggccucaacauguccaugugccaccccggccagaugucccuccucggccgcaccggcguccccccccagcagggcauggucccccacggccuccaccagggcgucaugucccccccccagggccucaugacccagcagaacuucaugcucaugaagcagcgcggcgucggcggcgaggucuacucccagcccccccacaugcucuccccccagggcucccucaugggcccccccccccagcagaaccucauggucucccacccccuccgccagcgcuccgucucccucgacucccagaugggcuaccuccccgcccccggcggcauggccaaccuccccuucuga

SEQ ID NO: 40286 - RNA, 2610 nt, Artificial Sequence
  derived and/or modified sequence opt2 from BCLAF1__Homo_sapiens__NP_001070908
augggccgcuccaacucccgcucccacuccucccgcuccaagucccgcucccaguccuccucccgcucccgcucccgcucccacucccgcaagaagcgcuaccgcucccgcucccgcaccuacucccgcucccgcucccgcgaccgcauguacucccgcgacuaccgccgcgacuaccgcaacaaccgcggcaugcgccgccccuacggcuaccgcggccgcggccgcggcuacuaccagggcggcggcggccgcuaccaccgcggcggcuaccgccccgucuggaaccgccgccacucccgcuccccccgccgcggccgcucccgcucccgcucccccaagcgccgcuccgucuccucccagcgcucccgcucccgcucccgccgcuccuaccgcuccucccgcuccccccgcuccuccuccucccgcuccuccucccccuacuccaagucccccgucuccaagcgccgcggcucccaggagaagcagaccaagaaggccgagggcgagccccaggaggaguccccccucaaguccaagucccaggaggagcccaaggacaccuucgagcacgaccccuccgaguccaucgacgaguucaacaaguccuccgccaccuccggcgacaucuggcccggccucuccgccuacgacaacuccccccgcuccccccacucccccucccccaucgccaccccccccucccaguccuccuccugcuccgacgcccccaugcucuccaccguccacuccgccaagaacacccccucccagcacucccacuccauccagcacucccccgagcgcuccggcuccggcuccgucggcaacggcuccucccgcuacucccccucccagaacucccccauccaccacauccccucccgccgcucccccgccaagaccaucgccccccagaacgccccccgcgacgagucccgcggccgcuccuccuucuaccccgacggcggcgaccaggagaccgccaagaccggcaaguuccucaagcgcuucaccgacgaggagucccgcgucuuccuccucgaccgcggcaacacccgcgacaaggaggccuccaaggagaagggcuccgagaagggccgcgccgagggcgagugggaggaccaggaggcccucgacuacuucuccgacaaggaguccggcaagcagaaguucaacgacuccgagggcgacgacaccgaggagaccgaggacuaccgccaguuccgcaaguccguccucgccgaccagggcaaguccuucgccaccgccucccaccgcaacaccgaggaggagggccucaaguacaaguccaaggucucccucaagggcaaccgcgaguccgacggcuuccgcgaggagaagaacuacaagcucaaggagaccggcuacgucgucgagcgccccuccaccaccaaggacaagcacaaggaggaggacaagaacuccgagcgcaucaccgucaagaaggagacccagucccccgagcaggucaaguccgagaagcucaaggaccucuucgacuacucccccccccuccacaagaaccucgacgcccgcgagaaguccaccuuccgcgaggaguccccccuccgcaucaagaugaucgccuccgacucccaccgccccgaggucaagcucaagauggcccccgucccccucgacgacuccaaccgccccgccucccucaccaaggaccgccuccucgccuccacccucguccacuccgucaagaaggagcaggaguuccgcuccaucuucgaccacaucaagcucccccaggccuccaaguccaccuccgaguccuucauccagcacaucgucucccucguccaccacgucaaggagcaguacuucaaguccgccgccaugacccucaacgagcgcuucaccuccuaccagaaggccaccgaggagcacuccacccgccagaagucccccgagauccaccgccgcaucgacaucucccccuccacccuccgcaagcacacccgccucgccggcgaggagcgcgucuucaaggaggagaaccagaagggcgacaagaagcuccgcugcgacuccgccgaccuccgccacgacaucgaccgccgccgcaaggagcgcuccaaggagcgcggcgacuccaagggcucccgcgaguccuccggcucccgcaagcaggagaagacccccaaggacuacaaggaguacaaguccuacaaggacgacuccaagcacaagcgcgagcaggaccacucccgcuccuccuccuccuccgccucccccuccucccccuccucccgcgaggagaaggaguccaagaaggagcgcgaggaggaguucaagacccaccacgagaugaaggaguacuccggcuucgccggcgucucccgcccccgcggcaccuuccacgacgaccgcgacgacggcgucgacuacugggccaagcgcggccgcggccgcggcaccuuccagcgcggccgcggccgcuucaacuucaagaaguccggcuccucccccaaguggacccacgacaaguaccagggcgacggcaucgucgaggacgaggaggagaccauggagaacaacgaggagaagaaggaccgccgcaaggaggagaaggaguga

SEQ ID NO: 40287 - RNA, 1644 nt, Artificial Sequence
  derived and/or modified sequence opt2 from BCO1__Homo_sapiens__NP_059125
auggacaucaucuucggccgcaaccgcaaggagcagcucgagcccguccgcgccaaggucaccggcaagauccccgccuggcuccagggcacccuccuccgcaacggccccggcaugcacaccgucggcgagucccgcuacaaccacugguucgacggccucgcccuccuccacuccuucaccauccgcgacggcgaggucuacuaccgcuccaaguaccuccgcuccgacaccuacaacaccaacaucgaggccaaccgcaucgucgucuccgaguucggcaccauggccuaccccgaccccugcaagaacaucuucuccaaggccuucuccuaccucucccacaccauccccgacuucaccgacaacugccucaucaacaucaugaagugcggcgaggacuucuacgccaccuccgagaccaacuacauccgcaagaucaacccccagacccucgagacccucgagaaggucgacuaccgcaaguacgucgccgucaaccucgccaccucccacccccacuacgacgaggccggcaacguccucaacaugggcaccuccaucgucgagaagggcaagaccaaguacgucaucuucaagauccccgccaccguccccgagggcaagaagcagggcaagucccccuggaagcacaccgaggucuucugcuccauccccucccgcucccuccucucccccuccuacuaccacuccuucggcgucaccgagaacuacgucaucuuccucgagcagcccuuccgccucgacauccucaagauggccaccgccuacauccgccgcauguccugggccuccugccucgccuuccaccgcgaggagaagaccuacauccacaucaucgaccagcgcacccgccagcccguccagaccaaguucuacaccgacgccauggucgucuuccaccacgucaacgccuacgaggaggacggcugcaucgucuucgacgucaucgccuacgaggacaacucccucuaccagcucuucuaccucgccaaccucaaccaggacuucaaggagaacucccgccucaccuccguccccacccuccgccgcuucgccgucccccuccacgucgacaagaacgccgaggucggcaccaaccucaucaaggucgccuccaccaccgccaccgcccucaaggaggaggacggccaggucuacugccagcccgaguuccucuacgagggccucgagcucccccgcgucaacuacgcccacaacggcaagcaguaccgcuacgucuucgccaccggcguccaguggucccccauccccaccaagaucaucaaguacgacauccucaccaaguccucccucaaguggcgcgaggacgacugcuggcccgccgagccccucuucguccccgcccccggcgccaaggacgaggacgacggcgucauccucuccgccaucgucuccaccgacccccagaagcuccccuuccuccucauccucgacgccaaguccuucaccgagcucgcccgcgccuccgucgacgucgacaugcacauggaccuccacggccucuucaucaccgacauggacugggacaccaagaagcaggccgccuccgaggagcagcgcgaccgcgccuccgacugccacggcgccccccucaccuga

SEQ ID NO: 40288 - RNA, 1620 nt, Artificial Sequence
  derived and/or modified sequence opt2 from BCO2__Homo_sapiens__NP_001243326
augggcaacaccccccagaagaaggccgucuucggccagugccgcggccuccccugcgucgccccccuccucaccaccgucgaggaggccccccgcggcaucuccgcccgcgucuggggccacuuccccaaguggcucaacggcucccuccuccgcaucggccccggcaaguucgaguucggcaaggacaaguacaaccacugguucgacggcauggcccuccuccaccaguuccgcauggccaagggcaccgucaccuaccgcuccaaguuccuccaguccgacaccuacaaggccaacuccgccaagaaccgcaucgucaucuccgaguucggcacccucgcccuccccgaccccugcaagaacgucuucgagcgcuucaugucccgcuucgagcuccccggcaaggccgccgccaugaccgacaacaccaacgucaacuacguccgcuacaagggcgacuacuaccucugcaccgagaccaacuucaugaacaaggucgacaucgagacccucgagaagaccgagaaggucgacugguccaaguucaucgccgucaacggcgccaccgcccacccccacuacgaccccgacggcaccgccuacaacaugggcaacuccuucggccccuacggcuucuccuacaaggucauccgcgucccccccgagaaggucgaccucggcgagaccauccacggcguccaggucaucugcuccaucgccuccaccgagaagggcaagcccuccuacuaccacuccuucggcaugacccgcaacuacaucaucuucaucgagcagccccucaagaugaaccucuggaagaucgccaccuccaagauccgcggcaaggccuucuccgacggcaucuccugggagccccagugcaacacccgcuuccacgucgucgagaagcgcaccggccagcuccuccccggccgcuacuacuccaagcccuucgucaccuuccaccagaucaacgccuucgaggaccagggcugcgucaucaucgaccucugcugccaggacaacggccgcacccucgaggucuaccagcuccagaaccuccgcaaggccggcgagggccucgaccagguccacaacuccgccgccaaguccuucccccgccgcuucguccucccccucaacgucucccucaacgcccccgagggcgacaaccucuccccccucuccuacaccuccgccuccgccgucaagcaggccgacggcaccaucuggugcucccacgagaaccuccaccaggaggaccucgagaaggagggcggcaucgaguucccccagaucuacuacgaccgcuucuccggcaagaaguaccacuucuucuacggcugcggcuuccgccaccucgucggcgacucccucaucaaggucgacgucgucuggcgcgaggacggcuucuaccccuccgagcccgucuucguccccgcccccggcaccaacgaggaggacggcggcgucauccucuccgucgucaucacccccaaccagaacgaguccaacuuccuccucguccucgacgccaagaacuucgaggagcucggccgcgccgagguccccguccagaugcccuacggcuuccacggcaccuucauccccaucuga

SEQ ID NO: 40289 - RNA, 5166 nt, Artificial Sequence
  derived and/or modified sequence opt2 from BCOR__Homo_sapiens__NP_001116855
augcucuccgccaccccccucuacggcaacguccacuccuggaugaacuccgagcgcguccgcaugugcggcgccuccgaggaccgcaagauccucgucaacgacggcgacgccuccaaggcccgccucgagcuccgcgaggagaacccccucaaccacaacgucgucgacgccuccaccgcccaccgcaucgacggccucgccgcccucuccauggaccgcaccggccucauccgcgagggccuccgcguccccggcaacaucgucuacuccucccucugcggccucggcuccgagaagggccgcgaggccgccaccuccacccucggcggccucggcuucuccuccgagcgcaaccccgagaugcaguucaagcccaacacccccgagaccgucgaggccuccgccgucuccggcaagccccccaacggcuucuccgccaucuacaagaccccccccggcauccagaaguccgccgucgccaccgccgaggcccucggccucgaccgccccgccuccgacaagcaguccccccucaacaucaacggcgccuccuaccuccgccuccccugggucaaccccuacauggagggcgccacccccgccaucuaccccuuccucgacucccccaacaaguacucccucaacauguacaaggcccuccucccccagcaguccuacucccucgcccagccccucuacucccccgucugcaccaacggcgagcgcuuccucuaccucccccccccccacuacgucggcccccacauccccuccucccucgccucccccaugcgccucuccacccccuccgccucccccgccauccccccccucguccacugcgccgacaagucccuccccuggaagaugggcgucucccccggcaaccccgucgacucccacgccuacccccacauccagaacuccaagcagccccgcguccccuccgccaaggccgucaccuccggccuccccggcgacaccgcccuccuccucccccccuccccccgccccuccccccgcguccaccuccccacccagcccgccgccgacaccuacuccgaguuccacaagcacuacgcccgcaucuccaccucccccuccgucgcccucuccaagcccuacaugaccgucuccuccgaguuccccgccgcccgccucuccaacggcaaguaccccaaggcccccgagggcggcgagggcgcccagcccguccccggccacgcccgcaagaccgccguccaggaccgcaaggacggcuccucccccccccuccucgagaagcagaccgucaccaaggacgucaccgacaagccccucgaccucuccuccaaggucgucgacgucgacgccuccaaggccgaccacaugaagaagauggcccccaccguccucguccacucccgcgccggcuccggccucguccucuccggcuccgagauccccaaggagacccucuccccccccggcaacggcugcgccaucuaccgcuccgagaucaucuccaccgcccccuccuccugggucguccccggccccucccccaacgaggagaacaacggcaaguccaugucccucaagaacaaggcccucgacugggccaucccccagcagcgcuccuccuccugcccccgcaugggcggcaccgacgccgucaucaccaacgucuccggcuccgucuccuccgccggccgccccgccuccgccucccccgcccccaacgccaacgccgacggcaccaagaccucccgcuccuccgucgagaccacccccuccgucauccagcacgucggccagccccccgccacccccgccaagcacuccuccuccaccuccuccaagggcgccaaggccuccaaccccgagcccuccuucaaggccaacgagaacggccucccccccuccuccaucuuccucucccccaacgaggccuuccgcuccccccccauccccuacccccgcuccuaccuccccuaccccgcccccgagggcaucgccgucuccccccucucccuccacggcaagggccccgucuacccccaccccguccuccuccccaacggcucccucuuccccggccaccucgcccccaagcccggccuccccuacggccuccccaccggccgccccgaguucgucaccuaccaggacgcccucggccucggcaugguccaccccaugcucaucccccacacccccaucgagaucaccaaggaggagaagcccgagcgccgcucccgcucccacgagcgcgcccgcuacgaggaccccacccuccgcaaccgcuucuccgagauccucgagaccuccuccaccaagcuccaccccgacguccccaccgacaagaaccucaagcccaaccccaacuggaaccagggcaagaccgucgucaaguccgacaagcucgucuacgucgaccuccuccgcgaggagcccgacgccaagaccgacaccaacgucuccaagcccuccuucgccgccgaguccgucggccaguccgccgagccccccaagcccuccgucgagcccgcccuccagcagcaccgcgacuucaucgcccuccgcgaggagcucggccgcaucuccgacuuccacgagaccuacaccuucaagcagcccgucuucaccgucuccaaggacuccguccucgccggcaccaacaaggagaaccucggccuccccgucuccacccccuuccucgagcccccccucggcuccgacggccccgccgucaccuucggcaagacccaggaggaccccaagcccuucugcgucggcuccgccccccccuccgucgacgucacccccaccuacaccaaggacggcgccgacgaggccgaguccaacgacggcaagguccucaagcccaagcccuccaagcucgccaagcgcaucgccaacuccgccggcuacgucggcgaccgcuucaagugcgucaccaccgagcucuacgccgacuccucccagcucucccgcgagcagcgcgcccuccagauggagggccuccaggaggacuccauccucugccuccccgccgccuacugcgagcgcgccaugaugcgcuucuccgagcucgagaugaaggagcgcgagggcggccaccccgccaccaaggacuccgagaugugcaaguucucccccgccgacugggagcgccucaagggcaaccaggacaagaagcccaaguccgucacccucgaggaggccaucgccgagcagaacgaguccgagcgcugcgaguacuccgucggcaacaagcaccgcgaccccuucgaggcccccgaggacaaggaccuccccgucgagaaguacuucgucgagcgccagcccgucuccgagccccccgccgaccaggucgccuccgacaugccccacucccccacccuccgcgucgaccgcaagcgcaaggucuccggcgacuccucccacaccgagaccaccgccgaggagguccccgaggacccccuccucaaggccaagcgccgccgcgucuccaagggccuccaccccaagaagcagcgccaccuccuccaccuccgcgagcgcugggagcagcaggucuccgccgccgacggcaagcccggccgccagucccgcaaggaggucacccaggccacccagcccgaggccaucccccagggcaccaacaucaccgaggagaagcccggccgcaagcgcgccgaggccaagggcaaccgcuccugguccgaggagucccucaagcccuccgacaacgagcagggccuccccgucuucuccggcuccccccccaugaagucccucuccuccaccuccgccggcggcaagaagcaggcccagcccuccugcgcccccgccucccgcccccccgccaagcagcagaagaucaaggagaaccagaagaccgacguccucugcgccgacgaggaggaggacugccaggccgccucccuccuccagaaguacaccgacaacuccgagaagcccuccggcaagcgccucugcaagaccaagcaccucaucccccaggagucccgccgcggccucccccucaccggcgaguacuacgucgagaacgccgacggcaaggucaccguccgccgcuuccgcaagcgccccgagcccuccuccgacuacgaccucucccccgccaagcaggagcccaagcccuucgaccgccuccagcagcuccuccccgccucccaguccacccagcuccccugcuccuccuccccccaggagaccacccagucccgccccaugccccccgaggcccgccgccucaucgucaacaagaacgccggcgagacccuccuccagcgcgccgcccgccucggcuacgaggaggucguccucuacugccucgagaacaagaucugcgacgucaaccaccgcgacaacgccggcuacugcgcccuccacgaggccugcgcccgcggcuggcucaacaucguccgccaccuccucgaguacggcgccgacgucaacugcuccgcccaggacggcacccgcccccuccacgacgccgucgagaacgaccaccucgagaucguccgccuccuccucuccuacggcgccgaccccacccucgccaccuacuccggccgcaccaucaugaagaugacccacuccgagcucauggagaaguuccucaccgacuaccucaacgaccuccagggccgcaacgacgacgacgccuccggcaccugggacuucuacggcuccuccgucugcgagcccgacgacgaguccggcuacgacguccucgccaacccccccggccccgaggaccaggacgacgacgacgacgccuacuccgacgucuucgaguucgaguucuccgagaccccccuccuccccugcuacaacauccaggucuccgucgcccagggcccccgcaacuggcuccuccucuccgacguccucaagaagcucaagauguccucccgcaucuuccgcugcaacuuccccaacgucgagaucgucaccaucgccgaggccgaguucuaccgccaggucuccgccucccuccucuucuccugcuccaaggaccucgaggccuucaaccccgaguccaaggagcuccucgaccucgucgaguucaccaacgagauccagacccuccucggcuccuccgucgaguggcuccaccccuccgaccucgccuccgacaacuacugguga

SEQ ID NO: 40290 - RNA, 5136 nt, Artificial Sequence
  derived and/or modified sequence opt2 from BCORL1__Homo_sapiens__NP_068765
augaucuccaccgccccccucuacuccggcguccacaacuggaccuccuccgaccgcauccgcaugugcggcaucaacgaggagcgccgcgccccccucuccgacgaggaguccaccaccggcgacugccagcacuucggcucccaggaguucugcgucuccuccuccuucuccaaggucgagcucaccgccgucggcuccggcuccaacgcccgcggcgccgaccccgacggcuccgccaccgagaagcucggccacaaguccgaggacaagcccgacgacccccagcccaagauggacuacgccggcaacgucgccgaggccgagggccuccucgucccccucuccucccccggcgacggccucaagcuccccgccuccgacuccgccgaggccuccaacucccgcgccgacugcuccuggaccccccucaacacccagauguccaagcaggucgacugcucccccgccggcgucaaggcccucgacucccgccagggcgucggcgagaagaacaccuucauccucgccacccucggcaccggcguccccgucgagggcacccucccccucgucaccaccaacuucuccccccuccccgcccccaucugcccccccgcccccggcuccgccuccgucccccacuccguccccgacgccuuccaggucccccucuccguccccgcccccgucccccacuccggccucguccccguccaggucgccaccuccguccccgcccccucccccccccucgcccccguccccgcccucgcccccgccccccccuccguccccacccucaucuccgacuccaacccccucuccgucuccgccuccguccucguccccguccccgccuccgccccccccuccggccccgucccccucuccgcccccgcccccgccccccucuccguccccgucuccgcccccccccucgcccucauccaggcccccgucccccccuccgcccccacccucguccucgcccccguccccacccccguccucgcccccaugcccgccuccaccccccccgccgcccccgccccccccuccguccccaugcccacccccacccccuccuccggcccccccuccacccccacccucauccccgccuucgcccccacccccguccccgcccccacccccgcccccaucuucacccccgcccccacccccaugcccgccgccacccccgccgccauccccaccuccgcccccauccccgccuccuucucccucucccgcgucugcuuccccgccgcccaggcccccgccaugcagaaggucccccucuccuuccagcccggcaccguccucacccccucccagccccucgucuacauccccccccccuccugcggccagccccucuccgucgccacccuccccaccacccucggcgucuccuccacccucacccuccccguccuccccuccuaccuccaggaccgcugccuccccggcguccucgccucccccgagcuccgcuccuaccccuacgccuucuccgucgcccgcccccucaccuccgacuccaagcucgucucccucgaggucaaccgccuccccugcaccucccccuccggcuccaccaccacccagcccgcccccgacggcguccccggcccccucgccgacaccucccucgucaccgccuccgccaagguccuccccaccccccagccccuccuccccgcccccuccggcuccuccgcccccccccaccccgccaagaugcccuccggcaccgagcagcagaccgagggcaccuccgucaccuucuccccccucaagucccccccccagcucgagcgcgagauggccuccccccccgagugcuccgagaugccccucgaccucuccuccaaguccaaccgccagaagcucccccuccccaaccagcgcaagaccccccccaugcccguccucacccccguccacaccuccuccaaggcccuccucuccaccguccucucccgcucccagcgcaccacccaggccgccggcggcaacgucaccuccugccucggcuccaccuccucccccuucgucaucuuccccgagaucguccgcaacggcgaccccuccaccugggucaagaacuccaccgcccucaucuccaccauccccggcaccuacgucggcgucgccaaccccguccccgccucccuccuccucaacaaggaccccaaccucggccucaaccgcgacccccgccaccuccccaagcaggagcccaucuccaucaucgaccagggcgagcccaagggcaccggcgccaccugcggcaagaagggcucccaggccggcgccgagggccagcccuccaccgucaagcgcuacacccccgcccgcaucgcccccggccuccccggcugccagaccaaggagcucucccucuggaagcccaccggccccgccaacaucuacccccgcugcuccgucaacggcaagcccaccuccacccagguccuccccgucggcuggucccccuaccaccaggccucccuccucuccaucggcaucuccuccgccggccagcucacccccucccagggcgcccccauccgccccaccuccgucgucuccgaguucuccggcguccccucccucuccuccuccgaggccguccacggccuccccgagggccagccccgccccggcggcuccuucguccccgagcaggaccccgucaccaagaacaagaccugccgcaucgccgccaagcccuacgaggagcaggucaaccccguccuccucacccucuccccccagaccggcacccucgcccucuccguccagcccuccggcggcgacauccgcaugaaccagggccccgaggaguccgagucccaccucugcuccgacuccacccccaagauggagggcccccagggcgccugcggccucaagcucgccggcgacaccaagcccaagaaccagguccucgccaccuacaugucccacgagcucguccucgccaccccccagaaccuccccaagaugcccgagcucccccuccucccccacgacucccaccccaaggagcucauccucgacgucguccccuccucccgccgcggcuccuccaccgagcgcccccagcucggcucccaggucgaccucggccgcgucaagauggagaaggucgacggcgacgucgucuucaaccucgccaccugcuuccgcgccgacggccuccccgucgccccccagcgcggccaggccgagguccgcgccaaggccggccaggcccgcgucaagcaggaguccgucggcgucuucgccugcaagaacaaguggcagcccgacgacgucaccgagucccucccccccaagaagaugaagugcggcaaggagaaggacuccgaggagcagcagcuccagccccaggccaaggccgucguccgcuccucccaccgccccaagugccgcaagcuccccuccgacccccaggaguccaccaagaaguccccccgcggcgccuccgacuccggcaaggagcacaacggcguccgcggcaagcacaagcaccgcaagcccaccaagcccgagucccagucccccggcaagcgcgccgacucccacgaggagggcucccucgagaagaaggccaaguccuccuuccgcgacuucauccccgucguccucuccacccgcacccgcucccaguccggcuccaucugcuccuccuucgccggcauggccgacuccgacaugggcucccaggaggucuuccccaccgaggaggaggaggaggucacccccacccccgccaagcgccgcaagguccgcaagacccagcgcgacacccaguaccgcucccaccacgcccaggacaagucccuccucucccagggccgccgccaccucuggcgcgcccgcgagaugcccuggcgcaccgaggccgcccgccagaugugggacaccaacgaggaggaggaggaggaggaggaggagggccuccucaagcgcaagaagcgccgccgccagaagucccgcaaguaccagaccggcgaguaccucaccgagcaggaggacgagcagcgccgcaagggccgcgccgaccucaaggcccgcaagcagaagaccuccuccucccagucccucgagcaccgccuccgcaaccgcaaccuccuccuccccaacaagguccagggcaucuccgacucccccaacggcuuccuccccaacaaccucgaggagcccgccugccucgagaacuccgagaagcccuccggcaagcgcaagugcaagaccaagcacauggccaccgucuccgaggaggccaaggacgucguccucuacugccuccagaaggacuccgaggacgucaaccaccgcgacaacgccggcuacaccgcccuccacgaggccugcucccgcggcuggaccgacauccucaacauccuccucgagcacggcgccaacgucaacugcuccgcccaggacggcacccgccccguccacgacgccgucgucaacgacaaccucgagaccaucuggcuccuccucuccuacggcgccgaccccacccucgccaccuacuccggccagaccgccaugaagcucgccuccuccgacaccaugaagcgcuuccucuccgaccaccucuccgaccuccagggccgcgccgagggcgaccccggcgucuccugggacuucuacuccuccuccguccucgaggagaaggacggcuucgccugcgaccuccuccacaacccccccggcuccuccgaccaggagggcgacgaccccauggaggaggacgacuucauguucgagcucuccgacaagccccuccuccccugcuacaaccuccaggucuccgucucccgcggccccugcaacugguuccucuucuccgacguccucaagcgccucaagcucuccucccgcaucuuccaggcccgcuucccccacuucgagaucaccaccaugcccaaggccgaguucuaccgccaggucgccuccucccagcuccucacccccgccgagcgccccggcggccucgacgaccgcuccccccccggcuccuccgagaccgucgagcucguccgcuacgagcccgaccuccuccgccuccucggcuccgaggucgaguuccaguccugcaacuccuga

SEQ ID NO: 40291 - RNA, 3816 nt, Artificial Sequence
  derived and/or modified sequence opt2 from BCR__Homo_sapiens__NP_004318
auggucgaccccgucggcuucgccgaggccuggaaggcccaguuccccgacuccgagcccccccgcauggagcuccgcuccgucggcgacaucgagcaggagcucgagcgcugcaaggccuccauccgccgccucgagcaggaggucaaccaggagcgcuuccgcaugaucuaccuccagacccuccucgccaaggagaagaaguccuacgaccgccagcgcuggggcuuccgccgcgccgcccaggcccccgacggcgccuccgagccccgcgccuccgccucccgcccccagcccgcccccgccgacggcgccgaccccccccccgccgaggagcccgaggcccgccccgacggcgagggcucccccggcaaggcccgccccggcaccgcccgccgccccggcgccgccgccuccggcgagcgcgacgaccgcggcccccccgccuccgucgccgcccuccgcuccaacuucgagcgcauccgcaagggccacggccagcccggcgccgacgccgagaagcccuucuacgucaacgucgaguuccaccacgagcgcggccucgucaaggucaacgacaaggaggucuccgaccgcaucuccucccucggcucccaggccaugcagauggagcgcaagaagucccagcacggcgccggcuccuccgucggcgacgccucccgcccccccuaccgcggccgcuccuccgaguccuccugcggcgucgacggcgacuacgaggacgccgagcucaacccccgcuuccucaaggacaaccucaucgacgccaacggcggcucccgcccccccuggcccccccucgaguaccagcccuaccaguccaucuacgucggcggcaugauggagggcgagggcaagggcccccuccuccgcucccaguccaccuccgagcaggagaagcgccucaccuggccccgccgcuccuacuccccccgcuccuucgaggacugcggcggcggcuacacccccgacugcuccuccaacgagaaccucaccuccuccgaggaggacuucuccuccggccaguccucccgcgucucccccucccccaccaccuaccgcauguuccgcgacaagucccgcucccccucccagaacucccagcaguccuucgacuccuccuccccccccaccccccagugccacaagcgccaccgccacugccccgucgucgucuccgaggccaccaucgucggcguccgcaagaccggccagaucuggcccaacgacggcgagggcgccuuccacggcgacgccgacggcuccuucggcaccccccccggcuacggcugcgccgccgaccgcgccgaggagcagcgccgccaccaggacggccuccccuacaucgacgacucccccuccuccuccccccaccucuccuccaagggccgcggcucccgcgacgcccucgucuccggcgcccucgaguccaccaaggccuccgagcucgaccucgagaagggccucgagaugcgcaaguggguccucuccggcauccucgccuccgaggagaccuaccucucccaccucgaggcccuccuccuccccaugaagccccucaaggccgccgccaccaccucccagcccguccucaccucccagcagaucgagaccaucuucuucaagguccccgagcucuacgagauccacaaggaguucuacgacggccucuucccccgcguccagcaguggucccaccagcagcgcgucggcgaccucuuccagaagcucgccucccagcucggcgucuaccgcgccuucgucgacaacuacggcgucgccauggagauggccgagaagugcugccaggccaacgcccaguucgccgagaucuccgagaaccuccgcgcccgcuccaacaaggacgccaaggaccccaccaccaagaacucccucgagacccuccucuacaagcccgucgaccgcgucacccgcuccacccucguccuccacgaccuccucaagcacacccccgccucccaccccgaccacccccuccuccaggacgcccuccgcaucucccagaacuuccucuccuccaucaacgaggagaucaccccccgccgccaguccaugaccgucaagaagggcgagcaccgccagcuccucaaggacuccuucauggucgagcucgucgagggcgcccgcaagcuccgccacgucuuccucuucaccgaccuccuccucugcaccaagcucaagaagcaguccggcggcaagacccagcaguacgacugcaagugguacaucccccucaccgaccucuccuuccagauggucgacgagcucgaggccguccccaacaucccccucguccccgacgaggagcucgacgcccucaagaucaagaucucccagaucaagaacgacauccagcgcgagaagcgcgccaacaagggcuccaaggccaccgagcgccucaagaagaagcucuccgagcaggagucccuccuccuccucaugucccccuccauggccuuccgcguccacucccgcaacggcaaguccuacaccuuccucaucuccuccgacuacgagcgcgccgaguggcgcgagaacauccgcgagcagcagaagaagugcuuccgcuccuucucccucaccuccgucgagcuccagaugcucaccaacuccugcgucaagcuccagaccguccacuccaucccccucaccaucaacaaggaggacgacgagucccccggccucuacggcuuccucaacgucaucguccacuccgccaccggcuucaagcaguccuccaaccucuacugcacccucgaggucgacuccuucggcuacuucgucaacaaggccaagacccgcgucuaccgcgacaccgccgagcccaacuggaacgaggaguucgagaucgagcucgagggcucccagacccuccgcauccucugcuacgagaagugcuacaacaagaccaagauccccaaggaggacggcgaguccaccgaccgccucaugggcaagggccagguccagcucgacccccaggcccuccaggaccgcgacuggcagcgcaccgucaucgccaugaacggcaucgaggucaagcucuccgucaaguucaacucccgcgaguucucccucaagcgcaugcccucccgcaagcagaccggcgucuucggcgucaagaucgccgucgucaccaagcgcgagcgcuccaagguccccuacaucguccgccagugcgucgaggagaucgagcgccgcggcauggaggaggucggcaucuaccgcgucuccggcgucgccaccgacauccaggcccucaaggccgccuucgacgucaacaacaaggacgucuccgucaugauguccgagauggacgucaacgccaucgccggcacccucaagcucuacuuccgcgagcuccccgagccccucuucaccgacgaguucuaccccaacuucgccgagggcaucgcccucuccgaccccgucgccaaggaguccugcaugcucaaccuccuccucucccuccccgaggccaaccuccucaccuuccucuuccuccucgaccaccucaagcgcgucgccgagaaggaggccgucaacaagaugucccuccacaaccucgccaccgucuucggccccacccuccuccgccccuccgagaaggaguccaagcuccccgccaaccccucccagcccaucaccaugaccgacuccuggucccucgaggucaugucccagguccagguccuccucuacuuccuccagcucgaggccauccccgcccccgacuccaagcgccaguccauccucuucuccaccgaggucuga

SEQ ID NO: 40292 - RNA, 1260 nt, Artificial Sequence
  derived and/or modified sequence opt2 from BCS1L__Homo_sapiens__NP_001073335
augccccucuccgacuucauccucgcccucaaggacaaccccuacuucggcgccggcuucggccucgucggcgucggcaccgcccucgcccucgcccgcaagggcguccagcucggccucgucgccuuccgccgccacuacaugaucacccucgagguccccgcccgcgaccgcuccuacgccuggcuccucuccuggcucacccgccacuccacccgcacccagcaccucuccgucgagaccuccuaccuccagcacgaguccggccgcaucuccaccaaguucgaguucguccccucccccggcaaccacuucaucugguaccgcggcaaguggauccgcgucgagcgcucccgcgagaugcagaugaucgaccuccagaccggcacccccugggaguccgucaccuucaccgcccucggcaccgaccgcaaggucuucuucaacauccucgaggaggcccgcgagcucgcccuccagcaggaggagggcaagaccgucauguacaccgccgucggcuccgaguggcgccccuucggcuacccccgccgccgccgcccccucaacuccgucguccuccagcagggccucgccgaccgcaucguccgcgacguccaggaguucaucgacaaccccaagugguacaccgaccgcggcauccccuaccgccgcggcuaccuccucuacggcccccccggcugcggcaaguccuccuucaucaccgcccucgccggcgagcucgagcacuccaucugccuccucucccucaccgacuccucccucuccgacgaccgccucaaccaccuccucuccgucgccccccagcagucccucguccuccucgaggacgucgacgccgccuuccucucccgcgaccucgccgucgagaaccccgucaaguaccagggccucggccgccucaccuucuccggccuccucaacgcccucgacggcgucgccuccaccgaggcccgcaucgucuucaugaccaccaaccacgucgaccgccucgaccccgcccucauccgccccggccgcgucgaccucaaggaguacgucggcuacugcucccacuggcagcucacccagauguuccagcgcuucuaccccggccaggcccccucccucgccgagaacuucgccgagcacguccuccgcgccaccaaccagaucucccccgcccagguccagggcuacuucaugcucuacaagaacgaccccgucggcgccauccacaacgccgagucccuccgccgcuga

SEQ ID NO: 40293 - RNA, 1032 nt, Artificial Sequence
  derived and/or modified sequence opt2 from BDH1__Homo_sapiens__NP_976059
augcucgccacccgccucucccgcccccucucccgccuccccggcaagacccucuccgccugcgaccgcgagaacggcgcccgccgcccccuccuccucggcuccaccuccuucauccccaucggccgccgcaccuacgccuccgccgccgagcccgucggcuccaaggccguccucgucaccggcugcgacuccggcuucggcuucucccucgccaagcaccuccacuccaagggcuuccucgucuucgccggcugccucaugaaggacaagggccacgacggcgucaaggagcucgacucccucaacuccgaccgccuccgcaccguccagcucaacgucugcuccuccgaggaggucgagaaggucgucgagaucguccgcuccucccucaaggaccccgagaagggcauguggggccucgucaacaacgccggcaucuccaccuucggcgaggucgaguucaccucccucgagaccuacaagcaggucgccgaggucaaccucuggggcaccguccgcaugaccaaguccuuccucccccucauccgccgcgccaagggccgcgucgucaacaucuccuccaugcucggccgcauggccaaccccgcccgcucccccuacugcaucaccaaguucggcgucgaggccuucuccgacugccuccgcuacgagauguacccccucggcgucaaggucuccgucgucgagcccggcaacuucaucgccgccaccucccucuacucccccgaguccauccaggccaucgccaagaagaugugggaggagcuccccgaggucguccgcaaggacuacggcaagaaguacuucgacgagaagaucgccaagauggagaccuacugcuccuccggcuccaccgacaccucccccgucaucgacgccgucacccacgcccucaccgccaccacccccuacacccgcuaccaccccauggacuacuacugguggcuccgcaugcagaucaugacccaccuccccggcgccaucuccgacaugaucuacauccgcuga

SEQ ID NO: 40294 - RNA, 624 nt, Artificial Sequence
  derived and/or modified sequence opt2 from BDH2__Homo_sapiens__XP_005263197
augggccgccucgacggcaaggucaucauccucaccgccgccgcccagggcaucggccaggccgccgcccucgccuucgcccgcgagggcgccaaggucaucgccaccgacaucaacgaguccaagcuccaggagcucgagaaguaccccggcauccagacccgcguccucgacgucaccaagaagaagcagaucgaccaguucgccaacgaggucgagcgccucgacguccucuucaacgucgccggcuucguccaccacggcaccguccucgacugcgaggagaaggacugggacuucuccaugaaccucaacguccgcuccauguaccucaugaucaaggccuuccuccccaagaugcucgcccagaaguccggcaacaucaucaacauguccuccgucgccuccuccgucaagggcaccgucgacacccccucccuccaggagcgcauccaggcccgcggcaaccccgaggaggcccgcaacgacuuccucaagcgccagaagaccggccgcuucgccaccgccgaggagaucgccaugcucugcgucuaccucgccuccgacgaguccgccuacgucaccggcaaccccgucaucaucgacggcggcuggucccucuga

SEQ ID NO: 40295 - RNA, 1062 nt, Artificial Sequence
  derived and/or modified sequence opt2 from BDKRB1__Homo_sapiens__NP_000701
auggccuccuccuggcccccccucgagcuccaguccuccaaccagucccagcucuucccccagaacgccaccgccugcgacaacgcccccgaggccugggaccuccuccaccgcguccuccccaccuucaucaucuccaucugcuucuucggccuccucggcaaccucuucguccuccucgucuuccuccucccccgccgccagcucaacgucgccgagaucuaccucgccaaccucgccgccuccgaccucgucuucguccucggccuccccuucugggccgagaacaucuggaaccaguucaacuggcccuucggcgcccuccucugccgcgucaucaacggcgucaucaaggccaaccucuucaucuccaucuuccucgucgucgccaucucccaggaccgcuaccgcguccucguccaccccauggccucccgccgccagcagcgccgccgccaggcccgcgucaccugcguccucaucugggucgucggcggccuccucuccauccccaccuuccuccuccgcuccauccaggccguccccgaccucaacaucaccgccugcauccuccuccucccccacgaggccuggcacuucgcccgcaucgucgagcucaacauccucggcuuccuccucccccucgccgccaucgucuucuucaacuaccacauccucgccucccuccgcacccgcgaggaggucucccgcacccgcugcggcggccgcaaggacuccaagaccaccgcccucauccucacccucgucgucgccuuccucgucugcugggcccccuaccacuucuucgccuuccucgaguuccucuuccagguccaggccguccgcggcugcuucugggaggacuucaucgaccucggccuccagcucgccaacuucuucgccuucaccaacuccucccucaaccccgucaucuacgucuucgucggccgccucuuccgcaccaaggucugggagcucuacaagcagugcacccccaagucccucgcccccaucuccuccucccaccgcaaggagaucuuccagcucuucuggcgcaacuga

SEQ ID NO: 40296 - RNA, 1176 nt, Artificial Sequence
  derived and/or modified sequence opt2 from BDKRB2__Homo_sapiens__NP_000614
auguucucccccuggaagaucuccauguuccucuccguccgcgaggacuccguccccaccaccgccuccuucuccgccgacaugcucaacgucacccuccagggccccacccucaacggcaccuucgcccaguccaagugcccccaggucgaguggcucggcuggcucaacaccauccagccccccuuccucuggguccucuucguccucgccacccucgagaacaucuucguccucuccgucuucugccuccacaaguccuccugcaccgucgccgagaucuaccucggcaaccucgccgccgccgaccucauccucgccugcggccuccccuucugggccaucaccaucuccaacaacuucgacuggcucuucggcgagacccucugccgcgucgucaacgccaucaucuccaugaaccucuacuccuccaucugcuuccucaugcucgucuccaucgaccgcuaccucgcccucgucaagaccauguccaugggccgcaugcgcggcguccgcugggccaagcucuacucccucgucaucuggggcugcacccuccuccucuccucccccaugcucgucuuccgcaccaugaaggaguacuccgacgagggccacaacgucaccgccugcgucaucuccuaccccucccucaucugggaggucuucaccaacaugcuccucaacgucgucggcuuccuccucccccucuccgucaucaccuucugcaccaugcagaucaugcagguccuccgcaacaacgagaugcagaaguucaaggagauccagaccgagcgccgcgccaccguccucguccucgucguccuccuccucuucaucaucugcuggcuccccuuccagaucuccaccuuccucgacacccuccaccgccucggcauccucuccuccugccaggacgagcgcaucaucgacgucaucacccagaucgccuccuucauggccuacuccaacuccugccucaacccccucgucuacgucaucgucggcaagcgcuuccgcaagaaguccugggaggucuaccagggcgucugccagaagggcggcugccgcuccgagcccauccagauggagaacuccaugggcacccuccgcaccuccaucuccgucgagcgccagauccacaagcuccaggacugggccggcucccgccaguga

SEQ ID NO: 40297 - RNA, 744 nt, Artificial Sequence
  derived and/or modified sequence opt2 from BDNF__Homo_sapiens__NP_001137280
augaccauccucuuccucaccauggucaucuccuacuucggcugcaugaaggccgcccccaugaaggaggccaacauccgcggccagggcggccucgccuaccccggcguccgcacccacggcacccucgaguccgucaacggccccaaggccggcucccgcggccucaccucccucgccgacaccuucgagcacgucaucgaggagcuccucgacgaggaccagaagguccgccccaacgaggagaacaacaaggacgccgaccucuacaccucccgcgucaugcucuccucccaggucccccucgagcccccccuccucuuccuccucgaggaguacaagaacuaccucgacgccgccaacauguccaugcgcguccgccgccacuccgaccccgcccgccgcggcgagcucuccgucugcgacuccaucuccgagugggucaccgccgccgacaagaagaccgccgucgacauguccggcggcaccgucaccguccucgagaagguccccgucuccaagggccagcucaagcaguacuucuacgagaccaagugcaaccccaugggcuacaccaaggagggcugccgcggcaucgacaagcgccacuggaacucccagugccgcaccacccaguccuacguccgcgcccucaccauggacuccaagaagcgcaucggcuggcgcuucauccgcaucgacaccuccugcgucugcacccucaccaucaagcgcggccgcuga

SEQ ID NO: 40298 - RNA, 7875 nt, Artificial Sequence
  derived and/or modified sequence opt2 from BDP1__Homo_sapiens__NP_060899
auguuccgccgcgcccgccucuccgucaagcccaacguccgccccggcgucggcgcccgcggcuccaccgccuccaacccccagcgcggccgcgaguccccccgcccccccgaccccgccaccgacuccgccuccaagcccgccgagcccaccgacguccccaccgucgacuucggcggcgccgagccccaggagaaggccccccgcuccuccaccgagaagaccggcggcgacaacgacgucgaggaguccucccgcuccuccuccaccgucucccagcgccgcaagcgcaucuccuccaccuccucccucgucaaguccuccgucuccguccccuccgagucccacccccucuccaccaucaaccaggaggccccccagcccaccgccaccuccaccaaggagaagcagcccugcuccgaccgcuaccgcaucuacaaggcccagaagcuccgcgagaugcucaaggaggagcuccgcaaggagaagaagcaguggaagaacaaguacgccaucaacgagucccagcgcccccccgaccgcuccaagaugaccaugcgcgacuucaucuacuaccuccccgacaacaaccccaugaccuccucccucgagcaggagaagaagaccgagaagcccuccacccccguccagacccgcgagcaggagggcaaguccacccccaacgccgaggacaacgagauggaggaggagaccgacgacggcccccuccucgucccccgcgucaaggucgccgaggacggcuccaucauccucgacgaggagucccucaccgucgagguccuccgcaccaagggccccugcgucgucgaggagaacgaccccaucuucgagcgcggcuccaccaccaccuacuccuccuuccgcaagaacuacuacuccaagcccugguccaacaaggagaccgacauguucuuccucgccaucuccauggucggcaccgacuucuccaugaucggccagcucuucccccaccgcgcccgcaucgagaucaagaacaaguucaagcgcgaggagaagaccaacggcuggcgcaucgacaaggccuuccaggagaagcgccccuucgacuucgacuucuucgcccaccuccuccagaagguccucgccgaggaggagaagcgcaagcagaaguccgucaagaaccacucccucaaggagaagaaguccaccaagccccgcaagaacgucaaggucaagaaggucgccugcgagggcgucaacaacgaccccgacgaguccauguccucccgcaucuccgacaccgagcgcucccagaaggacgcccagaccgucgaggaggagucccucacccucucccgcgaggacgccgagcaggucgcccucgaggucgaccucaaccagaagaagcgccgccgcaagaagcaggacggcgccaacgagcucggcgucaacaaccuccucgagaacgccaccguccaggccggccccuccaagggcgagaagcacaagaacaagugccaggccauccgccccgagcucaaggagggcgagugcuccaaggagcagaugcucuccugcacccagaacaucgacggcaucgucggcuucgccuccaccgagaaggucgagaagcgcaccgaccccauccucucccucuccaaccagcaggacgccaccuccgucgccaccgaguccuccgaguccuccaccuccgaccuccccuccuucgaggucggcauccgcgcccucugcgaggucaacaacgccgagggcuccugcaucgaggagcgcaacgucgaccucaagaacaacucccucgagaucgaccagaccgagaacgucaagcccaugcuccgcggccgcuuccagcgccccaagcccaaccucucccgcgccggcaagaaguccguccucucccagggcaagaccgaguccgaguccaagaacucccacuccaagaccuccgucgagaagaaccacgucgagaaggacaagaugaacacccucgacauccuccgcauggagaccaccgagcgcgagaaccccgaggccgagaccgucuccguccucggcgagaagaacugccuccaggagggcucccagcucaaggcccuccgccccguccagguccgcggccgccuccagaagcccaagcccaacgccggcaaggccgccgagcgcaaggagauccucaucucccaggaggagaucggcgccaacgucgagaagaacgagaacgaguccugcgccgaccgcgacaccccccagcacauggaggaccagucccgcaaggacuucgaggaggaggacgucauccuccagcccgagaagaacgacuccuuccagaacguccagcccgacgagcccaagguccucaacgagugccucuccguccaggagaacaacaaggccaacaagcucaaccagguccccauccuccgcacccgcuuccagaagcccaagcccaacaucggccgcggcaccggccgccgcgagaucuccuccaaggaggagguccucgagaagauccucgucuccggcgagauggccgccgcccuccgcgagaccguccgccucgacaccucccccaaggagaugguccccgccgagaucaacaccaaggagaugcaguccgaccucaaggagaccggccgccgcgccaucuccccccgcgagaagauccucgacgucaucgacgacaccaucgagauggagaccggccucaaggccaugggccgcgagaucugccuccgcgagaagacccccgaggucaucgacgccaccgaggagaucgacaaggaccucgaggaggccggccgccgcgagaucuccccccagaagaacggccccgaggaggucaagccccucggcgaggucgagaccgaccucaaggccaccggcaacgaguccuccccccgcgagaagacccccgaggucaccgacgccaccgaggagaucgacaagaaccucgaggagaccggccgccgcaagaucuccccccgcgagaacggccccgaggaggucaagcccgucgacgagauggagaccgaccucaacgccaccggccgcgaguccuccccccgcgagaagacccccgaggucaucgacgccaccgaggagaucgaccucgaggagaccgagcgcgaggucuccccccaggagaacggccucgaggaggucaagccccucggcgagauggagaccgaccucaaggccaccggccgcgacuccuucccccgcggcaagacccccgaggucaucgacgccaucgaggagaucgagaucgaccucgaggagaccgagcgcgagaucuccccccaggagaacggccucgaggaggucaagccccucggcgagaugcagaccgaccucaaggccaccggccgcgagaucuccccccgcgagaagacccccgaggucaucgacgccaccgaggagaucgacaaggaccucgaggagaccggccgccgcgagaucucccccgaggagaacggccccgaggaggucaagcccgucgacgagauggagaccgaccucaagaccaccggccgcgagggcuccucccgcgagaagacccgcgaggucaucgacgccgccgaggucaucgagaccgaccucgaggagaccgagcgcgagaucuccccccaggagaacggccccgaggaggucaagcccgucggcaagauggagaccgaccucaaggagauccgcgaggagaucucccagcgcgagaagguccucgccgaguucuccgccauccgcgagaaggagaucgaccucaaggagaccggcaagcgcgacauccccaucauggagaaggucuccggcaagauggccgucgucgaggagauggaggccgaccucaaggagaccggcaaggagaacuuccgcgagcgcggcuccgaggagaucugcgucaccgaggagaaggucgccgagcucaagcagaccggcaagaccgacaucuccccccgcgagaacgagcucgaggagaccuccaccucccgccagaccgacacccaccucaugcaguccggcuccaacgacuucuccgccguccccucccucgacauccagaacaucuccuccgagguccucuccaugaugcacacccccgucgaggagaagcgcaacuccgagaaggaggucuccucccacuucucccacuucaagaucuccucccagacccacgaguccgacaagaccgagguccagggcauccagucccccgacguccccgagcaguucuccgacaucaaccucuccaagucccucccccaggagcagaagccccucgagaucaagcccgcccccuucguccgcucccgcuucaagcgccccaagcccaaccucgcccgcgccgcccucaagcgcgagaccaccgaguccgagaaguacaucuacgagaagaaguccgagaccaagaagauggagaccaucgucaugcaggagaacaacgagcagaccgacacccuccccucccagcacgacgaggccucccucaugaucucccgcgagaaggacacccucggccaccgcaacgaggaggccgucauccuccccugcacccagaccgagcgcaaccucucccccuccaacuccugcgagcccaaggaggagucccaguccgcccccguccagaagaacgacuccgucgucuccgucggcaccaacaacgucaacaccuuccagcaggagaugaaggaguccgucauccagaccgcccgccagguccgcggccgccuccagcgcccccgccccaacauccgcaagaccggccagcgccagaucgucgacaagggcgaggccaagggcaucaucaaggagggccgcaccauccuccccaaggacgagaccgagaagaagguccucaccgucuccaacucccagaucgagaccgagaucgagguccccuccuccgccguccccgagcaccgcauguacgagaaccagucccaggucguccucgucgagaaccuccacgucaacaagaccaacgagaccauccgccacgagaacaagcccuacguccccuccuccgcccagaugacccgccgcaaguuccagaaggccaagcccaaccucggccgcgcccacuccaagaaggaggagcccguccucgagaaggucaccaccgaccaguccaaggagggcaagcccgaggaccaccuccuccagaagggcgccuccaacacccagcuccuccucaaggagaaggccgagcuccucaccucccucgaggucuccgcccgcaaggacugcgucggcuccaaggaguccgcccucgccaagaucgacgccgagcucgaggaggucggccccucccgccgcgucggcgaggagaccgucggcgacaacucccccuccuccgucgucgaggagcaguaccucaacaagcucaccuccugcccccagccccucaacgagaccuccuacuccaagaucgcccucgacggcaagaccaccaucuccuccaccuccgaguacgagcgcaaccgcggcgagcgccgcucccacaagaaguucaagcccaacgucacccgcggccgcggcuccaagcgcguccgcggcaagaccuccaagaaggagccccgcgccuccaaggccaugcucgucacccuccgcgccucccaggaggaggacgacgacgccgacgacuucgaguccgacuacgaggaggaguccuaccaccucgcccccgaggaggucaacaaggcccccgucuucguccccgucggccuccgcucccccgagcccgucuccgcccagaucgaggagaccauggaggagcucgagaucaccgucaacguccccgacgucggcugcaucgccgucgucgagcacgagcuccccaacaccgacgucaccaccgaggagaugaagcaggaggagaaccucuccguccccuucgagaugaccaccuccgagcacauccaggacgagcccggcaccaacgacggcuccaccgaggccgccaucacccuccucaccaugggcgaccucguccuccaguccgagaucuccuccgagcagggcgacgucggcgucugcaucaucccccacguccacuccaaggacaagucccacauccccuccucccucgacaacgucaaccacaagaucguccacgagugccaggagcucuccucccccgucaucaccaccucccccgccuccuucgaggagaacaagaucguccucgaggagcaguccucccgcgaggagaucucccucauggagaaggucaaggagaacgccacccccacccgcaacaccaucuccaaggucaccuccaaccuccgcauccgcucccgccucgccaagcccaagcccaaccucgagaagacccucggcaccaaccgccucgacgacuaccaggaggucuccucccucugcgucaccaagggcgccgagauggagacccagcgcgagaccgagaagaacgccuccaaggccaccgagcucgagaacaagaaccucggccccgucaccaccgccgagaacaaggaccaguccaagcucgccugcguccacggcaucaagggcaccuccaucuccuccgaggucaaccucaccgagcgcaacgagaaccaggaggaguccucccaggagguccacaugcucuccgucgcccccgucgccuccuccgagaccggccccugcacccucggccucgaccgcggccucggcgagaacuccgucgaggagccccagaucaaggacuccaagggcgacuccguccucacccuccccguccccgaguacacccccaccuccauccccgagguccagcaggagaacaucaucaacccccaggaccucaccgucaaccucgucgccaacgucccccaggacggcgaggacgagcaggccuucauccucacccucgucgagauccccgccaacgccgucgaggaguucaccgacgccaccgcccaguucaugcccaacccccuccuccccgcccccauccucgucaaguccgucaacaccgaggagcgcggcgacauguccaucugccuccccgccaccuccgucggccaggacgccaugggccucuccaucuccggccgcgacaacuccaagaagccccccgacaaccucgaccucgucucccgcaagcgcuuccagugccgccucgacaagaacgaccacaucccccccgccaagaagcgcucccucacccuccgcgacgacugccaggaguacaccaccgagguccacuccaaggagcucaccaacgucuucgaggagaccggcgagucccacaagggccaggacaucuuccucaccuccggcuccacccucaccacccccgagccccagcgccagcaggucgaggccgccuuccagucccgcggcucccgcucccccgacgccugcauggacaagaacgucccccagcucccccaggacgagaugaucgucuccgacaaggaggagcgcaccgacgccgcccccaagucccagcagauggacucccgcaccuccuccuccaaggccucccucucccgccccggccgccgcccccucggcuuccucucccucaucugcuccaagaacucccucgaguccgacgagcccaugcagguccacuccaagaagcgccucaagccccucauccccggccuccgcaagaagcucaagcgcuccaaccccuucaacgagucccaggagaagaaccgcgaguccuccgaccuccuccccucccccuccgucaucaccacccaguccgagaacaucuccuccuccgccacccaggucuccugcgaccagccccuccucaaggagggcuacaaguccgcccagaagcgcgccccccagggcgaggccaccaccgucuccgaguacuucuucaacgacaucuucaucgaggucgacgagaccgaguga

SEQ ID NO: 40299 - RNA, 627 nt, Artificial Sequence
  derived and/or modified sequence opt2 from BEAN1__Homo_sapiens__NP_001184154
augcgcuacgccugcuccuccuccgaggacuggccccccccccucgacaucuccuccgacggcgacgucgacgccaccguccuccgcgagcucuaccccgacuccccccccggcgucucccucucccgccuccgcugguccgccaugauguacaccggcuccuucaccuacuggguccgcuccaugcucucccgccacaagcucgacgccauccucggccgccucggcuacaccgccacccucgaguccgaguucucccucguccaggccaucuccaaggagaacgucaagcagauggucuucaagaucuuccucguccgcgucuccugcgaggccguccuccgcaccgccggcacccgcaugcucgagcccggcaccgagaagcucgcccgcacccacucccgccacuccuccgagaagcgccucgucaagcccugcuccugccucgagggcguccagcccggccccggcuccggcggcccccagcagggccccuccgagggcgucggcuccgagaccgcccucgccgagggcaccgccggccagcgcucccuccccauggcccucucccccuccgaggucuccaccgcccccaacucccuccccuccggcucccccguccucuga

SEQ ID NO: 40300 - RNA, 1782 nt, Artificial Sequence
  derived and/or modified sequence opt2 from BEGAIN__Homo_sapiens__NP_001153003
auggagaagcucuccgcccuccaggagcagaagggcgagcuccgcaagcgccucuccuacaccacccacaagcucgagaagcucgagaccgaguucgacuccacccgccacuaccucgagaucgagcuccgccgcgcccaggaggagcucgagaaggucaccgagaagcuccgccgcauccaguccaacuacauggcccuccagcgcaucaaccaggagcucgaggacaagcucuaccgcaugggccagcacuacgaggaggagaagcgcgcccucucccacgagaucgucgcccucaacucccaccuccucgaggccaaggucaccaucgacaagcucuccgaggacaacgagcucuaccgcaaggacugcaaccucgccgcccagcuccuccagugcucccagaccuacggccgcguccacaaggucuccgagcuccccuccgacuuccaggagcgcgucucccuccacauggagaagcacggcugcucccuccccuccccccucugccaccccgccuacgccgacuccguccccaccugcgucaucgccaagguccucgagaagcccgaccccgccucccucuccucccgccucuccgacgccuccgcccgcgaccucgccuucugcgacggcgucgagaagcccggcccccgcccccccuacaagggcgacaucuacugcuccgacaccgcccucuacugccccgaggagcgccgccgcgaccgccgccccuccgucgacgcccccgucaccgacgucggcuuccuccgcgcccagaacuccaccgacuccgccgccgaggaggaggaggaggccgaggccgccgccuuccccgccggcuuccagcacgaggccuuccccuccuacgccggcucccuccccaccuccuccuccuacuccuccuucuccgccaccuccgaggagaaggagcacgcccaggccuccacccucaccgccucccagcaggccaucuaccucaacucccgcgacgagcucuucgaccgcaagccccccgccaccaccuacgagggcuccccccgcuucgccaaggccaccgccgccgucgccgccccccucgaggccgaggucgcccccggcuucggccgcaccaugucccccuaccccgccgagaccuuccgcuuccccgccucccccggcccccagcaggcccucaugccccccaaccucuggucccuccgcgccaagcccggcaccgcccgccuccccggcgaggacaugcgcggccaguggcgcccccucuccgucgaggacaucggcgccuacuccuaccccgucuccgccgccggccgcgccucccccugcuccuucuccgagcgcuacuacggcggcgccggcggcucccccggcaagaaggccgacggccgcgccuccccccucuacgccuccuacaaggccgacuccuucuccgagggcgacgaccucucccagggccaccucgccgagcccugcuuccuccgcgccggcggcgaccucucccucucccccggccgcuccgccgacccccuccccggcuacgcccccuccgagggcggcgacggcgaccgccucggcguccagcucugcggcaccgccuccucccccgagcccgagcagggcucccgcgacucccucgagcccuccuccauggaggccucccccgagaugcaccccgccgcccgccucuccccccagcaggccuucccccgcaccggcggcuccggccucucccgcaaggacucccucaccaaggcccagcucuacggcacccuccucaacuga

SEQ ID NO: 40301 - RNA, 2487 nt, Artificial Sequence
  derived and/or modified sequence opt2 from BEND3__Homo_sapiens__NP_001073919
augaacuccaccgaguucaccgaggacgucgaggagguccucaaguccaucaccgucaaggucgagaccgaggccgaggacgccgcccucgacugcuccgucaacucccgcaccuccgagaagcacuccgucgacuccguccucaccgcccuccaggacuccuccaagcgcaagcagcucgucuccgacggccuccucgacuccguccccggcgucaagcgccgccgccucauccccgaggcccuccucgccggcaugcgcaaccgcgagaacuccucccccugccagggcaacggcgagcaggccggccgcggccgcucccucggcaacgucuggcccggcgaggaggagcccugcaacgacgccaccacccccuccuacaagaagccccucuacggcaucucccacaagaucauggagaagaagaacccccccuccggcgaccuccucaacgucuacgagcucuucgagaaggccaacgccuccaacucccccuccucccuccgccuccucaacgagccccagaagcgcgacugcggcuccaccggcgccggcaccgacaacgaccccaacaucuacuuccucauccagaagauguucuacaugcucaacacccucaccuccaacaugucccagcuccacuccaaggucgaccuccucucccucgaggucucccgcaucaagaagcaggucucccccaccgagauggucgccaaguuccagcccccccccgaguaccagcucaccgccgccgagcucaagcagaucgucgaccagucccucuccggcggcgaccucgccugccgccuccucguccagcucuuccccgagcucuucuccgacgucgacuucucccgcggcugcuccgccugcggcuucgccgccaagcgcaagcucgagucccuccaccuccagcucauccgcaacuacgucgaggucuacuaccccuccgucaaggacaccgccgucuggcaggccgagugccucccccagcucaacgacuucuucucccgcuucugggcccagcgcgagauggaggacucccagcccuccggccaggucgccuccuucuucgaggccgagcaggucgaccccggccacuuccucgacaacaaggaccaggaggaggcccucucccucgaccgcuccuccaccaucgccuccgaccacgucgucgacacccaggaccucaccgaguuccucgacgaggccuccucccccggcgaguucgccgucuuccuccuccaccgccucuuccccgagcucuucgaccaccgcaagcucggcgagcaguacuccugcuacggcgacggcggcaagcaggagcucgacccccagcgccuccagaucauccgcaacuacaccgagaucuacuuccccgacaugcaggaggaggaggccuggcuccagcagugcgcccagcgcaucaacgacgagcucgagggccucggccucgacgccggcuccgagggcgaccccccccgcgacgacugcuacgacuccuccucccuccccgacgacaucuccgucgucaaggucgaggacuccuucgagggcgagcgccccggccgccgcuccaagaagaucuggcucguccccaucgacuucgacaagcucgagaucccccagcccgacuucgagguccccggcgccgacugccuccucuccaaggagcagcuccgcuccaucuacgaguccucccucuccaucggcaacuucgccucccgccuccucguccaccucuuccccgagcucuucacccacgagaaccuccgcaagcaguacaacugcuccggcucccucggcaagaagcagcucgaccccucccgcaucaagcucauccgccacuacguccagcuccucuacccccgcgccaagaacgaccgcgucuggacccucgaguucgucggcaagcucgacgagcgcugccgccgccgcgacaccgagcagcgccgcuccuaccagcagcagcgcaagguccacguccccggccccgagugccgcgaccucaccuccuacgccaucaaccccgagcgcuuccgcgaggaguucgagggccccccccucccccccgagcgcuccuccaaggacuucugcaagaucccccucgacgagcucgucguccccucccccgacuuccccguccccucccccuaccuccucuccgacaaggagguccgcgagaucguccagcagucccucuccgucggcaacuucgccgcccgccuccucguccgccucuuccccgagcucuucaccgccgagaaccuccgccuccaguacaaccacuccggcgccugcaacaagaagcagcucgaccccacccgccuccgccucauccgccacuacgucgaggccgucuaccccgucgagaagauggaggaggucuggcacuacgagugcauccccuccaucgacgagcgcugccgccgccccaaccgcaagaagugcgacauccucaagaaggccaagaaggucgagaaguga

SEQ ID NO: 40302 - RNA, 1326 nt, Artificial Sequence
  derived and/or modified sequence opt2 from BEND4__Homo_sapiens__NP_001153019
auggaggaggagaugcagcccgccgaggagggccccuccguccccaagaucuacaagcagcgcucccccuacuccguccucaagaccuuccccuccaagcgccccgcccucgccaagcgcuacgagcgccccacccucgucgagcucccccacguccgcgcccccccccccccccccccccccuucgccccccacgccgccgucuccaucuccuccuccgagccccccccccagcaguuccaggcccaguccuccuacccccccggccccggccgcgccgccgccgccgccuccuccuccucccccuccugcacccccgccaccucccagggccaccuccgcacccccgcccagcccccccccgccucccccgccgccuccuccuccuccuccuucgccgccgucguccgcuacggccccggcgccgccgccgccgccggcaccggcggcaccggcuccgacuccgccucccucgagcucuccgccgagucccgcaugauccucgacgccuucgcccagcagugcucccgcguccucucccuccucaacugcggcggcaagcuccucgacuccaaccacucccaguccaugaucuccugcgucaagcaggagggcuccuccuacaacgagcgccaggagcacugccacaucggcaagggcguccacucccagaccuccgacaacgucgacaucgagaugcaguacaugcagcgcaagcagcagaccuccgccuuccuccgcgucuucaccgacucccuccagaacuaccuccucuccggcuccuuccccacccccaaccccuccuccgccuccgaguacggccaccucgccgacgucgacccccucuccaccucccccguccacacccucggcggcuggaccucccccgccaccuccgagucccacggccaccccuccuccuccacccuccccgaggaggaggaggaggaggacgaggagggcuacugcccccgcugccaggagcucgagcaggaggucaucucccuccagcaggagaacgaggagcuccgccgcaagcucgaguccauccccguccccugccagaccguccucgacuaccucaagaugguccuccagcaccacaaccagcuccucaucccccagcccgccgaccagcccaccgagggcuccaagcagcuccucaacaacuaccccgucuacaucaccuccaagcagugggacgaggccgucaacuccuccaagaaggacggccgccgccuccuccgcuaccucauccgcuucgucuucaccaccgacgagcucaaguacuccugcggccucggcaagcgcaagcgcauccacuga

SEQ ID NO: 40303 - RNA, 1815 nt, Artificial Sequence
  derived and/or modified sequence opt2 from BEST1__Homo_sapiens__NP_001132915
auguucgagaagcucacccucuacugcgacuccuacauccagcucauccccaucuccuucguccucggcuucuacgucacccucgucgucacccgcugguggaaccaguacgagaaccuccccuggcccgaccgccucaugucccucgucuccggcuucgucgagggcaaggacgagcagggccgccuccuccgccgcacccucauccgcuacgccaaccucggcaacguccucauccuccgcuccgucuccaccgccgucuacaagcgcuuccccuccgcccagcaccucguccaggccggcuucaugacccccgccgagcacaagcagcucgagaagcucucccucccccacaacauguucuggguccccugggucugguucgccaaccucuccaugaaggccuggcucggcggccgcauccgcgaccccauccuccuccagucccuccucaacgagaugaacacccuccgcacccagugcggccaccucuacgccuacgacuggaucuccaucccccucgucuacacccaggucgucaccgucgccgucuacuccuucuuccucaccugccucgucggccgccaguuccucaaccccgccaaggccuaccccggccacgagcucgaccucgucguccccgucuucaccuuccuccaguucuucuucuacgucggcuggcucaaggucgccgagcagcucaucaaccccuucggcgaggacgacgacgacuucgagaccaacuggaucgucgaccgcaaccuccaggucucccuccucgccgucgacgagaugcaccaggaccucccccgcauggagcccgacauguacuggaacaagcccgagccccagccccccuacaccgccgccuccgcccaguuccgccgcgccuccuucaugggcuccaccuucaacaucucccucaacaaggaggagauggaguuccagcccaaccaggaggacgaggaggacgcccacgccggcaucaucggccgcuuccucggccuccagucccacgaccaccaccccccccgcgccaacucccgcaccaagcuccucuggcccaagcgcgagucccuccuccacgagggccuccccaagaaccacaaggccgccaagcagaacguccgcggccaggaggacaacaaggccuggaagcucaaggccgucgacgccuucaaguccgccccccucuaccagcgccccggcuacuacuccgccccccagaccccccucucccccacccccauguucuucccccucgagcccuccgcccccuccaagcuccacuccgucaccggcaucgacaccaaggacaagucccucaagaccgucuccuccggcgccaagaaguccuucgagcuccucuccgaguccgacggcgcccucauggagcaccccgaggucucccagguccgccgcaagaccgucgaguucaaccucaccgacaugcccgagauccccgagaaccaccucaaggagccccucgagcagucccccaccaacauccacaccacccucaaggaccacauggaccccuacugggcccucgagaaccgcuccguccuccaccucaaccagggccacugcaucgcccucugccccacccccgccucccucgcccucucccuccccuuccuccacaacuuccucggcuuccaccacugccaguccacccucgaccuccgccccgcccucgccuggggcaucuaccucgccaccuucaccggcauccucggcaagugcuccggccccuuccucaccucccccugguaccaccccgaggacuuccucggccccggcgagggccgcuga

SEQ ID NO: 40304 - RNA, 1530 nt, Artificial Sequence
  derived and/or modified sequence opt2 from BEST2__Homo_sapiens__XP_005260020
augaccgucaccuacaccgcccgcgucgccaacgcccgcuucggcggcuucucccagcuccuccuccucuggcgcggcuccaucuacaagcuccucuggcgcgagcuccucugcuuccucggcuucuacauggcccucuccgccgccuaccgcuucguccucaccgagggccagaagcgcuacuucgagaagcucgucaucuacugcgaccaguacgccucccucauccccgucuccuucguccucggcuucuacgucacccucgucgucaaccgcugguggucccaguaccucugcaugccccuccccgacgcccucaugugcgucgucgccggcaccguccacggccgcgacgaccgcggccgccucuaccgccgcacccucaugcgcuacgccggccucuccgccguccucauccuccgcuccgucuccaccgccgucuucaagcgcuuccccaccaucgaccacgucgucgaggccggcuucaugacccgcgaggagcgcaagaaguucgagaaccucaacuccuccuacaacaaguacuggguccccugcgucugguucuccaaccucgccgcccaggcccgccgcgagggccgcauccgcgacaacuccgcccucaagcuccuccucgaggagcucaacgucuuccgcggcaagugcggcaugcucuuccacuacgacuggaucuccgucccccucgucuacacccaggucgucaccaucgcccucuacuccuacuuccucgccugccucaucggccgccaguuccucgaccccgcccagggcuacaaggaccacgaccucgaccucugcguccccaucuucacccuccuccaguucuucuucuacgccggcuggcucaaggucgccgagcagcucaucaaccccuucggcgaggacgacgacgacuucgagaccaacuuccucaucgaccgcaacuuccaggucuccaugcucgccgucgacgagauguacgacgaccucgccguccucgagaaggaccucuacugggacgccgccgaggcccgcgcccccuacaccgccgccaccgucuuccagcuccgccagcccuccuuccagggcuccaccuucgacaucacccucgccaaggaggacaugcaguuccagcgccucgacggccucgacggccccaugggcgaggcccccggcgacuuccuccagcgccuccuccccgccggcgccggcauggucgccggcggcccccucggccgccgccucuccuuccuccuccgcaagaacuccugcgucuccgaggccuccaccggcgccuccugcuccugcgccgucguccccgagggcgccgcccccgagugcuccugcggcgacccccuccucgaccccggccuccccgagcccgaggcccccccccccgccggccccgagccccucacccucauccccggccccgucgagcccuucuccaucgucaccaugcccggcccccgcggccccgccccccccuggcuccccucccccaucggcgaggaggaggagaaccucgccuga

SEQ ID NO: 40305 - RNA, 357 nt, Artificial Sequence
  derived and/or modified sequence opt2 from BET1__Homo_sapiens__NP_005859
augcgccgcgccggccucggcgagggcgucccccccggcaacuacggcaacuacggcuacgccaacuccggcuacuccgccugcgaggaggagaacgagcgccucaccgagucccuccgcuccaaggucaccgccaucaagucccucuccaucgagaucggccacgaggucaagacccagaacaagcuccucgccgagauggacucccaguucgacuccaccaccggcuuccucggcaagaccaugggcaagcucaagauccucucccgcggcucccagaccaagcuccucugcuacaugaugcucuucucccucuucgucuucuucaucaucuacuggaucaucaagcuccgcuga

SEQ ID NO: 40306 - RNA, 336 nt, Artificial Sequence
  derived and/or modified sequence opt2 from BET1L__Homo_sapiens__NP_001092257
auggccgacugggcccgcgcccagucccccggcgccgucgaggagauccucgaccgcgagaacaagcgcauggccgacucccucgccuccaaggucacccgccucaagucccucgcccucgacaucgaccgcgacgccgaggaccagaaccgcuaccucgacggcauggacuccgacuucaccuccaugaccucccuccucaccggcuccgucaagcgcuucuccaccauggcccgcuccggccaggacaaccgcaagcuccucugcggcauggccgucggccucaucgucgccuucuucauccucuccuacuuccucucccgcgcccgcaccuga

SEQ ID NO: 40307 - RNA, 378 nt, Artificial Sequence
  derived and/or modified sequence opt2 from BEX1__Homo_sapiens__NP_060946
auggaguccaaggagaagcgcgccgucaacucccucuccauggagaacgccaaccaggagaacgaggagaaggagcaggucgccaacaagggcgagccccucgcccucccccucgacgccggcgaguacugcgucccccgcggcaaccgccgccgcuuccgcguccgccagcccauccuccaguaccgcugggacaugaugcaccgccucggcgagccccaggcccgcaugcgcgaggagaacauggagcgcaucggcgaggagguccgccagcucauggagaagcuccgcgagaagcagcucucccacucccuccgcgccgucuccaccgaccccccccaccacgaccaccacgacgaguucugccucaugcccuga

SEQ ID NO: 40308 - RNA, 483 nt, Artificial Sequence
  derived and/or modified sequence opt2 from BEX2__Homo_sapiens__NP_001161871
augcagaagauggucgucugcggcgccaagugcugcggcgacgccccccacgucgagaaccgcgaggaggagaccgcccgcaucggccccggcgucauggaguccaaggaggagcgcgcccucaacaaccucaucgucgagaacgucaaccaggagaacgacgagaaggacgagaaggagcaggucgccaacaagggcgagccccucgcccucccccucaacgucuccgaguacugcgucccccgcggcaaccgccgccgcuuccgcguccgccagcccauccuccaguaccgcugggacaucaugcaccgccucggcgagccccaggcccgcaugcgcgaggagaacauggagcgcaucggcgaggagguccgccagcucauggagaagcuccgcgagaagcagcucucccacucccuccgcgccgucuccaccgaccccccccaccacgaccaccacgacgaguucugccucaugcccuga

SEQ ID NO: 40309 - RNA, 363 nt, Artificial Sequence
  derived and/or modified sequence opt2 from BEX4__Homo_sapiens__NP_001073894
auggaguccaaggaggagcucgccgccaacaaccucaacggcgagaacgcccagcaggagaacgagggcggcgagcaggcccccacccagaacgaggaggagucccgccaccucggcggcggcgagggccagaagcccggcggcaacauccgccgcggccgcguccgccgccucguccccaacuuccgcugggccauccccaaccgccacaucgagcacaacgaggcccgcgacgacgucgagcgcuucgucggccagaugauggagaucaagcgcaagacccgcgagcagcagaugcgccacuacaugcgcuuccagacccccgagcccgacaaccacuacgacuucugccucauccccuga

SEQ ID NO: 40310 - RNA, 1353 nt, Artificial Sequence
  derived and/or modified sequence opt2 from BFAR__Homo_sapiens__NP_057645
auggaggagccccagaaguccuacgucaacaccauggaccucgagcgcgacgagccccucaaguccaccggcccccagaucuccgucuccgaguucuccugccacugcugcuacgacauccucgucaaccccaccacccucaacugcggccacuccuucugccgccacugccucgcccucuggugggccuccuccaagaagaccgagugccccgagugccgcgagaagugggagggcuuccccaaggucuccauccuccuccgcgacgccaucgagaagcucuuccccgacgccauccgccuccgcuucgaggacauccagcagaacaacgacaucguccagucccucgccgccuuccagaaguacggcaacgaccagaucccccucgcccccaacaccggccgcgccaaccagcagaugggcggcggcuucuucuccggcguccucaccgcccucaccggcgucgccgucguccuccucgucuaccacugguccucccgcgaguccgagcacgaccuccucguccacaaggccgucgccaaguggaccgccgaggaggucguccucuggcucgagcagcucggccccugggccucccucuaccgcgagcgcuuccucuccgagcgcgucaacggccgccuccuccucacccucaccgaggaggaguucuccaagacccccuacaccaucgagaacuccucccaccgccgcgccauccucauggagcucgagcgcgucaaggcccucggcgucaagcccccccagaaccucugggaguacaaggccgucaaccccggccgcucccucuuccuccucuacgcccucaaguccuccccccgccucucccuccucuaccucuaccucuucgacuacaccgacaccuuccuccccuucauccacaccaucugcccccuccaggaggacuccuccggcgaggacaucgucaccaagcuccucgaccucaaggagcccaccuggaagcaguggcgcgaguuccucgucaaguacuccuuccuccccuaccagcucaucgccgaguucgccugggacuggcucgagguccacuacuggaccucccgcuuccucaucaucaacgccaugcuccucuccguccucgagcucuucuccuucuggcgcaucuggucccgcuccgagcucaagaccgucccccagcgcauguggucccacuucuggaaggucuccacccagggccucuucgucgccauguucuggccccucaucccccaguucgucugcaacugccucuucuacugggcccucuacuucaaccccaucaucaacaucgaccucgucgucaaggagcuccgccgccucgagacccagguccucuga

SEQ ID NO: 40311 - RNA, 1623 nt, Artificial Sequence
  derived and/or modified sequence opt2 from BFSP1__Homo_sapiens__NP_001155177
auguacgagaacgagugcgagugccagcuccuccucaaggagaugcucgagcgccucaacaaggaggccgacgaggcccuccuccacaaccuccgccuccagcucgaggcccaguuccuccaggacgacaucuccgccgccaaggaccgccacaagaagaaccuccucgagguccagaccuacaucuccauccuccagcagaucauccacaccaccccccccgccuccaucgucaccuccggcaugcgcgaggagaagcuccucaccgagcgcgaggucgccgcccuccgcucccagcucgaggagggccgcgagguccucucccaccuccaggcccagcgcgucgagcuccaggcccagaccaccacccucgagcaggccaucaaguccgcccacgagugcuacgacgacgagauccagcucuacaacgagcagaucgagacccuccgcaaggagaucgaggagaccgagcgcguccucgagaaguccuccuacgacugccgccagcucgccgucgcccagcagacccucaagaacgagcucgaccgcuaccaccgcaucaucgagaucgagggcaaccgccucaccuccgccuucaucgagacccccaucccccucuucacccagucccacggcgucucccucuccaccggcuccggcggcaaggaccucacccgcgcccuccaggacaucaccgccgccaagccccgccagaaggcccuccccaagaacgucccccgccgcaaggagaucaucaccaaggacaagaccaacggcgcccucgaggacgccccccucaagggccucgaggacaccaagcucguccaggucguccucaaggaggaguccgaguccaaguucgaguccgaguccaaggaggucuccccccucacccaggagggcgcccccgaggacguccccgacggcggccagaucuccaagggcuucggcaagcucuaccgcaaggucaaggagaagguccgcucccccaaggagcccgagacccccaccgagcucuacaccaaggagcgccacguccucgucaccggcgacgccaacuacgucgacccccgcuucuacgucuccuccaucaccgccaagggcggcgucgccgucuccgucgccgaggacuccguccucuacgacggccaggucgagcccucccccgagucccccaagcccccccucgagaacggccaggucggccuccaggagaaggaggacggccagcccaucgaccagcagcccaucgacaaggagaucgagcccgacggcgccgagcucgagggccccgaggagaagcgcgagggcgaggagcgcgacgaggagucccgccgccccugcgccauggucacccccggcgccgaggagcccuccauccccgagccccccaagcccgccgccgaccaggacggcgccgagguccucggcacccgcucccgcucccuccccgagaagggcccccccaaggcccucgccuacaagaccgucgaggucgucgaguccaucgagaagaucuccaccgaguccauccagaccuacgaggagaccgccgucaucgucgagaccaugaucggcaagaccaaguccgacaagaagaaguccggcgagaaguccuccuga

SEQ ID NO: 40312 - RNA, 1248 nt, Artificial Sequence
  derived and/or modified sequence opt2 from BFSP2__Homo_sapiens__NP_003562
auguccgagcgccgcgucgucgucgaccuccccaccuccgccuccuccuccaugccccuccagcgccgccgcgccuccuuccgcggcccccgcuccuccuccucccucgaguccccccccgccucccgcaccaacgccauguccggccucguccgcgcccccggcgucuacgucggcaccgcccccuccggcugcaucggcggccucggcgcccgcgucacccgccgcgcccucggcaucuccuccgucuuccuccagggccuccgcuccuccggccucgccaccguccccgcccccggccucgagcgcgaccacggcgccgucgaggaccucggcggcugccucgucgaguacauggccaagguccacgcccucgagcaggucucccaggagcucgagacccagcuccgcaugcaccucgaguccaaggccacccgcuccggcaacuggggcgcccuccgcgccuccugggccuccuccugccagcaggucggcgaggccguccucgagaacgcccgccucaugcuccagaccgagaccauccaggccggcgccgacgacuucaaggagcgcuacgagaacgagcagcccuuccgcaaggccgccgaggaggagaucaacucccucuacaaggucaucgacgaggccaaccucaccaagauggaccucgagucccagaucgagucccucaaggaggagcucggcucccucucccgcaacuacgaggaggacgucaagcuccuccacaagcagcucgccggcugcgagcucgagcagauggacgcccccaucggcaccggccucgacgacauccucgagaccauccgcauccagugggagcgcgacgucgagaagaaccgcgucgaggccggcgcccuccuccaggccaagcagcaggccgaggucgcccacaugucccagacccaggaggagaagcucgccgccgcccuccgcgucgagcuccacaacaccuccugccagguccagucccuccaggccgagaccgagucccuccgcgcccucaagcgcggccucgagaacacccuccacgacgccaagcacuggcacgacauggagcuccagaaccucggcgccgucgucggccgccucgaggccgagcuccgcgagauccgcgccgaggccgagcagcagcagcaggagcgcgcccaccuccucgcccgcaagugccagcuccagaaggacgucgccuccuaccacgcccuccucgaccgcgaggaguccggcuga

SEQ ID NO: 40313 - RNA, 303 nt, Artificial Sequence
  derived and/or modified sequence opt2 from BGLAP__Homo_sapiens__NP_954642
augcgcgcccucacccuccucgcccuccucgcccucgccgcccucugcaucgccggccaggccggcgccaagcccuccggcgccgaguccuccaagggcgccgccuucgucuccaagcaggagggcuccgaggucgucaagcgcccccgccgcuaccucuaccaguggcucggcgcccccguccccuaccccgacccccucgagccccgccgcgaggucugcgagcucaaccccgacugcgacgagcucgccgaccacaucggcuuccaggaggccuaccgccgcuucuacggccccgucuga

SEQ ID NO: 40314 - RNA, 1107 nt, Artificial Sequence
  derived and/or modified sequence opt2 from BGN__Homo_sapiens__NP_001702
auguggccccucuggcgccucgucucccuccucgcccucucccaggcccuccccuucgagcagcgcggcuucugggacuucacccucgacgacggccccuucaugaugaacgacgaggaggccuccggcgccgacaccuccggcguccucgaccccgacuccgucacccccaccuacuccgccaugugccccuucggcugccacugccaccuccgcgucguccagugcuccgaccucggccucaaguccguccccaaggagaucucccccgacaccacccuccucgaccuccagaacaacgacaucuccgagcuccgcaaggacgacuucaagggccuccagcaccucuacgcccucguccucgucaacaacaagaucuccaagauccacgagaaggccuucuccccccuccgcaagcuccagaagcucuacaucuccaagaaccaccucgucgagaucccccccaaccuccccuccucccucgucgagcuccgcauccacgacaaccgcauccgcaagguccccaagggcgucuucuccggccuccgcaacaugaacugcaucgagaugggcggcaacccccucgagaacuccggcuucgagcccggcgccuucgacggccucaagcucaacuaccuccgcaucuccgaggccaagcucaccggcauccccaaggaccuccccgagacccucaacgagcuccaccucgaccacaacaagauccaggccaucgagcucgaggaccuccuccgcuacuccaagcucuaccgccucggccucggccacaaccagauccgcaugaucgagaacggcucccucuccuuccuccccacccuccgcgagcuccaccucgacaacaacaagcucgcccgcguccccuccggccuccccgaccucaagcuccuccaggucgucuaccuccacuccaacaacaucaccaaggucggcgucaacgacuucugccccaugggcuucggcgucaagcgcgccuacuacaacggcaucucccucuucaacaaccccguccccuacugggagguccagcccgccaccuuccgcugcgucaccgaccgccucgccauccaguucggcaacuacaagaaguga

SEQ ID NO: 40315 - RNA, 570 nt, Artificial Sequence
  derived and/or modified sequence opt2 from BHLHA15__Homo_sapiens__NP_803238
augaagaccaagaaccgccccccccgccgccgcgcccccguccaggacaccgaggccacccccggcgagggcacccccgacggcucccuccccaaccccggccccgagcccgccaagggccuccgcucccgccccgcccgcgccgccgcccgcgcccccggcgagggccgccgccgccgccccggccccuccggccccggcggccgccgcgacuccuccauccagcgccgccucgaguccaacgagcgcgagcgccagcgcaugcacaagcucaacaacgccuuccaggcccuccgcgaggucaucccccacguccgcgccgacaagaagcucuccaagaucgagacccucacccucgccaagaacuacaucaagucccucaccgccaccauccucaccauguccuccucccgccuccccggccucgagggccccggccccaagcucuaccagcacuaccagcagcagcagcaggucgccggcggcgcccucggcgccaccgaggcccagccccagggccaccuccagcgcuacuccacccagauccacuccuuccgcgagggcaccuga

SEQ ID NO: 40316 - RNA, 708 nt, Artificial Sequence
  derived and/or modified sequence opt2 from BHLHA9__Homo_sapiens__NP_001157877
augcuccgcggcgcccccggccucggccucaccgcccgcaagggcgccgaggacuccgccgaggaccucggcggccccugccccgagcccggcggcgacuccggcguccucggcgccaacggcgccuccugcucccgcggcgaggccgaggagcccgccggccgccgccgcgcccgccccguccgcuccaaggcccgccgcauggccgccaacguccgcgagcgcaagcgcauccucgacuacaacgaggccuucaacgcccuccgccgcgcccuccgccacgaccucggcggcaagcgccucuccaagaucgccacccuccgccgcgccauccaccgcaucgccgcccucucccucguccuccgcgccucccccgccccccgcggccccugcggccaccucgagugccacggccccgccgcccgcggcgacaccggcgacaccggcgccuccccccccccccccgccggccccucccucgcccgccccgacgccgcccgccccuccguccccuccgccccccgcugcgccuccugccccccccacgccccccucgcccgccccuccgccgucgccgagggccccggccucgcccaggccuccggcggcuccuggcgccgcugccccggcgccuccuccgccggccccccccccuggccccgcggcuaccuccgcuccgcccccggcaugggccacccccgcuccuga

SEQ ID NO: 40317 - RNA, 1644 nt, Artificial Sequence
  derived and/or modified sequence opt2 from BHLHB9__Homo_sapiens__NP_001135999
auggccggcaccaagaacaagacccgcgcccaggccaagaccgagaagaaggccgccauccaggccaaggccggcgccgagcgcgaggccaccggcgucguccgccccgucgccaagacccgcgccaaggccaaggccaagaccggcuccaagaccgacgccgucgccgagaugaaggccgucuccaagaacaaggucgucgccgagaccaaggagggcgcccucuccgagcccaagacccucggcaaggccaugggcgacuucacccccaaggccggcaacgaguccaccuccuccaccugcaagaacgaggccggcaccgacgccugguucugggccggcgaggaggccaccaucaacuccugguucuggaacggcgaggaggccggcaacuccuucuccaccaagaacgacaagcccgagaucggcgcccaggucugcgccgaggagcucgagcccgccgccggcgccgacugcaagccccgcuccggcgccgaggaggaggaggaggagaacgucaucggcaacugguucugggagggcgacgacaccuccuucgaccccaaccccaagcccgucucccgcaucgucaagccccagcccgucuacgagaucaacgagaagaaccgccccaaggacugguccgaggucaccaucuggcccaacgcccccgccgucacccccgccguccucggcuuccgcucccaggcccccuccgaggccuccccccccuccuacaucguccucgccuccgccgaggagaacgccugcucccuccccgucgccaccgccugccgccccucccgcaacacccgcuccugcucccagcccauccccgagugccgcuucgacuccgaccccugcauccagaccaucgacgagauccgccgccagauccgcauccgcgaggucaacggcaucaagcccuucgccugccccugcaagauggagugcuacauggacuccgaggaguucgagaagcucgucucccuccucaaguccaccaccgacccccucauccacaagaucgcccgcaucgccaugggcguccacaacguccaccccuucgcccaggaguucaucaacgaggucggcgucgucacccucaucgagucccuccucuccuuccccucccccgagaugcgcaagaagaccgucaucacccucaacccccccuccggcgacgagcgccagcgcaagaucgagcuccacgucaagcacaugugcaaggagaccauguccuucccccucaacucccccggccagcaguccggccucaagauccucggccagcucaccaccgacuucguccaccacuacaucgucgccaacuacuucuccgagcucuuccaccuccucuccuccggcaacugcaagacccgcaaccucguccucaagcuccuccucaacauguccgagaaccccaccgccgcccgcgacaugaucaacaugaaggcccucgccgcccucaagcucaucuucaaccagaaggaggccaaggccaaccucgucuccggcgucgccaucuucaucaacaucaaggagcacauccgcaagggcuccaucgucgucgucgaccaccucuccuacaacacccucauggccaucuuccgcgaggucaaggagaucaucgagaccauguga

SEQ ID NO: 40318 - RNA, 1146 nt, Artificial Sequence
  derived and/or modified sequence opt2 from BHLHE22__Homo_sapiens__NP_689627
auggagcgcggcaugcaccucggcgccgccgccgccggcgaggacgaccucuuccuccacaagucccucuccgccuccaccuccaagcgccucgaggccgccuuccgcuccaccccccccggcauggaccucucccucgccccccccccccgcgagcgccccgccuccuccuccuccuccccccucggcugcuucgagcccgccgaccccgagggcgccggccuccuccuccccccccccggcggcggcggcggcggcuccgccggcuccggcggcggcggcggcggcggcgucggcguccccggccuccucgucggcuccgccggcgucggcggcgaccccucccucuccucccuccccgccggcgccgcccucugccucaaguacggcgaguccgccucccgcggcuccgucgccgaguccuccggcggcgagcagucccccgacgacgacuccgacggccgcugcgagcucguccuccgcgccggcgucgccgacccccgcgccucccccggcgccggcggcggcggcgccaaggccgccgagggcugcuccaacgcccaccuccacggcggcgccuccgucccccccggcggccucggcggcggcggcggcggcggcuccuccuccggcuccuccggcggcggcggcggcuccggcuccggcuccggcggcuccuccuccuccuccuccuccuccuccaagaaguccaaggagcagaaggcccuccgccucaacaucaacgcccgcgagcgccgccgcaugcacgaccucaacgacgcccucgacgagcuccgcgccgucauccccuacgcccacucccccuccguccgcaagcucuccaagaucgccacccuccuccucgccaagaacuacauccucaugcaggcccaggcccucgaggagaugcgccgccucgucgccuaccucaaccagggccaggccaucuccgccgccucccuccccuccuccgccgccgccgccgccgccgccgccgcccuccaccccgcccucggcgccuacgagcaggccgccggcuaccccuucuccgccggccucccccccgccgccuccugccccgagaagugcgcccucuucaacuccgucuccuccucccucugcaagcagugcaccgagaagcccuga

SEQ ID NO: 40319 - RNA, 726 nt, Artificial Sequence
  derived and/or modified sequence opt2 from BHLHE23__Homo_sapiens__NP_542173
auguccauccgcccccccggcgagccccccucccccggcggcgccgccauggccgagcucaagucccucuccggcgacgccuaccucgcccucucccacggcuacgccgccgccgccgccggccucgccuacggcgccgcccgcgagcccgaggccgcccgcggcuacggcacccccggccccggcggcgaccuccccgccgcccccgccccccgcgcccccgcccaggccgccgaguccuccggcgagcaguccggcgacgaggacgacgccuucgagcagcgccgccgccgccgcggccccggcuccgccgccgacggccgccgccgcccccgcgagcagcgcucccuccgccucuccaucaacgcccgcgagcgccgccgcaugcacgaccucaacgacgcccucgacggccuccgcgccgucauccccuacgcccacucccccuccguccgcaagcucuccaagaucgccacccuccuccucgccaagaacuacauccucaugcaggcccaggcccucgacgagaugcgccgccucgucgccuuccucaaccagggccagggccucgccgcccccgucaacgccgccccccucacccccuucggccaggccaccgucugccccuucuccgccggcgccgcccucggccccugccccgacaagugcgccgccuucuccggcacccccuccgcccucugcaagcacugccacgagaagcccuga

SEQ ID NO: 40320 - RNA, 1239 nt, Artificial Sequence
  derived and/or modified sequence opt2 from BHLHE40__Homo_sapiens__NP_003661
auggagcgcauccccuccgcccagcccccccccgccugccuccccaaggcccccggccucgagcacggcgaccuccccggcauguaccccgcccacauguaccaggucuacaagucccgccgcggcaucaagcgcuccgaggacuccaaggagaccuacaagcucccccaccgccucaucgagaagaagcgccgcgaccgcaucaacgagugcaucgcccagcucaaggaccuccuccccgagcaccucaagcucaccacccucggccaccucgagaaggccgucguccucgagcucacccucaagcacgucaaggcccucaccaaccucaucgaccagcagcagcagaagaucaucgcccuccaguccggccuccaggccggcgagcucuccggccgcaacgucgagaccggccaggagauguucugcuccggcuuccagaccugcgcccgcgagguccuccaguaccucgccaagcacgagaacacccgcgaccucaaguccucccagcucgucacccaccuccaccgcgucgucuccgagcuccuccagggcggcaccucccgcaagcccuccgaccccgcccccaaggucauggacuucaaggagaagcccuccucccccgccaagggcuccgagggccccggcaagaacugcguccccgucauccagcgcaccuucgcccacuccuccggcgagcaguccggcuccgacaccgacaccgacuccggcuacggcggcgaguccgagaagggcgaccuccgcuccgagcagcccugcuucaaguccgaccacggccgccgcuucaccaugggcgagcgcaucggcgccaucaagcaggaguccgaggagccccccaccaagaagaaccgcaugcagcucuccgacgacgagggccacuucaccuccuccgaccucaucuccucccccuuccucggcccccacccccaccagccccccuucugccuccccuucuaccucaucccccccuccgccaccgccuaccuccccaugcucgagaagugcugguaccccaccuccguccccguccucuaccccggccucaacgccuccgccgccgcccucuccuccuucaugaaccccgacaagaucuccgccccccuccucaugccccagcgccuccccuccccccuccccgcccaccccuccgucgacuccuccguccuccuccaggcccucaagcccauccccccccucaaccucgagaccaaggacuga

SEQ ID NO: 40321 - RNA, 1449 nt, Artificial Sequence
  derived and/or modified sequence opt2 from BHLHE41__Homo_sapiens__NP_110389
auggacgagggcaucccccaccuccaggagcgccagcuccucgagcaccgcgacuucaucggccucgacuacuccucccucuacaugugcaagcccaagcgcuccaugaagcgcgacgacaccaaggacaccuacaagcucccccaccgccucaucgagaagaagcgccgcgaccgcaucaacgagugcaucgcccagcucaaggaccuccuccccgagcaccucaagcucaccacccucggccaccucgagaaggccgucguccucgagcucacccucaagcaccucaaggcccucaccgcccucaccgagcagcagcaccagaagaucaucgcccuccagaacggcgagcgcucccucaagucccccauccaguccgaccucgacgccuuccacuccggcuuccagaccugcgccaaggagguccuccaguaccucucccgcuucgaguccuggaccccccgcgagccccgcugcguccagcucaucaaccaccuccacgccgucgccacccaguuccuccccaccccccagcuccucacccagcaggucccccucuccaagggcaccggcgcccccuccgccgccggcuccgccgccgcccccugccucgagcgcgccggccagaagcucgagccccucgccuacugcguccccgucauccagcgcacccagcccuccgccgagcucgccgccgagaacgacaccgacaccgacuccggcuacggcggcgaggccgaggcccgccccgaccgcgagaagggcaagggcgccggcgccucccgcgucaccaucaagcaggagccccccggcgaggacucccccgcccccaagcgcaugaagcucgacucccgcggcggcggcuccggcggcggccccggcggcggcgccgccgccgccgccgccgcccuccucggccccgaccccgccgccgccgccgcccuccuccgccccgacgccgcccuccucuccucccucgucgccuucggcggcggcggcggcgcccccuucccccagcccgccgccgccgccgcccccuucugccuccccuucugcuuccucucccccuccgccgccgccgccuacguccagcccuuccucgacaaguccggccucgagaaguaccucuaccccgccgccgccgccgcccccuucccccuccucuaccccggcauccccgcccccgccgccgccgccgccgccgccgccgccgccgccgccgccgccgccgccuuccccugccucuccuccguccucucccccccccccgagaaggccggcgccgccgccgccacccuccucccccacgaggucgccccccucggcgccccccacccccagcacccccacggccgcacccaccuccccuucgccggcccccgcgagcccggcaaccccgaguccuccgcccaggaggaccccucccagcccggcaaggaggcccccuga

SEQ ID NO: 40322 - RNA, 900 nt, Artificial Sequence
  derived and/or modified sequence opt2 from BHMT2__Homo_sapiens__NP_001171476
auggcccccgccggccgccccggcgccaagaagggcauccucgagcgccucgaguccggcgaggucgucaucggcgacggcuccuuccucaucacccucgagaagcgcggcuacgucaaggccggccucuggacccccgaggccgucaucgagcaccccgacgccguccgccagcuccacauggaguuccuccgcgccggcuccaacgucaugcagaccuucaccuucuccgccuccgaggacaacauggaguccaaguacuucgagcacgucgaggaggccgucugggccgucgagguccucaaggaguccgaccgccccgucgccgucaccaugugcaucggccccgagggcgacaugcacgacaucacccccggcgagugcgccguccgccucgucaaggccggcgccuccaucgucggcgucaacugccgcuucggccccgacaccucccucaagaccauggagcucaugaaggagggccucgagugggccggccucaaggcccaccucaugguccagccccucggcuuccacgcccccgacugcggcaaggagggcuucgucgaccuccccgaguaccccuucggccucgagucccgcgucgccacccgcugggacauccagaaguacgcccgcgaggccuacaaccucggcguccgcuacaucggcggcugcugcggcuucgagcccuaccacauccgcgccaucgccgaggagcucgcccccgagcgcggcuuccucccccccgccuccgagaagcacggcuccuggggcuccggccucgacaugcacaccaagcccuggauccgcgcccgcgcccgccgcgaguacugggagaaccuccuccccgccuccggccgccccuucugccccucccucuccaagcccgacuucuga

SEQ ID NO: 40323 - RNA, 1221 nt, Artificial Sequence
  derived and/or modified sequence opt2 from BHMT__Homo_sapiens__NP_001704
augccccccgucggcggcaagaaggccaagaagggcauccucgagcgccucaacgccggcgagaucgucaucggcgacggcggcuucgucuucgcccucgagaagcgcggcuacgucaaggccggccccuggacccccgaggccgccgucgagcaccccgaggccguccgccagcuccaccgcgaguuccuccgcgccggcuccaacgucaugcagaccuucaccuucuacgccuccgaggacaagcucgagaaccgcggcaacuacguccucgagaagaucuccggccaggaggucaacgaggccgccugcgacaucgcccgccaggucgccgacgagggcgacgcccucgucgccggcggcgucucccagacccccuccuaccucuccugcaaguccgagaccgaggucaagaaggucuuccuccagcagcucgaggucuucaugaagaagaacgucgacuuccucaucgccgaguacuucgagcacgucgaggaggccgucugggccgucgagacccucaucgccuccggcaagcccgucgccgccaccaugugcaucggccccgagggcgaccuccacggcgucccccccggcgagugcgccguccgccucgucaaggccggcgccuccaucaucggcgucaacugccacuucgaccccaccaucucccucaagaccgucaagcucaugaaggagggccucgaggccgcccgccucaaggcccaccucaugucccagccccucgccuaccacacccccgacugcaacaagcagggcuucaucgaccuccccgaguuccccuucggccucgagccccgcgucgccacccgcugggacauccagaaguacgcccgcgaggccuacaaccucggcguccgcuacaucggcggcugcugcggcuucgagcccuaccacauccgcgccaucgccgaggagcucgcccccgagcgcggcuuccucccccccgccuccgagaagcacggcuccuggggcuccggccucgacaugcacaccaagcccuggguccgcgcccgcgcccgcaaggaguacugggagaaccuccgcaucgccuccggccgccccuacaaccccuccauguccaagcccgacggcuggggcgucaccaagggcaccgccgagcucaugcagcagaaggaggccaccaccgagcagcagcucaaggagcucuucgagaagcagaaguucaagucccaguga

SEQ ID NO: 40324 - RNA, 2925 nt, Artificial Sequence
  derived and/or modified sequence opt2 from BICC1__Homo_sapiens__NP_001073981
auggccgcccagggcgagcccggcuaccucgccgcccaguccgaccccggcuccaacuccgagcgcuccaccgacucccccguccccggcuccgaggacgaccucgucgccggcgccacccuccacucccccgagugguccgaggagcgcuuccgcgucgaccgcaagaagcucgaggccaugcuccaggccgccgccgagggcaagggccgcuccggcgaggacuucuuccagaagaucauggaggagaccaacacccagaucgccuggcccuccaagcucaagaucggcgccaaguccaagaaggacccccacaucaaggucuccggcaagaaggaggacgucaaggaggccaaggagaugaucauguccguccucgacaccaaguccaaccgcgucacccucaagauggacgucucccacaccgagcacucccacgucaucggcaagggcggcaacaacaucaagaaggucauggaggagaccggcugccacauccacuuccccgacuccaaccgcaacaaccaggccgagaaguccaaccaggucuccaucgccggccagcccgccggcgucgaguccgcccgcguccgcauccgcgagcuccucccccucguccucauguucgagcuccccaucgccggcauccuccagcccguccccgaccccaacucccccuccauccagcacaucucccagaccuacaacaucuccgucuccuucaagcagcgcucccgcauguacggcgccaccgucaucguccgcggcucccagaacaacaccuccgccgucaaggagggcaccgccaugcuccucgagcaccucgccggcucccucgccuccgccauccccgucuccacccagcucgacaucgccgcccagcaccaccucuucaugaugggccgcaacggcuccaacaucaagcacaucaugcagcgcaccggcgcccagauccacuuccccgaccccuccaacccccagaagaaguccaccgucuaccuccagggcaccaucgaguccgucugccucgcccgccaguaccucaugggcugccucccccucguccucauguucgacaugaaggaggagaucgaggucgacccccaguucaucgcccagcucauggagcagcucgacgucuucaucuccaucaagcccaagcccaagcagcccuccaaguccgucaucgucaaguccgucgagcgcaacgcccucaacauguacgaggcccgcaagugccuccucggccucgaguccuccggcgucaccaucgccaccucccccucccccgccuccugccccgccggccucgccugccccucccucgacauccucgccuccgccggccucggccucaccggccucggccuccucggccccaccacccucucccucaacaccuccaccacccccaacucccuccucaacgcccucaacuccuccgucuccccccuccagucccccuccuccggcacccccucccccacccucugggcccccccccucgccaacaccuccuccgccaccggcuucuccgccaucccccaccucaugauccccuccaccgcccaggccacccucaccaacauccuccucuccggcguccccaccuacggccacaccgcccccucccccccccccggccucacccccgucgacguccacaucaacuccaugcagaccgagggcaagaagaucuccgccgcccucaacggccacgcccagucccccgacaucaaguacggcgccaucuccaccuccucccucggcgagaagguccucuccgccaaccacggcgaccccuccauccagaccuccggcuccgagcagaccucccccaaguccucccccaccgagggcugcaacgacgccuucgucgaggucggcaugccccgcucccccucccacuccggcaacgccggcgaccucaagcagaugaugugccccuccaaggucuccugcgccaagcgccagaccgucgagcuccuccagggcaccaagaacucccaccuccacuccaccgaccgccuccucuccgaccccgagcucuccgccaccgaguccccccucgccgacaagaaggcccccggcuccgagcgcgccgccgagcgcgccgccgccgcccagcagaacuccgagcgcgcccaccucgccccccgcuccuccuacgucaacaugcaggccuucgacuacgagcagaagaagcuccucgccaccaaggccaugcucaagaagcccgucgucaccgagguccgcacccccaccaacaccugguccggccucggcuucuccaaguccaugcccgccgagaccaucaaggagcuccgccgcgccaaccacgucuccuacaagcccaccaugaccaccaccuacgagggcuccuccaugucccucucccgcuccaacucccgcgagcaccucggcggcggcuccgaguccgacaacuggcgcgaccgcaacggcaucggccccggcucccacuccgaguucgccgccuccaucggcucccccaagcgcaagcagaacaaguccaccgagcacuaccucuccuccuccaacuacauggacugcaucuccucccucaccggcuccaacggcugcaaccucaacuccuccuucaagggcuccgaccuccccgagcucuucuccaagcucggccucggcaaguacaccgacgucuuccagcagcaggagaucgaccuccagaccuuccucacccucaccgaccaggaccucaaggagcucggcaucaccaccuucggcgcccgccgcaagaugcuccucgccaucuccgagcucaacaagaaccgccgcaagcucuucgagucccccaacgcccgcaccuccuuccucgagggcggcgccuccggccgccucccccgccaguaccacuccgacaucgccuccgucuccggccgcugguga

SEQ ID NO: 40325 - RNA, 2508 nt, Artificial Sequence
  derived and/or modified sequence opt2 from BICD1__Homo_sapiens__NP_001003398
auggccgccgaggagguccuccagaccgucgaccacuacaagaccgagaucgagcgccucaccaaggagcucaccgagaccacccacgagaagauccaggccgccgaguacggccucgucguccucgaggagaagcucacccucaagcagcaguacgacgagcucgaggccgaguacgacucccucaagcaggagcucgagcagcucaaggaggccuucggccaguccuucuccauccaccgcaaggucgccgaggacggcgagacccgcgaggagacccuccuccaggaguccgccuccaaggaggccuacuaccucggcaagauccucgagaugcagaacgagcucaagcagucccgcgccgucgucaccaacguccaggccgagaacgagcgccucaccgccgucguccaggaccucaaggagaacaacgagauggucgagcuccagcgcauccgcaugaaggacgagauccgcgaguacaaguuccgcgaggcccgccuccuccaggacuacaccgagcucgaggaggagaacaucacccuccagaagcucgucuccacccucaagcagaaccaggucgaguacgagggccucaagcacgagaucaagcgcuucgaggaggagaccguccuccucaacucccagcucgaggacgccauccgccucaaggagaucgccgagcaccagcucgaggaggcccucgagacccucaagaacgagcgcgagcagaagaacaaccuccgcaaggagcucucccaguacaucucccucaacgacaaccacaucuccaucuccgucgacggccucaaguucgccgaggacggcuccgagcccaacaacgacgacaagaugaacggccacauccacggcccccucgucaagcucaacggcgacuaccgcacccccacccuccgcaagggcgagucccucaaccccgucuccgaccucuucuccgagcucaacaucuccgagauccagaagcucaagcagcagcucaugcaggucgagcgcgagaaggccauccuccucgccaaccuccaggagucccagacccagcucgagcacaccaagggcgcccucaccgagcagcacgagcgcguccaccgccucaccgagcacgucaacgccaugcgcggccuccaguccuccaaggagcucaaggccgagcucgacggcgagaagggccgcgacuccggcgaggaggcccacgacuacgaggucgacaucaacggccucgagauccucgagugcaaguaccgcgucgccgucaccgaggucaucgaccucaaggccgagaucaaggcccucaaggagaaguacaacaaguccgucgagaacuacaccgacgagaaggccaaguacgaguccaagauccagauguacgacgagcaggucaccucccucgagaagaccaccaaggaguccggcgagaagauggcccacauggagaaggagcuccagaagaugaccuccaucgccaacgagaaccacuccacccucaacaccgcccaggacgagcucgucaccuucuccgaggagcucgcccagcucuaccaccacgucugccucugcaacaacgagacccccaaccgcgucaugcucgacuacuaccgccagucccgcgucacccgcuccggcucccucaagggccccgacgacccccgcggccuccucuccccccgccucgcccgccgcggcgucuccucccccgucgagacccgcaccuccuccgagcccgucgccaaggaguccaccgaggccuccaaggagcccucccccaccaagacccccaccaucucccccgucaucaccgccccccccuccucccccguccucgacaccuccgacauccgcaaggagcccaugaacaucuacaaccucaacgccaucauccgcgaccagaucaagcaccuccagaaggccgucgaccgcucccuccagcucucccgccagcgcgccgccgcccgcgagcucgcccccaugaucgacaaggacaaggaggcccucauggaggagauccucaagcucaagucccuccucuccaccaagcgcgagcagaucgccacccuccgcgccguccucaaggccaacaagcagaccgccgaggucgcccucgccaaccucaagaacaaguacgagaacgagaaggccauggucaccgagaccaugaccaagcuccgcaacgagcucaaggcccucaaggaggacgccgccaccuucuccucccuccgcgccauguucgccacccgcugcgacgaguacgucacccagcucgacgagaugcagcgccagcucgccgccgccgaggacgagaagaagacccucaacacccuccuccgcauggccauccagcagaagcucgcccucacccagcgccucgaggaccucgaguucgaccacgagcagucccgccgcuccaagggcaagcucggcaaguccaagaucggcucccccaagaucgucuccucccuccucccccccuaccgccacuccgcccacaacuga

SEQ ID NO: 40326 - RNA, 2568 nt, Artificial Sequence
  derived and/or modified sequence opt2 from BICD2__Homo_sapiens__NP_001003800
auguccgcccccuccgaggaggaggaguacgcccgccucgucauggaggcccagcccgaguggcuccgcgccgaggucaagcgccucucccacgagcucgccgagaccacccgcgagaagauccaggccgccgaguacggccucgccguccucgaggagaagcaccagcucaagcuccaguucgaggagcucgaggucgacuacgaggccauccgcuccgagauggagcagcucaaggaggccuucggccaggcccacaccaaccacaagaaggucgccgccgacggcgagucccgcgaggagucccucauccaggaguccgccuccaaggagcaguacuacguccgcaagguccucgagcuccagaccgagcucaagcagcuccgcaacguccucaccaacacccaguccgagaacgagcgccucgccuccgucgcccaggagcucaaggagaucaaccagaacgucgagauccagcgcggccgccuccgcgacgacaucaaggaguacaaguuccgcgaggcccgccuccuccaggacuacuccgagcucgaggaggagaacaucucccuccagaagcaggucuccguccuccgccagaaccaggucgaguucgagggccucaagcacgagaucaagcgccucgaggaggagaccgaguaccucaacucccagcucgaggacgccauccgccucaaggagaucuccgagcgccagcucgaggaggcccucgagacccucaagaccgagcgcgagcagaagaacucccuccgcaaggagcucucccacuacauguccaucaacgacuccuucuacaccucccaccuccacgucucccucgacggccucaaguucuccgacgacgccgccgagcccaacaacgacgccgaggcccucgucaacggcuucgagcacggcggccucgccaagcucccccucgacaacaagaccuccacccccaagaaggagggccucgccccccccucccccucccucgucuccgaccuccucuccgagcucaacaucuccgagauccagaagcucaagcagcagcucaugcagauggagcgcgagaaggccggccuccucgccacccuccaggacacccagaagcagcucgagcacacccgcggcucccucuccgagcagcaggagaaggucacccgccucaccgagaaccucuccgcccuccgccgccuccaggccuccaaggagcgccagaccgcccucgacaacgagaaggaccgcgacucccacgaggacggcgacuacuacgaggucgacaucaacggccccgagauccucgccugcaaguaccacgucgccgucgccgaggccggcgagcuccgcgagcagcucaaggcccuccgcuccacccacgaggcccgcgaggcccagcacgccgaggagaagggccgcuacgaggccgagggccaggcccucaccgagaaggucucccuccucgagaaggccucccgccaggaccgcgagcuccucgcccgccucgagaaggagcucaagaaggucuccgacgucgccggcgagacccagggcucccucuccgucgcccaggacgagcucgucaccuucuccgaggagcucgccaaccucuaccaccacgucugcaugugcaacaacgagacccccaaccgcgucaugcucgacuacuaccgcgagggccagggcggcgccggccgcaccucccccggcggccgcaccucccccgaggcccgcggccgccgcucccccauccuccuccccaagggccuccucgcccccgaggccggccgcgccgacggcggcaccggcgacuccucccccucccccggcuccucccuccccuccccccucuccgacccccgccgcgagcccaugaacaucuacaaccucaucgccaucauccgcgaccagaucaagcaccuccaggccgccgucgaccgcaccaccgagcucucccgccagcgcaucgccucccaggagcucggccccgccgucgacaaggacaaggaggcccucauggaggagauccucaagcucaagucccuccucuccaccaagcgcgagcagaucaccacccuccgcaccguccucaaggccaacaagcagaccgccgaggucgcccucgccaaccucaaguccaaguacgagaacgagaaggccauggucaccgagaccaugaugaagcuccgcaacgagcucaaggcccucaaggaggacgccgccaccuucuccucccuccgcgccauguucgccacccgcugcgacgaguacaucacccagcucgacgagaugcagcgccagcucgccgccgccgaggacgagaagaagacccucaacucccuccuccgcauggccauccagcagaagcucgcccucacccagcgccucgagcuccucgagcucgaccacgagcagacccgccgcggccgcgccaaggccgcccccaagaccaagcccgccacccccuccgucucccacaccugcgccugcgccuccgaccgcgccgagggcaccggccucgccaaccaggucuucugcuccgagaagcacuccaucuacugcgacuga

SEQ ID NO: 40327 - RNA, 588 nt, Artificial Sequence
  derived and/or modified sequence opt2 from BID__Homo_sapiens__NP_001187
auggacugcgaggucaacaacggcuccucccuccgcgacgagugcaucaccaaccuccucgucuucggcuuccuccaguccugcuccgacaacuccuuccgccgcgagcucgacgcccucggccacgagcuccccguccucgccccccagugggagggcuacgacgagcuccagaccgacggcaaccgcuccucccacucccgccucggccgcaucgaggccgacuccgagucccaggaggacaucauccgcaacaucgcccgccaccucgcccaggucggcgacuccauggaccgcuccaucccccccggccucgucaacggccucgcccuccagcuccgcaacaccucccgcuccgaggaggaccgcaaccgcgaccucgccaccgcccucgagcagcuccuccaggccuacccccgcgacauggagaaggagaagaccaugcucguccucgcccuccuccucgccaagaaggucgccucccacacccccucccuccuccgcgacgucuuccacaccaccgucaacuucaucaaccagaaccuccgcaccuacguccgcucccucgcccgcaacggcauggacuga

SEQ ID NO: 40328 - RNA, 1365 nt, Artificial Sequence
  derived and/or modified sequence opt2 from BIN1__Homo_sapiens__NP_004296
auggccgagaugggcuccaagggcgucaccgccggcaagaucgccuccaacguccagaagaagcucacccgcgcccaggagaagguccuccagaagcucggcaaggccgacgagaccaaggacgagcaguucgagcagugcguccagaacuucaacaagcagcucaccgagggcacccgccuccagaaggaccuccgcaccuaccucgccuccgucaaggccaugcacgaggccuccaagaagcucaacgagugccuccaggaggucuacgagcccgacuggcccggccgcgacgaggccaacaagaucgccgagaacaacgaccuccucuggauggacuaccaccagaagcucgucgaccaggcccuccucaccauggacaccuaccucggccaguuccccgacaucaagucccgcaucgccaagcgcggccgcaagcucgucgacuacgacuccgcccgccaccacuacgagucccuccagaccgccaagaagaaggacgaggccaagaucgccaaggccgaggaggagcucaucaaggcccagaaggucuucgaggagaugaacgucgaccuccaggaggagcuccccucccucuggaacucccgcgucggcuucuacgucaacaccuuccaguccaucgccggccucgaggagaacuuccacaaggagauguccaagcucaaccagaaccucaacgacguccucgucggccucgagaagcagcacggcuccaacaccuucaccgucaaggcccagccccgcaagaaguccaagcucuucucccgccuccgccgcaagaagaacuccgacaacgcccccgccaagggcaacaagucccccuccccccccgacggcucccccgccgccacccccgagauccgcgucaaccacgagcccgagcccgccggcggcgccacccccggcgccacccuccccaagucccccucccagcccgccgaggccuccgaggucgccggcggcacccagcccgccgccggcgcccaggagcccggcgagaccgccgccuccgaggccgccuccuccucccuccccgccgucgucgucgagaccuuccccgccaccgucaacggcaccgucgagggcggcuccggcgccggccgccucgaccucccccccggcuucauguucaagguccaggcccagcacgacuacaccgccaccgacaccgacgagcuccagcucaaggccggcgacgucguccucgucauccccuuccagaaccccgaggagcaggacgagggcuggcucaugggcgucaaggaguccgacuggaaccagcacaaggagcucgagaagugccgcggcgucuuccccgagaacuucaccgagcgcguccccuga

SEQ ID NO: 40329 - RNA, 1620 nt, Artificial Sequence
  derived and/or modified sequence opt2 from BIN2__Homo_sapiens__NP_001276936
augguccuccagaagcucggcaaggccgucgagaccaaggacgagcgcuucgagcaguccgccuccaacuucuaccagcagcaggccgagggccacaagcucuacaaggaccucaagaacuuccucuccgccgucaaggucaugcacgaguccuccaagcgcgucuccgagacccuccaggagaucuacuccuccgagugggacggccacgaggagcucaaggccaucgucuggaacaacgaccuccucugggaggacuacgaggagaagcucgccgaccaggccguccgcaccauggagaucuacgucgcccaguucuccgagaucaaggagcgcaucgccaagcgcggccgcaagcucgucgacuacgacuccgcccgccaccaccucgaggccguccagaacgccaagaagaaggacgaggccaagaccgccaaggccgaggaggaguucaacaaggcccagaccgucuucgaggaccucaaccaggagcuccucgaggagcuccccauccucuacaacucccgcaucggcugcuacgucaccaucuuccagaacaucuccaaccuccgcgacgucuucuaccgcgagauguccaagcucaaccacaaccucuacgaggucauguccaagcucgagaagcagcacuccaacaaggucuucgucgucaagggccucuccuccuccucccgccgcucccucgucaucuccccccccguccgcaccgccaccgucuccuccccccucaccucccccaccucccccuccacccucucccucaaguccgaguccgaguccgucuccgccaccgaggaccucgcccccgacgccgcccagggcgaggacaacuccgagaucaaggagcuccucgaggaggaggagaucgagaaggagggcuccgaggccuccuccuccgaggaggacgagccccuccccgccugcaacggccccgcccaggcccagcccucccccaccaccgagcgcgccaagucccaggaggagguccuccccuccuccaccacccccucccccggcggcgcccucucccccuccggccagcccuccuccuccgccaccgaggucguccuccgcacccgcaccgccuccgagggcuccgagcagcccaagaagcgcgccuccauccagcgcaccuccgccccccccucccgccccccccccccccgcgccaccgccuccccccgccccuccuccggcaacauccccuccucccccaccgccuccggcggcggcucccccaccuccccccgcgccucccucggcaccggcaccgccuccccccgcaccucccucgaggucucccccaaccccgagccccccgagaagcccguccgcacccccgaggccaaggagaacgagaacauccacaaccagaaccccgaggagcucugcaccucccccacccucaugaccucccaggucgccuccgagcccggcgaggccaagaagauggaggacaaggagaaggacaacaagcucaucuccgccaacuccuccgagggccaggaccagcuccaggucuccaugguccccgagaacaacaaccucaccgcccccgagccccaggaggaggucuccaccuccgagaacccccagcucuga

SEQ ID NO: 40330 - RNA, 762 nt, Artificial Sequence
  derived and/or modified sequence opt2 from BIN3__Homo_sapiens__NP_061158
auguccuggauccccuucaagaucggccagcccaagaagcagaucguccccaagaccgucgagcgcgacuucgagcgcgaguacggcaagcuccagcagcucgaggagcagacccgccgccuccagaaggacaugaagaaguccaccgacgccgaccucgccauguccaaguccgccgucaagaucucccucgaccuccucuccaacccccucugcgagcaggaccaggaccuccucaacauggucaccgcccucgacaccgccaugaagcgcauggacgccuucaaccaggagaaggucaaccagauccagaagaccgucaucgagccccucaagaaguucggcuccgucuuccccucccucaacauggccgucaagcgccgcgagcaggcccuccaggacuaccgccgccuccaggccaaggucgagaaguacgaggagaaggagaagaccggccccguccucgccaagcuccaccaggcccgcgaggagcuccgccccguccgcgaggacuucgaggccaagaaccgccagcuccucgaggagaugccccgcuucuacggcucccgccucgacuacuuccagcccuccuucgagucccucauccgcgcccaggucgucuacuacuccgagaugcacaagaucuucggcgaccucucccaccagcucgaccagcccggccacuccgacgagcagcgcgagcgcgagaacgaggccaagcucuccgagcuccgcgcccucuccaucgucgccgacgacuga

SEQ ID NO: 40331 - RNA, 1857 nt, Artificial Sequence
  derived and/or modified sequence opt2 from BIRC2__Homo_sapiens__NP_001243092
augcacaagaccgccucccagcgccucuuccccggccccuccuaccagaacaucaaguccaucauggaggacuccaccauccucuccgacuggaccaacuccaacaagcagaagaugaaguacgacuucuccugcgagcucuaccgcauguccaccuacuccaccuuccccgccggcguccccgucuccgagcgcucccucgcccgcgccggcuucuacuacaccggcgucaacgacaaggucaagugcuucugcugcggccucaugcucgacaacuggaagcucggcgacucccccauccagaagcacaagcagcucuaccccuccugcuccuucauccagaaccucgucuccgccucccucggcuccaccuccaagaacaccucccccaugcgcaacuccuucgcccacucccucucccccacccucgagcacuccucccucuucuccggcuccuacuccucccucucccccaacccccucaacucccgcgccgucgaggacaucuccuccucccgcaccaaccccuacuccuacgccauguccaccgaggaggcccgcuuccucaccuaccacauguggccccucaccuuccucucccccuccgagcucgcccgcgccggcuucuacuacaucggccccggcgaccgcgucgccugcuucgccugcggcggcaagcucuccaacugggagcccaaggacgacgccauguccgagcaccgccgccacuuccccaacugccccuuccucgagaacucccucgagacccuccgcuucuccaucuccaaccucuccaugcagacccacgccgcccgcaugcgcaccuucauguacuggcccuccuccguccccguccagcccgagcagcucgccuccgccggcuucuacuacgucggccgcaacgacgacgucaagugcuucugcugcgacggcggccuccgcugcugggaguccggcgacgaccccugggucgagcacgccaagugguucccccgcugcgaguuccucauccgcaugaagggccaggaguucgucgacgagauccagggccgcuacccccaccuccucgagcagcuccucuccaccuccgacaccaccggcgaggagaacgccgacccccccaucauccacuucggccccggcgaguccuccuccgaggacgccgucaugaugaacacccccgucgucaaguccgcccucgagaugggcuucaaccgcgaccucgucaagcagaccguccaguccaagauccucaccaccggcgagaacuacaagaccgucaacgacaucgucuccgcccuccucaacgccgaggacgagaagcgcgaggaggagaaggagaagcaggccgaggagauggccuccgacgaccucucccucauccgcaagaaccgcauggcccucuuccagcagcucaccugcguccuccccauccucgacaaccuccucaaggccaacgucaucaacaagcaggagcacgacaucaucaagcagaagacccagaucccccuccaggcccgcgagcucaucgacaccauccucgucaagggcaacgccgccgccaacaucuucaagaacugccucaaggagaucgacuccacccucuacaagaaccucuucgucgacaagaacaugaaguacauccccaccgaggacgucuccggccucucccucgaggagcagcuccgccgccuccaggaggagcgcaccugcaaggucugcauggacaaggaggucuccgucgucuucauccccugcggccaccucgucgucugccaggagugcgcccccucccuccgcaagugccccaucugccgcggcaucaucaagggcaccguccgcaccuuccucuccuga

SEQ ID NO: 40332 - RNA, 1815 nt, Artificial Sequence
  derived and/or modified sequence opt2 from BIRC3__Homo_sapiens__NP_892007
augaacaucgucgagaacuccaucuuccucuccaaccucaugaaguccgccaacaccuucgagcucaaguacgaccucuccugcgagcucuaccgcauguccaccuacuccaccuuccccgccggcguccccgucuccgagcgcucccucgcccgcgccggcuucuacuacaccggcgucaacgacaaggucaagugcuucugcugcggccucaugcucgacaacuggaagcgcggcgacucccccaccgagaagcacaagaagcucuaccccuccugccgcuucguccagucccucaacuccgucaacaaccucgaggccaccucccagcccaccuuccccuccuccgucaccaacuccacccacucccuccuccccggcaccgagaacuccggcuacuuccgcggcuccuacuccaacucccccuccaaccccgucaacucccgcgccaaccaggacuucuccgcccucaugcgcuccuccuaccacugcgccaugaacaacgagaacgcccgccuccucaccuuccagaccuggccccucaccuuccucucccccaccgaccucgccaaggccggcuucuacuacaucggccccggcgaccgcgucgccugcuucgccugcggcggcaagcucuccaacugggagcccaaggacaacgccauguccgagcaccuccgccacuuccccaagugccccuucaucgagaaccagcuccaggacaccucccgcuacaccgucuccaaccucuccaugcagacccacgccgcccgcuucaagaccuucuucaacuggcccuccuccguccucgucaaccccgagcagcucgccuccgccggcuucuacuacgucggcaacuccgacgacgucaagugcuucugcugcgacggcggccuccgcugcugggaguccggcgacgaccccuggguccagcacgccaagugguucccccgcugcgaguaccucauccgcaucaagggccaggaguucauccgccagguccaggccuccuacccccaccuccucgagcagcuccucuccaccuccgacucccccggcgacgagaacgccgaguccuccaucauccacuucgagcccggcgaggaccacuccgaggacgccaucaugaugaacacccccgucaucaacgccgccgucgagaugggcuucucccgcucccucgucaagcagaccguccagcgcaagauccucgccaccggcgagaacuaccgccucgucaacgaccucguccucgaccuccucaacgccgaggacgagauccgcgaggaggagcgcgagcgcgccaccgaggagaaggaguccaacgaccuccuccucauccgcaagaaccgcauggcccucuuccagcaccucaccugcgucauccccauccucgacucccuccucaccgccggcaucaucaacgagcaggagcacgacgucaucaagcagaagacccagaccucccuccaggcccgcgagcucaucgacaccauccucgucaagggcaacaucgccgccaccgucuuccgcaacucccuccaggaggccgaggccguccucuacgagcaccucuucguccagcaggacaucaaguacauccccaccgaggacgucuccgaccuccccgucgaggagcagcuccgccgccuccaggaggagcgcaccugcaaggucugcauggacaaggaggucuccaucgucuucauccccugcggccaccucgucgucugcaaggacugcgcccccucccuccgcaagugccccaucugccgcuccaccaucaagggcaccguccgcaccuuccucuccuga

SEQ ID NO: 40333 - RNA, 414 nt, Artificial Sequence
  derived and/or modified sequence opt2 from BIRC5__Homo_sapiens__NP_001012270
augggcgcccccacccucccccccgccuggcagcccuuccucaaggaccaccgcaucuccaccuucaagaacuggcccuuccucgagggcugcgccugcacccccgagcgcauggccgaggccggcuucauccacugccccaccgagaacgagcccgaccucgcccagugcuucuucugcuucaaggagcucgagggcugggagcccgacgacgaccccaugcagcgcaagcccaccauccgccgcaagaaccuccgcaagcuccgccgcaagugcgccguccccuccuccuccuggcuccccuggaucgaggccuccggccgcuccugccucguccccgaguggcuccaccacuuccagggccucuuccccggcgccaccucccuccccgucggcccccucgccauguccuga

SEQ ID NO: 40334 - RNA, 14574 nt, Artificial Sequence
  derived and/or modified sequence opt2 from BIRC6__Homo_sapiens__NP_057336
auggucaccggcggcggcgccgccccccccggcaccgucaccgagccccuccccuccgucaucguccucuccgccggccgcaagauggccgccgccgccgccgccgccuccggccccggcugcuccuccgccgccggcgccggcgccgccggcgucuccgaguggcucguccuccgcgacggcugcaugcacugcgacgccgacggccuccacucccucuccuaccaccccgcccucaacgccauccucgccgucaccucccgcggcaccaucaaggucaucgacggcaccuccggcgccacccuccaggccuccgcccucuccgccaagcccggcggccaggucaagugccaguacaucuccgccgucgacaaggucaucuucgucgacgacuacgccgucggcugccgcaaggaccucaacggcauccuccuccucgacaccgcccuccagacccccgucuccaagcaggacgacgucguccagcucgagcuccccgucaccgaggcccagcagcuccucuccgccugccucgagaaggucgacaucuccuccaccgagggcuacgaccucuucaucacccagcucaaggacggccucaagaacaccucccacgagaccgccgccaaccacaaggucgccaagugggccaccgucaccuuccaccucccccaccacguccucaaguccaucgccuccgccaucgucaacgagcucaagaagaucaaccagaacgucgccgcccuccccgucgccuccuccgucauggaccgccucuccuaccuccuccccuccgcccgccccgagcucggcgucggccccggccgcuccgucgaccgcucccucauguacuccgaggccaaccgccgcgagaccuucaccuccuggccccacgucggcuaccgcugggcccagcccgaccccauggcccaggccggcuucuaccaccagcccgccuccuccggcgacgaccgcgccaugugcuucaccugcuccgucugccucgucugcugggagcccaccgacgagcccugguccgagcacgagcgccacucccccaacugccccuucgucaagggcgagcacacccagaacgucccccucuccgucacccucgccaccucccccgcccaguuccccugcaccgacggcaccgaccgcaucuccugcuucggcuccggcuccugcccccacuuccucgccgccgccaccaagcgcggcaagaucugcaucugggacgucuccaagcucaugaagguccaccucaaguucgagaucaacgccuacgaccccgccaucguccagcagcucauccucuccggcgaccccuccuccggcgucgacucccgccgccccacccucgccuggcucgaggacuccuccuccugcuccgacauccccaagcucgagggcgacuccgacgaccuccucgaggacuccgacuccgaggagcacucccgcuccgacuccgucaccggccacaccucccagaaggaggccauggaggucucccucgacaucaccgcccucuccauccuccagcagcccgagaagcuccagugggagaucgucgccaacguccucgaggacaccgucaaggaccucgaggagcucggcgccaaccccugccucaccaacuccaaguccgagaagaccaaggagaagcaccaggagcagcacaacauccccuuccccugccuccucgccggcggccuccucaccuacaagucccccgccaccucccccaucuccuccaacucccaccgcucccucgacggccucucccgcacccagggcgaguccaucuccgagcagggcuccaccgacaacgaguccugcaccaacuccgagcucaacuccccccucguccgccgcacccuccccguccuccuccucuacuccaucaaggaguccgacgagaaggccggcaagaucuucucccagaugaacaacaucauguccaagucccuccacgacgacggcuucaccgucccccagaucaucgagauggagcucgacucccaggagcagcuccuccuccaggacccccccgucaccuacauccagcaguucgccgacgccgccgccaaccucaccucccccgacuccgagaaguggaacuccgucuuccccaagcccggcacccucguccagugccuccgccuccccaaguucgccgaggaggagaaccucugcaucgacuccaucacccccugcgccgacggcauccaccuccucgucggccuccgcaccugccccgucgagucccucuccgccaucaaccaggucgaggcccucaacaaccucaacaagcucaacuccgcccucugcaaccgccgcaagggcgagcucgaguccaaccucgccgucgucaacggcgccaacaucuccgucauccagcacgagucccccgccgacguccagaccccccucaucauccagcccgagcagcgcaacgucuccggcggcuaccucguccucuacaagaugaacuacgccacccgcaucgucacccucgaggaggagcccaucaagauccagcacaucaaggacccccaggacaccaucaccucccucauccuccucccccccgacauccucgacaaccgcgaggacgacugcgaggagcccaucgaggacaugcagcucaccuccaagaacggcuucgagcgcgagaagaccuccgacaucuccacccucggccaccucgucaucaccacccagggcggcuacgucaagauccucgaccucuccaacuucgagauccucgccaaggucgagccccccaagaaggagggcaccgaggagcaggacaccuucgucuccgucaucuacugcuccggcaccgaccgccucugcgccugcaccaagggcggcgagcuccacuuccuccagaucggcggcaccugcgacgacaucgacgaggccgacauccucgucgacggcucccucuccaagggcaucgagcccuccuccgagggcuccaagccccucuccaaccccuccucccccggcaucuccggcgucgaccuccucgucgaccagcccuucacccucgagauccucaccucccucgucgagcucacccgcuucgagacccucaccccccgcuucuccgccaccgucccccccugcugggucgagguccagcaggagcagcagcagcgccgccacccccagcaccuccaccagcagcaccacggcgacgccgcccagcacacccgcaccuggaagcuccagaccgacuccaacuccugggacgagcacgucuucgagcucguccuccccaaggccugcauggucggccacgucgacuucaaguucguccucaacuccaacaucaccaacaucccccagauccaggucacccuccucaagaacaaggcccccggccucggcaaggucaacgcccucaacaucgaggucgagcagaacggcaagcccucccucgucgaccucaacgaggagaugcagcacauggacgucgaggagucccagugccuccgccucugccccuuccucgaggaccacaaggaggacauccucugcggccccgucuggcucgccuccggccucgaccucuccggccacgccggcaugcucacccucaccucccccaagcucgucaagggcauggccggcggcaaguaccgcuccuuccucauccacgucaaggccgucaacgagcgcggcaccgaggagaucugcaacggcggcaugcgccccgucguccgccuccccucccucaagcaccaguccaacaagggcuacucccucgccucccuccucgccaaggucgccgccggcaaggagaaguccuccaacgucaagaacgagaacaccuccggcacccgcaaguccgagaaccuccgcggcugcgaccuccuccaggaggucuccgucaccauccgccgcuucaagaagaccuccaucuccaaggagcgcguccagcgcugcgccaugcuccaguucuccgaguuccacgagaagcuccucaacacccucugccgcaagaccgacgacggccagaucaccgagcacgcccagucccucguccucgacacccucugcuggcucgccggcguccacuccaacggccccggcuccuccaaggagggcaacgagaaccuccucuccaagacccgcaaguuccucuccgacaucguccgcgucugcuucuucgaggccggccgcuccaucgcccacaagugcgcccgcuuccucgcccucugcaucuccaacggcaagugcgaccccugccagcccgccuucggccccguccuccucaaggcccuccucgacaacauguccuuccuccccgccgccaccaccggcggcuccgucuacugguacuucguccuccucaacuacgucaaggacgaggaccucgccggcugcuccaccgccugcgccucccuccucaccgccgucucccgccagcuccaggaccgccucacccccauggaggcccuccuccagacccgcuacggccucuacuccucccccuucgaccccguccucuucgaccucgagauguccggcuccuccugcaagaacgucuacaacuccuccaucggcguccaguccgacgagaucgaccucuccgacguccucuccggcaacggcaaggucuccuccugcaccgccgccgagggcuccuucaccucccucaccggccuccucgaggucgagccccuccacuucaccugcgucuccaccuccgacggcacccgcaucgagcgcgacgacgccauguccuccuucggcgucacccccgccgucggcggccucuccuccggcaccgucggcgaggccuccaccgcccucuccuccgccgcccaggucgcccuccagucccucucccacgccauggccuccgccgagcagcagcuccagguccuccaggagaagcagcagcagcuccucaagcuccagcagcagaaggccaagcucgaggccaagcuccaccagaccaccgccgccgccgccgccgccgccuccgccgucggccccguccacaacuccguccccuccaaccccgucgccgcccccggcuucuucauccaccccuccgacgucaucccccccacccccaagaccaccccccucuucaugacccccccccucaccccccccaacgaggccgucuccgucgucaucaacgccgagcucgcccagcucuuccccggcuccgucaucgacccccccgccgucaaccucgccgcccacaacaagaacuccaacaagucccgcaugaacccccucggcuccggccucgcccucgccaucucccacgccucccacuuccuccagccccccccccaccaguccaucaucaucgagcgcaugcacuccggcgcccgccgcuucgucacccucgacuucggccgccccauccuccucaccgacguccucauccccaccugcggcgaccucgccucccucuccaucgacaucuggacccucggcgaggaggucgacggccgccgccucgucgucgccaccgacaucuccacccacucccucauccuccacgaccucauccccccccccgucugccgcuucaugaagaucaccgucaucggccgcuacggcuccaccaacgcccgcgccaagaucccccucggcuucuacuacggccacaccuacauccuccccugggaguccgagcucaagcucaugcacgacccccucaagggcgagggcgaguccgccaaccagcccgagaucgaccagcaccucgccaugauggucgcccuccaggaggacauccagugccgcuacaaccucgccugccaccgccucgagacccuccuccaguccaucgaccuccccccccucaacuccgccaacaacgcccaguacuuccuccgcaagcccgacaaggccgucgaggaggacucccgcgucuucuccgccuaccaggacugcauccagcuccagcuccagcucaaccucgcccacaacgccguccagcgccucaaggucgcccucggcgccucccgcaagaugcucuccgagaccuccaaccccgaggaccucauccagaccuccuccaccgagcagcuccgcaccaucauccgcuaccuccucgacacccuccucucccuccuccacgccuccaacggccacuccguccccgccguccuccaguccaccuuccacgcccaggccugcgaggagcucuucaagcaccucugcaucuccggcacccccaagauccgccuccacaccggccuccuccucguccagcucugcggcggcgagcgcugguggggccaguuccucuccaacguccuccaggagcucuacaacuccgagcagcuccucaucuucccccaggaccgcgucuucaugcuccucuccugcaucggccagcgcucccucuccaacuccggcguccucgagucccuccucaaccuccucgacaaccuccucuccccccuccagccccagcuccccaugcaccgccgcaccgagggcguccucgacauccccaugaucuccugggucgucaugcucgucucccgccuccucgacuacgucgccaccgucgaggacgaggccgccgccgccaagaagccccucaacggcaaccagugguccuucaucaacaacaaccuccacacccagucccucaaccgcuccuccaagggcuccuccucccucgaccgccucuacucccgcaagauccgcaagcagcucguccaccacaagcagcagcucaaccuccucaaggccaagcagaaggcccucgucgagcagauggagaaggagaagauccaguccaacaagggcuccuccuacaagcuccucgucgagcaggccaagcucaagcaggccaccuccaagcacuucaaggaccucauccgccuccgccgcaccgccgaguggucccgcuccaaccucgacaccgaggucaccaccgccaaggagucccccgagaucgagccccuccccuucacccucgcccacgagcgcugcaucuccgucguccagaagcucguccucuuccuccucuccauggacuucaccugccacgccgaccuccuccucuucgucugcaagguccucgcccgcaucgccaacgccacccgccccaccauccaccucugcgagaucgucaacgagccccagcucgagcgccuccuccuccuccucgucggcaccgacuucaaccgcggcgacaucuccuggggcggcgccugggcccaguacucccucaccugcaugcuccaggacauccucgccggcgagcuccucgcccccgucgccgccgaggccauggaggagggcaccgucggcgacgacgucggcgccaccgccggcgacuccgacgacucccuccagcaguccuccguccagcuccucgagaccaucgacgagccccucacccacgacaucaccggcgcccccccccucuccucccucgagaaggacaaggagaucgaccucgagcuccuccaggaccucauggaggucgacaucgacccccucgacaucgaccucgagaaggacccccucgccgccaaggucuucaagcccaucuccuccaccugguacgacuacuggggcgccgacuacggcaccuacaacuacaaccccuacaucggcggccucggcauccccgucgccaagccccccgccaacaccgagaagaacggcucccagaccgucuccgucuccgucucccaggcccucgacgcccgccucgaggucggccucgagcagcaggccgagcucaugcucaagaugauguccacccucgaggccgacuccauccuccaggcccucaccaacaccucccccacccucucccagucccccaccggcaccgacgacucccuccucggcggccuccaggccgccaaccagaccucccagcucaucauccagcucuccuccguccccaugcucaacgucugcuucaacaagcucuucuccaugcuccagguccaccacguccagcucgagucccuccuccagcucuggcucacccucucccucaacuccuccuccaccggcaacaaggagaacggcgccgacaucuuccucuacaacgccaaccgcauccccgucaucucccucaaccaggccuccaucaccuccuuccucaccguccucgccugguaccccaacacccuccuccgcaccuggugccucguccuccacucccucacccucaugaccaacaugcagcucaacuccggcuccuccuccgccaucggcacccaggaguccaccgcccaccuccucgucuccgaccccaaccucauccacguccucgucaaguuccucuccggcaccuccccccacggcaccaaccagcacuccccccaggucggccccaccgccacccaggccaugcaggaguuccucacccgccuccagguccaccucuccuccaccugcccccagaucuucuccgaguuccuccucaagcucauccacauccucuccaccgagcgcggcgccuuccagaccggccagggcccccucgacgcccaggucaagcuccucgaguucacccucgagcagaacuucgaggucgucuccgucuccaccaucuccgccgucaucgaguccgucaccuuccucguccaccacuacaucaccugcuccgacaaggucaugucccgcuccggcuccgacuccuccgucggcgcccgcgccugcuucggcggccucuucgccaaccucauccgccccggcgacgccaaggccgucugcggcgagaugacccgcgaccagcucauguucgaccuccucaagcucgucaacauccucguccagcucccccucuccggcaaccgcgaguacuccgcccgcgucuccgucaccaccaacaccaccgacuccgucuccgacgaggagaaggucuccggcggcaaggacggcaacggcuccuccaccuccguccagggcucccccgccuacgucgccgaccucguccucgccaaccagcagaucaugucccagauccucuccgcccucggccucugcaacuccuccgccauggccaugaucaucggcgccuccggccuccaccucaccaagcacgagaacuuccacggcggccucgacgccaucuccgucggcgacggccucuucaccauccucaccacccucuccaagaaggccuccaccguccacaugaugcuccagcccauccucaccuacauggccugcggcuacaugggccgccagggcucccucgccaccugccagcucuccgagccccuccucugguucauccuccgcguccucgacaccuccgacgcccucaaggccuuccacgacaugggcggcguccagcucaucugcaacaacauggucaccuccacccgcgccaucgucaacaccgcccgcuccauggucuccaccaucaugaaguuccucgacuccggccccaacaaggccgucgacuccacccucaagacccgcauccucgccuccgagcccgacaacgccgagggcauccacaacuucgccccccucggcaccaucaccuccuccucccccaccgcccagcccgccgagguccuccuccaggccacccccccccaccgccgcgcccgcuccgccgccugguccuacaucuuccuccccgaggaggccuggugcgaccucaccauccaccuccccgccgccguccuccucaaggagauccacauccagccccaccucgccucccucgccaccugccccuccuccgucuccgucgaggucuccgccgacggcgucaacaugcucccccucuccacccccgucgucaccuccggccucaccuacaucaagauccagcucgucaaggccgaggucgccuccgccgucugccuccgccuccaccgcccccgcgacgccuccacccucggccucucccagaucaagcuccucggccucaccgccuucggcaccaccuccuccgccaccgucaacaaccccuuccuccccuccgaggaccaggucuccaagaccuccaucggcuggcuccgccuccuccaccacugccucacccacaucuccgaccucgagggcaugauggccuccgccgccgcccccaccgccaaccuccuccagaccugcgccgcccuccucaugucccccuacugcggcaugcacucccccaacaucgaggucguccucgucaagaucggccuccaguccacccgcaucggccucaagcucaucgacauccuccuccgcaacugcgccgccuccggcuccgaccccaccgaccucaacuccccccuccucuucggccgccucaacggccucuccuccgacuccaccaucgacauccucuaccagcucggcaccacccaggaccccggcaccaaggaccgcauccaggcccuccucaagugggucuccgacuccgcccgcgucgccgccaugaagcgcuccggccgcaugaacuacaugugccccaacuccuccaccgucgaguacggccuccucaugcccucccccucccaccuccacugcgucgccgccauccucuggcacuccuacgagcuccucgucgaguacgaccuccccgcccuccucgaccaggagcucuucgagcuccucuucaacugguccaugucccuccccugcaacaugguccucaagaaggccgucgacucccuccucugcuccaugugccacguccaccccaacuacuucucccuccucaugggcuggaugggcaucacccccccccccguccagugccaccaccgccucuccaugaccgacgacuccaagaagcaggaccucuccuccucccucaccgacgacuccaagaacgcccaggccccccucgcccucaccgagucccaccucgccacccucgccuccuccucccagucccccgaggccaucaagcagcuccucgacuccggccuccccucccuccucguccgcucccucgccuccuucugcuucucccacaucuccuccuccgaguccaucgcccaguccaucgacaucucccaggacaagcuccgccgccaccacgucccccagcagugcaacaagaugcccaucaccgccgaccucgucgcccccauccuccgcuuccucaccgaggucggcaacucccacaucaugaaggacuggcucggcggcuccgaggucaacccccucuggaccgcccuccucuuccuccucugccacuccggcuccaccuccggcucccacaaccucggcgcccagcagaccuccgcccgcuccgccucccucuccuccgccgccaccaccggccucaccacccagcagcgcaccgccaucgagaacgccaccgucgccuucuuccuccagugcaucuccugccaccccaacaaccagaagcucauggcccagguccucugcgagcucuuccagaccuccccccagcgcggcaaccuccccaccuccggcaacaucuccggcuucauccgccgccucuuccuccagcucaugcucgaggacgagaaggucaccauguuccuccagucccccugcccccucuacaagggccgcaucaacgccaccucccacgucauccagcaccccauguacggcgccggccacaaguuccgcacccuccaccuccccgucuccaccacccucuccgacguccucgaccgcgucuccgacacccccuccaucaccgccaagcucaucuccgagcagaaggacgacaaggagaagaagaaccacgaggagaaggagaaggucaaggccgagaacggcuuccaggacaacuacuccgucgucgucgccuccggccucaagucccaguccaagcgcgccgucuccgccacccccccccgcccccccucccgccgcggccgcaccauccccgacaagaucggcuccaccuccggcgccgaggccgccaacaagaucaucaccguccccgucuuccaccucuuccacaagcuccucgccggccagccccuccccgccgagaugacccucgcccagcuccucacccuccucuacgaccgcaagcucccccagggcuaccgcuccaucgaccucaccgucaagcucggcucccgcgucaucaccgaccccucccucuccaagaccgacuccuacaagcgccuccaccccgagaaggaccacggcgaccuccucgccuccugccccgaggacgaggcccucacccccggcgacgagugcauggacggcauccucgacgagucccuccucgagaccugccccauccaguccccccuccaggucuucgccggcaugggcggccucgcccucaucgccgagcgccuccccaugcucuaccccgaggucauccagcaggucuccgcccccgucgucaccuccaccacccaggagaagcccaaggacuccgaccaguucgagugggucaccaucgagcaguccggcgagcucgucuacgaggcccccgagaccgucgccgccgagcccccccccaucaaguccgccguccagaccaugucccccauccccgcccacucccucgccgccuucggccucuuccuccgccuccccggcuacgccgagguccuccucaaggagcgcaagcacgcccagugccuccuccgccucguccucggcgucaccgacgacggcgagggcucccacauccuccagucccccuccgccaacguccuccccacccuccccuuccacguccuccgcucccucuucuccaccaccccccucaccaccgacgacggcguccuccuccgccgcauggcccucgagaucggcgcccuccaccucauccucgucugccucuccgcccucucccaccacuccccccgcguccccaacuccuccgucaaccagaccgagccccaggucuccuccucccacaaccccaccuccaccgaggagcagcagcucuacugggccaagggcaccggcuucggcaccggcuccaccgccuccggcugggacgucgagcaggcccucaccaagcagcgccucgaggaggagcacgucaccugccuccuccagguccucgccuccuacaucaaccccgucuccuccgccgucaacggcgaggcccaguccucccacgagacccgcggccagaacuccaacgcccuccccuccguccuccucgagcuccucucccaguccugccucauccccgccauguccuccuaccuccgcaacgacuccguccucgacauggcccgccacgucccccucuaccgcgcccuccucgagcuccuccgcgccaucgccuccugcgccgccauggucccccuccuccucccccucuccaccgagaacggcgaggaggaggaggagcaguccgagugccagaccuccgucggcacccuccucgccaagaugaagaccugcgucgacaccuacaccaaccgccuccgcuccaagcgcgagaacgucaagaccggcgucaagcccgacgccuccgaccaggagcccgagggccucacccuccucguccccgacauccagaagaccgccgagaucgucuacgccgccaccaccucccuccgccaggccaaccaggagaagaagcucggcgaguacuccaagaaggccgccaugaagcccaagccccucuccguccucaagucccucgaggagaaguacgucgccgucaugaagaagcuccaguucgacaccuucgagauggucuccgaggacgaggacggcaagcucggcuucaaggucaacuaccacuacaugucccaggucaagaacgccaacgacgccaacuccgccgcccgcgcccgccgccucgcccaggaggccgucacccucuccaccucccucccccucuccuccuccuccuccgucuucguccgcugcgacgaggagcgccucgacaucaugaagguccucaucaccggccccgccgacacccccuacgccaacggcugcuucgaguucgacgucuacuucccccaggacuaccccuccucccccccccucgucaaccucgagaccaccggcggccacuccguccgcuucaaccccaaccucuacaacgacggcaaggucugccucuccauccucaacaccuggcacggccgccccgaggagaaguggaacccccagaccuccuccuuccuccagguccucgucuccguccagucccucauccucgucgccgagcccuacuucaacgagcccggcuacgagcgcucccgcggcacccccuccggcacccaguccucccgcgaguacgacggcaacauccgccaggccaccgucaagugggccaugcucgagcagauccgcaaccccucccccugcuucaaggaggucauccacaagcacuucuaccucaagcgcgucgagaucauggcccagugcgaggaguggaucgccgacauccagcaguacuccuccgacaagcgcgucggccgcaccaugucccaccacgccgccgcccucaagcgccacaccgcccagcuccgcgaggagcuccucaagcuccccugccccgagggccucgaccccgacaccgacgacgcccccgaggucugccgcgccaccaccggcgccgaggagacccucaugcacgaccaggucaagcccuccuccuccaaggagcuccccuccgacuuccagcucuga

SEQ ID NO: 40335 - RNA, 843 nt, Artificial Sequence
  derived and/or modified sequence opt2 from BIRC7__Homo_sapiens__NP_071444
augggccccaaggacuccgccaagugccuccaccgcggcccccagcccucccacugggccgccggcgacggccccacccaggagcgcugcggcccccgcucccucggcucccccguccucggccucgacaccugccgcgccugggaccacgucgacggccagauccucggccagcuccgcccccucaccgaggaggaggaggaggagggcgccggcgccacccucucccgcggccccgccuuccccggcaugggcuccgaggagcuccgccucgccuccuucuacgacuggccccucaccgccgaggucccccccgagcuccucgccgccgccggcuucuuccacaccggccaccaggacaagguccgcugcuucuucugcuacggcggccuccaguccuggaagcgcggcgacgaccccuggaccgagcacgccaagugguuccccuccugccaguuccuccuccgcuccaagggccgcgacuucguccacuccguccaggagacccacucccagcuccucggcuccugggaccccugggaggagcccgaggacgccgcccccgucgcccccuccguccccgccuccggcuaccccgagcuccccaccccccgccgcgagguccaguccgaguccgcccaggagcccggcgcccgcgacgucgaggcccagcuccgccgccuccaggaggagcgcaccugcaaggucugccucgaccgcgccgucuccaucgucuucguccccugcggccaccucgucugcgccgagugcgcccccggccuccagcucugccccaucugccgcgcccccguccgcucccgcguccgcaccuuccucuccuga

SEQ ID NO: 40336 - RNA, 846 nt, Artificial Sequence
  derived and/or modified sequence opt2 from BIVM__Homo_sapiens__NP_001153068
augggcgccggcaaccucccccccaucacccaggaggaggcccuccacauccucggcuuccagccccccuucgaggacauccgcuucggccccuucaccggcaacaccacccucaugcgcugguuccgccagaucaacgaccacuuccacgucaagggcugcuccuacguccucuacaagccccacggcaagaacaagaccgccggcgagaccgccuccggcgcccucuccaagcucacccgcggccucaaggacgagucccucgccuacaucuaccacugccagaaccacuacuucugccccaucggcuucgaggccacccccgucaaggccaacaaggccuucucccgcggcccccucuccccccaggaggucgaguacuggauccucaucggcgaguccucccgcaagcaccccgccauccacugcaagaagugggccgacaucgucaccgaccucaacacccagaaccccgaguaccucgacauccgccaccucgagcgcggccuccaguaccgcaagaccaagaagcccaccuucuucuccucccaggucggcggcaaccuccacugcaucaucgccuuccagcgccucaacuggcagcgcuucggccucuggaacuuccccuucggcaccauccgccaggagucccagccccccacccacgcccagggcaucgccaaguccgaguccgaggacaacaucuccaagaagcagcacggccgccucggccgcuccuucuccgccuccuuccaccaggacuccgccuggaagaagauguccuccauccacgagcgccgcaacuccggcuaccagggcuacuccgacuacgacggcaacgacuga

SEQ ID NO: 40337 - RNA, 264 nt, Artificial Sequence
  derived and/or modified sequence opt2 from BLCAP__Homo_sapiens__NP_001161292
auguacugccuccaguggcuccuccccguccuccucauccccaagccccucaaccccgcccucugguucucccacuccauguucaugggcuucuaccuccucuccuuccuccucgagcgcaagcccugcaccaucugcgcccucgucuuccucgccgcccucuuccucaucugcuacuccugcuggggcaacugcuuccucuaccacugcuccgacuccccccuccccgaguccgcccacgaccccggcgucgucggcaccuga

SEQ ID NO: 40338 - RNA, 327 nt, Artificial Sequence
  derived and/or modified sequence opt2 from BLID__Homo_sapiens__NP_001001786
auggucacccuccuccccaucgagggccaggagauccacuucuucgagauccucgaguccgagugcguccucuacaccggcuggaucgagcgcgccuccggcuccuccaucuaccccgaggccaaggcccgccucccccucgaggcccuccucggcuccaacaaggagcccaugcuccccaaggagaccguccucucccucaagcgcuacaaccucggcuccuccgccaugaagcgcaacguccccggccacguccuccagcgccccuccuaccucacccgcauccaggucacccuccucugcaacuccuccgccgaggcccucuga

SEQ ID NO: 40339 - RNA, 1518 nt, Artificial Sequence
  derived and/or modified sequence opt2 from BLK__Homo_sapiens__NP_001706
augggccucgucuccuccaagaagcccgacaaggagaagcccaucaaggagaaggacaagggccagugguccccccucaaggucuccgcccaggacaaggacgcccccccccuccccccccucgucgucuucaaccaccucaccccccccccccccgacgagcaccucgacgaggacaagcacuucgucgucgcccucuacgacuacaccgccaugaacgaccgcgaccuccagaugcucaagggcgagaagcuccagguccucaagggcaccggcgacugguggcucgcccgcucccucgucaccggccgcgagggcuacguccccuccaacuucgucgcccgcgucgagucccucgagauggagcgcugguucuuccgcucccagggccgcaaggaggccgagcgccagcuccucgcccccaucaacaaggccggcuccuuccucauccgcgaguccgagaccaacaagggcgccuucucccucuccgucaaggacgucaccacccagggcgagcucaucaagcacuacaagauccgcugccucgacgagggcggcuacuacaucuccccccgcaucaccuuccccucccuccaggcccucguccagcacuacuccaagaagggcgacggccucugccagcgccucacccuccccugcguccgccccgccccccagaaccccugggcccaggacgagugggagaucccccgccagucccuccgccucguccgcaagcucggcuccggccaguucggcgaggucuggaugggcuacuacaagaacaacaugaaggucgccaucaagacccucaaggagggcaccaugucccccgaggccuuccucggcgaggccaacgucaugaaggcccuccagcacgagcgccucguccgccucuacgccgucgucaccaaggagcccaucuacaucgucaccgaguacauggcccgcggcugccuccucgacuuccucaagaccgacgagggcucccgccucucccucccccgccucaucgacauguccgcccagaucgccgagggcauggccuacaucgagcgcaugaacuccauccaccgcgaccuccgcgccgccaacauccucgucuccgaggcccucugcugcaagaucgccgacuucggccucgcccgcaucaucgacuccgaguacaccgcccaggagggcgccaaguuccccaucaaguggaccgcccccgaggccauccacuucggcgucuucaccaucaaggccgacgucugguccuucggcguccuccucauggaggucgucaccuacggccgcguccccuaccccggcauguccaaccccgaggucauccgcaaccucgagcgcggcuaccgcaugccccgccccgacaccugcccccccgagcucuaccgcggcgucaucgccgagugcuggcgcucccgccccgaggagcgccccaccuucgaguuccuccaguccguccucgaggacuucuacaccgccaccgagcgccaguacgagcuccagcccuga

SEQ ID NO: 40340 - RNA, 1368 nt, Artificial Sequence
  derived and/or modified sequence opt2 from BLMH__Homo_sapiens__NP_000377
auguccuccuccggccucaacuccgagaaggucgccgcccucauccagaagcucaacuccgacccccaguucguccucgcccagaacgucggcaccacccacgaccuccucgacaucugccucaagcgcgccaccguccagcgcgcccagcacgucuuccagcacgccgucccccaggagggcaagcccaucaccaaccagaaguccuccggccgcugcuggaucuucuccugccucaacgucaugcgccuccccuucaugaagaagcucaacaucgaggaguucgaguucucccaguccuaccucuucuucugggacaaggucgagcgcugcuacuucuuccucuccgccuucgucgacaccgcccagcgcaaggagcccgaggacggccgccucguccaguuccuccucaugaaccccgccaacgacggcggccagugggacaugcucgucaacaucgucgagaaguacggcgucauccccaagaagugcuuccccgaguccuacaccaccgaggccacccgccgcaugaacgacauccucaaccacaagaugcgcgaguucugcauccgccuccgcaaccucguccacuccggcgccaccaagggcgagaucuccgccacccaggacgucaugauggaggagaucuuccgcgucgucugcaucugccucggcaacccccccgagaccuucaccugggaguaccgcgacaaggacaagaacuaccagaagaucggccccaucaccccccucgaguucuaccgcgagcacgucaagccccucuucaacauggaggacaagaucugccucgucaacgacccccgcccccagcacaaguacaacaagcucuacaccgucgaguaccucuccaacauggucggcggccgcaagacccucuacaacaaccagcccaucgacuuccucaagaagauggucgccgccuccaucaaggacggcgaggccgucugguucggcugcgacgucggcaagcacuucaacuccaagcucggccucuccgacaugaaccucuacgaccacgagcucgucuucggcgucucccucaagaacaugaacaaggccgagcgccucaccuucggcgagucccucaugacccacgccaugaccuucaccgccgucuccgagaaggacgaccaggacggcgccuucaccaaguggcgcgucgagaacuccuggggcgaggaccacggccacaagggcuaccucugcaugaccgacgagugguucuccgaguacgucuacgaggucgucgucgaccgcaagcacguccccgaggagguccucgccguccucgagcaggagcccaucauccuccccgccugggaccccaugggcgcccucgccgaguga

SEQ ID NO: 40341 - RNA, 4254 nt, Artificial Sequence
  derived and/or modified sequence opt2 from BLM__Homo_sapiens__NP_001274175
auggccgccgucccccagaacaaccuccaggagcagcucgagcgccacuccgcccgcacccucaacaacaagcucucccucuccaagcccaaguucuccggcuucaccuucaagaagaagaccuccuccgacaacaacgucuccgucaccaacgucuccgucgccaagacccccguccuccgcaacaaggacgucaacgucaccgaggacuucuccuucuccgagccccuccccaacaccaccaaccagcagcgcgucaaggacuucuucaagaacgcccccgccggccaggagacccagcgcggcggcuccaagucccuccuccccgacuuccuccagacccccaaggaggucgucugcaccacccagaacacccccaccgucaagaagucccgcgacaccgcccucaagaagcucgaguucuccuccucccccgacucccucuccaccaucaacgacugggacgacauggacgacuucgacaccuccgagaccuccaaguccuucgucacccccccccagucccacuucguccgcgucuccaccgcccagaaguccaagaagggcaagcgcaacuucuucaaggcccagcucuacaccaccaacaccgucaagaccgaccuccccccccccuccuccgaguccgagcagaucgaccucaccgaggagcagaaggacgacuccgaguggcucuccuccgacgucaucugcaucgacgacggccccaucgccgagguccacaucaacgaggacgcccaggaguccgacucccucaagacccaccucgaggacgagcgcgacaacuccgagaagaagaagaaccucgaggaggccgagcuccacuccaccgagaagguccccugcaucgaguucgacgacgacgacuacgacaccgacuucgucccccccucccccgaggagaucaucuccgccuccuccuccuccuccaagugccucuccacccucaaggaccucgacaccuccgaccgcaaggaggacguccucuccaccuccaaggaccuccucuccaagcccgagaagauguccaugcaggagcucaaccccgagaccuccaccgacugcgacgcccgccagaucucccuccagcagcagcucauccacgucauggagcacaucugcaagcucaucgacaccauccccgacgacaagcucaagcuccucgacugcggcaacgagcuccuccagcagcgcaacauccgccgcaagcuccucaccgaggucgacuucaacaaguccgacgccucccuccucggcucccucuggcgcuaccgccccgacucccucgacggccccauggagggcgacuccugccccaccggcaacuccaugaaggagcucaacuucucccaccuccccuccaacuccgucucccccggcgacugccuccucaccaccacccucggcaagaccggcuucuccgccacccgcaagaaccucuucgagcgcccccucuucaacacccaccuccagaaguccuucgucuccuccaacugggccgagaccccccgccucggcaagaagaacgaguccuccuacuuccccggcaacguccucaccuccaccgccgucaaggaccagaacaagcacaccgccuccaucaacgaccucgagcgcgagacccagcccuccuacgacaucgacaacuucgacaucgacgacuucgacgacgacgacgacugggaggacaucaugcacaaccucgccgccuccaaguccuccaccgccgccuaccagcccaucaaggagggccgccccaucaaguccgucuccgagcgccucuccuccgccaagaccgacugccuccccgucuccuccaccgcccagaacaucaacuucuccgaguccauccagaacuacaccgacaaguccgcccagaaccucgccucccgcaaccucaagcacgagcgcuuccagucccucuccuucccccacaccaaggagaugaugaagaucuuccacaagaaguucggccuccacaacuuccgcaccaaccagcucgaggccaucaacgccgcccuccucggcgaggacugcuucauccucaugcccaccggcggcggcaagucccucugcuaccagcuccccgccugcgucucccccggcgucaccgucgucaucuccccccuccgcucccucaucgucgaccagguccagaagcucaccucccucgacauccccgccaccuaccucaccggcgacaagaccgacuccgaggccaccaacaucuaccuccagcucuccaagaaggaccccaucaucaagcuccucuacgucacccccgagaagaucugcgccuccaaccgccucaucuccacccucgagaaccucuacgagcgcaagcuccucgcccgcuucgucaucgacgaggcccacugcgucucccaguggggccacgacuuccgccaggacuacaagcgcaugaacaugcuccgccagaaguuccccuccguccccgucauggcccucaccgccaccgccaacccccgcguccagaaggacauccucacccagcucaagauccuccgcccccaggucuucuccauguccuucaaccgccacaaccucaaguacuacguccuccccaagaagcccaagaaggucgccuucgacugccucgaguggauccgcaagcaccaccccuacgacuccggcaucaucuacugccucucccgccgcgagugcgacaccauggccgacacccuccagcgcgacggccucgccgcccucgccuaccacgccggccucuccgacuccgcccgcgacgagguccagcagaaguggaucaaccaggacggcugccaggucaucugcgccaccaucgccuucggcaugggcaucgacaagcccgacguccgcuucgucauccacgccucccuccccaaguccgucgagggcuacuaccaggaguccggccgcgccggccgcgacggcgagaucucccacugccuccucuucuacaccuaccacgacgucacccgccucaagcgccucaucaugauggagaaggacggcaaccaccacacccgcgagacccacuucaacaaccucuacuccaugguccacuacugcgagaacaucaccgagugccgccgcauccagcuccucgccuacuucggcgagaacggcuucaaccccgacuucugcaagaagcaccccgacgucuccugcgacaacugcugcaagaccaaggacuacaagacccgcgacgucaccgacgacgucaaguccaucguccgcuucguccaggagcacuccuccucccagggcaugcgcaacaucaagcacgucggccccuccggccgcuucaccaugaacaugcucgucgacaucuuccucggcuccaaguccgccaagauccaguccggcaucuucggcaagggcuccgccuacucccgccacaacgccgagcgccucuucaagaagcucauccucgacaagauccucgacgaggaccucuacaucaacgccaacgaccaggccaucgccuacgucaugcucggcaacaaggcccagaccguccucaacggcaaccucaaggucgacuucauggagaccgagaacuccuccuccgucaagaagcagaaggcccucgucgccaaggucucccagcgcgaggagauggucaagaagugccucggcgagcucaccgaggucugcaagucccucggcaaggucuucggcguccacuacuucaacaucuucaacaccgucacccucaagaagcucgccgagucccucuccuccgaccccgagguccuccuccagaucgacggcgucaccgaggacaagcucgagaaguacggcgccgaggucaucuccguccuccagaaguacuccgaguggaccucccccgccgaggacuccucccccggcaucucccucuccuccucccgcggccccggccgcuccgccgccgaggagcucgacgaggagauccccgucuccucccacuacuucgccuccaagacccgcaacgagcgcaagcgcaagaagaugcccgccucccagcgcuccaagcgccgcaagaccgccuccuccggcuccaaggccaagggcggcuccgccaccugccgcaagaucuccuccaagaccaaguccuccuccaucaucggcuccuccuccgccucccacaccucccaggccaccuccggcgccaacuccaagcucggcaucauggccccccccaagcccaucaaccgccccuuccucaagcccuccuacgccuucuccuga

SEQ ID NO: 40342 - RNA, 1302 nt, Artificial Sequence
  derived and/or modified sequence opt2 from BLNK__Homo_sapiens__NP_001107566
auggacaagcucaacaagaucaccguccccgccucccagaagcuccgccagcuccagaagaugguccacgacaucaagaacaacgagggcggcaucaugaacaagaucaagaagcucaaggucaaggccccccccuccgucccccgccgcgacuacgccuccgagucccccgccgacgaggaggagcagugguccgacgacuucgacuccgacuacgagaaccccgacgagcacuccgacuccgagauguacgucaugcccgccgaggagaacgccgacgacuccuacgagcccccccccgucgagcaggagacccgccccguccaccccgcccuccccuucgcccgcggcgaguacaucgacaaccgcuccucccagcgccacuccccccccuucuccaagacccuccccuccaagcccuccuggcccuccgagaaggcccgccucaccuccacccuccccgcccucaccgcccuccagaagccccaggucccccccaagcccaagggccuccucgaggacgaggccgacuacgucguccccgucgaggacaacgacgagaacuacauccaccccaccgaguccuccucccccccccccgagaagggccgcaacuccggcgccugggagaccaagucccccccccccgccgcccccuccccccucccccgcgccggcaagaagcccaccaccccccucaagaccacccccgucgccucccagcagaacgccuccuccgucugcgaggagaagcccauccccgccgagcgccaccgcggcuccucccaccgccaggaggccguccagucccccgucuucccccccgcccagaagcagauccaccagaagcccaucccccucccccgcuucaccgagggcggcaaccccaccgucgacggcccccuccccuccuucuccuccaacuccaccaucuccgagcaggaggccggcguccucugcaagcccugguacgccggcgccugcgaccgcaaguccgccgaggaggcccuccaccgcuccaacaaggacggcuccuuccucauccgcaaguccuccggccacgacuccaagcagcccuacacccucgucgucuucuucaacaagcgcgucuacaacauccccguccgcuucaucgaggccaccaagcaguacgcccucggccgcaagaagaacggcgaggaguacuucggcuccgucgccgagaucauccgcaaccaccagcacuccccccucguccucaucgacucccagaacaacaccaaggacuccacccgccucaaguacgccgucaaggucuccuga

SEQ ID NO: 40343 - RNA, 288 nt, Artificial Sequence
  derived and/or modified sequence opt2 from BLOC1S2__Homo_sapiens__NP_001269365
augcgccucccccgcaagucccucgaggucgccaccuccgaggacuacaagcuccucgagaacaugaacaagcucaccucccucaaguaccucgagaugaaggacaucgccaucaacaucucccgcaaccucaaggaccucaaccagaaguacgccggccuccagcccuaccucgaccagaucaacgucaucgaggagcaggucgccgcccucgagcaggccgccuacaagcucgacgccuacuccaagaagcucgaggccaaguacaagaagcucgagaagcgcuga

SEQ ID NO: 40344 - RNA, 609 nt, Artificial Sequence
  derived and/or modified sequence opt2 from BLOC1S3__Homo_sapiens__NP_997715
auggccucccagggccgccgccgccgcccccuccgccgccccgagaccgucguccccggcgaggccaccgagaccgacuccgagcgcuccgccuccuccuccgaggaggaggagcucuaccucggccccuccggccccacccgcggccgccccaccggccuccgcgucgccggcgaggccgccgagaccgacuccgagcccgagcccgagcccgagcccaccgccgccccccgcgaccuccccccccucgucguccagcgcgaguccgccgaggaggccuggggcaccgaggaggcccccgcccccgcccccgcccgcucccuccuccagcuccgccucgccgagucccaggcccgccucgaccacgacgucgccgccgccgucuccggcgucuaccgccgcgccggccgcgacgucgccgcccucgccucccgccucgccgccgcccaggccgccggccucgccgccgcccacuccguccgccucgcccgcggcgaccucugcgcccucgccgagcgccucgacaucgucgccggcugccgccuccuccccgacauccgcggcguccccggcaccgagcccgagaaggaccccggcccccgcgccuga

SEQ ID NO: 40345 - RNA, 654 nt, Artificial Sequence
  derived and/or modified sequence opt2 from BLOC1S4__Homo_sapiens__NP_060836
auggagggcuccuucuccgacggcggcgcccuccccgagggccucgccgaggaggccgagccccagggcgccgccugguccggcgacuccggcaccgucucccagucccacuccuccgccuccggccccugggaggacgagggcgccgaggacggcgcccccggccgcgaccucccccuccuccgccgcgccgccgccggcuacgccgccugccuccuccccggcgccggcgcccgccccgaggucgaggcccucgacgccucccucgaggaccuccucacccgcgucgacgaguucgucggcaugcucgacaugcuccgcggcgacuccucccacgucgucuccgagggcgucccccgcauccacgccaaggccgccgagaugcgccgcaucuacucccgcaucgaccgccucgaggccuucguccgcauggucggcggccgcgucgcccgcauggaggagcaggucaccaaggccgaggccgagcucggcaccuucccccgcgccuucaagaagcuccuccacaccaugaacguccccucccucuucuccaaguccgcccccucccgcccccagcaggccggcuacgaggcccccguccucuuccgcaccgaggacuacuuccccugcugcuccgagcgcccccagcucuga

SEQ ID NO: 40346 - RNA, 372 nt, Artificial Sequence
  derived and/or modified sequence opt2 from BLOC1S5__Homo_sapiens__NP_001186251
auggagaagcgcggccuccgcgagaugcgcguccucgagaaccucaagaacaugauccacgagaccaacgagcacacccuccccaagugccgcgacaccaugcgcgacucccucucccagguccuccagcgccuccaggccgccaacgacuccgucugccgccuccagcagcgcgagcaggagcgcaagaagauccacuccgaccaccucgucgccuccgagaagcagcacaugcuccagugggacaacuucaugaaggagcagcccaacaagcgcgccgaggucgacgaggagcaccgcaaggccauggagcgccucaaggagcaguacgccgagauggagaaggaccucgccaaguucuccaccuucuga

SEQ ID NO: 40347 - RNA, 519 nt, Artificial Sequence
  derived and/or modified sequence opt2 from BLOC1S6__Homo_sapiens__NP_036520
auguccguccccggccccuccucccccgacggcgcccucacccgcccccccuacugccucgaggccggcgagcccacccccggccucuccgacaccucccccgacgagggccucaucgaggaccucaccaucgaggacaaggccgucgagcagcucgccgagggccuccucucccacuaccuccccgaccuccagcgcuccaagcaggcccuccaggagcucacccagaaccaggucguccuccucgacacccucgagcaggagaucuccaaguucaaggagugccacuccaugcucgacaucaacgcccucuucgccgaggccaagcacuaccacgccaagcucgucaacauccgcaaggagaugcucaugcuccacgagaagaccuccaagcucaagaagcgcgcccucaagcuccagcagaagcgccagaaggaggagcucgagcgcgagcagcagcgcgagaaggaguucgagcgcgagaagcagcucaccgcccgccccgccaagcgcauguga

SEQ ID NO: 40348 - RNA, 891 nt, Artificial Sequence
  derived and/or modified sequence opt2 from BLVRA__Homo_sapiens__XP_011513776
augaacgccgagcccgagcgcaaguucggcgucgucgucgucggcgucggccgcgccggcuccguccgcaugcgcgaccuccgcaacccccaccccuccuccgccuuccucaaccucaucggcuucgucucccgccgcgagcucggcuccaucgacggcguccagcagaucucccucgaggacgcccucuccucccaggaggucgaggucgccuacaucugcuccgaguccuccucccacgaggacuacauccgccaguuccucaacgccggcaagcacguccucgucgaguaccccaugacccucucccucgccgccgcccaggagcucugggagcucgccgagcagaagggcaagguccuccacgaggagcacgucgagcuccucauggaggaguucgccuuccucaagaaggaggucgucggcaaggaccuccucaagggcucccuccucuucaccgccggcccccucgaggaggagcgcuucggcuuccccgccuucuccggcaucucccgccucaccuggcucgucucccucuucggcgagcucucccucgucuccgccacccucgaggagcgcaaggaggaccaguacaugaagaugaccgucugccucgagaccgagaagaaguccccccucuccuggaucgaggagaagggccccggccucaagcgcaaccgcuaccucuccuuccacuucaaguccggcucccucgagaacguccccaacgucggcgucaacaagaacaucuuccucaaggaccagaacaucuucguccagaagcuccucggccaguucuccgagaaggagcucgccgccgagaagaagcgcauccuccacugccucggccucgccgaggagauccagaaguacugcugcucccgcaaguga

SEQ ID NO: 40349 - RNA, 621 nt, Artificial Sequence
  derived and/or modified sequence opt2 from BLVRB__Homo_sapiens__NP_000704
auggccgucaagaagaucgccaucuucggcgccaccggccagaccggccucaccacccucgcccaggccguccaggccggcuacgaggucaccguccucguccgcgacuccucccgccuccccuccgagggcccccgccccgcccacgucgucgucggcgacguccuccaggccgccgacgucgacaagaccgucgccggccaggacgccgucaucguccuccucggcacccgcaacgaccucucccccaccaccgucauguccgagggcgcccgcaacaucgucgccgccaugaaggcccacggcgucgacaaggucgucgccugcaccuccgccuuccuccucugggaccccaccaagguccccccccgccuccaggccgucaccgacgaccacauccgcaugcacaagguccuccgcgaguccggccucaaguacgucgccgucaugcccccccacaucggcgaccagccccucaccggcgccuacaccgucacccucgacggccgcggccccucccgcgucaucuccaagcacgaccucggccacuucaugcuccgcugccucaccaccgacgaguacgacggccacuccaccuaccccucccaccaguaccaguga

SEQ ID NO: 40350 - RNA, 1203 nt, Artificial Sequence
  derived and/or modified sequence opt2 from BLZF1__Homo_sapiens__NP_003657
augaccaccaagaaccucgagaccaaggucaccgucaccuccucccccauccgcggcgccggcgacggcauggagaccgaggagccccccaaguccgucgaggucaccuccggcguccagucccgcaagcaccacucccuccagucccccuggaagaaggccguccccuccgagucccccggcguccuccagcucggcaagaugcucaccgagaaggccauggaggucaaggccguccgcauccucguccccaaggccgccaucacccacgacauccccaacaagaacaccaaggucaagucccucggccaccacaagggcgaguuccucggccaguccgagggcgucaucgagcccaacaaggagcucuccgaggucaagaacguccucgagaagcucaagaacuccgagcgccgccuccuccaggacaaggagggccucuccaaccagcuccgcguccagaccgaggucaaccgcgagcucaagaagcuccucgucgccuccgucggcgacgaccuccaguaccacuucgagcgccucgcccgcgagaagaaccagcucauccucgagaacgaggcccucggccgcaacaccgcccagcucuccgagcagcucgagcgcauguccauccagugcgacgucuggcgcuccaaguuccucgccucccgcgucauggccgacgagcucaccaacucccgcgccgcccuccagcgccagaaccgcgacgcccacggcgccauccaggaccuccucuccgagcgcgagcaguuccgccaggagaugaucgccacccagaagcuccucgaggagcuccucgucucccuccaguggggccgcgagcagaccuacucccccuccguccagccccacuccaccgccgagcucgcccucaccaaccacaagcucgccaaggccgucaacucccaccuccucggcaacgucggcaucaacaaccagaagaagauccccuccaccgucgaguucugcuccacccccgccgagaagauggccgagaccguccuccgcauccucgaccccgucaccugcaaggaguccucccccgacaaccccuucuucgaguccucccccaccacccuccucgccaccaagaagaacaucggccgcuuccaccccuacacccgcuacgagaacaucaccuucaacugcugcaaccacugccgcggcgagcucaucgcccucuga

SEQ ID NO: 40351 - RNA, 492 nt, Artificial Sequence
  derived and/or modified sequence opt2 from BMF__Homo_sapiens__NP_001003942
auggagcccucccagugcgucgaggagcucgaggacgacgucuuccagcccgaggacggcgagcccgucacccagcccggcucccuccucuccgccgaccucuucgcccagucccuccucgacugcccccucucccgccuccagcucuucccccucacccacugcugcggccccggccuccgccccaccucccaggaggacaaggccacccagacccucucccccgccucccccucccagggcgucaugcuccccugcggcgucaccgaggagccccagcgccucuucuacggcaacgccggcuaccgccucccccuccccgccuccuuccccgccguccuccccaucggcgagcagccccccgagggccaguggcagcaccaggccgagcaccagcagaaccagaaccgcgucugguggcagauccuccucuuccuccacaaccucgcccucaacggcgaggagaaccgcaacggcgccggcccccgcuga

SEQ ID NO: 40352 - RNA, 981 nt, Artificial Sequence
  derived and/or modified sequence opt2 from BMI1__Homo_sapiens__NP_005171
augcaccgcaccacccgcaucaagaucaccgagcucaacccccaccucaugugcguccucugcggcggcuacuucaucgacgccaccaccaucaucgagugccuccacuccuucugcaagaccugcaucguccgcuaccucgagaccuccaaguacugccccaucugcgacguccagguccacaagacccgcccccuccucaacauccgcuccgacaagacccuccaggacaucgucuacaagcucguccccggccucuucaagaacgagaugaagcgccgccgcgacuucuacgccgcccaccccuccgccgacgccgccaacggcuccaacgaggaccgcggcgaggucgccgacgaggacaagcgcaucaucaccgacgacgagaucaucucccucuccaucgaguucuucgaccagaaccgccucgaccgcaaggucaacaaggacaaggagaaguccaaggaggaggucaacgacaagcgcuaccuccgcugccccgccgccaugaccgucaugcaccuccgcaaguuccuccgcuccaagauggacauccccaacaccuuccagaucgacgucauguacgaggaggagccccucaaggacuacuacacccucauggacaucgccuacaucuacaccuggcgccgcaacggcccccucccccucaaguaccgcguccgccccaccugcaagcgcaugaagaucucccaccagcgcgacggccucaccaacgccggcgagcucgaguccgacuccggcuccgacaaggccaacucccccgccggcggcauccccuccaccuccuccugccuccccucccccuccacccccguccaguccccccacccccaguucccccacaucuccuccaccaugaacggcaccuccaacucccccuccggcaaccaccaguccuccuucgccaaccgcccccgcaaguccuccgucaacggcuccuccgccaccuccuccggcuga

SEQ ID NO: 40353 - RNA, 1275 nt, Artificial Sequence
  derived and/or modified sequence opt2 from BMP10__Homo_sapiens__NP_055297
augggcucccucguccucacccucugcgcccucuucugccucgccgccuaccucgucuccggcucccccaucaugaaccucgagcaguccccccucgaggaggacaugucccucuucggcgacgucuucuccgagcaggacggcgucgacuucaacacccuccuccaguccaugaaggacgaguuccucaagacccucaaccucuccgacauccccacccaggacuccgccaaggucgacccccccgaguacaugcucgagcucuacaacaaguucgccaccgaccgcaccuccaugcccuccgccaacaucauccgcuccuucaagaacgaggaccucuucucccagcccgucuccuucaacggccuccgcaaguacccccuccucuucaacgucuccaucccccaccacgaggaggucaucauggccgagcuccgccucuacacccucguccagcgcgaccgcaugaucuacgacggcgucgaccgcaagaucaccaucuucgagguccucgaguccaagggcgacaacgagggcgagcgcaacaugcucguccucgucuccggcgagaucuacggcaccaacuccgagugggagaccuucgacgucaccgacgccauccgccgcuggcagaaguccggcuccuccacccaccagcucgagguccacaucgaguccaagcacgacgaggccgaggacgccuccuccggccgccucgagaucgacaccuccgcccagaacaagcacaacccccuccucaucgucuucuccgacgaccaguccuccgacaaggagcgcaaggaggagcucaacgagaugaucucccacgagcagcuccccgagcucgacaaccucggccucgacuccuucuccuccggccccggcgaggaggcccuccuccagaugcgcuccaacaucaucuacgacuccaccgcccgcauccgccgcaacgccaagggcaacuacugcaagcgcaccccccucuacaucgacuucaaggagaucggcugggacuccuggaucaucgccccccccggcuacgaggccuacgagugccgcggcgucugcaacuacccccucgccgagcaccucacccccaccaagcacgccaucauccaggcccucguccaccucaagaacucccagaaggccuccaaggccugcugcguccccaccaagcucgagcccaucuccauccucuaccucgacaagggcgucgucaccuacaaguucaaguacgagggcauggccgucuccgagugcggcugccgcuga

SEQ ID NO: 40354 - RNA, 1179 nt, Artificial Sequence
  derived and/or modified sequence opt2 from BMP15__Homo_sapiens__NP_005439
augguccuccucuccauccuccgcauccucuuccucugcgagcucguccucuucauggagcaccgcgcccagauggccgagggcggccaguccuccaucgcccuccucgccgaggcccccacccucccccucaucgaggagcuccucgaggagucccccggcgagcagccccgcaagccccgccuccucggccacucccuccgcuacaugcucgagcucuaccgccgcuccgccgacucccacggccacccccgcgagaaccgcaccaucggcgccaccaugguccgccucgucaagccccucaccaacgucgcccgcccccaccgcggcaccuggcacauccagauccucggcuucccccuccgccccaaccgcggccucuaccagcucguccgcgccaccgucgucuaccgccaccaccuccagcucacccgcuucaaccucuccugccacgucgagcccuggguccagaagaaccccaccaaccacuuccccuccuccgagggcgacuccuccaagcccucccucauguccaacgccuggaaggagauggacaucacccagcucguccagcagcgcuucuggaacaacaagggccaccgcauccuccgccuccgcuucaugugccagcagcagaaggacuccggcggccucgagcucuggcacggcaccuccucccucgacaucgccuuccuccuccucuacuucaacgacacccacaaguccauccgcaaggccaaguuccucccccgcggcauggaggaguucauggagcgcgagucccuccuccgccgcacccgccaggccgacggcaucuccgccgaggucaccgccuccuccuccaagcacuccggccccgagaacaaccagugcucccuccaccccuuccagaucuccuuccgccagcucggcugggaccacuggaucaucgccccccccuucuacacccccaacuacugcaagggcaccugccuccgcguccuccgcgacggccucaacucccccaaccacgccaucauccagaaccucaucaaccagcucgucgaccaguccgucccccgccccuccugcguccccuacaaguacguccccaucuccguccucaugaucgaggccaacggcuccauccucuacaaggaguacgagggcaugaucgccgaguccugcaccugccgcuga

SEQ ID NO: 40355 - RNA, 2193 nt, Artificial Sequence
  derived and/or modified sequence opt2 from BMP1__Homo_sapiens__NP_001190
augcccggcgucgcccgccucccccuccuccucggccuccuccuccucccccgccccggccgcccccucgaccucgccgacuacaccuacgaccucgccgaggaggacgacuccgagccccucaacuacaaggaccccugcaaggccgccgccuuccucggcgacaucgcccucgacgaggaggaccuccgcgccuuccagguccagcaggccgucgaccuccgccgccacaccgcccgcaaguccuccaucaaggccgccguccccggcaacaccuccacccccuccugccaguccaccaacggccagccccagcgcggcgccugcggccgcuggcgcggccgcucccgcucccgccgcgccgccaccucccgccccgagcgcgucuggcccgacggcgucauccccuucgucaucggcggcaacuucaccggcucccagcgcgccgucuuccgccaggccaugcgccacugggagaagcacaccugcgucaccuuccucgagcgcaccgacgaggacuccuacaucgucuucaccuaccgccccugcggcugcugcuccuacgucggccgccgcggcggcggcccccaggccaucuccaucggcaagaacugcgacaaguucggcaucgucguccacgagcucggccacgucgucggcuucuggcacgagcacacccgccccgaccgcgaccgccacgucuccaucguccgcgagaacauccagcccggccaggaguacaacuuccucaagauggagccccaggaggucgagucccucggcgagaccuacgacuucgacuccaucaugcacuacgcccgcaacaccuucucccgcggcaucuuccucgacaccaucguccccaaguacgaggucaacggcgucaagccccccaucggccagcgcacccgccucuccaagggcgacaucgcccaggcccgcaagcucuacaagugccccgccugcggcgagacccuccaggacuccaccggcaacuucuccucccccgaguaccccaacggcuacuccgcccacaugcacugcgucuggcgcaucuccgucacccccggcgagaagaucauccucaacuucaccucccucgaccucuaccgcucccgccucugcugguacgacuacgucgagguccgcgacggcuucuggcgcaaggccccccuccgcggccgcuucugcggcuccaagcuccccgagcccaucgucuccaccgacucccgccucugggucgaguuccgcuccuccuccaacugggucggcaagggcuucuucgccgucuacgaggccaucugcggcggcgacgucaagaaggacuacggccacauccagucccccaacuaccccgacgacuaccgccccuccaaggucugcaucuggcgcauccaggucuccgagggcuuccacgucggccucaccuuccaguccuucgagaucgagcgccacgacuccugcgccuacgacuaccucgagguccgcgacggccacuccgaguccuccacccucaucggccgcuacugcggcuacgagaagcccgacgacaucaaguccaccuccucccgccucuggcucaaguucgucuccgacggcuccaucaacaaggccggcuucgccgucaacuucuucaaggaggucgacgagugcucccgccccaaccgcggcggcugcgagcagcgcugccucaacacccucggcuccuacaagugcuccugcgaccccggcuacgagcucgcccccgacaagcgccgcugcgaggccgccugcggcggcuuccucaccaagcucaacggcuccaucaccucccccggcuggcccaaggaguacccccccaacaagaacugcaucuggcagcucgucgcccccacccaguaccgcaucucccuccaguucgacuucuucgagaccgagggcaacgacgucugcaaguacgacuucgucgagguccgcuccggccucaccgccgacuccaagcuccacggcaaguucugcggcuccgagaagcccgaggucaucaccucccaguacaacaacaugcgcgucgaguucaaguccgacaacaccgucuccaagaagggcuucaaggcccacuucuucuccgagaagcgccccgcccuccagcccccccgcggccgcccccaccagcucaaguuccgcguccagaagcgcaaccgcaccccccaguga

SEQ ID NO: 40356 - RNA, 1191 nt, Artificial Sequence
  derived and/or modified sequence opt2 from BMP2__Homo_sapiens__NP_001191
auggucgccggcacccgcugccuccucgcccuccuccucccccagguccuccucggcggcgccgccggccucguccccgagcucggccgccgcaaguucgccgccgccuccuccggccgccccuccucccagcccuccgacgagguccucuccgaguucgagcuccgccuccucuccauguucggccucaagcagcgccccacccccucccgcgacgccgucgucccccccuacaugcucgaccucuaccgccgccacuccggccagcccggcucccccgcccccgaccaccgccucgagcgcgccgccucccgcgccaacaccguccgcuccuuccaccacgaggagucccucgaggagcuccccgagaccuccggcaagaccacccgccgcuucuucuucaaccucuccuccauccccaccgaggaguucaucaccuccgccgagcuccaggucuuccgcgagcagaugcaggacgcccucggcaacaacuccuccuuccaccaccgcaucaacaucuacgagaucaucaagcccgccaccgccaacuccaaguuccccgucacccgccuccucgacacccgccucgucaaccagaacgccucccgcugggaguccuucgacgucacccccgccgucaugcgcuggaccgcccagggccacgccaaccacggcuucgucgucgaggucgcccaccucgaggagaagcagggcgucuccaagcgccacguccgcaucucccgcucccuccaccaggacgagcacuccuggucccagauccgcccccuccucgucaccuucggccacgacggcaagggccacccccuccacaagcgcgagaagcgccaggccaagcacaagcagcgcaagcgccucaaguccuccugcaagcgccacccccucuacgucgacuucuccgacgucggcuggaacgacuggaucgucgccccccccggcuaccacgccuucuacugccacggcgagugccccuucccccucgccgaccaccucaacuccaccaaccacgccaucguccagacccucgucaacuccgucaacuccaagauccccaaggccugcugcguccccaccgagcucuccgccaucuccaugcucuaccucgacgagaacgagaaggucguccucaagaacuaccaggacauggucgucgagggcugcggcugccgcuga

SEQ ID NO: 40357 - RNA, 1989 nt, Artificial Sequence
  derived and/or modified sequence opt2 from BMP2K__Homo_sapiens__NP_060063
augaagaaguucucccgcaugcccaaguccgagggcggcuccggcggcggcgccgccggcggcggcgccggcggcgccggcgccggcgccggcugcggcuccggcggcuccuccgucggcguccgcgucuucgccgucggccgccaccaggucacccucgaggagucccucgccgagggcggcuucuccaccgucuuccucguccgcacccacggcggcauccgcugcgcccucaagcgcauguacgucaacaacaugcccgaccucaacgucugcaagcgcgagaucaccaucaugaaggagcucuccggccacaagaacaucgucggcuaccucgacugcgccgucaacuccaucuccgacaacgucugggagguccucauccucauggaguacugccgcgccggccaggucgucaaccagaugaacaagaagcuccagaccggcuucaccgagcccgagguccuccagaucuucugcgacaccugcgaggccgucgcccgccuccaccagugcaagacccccaucauccaccgcgaccucaaggucgagaacauccuccucaacgacggcggcaacuacguccucugcgacuucggcuccgccaccaacaaguuccucaacccccagaaggacggcgucaacgucgucgaggaggagaucaagaaguacaccacccucuccuaccgcgcccccgagaugaucaaccucuacggcggcaagcccaucaccaccaaggccgacaucugggcccucggcugccuccucuacaagcucugcuucuucacccuccccuucggcgagucccaggucgccaucugcgacggcaacuucaccauccccgacaacucccgcuacucccgcaacauccacugccucauccgcuucaugcucgagcccgaccccgagcaccgccccgacaucuuccaggucuccuacuucgccuucaaguucgccaagaaggacugccccgucuccaacaucaacaacuccuccauccccuccgcccuccccgagcccaugaccgccuccgaggccgccgcccgcaagucccagaucaaggcccgcaucaccgacaccaucggccccaccgagaccuccaucgccccccgccagcgccccaaggccaacuccgccaccaccgccacccccuccguccucaccauccaguccuccgccacccccgucaagguccucgcccccggcgaguucggcaaccaccgccccaagggcgcccuccgccccggcaacggccccgagauccuccucggccagggccccccccagcagcccccccagcagcaccgcguccuccagcagcuccagcagggcgacuggcgccuccagcagcuccaccuccagcaccgccacccccaccagcagcagcagcagcagcagcagcagcagcagcagcagcagcagcagcagcagcagcagcagcagcagcagcagcagcagcaccaccaccaccaccaccaccaccuccuccaggacgccuacaugcagcaguaccagcacgccacccagcagcagcagaugcuccagcagcaguuccucaugcacuccgucuaccagccccagcccuccgccucccaguaccccaccaugaugccccaguaccagcaggccuucuuccagcagcagaugcucgcccagcaccagcccucccagcagcaggccucccccgaguaccucaccuccccccaggaguucucccccgcccucgucuccuacaccuccucccuccccgcccaggucggcaccaucauggacuccuccuacuccgccaaccgcuccgucgccgacaaggaggccaucgccaacuucaccaaccagaagaacaucuccaacccccccgacauguccggcuggaaccccuucggcgaggacaacuucuccaagcucaccgaggaggagcuccucgaccgcgaguucgaccuccuccgcuccuccaagggccaccucaaggccuacuucgccucccaguga

SEQ ID NO: 40358 - RNA, 1320 nt, Artificial Sequence
  derived and/or modified sequence opt2 from BMP3__Homo_sapiens__XP_006714354
auggccggcgccucccgccuccucuuccucuggcucggcugcuucugcgucucccucgcccagggcgagcgccccaagccccccuuccccgagcuccgcaaggccguccccggcgaccgcaccgccggcggcggccccgacuccgagcuccagccccaggacaaggucuccgagcacaugcuccgccucuacgaccgcuacuccaccguccaggccgcccgcacccccggcucccucgagggcggcucccagcccuggcgcccccgccuccuccgcgagggcaacaccguccgcuccuuccgcgccgccgccgccgagacccucgagcgcaagggccucuacaucuucaaccucaccucccucaccaaguccgagaacauccucuccgccacccucuacuucugcaucggcgagcucggcaacaucucccucuccugccccgucuccggcggcugcucccaccacgcccagcgcaagcacauccagaucgaccucuccgccuggacccucaaguucucccgcaaccagucccagcuccucggccaccucuccgucgacauggccaagucccaccgcgacaucauguccuggcucuccaaggacaucacccagcuccuccgcaaggccaaggagaacgaggaguuccucaucggcuucaacaucaccuccaagggccgccagcuccccaagcgccgccuccccuuccccgagcccuacauccucgucuacgccaacgacgccgccaucuccgagcccgaguccgucgucuccucccuccagggccaccgcaacuuccccaccggcaccguccccaagugggacucccacauccgcgccgcccucuccaucgagcgccgcaagaagcgcuccaccggcguccuccucccccuccagaacaacgagcuccccggcgccgaguaccaguacaagaaggacgaggucugggaggagcgcaagcccuacaagacccuccaggcccaggcccccgagaaguccaagaacaagaagaagcagcgcaagggcccccaccgcaagucccagacccuccaguucgacgagcagacccucaagaaggcccgccgcaagcaguggaucgagccccgcaacugcgcccgccgcuaccucaagucccucaagcccuccaaccacgccaccauccaguccaucguccgcgccgucggcgucguccccggcauccccgagcccugcugcguccccgagaagauguccucccucuccauccucuucuucgacgagaacaagaacgucguccucaaggucuaccccaacaugaccgucgaguccugcgccugccgcuga

SEQ ID NO: 40359 - RNA, 1227 nt, Artificial Sequence
  derived and/or modified sequence opt2 from BMP4__Homo_sapiens__NP_001193
augauccccggcaaccgcaugcucauggucguccuccucugccagguccuccucggcggcgccucccacgccucccucauccccgagaccggcaagaagaaggucgccgagauccagggccacgccggcggccgccgcuccggccagucccacgagcuccuccgcgacuucgaggccacccuccuccagauguucggccuccgccgccgcccccagcccuccaaguccgccgucauccccgacuacaugcgcgaccucuaccgccuccaguccggcgaggaggaggaggagcagauccacuccaccggccucgaguaccccgagcgccccgccucccgcgccaacaccguccgcuccuuccaccacgaggagcaccucgagaacauccccggcaccuccgagaacuccgccuuccgcuuccucuucaaccucuccuccauccccgagaacgaggucaucuccuccgccgagcuccgccucuuccgcgagcaggucgaccagggccccgacugggagcgcggcuuccaccgcaucaacaucuacgaggucaugaagccccccgccgaggucguccccggccaccucaucacccgccuccucgacacccgccucguccaccacaacgucacccgcugggagaccuucgacgucucccccgccguccuccgcuggacccgcgagaagcagcccaacuacggccucgccaucgaggucacccaccuccaccagacccgcacccaccagggccagcacguccgcaucucccgcucccucccccagggcuccggcaacugggcccagcuccgcccccuccucgucaccuucggccacgacggccgcggccacgcccucacccgccgccgccgcgccaagcgcucccccaagcaccacucccagcgcgcccgcaagaagaacaagaacugccgccgccacucccucuacgucgacuucuccgacgucggcuggaacgacuggaucgucgccccccccggcuaccaggccuucuacugccacggcgacugccccuucccccucgccgaccaccucaacuccaccaaccacgccaucguccagacccucgucaacuccgucaacuccuccauccccaaggccugcugcguccccaccgagcucuccgccaucuccaugcucuaccucgacgaguacgacaaggucguccucaagaacuaccaggagauggucgucgagggcugcggcugccgcuga

SEQ ID NO: 40360 - RNA, 1365 nt, Artificial Sequence
  derived and/or modified sequence opt2 from BMP5__Homo_sapiens__NP_066551
augcaccucaccgucuuccuccucaagggcaucgucggcuuccucugguccugcuggguccucgucggcuacgccaagggcggccucggcgacaaccacguccacuccuccuucaucuaccgccgccuccgcaaccacgagcgccgcgagauccagcgcgagauccucuccauccucggccucccccaccgcccccgccccuucucccccggcaagcaggccuccuccgccccccucuucaugcucgaccucuacaacgccaugaccaacgaggagaaccccgaggaguccgaguacuccguccgcgccucccucgccgaggagacccgcggcgcccgcaagggcuaccccgccucccccaacggcuacccccgccgcauccagcucucccgcaccaccccccucaccacccagucccccccccucgccucccuccacgacaccaacuuccucaacgacgccgacauggucauguccuucgucaaccucgucgagcgcgacaaggacuucucccaccagcgccgccacuacaaggaguuccgcuucgaccucacccagaucccccacggcgaggccgucaccgccgccgaguuccgcaucuacaaggaccgcuccaacaaccgcuucgagaacgagaccaucaagaucuccaucuaccagaucaucaaggaguacaccaaccgcgacgccgaccucuuccuccucgacacccgcaaggcccaggcccucgacgucggcuggcucgucuucgacaucaccgucaccuccaaccacugggucaucaacccccagaacaaccucggccuccagcucugcgccgagaccggcgacggccgcuccaucaacgucaaguccgccggccucgucggccgccagggcccccaguccaagcagcccuucauggucgccuucuucaaggccuccgagguccuccuccgcuccguccgcgccgccaacaagcgcaagaaccagaaccgcaacaaguccuccucccaccaggacuccucccgcauguccuccgucggcgacuacaacaccuccgagcagaagcaggccugcaagaagcacgagcucuacgucuccuuccgcgaccucggcuggcaggacuggaucaucgcccccgagggcuacgccgccuucuacugcgacggcgagugcuccuucccccucaacgcccacaugaacgccaccaaccacgccaucguccagacccucguccaccucauguuccccgaccacguccccaagcccugcugcgcccccaccaagcucaacgccaucuccguccucuacuucgacgacuccuccaacgucauccucaagaaguaccgcaacauggucguccgcuccugcggcugccacuga

SEQ ID NO: 40361 - RNA, 1542 nt, Artificial Sequence
  derived and/or modified sequence opt2 from BMP6__Homo_sapiens__NP_001709
augcccggccucggccgccgcgcccaguggcucugcuggugguggggccuccucugcuccugcugcggcccccccccccuccgccccccccuccccgccgccgccgccgccgccgccggcggccagcuccucggcgacggcggcucccccggccgcaccgagcagcccccccccuccccccaguccuccuccggcuuccucuaccgccgccucaagacccaggagaagcgcgagaugcagaaggagauccucuccguccucggccucccccaccgcccccgcccccuccacggccuccagcagccccagccccccgcccuccgccagcaggaggagcagcagcagcagcagcagcucccccgcggcgagcccccccccggccgccucaaguccgccccccucuucaugcucgaccucuacaacgcccucuccgccgacaacgacgaggacggcgccuccgagggcgagcgccagcaguccuggccccacgaggccgccuccuccucccagcgccgccagcccccccccggcgccgcccacccccucaaccgcaagucccuccucgcccccggcuccggcuccggcggcgccuccccccucaccuccgcccaggacuccgccuuccucaacgacgccgacauggucauguccuucgucaaccucgucgaguacgacaaggaguucuccccccgccagcgccaccacaaggaguucaaguucaaccucucccagauccccgagggcgaggucgucaccgccgccgaguuccgcaucuacaaggacugcgucaugggcuccuucaagaaccagaccuuccucaucuccaucuaccagguccuccaggagcaccagcaccgcgacuccgaccucuuccuccucgacacccgcgucgucugggccuccgaggagggcuggcucgaguucgacaucaccgccaccuccaaccucugggucgucaccccccagcacaacaugggccuccagcucuccgucgucacccgcgacggcguccacguccacccccgcgccgccggccucgucggccgcgacggccccuacgacaagcagcccuucauggucgccuucuucaaggucuccgagguccacguccgcaccacccgcuccgccuccucccgccgccgccagcagucccgcaaccgcuccacccagucccaggacgucgcccgcgucuccuccgccuccgacuacaacuccuccgagcucaagaccgccugccgcaagcacgagcucuacgucuccuuccaggaccucggcuggcaggacuggaucaucgcccccaagggcuacgccgccaacuacugcgacggcgagugcuccuucccccucaacgcccacaugaacgccaccaaccacgccaucguccagacccucguccaccucaugaaccccgaguacguccccaagcccugcugcgcccccaccaagcucaacgccaucuccguccucuacuucgacgacaacuccaacgucauccucaagaaguaccgcaacauggucguccgcgccugcggcugccacuga

SEQ ID NO: 40362 - RNA, 1296 nt, Artificial Sequence
  derived and/or modified sequence opt2 from BMP7__Homo_sapiens__NP_001710
augcacguccgcucccuccgcgccgccgccccccacuccuucgucgcccucugggccccccucuuccuccuccgcuccgcccucgccgacuucucccucgacaacgagguccacuccuccuucauccaccgccgccuccgcucccaggagcgccgcgagaugcagcgcgagauccucuccauccucggccucccccaccgcccccgcccccaccuccagggcaagcacaacuccgcccccauguucaugcucgaccucuacaacgccauggccgucgaggagggcggcggccccggcggccagggcuucuccuaccccuacaaggccgucuucuccacccagggccccccccucgccucccuccaggacucccacuuccucaccgacgccgacauggucauguccuucgucaaccucgucgagcacgacaaggaguucuuccacccccgcuaccaccaccgcgaguuccgcuucgaccucuccaagauccccgagggcgaggccgucaccgccgccgaguuccgcaucuacaaggacuacauccgcgagcgcuucgacaacgagaccuuccgcaucuccgucuaccagguccuccaggagcaccucggccgcgaguccgaccucuuccuccucgacucccgcacccucugggccuccgaggagggcuggcucgucuucgacaucaccgccaccuccaaccacugggucgucaacccccgccacaaccucggccuccagcucuccgucgagacccucgacggccaguccaucaaccccaagcucgccggccucaucggccgccacggcccccagaacaagcagcccuucauggucgccuucuucaaggccaccgagguccacuuccgcuccauccgcuccaccggcuccaagcagcgcucccagaaccgcuccaagacccccaagaaccaggaggcccuccgcauggccaacgucgccgagaacuccuccuccgaccagcgccaggccugcaagaagcacgagcucuacgucuccuuccgcgaccucggcuggcaggacuggaucaucgcccccgagggcuacgccgccuacuacugcgagggcgagugcgccuucccccucaacuccuacaugaacgccaccaaccacgccaucguccagacccucguccacuucaucaaccccgagaccguccccaagcccugcugcgcccccacccagcucaacgccaucuccguccucuacuucgacgacuccuccaacgucauccucaagaaguaccgcaacauggucguccgcgccugcggcugccacuga

SEQ ID NO: 40363 - RNA, 837 nt, Artificial Sequence
  derived and/or modified sequence opt2 from BMP8B__Homo_sapiens__XP_011540326
augaccgcccuccccggcccccucuggcuccucggccucgcccucugcgcccucggcggcggcggccccggccuccgccccccccccggcugcccccagcgccgccucggcgcccgcgagcgccgcgacguccagcgcgagauccucgccguccucggccuccccggccgcccccgcccccgcgccccccccgccgccucccgccuccccgccuccgccccccucuucaugcucgaccucuaccacgccauggccggcgacgacgacgaggacggcgcccccgccgagcgccgccucggccgcgccgaccucgucauguccuucgucaacauggucgagcgcgaccgcgcccucggccaccaggagccccacuggaaggaguuccgcuucgaccucacccagauccccgccggcgaggccgucaccgccgccgaguuccgcaucuacaagguccccuccauccaccuccucaaccgcacccuccacgucuccauguuccaggucguccaggagcaguccaaccgcgaguccgaccucuucuuccucgaccuccagacccuccgcgccggcgacgagggcuggcucguccucgacgucaccgccgccuccgacugcuggcuccucaagcgccacaaggaccucggccuccgccucuacgucgagaccgaggacggcgagaccuggaccggcuggggcuggaccaaggacucccgccuccagauguggaagcuccgccucucccgcacccccuggguccucucccuccacgcccccggccccgcccaggcccccgccgagcgcccccuccucugccuccuccagggccacugccccuga

SEQ ID NO: 40364 - RNA, 2058 nt, Artificial Sequence
  derived and/or modified sequence opt2 from BMPER__Homo_sapiens__NP_597725
augcucugguucuccggcgucggcgcccucgccgagcgcuacugccgccgcucccccggcaucaccugcugcguccuccuccuccucaacugcuccggcguccccaugucccucgccuccuccuuccucaccggcuccgucgccaagugcgagaacgagggcgagguccuccagauccccuucaucaccgacaaccccugcaucaugugcgucugccucaacaaggaggucaccugcaagcgcgagaagugccccguccucucccgcgacugcgcccucgccaucaagcagcgcggcgccugcugcgagcagugcaagggcugcaccuacgagggcaacaccuacaacuccuccuucaaguggcagucccccgccgagcccugcguccuccgccagugccaggagggcgucgucaccgaguccggcguccgcugcgucguccacugcaagaacccccucgagcaccucggcaugugcugccccaccugccccggcugcgucuucgagggcguccaguaccaggagggcgaggaguuccagcccgagggcuccaagugcaccaagugcuccugcaccggcggccgcacccagugcguccgcgaggucugccccauccucuccugcccccagcaccucucccacaucccccccggccagugcugccccaagugccucggccagcgcaaggucuucgaccuccccuucggcuccugccucuuccgcuccgacgucuacgacaacggcuccuccuuccucuacgacaacugcaccgccugcaccugccgcgacuccaccgucgucugcaagcgcaagugcucccaccccggcggcugcgaccagggccaggagggcugcugcgaggagugccuccuccgcgucccccccgaggacaucaaggucugcaaguucggcaacaagaucuuccaggacggcgagaugugguccuccaucaacugcaccaucugcgccugcgucaagggccgcaccgagugccgcaacaagcagugcauccccaucuccuccugcccccagggcaagauccucaaccgcaagggcugcugccccaucugcaccgagaagcccggcgucugcaccgucuucggcgacccccacuacaacaccuucgacggccgcaccuucaacuuccagggcaccugccaguacguccucaccaaggacugcuccucccccgccucccccuuccagguccucgucaagaacgacgcccgccgcacccgcuccuucuccuggaccaaguccgucgagcucguccucggcgagucccgcgucucccuccagcagcaccucaccguccgcuggaacggcucccgcaucgcccuccccugccgcgccccccacuuccacaucgaccucgacggcuaccuccucaaggucaccaccaaggccggccucgagaucuccugggacggcgacuccuucgucgaggucauggccgccccccaccucaagggcaagcucugcggccucugcggcaacuacaacggccacaagcgcgacgaccucaucggcggcgacggcaacuucaaguucgacgucgacgacuucgccgaguccuggcgcgucgaguccaacgaguucugcaaccgcccccagcgcaagcccguccccgagcucugccagggcaccgucaaggucaagcuccgcgcccaccgcgagugccagaagcucaaguccugggaguuccagaccugccacuccaccgucgacuacgccaccuucuaccgcuccugcgucaccgacaugugcgagugccccguccacaagaacugcuacugcgaguccuuccucgccuacacccgcgccugccagcgcgagggcaucaagguccacugggagccccagcagaacugcgccgccacccagugcaagcacggcgccgucuacgacaccugcggccccggcugcaucaagaccugcgacaacuggaacgagaucggccccugcaacaagcccugcgucgccggcugccacugccccgccaaccucguccuccacaagggccgcugcaucaagcccguccucugcccccagcgcuga

SEQ ID NO: 40365 - RNA, 1599 nt, Artificial Sequence
  derived and/or modified sequence opt2 from BMPR1A__Homo_sapiens__NP_004320
augccccagcucuacaucuacauccgccuccucggcgccuaccucuucaucaucucccgcguccagggccagaaccucgacuccaugcuccacggcaccggcaugaaguccgacuccgaccagaagaaguccgagaacggcgucacccucgcccccgaggacacccuccccuuccucaagugcuacugcuccggccacugccccgacgacgccaucaacaacaccugcaucaccaacggccacugcuucgccaucaucgaggaggacgaccagggcgagaccacccucgccuccggcugcaugaaguacgagggcuccgacuuccagugcaaggacucccccaaggcccagcuccgccgcaccaucgagugcugccgcaccaaccucugcaaccaguaccuccagcccacccucccccccgucgucaucggccccuucuucgacggcuccauccgcuggcucguccuccucaucuccauggccgucugcaucaucgccaugaucaucuucuccuccugcuucugcuacaagcacuacugcaaguccaucuccucccgccgccgcuacaaccgcgaccucgagcaggacgaggccuucauccccgucggcgagucccucaaggaccucaucgaccagucccaguccuccggcuccggcuccggccucccccuccucguccagcgcaccaucgccaagcagauccagaugguccgccaggucggcaagggccgcuacggcgaggucuggaugggcaaguggcgcggcgagaaggucgccgucaaggucuucuucaccaccgaggaggccuccugguuccgcgagaccgagaucuaccagaccguccucaugcgccacgagaacauccucggcuucaucgccgccgacaucaagggcaccggcuccuggacccagcucuaccucaucaccgacuaccacgagaacggcucccucuacgacuuccucaagugcgccacccucgacacccgcgcccuccucaagcucgccuacuccgccgccugcggccucugccaccuccacaccgagaucuacggcacccagggcaagcccgccaucgcccaccgcgaccucaaguccaagaacauccucaucaagaagaacggcuccugcugcaucgccgaccucggccucgccgucaaguucaacuccgacaccaacgaggucgacgucccccucaacacccgcgucggcaccaagcgcuacauggcccccgagguccucgacgagucccucaacaagaaccacuuccagcccuacaucauggccgacaucuacuccuucggccucaucaucugggagauggcccgccgcugcaucaccggcggcaucgucgaggaguaccagcuccccuacuacaacaugguccccuccgaccccuccuacgaggacaugcgcgaggucgucugcgucaagcgccuccgccccaucgucuccaaccgcuggaacuccgacgagugccuccgcgccguccucaagcucauguccgagugcugggcccacaaccccgccucccgccucaccgcccuccgcaucaagaagacccucgccaagauggucgagucccaggacgucaagaucuga

SEQ ID NO: 40366 - RNA, 1509 nt, Artificial Sequence
  derived and/or modified sequence opt2 from BMPR1B__Homo_sapiens__NP_001243721
augcuccuccgcuccgccggcaagcucaacgucggcaccaagaaggaggacggcgaguccaccgcccccaccccccgccccaagguccuccgcugcaagugccaccaccacugccccgaggacuccgucaacaacaucugcuccaccgacggcuacugcuucaccaugaucgaggaggacgacuccggccuccccgucgucaccuccggcugccucggccucgagggcuccgacuuccagugccgcgacacccccaucccccaccagcgccgcuccaucgagugcugcaccgagcgcaacgagugcaacaaggaccuccaccccacccuccccccccucaagaaccgcgacuucgucgacggccccauccaccaccgcgcccuccucaucuccgucaccgucugcucccuccuccucguccucaucauccucuucugcuacuuccgcuacaagcgccaggagacccgcccccgcuacuccaucggccucgagcaggacgagaccuacaucccccccggcgagucccuccgcgaccucaucgagcagucccaguccuccggcuccggcuccggccucccccuccucguccagcgcaccaucgccaagcagauccagauggucaagcagaucggcaagggccgcuacggcgaggucuggaugggcaaguggcgcggcgagaaggucgccgucaaggucuucuucaccaccgaggaggccuccugguuccgcgagaccgagaucuaccagaccguccucaugcgccacgagaacauccucggcuucaucgccgccgacaucaagggcaccggcuccuggacccagcucuaccucaucaccgacuaccacgagaacggcucccucuacgacuaccucaaguccaccacccucgacgccaaguccaugcucaagcucgccuacuccuccgucuccggccucugccaccuccacaccgagaucuucuccacccagggcaagcccgccaucgcccaccgcgaccucaaguccaagaacauccucgucaagaagaacggcaccugcugcaucgccgaccucggccucgccgucaaguucaucuccgacaccaacgaggucgacaucccccccaacacccgcgucggcaccaagcgcuacaugccccccgagguccucgacgagucccucaaccgcaaccacuuccaguccuacaucauggccgacauguacuccuucggccucauccucugggaggucgcccgccgcugcgucuccggcggcaucgucgaggaguaccagcuccccuaccacgaccucguccccuccgaccccuccuacgaggacaugcgcgagaucgucugcaucaagaagcuccgccccuccuuccccaaccgcugguccuccgacgagugccuccgccagaugggcaagcucaugaccgagugcugggcccacaaccccgccucccgccucaccgcccuccgcgucaagaagacccucgccaagauguccgagucccaggacaucaagcucuga

SEQ ID NO: 40367 - RNA, 3117 nt, Artificial Sequence
  derived and/or modified sequence opt2 from BMPR2__Homo_sapiens__NP_001195
augaccuccucccuccagcgccccuggcgcguccccuggcuccccuggaccauccuccucgucuccaccgccgccgccucccagaaccaggagcgccucugcgccuucaaggaccccuaccagcaggaccucggcaucggcgagucccgcaucucccacgagaacggcaccauccucugcuccaagggcuccaccugcuacggccucugggagaaguccaagggcgacaucaaccucgucaagcagggcugcuggucccacaucggcgacccccaggagugccacuacgaggagugcgucgucaccaccaccccccccuccauccagaacggcaccuaccgcuucugcugcugcuccaccgaccucugcaacgucaacuucaccgagaacuuccccccccccgacaccaccccccucucccccccccacuccuucaaccgcgacgagaccaucaucaucgcccucgccuccgucuccguccucgccguccucaucgucgcccucugcuucggcuaccgcaugcucaccggcgaccgcaagcagggccuccacuccaugaacaugauggaggccgccgccuccgagcccucccucgaccucgacaaccucaagcuccucgagcucaucggccgcggccgcuacggcgccgucuacaagggcucccucgacgagcgccccgucgccgucaaggucuucuccuucgccaaccgccagaacuucaucaacgagaagaacaucuaccgcgucccccucauggagcacgacaacaucgcccgcuucaucgucggcgacgagcgcgucaccgccgacggccgcauggaguaccuccucgucauggaguacuaccccaacggcucccucugcaaguaccucucccuccacaccuccgacugggucuccuccugccgccucgcccacuccgucacccgcggccucgccuaccuccacaccgagcucccccgcggcgaccacuacaagcccgccaucucccaccgcgaccucaacucccgcaacguccucgucaagaacgacggcaccugcgucaucuccgacuucggccucuccaugcgccucaccggcaaccgccucguccgccccggcgaggaggacaacgccgccaucuccgaggucggcaccauccgcuacauggcccccgagguccucgagggcgccgucaaccuccgcgacugcgaguccgcccucaagcaggucgacauguacgcccucggccucaucuacugggagaucuucaugcgcugcaccgaccucuuccccggcgaguccguccccgaguaccagauggccuuccagaccgaggucggcaaccaccccaccuucgaggacaugcagguccucgucucccgcgagaagcagcgccccaaguuccccgaggccuggaaggagaacucccucgccguccgcucccucaaggagaccaucgaggacugcugggaccaggacgccgaggcccgccucaccgcccagugcgccgaggagcgcauggccgagcucaugaugaucugggagcgcaacaaguccgucucccccaccgucaaccccauguccaccgccaugcagaacgagcgcaaccucucccacaaccgccgcguccccaagaucggccccuaccccgacuacuccuccuccuccuacaucgaggacuccauccaccacaccgacuccaucgucaagaacaucuccuccgagcacuccauguccuccaccccccucaccaucggcgagaagaaccgcaacuccaucaacuacgagcgccagcaggcccaggcccgcauccccucccccgagaccuccgucaccucccucuccaccaacaccaccaccaccaacaccaccggccucacccccuccaccggcaugaccaccaucuccgagaugcccuaccccgacgagaccaaccuccacaccaccaacgucgcccaguccaucggccccacccccgucugccuccagcucaccgaggaggaccucgagaccaacaagcucgaccccaaggaggucgacaagaaccucaaggaguccuccgacgagaaccucauggagcacucccucaagcaguucuccggccccgacccccucuccuccaccuccuccucccuccucuacccccucaucaagcucgccgucgaggccaccggccagcaggacuucacccagaccgccaacggccaggccugccucauccccgacguccuccccacccagaucuacccccuccccaagcagcagaaccuccccaagcgccccaccucccucccccucaacaccaagaacuccaccaaggagccccgccucaaguucggcuccaagcacaaguccaaccucaagcaggucgagaccggcgucgccaagaugaacaccaucaacgccgccgagccccacgucgucaccgucaccaugaacggcgucgccggccgcaaccacuccgucaacucccacgccgccaccacccaguacgccaacggcaccguccucuccggccagaccaccaacaucgucacccaccgcgcccaggagaugcuccagaaccaguucaucggcgaggacacccgccucaacaucaacuccucccccgacgagcacgagccccuccuccgccgcgagcagcaggccggccacgacgagggcguccucgaccgccucgucgaccgccgcgagcgcccccucgagggcggccgcaccaacuccaacaacaacaacuccaaccccugcuccgagcaggacguccucgcccagggcguccccuccaccgccgccgaccccggccccuccaagccccgccgcgcccagcgccccaacucccucgaccucuccgccaccaacguccucgacggcuccuccauccagaucggcgaguccacccaggacggcaaguccggcuccggcgagaagaucaagaagcgcgucaagacccccuacucccucaagcgcuggcgccccuccaccugggucaucuccaccgagucccucgacugcgaggucaacaacaacggcuccaaccgcgccguccacuccaaguccuccaccgccgucuaccucgccgagggcggcaccgccaccaccauggucuccaaggacaucggcaugaacugccucuga

SEQ ID NO: 40368 - RNA, 3849 nt, Artificial Sequence
  derived and/or modified sequence opt2 from BMS1__Homo_sapiens__NP_055568
auggaggccaaggaccagaagaagcaccgcaagaagaacuccggccccaaggccgccaagaagaagaagcgccuccuccaggaccuccagcucggcgacgaggaggacgcccgcaagcgcaaccccaaggccuucgccguccaguccgccguccgcauggcccgcuccuuccaccgcacccaggaccucaagaccaagaagcaccacauccccgucgucgaccgcaccccccucgagcccccccccaucgucgucgucgucaugggcccccccaaggucggcaaguccacccucauccagugccucauccgcaacuucacccgccagaagcucaccgagauccgcggccccgucaccaucgucuccggcaagaagcgccgccucaccaucaucgagugcggcugcgacaucaacaugaugaucgaccucgccaaggucgccgaccucguccucaugcucaucgacgccuccuucggcuucgagauggagaccuucgaguuccucaacaucugccagguccacggcuuccccaagaucaugggcguccucacccaccucgacuccuucaagcacaacaagcagcucaagaagaccaagaagcgccucaagcaccgcuucuggaccgaggucuaccccggcgccaagcucuucuaccucuccggcaugguccacggcgaguaccagaaccaggagauccacaaccucggccgcuucaucaccgucaugaaguuccgcccccucaccuggcagaccucccaccccuacauccucgccgaccgcauggaggaccucaccaaccccgaggacauccgcaccaacaucaagugcgaccgcaaggucucccucuacggcuaccuccgcggcgcccaccucaagaacaagucccagauccacaugcccggcgucggcgacuucgccgucuccgacaucuccuuccuccccgaccccugcgcccuccccgagcagcagaagaagcgcugccucaacgagaaggagaagcucgucuacgccccccucuccggcgucggcggcguccucuacgacaaggacgccgucuacgucgaccucggcggcucccacgucuuccaggacgaggucggccccacccacgagcucguccagucccucaucuccacccacuccaccaucgacgccaagauggccuccucccgcgucacccucuucuccgacuccaagccccucggcuccgaggacaucgacaaccagggccucaugaugcccaaggaggagaagcagauggaccucaacaccggccgcaugcgccgcaaggccaucuucggcgacgaggacgaguccggcgacuccgacgacgaggaggacgacgagauguccgaggacgacggccucgagaacggcuccuccgacgaggaggccgaggaggaggagaacgccgagaugaccgaccaguacauggccgucaagggcaucaagcgccgcaagcucgagcucgaggaggacuccgagauggaccuccccgccuucgccgacuccgacgacgaccucgagcgcuccuccgccgaggagggcgaggccgaggaggccgacgaguccuccgaggaggaggacugcaccgccggcgagaagggcaucuccggcuccaaggccgccggcgagggcuccaaggccggccucucccccgccaacugccaguccgaccgcgucaaccucgagaagucccuccucaugaagaaggccgcccuccccaccuucgacuccggccacugcaccgccgaggaggucuucgccuccgaggacgaguccgaggaguccuccucccucuccgccgaggaggaggacuccgagaacgaggaggccauccgcaagaagcucuccaagcccucccaggucuccuccggccagaagcucggcccccagaacuucaucgacgagaccuccgacaucgagaaccuccucaaggaggaggaggacuacaaggaggagaacaacgacuccaaggagaccuccggcgcccucaaguggaaggaggaccucucccgcaaggccgccgaggccuuccuccgccagcagcaggccgcccccaaccuccgcaagcucaucuacggcaccgucaccgaggacaacgaggaggaggacgacgacacccucgaggagcucggcggccucuuccgcgucaaccagcccgaccgcgagugcaagcacaaggccgacucccucgacugcucccgcuuccucgucgaggccccccacgacugggaccucgaggaggucaugaacuccauccgcgacugcuucgucaccggcaagugggaggacgacaaggacgccgccaagguccucgccgaggacgaggagcucuacggcgacuucgaggaccucgagaccggcgacguccacaagggcaaguccggccccaacacccagaacgaggacaucgagaaggaggucaaggaggagaucgaccccgacgaggaggaguccgccaagaagaagcaccucgacaagaagcgcaagcucaaggagauguucgacgccgaguacgacgagggcgaguccaccuacuucgacgaccucaagggcgagaugcagaagcaggcccagcucaaccgcgccgaguucgaggaccaggacgacgaggcccgcguccaguacgagggcuuccgccccggcauguacguccgcaucgagaucgagaacguccccugcgaguucguccagaacuucgacccccacuaccccaucauccucggcggccucggcaacuccgagggcaacgucggcuacguccagaugcgccucaagaagcaccgcugguacaagaagauccucaagucccgcgaccccaucaucuucuccgucggcuggcgccgcuuccagaccaucccccucuacuacaucgaggaccacaacggccgccagcgccuccucaaguacaccccccagcacaugcacugcggcgccgccuucuggggccccaucaccccccagggcaccggcuuccucgccauccaguccgucuccggcaucaugcccgacuuccgcaucgccgccaccggcgucguccucgaccucgacaaguccaucaagaucgucaagaagcucaagcucaccggcuuccccuacaagaucuucaagaacaccuccuucaucaagggcauguucaacuccgcccucgaggucgccaaguucgagggcgccgucauccgcaccgucuccggcauccgcggccagaucaagaaggcccuccgcgcccccgagggcgccuuccgcgccuccuucgaggacaagcuccucauguccgacaucgucuucaugcgcaccugguaccccgucuccauccccgccuucuacaaccccgucaccucccuccucaagcccgucggcgagaaggacaccugguccggcaugcgcaccaccggccagcuccgccucgcccacggcguccgccucaaggccaacaaggacucccucuacaagcccauccuccgccagaagaagcacuucaacucccuccacauccccaaggcccuccagaaggcccuccccuucaagaacaagcccaagacccaggccaaggccggcaagguccccaaggaccgccgccgccccgccgucauccgcgagccccacgagcgcaagauccucgcccuccucgacgcccucuccaccguccacucccagaagaugaagaaggccaaggagcagcgccaccuccacaacaaggagcacuuccgcgccaagcagaaggaggaggaggagaagcucaagcgccagaaggaccuccgcaagaagcucuuccgcauccagggccagaaggagcgccgcaaccagaaguccucccucaagggcgccgagggccagcuccaguga

SEQ ID NO: 40369 - RNA, 2028 nt, Artificial Sequence
  derived and/or modified sequence opt2 from BMX__Homo_sapiens__NP_001712
auggacaccaaguccauccucgaggagcuccuccucaagcgcucccagcagaagaagaagaugucccccaacaacuacaaggagcgccucuucguccucaccaagaccaaccucuccuacuacgaguacgacaagaugaagcgcggcucccgcaagggcuccaucgagaucaagaagauccgcugcgucgagaaggucaaccucgaggagcagacccccgucgagcgccaguaccccuuccagaucgucuacaaggacggccuccucuacgucuacgccuccaacgaggagucccgcucccaguggcucaaggcccuccagaaggagauccgcggcaacccccaccuccucgucaaguaccacuccggcuucuucgucgacggcaaguuccucugcugccagcaguccugcaaggccgcccccggcugcacccucugggaggccuacgccaaccuccacaccgccgucaacgaggagaagcaccgcguccccaccuuccccgaccgcguccucaagaucccccgcgccguccccguccucaagauggacgcccccuccuccuccaccacccucgcccaguacgacaacgaguccaagaagaacuacggcucccagccccccuccuccuccaccucccucgcccaguacgacuccaacuccaagaagaucuacggcucccagcccaacuucaacaugcaguacaucccccgcgaggacuuccccgacugguggcagguccgcaagcucaaguccuccuccuccuccgaggacgucgccuccuccaaccagaaggagcgcaacgucaaccacaccaccuccaagaucuccugggaguuccccgaguccuccuccuccgaggaggaggagaaccucgacgacuacgacugguucgccggcaacaucucccgcucccaguccgagcagcuccuccgccagaagggcaaggagggcgccuucaugguccgcaacuccucccaggucggcauguacaccgucucccucuucuccaaggccgucaacgacaagaagggcaccgucaagcacuaccacguccacaccaacgccgagaacaagcucuaccucgccgagaacuacugcuucgacuccauccccaagcucauccacuaccaccagcacaacuccgccggcaugaucacccgccuccgccaccccgucuccaccaaggccaacaagguccccgacuccgucucccucggcaacggcaucugggagcucaagcgcgaggagaucacccuccucaaggagcucggcuccggccaguucggcgucguccagcucggcaaguggaagggccaguacgacgucgccgucaagaugaucaaggagggcuccauguccgaggacgaguucuuccaggaggcccagaccaugaugaagcucucccaccccaagcucgucaaguucuacggcgucugcuccaaggaguaccccaucuacaucgucaccgaguacaucuccaacggcugccuccucaacuaccuccgcucccacggcaagggccucgagcccucccagcuccucgagaugugcuacgacgucugcgagggcauggccuuccucgagucccaccaguucauccaccgcgaccucgccgcccgcaacugccucgucgaccgcgaccucugcgucaaggucuccgacuucggcaugacccgcuacguccucgacgaccaguacgucuccuccgucggcaccaaguuccccgucaagugguccgcccccgaggucuuccacuacuucaaguacuccuccaaguccgacgucugggccuucggcauccucaugugggaggucuucucccucggcaagcagcccuacgaccucuacgacaacucccaggucguccucaaggucucccagggccaccgccucuaccgcccccaccucgccuccgacaccaucuaccagaucauguacuccugcuggcacgagcuccccgagaagcgccccaccuuccagcagcuccucuccuccaucgagccccuccgcgagaaggacaagcacuga

SEQ ID NO: 40370 - RNA, 2964 nt, Artificial Sequence
  derived and/or modified sequence opt2 from BNC1__Homo_sapiens__NP_001288135
augcgcugccgcaacauguucuucuccuucaaggccucccucugcggcugcggcgccgccaccgcccccucccucaccgccaucuccugcacccucaacugcuccugccaguccuucaagcccggcaagaucaaccaccgccagugcgaccagugcaagcacggcugggucgcccacgcccucuccaagcuccgcaucccccccauguaccccaccucccaggucgagaucguccaguccaacgucgucuucgacaucuccucccucaugcucuacggcacccaggccauccccguccgccucaagauccuccucgaccgccucuucuccguccucaagcaggacgagguccuccagauccuccacgcccucgacuggacccuccaggacuacauccgcggcuacguccuccaggacgccuccggcaagguccucgaccacugguccaucaugaccuccgaggaggaggucgccacccuccagcaguuccuccgcuucggcgagaccaaguccaucgucgagcucauggccauccaggagaaggaggagcaguccaucaucaucccccccuccaccgccaacgucgacauccgcgccuucaucgaguccugcucccaccgcuccuccucccuccccacccccgucgacaagggcaaccccuccuccauccaccccuucgagaaccucaucuccaacaugaccuucaugcuccccuuccaguucuucaacccccucccccccgcccucaucggcucccuccccgagcaguacaugcucgagcagggccacgaccagucccaggaccccaagcaggagguccacggccccuuccccgacuccuccuuccucaccuccuccuccacccccuuccaggucgagaaggaccagugccucaacugccccgacgccaucaccaagaaggaggacuccacccaccucuccgacuccuccuccuacaacaucgucaccaaguucgagcgcacccagcucucccccgaggccaaggucaagcccgagcgcaacucccucggcaccaagaagggccgcgucuucugcaccgccugcgagaagaccuucuacgacaagggcacccucaagauccacuacaacgccguccaccucaagaucaagcacaagugcaccaucgagggcugcaacauggucuucuccucccuccgcucccgcaaccgccacuccgccaaccccaacccccgccuccacaugcccaugaaccgcaacaaccgcgacaaggaccuccgcaacucccucaaccucgccuccuccgagaacuacaagugccccggcuucaccgucaccucccccgacugccgccccccccccuccuaccccggcuccggcgaggacuccaagggccagcccgccuuccccaacaucggccagaacggcguccucuuccccaaccucaagaccguccagcccguccuccccuucuaccgcucccccgccacccccgccgaggucgccaacacccccggcauccuccccucccucccccuccucuccuccuccauccccgagcagcucaucuccaacgagaugcccuucgacgcccuccccaagaagaagucccgcaaguccuccaugcccaucaagaucgagaaggaggccgucgagaucgccaacgagaagcgccacaaccucuccuccgacgaggacaugccccuccaggucgucuccgaggacgagcaggaggccugcuccccccagucccaccgcgucuccgaggagcagcacguccaguccggcggccucggcaagcccuuccccgagggcgagcgccccugccaccgcgaguccgucaucgaguccuccggcgccaucucccagacccccgagcaggccacccacaacuccgagcgcgagaccgagcagacccccgcccucaucauggucccccgcgaggucgaggacggcggccacgagcacuacuucacccccggcauggagccccagguccccuucuccgacuacauggagcuccagcagcgccuccucgccggcggccucuucuccgcccucuccaaccgcggcauggccuuccccugccucgaggacuccaaggagcucgagcacgucggccagcacgcccucgcccgccagaucgaggagaaccgcuuccagugcgacaucugcaagaagaccuucaagaacgccugcuccgucaagauccaccacaagaacaugcacgucaaggagaugcacaccugcaccgucgagggcugcaacgccaccuuccccucccgccgcucccgcgaccgccacuccuccaaccucaaccuccaccagaaggcccucucccaggaggcccucgaguccuccgaggaccacuuccgcgccgccuaccuccucaaggacgucgccaaggaggccuaccaggacgucgccuucacccagcaggccucccagaccuccgucaucuucaagggcaccucccgcaugggcucccucgucuaccccaucacccagguccacuccgccucccucgaguccuacaacuccggcccccucuccgagggcaccauccucgaccucuccaccaccuccuccaugaaguccgaguccuccucccacuccuccugggacuccgacggcgucuccgaggagggcaccguccucauggaggacuccgacggcaacugcgagggcuccucccucguccccggcgaggacgaguaccccaucugcguccucauggagaaggccgaccagucccucgccucccuccccuccggccuccccaucaccugccaccucugccagaagaccuacuccaacaagggcaccuuccgcgcccacuacaagaccguccaccuccgccagcuccacaagugcaagguccccggcugcaacaccauguucuccuccguccgcucccgcaaccgccacucccagaaccccaaccuccacaagucccucgccuccucccccucccaccuccaguga

SEQ ID NO: 40371 - RNA, 3300 nt, Artificial Sequence
  derived and/or modified sequence opt2 from BNC2__Homo_sapiens__NP_060107
auggcccaccucggccccaccccccccccccacucccucaacuacaaguccgaggaccgccucuccgagcaggacuggcccgccuacuucaagguccccugcugcggcgucgacaccucccagaucgaguccgaggaggccgaggucgacguccgcgagcgcgagacccagcgcgaccgcgagcccaagcgcgcccgcgaccucacccuccgcgacuccugcaccgacaacuccaugcaguucggcacccgcaccaccaccgccgagcccggcuucaugggcaccuggcagaacgccgacaccaaccuccucuuccgcaugucccagcaggccauccgcugcacccucgucaacugcaccugcgagugcuuccagcccggcaagaucaaccuccgcaccugcgaccagugcaagcacggcugggucgcccacgcccucgacaagcucuccacccagcaccucuaccaccccacccaggucgagaucguccaguccaacgucgucuucgacaucuccucccucaugcucuacggcacccaggccguccccguccgccucaagauccuccucgaccgccucuucuccguccucaagcaggaggagguccuccacauccuccacggccucggcuggacccuccgcgacuacguccgcggcuacauccuccaggacgccgccggcaagguccucgaccgcugggccaucaugucccgcgaggaggagaucaucacccuccagcaguuccuccgcuucggcgagaccaaguccaucgucgagcucauggccauccaggagaaggagggccaggccgucgccguccccuccuccaagaccgacuccgacauccgcaccuucaucgaguccaacaaccgcacccgcucccccucccuccucgcccaccucgagaacuccaaccccuccuccauccaccacuucgagaacauccccaacucccucgccuuccuccuccccuuccaguacaucaaccccgucuccgccccccuccucggccucccccccaacggccuccuccucgagcagcccggccuccgccuccgcgagcccucccucuccacccagaacgaguacaacgaguccuccgaguccgaggucucccccacccccuacaagaacgaccagacccccaaccgcaacgcccucaccuccaucaccaacgucgagcccaagaccgagcccgccugcgucucccccauccagaacuccgcccccgucuccgaccucaccaagaccgagcaccccaaguccuccuuccgcauccaccgcaugcgccgcaugggcuccgccucccgcaagggccgcgucuucugcaacgccugcggcaagaccuucuacgacaagggcacccucaagauccacuacaacgccguccaccucaagaucaagcaccgcugcaccaucgagggcugcaacauggucuucuccucccuccgcucccgcaaccgccacuccgccaaccccaacccccgccuccacaugcccaugcuccgcaacaaccgcgacaaggaccucauccgcgccaccuccggcgccgccacccccgucaucgccuccaccaaguccaaccucgcccucaccucccccggccgcccccccaugggcuucaccacccccccccucgaccccguccuccagaacccccuccccucccagcucgucuucuccggccucaagaccguccagcccgucccccccuucuaccgcucccuccucacccccggcgagauggucuccccccccaccucccuccccaccucccccaucauccccaccuccggcaccaucgagcagcacccccccccccccuccgagcccgucguccccgccgucaugauggccacccacgagcccuccgccgaccucgcccccaagaagaagccccgcaaguccuccaugcccgucaagaucgagaaggagaucaucgacaccgccgacgaguucgacgacgaggacgacgaccccaacgacggcggcgccgucgucaacgacaugucccacgacaaccacugccacucccaggaggagaugucccccggcauguccgucaaggacuucuccaagcacaaccgcacccgcugcaucucccgcaccgagauccgccgcgccgacuccaugaccuccgaggaccaggagcccgagcgcgacuacgagaacgaguccgaguccuccgagcccaagcucggcgaggaguccauggagggcgacgagcacauccacuccgaggucuccgagaagguccucaugaacuccgagcgccccgacgagaaccacuccgagcccucccaccaggacgucaucaaggucaaggaggaguucaccgaccccaccuacgacauguucuacaugucccaguacggccucuacaacggcggcggcgccuccauggccgcccuccacgaguccuucaccuccucccucaacuacggcuccccccagaaguucucccccgagggcgaccucugcuccucccccgaccccaagaucugcuacgucugcaagaaguccuucaaguccuccuacuccgucaagcuccacuaccgcaacguccaccucaaggagaugcacgucugcaccgucgccggcugcaacgccgccuuccccucccgccgcucccgcgaccgccacuccgccaacaucaaccuccaccgcaagcuccucaccaaggagcucgacgacaugggccucgacuccucccagcccucccucuccaaggaccuccgcgacgaguuccucgucaagaucuacggcgcccagcaccccaugggccucgacguccgcgaggacgccuccucccccgccggcaccgaggacucccaccucaacggcuacggccgcggcauggccgaggacuacaugguccucgaccucuccaccaccuccucccuccaguccuccuccuccauccacuccucccgcgaguccgacgccggcuccgacgagggcauccuccucgacgacaucgacggcgccuccgacuccggcgaguccgcccacaaggccgaggcccccgcccuccccggcucccucggcgccgaggucuccggcucccucauguucuccucccucuccggcuccaacggcggcaucaugugcaacaucugccacaagauguacuccaacaagggcacccuccgcguccacuacaagaccguccaccuccgcgagaugcacaagugcaagguccccggcugcaacaugauguucuccuccguccgcucccgcaaccgccacucccagaaccccaaccuccacaagaacauccccuucaccuccgucgacuga

SEQ ID NO: 40372 - RNA, 687 nt, Artificial Sequence
  derived and/or modified sequence opt2 from BNIP1__Homo_sapiens__NP_001196
auggccgccccccaggacguccacguccgcaucugcaaccaggagaucgucaaguucgaccucgaggucaaggcccucauccaggacauccgcgacugcuccggcccccucuccgcccucaccgagcucaacaccaaggucaaggagaaguuccagcagcuccgccaccgcauccaggaccucgagcagcucgccaaggagcaggacaaggaguccgagaagcagcuccuccuccaggaggucgagaaccacaagaagcagaugcucuccaaccaggccuccuggcgcaaggccaaccucaccugcaagaucgccaucgacaaccucgagaaggccgagcuccuccagggcggcgaccuccuccgccagcgcaagaccaccaaggagucccucgcccagaccuccuccaccaucaccgagucccucaugggcaucucccgcaugauggcccagcagguccagcaguccgaggaggccaugcagucccucgucaccuccucccgcaccauccucgacgccaacgaggaguucaaguccauguccggcaccauccagcucggccgcaagcucaucaccaaguacaaccgccgcgagcucaccgacaagcuccucaucuuccucgcccucgcccucuuccucgccaccguccucuacaucgucaagaagcgccucuuccccuuccucuga

SEQ ID NO: 40373 - RNA, 1308 nt, Artificial Sequence
  derived and/or modified sequence opt2 from BNIP2__Homo_sapiens__NP_004321
augcucugcggcuuccaggaggacgccaccccccccccccccccccgcccccgccgccuccaccgccgccucccccgccccgaggaggucggcaugcucucccucccccccggccuccucaccgucuccggcuccgccgccgccgccgacgccgucccccuccgccccggcgacugggccggcgucuccaccgccgaccgcggcgagcgcgccccccucggccccgccuucugcgaccucgccgucucccccaccucccccgccuggcgcggcgaggaggacgagggcgccaaggccuccuccggcgacaucggcucccucgacuaccaggaguucgucgucgacaucgagucccgccuccgcauggagggcgucgagcucaaggaggaguggcaggacgaggacuuccccaucccccuccccgaggacgacuccaucgaggccgacauccucgccaucaccggccccgaggaccagcccggcucccucgaggucaacggcaacaagguccgcaagaagcucauggcccccgacaucucccucacccucgaccccuccgacggcuccguccucuccgacgaccucgacgaguccggcgagaucgaccucgacggccucgacacccccuccgagaacuccaacgaguucgagugggaggacgaccuccccaagcccaagaccaccgaggucauccgcaagggcuccaucaccgaguacaccgccgccgaggagaaggaggacggccgccgcuggcgcauguuccgcaucggcgagcaggaccaccgcgucgacaugaaggccaucgagcccuacaagaaggucaucucccacggcggcuacuacggcgacggccucaacgccaucgucgucuucgccgucugcuucaugcccgaguccucccagcccaacuaccgcuaccucauggacaaccucuucaaguacgucaucggcacccucgagcuccucgucgccgagaacuacaugaucgucuaccucaacggcgccaccacccgccgcaagaugcccucccucggcuggcuccgcaagugcuaccagcagaucgaccgccgccuccgcaagaaccucaagucccucaucaucguccaccccuccugguucauccgcacccuccucgccgucacccgccccuucaucuccuccaaguucucccagaagauccgcuacgucuucaaccucgccgagcucgccgagcucguccccauggaguacgucggcauccccgagugcaucaagcaggucgaccaggagcucaacggcaagcaggacgagcccaagaacgagcaguga

SEQ ID NO: 40374 - RNA, 780 nt, Artificial Sequence
  derived and/or modified sequence opt2 from BNIP3__Homo_sapiens__NP_004043
augggcgacgccgccgccgacccccccggccccgcccuccccugcgaguuccuccgccccggcugcggcgccccccucucccccggcgcccagcucggccgcggcgcccccaccuccgccuuccccccccccgccgccgaggcccaccccgccgcccgccgcggccuccgcuccccccagcuccccuccggcgccaugucccagaacggcgcccccggcaugcaggaggagucccuccagggcuccugggucgagcuccacuucuccaacaacggcaacggcggcuccguccccgccuccgucuccaucuacaacggcgacauggagaagauccuccucgacgcccagcacgaguccggccgcuccuccuccaaguccucccacugcgacucccccccccgcucccagaccccccaggacaccaaccgcgccuccgagaccgacacccacuccaucggcgagaagaacuccucccaguccgaggaggacgacaucgagcgccgcaaggaggucgaguccauccucaagaagaacuccgacuggaucugggacugguccucccgccccgagaacaucccccccaaggaguuccucuucaagcaccccaagcgcaccgccacccucuccaugcgcaacaccuccgucaugaagaagggcggcaucuucuccgccgaguuccucaaggucuuccuccccucccuccuccucucccaccuccucgccaucggccucggcaucuacaucggccgccgccucaccaccuccaccuccaccuucuga

SEQ ID NO: 40375 - RNA, 660 nt, Artificial Sequence
  derived and/or modified sequence opt2 from BNIP3L__Homo_sapiens__NP_004322
auguccucccaccucgucgagcccccccccccccuccacaacaacaacaacaacugcgaggagaacgagcagucccuccccccccccgccggccucaacuccuccugggucgagcuccccaugaacuccuccaacggcaacgacaacggcaacggcaagaacggcggccucgagcacguccccuccuccuccuccauccacaacggcgacauggagaagauccuccucgacgcccagcacgaguccggccaguccuccucccgcggcuccucccacugcgacucccccuccccccaggaggacggccagaucauguucgacgucgagaugcacaccucccgcgaccacuccucccaguccgaggaggaggucgucgagggcgagaaggaggucgaggcccucaagaaguccgccgacugggucuccgacugguccucccgccccgagaacaucccccccaaggaguuccacuuccgccaccccaagcgcuccgucucccucuccaugcgcaaguccggcgccaugaagaagggcggcaucuucuccgccgaguuccucaaggucuucauccccucccucuuccucucccacguccucgcccucggccucggcaucuacaucggcaagcgccucuccacccccuccgccuccaccuacuga

SEQ ID NO: 40376 - RNA, 1032 nt, Artificial Sequence
  derived and/or modified sequence opt2 from BNIPL__Homo_sapiens__XP_011507538
augggcaccauccaggaggccggcaagaagaccgacgucggcguccgcgagaucgccgaggcccccgagcucggcgccgcccuccgccacggcgagcucgagcucaaggaggaguggcaggacgaggaguucccccgccuccuccccgaggaggccggcaccuccgaggaccccgaggaccccaagggcgacucccaggccgccgccggcacccccuccacccucgcccucugcggccagcgccccaugcgcaagcgccucuccgcccccgagcuccgccucucccucaccaagggccccggcaacgacggcgccucccccacccaguccgcccccuccucccccgacggcuccuccgaccucgagaucgacgagcucgagacccccuccgacuccgagcagcucgacuccggccacgaguucgagugggaggacgagcucccccgcgccgagggccucggcaccuccgagaccgccgagcgccucggccgcggcugcaugugggacgucaccggcgaggacggccaccacuggcgcgucuuccgcaugggcccccgcgagcagcgcgucgacaugaccgucaucgagcccuacaagaagguccucucccacggcggcuaccacggcgacggccucaacgccgucauccucuucgccuccugcuaccucccccgcuccuccauccccaacuacaccuacgucauggagcaccucuuccgcuacauggucggcacccucgagcuccucgucgccgagaacuaccuccucguccaccucuccggcggcaccucccgcgcccagguccccccccucuccuggauccgccagugcuaccgcacccucgaccgccgccuccgcaagaaccuccgcgcccucgucgucguccacgccaccugcuccaaguucacccgcaagauccgcuuccucgacucccucggcgagcucgcccagcucaucucccucgaccagguccacauccccgaggccguccgccagcucgaccgcgaccuccacggcuccggcggcaccuga

SEQ ID NO: 40377 - RNA, 3348 nt, Artificial Sequence
  derived and/or modified sequence opt2 from BOC__Homo_sapiens__NP_001288790
augcuccgcggcaccaugaccgccuggcgcggcaugcgccccgaggucacccucgccugccuccuccucgccaccgccggcugcuucgccgaccucaacgaggucccccaggucaccguccagcccgccuccaccguccagaagcccggcggcaccgucauccucggcugcgucgucgagcccccccgcaugaacgucaccuggcgccucaacggcaaggagcucaacggcuccgacgacgcccucggcguccucaucacccacggcacccucgucaucaccgcccucaacaaccacaccgucggccgcuaccagugcgucgcccgcaugcccgccggcgccgucgccuccguccccgccaccgucacccucgccaaccuccaggacuucaagcucgacguccagcacgucaucgaggucgacgagggcaacaccgccgucaucgccugccaccuccccgagucccaccccaaggcccagguccgcuacuccgucaagcaggaguggcucgaggccucccgcggcaacuaccucaucaugcccuccggcaaccuccagaucgucaacgccucccaggaggacgagggcauguacaagugcgccgccuacaaccccgucacccaggaggucaagaccuccggcuccuccgaccgccuccgcguccgccgcuccaccgccgaggccgcccgcaucaucuacccccccgaggcccagaccaucaucgucaccaagggccagucccucauccucgagugcgucgccuccggcaucccccccccccgcgucaccugggccaaggacggcuccuccgucaccggcuacaacaagacccgcuuccuccucuccaaccuccucaucgacaccaccuccgaggaggacuccggcaccuaccgcugcauggccgacaacggcgucggccagcccggcgccgccgucauccucuacaacguccaggucuucgagccccccgaggucaccauggagcucucccagcucgucauccccuggggccaguccgccaagcucaccugcgagguccgcggcaaccccccccccuccguccucuggcuccgcaacgccgucccccucaucuccucccagcgccuccgccucucccgccgcgcccuccgcguccucuccaugggccccgaggacgagggcgucuaccagugcauggccgagaacgaggucggcuccgcccacgccgucguccagcuccgcaccucccgccccuccaucaccccccgccucuggcaggacgccgagcucgccaccggcaccccccccgucucccccuccaagcucggcaaccccgagcagaugcuccgcggccagcccgcccucccccgcccccccaccuccgucggccccgccuccccccagugccccggcgagaagggccagggcgcccccgccgaggcccccaucauccucuccuccccccgcaccuccaagaccgacuccuacgagcucgucuggcgcccccgccacgagggcuccggccgcgcccccauccucuacuacgucgucaagcaccgcaagcaggucaccaacuccuccgacgacuggaccaucuccggcauccccgccaaccagcaccgccucacccucacccgccucgaccccggcucccucuacgaggucgagauggccgccuacaacugcgccggcgagggccagaccgccauggucaccuuccgcaccggccgccgccccaagcccgagaucauggccuccaaggagcagcagauccagcgcgacgaccccggcgccuccccccaguccuccucccagcccgaccacggccgccucuccccccccgaggcccccgaccgccccaccaucuccaccgccuccgagaccuccgucuacgucaccuggaucccccgcggcaacggcggcuuccccauccaguccuuccgcgucgaguacaagaagcucaagaaggucggcgacuggauccucgccaccuccgccaucccccccucccgccucuccgucgagaucaccggccucgagaagggcaccuccuacaaguuccgcguccgcgcccucaacaugcucggcgaguccgagcccuccgcccccucccgccccuacgucgucuccggcuacuccggccgcgucuacgagcgccccgucgccggccccuacaucaccuucaccgacgccgucaacgagaccaccaucaugcucaaguggauguacauccccgccuccaacaacaacacccccauccacggcuucuacaucuacuaccgccccaccgacuccgacaacgacuccgacuacaagaaggacauggucgagggcgacaaguacuggcacuccaucucccaccuccagcccgagaccuccuacgacaucaagaugcagugcuucaacgagggcggcgaguccgaguucuccaacgucaugaucugcgagaccaaggcccgcaaguccuccggccagcccggccgccuccccccccccacccucgcccccccccagcccccccuccccgagaccaucgagcgccccgucggcaccggcgccauggucgcccgcuccuccgaccuccccuaccucaucgucggcgucguccucggcuccaucguccucaucaucgucaccuucauccccuucugccucuggcgcgccugguccaagcagaagcacaccaccgaccucggcuucccccgcuccgcccucccccccuccugccccuacaccauggucccccucggcggccuccccggccaccaggccuccggccagcccuaccucuccggcaucuccggccgcgccugcgccaacggcauccacaugaaccgcggcugccccuccgccgccgucggcuaccccggcaugaagccccagcagcacugccccggcgagcuccagcagcaguccgacaccuccucccuccuccgccagacccaccucggcaacggcuacgacccccagucccaccagaucacccgcggccccaaguccucccccgacgagggcuccuuccucuacacccuccccgacgacuccacccaccagcuccuccagccccaccacgacugcugccagcgccaggagcagcccgccgccgucggccaguccggcguccgccgcgcccccgacucccccguccucgaggccgucugggacccccccuuccacuccggcccccccugcugccucggccucguccccgucgaggaggucgacucccccgacuccugccaggucuccggcggcgacuggugcccccagcaccccgucggcgccuacgucggccaggagcccggcaugcagcucucccccggcccccucguccgcgucuccuucgagacccccccccucaccaucuga

SEQ ID NO: 40378 - RNA, 519 nt, Artificial Sequence
  derived and/or modified sequence opt2 from BOD1L2__Homo_sapiens__NP_001244893
auggccgacggcggcggcggcggcuccggcggcgccggccccgccuccacccgcgccuccggcggcggcggccccaucaaccccgccucccucccccccggcgacccccagcucaucgccaucaucgucggccagcucaagucccgcggccucuucgacuccuuccgccgcgacugcaaggccgacgucgacaccaagcccgccuaccagaaccucucccagaaggccgacaacuucgucuccacccaccucgacaagcaggaguggaacccccccgccaacgacaaccagcuccacgacggccuccgccaguccgucguccaguccggccgcuccgaggccggcgucgaccgcaucuccucccaggucgucgaccccaagcucaaccacaucuuccgcccccagaucgagcagaucauccacgaguuccucgucgcccagaaggaggccgccguccccgcccucccccccgagcccgagggccaggacccccccgcccccucccaggacaccuccuga

SEQ ID NO: 40379 - RNA, 639 nt, Artificial Sequence
  derived and/or modified sequence opt2 from BOK__Homo_sapiens__NP_115904
auggagguccuccgccgcuccuccgucuucgccgccgagaucauggacgccuucgaccgcucccccaccgacaaggagcucgucgcccaggccaaggcccucggccgcgaguacguccacgcccgccuccuccgcgccggccucuccugguccgcccccgagcgcgccgcccccguccccggccgccucgccgaggucugcgccguccuccuccgccucggcgacgagcucgagaugauccgccccuccgucuaccgcaacgucgcccgccagcuccacaucucccuccaguccgagcccgucgucaccgacgccuuccucgccgucgccggccacaucuucuccgccggcaucaccuggggcaaggucgucucccucuacgccgucgccgccggccucgccgucgacugcguccgccaggcccagcccgccaugguccacgcccucgucgacugccucggcgaguucguccgcaagacccucgccaccuggcuccgccgccgcggcggcuggaccgacguccucaagugcgucgucuccaccgaccccggccuccgcucccacuggcucgucgccgcccucugcuccuucggccgcuuccucaaggccgccuucuucguccuccuccccgagcgcuga

SEQ ID NO: 40380 - RNA, 306 nt, Artificial Sequence
  derived and/or modified sequence opt2 from BOLA3__Homo_sapiens__NP_001030582
auggccgccuggucccccgccgccgccgccccccuccuccgcggcauccgcggccucccccuccaccaccgcauguucgccacccagaccgagggcgagcuccgcgucacccagauccucaaggagaaguucccccgcgccaccgccaucaaggucaccgacaucuccggcaccaagcgccgcaaccagcgcgacgccuggaucgccgacaucuaccucugcccccagacccucaccacccccuggcuccaccgcugcugcugccuccgccccuggaugaacuucaccgacaucauccuccccuga

SEQ ID NO: 40381 - RNA, 525 nt, Artificial Sequence
  derived and/or modified sequence opt2 from BOLL__Homo_sapiens__NP_001271287
augaccgagcucgaguaccccaagggcuccuccaucaugcccgccgccggcaccauguaccucaccaccuccaccggcuaccccuacaccuaccacaacggcgucgccuacuuccacacccccgaggucaccuccguccccccccccuggcccucccgcuccgucugcuccucccccgucauggucgcccagcccaucuaccagcagcccgccuaccacuaccaggccaccacccaguaccuccccggccaguggcagugguccgucccccagcccuccgccuccuccgcccccuuccucuaccuccagcccuccgaggucaucuaccagcccgucgagaucgcccaggacggcggcugcgucccccccccccucucccucauggagaccuccguccccgagcccuacuccgaccacggcguccaggccaccuaccaccaggucuacgcccccuccgccaucaccaugcccgcccccgucaugcagcccgagcccaucaagaccgucugguccauccacuacuga

SEQ ID NO: 40382 - RNA, 2241 nt, Artificial Sequence
  derived and/or modified sequence opt2 from BOP1__Homo_sapiens__NP_056016
auggccggcucccgcggcgccggccgcaccgccgcccccuccguccgccccgagaagcgccgcuccgagcccgagcucgagcccgagcccgagcccgagcccccccuccucugcaccuccccccucucccacuccaccggcuccgacuccggcgucuccgacuccgaggaguccgucuucuccggccucgaggacuccggcuccgacuccuccgaggacgacgacgagggcgacgaggagggcgaggacggcgcccucgacgacgagggccacuccggcaucaagaagaccaccgaggagcagguccaggccuccacccccugcccccgcaccgagauggccuccgcccgcaucggcgacgaguacgccgaggacuccuccgacgaggaggacauccgcaacaccgucggcaacgucccccucgagugguacgacgacuucccccacgucggcuacgaccucgacggccgccgcaucuacaagccccuccgcacccgcgacgagcucgaccaguuccucgacaagauggacgaccccgacuacuggcgcaccguccaggaccccaugaccggccgcgaccuccgccucaccgacgagcaggucgcccucguccgccgccuccaguccggccaguucggcgacgucggcuucaaccccuacgagcccgccgucgacuucuucuccggcgacgucaugauccaccccgucaccaaccgccccgccgacaagcgcuccuucauccccucccucgucgagaaggagaaggucucccgcaugguccacgccaucaagaugggcuggauccagccccgccgcccccgcgaccccacccccuccuucuacgaccucugggcccaggaggaccccaacgccguccucggccgccacaagaugcacguccccgcccccaagcucgcccuccccggccacgccgaguccuacaaccccccccccgaguaccuccucuccgaggaggagcgccucgccugggagcagcaggagcccggcgagcgcaagcucuccuuccucccccgcaaguuccccucccuccgcgccguccccgccuacggccgcuucauccaggagcgcuucgagcgcugccucgaccucuaccucugcccccgccagcgcaagaugcgcgucaacgucgaccccgaggaccucauccccaagcucccccgcccccgcgaccuccagcccuuccccaccugccaggcccucgucuaccgcggccacuccgaccucguccgcugccucuccgucucccccggcggccaguggcucgucuccggcuccgacgacggcucccuccgccucugggaggucgccaccgcccgcugcguccgcaccguccccgucggcggcgucgucaaguccgucgccuggaaccccucccccgccgucugccucgucgccgccgccgucgaggacuccguccuccuccucaaccccgcccucggcgaccgccucgucgccggcuccaccgaccagcuccucuccgccuucgucccccccgaggagcccccccuccagcccgcccgcuggcucgaggccuccgaggaggagcgccaggucggccuccgccuccgcaucugccacggcaagcccgucacccaggucaccuggcacggccgcggcgacuaccucgccgucguccucgccacccagggccacacccagguccucauccaccagcucucccgccgccgcucccagucccccuuccgccgcucccacggccagguccagcgcgucgccuuccaccccgcccgccccuuccuccucgucgccucccagcgcuccguccgccucuaccaccuccuccgccaggagcucaccaagaagcucaugcccaacugcaagugggucuccucccucgccguccaccccgccggcgacaacgucaucugcggcuccuacgacuccaagcucgucugguucgaccucgaccucuccaccaagcccuaccgcaugcuccgccaccacaagaaggcccuccgcgccgucgccuuccacccccgcuacccccucuucgccuccggcuccgacgacggcuccgucaucgucugccacggcauggucuacaacgaccuccuccagaacccccuccucguccccgucaagguccucaagggccacguccucacccgcgaccucggcguccucgacgucaucuuccaccccacccagcccugggucuucuccuccggcgccgacggcaccguccgccucuucaccuga

SEQ ID NO: 40383 - RNA, 1905 nt, Artificial Sequence
  derived and/or modified sequence opt2 from BORA__Homo_sapiens__NP_001273675
auggagcgcuuccucuuccccgcccccgaccuccccgcccgcuccccccucgucaacggcuccucccagggcgucggcgucgaggagcgcggcacccgcaaguccggccacgucggccucggcgccaccccccccucccacuccauccagggcucccgccuccaccucaaccuccccgaggucgacuccuuccccccccaccccgccaaguucucccucugcgccaugggcgacgucaaggaguccaagaugcagaucacccccgagacccccggccgcauccccguccucaaccccuucgagucccccuccgacuacuccaaccuccacgagcagacccucgccucccccuccgucuucaaguccaccaagcuccccacccccggcaaguuccgcugguccaucgaccagcucgccgucaucaaccccgucgagaucgaccccgaggacauccaccgccaggcccucuaccucucccacucccgcaucgacaaggacgucgaggacaagcgccagaaggccaucgaggaguucuucaccaaggacgucaucguccccucccccuggaccgaccacgagggcaagcagcucucccagugccacuccuccaagugcaccaacaucaacuccgacucccccgucggcaagaagcucaccauccacuccgagaaguccgacgccgccugccagacccuccucucccuccccgucgacuucaaccucgagaacauccucggcgacuacuuccgcgccgacgaguucgccgaccagucccccggcaaccucuccuccuccucccuccgccgcaagcucuuccucgacggcaacggcuccaucuccgacucccuccccuccgccucccccggcuccccccacuccggcguccagaccucccucgagauguucuacuccaucgaccucucccccgucaagugccgcuccccccuccagacccccuccuccggccaguucuccuccucccccauccaggccuccgccaagaaguacucccucggcuccaucaccucccccucccccaucuccucccccaccuucucccccaucgaguuccagaucggcgagaccccccucuccgagcagcgcaaguucaccguccacucccccgacgccuccuccggcaccaacuccaacggcaucaccaaccccugcauccgcucccccuacaucgacggcugcucccccaucaagaacuggucccccaugcgccuccagauguacuccggcggcacccaguaccgcaccuccgucauccagauccccuucacccucgagacccagggcgaggacgaggaggacaaggagaacauccccuccaccgacgucuccucccccgccauggacgccgccggcauccaccuccgccaguucuccaacgaggccuccacccacggcacccaccucgucgucaccgccauguccgucacccagaaccaguccuccgccuccgagaaggagcucgcccuccuccaggacgucgagcgcgagaaggacaacaacaccgucgacauggucgaccccaucgagaucgccgacgagaccaccuggaucaaggagcccgucgacaacggcucccuccccaugaccgacuucgucuccggcaucgccuucuccaucgagaacucccacaugugcauguccccccucgccgaguccuccgucauccccugcgaguccuccaacauccagauggacuccggcuacaacacccagaacugcggcuccaacaucauggacaccgucggcgccgaguccuacugcaaggaguccgacgcccagaccugcgaggucgaguccaagucccaggccuucaacaugaagcaggaccacaccacccagcgcugcuggaugaagaccgccucccccuuccagugcuccucccccuga

SEQ ID NO: 40384 - RNA, 780 nt, Artificial Sequence
  derived and/or modified sequence opt2 from BPGM__Homo_sapiens__NP_001280014
auguccaaguacaagcucaucaugcuccgccacggcgagggcgccuggaacaaggagaaccgcuucugcuccugggucgaccagaagcucaacuccgagggcauggaggaggcccgcaacugcggcaagcagcucaaggcccucaacuucgaguucgaccucgucuucaccuccguccucaaccgcuccauccacaccgccuggcucauccucgaggagcucggccaggaguggguccccgucgaguccuccuggcgccucaacgagcgccacuacggcgcccucaucggccucaaccgcgagcagauggcccucaaccacggcgaggagcagguccgccucuggcgccgcuccuacaacgucacccccccccccaucgaggagucccaccccuacuaccaggagaucuacaacgaccgccgcuacaaggucugcgacgucccccucgaccagcucccccgcuccgagucccucaaggacguccucgagcgccuccuccccuacuggaacgagcgcaucgcccccgagguccuccgcggcaagaccauccucaucuccgcccacggcaacuccucccgcgcccuccucaagcaccucgagggcaucuccgacgaggacaucaucaacaucacccuccccaccggcguccccauccuccucgagcucgacgagaaccuccgcgccgucggcccccaccaguuccucggcgaccaggaggccauccaggccgccaucaagaaggucgaggaccagggcaaggucaagcaggccaagaaguga

SEQ ID NO: 40385 - RNA, 771 nt, Artificial Sequence
  derived and/or modified sequence opt2 from BPIFA1__Homo_sapiens__NP_057667
auguuccagaccggcggccucaucgucuucuacggccuccucgcccagaccauggcccaguucggcggccuccccgucccccucgaccagacccucccccucaacgucaaccccgcccucccccucucccccaccggccucgccggcucccucaccaacgcccucuccaacggccuccucuccggcggccuccucggcauccucgagaaccucccccuccucgacauccucaagcccggcggcggcaccuccggcggccuccucggcggccuccucggcaaggucaccuccgucauccccggccucaacaacaucaucgacaucaaggucaccgacccccagcuccucgagcucggccucguccagucccccgacggccaccgccucuacgucaccaucccccucggcaucaagcuccaggucaacaccccccucgucggcgccucccuccuccgccucgccgucaagcucgacaucaccgccgagauccucgccguccgcgacaagcaggagcgcauccaccucguccucggcgacugcacccacucccccggcucccuccagaucucccuccucgacggccucggcccccuccccauccagggccuccucgacucccucaccggcauccucaacaagguccuccccgagcucguccagggcaacgucugcccccucgucaacgagguccuccgcggccucgacaucacccucguccacgacaucgucaacaugcucauccacggccuccaguucgucaucaaggucuga

SEQ ID NO: 40386 - RNA, 750 nt, Artificial Sequence
  derived and/or modified sequence opt2 from BPIFA2__Homo_sapiens__NP_542141
augcuccagcucuggaagcucguccuccucugcggcguccucaccggcaccuccgagucccuccucgacaaccucggcaacgaccucuccaacgucgucgacaagcucgagcccguccuccacgagggccucgagaccgucgacaacacccucaagggcauccucgagaagcucaaggucgaccucggcguccuccagaaguccuccgccuggcagcucgccaagcagaaggcccaggaggccgagaagcuccucaacaacgucaucuccaagcuccuccccaccaacaccgacaucuucggccucaagaucuccaacucccucauccucgacgucaaggccgagcccaucgacgacggcaagggccucaaccucuccuuccccgucaccgccaacgucaccgucgccggccccaucaucggccagaucaucaaccucaaggccucccucgaccuccucaccgccgucaccaucgagaccgacccccagacccaccagcccgucgccguccucggcgagugcgccuccgaccccaccuccaucucccucucccuccucgacaagcacucccagaucaucaacaaguucgucaacuccgucaucaacacccucaaguccaccgucuccucccuccuccagaaggagaucugcccccucauccgcaucuucauccacucccucgacgucaacgucauccagcaggucgucgacaacccccagcacaagacccagcuccagacccucaucuga

SEQ ID NO: 40387 - RNA, 657 nt, Artificial Sequence
  derived and/or modified sequence opt2 from BPIFA3__Homo_sapiens__NP_001035904
augaugugcccccucuggcgccuccucaucuuccucggccuccucgcccucccccucgccccccacaagcagcccuggcccggccucgcccaggcccaccgcgacaacaaguccacccucgcccgcaucaucgcccagggccucaucaagcacaacgccgagucccgcauccagaacauccacuucggcgaccgccucaacgccuccgcccaggucgcccccggccucgucggcuggcucaucuccggccgcaagcaccagcagcagcaggagucccgcuccuucgacaacaacaucgucaagaugugcgcccacauguccaucgucgucgaguucuggcucgagaaggacgaguucggccgccgcgaccucgucaucggcaagugcgacgccgagcccuccuccguccacgucgccauccucaccgaggccaucccccccaagaugaaccaguuccucuacaaccucaaggagaaccuccagaagguccucccccacauggucgagucccaggucugcccccucaucggcgagauccucggccagcucgacgucaagcuccucaagucccucaucgagcaggaggccgcccacgagcccacccaccacgagaccucccagcccuccgccugccaggccggcgagucccccuccuga

SEQ ID NO: 40388 - RNA, 1455 nt, Artificial Sequence
  derived and/or modified sequence opt2 from BPIFB1__Homo_sapiens__NP_149974
auggccggccccuggaccuucacccuccucugcggccuccucgccgccacccucauccaggccacccucucccccaccgccguccucauccucggccccaaggucaucaaggagaagcucacccaggagcucaaggaccacaacgccaccuccauccuccagcagcucccccuccucuccgccaugcgcgagaagcccgccggcggcauccccguccucggcucccucgucaacaccguccucaagcacaucaucuggcucaaggucaucaccgccaacauccuccagcuccaggucaagcccuccgccaacgaccaggagcuccucgucaagaucccccucgacauggucgccggcuucaacaccccccucgucaagaccaucgucgaguuccacaugaccaccgaggcccaggccaccauccgcauggacaccuccgccuccggccccacccgccucguccucuccgacugcgccaccucccacggcucccuccgcauccagcuccuccacaagcucuccuuccucgucaacgcccucgccaagcaggucaugaaccuccucguccccucccuccccaaccucgucaagaaccagcucugccccgucaucgaggccuccuucaacggcauguacgccgaccuccuccagcucgucaagguccccaucucccucuccaucgaccgccucgaguucgaccuccucuaccccgccaucaagggcgacaccauccagcucuaccucggcgccaagcuccucgacucccagggcaaggucaccaagugguucaacaacuccgccgccucccucaccaugcccacccucgacaacauccccuucucccucaucgucucccaggacgucgucaaggccgccgucgccgccguccucucccccgaggaguucaugguccuccucgacuccguccuccccgaguccgcccaccgccucaaguccuccaucggccucaucaacgagaaggccgccgacaagcucggcuccacccagaucgucaagauccucacccaggacacccccgaguucuucaucgaccagggccacgccaaggucgcccagcucaucguccucgaggucuuccccuccuccgaggcccuccgcccccucuucacccucggcaucgaggccuccuccgaggcccaguucuacaccaagggcgaccagcucauccucaaccucaacaacaucuccuccgaccgcauccagcucaugaacuccggcaucggcugguuccagcccgacguccucaagaacaucaucaccgagaucauccacuccauccuccuccccaaccagaacggcaagcuccgcuccggcguccccgucucccucgucaaggcccucggcuucgaggccgccgaguccucccucaccaaggacgcccucguccucacccccgccucccucuggaagcccuccucccccgucucccaguga

SEQ ID NO: 40389 - RNA, 1377 nt, Artificial Sequence
  derived and/or modified sequence opt2 from BPIFB2__Homo_sapiens__NP_079503
auggccugggccucccgccucggccuccuccucgcccuccuccuccccgucgucggcgccuccacccccggcaccgucguccgccucaacaaggccgcccucuccuacgucuccgagaucggcaaggccccccuccagcgcgcccuccaggucaccgucccccacuuccucgacugguccggcgaggcccuccagcccacccgcauccgcauccucaacguccacgucccccgccuccaccucaaguucaucgccggcuucggcguccgccuccucgccgccgccaacuucaccuucaaggucuuccgcgcccccgagccccucgagcucacccuccccgucgagcuccucgccgacacccgcgucacccaguccuccauccgcacccccgucgucuccaucuccgccugcucccucuucuccggccacgccaacgaguucgacggcuccaacuccaccucccacgcccuccucguccucguccagaagcacaucaaggccguccucuccaacaagcucugccucuccaucuccaaccucguccagggcgucaacguccaccucggcacccucaucggccucaaccccgucggccccgagucccagauccgcuacuccauggucuccguccccaccgucaccuccgacuacaucucccucgaggucaacgccguccucuuccuccucggcaagcccaucauccuccccaccgacgccacccccuucguccucccccgccacgucggcaccgagggcuccauggccaccgucggccucucccagcagcucuucgacuccgcccuccuccuccuccagaaggccggcgcccucaaccucgacaucaccggccagcuccgcuccgacgacaaccuccucaacaccuccgcccucggccgccucauccccgaggucgcccgccaguuccccgagcccaugcccgucguccucaagguccgccucggcgccacccccgucgccaugcuccacaccaacaacgccacccuccgccuccagcccuucgucgagguccucgccaccgccuccaacuccgccuuccagucccucuucucccucgacgucgucgucaaccuccgccuccagcucuccgucuccaaggucaagcuccagggcaccaccuccguccucggcgacguccagcucaccgucgccuccuccaacgucggcuucaucgacaccgaccagguccgcacccucaugggcaccgucuucgagaagccccuccucgaccaccucaacgcccuccucgccaugggcaucgcccuccccggcgucgucaaccuccacuacgucgcccccgagaucuucgucuacgagggcuacgucgucaucuccuccggccucuucuaccaguccuga

SEQ ID NO: 40390 - RNA, 1524 nt, Artificial Sequence
  derived and/or modified sequence opt2 from BPIFC__Homo_sapiens__NP_777592
augugcaccaagaccauccccguccucuggggcugcuuccuccucuggaaccucuacgucuccuccucccagaccaucuaccccggcaucaaggcccgcaucacccagcgcgcccucgacuacggcguccaggccggcaugaagaugaucgagcagaugcucaaggagaagaagcuccccgaccucuccggcuccgagucccucgaguuccucaaggucgacuacgucaacuacaacuucuccaacaucaagaucuccgccuucuccuuccccaacaccucccucgccuucguccccggcgucggcaucaaggcccucaccaaccacggcaccgccaacaucuccaccgacuggggcuucgaguccccccucuuccaggacaccggcggcgccgaccucuuccucuccggcgucuacuucaccggcaucaucauccucacccgcaacgacuucggccaccccacccucaagcuccaggacugcuacgcccagcucucccacgcccacgucuccuucuccggcgagcucuccguccucuacaacuccuucgccgagcccauggagaagcccauccucaagaaccucaacgagaugcucugccccaucaucgccuccgaggucaaggcccucaacgccaaccucuccacccucgagguccucaccaagaucgacaacuacacccuccucgacuacucccucaucuccucccccgagaucaccgagaacuaccucgaccucaaccucaagggcgucuucuacccccucgagaaccucaccgacccccccuucucccccguccccuucguccuccccgagcgcuccaacuccaugcucuacaucggcaucgccgaguacuucuucaaguccgccuccuucgcccacuucaccgccggcgucuucaacgucacccucuccaccgaggagaucuccaaccacuucguccagaacucccagggccucggcaacguccucucccgcaucgccgagaucuacauccucucccagcccuucaugguccgcaucauggccaccgagccccccaucaucaaccuccagcccggcaacuucacccucgacauccccgccuccaucaugaugcucacccagcccaagaacuccaccgucgagaccaucgucuccauggacuucgucgccuccaccuccgucggccucgucauccucggccagcgccucgucugcucccucucccucaaccgcuuccgccucgcccuccccgaguccaaccgcuccaacaucgagguccuccgcuucgagaacauccucuccuccauccuccacuucggcguccucccccucgccaacgccaagcuccagcagggcuucccccucuccaacccccacaaguuccucuucgucaacuccgacaucgagguccucgagggcuuccuccucaucuccaccgaccucaaguacgagaccuccuccaagcagcagcccuccuuccacgucugggagggccucaaccucaucucccgccaguggcgcggcaaguccgcccccuga

SEQ ID NO: 40391 - RNA, 1464 nt, Artificial Sequence
  derived and/or modified sequence opt2 from BPI__Homo_sapiens__NP_001716
augcgcgagaacauggcccgcggccccugcaacgccccccgcugggccucccucaugguccucgucgccaucggcaccgccgucaccgccgccgucaaccccggcgucgucguccgcaucucccagaagggccucgacuacgccucccagcagggcaccgccgcccuccagaaggagcucaagcgcaucaagauccccgacuacuccgacuccuucaagaucaagcaccucggcaagggccacuacuccuucuacuccauggacauccgcgaguuccagcuccccuccucccagaucuccaugguccccaacgucggccucaaguucuccaucuccaacgccaacaucaagaucuccggcaaguggaaggcccagaagcgcuuccucaagauguccggcaacuucgaccucuccaucgagggcauguccaucuccgccgaccucaagcucggcuccaaccccaccuccggcaagcccaccaucaccugcuccuccugcuccucccacaucaacuccguccacguccacaucuccaaguccaaggucggcuggcucauccagcucuuccacaagaagaucgaguccgcccuccgcaacaagaugaacucccaggucugcgagaaggucaccaacuccgucuccuccgagcuccagcccuacuuccagacccuccccgucaugaccaagaucgacuccgucgccggcaucaacuacggccucgucgccccccccgccaccaccgccgagacccucgacguccagaugaagggcgaguucuacuccgagaaccaccacaaccccccccccuucgccccccccgucauggaguuccccgccgcccacgaccgcauggucuaccucggccucuccgacuacuucuucaacaccgccggccucgucuaccaggaggccggcguccucaagaugacccuccgcgacgacaugauccccaaggaguccaaguuccgccucaccaccaaguucuucggcaccuuccuccccgaggucgccaagaaguuccccaacaugaagauccagauccacgucuccgccuccacccccccccaccucuccguccagcccaccggccucaccuucuaccccgccgucgacguccaggccuucgccguccuccccaacuccucccucgccucccucuuccucaucggcaugcacaccaccggcuccauggaggucuccgccgaguccaaccgccucgucggcgagcucaagcucgaccgccuccuccucgagcucaagcacuccaacaucggccccuuccccgucgagcuccuccaggacaucaugaacuacaucguccccauccucguccucccccgcgucaacgagaagcuccagaagggcuucccccuccccacccccgcccgcguccagcucuacaacgucguccuccagccccaccagaacuuccuccucuucggcgccgacgucgucuacaaguga

SEQ ID NO: 40392 - RNA, 762 nt, Artificial Sequence
  derived and/or modified sequence opt2 from BPNT1__Homo_sapiens__NP_001273078
auguccaucugcuccucccucgcccgcaaguuccccaagcucaccaucaucggcgaggaggaccuccccuccgaggaggucgaccaggagcucaucgaggacucccagugggaggagauccucaagcagcccugccccucccaguacuccgccaucaaggaggaggaccucgucgucugggucgacccccucgacggcaccaaggaguacaccgagggccuccucgacaacgucaccguccucaucggcaucgccuacgagggcaaggccaucgccggcgucaucaaccagcccuacuacaacuacgaggccggccccgacgccguccucggccgcaccaucuggggcguccucggccucggcgccuucggcuuccagcucaaggagguccccgccggcaagcacaucaucaccaccacccgcucccacuccaacaagcucgucaccgacugcgucgccgccaugaaccccgacgccguccuccgcgucggcggcgccggcaacaagaucauccagcucaucgagggcaaggccuccgccuacgucuucgccucccccggcugcaagaagugggacaccugcgcccccgaggucauccuccacgccgucggcggcaagcucaccgacauccacggcaacguccuccaguaccacaaggacgucaagcacaugaacuccgccggcguccucgccacccuccgcaacuacgacuacuacgccucccgcguccccgaguccaucaagaacgcccucguccccuga

SEQ ID NO: 40393 - RNA, 8712 nt, Artificial Sequence
  derived and/or modified sequence opt2 from BPTF__Homo_sapiens__NP_004450
augcgcggccgccgcggccgcccccccaagcagcccgccgcccccgccgccgagcgcugcgcccccgccccccccccccccccccccccccccaccuccggccccaucggcggccuccgcucccgccaccgcggcuccucccgcggccgcugggccgccgcccaggccgaggucgcccccaagacccgccucuccuccccccgcggcggcuccuccucccgccgcaagccccccccccccccccccgccccccccuccaccuccgcccccggccgcggcggccgcggcggcggcggcggccgcaccggcggcggcggcggcggcggccaccucgcccgcaccaccgccgcccgccgcgccgucaacaaggucgucuacgacgaccacgaguccgaggaggaggaggaggaggaggacauggucuccgaggaggaggaggaggaggacggcgacgccgaggagacccaggacuccgaggacgacgaggaggacgagauggaggaggacgacgacgacuccgacuaccccgaggagauggaggacgacgacgacgacgccuccuacugcaccgaguccuccuuccgcucccacuccaccuacuccuccacccccggccgccgcaagccccgcguccaccgcccccgcucccccauccucgaggagaaggacauccccccccucgaguuccccaaguccuccgaggaccucaugguccccaacgagcacaucaugaacgucaucgccaucuacgagguccuccgcaacuucggcaccguccuccgccucucccccuuccgcuucgaggacuucugcgccgcccucgucucccaggagcagugcacccucauggccgagaugcacgucguccuccucaaggccguccuccgcgaggaggacaccuccaacaccaccuucggccccgccgaccucaaggacuccgucaacuccacccucuacuucaucgacggcaugaccuggcccgagguccuccgcgucuacugcgaguccgacaaggaguaccaccacguccuccccuaccaggaggccgaggacuaccccuacggccccgucgagaacaagaucaagguccuccaguuccucgucgaccaguuccucaccaccaacaucgcccgcgaggagcucauguccgagggcgucauccaguacgacgaccacugccgcgucugccacaagcucggcgaccuccucugcugcgagaccugcuccgccgucuaccaccucgagugcgucaagcccccccucgaggagguccccgaggacgaguggcagugcgaggucugcgucgcccacaagguccccggcgucaccgacugcgucgccgagauccagaagaacaagcccuacauccgccacgagcccaucggcuacgaccgcucccgccgcaaguacugguuccucaaccgccgccucaucaucgaggaggacaccgagaacgagaacgagaagaagaucugguacuacuccaccaagguccagcucgccgagcucaucgacugccucgacaaggacuacugggaggccgagcucugcaagauccucgaggagaugcgcgaggagauccaccgccacauggacaucaccgaggaccucaccaacaaggcccgcggcuccaacaaguccuuccucgccgccgccaacgaggagauccucgaguccauccgcgccaagaagggcgacaucgacaacgucaagucccccgaggagaccgagaaggacaagaacgagaccgagaacgacuccaaggacgccgagaagaaccgcgaggaguucgaggaccagucccucgagaaggacuccgacgacaagacccccgacgacgaccccgagcagggcaaguccgaggagcccaccgaggucggcgacaagggcaacuccgucuccgccaaccucggcgacaacaccaccaacgccaccuccgaggagaccucccccuccgagggccgcucccccgucggcugccucuccgagacccccgacuccuccaacauggccgagaagaaggucgccuccgagcucccccaggacguccccgaggagcccaacaagaccugcgaguccuccaacaccuccgccaccaccaccuccauccagcccaaccucgagaacuccaacuccuccuccgagcucaacuccucccaguccgaguccgccaaggccgccgacgaccccgagaacggcgagcgcgagucccacacccccgucuccauccaggaggagaucgucggcgacuucaaguccgagaaguccaacggcgagcucuccgagucccccggcgccggcaagggcgccuccggcuccacccgcaucaucacccgccuccgcaaccccgacuccaagcucucccagcucaagucccagcaggucgccgccgccgcccacgaggccaacaagcucuucaaggagggcaaggagguccucgucgucaacucccagggcgagaucucccgccucuccaccaagaaggaggucaucaugaagggcaacaucaacaacuacuucaagcucggccaggagggcaaguaccgcgucuaccacaaccaguacuccaccaacuccuucgcccucaacaagcaccagcaccgcgaggaccacgacaagcgccgccaccucgcccacaaguucugccucacccccgccggcgaguucaaguggaacggcuccguccacggcuccaagguccucaccaucuccacccuccgccucaccaucacccagcucgagaacaacauccccuccuccuuccuccaccccaacugggccucccaccgcgccaacuggaucaaggccguccagaugugcuccaagccccgcgaguucgcccucgcccucgccauccucgagugcgccgucaagcccgucgucaugcuccccaucuggcgcgagucccucggccacacccgccuccaccgcaugaccuccaucgagcgcgaggagaaggagaaggucaagaagaaggagaagaagcaggaggaggaggagaccaugcagcaggccaccugggucaaguacaccuuccccgucaagcaccaggucuggaagcagaagggcgaggaguaccgcgucaccggcuacggcggcugguccuggaucuccaagacccacgucuaccgcuucguccccaagcuccccggcaacaccaacgucaacuaccgcaagucccucgagggcaccaagaacaacauggacgagaacauggacgaguccgacaagcgcaagugcucccgcucccccaagaagaucaagaucgagcccgacuccgagaaggacgaggucaagggcuccgacgccgccaagggcgccgaccagaacgagauggacaucuccaagaucaccgagaagaaggaccaggacgucaaggagcuccucgacuccgacuccgacaagcccugcaaggaggagcccauggaggucgacgacgacaugaagaccgagucccacgucaacugccaggaguccucccaggucgacgucgucaacgucuccgagggcuuccaccuccgcaccuccuacaagaagaagaccaaguccuccaagcucgacggccuccucgagcgccgcaucaagcaguucacccucgaggagaagcagcgccucgagaagaucaagcucgagggcggcaucaagggcaucggcaagaccuccaccaacuccuccaagaaccucuccgagucccccgucaucaccaaggccaaggagggcugccaguccgacuccaugcgccaggagcagucccccaacgccaacaacgaccagcccgaggaccucauccagggcugcuccgaguccgacuccuccguccuccgcauguccgaccccucccacaccaccaacaagcucuaccccaaggaccgcguccucgacgacgucuccauccgcucccccgagaccaagugccccaagcagaacuccaucgagaacgacaucgaggagaaggucuccgaccucgccucccgcggccaggagcccuccaaguccaagaccaagggcaacgacuucuucaucgacgacuccaagcucgccuccgccgacgacaucggcacccucaucugcaagaacaagaagccccucauccaggaggaguccgacaccaucgucuccuccuccaaguccgcccuccacuccuccguccccaaguccaccaacgaccgcgacgccaccccccucucccgcgccauggacuucgagggcaagcucggcugcgacuccgaguccaacuccacccucgagaacuccuccgacaccgucuccauccaggacuccuccgaggaggacaugaucguccagaacuccaacgaguccaucuccgagcaguuccgcacccgcgagcaggacgucgagguccucgagccccucaagugcgagcucgucuccggcgaguccaccggcaacugcgaggaccgccuccccgucaagggcaccgaggccaacggcaagaagcccucccagcagaagaagcucgaggagcgccccgucaacaagugcuccgaccagaucaagcucaagaacaccaccgacaagaagaacaacgagaaccgcgaguccgagaagaagggccagcgcaccuccaccuuccagaucaacggcaaggacaacaagcccaagaucuaccucaagggcgagugccucaaggagaucuccgagucccgcgucgucuccggcaacgucgagcccaaggucaacaacaucaacaagaucauccccgagaacgacaucaagucccucaccgucaaggaguccgccauccgccccuucaucaacggcgacgucaucauggaggacuucaacgagcgcaacuccuccgagaccaagucccaccuccucuccuccuccgacgccgagggcaacuaccgcgacucccucgagacccuccccuccaccaaggaguccgacuccacccagaccaccacccccuccgccuccugccccgaguccaacuccgucaaccaggucgaggacauggagaucgagaccuccgaggucaagaaggucaccuccucccccaucaccuccgaggaggaguccaaccucuccaacgacuucaucgacgagaacggccuccccaucaacaagaacgagaacgucaacggcgaguccaagcgcaagaccgucaucaccgaggucaccaccaugaccuccaccgucgccaccgaguccaagaccgucaucaaggucgagaagggcgacaagcagaccgucgucuccuccaccgagaacugcgccaaguccaccgucaccaccaccaccaccaccgucaccaagcucuccacccccuccaccggcggcuccgucgacaucaucuccgucaaggagcaguccaagaccgucgucaccaccaccgucaccgacucccucaccaccaccggcggcacccucgucaccuccaugaccgucuccaaggaguacuccacccgcgacaaggucaagcucaugaaguucucccgccccaagaagacccgcuccggcaccgcccuccccuccuaccgcaaguucgucaccaaguccuccaagaaguccaucuucguccuccccaacgacgaccucaagaagcucgcccgcaagggcggcauccgcgagguccccuacuucaacuacaacgccaagcccgcccucgacaucuggcccuaccccuccccccgccccaccuucggcaucaccuggcgcuaccgccuccagaccgucaagucccucgccggcgucucccucaugcuccgccuccucugggccucccuccgcugggacgacauggccgccaaggccccccccggcggcggcaccacccgcaccgagaccuccgagaccgagaucaccaccaccgagaucaucaagcgccgcgacgucggccccuacggcauccgcuccgaguacugcauccgcaagaucaucugccccaucggcguccccgagacccccaaggagacccccaccccccagcgcaagggccuccgcuccuccgcccuccgccccaagcgccccgagacccccaagcagaccggccccgucaucaucgagaccugggucgccgaggaggagcucgagcucugggagauccgcgccuucgccgagcgcgucgagaaggagaaggcccaggccgucgagcagcaggccaagaagcgccucgagcagcagaagcccaccgucaucgccaccuccaccaccucccccaccuccuccaccaccuccaccaucucccccgcccagaaggucauggucgcccccaucuccggcuccgucaccaccggcaccaagaugguccucaccaccaaggucggcucccccgccaccgucaccuuccagcagaacaagaacuuccaccagaccuucgccaccugggucaagcagggccaguccaacuccggcgucguccagguccagcagaagguccucggcaucauccccuccuccaccggcaccucccagcagaccuucaccuccuuccagccccgcaccgccaccgucaccauccgccccaacaccuccggcuccggcggcaccaccuccaacucccaggucaucaccggcccccagauccgccccggcaugaccgucauccgcaccccccuccagcaguccacccucggcaaggccaucauccgcacccccgucaugguccagcccggcgccccccagcaggucaugacccagaucauccgcggccagcccgucuccaccgccgucuccgcccccaacaccgucuccuccacccccggccagaagucccucaccuccgccaccuccaccuccaacauccaguccuccgccucccagcccccccgcccccagcagggccaggucaagcucaccauggcccagcucacccagcucacccagggccacggcggcaaccagggccucaccgucgucauccagggccagggccagaccaccggccagcuccagcucaucccccagggcgucaccguccuccccggccccggccagcagcucaugcaggccgccaugcccaacggcaccguccagcgcuuccucuucaccccccucgccaccaccgccaccaccgccuccaccaccaccaccaccgucuccaccaccgccgccggcaccggcgagcagcgccaguccaagcucuccccccagaugcagguccaccaggacaagacccucccccccgcccaguccuccuccgucggccccgccgaggcccagccccagaccgcccagcccuccgcccagccccagccccagacccagccccagucccccgcccagcccgagguccagacccagcccgagguccagacccagaccaccgucuccucccacguccccuccgaggcccagcccacccacgcccaguccuccaagccccaggucgccgcccagucccagccccaguccaacguccagggccagucccccguccgcguccagucccccucccagacccgcauccgccccuccacccccucccagcucucccccggccagcagucccagguccagaccaccaccucccagcccauccccauccagccccacaccucccuccagauccccucccagggccagccccagucccagccccaggucgucaugaagcacaacgccgucaucgagcaccucaagcagaagaaguccaugacccccgccgagcgcgaggagaaccagcgcaugaucgucugcaaccaggucaugaaguacauccucgacaagaucgacaaggaggagaagcaggccgccaagaagcgcaagcgcgaggaguccgucgagcagaagcgcuccaagcagaacgccaccaagcucuccgcccuccucuucaagcacaaggagcagcuccgcgccgagauccucaagaagcgcgcccuccucgacaaggaccuccagaucgagguccaggaggagcucaagcgcgaccucaagaucaagaaggagaaggaccucaugcagcucgcccaggccaccgccgucgccgcccccugcccccccgucacccccgccccccccgccccccccgcccccccccccucccccccccccccccccgccguccagcacaccggccuccucuccacccccacccuccccgccgccucccagaagcgcaagcgcgaggaggagaaggacuccuccuccaaguccaagaagaagaagaugaucuccaccaccuccaaggagaccaagaaggacaccaagcucuacugcaucugcaagacccccuacgacgaguccaaguucuacaucggcugcgaccgcugccagaacugguaccacggccgcugcgucggcauccuccaguccgaggccgagcucaucgacgaguacgucugcccccagugccaguccaccgaggacgccaugaccguccucaccccccucaccgagaaggacuacgagggccucaagcgcguccuccgcucccuccaggcccacaagauggccuggcccuuccucgagcccgucgaccccaacgacgcccccgacuacuacggcgucaucaaggagcccauggaccucgccaccauggaggagcgcguccagcgccgcuacuacgagaagcucaccgaguucgucgccgacaugaccaagaucuucgacaacugccgcuacuacaaccccuccgacucccccuucuaccagugcgccgagguccucgaguccuucuucguccagaagcucaagggcuucaaggccucccgcucccacaacaacaagcuccaguccaccgccuccuga

SEQ ID NO: 40394 - RNA, 321 nt, Artificial Sequence
  derived and/or modified sequence opt2 from BPY2__Homo_sapiens__NP_004669
augaugacccucgucccccgcgcccgcacccgcgccggccaggaccacuacucccaccccugcccccgcuucucccagguccuccucaccgagggcaucaugaccuacugccucaccaagaaccucuccgacgucaacauccuccaccgccuccucaagaacggcaacguccgcaacacccuccuccaguccaaggucggccuccucaccuacuacgucaagcucuaccccggcgaggucacccuccucacccgccccuccauccagaugcgccucugcugcaucaccggcuccgucucccgcccccgcucccagaaguga

SEQ ID NO: 40395 - RNA, 2301 nt, Artificial Sequence
  derived and/or modified sequence opt2 from BRAF__Homo_sapiens__NP_004324
auggccgcccucuccggcggcggcggcggcggcgccgagcccggccaggcccucuucaacggcgacauggagcccgaggccggcgccggcgccggcgccgccgccuccuccgccgccgaccccgccauccccgaggaggucuggaacaucaagcagaugaucaagcucacccaggagcacaucgaggcccuccucgacaaguucggcggcgagcacaacccccccuccaucuaccucgaggccuacgaggaguacaccuccaagcucgacgcccuccagcagcgcgagcagcagcuccucgagucccucggcaacggcaccgacuucuccgucuccuccuccgccuccauggacaccgucaccuccuccuccuccuccucccucuccguccuccccuccucccucuccgucuuccagaaccccaccgacgucgcccgcuccaaccccaaguccccccagaagcccaucguccgcgucuuccuccccaacaagcagcgcaccgucguccccgcccgcugcggcgucaccguccgcgacucccucaagaaggcccucaugaugcgcggccucauccccgagugcugcgccgucuaccgcauccaggacggcgagaagaagcccaucggcugggacaccgacaucuccuggcucaccggcgaggagcuccacgucgagguccucgagaacgucccccucaccacccacaacuucguccgcaagaccuucuucacccucgccuucugcgacuucugccgcaagcuccucuuccagggcuuccgcugccagaccugcggcuacaaguuccaccagcgcugcuccaccgaggucccccucaugugcgucaacuacgaccagcucgaccuccucuucgucuccaaguucuucgagcaccaccccaucccccaggaggaggccucccucgccgagaccgcccucaccuccggcuccucccccuccgcccccgccuccgacuccaucggcccccagauccucaccucccccucccccuccaaguccauccccaucccccagcccuuccgccccgccgacgaggaccaccgcaaccaguucggccagcgcgaccgcuccuccuccgcccccaacguccacaucaacaccaucgagcccgucaacaucgacgaccucauccgcgaccagggcuuccgcggcgacggcggcuccaccaccggccucuccgccaccccccccgccucccuccccggcucccucaccaacgucaaggcccuccagaagucccccggcccccagcgcgagcgcaaguccuccuccuccuccgaggaccgcaaccgcaugaagacccucggccgccgcgacuccuccgacgacugggagauccccgacggccagaucaccgucggccagcgcaucggcuccggcuccuucggcaccgucuacaagggcaaguggcacggcgacgucgccgucaagaugcucaacgucaccgcccccaccccccagcagcuccaggccuucaagaacgaggucggcguccuccgcaagacccgccacgucaacauccuccucuucaugggcuacuccaccaagccccagcucgccaucgucacccaguggugcgagggcuccucccucuaccaccaccuccacaucaucgagaccaaguucgagaugaucaagcucaucgacaucgcccgccagaccgcccagggcauggacuaccuccacgccaaguccaucauccaccgcgaccucaaguccaacaacaucuuccuccacgaggaccucaccgucaagaucggcgacuucggccucgccaccgucaagucccgcugguccggcucccaccaguucgagcagcucuccggcuccauccucuggauggcccccgaggucauccgcaugcaggacaagaaccccuacuccuuccaguccgacgucuacgccuucggcaucguccucuacgagcucaugaccggccagcuccccuacuccaacaucaacaaccgcgaccagaucaucuucauggucggccgcggcuaccucucccccgaccucuccaagguccgcuccaacugccccaaggccaugaagcgccucauggccgagugccucaagaagaagcgcgacgagcgcccccucuucccccagauccucgccuccaucgagcuccucgcccgcucccuccccaagauccaccgcuccgccuccgagcccucccucaaccgcgccggcuuccagaccgaggacuucucccucuacgccugcgccucccccaagacccccauccaggccggcggcuacggcgccuuccccguccacuga

SEQ ID NO: 40396 - RNA, 1779 nt, Artificial Sequence
  derived and/or modified sequence opt2 from BRAP__Homo_sapiens__NP_006759
auguccgucucccucgucgucauccgccucgagcucgccgagcacucccccguccccgccggcuucggcuucuccgccgccgccggcgagauguccgacgaggagaucaagaagaccacccucgccuccgccgucgccugccucgagggcaagucccccggcgagaaggucgccaucauccaccagcaccucggccgccgcgagaugaccgacgucaucaucgagaccaugaaguccaaccccgacgagcucaagaccaccgucgaggagcgcaaguccuccgaggccucccccaccgcccagcgcuccaaggaccacuccaaggagugcaucaacgccgcccccgacucccccuccaagcagcuccccgaccagaucuccuucuucuccggcaaccccuccgucgagaucguccacggcaucaugcaccucuacaagaccaacaagaugaccucccucaaggaggacguccgccgcuccgccaugcucugcauccucaccguccccgccgccaugaccucccacgaccucaugaaguucgucgcccccuucaacgaggucaucgagcagaugaagaucauccgcgacuccacccccaaccaguacaugguccucaucaaguuccgcgcccaggccgacgccgacuccuucuacaugaccugcaacggccgccaguucaacuccaucgaggacgacgucugccagcucgucuacgucgagcgcgccgagguccucaaguccgaggacggcgccucccuccccgucauggaccucaccgagcuccccaagugcaccgucugccucgagcgcauggacgaguccgucaacggcauccucaccacccucugcaaccacuccuuccacucccagugccuccagcgcugggacgacaccaccugccccgucugccgcuacugccagacccccgagcccgucgaggagaacaagugcuucgagugcggcguccaggagaaccucuggaucugccucaucugcggccacaucggcugcggccgcuacgucucccgccacgccuacaagcacuucgaggagacccagcacaccuacgccaugcagcucaccaaccaccgcgucugggacuacgccggcgacaacuacguccaccgccucgucgccuccaagaccgacggcaagaucguccaguacgagugcgagggcgacaccugccaggaggagaagaucgacgcccuccagcucgaguacuccuaccuccucaccucccagcucgagucccagcgcaucuacugggagaacaagaucguccgcaucgagaaggacaccgccgaggagaucaacaacaugaagaccaaguucaaggagaccaucgagaagugcgacaaccucgagcacaagcucaacgaccuccucaaggagaagcaguccgucgagcgcaagugcacccagcucaacaccaaggucgccaagcucaccaacgagcucaaggaggagcaggagaugaacaagugccuccgcgccaaccagguccuccuccagaacaagcucaaggaggaggagcgcguccucaaggagaccugcgaccagaaggaccuccagaucaccgagauccaggagcagcuccgcgacgucauguucuaccucgagacccagcagaagaucaaccaccuccccgccgagacccgccaggagauccaggagggccagaucaacaucgccauggccuccgccuccucccccgccuccuccggcggcuccggcaagcuccccucccgcaagggccgcuccaagcgcggcaaguga

SEQ ID NO: 40397 - RNA, 2466 nt, Artificial Sequence
  derived and/or modified sequence opt2 from BRAT1__Homo_sapiens__NP_689956
auggaccccgagugcgcccagcuccuccccgcccucugcgccguccucgucgacccccgccagcccgucgccgacgacaccugccucgagaagcuccucgacugguucaagaccgucaccgagggcgaguccuccgucguccuccuccaggagcaccccugccucgucgagcuccucucccacguccucaagguccaggaccucuccuccggcguccucuccuucucccuccgccucgccggcaccuucgccgcccaggagaacugcuuccaguaccuccagcagggcgagcuccuccccggccucuucggcgagcccggcccccucggccgcgccaccugggccguccccaccguccgcuccggcuggauccagggccuccgcucccucgcccagcaccccuccgcccuccgcuuccucgccgaccacggcgccgucgacaccaucuucucccuccagggcgacuccucccucuucgucgccuccgccgccucccagcuccucguccacguccucgcccucuccaugcgcggcggcgccgagggccagcccugccuccccggcggcgacuggcccgccugcgcccagaagaucauggaccacgucgaggagucccucugcuccgccgccacccccaaggucacccaggcccucaacguccucaccaccaccuucggccgcugccagucccccuggaccgaggcccucuggguccgccucuccccccgcgucgccugccuccucgagcgcgaccccauccccgccgcccacuccuucgucgaccuccuccucugcgucgcccgcucccccgucuucuccuccuccgacggcucccucugggagaccgucgcccgcgcccucuccugccucggccccacccacaugggcccccucgcccucggcauccucaagcucgagcacugcccccaggcccuccgcacccaggccuuccagguccuccuccagccccucgccugcguccucaaggccaccguccaggcccccggcccccccggccuccucgacggcaccgccgacgacgccaccaccgucgacacccuccucgccuccaaguccuccugcgccggccuccucugccgcacccucgcccaccucgaggagcuccagccccucccccagcgccccucccccuggccccaggccucccuccucggcgccaccgucaccguccuccgccucugcgacggcuccgccgcccccgccuccuccgucggcggccaccucugcggcacccucgccggcugcguccgcguccagcgcgccgcccucgacuuccucggcacccucucccagggcaccggcccccaggagcucgucacccaggcccucgccguccuccucgagugccucgagucccccggcuccucccccaccguccucaagaaggccuuccaggccacccuccgcuggcuccucuccucccccaagacccccggcugcuccgaccucggcccccucaucccccaguuccuccgcgagcucuuccccguccuccagaagcgccucugccaccccugcugggagguccgcgacuccgcccucgaguuccucacccagcucucccgccacuggggcggccaggccgacuuccgcugcgcccuccucgccuccgaggucccccagcucgcccuccagcuccuccaggaccccgaguccuacguccgcgccuccgccgucaccgccaugggccagcucuccucccagggccuccacgcccccaccucccccgagcacgccgaggcccgccagucccucuuccucgagcuccuccacauccucuccgucgacuccgagggcuucccccgccgcgccgucaugcaggucuucaccgaguggcuccgcgacggccacgccgacgccgcccaggacaccgagcaguucgucgccaccguccuccaggccgccucccgcgaccucgacugggagguccgcgcccagggccucgagcucgcccucgucuuccucggccagacccucggccccccccgcacccacugccccuacgccgucgcccuccccgaggucgcccccgcccagccccucaccgaggcccuccgcgcccucugccacgucggccucuucgacuucgccuucugcgcccucuucgacugcgaccgccccgucgcccagaaguccugcgaccuccuccucuuccuccgcgacaagaucgccuccuacuccucccuccgcgaggcccgcggcucccccaacaccgccuccgccgaggccacccucccccgcuggcgcgccggcgagcaggcccagccccccggcgaccaggagcccgaggccguccucgccaugcuccgcucccucgaccucgagggccuccgcuccacccucgccgaguccuccgaccacgucgagaaguccccccagucccuccuccaggacaugcucgccaccggcggcuuccuccagggcgacgaggccgacugcuacuga

SEQ ID NO: 40398 - RNA, 5592 nt, Artificial Sequence
  derived and/or modified sequence opt2 from BRCA1__Homo_sapiens__NP_009225
auggaccucuccgcccuccgcgucgaggagguccagaacgucaucaacgccaugcagaagauccucgagugccccaucugccucgagcucaucaaggagcccgucuccaccaagugcgaccacaucuucugcaaguucugcaugcucaagcuccucaaccagaagaagggccccucccagugcccccucugcaagaacgacaucaccaagcgcucccuccaggaguccacccgcuucucccagcucgucgaggagcuccucaagaucaucugcgccuuccagcucgacaccggccucgaguacgccaacuccuacaacuucgccaagaaggagaacaacucccccgagcaccucaaggacgaggucuccaucauccaguccaugggcuaccgcaaccgcgccaagcgccuccuccaguccgagcccgagaaccccucccuccaggagaccucccucuccguccagcucuccaaccucggcaccguccgcacccuccgcaccaagcagcgcauccagccccagaagaccuccgucuacaucgagcucggcuccgacuccuccgaggacaccgucaacaaggccaccuacugcuccgucggcgaccaggagcuccuccagaucaccccccagggcacccgcgacgagaucucccucgacuccgccaagaaggccgccugcgaguucuccgagaccgacgucaccaacaccgagcaccaccagcccuccaacaacgaccucaacaccaccgagaagcgcgccgccgagcgccaccccgagaaguaccagggcuccuccgucuccaaccuccacgucgagcccugcggcaccaacacccacgccuccucccuccagcacgagaacuccucccuccuccucaccaaggaccgcaugaacgucgagaaggccgaguucugcaacaaguccaagcagcccggccucgcccgcucccagcacaaccgcugggccggcuccaaggagaccugcaacgaccgccgcacccccuccaccgagaagaaggucgaccucaacgccgacccccucugcgagcgcaaggaguggaacaagcagaagcuccccugcuccgagaacccccgcgacaccgaggacguccccuggaucacccucaacuccuccauccagaaggucaacgagugguucucccgcuccgacgagcuccucggcuccgacgacucccacgacggcgaguccgaguccaacgccaaggucgccgacguccucgacguccucaacgaggucgacgaguacuccggcuccuccgagaagaucgaccuccucgccuccgacccccacgaggcccucaucugcaaguccgagcgcguccacuccaaguccgucgaguccaacaucgaggacaagaucuucggcaagaccuaccgcaagaaggccucccuccccaaccucucccacgucaccgagaaccucaucaucggcgccuucgucaccgagccccagaucauccaggagcgcccccucaccaacaagcucaagcgcaagcgccgccccaccuccggccuccaccccgaggacuucaucaagaaggccgaccucgccguccagaagacccccgagaugaucaaccagggcaccaaccagaccgagcagaacggccaggucaugaacaucaccaacuccggccacgagaacaagaccaagggcgacuccauccagaacgagaagaaccccaaccccaucgagucccucgagaaggaguccgccuucaagaccaaggccgagcccaucuccuccuccaucuccaacauggagcucgagcucaacauccacaacuccaaggcccccaagaagaaccgccuccgccgcaaguccuccacccgccacauccacgcccucgagcucgucgucucccgcaaccucuccccccccaacugcaccgagcuccagaucgacuccugcuccuccuccgaggagaucaagaagaagaaguacaaccagaugcccguccgccacucccgcaaccuccagcucauggagggcaaggagcccgccaccggcgccaagaaguccaacaagcccaacgagcagaccuccaagcgccacgacuccgacaccuuccccgagcucaagcucaccaacgcccccggcuccuucaccaagugcuccaacaccuccgagcucaaggaguucgucaaccccucccucccccgcgaggagaaggaggagaagcucgagaccgucaaggucuccaacaacgccgaggaccccaaggaccucaugcucuccggcgagcgcguccuccagaccgagcgcuccgucgaguccuccuccaucucccucguccccggcaccgacuacggcacccaggaguccaucucccuccucgaggucuccacccucggcaaggccaagaccgagcccaacaagugcgucucccagugcgccgccuucgagaaccccaagggccucauccacggcugcuccaaggacaaccgcaacgacaccgagggcuucaaguacccccucggccacgaggucaaccacucccgcgagaccuccaucgagauggaggaguccgagcucgacgcccaguaccuccagaacaccuucaaggucuccaagcgccaguccuucgcccccuucuccaaccccggcaacgccgaggaggagugcgccaccuucuccgcccacuccggcucccucaagaagcagucccccaaggucaccuucgagugcgagcagaaggaggagaaccagggcaagaacgaguccaacaucaagcccguccagaccgucaacaucaccgccggcuuccccgucgucggccagaaggacaagcccgucgacaacgccaagugcuccaucaagggcggcucccgcuucugccucuccucccaguuccgcggcaacgagaccggccucaucacccccaacaagcacggccuccuccagaaccccuaccgcauccccccccucuuccccaucaaguccuucgucaagaccaagugcaagaagaaccuccucgaggagaacuucgaggagcacuccaugucccccgagcgcgagaugggcaacgagaacauccccuccaccgucuccaccaucucccgcaacaacauccgcgagaacgucuucaaggaggccuccuccuccaacaucaacgaggucggcuccuccaccaacgaggucggcuccuccaucaacgagaucggcuccuccgacgagaacauccaggccgagcucggccgcaaccgcggccccaagcucaacgccaugcuccgccucggcguccuccagcccgaggucuacaagcagucccuccccggcuccaacugcaagcaccccgagaucaagaagcaggaguacgaggaggucguccagaccgucaacaccgacuucucccccuaccucaucuccgacaaccucgagcagcccaugggcuccucccacgccucccaggucugcuccgagacccccgacgaccuccucgacgacggcgagaucaaggaggacaccuccuucgccgagaacgacaucaaggaguccuccgccgucuucuccaaguccguccagaagggcgagcucucccgcucccccucccccuucacccacacccaccucgcccagggcuaccgccgcggcgccaagaagcucgaguccuccgaggagaaccucuccuccgaggacgaggagcuccccugcuuccagcaccuccucuucggcaaggucaacaacauccccucccaguccacccgccacuccaccgucgccaccgagugccucuccaagaacaccgaggagaaccuccucucccucaagaacucccucaacgacugcuccaaccaggucauccucgccaaggccucccaggagcaccaccucuccgaggagaccaagugcuccgccucccucuucuccucccagugcuccgagcucgaggaccucaccgccaacaccaacacccaggaccccuuccucaucggcuccuccaagcagaugcgccaccaguccgagucccagggcgucggccucuccgacaaggagcucgucuccgacgacgaggagcgcggcaccggccucgaggagaacaaccaggaggagcaguccauggacuccaaccucggcgaggccgccuccggcugcgaguccgagaccuccgucuccgaggacugcuccggccucuccucccaguccgacauccucaccacccagcagcgcgacaccaugcagcacaaccucaucaagcuccagcaggagauggccgagcucgaggccguccucgagcagcacggcucccagcccuccaacuccuaccccuccaucaucuccgacuccuccgcccucgaggaccuccgcaaccccgagcaguccaccuccgagaaggccguccucaccucccagaaguccuccgaguaccccaucucccagaaccccgagggccucuccgccgacaaguucgaggucuccgccgacuccuccaccuccaagaacaaggagcccggcgucgagcgcuccucccccuccaagugccccucccucgacgaccgcugguacaugcacuccugcuccggcucccuccagaaccgcaacuaccccucccaggaggagcucaucaaggucgucgacgucgaggagcagcagcucgaggaguccggcccccacgaccucaccgagaccuccuaccucccccgccaggaccucgagggcacccccuaccucgaguccggcaucucccucuucuccgacgaccccgaguccgaccccuccgaggaccgcgcccccgaguccgcccgcgucggcaacauccccuccuccaccuccgcccucaaggucccccagcucaaggucgccgaguccgcccagucccccgccgccgcccacaccaccgacaccgccggcuacaacgccauggaggaguccgucucccgcgagaagcccgagcucaccgccuccaccgagcgcgucaacaagcgcauguccauggucgucuccggccucacccccgaggaguucaugcucgucuacaaguucgcccgcaagcaccacaucacccucaccaaccucaucaccgaggagaccacccacgucgucaugaagaccgacgccgaguucgucugcgagcgcacccucaaguacuuccucggcaucgccggcggcaagugggucgucuccuacuucugggucacccaguccaucaaggagcgcaagaugcucaacgagcacgacuucgagguccgcggcgacgucgucaacggccgcaaccaccagggccccaagcgcgcccgcgagucccaggaccgcaagaucuuccgcggccucgagaucugcugcuacggccccuucaccaacaugcccaccgaccagcucgaguggaugguccagcucugcggcgccuccgucgucaaggagcucuccuccuucacccucggcaccggcguccaccccaucgucgucguccagcccgacgccuggaccgaggacaacggcuuccacgccaucggccagaugugcgaggcccccgucgucacccgcgaguggguccucgacuccgucgcccucuaccagugccaggagcucgacaccuaccucaucccccagaucccccacucccacuacuga

SEQ ID NO: 40399 - RNA, 10257 nt, Artificial Sequence
  derived and/or modified sequence opt2 from BRCA2__Homo_sapiens__NP_000050
augcccaucggcuccaaggagcgccccaccuucuucgagaucuucaagacccgcugcaacaaggccgaccucggccccaucucccucaacugguucgaggagcucuccuccgaggccccccccuacaacuccgagcccgccgaggaguccgagcacaagaacaacaacuacgagcccaaccucuucaagaccccccagcgcaagcccuccuacaaccagcucgccuccacccccaucaucuucaaggagcagggccucacccucccccucuaccagucccccgucaaggagcucgacaaguucaagcucgaccucggccgcaacguccccaacucccgccacaagucccuccgcaccgucaagaccaagauggaccaggccgacgacgucuccugcccccuccucaacuccugccucuccgagucccccgucguccuccagugcacccacgucaccccccagcgcgacaaguccgucgucugcggcucccucuuccacacccccaaguucgucaagggccgccagacccccaagcacaucuccgagucccucggcgccgaggucgaccccgacauguccugguccuccucccucgccaccccccccacccucuccuccaccguccucaucguccgcaacgaggaggccuccgagaccgucuucccccacgacaccaccgccaacgucaaguccuacuucuccaaccacgacgagucccucaagaagaacgaccgcuucaucgccuccgucaccgacuccgagaacaccaaccagcgcgaggccgccucccacggcuucggcaagaccuccggcaacuccuucaaggucaacuccugcaaggaccacaucggcaaguccaugcccaacguccucgaggacgaggucuacgagaccgucgucgacaccuccgaggaggacuccuucucccucugcuucuccaagugccgcaccaagaaccuccagaagguccgcaccuccaagacccgcaagaagaucuuccacgaggccaacgccgacgagugcgagaaguccaagaaccaggucaaggagaaguacuccuucgucuccgaggucgagcccaacgacaccgacccccucgacuccaacgucgccaaccagaagcccuucgaguccggcuccgacaagaucuccaaggaggucguccccucccucgccugcgaguggucccagcucacccucuccggccucaacggcgcccagauggagaagaucccccuccuccacaucuccuccugcgaccagaacaucuccgagaaggaccuccucgacaccgagaacaagcgcaagaaggacuuccucaccuccgagaacucccucccccgcaucuccucccuccccaaguccgagaagccccucaacgaggagaccgucgucaacaagcgcgacgaggagcagcaccucgagucccacaccgacugcauccucgccgucaagcaggccaucuccggcaccucccccgucgccuccuccuuccagggcaucaagaaguccaucuuccgcauccgcgagucccccaaggagaccuucaacgccuccuucuccggccacaugaccgaccccaacuucaagaaggagaccgaggccuccgaguccggccucgagauccacaccgucugcucccagaaggaggacucccucugccccaaccucaucgacaacggcuccuggcccgccaccaccacccagaacuccgucgcccucaagaacgccggccucaucuccacccucaagaagaagaccaacaaguucaucuacgccauccacgacgagaccuccuacaagggcaagaagauccccaaggaccagaaguccgagcucaucaacugcuccgcccaguucgaggccaacgccuucgaggccccccucaccuucgccaacgccgacuccggccuccuccacuccuccgucaagcgcuccugcucccagaacgacuccgaggagcccacccucucccucaccuccuccuucggcaccauccuccgcaagugcucccgcaacgagaccugcuccaacaacaccgucaucucccaggaccucgacuacaaggaggccaagugcaacaaggagaagcuccagcucuucaucacccccgaggccgacucccucuccugccuccaggagggccagugcgagaacgaccccaaguccaagaaggucuccgacaucaaggaggagguccucgccgccgccugccaccccguccagcacuccaaggucgaguacuccgacaccgacuuccagucccagaagucccuccucuacgaccacgagaacgccuccacccucauccucacccccaccuccaaggacguccucuccaaccucgucaugaucucccgcggcaaggaguccuacaagauguccgacaagcucaagggcaacaacuacgaguccgacgucgagcucaccaagaacauccccauggagaagaaccaggacgucugcgcccucaacgagaacuacaagaacgucgagcuccucccccccgagaaguacaugcgcgucgccucccccucccgcaagguccaguucaaccagaacaccaaccuccgcgucauccagaagaaccaggaggagaccaccuccaucuccaagaucaccgucaaccccgacuccgaggagcucuucuccgacaacgagaacaacuucgucuuccaggucgccaacgagcgcaacaaccucgcccucggcaacaccaaggagcuccacgagaccgaccucaccugcgucaacgagcccaucuucaagaacuccaccaugguccucuacggcgacaccggcgacaagcaggccacccaggucuccaucaagaaggaccucgucuacguccucgccgaggagaacaagaacuccgucaagcagcacaucaagaugacccucggccaggaccucaaguccgacaucucccucaacaucgacaagauccccgagaagaacaacgacuacaugaacaagugggccggccuccucggccccaucuccaaccacuccuucggcggcuccuuccgcaccgccuccaacaaggagaucaagcucuccgagcacaacaucaagaaguccaagauguucuucaaggacaucgaggagcaguaccccaccucccucgccugcgucgagaucgucaacacccucgcccucgacaaccagaagaagcucuccaagccccaguccaucaacaccgucuccgcccaccuccaguccuccgucgucgucuccgacugcaagaacucccacaucaccccccagaugcucuucuccaagcaggacuucaacuccaaccacaaccucacccccucccagaaggccgagaucaccgagcucuccaccauccucgaggaguccggcucccaguucgaguucacccaguuccgcaagcccuccuacauccuccagaaguccaccuucgagguccccgagaaccagaugaccauccucaagaccaccuccgaggagugccgcgacgccgaccuccacgucaucaugaacgcccccuccaucggccaggucgacuccuccaagcaguucgagggcaccgucgagaucaagcgcaaguucgccggccuccucaagaacgacugcaacaaguccgccuccggcuaccucaccgacgagaacgaggucggcuuccgcggcuucuacuccgcccacggcaccaagcucaacgucuccaccgaggcccuccagaaggccgucaagcucuucuccgacaucgagaacaucuccgaggagaccuccgccgagguccaccccaucucccucuccuccuccaagugccacgacuccgucgucuccauguucaagaucgagaaccacaacgacaagaccgucuccgagaagaacaacaagugccagcucauccuccagaacaacaucgagaugaccaccggcaccuucgucgaggagaucaccgagaacuacaagcgcaacaccgagaacgaggacaacaaguacaccgccgccucccgcaacucccacaaccucgaguucgacggcuccgacuccuccaagaacgacaccgucugcauccacaaggacgagaccgaccuccucuucaccgaccagcacaacaucugccucaagcucuccggccaguucaugaaggagggcaacacccagaucaaggaggaccucuccgaccucaccuuccucgaggucgccaaggcccaggaggccugccacggcaacaccuccaacaaggagcagcucaccgccaccaagaccgagcagaacaucaaggacuucgagaccuccgacaccuucuuccagaccgccuccggcaagaacaucuccgucgccaaggaguccuucaacaagaucgucaacuucuucgaccagaagcccgaggagcuccacaacuucucccucaacuccgagcuccacuccgacauccgcaagaacaagauggacauccucuccuacgaggagaccgacaucgucaagcacaagauccucaaggaguccguccccgucggcaccggcaaccagcucgucaccuuccagggccagcccgagcgcgacgagaagaucaaggagcccacccuccucggcuuccacaccgccuccggcaagaaggucaagaucgccaaggagucccucgacaaggucaagaaccucuucgacgagaaggagcagggcaccuccgagaucaccuccuucucccaccagugggccaagacccucaaguaccgcgaggccugcaaggaccucgagcucgccugcgagaccaucgagaucaccgccgcccccaagugcaaggagaugcagaacucccucaacaacgacaagaaccucgucuccaucgagaccgucgucccccccaagcuccucuccgacaaccucugccgccagaccgagaaccucaagaccuccaaguccaucuuccucaaggucaagguccacgagaacgucgagaaggagaccgccaagucccccgccaccugcuacaccaaccagucccccuacuccgucaucgagaacuccgcccucgccuucuacaccuccugcucccgcaagaccuccgucucccagaccucccuccucgaggccaagaaguggcuccgcgagggcaucuucgacggccagcccgagcgcaucaacaccgccgacuacgucggcaacuaccucuacgagaacaacuccaacuccaccaucgccgagaacgacaagaaccaccucuccgagaagcaggacaccuaccucuccaacuccuccauguccaacuccuacuccuaccacuccgacgaggucuacaacgacuccggcuaccucuccaagaacaagcucgacuccggcaucgagcccguccucaagaacgucgaggaccagaagaacaccuccuucuccaaggucaucuccaacgucaaggacgccaacgccuacccccagaccgucaacgaggacaucugcgucgaggagcucgucaccuccuccucccccugcaagaacaagaacgccgccaucaagcucuccaucuccaacuccaacaacuucgaggucggcccccccgccuuccgcaucgccuccggcaagaucgucugcgucucccacgagaccaucaagaaggucaaggacaucuucaccgacuccuucuccaaggucaucaaggagaacaacgagaacaaguccaagaucugccagaccaagaucauggccggcugcuacgaggcccucgacgacuccgaggacauccuccacaacucccucgacaacgacgagugcuccacccacucccacaaggucuucgccgacauccaguccgaggagauccuccagcacaaccagaacauguccggccucgagaaggucuccaagaucucccccugcgacgucucccucgagaccuccgacaucugcaagugcuccaucggcaagcuccacaaguccgucuccuccgccaacaccugcggcaucuucuccaccgccuccggcaaguccguccaggucuccgacgccucccuccagaacgcccgccaggucuucuccgagaucgaggacuccaccaagcaggucuucuccaagguccucuucaaguccaacgagcacuccgaccagcucacccgcgaggagaacaccgccauccgcacccccgagcaccucaucucccagaagggcuucuccuacaacgucgucaacuccuccgccuucuccggcuucuccaccgccuccggcaagcaggucuccauccucgaguccucccuccacaaggucaagggcguccucgaggaguucgaccucauccgcaccgagcacucccuccacuacucccccaccucccgccagaacgucuccaagauccucccccgcgucgacaagcgcaaccccgagcacugcgucaacuccgagauggagaagaccugcuccaaggaguucaagcucuccaacaaccucaacgucgagggcggcuccuccgagaacaaccacuccaucaaggucucccccuaccucucccaguuccagcaggacaagcagcagcucguccucggcaccaaggucucccucgucgagaacauccacguccucggcaaggagcaggccucccccaagaacgucaagauggagaucggcaagaccgagaccuucuccgacguccccgucaagaccaacaucgaggucugcuccaccuacuccaaggacuccgagaacuacuucgagaccgaggccgucgagaucgccaaggccuucauggaggacgacgagcucaccgacuccaagcuccccucccacgccacccacucccucuucaccugccccgagaacgaggagaugguccucuccaacucccgcaucggcaagcgccgcggcgagccccucauccucgucggcgagcccuccaucaagcgcaaccuccucaacgaguucgaccgcaucaucgagaaccaggagaagucccucaaggccuccaaguccacccccgacggcaccaucaaggaccgccgccucuucaugcaccacgucucccucgagcccaucaccugcguccccuuccgcaccaccaaggagcgccaggagauccagaaccccaacuucaccgcccccggccaggaguuccucuccaagucccaccucuacgagcaccucacccucgagaaguccuccuccaaccucgccgucuccggccaccccuucuaccaggucuccgccacccgcaacgagaagaugcgccaccucaucaccaccggccgccccaccaaggucuucgucccccccuucaagaccaagucccacuuccaccgcgucgagcagugcguccgcaacaucaaccucgaggagaaccgccagaagcagaacaucgacggccacggcuccgacgacuccaagaacaagaucaacgacaacgagauccaccaguucaacaagaacaacuccaaccaggccgccgccgucaccuucaccaagugcgaggaggagccccucgaccucaucaccucccuccagaacgcccgcgacauccaggacaugcgcaucaagaagaagcagcgccagcgcgucuucccccagcccggcucccucuaccucgccaagaccuccacccucccccgcaucucccucaaggccgccgucggcggccagguccccuccgccugcucccacaagcagcucuacaccuacggcgucuccaagcacugcaucaagaucaacuccaagaacgccgaguccuuccaguuccacaccgaggacuacuucggcaaggagucccucuggaccggcaagggcauccagcucgccgacggcggcuggcucauccccuccaacgacggcaaggccggcaaggaggaguucuaccgcgcccucugcgacacccccggcgucgaccccaagcucaucucccgcaucugggucuacaaccacuaccgcuggaucaucuggaagcucgccgccauggagugcgccuuccccaaggaguucgccaaccgcugccucucccccgagcgcguccuccuccagcucaaguaccgcuacgacaccgagaucgaccgcucccgccgcuccgccaucaagaagaucauggagcgcgacgacaccgccgccaagacccucguccucugcgucuccgacaucaucucccucuccgccaacaucuccgagaccuccuccaacaagaccuccuccgccgacacccagaaggucgccaucaucgagcucaccgacggcugguacgccgucaaggcccagcucgaccccccccuccucgccguccucaagaacggccgccucaccgucggccagaagaucauccuccacggcgccgagcucgucggcucccccgacgccugcaccccccucgaggcccccgagucccucaugcucaagaucuccgccaacuccacccgccccgcccgcugguacaccaagcucggcuucuuccccgacccccgccccuucccccucccccucuccucccucuucuccgacggcggcaacgucggcugcgucgacgucaucauccagcgcgccuaccccauccaguggauggagaagaccuccuccggccucuacaucuuccgcaacgagcgcgaggaggagaaggaggccgccaaguacgucgaggcccagcagaagcgccucgaggcccucuucaccaagauccaggaggaguucgaggagcacgaggagaacaccaccaagcccuaccuccccucccgcgcccucacccgccagcagguccgcgcccuccaggacggcgccgagcucuacgaggccgucaagaacgccgccgaccccgccuaccucgagggcuacuucuccgaggagcagcuccgcgcccucaacaaccaccgccagaugcucaacgacaagaagcaggcccagauccagcucgagauccgcaaggccauggaguccgccgagcagaaggagcagggccucucccgcgacgucaccaccgucuggaagcuccgcaucgucuccuacuccaagaaggagaaggacuccgucauccucuccaucuggcgccccuccuccgaccucuacucccuccucaccgagggcaagcgcuaccgcaucuaccaccucgccaccuccaaguccaaguccaaguccgagcgcgccaacauccagcucgccgccaccaagaagacccaguaccagcagcuccccgucuccgacgagauccucuuccagaucuaccagccccgcgagccccuccacuucuccaaguuccucgaccccgacuuccagcccuccugcuccgaggucgaccucaucggcuucgucgucuccgucgucaagaagaccggccucgcccccuucgucuaccucuccgacgagugcuacaaccuccucgccaucaaguucuggaucgaccucaacgaggacaucaucaagccccacaugcucaucgccgccuccaaccuccaguggcgccccgaguccaaguccggccuccucacccucuucgccggcgacuucuccgucuucuccgccucccccaaggagggccacuuccaggagaccuucaacaagaugaagaacaccgucgagaacaucgacauccucugcaacgaggccgagaacaagcucaugcacauccuccacgccaacgaccccaagugguccacccccaccaaggacugcaccuccggccccuacaccgcccagaucauccccggcaccggcaacaagcuccucauguccucccccaacugcgagaucuacuaccaguccccccucucccucugcauggccaagcgcaaguccgucuccacccccgucuccgcccagaugaccuccaaguccugcaagggcgagaaggagaucgacgaccagaagaacugcaagaagcgccgcgcccucgacuuccucucccgccucccccuccccccccccgucucccccaucugcaccuucgucucccccgccgcccagaaggccuuccagcccccccgcuccugcggcaccaaguacgagacccccaucaagaagaaggagcucaacuccccccagaugacccccuucaagaaguucaacgagaucucccuccucgaguccaacuccaucgccgacgaggagcucgcccucaucaacacccaggcccuccucuccggcuccaccggcgagaagcaguucaucuccgucuccgaguccacccgcaccgcccccaccuccuccgaggacuaccuccgccucaagcgccgcugcaccaccucccucaucaaggagcaggaguccucccaggccuccaccgaggagugcgagaagaacaagcaggacaccaucaccaccaagaaguacaucuga

SEQ ID NO: 40400 - RNA, 876 nt, Artificial Sequence
  derived and/or modified sequence opt2 from BRCC3__Homo_sapiens__NP_001018065
auggccguccaggucguccaggccguccaggccguccaccucgaguccgacgccuuccucgucugccucaaccacgcccucuccaccgagaaggaggaggucaugggccucugcaucggcgagcucaacgacgacacccgcuccgacuccaaguucgccuacaccggcaccgagaugcgcaccgucgccgagaaggucgacgccguccgcaucguccacauccacuccgucaucauccuccgccgcuccgacaagcgcaaggaccgcgucgagaucucccccgagcagcucuccgccgccuccaccgaggccgagcgccucgccgagcucaccggccgccccaugcgcgucgucggcugguaccacucccacccccacaucaccgucuggcccucccacgucgacguccgcacccaggccauguaccagaugauggaccagggcuucgucggccucaucuucuccugcuucaucgaggacaagaacaccaagaccggccgcguccucuacaccugcuuccaguccauccaggcccagaaguccuccgaguacgagcgcaucgagauccccauccacaucgucccccacgucaccaucggcaaggucugccucgaguccgccgucgagcuccccaagauccucugccaggaggagcaggacgccuaccgccgcauccacucccucacccaccucgacuccgucaccaagauccacaacggcuccgucuucaccaagaaccucugcucccagauguccgccgucuccggcccccuccuccaguggcucgaggaccgccucgagcagaaccagcagcaccuccaggagcuccagcaggagaaggaggagcucaugcaggagcucuccucccucgaguga

SEQ ID NO: 40401 - RNA, 3570 nt, Artificial Sequence
  derived and/or modified sequence opt2 from BRD1__Homo_sapiens__NP_001291737
augcgccgcaagggccgcugccaccgcggcuccgccgcccgccaccccuccucccccugcuccgucaagcacucccccacccgcgagacccucaccuacgcccaggcccagcgcauggucgagaucgagaucgagggccgccuccaccgcaucuccaucuucgacccccucgagaucauccucgaggacgaccucaccgcccaggagauguccgagugcaacuccaacaaggagaacuccgagcgcccccccgucugccuccgcaccaagcgccacaagaacaaccgcgucaagaagaagaacgaggcccuccccuccgcccacggcacccccgccuccgccuccgcccuccccgagcccaagguccgcaucgucgaguacuccccccccuccgccccccgccgcccccccgucuacuacaaguucaucgagaaguccgccgaggagcucgacaacgaggucgaguacgacauggacgaggaggacuacgccuggcucgagaucgucaacgagaagcgcaagggcgacugcguccccgccgucucccaguccauguucgaguuccucauggaccgcuucgagaaggagucccacugcgagaaccagaagcagggcgagcagcagucccucaucgacgaggacgccgucugcugcaucugcauggacggcgagugccagaacuccaacgucauccucuucugcgacaugugcaaccucgccguccaccaggagugcuacggcguccccuacauccccgagggccaguggcucugccgccacugccuccagucccgcgcccgccccgccgacugcguccucugccccaacaagggcggcgccuucaagaagaccgacgacgaccgcuggggccacgucgucugcgcccucuggauccccgaggucggcuucgccaacaccgucuucaucgagcccaucgacggcguccgcaacaucccccccgcccgcuggaagcucaccugcuaccucugcaagcagaagggcgucggcgccugcauccagugccacaaggccaacugcuacaccgccuuccacgucaccugcgcccagaaggccggccucuacaugaagauggagcccgucaaggagcucaccggcggcggcaccaccuucuccguccgcaagaccgccuacugcgacguccacaccccccccggcugcacccgccgcccccucaacaucuacggcgacgucgagaugaagaacggcgucugccgcaaggaguccuccgucaagaccguccgcuccaccuccaagguccgcaagaaggccaagaaggccaagaaggcccucgccgagcccugcgccguccuccccaccgucugcgcccccuacauccccccccagcgccucaaccgcaucgccaaccaggucgccauccagcgcaagaagcaguucgucgagcgcgcccacuccuacuggcuccucaagcgccucucccgcaacggcgccccccuccuccgccgccuccaguccucccuccagucccagcgcuccucccagcagcgcgagaacgacgaggagaugaaggccgccaaggagaagcucaaguacuggcagcgccuccgccacgaccucgagcgcgcccgccuccucaucgagcuccuccgcaagcgcgagaagcucaagcgcgagcaggucaaggucgagcaggucgccauggagcuccgccucaccccccucaccguccuccuccgcuccguccucgaccagcuccaggacaaggaccccgcccgcaucuucgcccagcccgucucccucaaggagguccccgacuaccucgaccacaucaagcaccccauggacuucgccaccaugcgcaagcgccucgaggcccagggcuacaagaaccuccacgaguucgaggaggacuucgaccucaucaucgacaacugcaugaaguacaacgcccgcgacaccgucuucuaccgcgccgccguccgccuccgcgaccagggcggcgucguccuccgccaggcccgccgcgaggucgacuccaucggccucgaggaggccuccggcaugcaccuccccgagcgccccgccgccgccccccgccgccccuucuccugggaggacgucgaccgccuccucgaccccgccaaccgcgcccaccucggccucgaggagcagcuccgcgagcuccucgacaugcucgaccucaccugcgccaugaaguccuccggcucccgcuccaagcgcgccaagcuccucaagaaggagaucgcccuccuccgcaacaagcucucccagcagcacucccagccccuccccaccggccccggccucgagggcuucgaggaggacggcgccgcccucggccccgaggccggcgaggagggcgacaaguccccccccaagcucgagcccuccgacgcccucccccuccccuccaacuccgagaccaacuccgagccccccacccucaagcccgucgagcucaaccccgagcaguccaagcucuucaagcgcgucaccuucgacaacgagucccacuccgccugcacccaguccgcccucgucuccggccgcccccccgagcccacccgcgccuccuccggcgacguccccgccgccgccgccuccgccgucgccgagcccgccuccgacgucaaccgccgcaccuccguccucuucugcaaguccaaguccgucuccccccccaaguccgccaagaacaccgagacccagcccaccuccccccagcucggcaccaagaccuuccucuccgucguccucccccgccucgagacccuccuccagccccgcaagcgcucccgcuccaccugcggcgacuccgaggucgaggaggagucccccggcaagcgccucgacgccggccucaccaacggcuucggcggcgcccgcuccgagcaggagcccggcggcggccucggccgcaaggccaccccccgccgccgcugcgccuccgaguccuccaucuccuccuccaacuccccccucugcgacuccuccuucaacgcccccaagugcggccgcggcaagcccgcccucguccgccgccacacccucgaggaccgcuccgagcucaucuccugcaucgagaacggcaacuacgccaaggccgcccgcaucgccgccgaggucggccaguccuccauguggaucuccaccgacgccgccgccuccguccucgagccccucaaggucgucugggccaagugcuccggcuaccccuccuaccccgcccucaucaucgaccccaagaugccccgcguccccggccaccacaacggcgucaccauccccgcccccccccucgacguccucaagaucggcgagcacaugcagaccaaguccgacgagaagcucuuccucguccucuucuucgacaacaagcgcuccuggcaguggcuccccaaguccaagauggucccccucggcaucgacgagaccaucgacaagcucaagaugauggagggccgcaacuccuccauccgcaaggccguccgcaucgccuucgaccgcgccaugaaccaccucucccgcguccacggcgagcccaccuccgaccucuccgacaucgacuga

SEQ ID NO: 40402 - RNA, 2406 nt, Artificial Sequence
  derived and/or modified sequence opt2 from BRD2__Homo_sapiens__NP_001106653
augcuccagaacgucaccccccacaacaagcuccccggcgagggcaacgccggccuccucggccucggccccgaggccgccgcccccggcaagcgcauccgcaagcccucccuccucuacgagggcuucgagucccccaccauggccuccguccccgcccuccagcucacccccgccaacccccccccccccgaggucuccaaccccaagaagcccggccgcgucaccaaccagcuccaguaccuccacaaggucgucaugaaggcccucuggaagcaccaguucgccuggcccuuccgccagcccgucgacgccgucaagcucggccuccccgacuaccacaagaucaucaagcagcccauggacaugggcaccaucaagcgccgccucgagaacaacuacuacugggccgccuccgagugcaugcaggacuucaacaccauguucaccaacugcuacaucuacaacaagcccaccgacgacaucguccucauggcccagacccucgagaagaucuuccuccagaaggucgccuccaugccccaggaggagcaggagcucgucgucaccauccccaagaacucccacaagaagggcgccaagcucgccgcccuccagggcuccgucaccuccgcccaccagguccccgccgucuccuccgucucccacaccgcccucuacacccccccccccgagauccccaccaccguccucaacaucccccaccccuccgucaucuccuccccccuccucaagucccuccacuccgccggccccccccuccucgccgucaccgccgccccccccgcccagccccucgccaagaagaagggcgucaagcgcaaggccgacaccaccacccccacccccaccgccauccucgcccccggcucccccgccuccccccccggcucccucgagcccaaggccgcccgccucccccccaugcgccgcgaguccggccgccccaucaagcccccccgcaaggaccuccccgacucccagcagcagcaccaguccuccaagaagggcaagcucuccgagcagcucaagcacugcaacggcauccucaaggagcuccucuccaagaagcacgccgccuacgccuggcccuucuacaagcccgucgacgccuccgcccucggccuccacgacuaccacgacaucaucaagcaccccauggaccucuccaccgucaagcgcaagauggagaaccgcgacuaccgcgacgcccaggaguucgccgccgacguccgccucauguucuccaacugcuacaaguacaacccccccgaccacgacgucgucgccauggcccgcaagcuccaggacgucuucgaguuccgcuacgccaagaugcccgacgagccccucgagcccggcccccuccccgucuccaccgccaugccccccggccucgccaaguccuccuccgaguccuccuccgaggaguccuccuccgaguccuccuccgaggaggaggaggaggaggacgaggaggacgaggaggaggaggaguccgaguccuccgacuccgaggaggagcgcgcccaccgccucgccgagcuccaggagcagcuccgcgccguccacgagcagcucgccgcccucucccagggccccaucuccaagcccaagcgcaagcgcgagaagaaggagaagaagaagaagcgcaaggccgagaagcaccgcggccgcgccggcgccgacgaggacgacaagggcccccgcgccccccgccccccccagcccaagaaguccaagaaggccuccggcuccggcggcggcuccgccgcccucggccccuccggcuucggccccuccggcggcuccggcaccaagcuccccaagaaggccaccaagaccgccccccccgcccuccccaccggcuacgacuccgaggaggaggaggagucccgccccauguccuacgacgagaagcgccagcucucccucgacaucaacaagcuccccggcgagaagcucggccgcgucguccacaucauccaggcccgcgagcccucccuccgcgacuccaaccccgaggagaucgagaucgacuucgagacccucaagcccuccacccuccgcgagcucgagcgcuacguccucuccugccuccgcaagaagccccgcaagcccuacaccaucaagaagcccgucggcaagaccaaggaggagcucgcccucgagaagaagcgcgagcucgagaagcgccuccaggacgucuccggccagcucaacuccaccaagaagccccccaagaaggccaacgagaagaccgaguccuccuccgcccagcaggucgccgucucccgccucuccgccuccuccuccuccuccgacuccuccuccuccuccuccuccuccuccuccuccgacaccuccgacuccgacuccggcuga

SEQ ID NO: 40403 - RNA, 2181 nt, Artificial Sequence
  derived and/or modified sequence opt2 from BRD3__Homo_sapiens__NP_031397
auguccaccgccaccaccgucgcccccgccggcauccccgccacccccggccccgucaacccccccccccccgaggucuccaaccccuccaagcccggccgcaagaccaaccagcuccaguacaugcagaacgucgucgucaagacccucuggaagcaccaguucgccuggcccuucuaccagcccgucgacgccaucaagcucaaccuccccgacuaccacaagaucaucaagaaccccauggacaugggcaccaucaagaagcgccucgagaacaacuacuacugguccgccuccgagugcaugcaggacuucaacaccauguucaccaacugcuacaucuacaacaagcccaccgacgacaucguccucauggcccaggcccucgagaagaucuuccuccagaaggucgcccagaugccccaggaggaggucgagcuccucccccccgcccccaagggcaagggccgcaagcccgccgccggcgcccaguccgccggcacccagcaggucgccgccgucuccuccgucucccccgccacccccuuccaguccgucccccccaccgucucccagacccccgucaucgccgccacccccguccccaccaucaccgccaacgucaccuccguccccgucccccccgccgccgccccccccccccccgccacccccaucguccccgucgucccccccaccccccccgucgucaagaagaagggcgucaagcgcaaggccgacaccaccacccccaccaccuccgccaucaccgccucccgcuccgaguccccccccccccucuccgaccccaagcaggccaaggucgucgcccgccgcgaguccggcggccgccccaucaagccccccaagaaggaccucgaggacggcgaggucccccagcacgccggcaagaagggcaagcucuccgagcaccuccgcuacugcgacuccauccuccgcgagaugcucuccaagaagcacgccgccuacgccuggcccuucuacaagcccgucgacgccgaggcccucgagcuccacgacuaccacgacaucaucaagcaccccauggaccucuccaccgucaagcgcaagauggacggccgcgaguaccccgacgcccagggcuucgccgccgacguccgccucauguucuccaacugcuacaaguacaacccccccgaccacgaggucgucgccauggcccgcaagcuccaggacgucuucgagaugcgcuucgccaagaugcccgacgagcccgucgaggcccccgcccuccccgcccccgccgcccccauggucuccaagggcgccgaguccucccgcuccuccgaggaguccuccuccgacuccggcuccuccgacuccgaggaggagcgcgccacccgccucgccgagcuccaggagcagcucaaggccguccacgagcagcucgccgcccucucccaggcccccgucaacaagcccaagaagaagaaggagaagaaggagaaggagaagaagaagaaggacaaggagaaggagaaggagaagcacaaggucaaggccgaggaggagaagaaggccaaggucgccccccccgccaagcaggcccagcagaagaaggcccccgccaagaaggccaacuccaccaccaccgccggccgccagcucaagaagggcggcaagcaggccuccgccuccuacgacuccgaggaggaggaggagggccuccccauguccuacgacgagaagcgccagcucucccucgacaucaaccgccuccccggcgagaagcucggccgcgucguccacaucauccagucccgcgagcccucccuccgcgacuccaaccccgacgagaucgagaucgacuucgagacccucaagcccaccacccuccgcgagcucgagcgcuacgucaaguccugccuccagaagaagcagcgcaagcccuucuccgccuccggcaagaagcaggccgccaaguccaaggaggagcucgcccaggagaagaagaaggagcucgagaagcgccuccaggacgucuccggccagcucuccuccuccaagaagcccgcccgcaaggagaagcccggcuccgcccccuccggcggccccucccgccucuccuccuccuccuccuccgaguccggcuccuccuccuccuccggcuccuccuccgacuccuccgacuccgaguga

SEQ ID NO: 40404 - RNA, 4089 nt, Artificial Sequence
  derived and/or modified sequence opt2 from BRD4__Homo_sapiens__XP_011526156
auguccgccgaguccggccccggcacccgccuccgcaaccuccccgucaugggcgacggccucgagaccucccagauguccaccacccaggcccaggcccagccccagcccgccaacgccgccuccaccaacccccccccccccgagaccuccaaccccaacaagcccaagcgccagaccaaccagcuccaguaccuccuccgcgucguccucaagacccucuggaagcaccaguucgccuggcccuuccagcagcccgucgacgccgucaagcucaaccuccccgacuacuacaagaucaucaagacccccauggacaugggcaccaucaagaagcgccucgagaacaacuacuacuggaacgcccaggagugcauccaggacuucaacaccauguucaccaacugcuacaucuacaacaagcccggcgacgacaucguccucauggccgaggcccucgagaagcucuuccuccagaagaucaacgagcuccccaccgaggagaccgagaucaugaucguccaggccaagggccgcggccgcggccgcaaggagaccggcaccgccaagcccggcgucuccaccguccccaacaccacccaggccuccacccccccccagacccagaccccccagcccaaccccccccccguccaggccaccccccaccccuuccccgccgucacccccgaccucaucguccagacccccgucaugaccgucguccccccccagccccuccagacccccccccccguccccccccagccccagcccccccccgcccccgccccccagcccguccagucccacccccccaucaucgccgccaccccccagcccgucaagaccaagaagggcgucaagcgcaaggccgacaccaccacccccaccaccaucgaccccauccacgagccccccucccucccccccgagcccaagaccaccaagcucggccagcgccgcgaguccucccgccccgucaagccccccaagaaggacguccccgacucccagcagcaccccgcccccgagaaguccuccaaggucuccgagcagcucaagugcugcuccggcauccucaaggagauguucgccaagaagcacgccgccuacgccuggcccuucuacaagcccgucgacgucgaggcccucggccuccacgacuacugcgacaucaucaagcaccccauggacauguccaccaucaaguccaagcucgaggcccgcgaguaccgcgacgcccaggaguucggcgccgacguccgccucauguucuccaacugcuacaaguacaacccccccgaccacgaggucgucgccauggcccgcaagcuccaggacgucuucgagaugcgcuucgccaagaugcccgacgagcccgaggagcccgucgucgccgucuccucccccgccguccccccccccaccaaggucgucgccccccccuccuccuccgacuccuccuccgacuccuccuccgacuccgacuccuccaccgacgacuccgaggaggagcgcgcccagcgccucgccgagcuccaggagcagcucaaggccguccacgagcagcucgccgcccucucccagccccagcagaacaagcccaagaagaaggagaaggacaagaaggagaagaagaaggagaagcacaagcgcaaggaggaggucgaggagaacaagaaguccaaggccaaggagcccccccccaagaagaccaagaagaacaacuccuccaacuccaacgucuccaagaaggagcccgcccccaugaaguccaagcccccccccaccuacgaguccgaggaggaggacaagugcaagcccauguccuacgaggagaagcgccagcucucccucgacaucaacaagcuccccggcgagaagcucggccgcgucguccacaucauccagucccgcgagcccucccucaagaacuccaaccccgacgagaucgagaucgacuucgagacccucaagcccuccacccuccgcgagcucgagcgcuacgucaccuccugccuccgcaagaagcgcaagccccaggccgagaaggucgacgucaucgccggcuccuccaagaugaagggcuucuccuccuccgaguccgaguccuccuccgaguccuccuccuccgacuccgaggacuccgagaccgagauggcccccaaguccaagaagaagggccaccccggccgcgagcagaagaagcaccaccaccaccaccaccagcagaugcagcaggcccccgcccccgucccccagcagccccccccccccccccagcagccccccccccccccccccccccagcagcagcagcagccccccccccccccccccccccccuccaugccccagcaggccgcccccgccaugaaguccucccccccccccuucaucgccacccagguccccguccucgagccccagcuccccggcuccgucuucgaccccaucggccacuucacccagcccauccuccaccucccccagcccgagcuccccccccaccucccccagccccccgagcacuccacccccccccaccucaaccagcacgccgucgucuccccccccgcccuccacaacgcccucccccagcagcccucccgccccuccaaccgcgccgccgcccucccccccaagcccgcccgcccccccgccgucucccccgcccucacccagaccccccuccucccccagccccccauggcccagcccccccagguccuccucgaggacgaggagccccccgcccccccccucaccuccaugcagaugcagcucuaccuccagcagcuccagaagguccagccccccaccccccuccuccccuccgucaagguccagucccagcccccccccccccuccccccccccccccaccccuccguccagcagcagcuccagcagcagccccccccccccccccccccccagccccagccccccccccagcagcagcaccagccccccccccgccccguccaccuccagcccaugcaguucuccacccacauccagcagcccccccccccccagggccagcagcccccccaccccccccccggccagcagcccccccccccccagcccgccaagccccagcaggucauccagcaccaccacuccccccgccaccacaaguccgaccccuacuccaccggccaccuccgcgaggcccccuccccccucaugauccacuccccccagaugucccaguuccagucccucacccaccagucccccccccagcagaacguccagcccaagaagcaggagcuccgcgccgccuccgucguccagccccagccccucgucgucgucaaggaggagaagauccacucccccaucauccgcuccgagcccuucucccccucccuccgccccgagccccccaagcaccccgaguccaucaaggcccccguccaccucccccagcgccccgagaugaagcccgucgacgucggccgccccgucauccgcccccccgagcagaacgcccccccccccggcgcccccgacaaggacaagcagaagcaggagcccaagacccccgucgcccccaagaaggaccucaagaucaagaacaugggcuccugggccucccucguccagaagcaccccaccacccccuccuccaccgccaaguccuccuccgacuccuucgagcaguuccgccgcgccgcccgcgagaaggaggagcgcgagaaggcccucaaggcccaggccgagcacgccgagaaggagaaggagcgccuccgccaggagcgcaugcgcucccgcgaggacgaggacgcccucgagcaggcccgccgcgcccacgaggaggcccgccgccgccaggagcagcagcagcagcagcgccaggagcagcagcagcagcagcagcagcaggccgccgccgucgccgccgccgccaccccccaggcccaguccucccagccccaguccaugcucgaccagcagcgcgagcucgcccgcaagcgcgagcaggagcgccgccgccgcgaggccauggccgccaccaucgacaugaacuuccaguccgaccuccucuccaucuucgaggagaaccucuucuga

SEQ ID NO: 40405 - RNA, 1959 nt, Artificial Sequence
  derived and/or modified sequence opt2 from BRD7__Homo_sapiens__NP_001167455
augggcaagaagcacaagaagcacaaguccgacaagcaccucuacgaggaguacgucgagaagccccucaagcucguccucaaggucggcggcaacgaggucaccgagcucuccaccggcuccuccggccacgacuccucccucuucgaggacaagaacgaccacgacaagcacaaggaccgcaagcgcaagaagcgcaagaagggcgagaagcagauccccggcgaggagaagggccgcaagcgccgccgcgucaaggaggacaagaagaagcgcgaccgcgaccgcgucgagaacgaggccgagaaggaccuccagugccacgcccccguccgccucgaccucccccccgagaagccccucaccuccucccucgccaagcaggaggaggucgagcagaccccccuccaggaggcccucaaccagcucaugcgccagcuccagcgcaaggaccccuccgccuucuucuccuuccccgucaccgacuucaucgcccccggcuacuccaugaucaucaagcaccccauggacuucuccaccaugaaggagaagaucaagaacaacgacuaccaguccaucgaggagcucaaggacaacuucaagcucaugugcaccaacgccaugaucuacaacaagcccgagaccaucuacuacaaggccgccaagaagcuccuccacuccggcaugaagauccucucccaggagcgcauccagucccucaagcaguccaucgacuucauggccgaccuccagaagacccgcaagcagaaggacggcaccgacaccucccaguccggcgaggacggcggcugcuggcagcgcgagcgcgaggacuccggcgacgccgaggcccacgccuucaagucccccuccaaggagaacaagaagaaggacaaggacaugcucgaggacaaguucaaguccaacaaccucgagcgcgagcaggagcagcucgaccgcaucgucaaggaguccggcggcaagcucacccgccgccucgucaacucccagugcgaguucgagcgccgcaagcccgacggcaccaccacccucggccuccuccaccccgucgaccccaucgucggcgagcccggcuacugccccguccgccucggcaugaccaccggccgccuccaguccggcgucaacacccuccagggcuucaaggaggacaagcgcaacaaggucacccccguccucuaccucaacuacggccccuacuccuccuacgccccccacuacgacuccaccuucgccaacaucuccaaggacgacuccgaccucaucuacuccaccuacggcgaggacuccgaccuccccuccgacuucuccauccacgaguuccucgccaccugccaggacuaccccuacgucauggccgacucccuccucgacguccucaccaagggcggccacucccgcacccuccaggagauggagaugucccuccccgaggacgagggccacacccgcacccucgacaccgccaaggagauggagcagaucaccgaggucgagccccccggccgccucgacuccuccacccaggaccgccucaucgcccucaaggccgucaccaacuucggcguccccgucgaggucuucgacuccgaggaggccgagaucuuccagaagaagcucgacgagaccacccgccuccuccgcgagcuccaggaggcccagaacgagcgccucuccacccgccccccccccaacaugaucugccuccucggccccuccuaccgcgagaugcaccucgccgagcaggucaccaacaaccucaaggagcucgcccagcaggucacccccggcgacaucgucuccaccuacggcguccgcaaggccaugggcaucuccauccccucccccgucauggagaacaacuucgucgaccucaccgaggacaccgaggagcccaagaagaccgacgucgccgagugcggccccggcggcuccuga

SEQ ID NO: 40406 - RNA, 2601 nt, Artificial Sequence
  derived and/or modified sequence opt2 from BRD8__Homo_sapiens__NP_001157798
auggccaccggcaccggcaagcacaagcuccucuccaccggccccaccgagcccugguccauccgcgagaagcucugccucgccuccuccgucaugcgcuccggcgaccagaacugggucuccgucucccgcgccaucaagcccuucgccgagcccggccgcccccccgacugguucucccagaagcacugcgccucccaguacuccgagcuccucgagaccaccgagacccccaagcgcaagcgcggcgagaagggcgaggucgucgagaccgucgaggacgucaucguccgcaagcucaccgccgagcgcgucgaggagcucaagaaggucaucaaggagacccaggagcgcuaccgccgccucaagcgcgacgccgagcucauccaggccggccacauggacucccgccucgacgagcucugcaacgacaucgccaccaagaagaagcucgaggaggaggaggccgaggucaagcgcaaggccaccgacgccgccuaccaggcccgccaggccgucaagacccccccccgccgccuccccaccgucaugguccgcucccccaucgacuccgccucccccggcggcgacuacccccucggcgaccucacccccaccaccauggaggaggccaccuccggcgucacccccggcacccuccccuccacccccgucaccuccuuccccggcauccccgacacccucccccccggcuccgccccccucgaggcccccaugacccccgucaccgacgacuccccccagaagaagaugcucggccagaaggccacccccccccccuccccccuccucuccgagcuccucaagaagggcucccuccuccccaccuccccccgccucgucaacgaguccgagauggccgucgccuccggccaccucaacuccaccggcguccuccucgaggucggcggcguccuccccaugauccacggcggcgagauccagcagacccccaacaccgucgccgccucccccgccgccuccgucucccagcccgacaacugcguccccauggaggccgucggcgacccccacaccgucaccgucuccauggacuccuccgagaucuccaugaucaucaacuccaucaaggaggagugcuuccgcuccggcgucgccgaggcccccgucggcuccaaggcccccuccaucgacggcaaggaggagcucgaccucgccgagaagauggacaucgccgucuccuacaccggcgaggagcucgacuucgagaccgucggcgacaucaucgccaucaucgaggacaaggucgacgaccaccccgagguccucgacgucgccgccgucgaggccgcccucuccuucugcgaggagaacgacgacccccagucccuccccggccccugggagcaccccauccagcaggagcgcgacaagcccgucccccuccccgcccccgagaugaccgucaagcaggagcgccucgacuucgaggagaccgagaacaagggcauccacgagcucgucgacauccgcgagcccuccgccgagaucaaggucgagcccgccgagcccgagcccgucaucuccggcgccgagaucgucgccggcgucguccccgccaccuccauggagccccccgagcuccgcucccaggaccucgacgaggagcucggcuccaccgccgccggcgagaucgucgaggccgacgucgccaucggcaagggcgacgagaccccccucaccaacgucaagaccgaggccucccccgaguccaugcucucccccucccacggcuccaaccccaucgaggacccccucgaggccgagacccagcacaaguucgagauguccgacucccucaaggaggaguccggcaccaucuucggcucccagaucaaggacgcccccggcgaggacgaggaggaggacggcgucuccgaggccgccucccucgaggagcccaaggaggaggaccagggcgagggcuaccucuccgagauggacaacgagccccccgucuccgaguccgacgacggcuucuccauccacaacgccacccuccagucccacacccucgccgacuccauccccuccucccccgccuccucccaguucuccgucugcuccgaggaccaggaggccauccaggcccagaagaucuggaagaaggccaucaugcucgucuggcgcgccgccgccaaccaccgcuacgccaacgucuuccuccagcccgucaccgacgacaucgcccccggcuaccacuccaucguccagcgccccauggaccucuccaccaucaagaagaacaucgagaacggccucauccgcuccaccgccgaguuccagcgcgacaucaugcucauguuccagaacgccgucauguacaacuccuccgaccacgacgucuaccacauggccgucgagaugcagcgcgacguccucgagcagauccagcaguuccucgccacccagcucaucaugcagaccuccgaguccggcaucuccgccaagucccuccgcggccgcgacuccacccgcaagcaggacgccuccgagaaggacggcggcacccgcggccgccgcugcgccaucgaggccgacaugaagaugaagaaguga

SEQ ID NO: 40407 - RNA, 1248 nt, Artificial Sequence
  derived and/or modified sequence opt2 from BRE__Homo_sapiens__NP_004890
augucccccgaggucgcccucaaccgcaucucccccaugcucucccccuucaucuccuccgucguccgcaacggcaaggucggccucgacgccaccaacugccuccgcaucaccgaccucaaguccggcugcaccucccucacccccggccccaacugcgaccgcuucaagcuccacauccccuacgccggcgagacccucaagugggacaucaucuucaacgcccaguaccccgagcucccccccgacuucaucuucggcgaggacgccgaguuccuccccgaccccuccgcccuccagaaccucgccuccuggaaccccuccaaccccgagugccuccuccucgucgucaaggagcucguccagcaguaccaccaguuccagugcucccgccuccgcgaguccucccgccucauguucgaguaccagacccuccucgaggagccccaguacggcgagaacauggagaucuacgccggcaagaagaacaacuggaccggcgaguucuccgcccgcuuccuccucaagcuccccgucgacuucuccaacauccccaccuaccuccucaaggacgucaacgaggaccccggcgaggacgucgcccuccucuccgucuccuucgaggacaccgaggccacccaggucuaccccaagcucuaccucuccccccgcaucgagcacgcccucggcggcuccuccgcccuccacauccccgccuuccccggcggcggcugccucaucgacuacgucccccaggucugccaccuccucaccaacaagguccaguacgucauccagggcuaccacaagcgccgcgaguacaucgccgccuuccucucccacuucggcaccggcgucgucgaguacgacgccgagggcuucaccaagcucacccuccuccucauguggaaggacuucugcuuccucguccacaucgaccucccccucuucuucccccgcgaccagcccacccucaccuuccaguccgucuaccacuucaccaacuccggccagcucuacucccaggcccagaagaacuaccccuacuccccccgcugggacggcaacgagauggccaagcgcgccaagggcugccagggcucccgcgacgccugcucccccugggagcagguccucgccuucgccgucgccaagaccggcugcaagcuccuccagccccagcgcaacuggcccuccucccgcggcccccccuggcgcgccuccgagggcgagcgcaccgcccaguga

SEQ ID NO: 40408 - RNA, 1755 nt, Artificial Sequence
  derived and/or modified sequence opt2 from BRF1__Homo_sapiens__NP_001229715
auggccgucucccgccaccucacccgcggccgcaagauggcccacgucaucgccgccugccucuaccucgucugccgcaccgagggcaccccccacaugcuccucgaccucuccgaccuccuccaggucaacgucuacguccucggcaagaccuuccuccuccucgcccgcgagcucugcaucaacgcccccgccaucgaccccugccucuacaucccccgcuucgcccaccuccucgaguucggcgagaagaaccacgaggucuccaugaccgcccuccgccuccuccagcgcaugaagcgcgacuggaugcacaccggccgccgccccuccggccucugcggcgccgcccuccucgucgccgcccgcaugcacgacuuccgccgcaccgucaaggaggucaucuccgucgucaaggucugcgaguccacccuccgcaagcgccucaccgaguucgaggacacccccaccucccagcucaccaucgacgaguucaugaagaucgaccucgaggaggagugcgacccccccuccuacaccgccggccagcgcaagcuccgcaugaagcagcucgagcagguccucuccaagaagcucgaggaggucgagggcgagaucuccuccuaccaggacgccaucgagaucgagcucgagaacucccgccccaaggccaagggcggccucgccucccucgccaaggacggcuccaccgaggacaccgccuccucccucugcggcgaggaggacaccgaggacgaggagcucgaggccgccgccucccaccucaacaaggaccucuaccgcgagcuccucggcggcgcccccggcuccuccgaggccgccggcucccccgaguggggcggccgcccccccgcccucggcucccuccucgacccccuccccaccgccgccucccucggcaucuccgacuccauccgcgagugcaucuccucccaguccuccgaccccaaggacgccuccggcgacggcgagcucgaccucuccggcaucgacgaccucgagaucgaccgccgcgaccucuccaugccccgcugcgccaaggccaagucccagccccacuuccccguccucgcccaguacauccucaacgaguccgaggcccgcgucaaggccgagcucuggaugcgcgagaacgccgaguaccuccgcgagcagcgcgagaaggaggcccgcaucgccaaggagaaggagcucggcaucuacaaggagcacaagcccaagaaguccugcaagcgccgcgagcccauccaggccuccaccgcccgcgaggccaucgagaagaugcucgagcagaagaagaucuccuccaagaucaacuacuccguccuccgcggccucuccuccgccggcggcggcuccccccaccgcgaggacgcccagcccgagcacuccgccuccgcccgcaagcucucccgccgccgcacccccgccucccgcuccggcgccgaccccgucaccuccgucggcaagcgccuccgcccccucgucuccacccagcccgccaagaaggucgccaccggcgaggcccuccuccccuccucccccacccucggcgccgagcccgcccgcccccaggccguccucgucgaguccggccccgucuccuaccacgccgacgaggaggccgacgaggaggagcccgacgaggaggacggcgagcccugcgucuccgcccuccagaugaugggcuccaacgacuacggcugcgacggcgacgaggacgacggcuacuga
